(12) United States Patent
Matsuzaki et al.

(10) Patent No.: US 7,300,788 B2
(45) Date of Patent: Nov. 27, 2007

(54) METHOD FOR GENOTYPING POLYMORPHISMS IN HUMANS

(75) Inventors: Hajime Matsuzaki, Palo Alto, CA (US); Rui Mei, Santa Clara, CA (US); Mei-Mei Shen, Cupertino, CA (US); Giulia C. Kennedy, San Francisco, CA (US)

(73) Assignee: Affymetrix, Inc., Santa Clara, CA (US)

( * ) Notice: Subject to any disclaimer, the term of this patent is extended or adjusted under 35 U.S.C. 154(b) by 293 days.

(21) Appl. No.: 10/681,773

(22) Filed: Oct. 7, 2003

(65) Prior Publication Data

US 2004/0146890 A1    Jul. 29, 2004

Related U.S. Application Data

(60) Provisional application No. 60/417,190, filed on Oct. 8, 2002, provisional application No. 60/470,475, filed on May 14, 2003.

(51) Int. Cl.
*C12M 1/34* (2006.01)
*C12M 3/00* (2006.01)
*C07H 21/04* (2006.01)
*C12Q 1/68* (2006.01)

(52) U.S. Cl. ............ 435/287.2; 536/23.1; 536/24.3; 435/91.1

(58) Field of Classification Search ............ None
See application file for complete search history.

(56) References Cited

U.S. PATENT DOCUMENTS 5,900,481 A * 5/1999 Lough et al. ............ 536/55.3
6,812,339 B1 * 11/2004 Venter et al. ............ 536/24.31

OTHER PUBLICATIONS

Hacker et al; Gut, 1997, vol. 40, pp. 623-627.*
Pennisi, Science, 1998; 281 (5384):1787-1789.*
Malhotra et al; Am. J. Of Psychiatry, vol. 161, pp. 780-796, May 2004.*
dbSNP build history.*
Affymetrix GeneChip Human Mapping 10K array (product Data Sheet, 2003; pp. 1-4).*
Carrasquillo, Minerva M., et al., Genome-wide association study and mouse model identify interaction between RET and EDNRB pathways in Hirschsprung disease, Nature Genetics, Oct. 2002, pp. 237-244, vol. 32, Nature Publishing Group, New York, NY, USA.
Dalma-Weiszhausz, Dennise D., et al., Single nucleotide polymorphisms and their characterization with oligonucleotide microarrays, Psychiartic Genetics, 2002, pp. 97-107, vol. 12, No. 2, Lippincott Williams & Wilkins, Philadelphia, PA, USA.
Dong, Shoulian, et al., Flexible Use of High-Density Oligonucleotide Arrays for Single-Nucleotide Polymorphism Discovery and Validation, Genome Research, 2001, pp. 1418-1424, vol. 11, Cold Spring Harbor Laboratory Press, USA.
Dumur, Caterine I., et al., Genome-wide detection of LOH in prostate cancer using human SNP microarray technology, Genomics, 2003, pp. 260-269, vol. 81, Academic Press, USA.
Fan, Jian-Bing, et al., Paternal Origins of Complete Hydatidiform Moles Proven by Whole Genome Single-Nucleotide Polymorphism Haploytyping, Genomics, Jan. 2002, pp. 58-62, vol. 79, No. 1, Academic Press, USA.
Garcia, Christine Kim, et al., Sequence Diversity in Genes of Lipid Metabolism, Genome Research, 2001, pp. 1043-1052, vol. 11, Cold Spring Harbor Laboratory Press, USA.
Guo, Qingbin M., DNA Microarray and cancer, Current Opinion in Oncology, 2003, pp. 36-43, vol. 15, Lippincott Williams & Wilkins, Philadelphia, PA, USA.
Halushka, Marc K., et al., Patterns of single-nucleotide polymorphisms in candidate genes for blood-pressure homeostasis, Nature Genetics, Jul. 1999, pp. 239-247, vol. 22, Nature America, Inc., USA.
Lindblad-Toh, Kerstin, et al., Loss-of-heterozgosity analysis of small-cell lung carcinomas using single-nucleotide polymorphism arrays, Nature Biotechnology, Sep. 2000, pp. 1001-1005, vol. 18, Nature Publishing Group, New York, NY, USA.
Lindblad-Toh, Kerstin, et al., Large-scale discovery and genotyping of single-nucleotide polymorphisms in the mouse, Nature Genetics, Apr. 2000, pp. 381-386, vol. 24, Nature America, Inc., USA.
Lindroos, Katarina, et al., Minisequencing on oligonucleotide microarrays: comparison of immobilisation chemistries, Nucleic Acids Research, 2001, pp. e69 (1-7), vol. 29, No. 13, Oxford University Press, UK.
Mei, Rui, et al., Genome-wide Detection of Allelic Imbalance Using Human SNPs and High-density DNA Arrays, Genome Research, 2000, pp. 1126-1137, vol. 10, No. 8, Cold Spring Harbor Laboratory Press, USA.

(Continued)

*Primary Examiner*—Jehanne Sitton
(74) *Attorney, Agent, or Firm*—Sandra E. Wells

(57) ABSTRACT

The invention provides nucleic acid sequences that are complementary, in one embodiment, to a wide variety of human polymorphisms. The invention provides the sequences in such a way as to make them available for a variety of analyses including genotyping a large number of SNPs in parallel. The invention also provides a collection of human SNPs that is useful for genetic analysis within and across populations. As such, the invention relatesd to diverse fields impacted by the nature of genetics, including biology, medicine, and medical diagnostics.

4 Claims, No Drawings

OTHER PUBLICATIONS

Schubert, Elizabeth L., et al., Single Nucleotide Polymorphism Array Analysis of Flow-Sorted Epithelial cells from Frozen Versus Fixed Tissues for Whole Genome Analysis of Allelic Loss in Breast Cancer, American Journal of Pathology, Jan. 2002, pp. 73-79, vol. 160, No. 1, American Society for Investigative Patholoy, USA.

Warrington, Janet A., et al., New Developments in High-Throughput Resequencing and Variation Detection Using High Density Microarrays, Human Mutation, 2002, pp. 402-409, vol. 19, No. 4, Wiley-Liss, Inc., USA.

Wilson, S.G., et al., Comparison of Genome Screens for Two Independent Cohorts Provides Replication of Suggestive Linkage of Bone Mineral Density to 3p21 and 1p36, American Journal of Human Genetics, 2003, pp. 144-155, vol. 72, No. 1, American Socity of Human Genetics, USA.

Zhou, Wei, Mapping genetic alterations in tumors with single nucleotide polymorphisms, Current Opinion in Oncology, 2003, pp. 50-54, vol. 15, No. 1, Lippincott Williams & Wilkins, Inc, Philadelphia, PA, USA.

Rubenstein, K, The Current State of the Biochip Business, Drug & Market Development, Nov. 1999, pp. 392-396, vol. 10, No. 11, Drug & Market Development Publications, USA.

* cited by examiner

METHOD FOR GENOTYPING POLYMORPHISMS IN HUMANS

RELATED APPLICTIONS

The present application claims priority to U.S. Provisional Application Nos. 60/417,190 filed Oct. 8, 2002 and 60/470,475 filed May 14, 2003 the disclosures of which are each incorporated herein by reference in their entireties.

FIELD OF THE INVENTION

The present invention provides pools of nucleic acid sequences and arrays of nucleic acid sequences that are useful for genotyping polymorphisms in nucleic acid samples derived from humans. The invention also provides a collection of SNPs that may be amplified reproducibly and genotyped in parallel using a single assay. The invention relates to diverse fields, including genetics, genomics, biology, population biology, medicine, and medical diagnostics.

REFERENCE TO SEQUENCE LISTING

The Sequence Listing submitted on compact disk is hereby incorporated by reference.
The file on the disk is named 3522.2seqlist.txt, the file is 17.0 MB and the date of creation is Oct. 6, 2003.

BACKGROUND

The past years have seen a dynamic change in the ability of science to comprehend vast amounts of data. Pioneering technologies such as nucleic acid arrays allow scientists to delve into the world of genetics in far greater detail than ever before. Exploration of genomic DNA has long been a dream of the scientific community. Held within the complex structures of genomic DNA lies the potential to identify, diagnose, or treat diseases like cancer, Alzheimer disease or alcoholism. Exploitation of genomic information from plants and animals may also provide answers to the world's food distribution problems.

Recent efforts in the scientific community, such as the publication of the draft sequence of the human genome in February 2001, have changed the dream of genome exploration into a reality. Genome-wide assays, however, must contend with the complexity of genomes; the human genome for example is estimated to have a complexity of $3 \times 10^9$ base pairs. Novel methods of sample preparation and sample analysis that reduce complexity may provide for the fast and cost effective exploration of complex samples of nucleic acids, particularly genomic DNA.

Single nucleotide polymorphisms (SNPs) have emerged as the marker of choice for genome wide association studies and genetic linkage studies. Building SNP maps of the genome will provide the framework for new studies to identify the underlying genetic basis of complex diseases such as cancer, mental illness and diabetes. Due to the wide ranging applications of SNPs there is still a need for the development of robust, flexible, cost-effective technology platforms that allow for scoring genotypes in large numbers of samples.

All documents, i.e., publications and patent applications, cited in this disclosure, including the foregoing, are incorporated by reference herein in their entireties for all purposes to the same extent as if each of the individual documents were specifically and individually indicated to be so incorporated by reference herein in its entirety.

SUMMARY OF THE INVENTION

The invention provides nucleic acid sequences that are complementary to particular regions of the human genome that are known or predicted to contain single nucleotide polymorphisms (SNPs). The invention further provides a collection of SNPs that are useful for performing analysis of the human genome. For example, in one embodiment the invention comprises an array comprising any 10 or more, 100 or more, 1000 or more, 10,000 or more, 100,000 or more, or 1,000,000 or more nucleic acid probes containing 9 or more consecutive nucleotides from the sequences listed in SEQ ID NOS: 1-124,031, or the perfect match, perfect mismatch, antisense match or antisense mismatch thereof. In a preferred embodiment the array comprises each of the sequences listed in SEQ ID NOS 1-124,031, each probe being a different 25 nucleotide sequence from the sequence listing. In a further embodiment, the invention comprises the use of any of the above arrays or fragments disclosed in SEQ ID NOS 1-124,031 to: monitor loss of heterozygosity; identify imprinted genes; genotype polymorphisms; determine allele frequencies in a population, characterize biallelic markers; produce genetic maps; detect linkage disequilibrium, determine allele frequencies, do association studies, analyze genetic variation, to identify markers linked to a phenotype or, compare genotypes between different individuals or populations. In a further embodiment the invention comprises a method of analysis comprising hybridizing one or more pools of nucleic acids to two or more of the fragments disclosed in SEQ ID NOS 1-124,031 and detecting said hybridization. In a further embodiment the invention comprises the use of any one or more of the fragments disclosed in SEQ ID NOS 1-124,031 as a primer for PCR.

DETAILED DESCRIPTION OF THE INVENTION a) General

The present invention has many preferred embodiments and relies on many patents, applications and other references for details known to those of the art. Therefore, when a patent, application, or other reference is cited or repeated below, it should be understood that it is incorporated by reference in its entirety for all purposes as well as for the proposition that is recited.

As used in this application, the singular form "a," "an," and "the" include plural references unless the context clearly dictates otherwise. For example, the term "an agent" includes a plurality of agents, including mixtures thereof.

An individual is not limited to a human being but may also be other organisms including but not limited to mammals, plants, bacteria, or cells derived from any of the above.

Throughout this disclosure, various aspects of this invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This The practice of the present invention may employ, unless otherwise indicated, conventional techniques and descriptions of organic chemistry, polymer technology, molecular biology (including recombinant techniques), cell biology, biochemistry, and immunology, which are within the skill of the art. Such conventional techniques include polymer array synthesis, hybridization, ligation, and detection of hybridization using a label. Specific illustrations of suitable techniques can be had by reference to the example herein below. However, other equivalent conventional procedures can, of course, also be used. Such conventional techniques and descriptions can be found in standard laboratory manuals such as *Genome Analysis: A Laboratory Manual Series (Vols. I-IV), Using Antibodies: A Laboratory Manual, Cells: A Laboratory Manual, PCR Primer: A Laboratory Manual, and Molecular Cloning: A Laboratory Manual* (all from Cold Spring Harbor Laboratory Press), Stryer, L. (1995) *Biochemistry* (4th Ed.) Freeman, New York, Gait, "*Oligonucleotide Synthesis: A Practical Approach*" 1984, IRL Press, London, Nelson and Cox (2000), *Lehninger, Principles of Biochemistry* $3^{rd}$ Ed., W.H. Freeman Pub., New York, N.Y. and Berg et al. (2002) *Biochemistry*, $5^{th}$ Ed., W.H. Freeman Pub., New York, N.Y., all of which are herein incorporated in their entirety by reference for all purposes.

The present invention can employ solid substrates, including arrays in some preferred embodiments. Methods and techniques applicable to polymer (including protein) array synthesis have been described in U.S. Ser. No. 09/536,841, WO 00/58516, U.S. Pat. Nos. 5,143,854, 5,242,974, 5,252, 743, 5,324,633, 5,384,261, 5,405,783, 5,424,186, 5,451,683, 5,482,867, 5,491,074, 5,527,681, 5,550,215, 5,571,639, 5,578,832, 5,593,839, 5,599,695, 5,624,711, 5,631,734, 5,795,716, 5,831,070, 5,837,832, 5,856,101, 5,858,659, 5,936,324, 5,968,740, 5,974,164, 5,981,185, 5,981,956, 6,025,601, 6,033,860, 6,040,193, 6,090,555, 6,136,269, 6,269,846 and 6,428,752, in PCT Applications Nos. PCT/US99/00730 (International Publication Number WO 99/36760) and PCT/US01/04285, which are all incorporated herein by reference in their entirety for all purposes.

Patents that describe synthesis techniques in specific embodiments include U.S. Pat. Nos. 5,412,087, 6,147,205, 6,262,216, 6,310,189, 5,889,165, and 5,959,098. Nucleic acid arrays are described in many of the above patents, but the same techniques are applied to polypeptide arrays.

Nucleic acid arrays that are useful in the present invention include those that are commercially available from Affymetrix (Santa Clara, Calif.) under the brand name GeneChip®. Example arrays are shown on the website at affymetrix.com.

The present invention also contemplates many uses for polymers attached to solid substrates. These uses include gene expression monitoring, profiling, library screening, genotyping and diagnostics. Gene expression monitoring, and profiling methods can be shown in U.S. Pat. Nos. 5,800,992, 6,013,449, 6,020,135, 6,033,860, 6,040,138, 6,177,248 and 6,309,822. Genotyping and uses therefore are shown in U.S. Serial Nos. 60/319,253, 10/013,598, and U.S. Pat. Nos. 5,856,092, 6,300,063, 5,858,659, 6,284,460, 6,361,947, 6,368,799 and 6,333,179. Other uses are embodied in U.S. Pat. Nos. 5,871,928, 5,902,723, 6,045,996, 5,541,061, and 6,197,506.

The present invention also contemplates sample preparation methods in certain preferred embodiments. Prior to or concurrent with genotyping, the genomic sample may be amplified by a variety of mechanisms, some of which may employ PCR. See, e.g., *PCR Technology: Principles and Applications for DNA Amplification* (Ed. H. A. Erlich, Freeman Press, NY, N.Y., 1992); *PCR Protocols: A Guide to Methods and Applications* (Eds. Innis, et al., Academic Press, San Diego, Calif., 1990); Mattila et al., *Nucleic Acids Res.* 19, 4967 (1991); Eckert et al., *PCR Methods and Applications* 1, 17 (1991); PCR (Eds. McPherson et al., IRL Press, Oxford); and U.S. Pat. Nos. 4,683,202, 4,683,195, 4,800,159 4,965,188, and 5,333,675, and each of which is incorporated herein by reference in their entireties for all purposes. The sample may be amplified on the array. See, for example, U.S. Pat. No. 6,300,070 which is incorporated herein by reference.

Other suitable amplification methods include the ligase chain reaction (LCR) (e.g., Wu and Wallace, *Genomics* 4, 560 (1989), Landegren et al., *Science* 241, 1077 (1988) and Barringer et al. *Gene* 89:117 (1990)), transcription amplification (Kwoh et al., *Proc. Natl. Acad. Sci. USA* 86, 1173 (1989) and WO88/10315), self-sustained sequence replication (Guatelli et al., *Proc. Nat. Acad. Sci. USA*, 87, 1874 (1990) and WO90/06995), selective amplification of target polynucleotide sequences (U.S. Pat. No. 6,410,276), consensus sequence primed polymerase chain reaction (CP-PCR) (U.S. Pat. No. 4,437,975), arbitrarily primed polymerase chain reaction (AP-PCR) (U.S. Pat. No. 5,413,909, 5,861,245) and nucleic acid based sequence amplification (NABSA). (See, U.S. Pat. Nos. 5,409,818, 5,554,517, and 6,063,603, each of which is incorporated herein by reference). Other amplification methods that may be used are described in, U.S. Pat. Nos. 5,242,794, 5,494,810, 4,988,617 and in U.S. Ser. No. 09/854,317, each of which is incorporated herein by reference.

Additional methods of sample preparation and techniques for reducing the complexity of a nucleic sample are described in Dong et al., *Genome Research* 11, 1418 (2001), in U.S. Pat. Nos. 6,361,947, 6,391,592 and U.S. Ser. Nos. 09/916,135, 09/920,491, 09/910,292, and 10/013,598. Additional methods of using a genotyping array are disclosed, for example, in U.S. patent application Ser. Nos. 10/442,021, 10/650,332, 10/316,629, 10/316,517, 10,264,945, 10/321, 741, 60/496,539, and 60/453,930.

Methods for conducting polynucleotide hybridization assays have been well developed in the art. Hybridization assay procedures and conditions will vary depending on the application and are selected in accordance with the general binding methods known including those referred to in: Maniatis et al. *Molecular Cloning: A Laboratory Manual* ($2^{nd}$ Ed. Cold Spring Harbor, N.Y., 1989); Berger and Kimmel *Methods in Enzymology*, Vol. 152, *Guide to Molecular Cloning Techniques* (Academic Press, Inc., San Diego, Calif., 1987); Young and Davism, *P.N.A.S,* 80: 1194 (1983). Methods and apparatus for carrying out repeated and controlled hybridization reactions have been described in U.S. Pat. Nos. 5,871,928, 5,874,219, 6,045,996 and 6,386,749, 6,391,623 each of which are incorporated herein by reference The present invention also contemplates signal detection of hybridization between ligands in certain preferred embodiments. See U.S. Pat. Nos. 5,143,854, 5,578,832; 5,631,734; 5,834,758; 5,936,324; 5,981,956; 6,025,601; 6,141,096; 6,185,030; 6,201,639; 6,218,803; and 6,225,625, in U.S. Ser. No. 60/364,731 and in PCT Application PCT/US99/06097 (published as WO99/47964), each of which also is hereby incorporated by reference in its entirety for all purposes.

Methods and apparatus for signal detection and processing of intensity data are disclosed in, for example, U.S. Pat. Nos. 5,143,854, 5,547,839, 5,578,832, 5,631,734, 5,800, 992, 5,834,758; 5,856,092, 5,902,723, 5,936,324, 5,981, 956, 6,025,601, 6,090,555, 6,141,096, 6,185,030, 6,201, 639; 6,218,803; and 6,225,625, in U.S. Ser. No. 60/364,731 and in PCT Application PCT/US99/06097 (published as WO99/47964), each of which also is hereby incorporated by reference in its entirety for all purposes.

The practice of the present invention may also employ conventional biology methods, software and systems. Computer software products of the invention typically include computer readable medium having computer-executable instructions for performing the logic steps of the method of the invention. Suitable computer readable medium include floppy disk, CD-ROM/DVD/DVD-ROM, hard-disk drive, flash memory, ROM/RAM, magnetic tapes and etc. The computer executable instructions may be written in a suitable computer language or combination of several languages. Basic computational biology methods are described in, e.g. Setubal and Meidanis et al., *Introduction to Computational Biology Methods* (PWS Publishing Company, Boston, 1997); Salzberg, Searles, Kasif, (Ed.), *Computational Methods in Molecular Biology*, (Elsevier, Amsterdam, 1998); Rashidi and Buehler, *Bioinformatics Basics: Application in Biological Science and Medicine* (CRC Press, London, 2000) and *Ouelette and Bzevanis Bioinformatics: A Practical Guide for Analysis of Gene and Proteins* (Wiley & Sons, Inc., $2^{nd}$ ed., 2001). See U.S. Pat. No. 6,420,108.

The present invention may also make use of various computer program products and software for a variety of purposes, such as probe design, management of data, analysis, and instrument operation. See, U.S. Pat. Nos. 5,593,839, 5,795,716, 5,733,729, 5,974,164, 6,066,454, 6,090,555, 6,185,561, 6,188,783, 6,223,127, 6,229,911 and 6,308,170.

Additionally, the present invention may have preferred embodiments that include methods for providing genetic information over networks such as the Internet as shown in U.S. Ser. Nos. 10/063,559 (United States Publication No. US20020183936), 60/349,546, 60/376,003, 60/394,574 and 60/403,381.

Each of the references, patents and patent applications cited in the specification is incorporated be reference in its entirety for all purposes.

B. Definitions

Massive Parallel Screening: The phrase "massively parallel screening" refers to the simultaneous screening of from about 100, 1000, 10,000 or 100,000 to 1000, 10,000, 100, 000, 1,000,000 or 3,000,000 or more different nucleic acid hybridizations.

Probe: As used herein a "probe" is defined as a nucleic acid capable of binding to a target nucleic acid of complementary sequence through one or more types of chemical bonds, usually through complementary base pairing, usually through hydrogen bond formation. As used herein, a probe may include natural (i.e. A, G, U, C, or T) or modified bases (7-deazaguanosine, inosine, etc.). In addition, a linkage other than a phosphodiester bond may join the bases in probes. Modifications in probes may be used to improve or alter hybridization properties. Thus, probes may be peptide nucleic acids in which the constituent bases are joined by peptide bonds rather than phosphodiester linkages. Other modifications may also be used, for example, methylation or inclusion of a label or dye.

Perfect match: The term "match," "perfect match," "perfect match probe" or "perfect match control" refers to a nucleic acid that has a sequence that is designed to be perfectly complementary to a particular target sequence or portion thereof. For example, if the target sequence is 5'-GATTGCATA-3' the perfect complement is 5'-TATG-CAATC-3'. Where the target sequence is longer than the probe the probe is typically perfectly complementary to a portion (subsequence) of the target sequence. For example, if the target sequence is a fragment that is 800 bases, the perfect match probe may be perfectly complementary to a 25 base region of the target. A perfect match (PM) probe can be a "test probe", a "normalization control" probe, an expression level control probe and the like. A perfect match control or perfect match is, however, distinguished from a "mismatch" or "mismatch probe."

Mismatch: The term "mismatch," "mismatch control" or "mismatch probe" refers to a nucleic acid whose sequence is deliberately designed not to be perfectly complementary to a particular target sequence. As a non-limiting example, for each mismatch (MM) control in a high-density probe array there typically exists a corresponding perfect match (PM) probe that is perfectly complementary to the same particular target sequence. The mismatch may comprise one or more bases. While the mismatch(es) may be located anywhere in the mismatch probe, terminal mismatches are less desirable because a terminal mismatch is less likely to prevent hybridization of the target sequence. In a particularly preferred embodiment, the mismatch is located at the center of the probe, for example if the probe is 25 bases the mismatch position is position 13, also termed the central position, such that the mismatch is most likely to destabilize the duplex with the target sequence under the test hybridization conditions. A homo-mismatch substitutes an adenine (A) for a thymine (T) and vice versa and a guanine (G) for a cytosine (C) and vice versa. For example, if the target sequence was: 5'-AGGTCCA-3', a probe designed with a single homo-mismatch at the central, or fourth position, would result in the following sequence: 3'-TCCTGGT-5', the PM probe would be 3'-TCCAGGT-5'.

DNA Library—as used herein the term "genomic library" or "genomic DNA library" refers to a collection of cloned DNA molecules consisting of fragments of the entire genome (genomic library) or of DNA copies of all the mRNA produced by a cell type (cDNA library) inserted into a suitable cloning vector.

Nucleic acids according to the present invention may include any polymer or oligomer of pyrimidine and purine bases, preferably cytosine, thymine, and uracil, and adenine and guanine, respectively. (See Albert L. Lehninger, *Principles of Biochemistry*, at 793-800 (Worth Pub. 1982) which is herein incorporated in its entirety for all purposes). Indeed, the present invention contemplates any deoxyribonucleotide, ribonucleotide or peptide nucleic acid component, and any chemical variants thereof, such as methylated, hydroxymethylated or glucosylated forms of these bases, and the like. The polymers or oligomers may be heterogeneous or homogeneous in composition, and may be isolated from naturally occurring sources or may be artificially or synthetically produced. In addition, the nucleic acids may be DNA or RNA, or a mixture thereof, and may exist permanently or transitionally in single-stranded or double-stranded form, including homoduplex, heteroduplex, and hybrid states.

An "oligonucleotide" or "polynucleotide" is a nucleic acid ranging from at least 2, preferably at least 8, 15 or 20 nucleotides in length, but may be up to 50, 100, 1000, or 5000 nucleotides long or a compound that specifically hybridizes to a polynucleotide. Polynucleotides of the present invention include sequences of deoxyribonucleic acid (DNA) or ribonucleic acid (RNA) or mimetics thereof which may be isolated from natural sources, recombinantly produced or artificially synthesized. A further example of a polynucleotide of the present invention may be a peptide nucleic acid (PNA). (See U.S. Pat. No. 6,156,501 which is hereby incorporated by reference in its entirety.) The invention also encompasses situations in which there is a nontraditional base pairing such as Hoogsteen base pairing which has been identified in certain tRNA molecules and postulated to exist in a triple helix. "Polynucleotide" and "oligonucleotide" are used interchangeably in this application.

A genome is all the genetic material of an organism. In some instances, the term genome may refer to the chromosomal DNA. Genome may be multichromosomal such that the DNA is cellularly distributed among a plurality of individual chromosomes. For example, in human there are 22 pairs of chromosomes plus a gender associated XX or XY pair. DNA derived from the genetic material in the chromosomes of a particular organism is genomic DNA. The term genome may also refer to genetic materials from organisms that do not have chromosomal structure. In addition, the term genome may refer to mitochondria DNA. A genomic library is a collection of DNA fragments representing the whole or a portion of a genome. Frequently, a genomic library is a collection of clones made from a set of randomly generated, sometimes overlapping DNA fragments representing the entire genome or a portion of the genome of an organism.

The term "chromosome" refers to the heredity-bearing gene carrier of a cell which is derived from chromatin and which comprises DNA and protein components (especially histones). The conventional internationally recognized individual human genome chromosome numbering system is employed herein. The size of an individual chromosome can vary from one type to another within a given multi-chromosomal genome and from one genome to another. In the case of the human genome, the entire DNA mass of a given chromosome is usually greater than about 100,000,000 bp. For example, the size of the entire human genome is about $3 \times 10^9$ bp. The largest chromosome, chromosome no. 1, contains about $2.4 \times 10^8$ bp while the smallest chromosome, chromosome no. 22, contains about $5.3 \times 10^7$ bp.

A "chromosomal region" is a portion of a chromosome. The actual physical size or extent of any individual chromosomal region can vary greatly. The term "region" is not necessarily definitive of a particular one or more genes because a region need not take into specific account the particular coding segments (exons) of an individual gene.

An allele refers to one specific form of a genetic sequence (such as a gene) within a cell, an individual or within a population, the specific form differing from other forms of the same gene in the sequence of at least one, and frequently more than one, variant sites within the sequence of the gene. The sequences at these variant sites that differ between different alleles are termed "variances", "polymorphisms", or "mutations". At each autosomal specific chromosomal location or "locus" an individual possesses two alleles, one inherited from one parent and one from the other parent, for example one from the mother and one from the father. An individual is "heterozygous" at a locus if it has two different alleles at that locus. An individual is "homozygous" at a locus if it has two identical alleles at that locus.

Polymorphism refers to the occurrence of two or more genetically determined alternative sequences or alleles in a population. A polymorphic marker or site is the locus at which divergence occurs. Preferred markers have at least two alleles, each occurring at a frequency of preferably greater than 1%, and more preferably greater than 10% or 20% of a selected population. A polymorphism may comprise one or more base changes, an insertion, a repeat, or a deletion. A polymorphic locus may be as small as one base pair. Polymorphic markers include restriction fragment length polymorphisms, variable number of tandem repeats (VNTR's), hypervariable regions, minisatellites, dinucleotide repeats, trinucleotide repeats, tetranucleotide repeats, simple sequence repeats, and insertion elements such as Alu. The first identified allelic form is arbitrarily designated as the reference form and other allelic forms are designated as alternative or variant alleles. The allelic form occurring most frequently in a selected population is sometimes referred to as the wildtype form. A diallelic polymorphism has two forms. A triallelic polymorphism has three forms. A polymorphism between two nucleic acids can occur naturally, or be caused by exposure to or contact with chemicals, enzymes, or other agents, or exposure to agents that cause damage to nucleic acids, for example, ultraviolet radiation, mutagens or carcinogens.

Single nucleotide polymorphisms (SNPs) are positions at which two alternative bases occur at appreciable frequency (>1%) in a given population. SNPs are the most common type of human genetic variation. A polymorphic site is frequently preceded by and followed by highly conserved sequences (e.g., sequences that vary in less than 1/100 or 1/1000 members of the populations).

A SNP may arise due to substitution of one nucleotide for another at the polymorphic site. A transition is the replacement of one purine by another purine or one pyrimidine by another pyrimidine. A transversion is the replacement of a purine by a pyrimidine or vice versa. SNPs can also arise from a deletion of a nucleotide or an insertion of a nucleotide relative to a reference allele.

The term genotyping refers to the determination of the genetic information an individual carries at one or more positions in the genome. For example, genotyping may comprise the determination of which allele or alleles an individual carries for a single SNP or the determination of which allele or alleles an individual carries for a plurality of SNPs. For example, a particular nucleotide in a genome may be an A in some individuals and a C in other individuals. Those individuals who have an A at the position have the A allele and those who have a C have the C allele. In a diploid organism the individual will have two copies of the sequence containing the polymorphic position so the individual may have an A allele and a C allele or alternatively two copies of the A allele or two copies of the C allele. Those individuals who have two copies of the C allele are homozygous for the C allele, those individuals who have two copies of the A allele are homozygous for the C allele, and those individuals who have one copy of each allele are heterozygous. The array may be designed to distinguish between each of these three possible outcomes. A polymorphic location may have two or more possible alleles and the array may be designed to distinguish between all possible combinations.

A genetic map is a map that presents the order of specific sequences on a chromosome. A genetic map expresses the positions of genes relative to each othere without a physical anchor on the chromosome. The distance between markers is typically determined by the frequency of recombination, which is related to the relative distance between markers. Genetic map distances are typically expressed as recombination units or centimorgans (cM). The physical map gives the position of a marker and its distance from other genes or markers on the same chromosome in base pairs and related to given positions along the chromosome. See, *Color Atlas of Genetics*, Ed. Passarge, Thieme, New York, N.Y. (2001), which is incorporated by reference. Genetic variation refers to variation in the sequence of the same region between two or more individuals.

Normal cells that are heterozygous at one or more loci may give rise to tumor cells that are homozygous at those loci. This loss of heterozygosity may result from structural deletion of normal genes or loss of the chromosome carrying the normal gene, mitotic recombination between normal and mutant genes, followed by formation of daughter cells homozygous for deleted or inactivated (mutant) genes; or loss of the chromosome with the normal gene and duplication of the chromosome with the deleted or inactivated (mutant) gene.

Linkage disequilibrium or allelic association means the preferential association of a particular allele or genetic marker with a specific allele, or genetic marker at a nearby chromosomal location more frequently than expected by chance for any particular allele frequency in the population. For example, if locus X has alleles a and b, which occur at equal frequency, and linked locus Y has alleles c and d, which occur at equal frequency, one would expect the combination ac to occur at a frequency of 0.25. If ac occurs more frequently, then alleles a and c are in linkage disequilibrium. Linkage disequilibrium may result, for example, because the regions are physically close, from natural selection of certain combination of alleles or because an allele has been introduced into a population too recently to have reached equilibrium with linked alleles. A marker in linkage disequilibrium can be particularly useful in detecting susceptibility to disease (or other phenotype) notwithstanding that the marker does not cause the disease. For example, a marker (X) that is not itself a causative element of a disease, but which is in linkage disequilibrium with a gene (including regulatory sequences) (Y) that is a causative element of a phenotype, can be detected to indicate susceptibility to the disease in circumstances in which the gene Y may not have been identified or may not be readily detectable.

The term "target sequence", "target nucleic acid" or "target" refers to a nucleic acid of interest. The target sequence may or may not be of biological significance. Typically, though not always, it is the significance of the target sequence which is being studied in a particular experiment. As non-limiting examples, target sequences may include regions of genomic DNA which are believed to contain one or more polymorphic sites, DNA encoding or believed to encode genes or portions of genes of known or unknown function, DNA encoding or believed to encode proteins or portions of proteins of known or unknown function, DNA encoding or believed to encode regulatory regions such as promoter sequences, splicing signals, polyadenylation signals, etc. In many embodiments a collection of target sequences comprising one or more SNPs from Table 1 is assayed. One of skill in the art will recognize that genomic DNA in humans and related primates is double stranded. Each of the SNPs in Table 1 thus represents two complementary strands. The polymorphic position represents a base pair, for example, if the allele on one strand is a G, the allele on the opposite strand is a C. In addition to the polymorphic position, there is also sequence that is upstream and downstream, or 5' of and 3' of the SNP position. The at least 50 bases upstream and at least 50 bases downstream of the SNP is preferably the same for each allele of the SNP for each SNP in Table 1.

The SNPs of Table 1 were selected based on shared characteristics that allow two or more target sequences comprising SNPs from Table 1 to be amplified reproducibly in the same amplification reaction. The SNPs of Table 1 are found on fragments between 300 and 1000 base pairs when human genomic DNA is digested with XbaI may be interrogated in a single assay. A single array may interrogate more than 2, 100, 1000, 5,000 or more SNPs from Table 1. The array may interrogate for the presence or absence of different alleles in the SNPs of Table 1.

Target sequences may be interrogated by hybridization to an array. The array may be specially designed to interrogate one or more selected target sequence. The array may contain a collection of probes that are designed to hybridize to a region of the target sequence or its complement. Different probe sequences are located at spatially addressable locations on the array. For genotyping a single polymorphic site probes that match the sequence of each allele may be included. At least one perfect match probe, which is exactly complementary to the polymorphic base and to a region surrounding the polymorphic base, may be included for each allele. In a preferred embodiment the array comprises probes that include 12 bases on either side of the SNP. Multiple perfect match probes may be included as well as mismatch probes.

The methods may be combined with other methods of genome analysis and complexity reduction. Other methods of complexity reduction include, for example, AFLP, see U.S. Pat. No. 6,045,994, which is incorporated herein by reference, and arbitrarily primed-PCR (AP-PCR) see McClelland and Welsh, in *PCR Primer: A laboratory Manual*, (1995) eds. C. Dieffenbach and G. Dveksler, Cold Spring Harbor Lab Press, for example, at p 203, which is incorporated herein by reference in its entirety. Additional methods of sample preparation and techniques for reducing the complexity of a nucleic sample are described in Dong et al., *Genome Research* 11, 1418 (2001), in U.S. Pat. Nos. 6,361,947, 6,391,592, 6,458,530 and U.S. Patent Application Nos. 20030039069, Ser. Nos. 09/916,135, 09/920,491, 09/910,292 and 10/264,945, which are incorporated herein by reference in their entireties.

An "array" comprises a support, preferably solid, with nucleic acid probes attached to the support. Preferred arrays typically comprise a plurality of different nucleic acid probes that are coupled to a surface of a substrate in different, known locations. These arrays, also described as "microarrays" or colloquially "chips" have been generally described in the art, for example, U.S. Pat. Nos. 5,143,854, 5,445,934, 5,744,305, 5,677,195, 5,800,992, 6,040,193, 5,424,186 and Fodor et al., *Science*, 251:767-777 (1991), each of which is incorporated by reference in its entirety for all purposes.

Arrays may generally be produced using a variety of techniques, such as mechanical synthesis methods or light directed synthesis methods that incorporate a combination of photolithographic methods and solid phase synthesis methods. Techniques for the synthesis of these arrays using mechanical synthesis methods are described in, e.g., U.S. Pat. Nos. 5,384,261, and 6,040,193, which are incorporated herein by reference in their entirety for all purposes. Although a planar array surface is preferred, the array may be fabricated on a surface of virtually any shape or even a multiplicity of surfaces. Arrays may be nucleic acids on beads, gels, polymeric surfaces, fibers such as fiber optics, glass or any other appropriate substrate. (See U.S. Pat. Nos. 5,770,358, 5,789,162, 5,708,153, 6,040,193 and 5,800,992, which are hereby incorporated by reference in their entirety for all purposes.)

Arrays may be packaged in such a manner as to allow for diagnostic use or can be an all-inclusive device; e.g., U.S. Pat. Nos. 5,856,174 and 5,922,591 incorporated in their entirety by reference for all purposes. Preferred arrays are commercially available from Affymetrix (Santa Clara, Calif.) under the brand name GeneChip® and are directed to a variety of purposes, including genotyping and gene expression monitoring for a variety of eukaryotic and prokaryotic species.

Hybridization probes are oligonucleotides capable of binding in a base-specific manner to a complementary strand of nucleic acid. Such probes include peptide nucleic acids, as described in Nielsen et al., *Science* 254, 1497-1500 (1991), and other nucleic acid analogs and nucleic acid mimetics. See U.S. patent application Ser. No. 08/630,427.

Hybridizations are usually performed under stringent conditions, for example, at a salt concentration of no more than 1 M and a temperature of at least 25° C. For example, conditions of 5×SSPE (750 mM NaCl, 50 mM NaPhosphate, 5 mM EDTA, pH 7.4) and a temperature of 25-30° C. are suitable for allele-specific probe hybridizations. For stringent conditions, see, for example, Sambrook et al. which is hereby incorporated by reference in its entirety for all purposes above.

An individual is not limited to a human being, but may also include other organisms including but not limited to mammals, plants, fungi, bacteria or cells derived from any of the above.

C. Interrogation of Selected Human SNPs

SEQ ID NOS 1-124,031, are disclosed. Each of the sequences is complementary to one allele of a human SNP listed in Table 1 (Table 1 lists two alleles for each SNP) and 12 bases upstream and downstream of the SNP. Each sequence corresponds to and represents at least three additional nucleic acid sequences included in the invention. For example, if the first nucleic acid sequence listed in SEQ ID NOS 1-124,031 is: 5'-cggatcgcg-3', which is the sense match probe (complementary to one strand of the target sequence), the additional sequences included in the invention which are represented by this nucleic acid sequence are, for example:
5'-cggaacgcg-3'=sense mismatch probe (mismatch base underlined)
5'-cgcgatccg-3'=antisense match probe
5'-cgcgttccg-3'=antisense mismatch probe (mismatch base underlined)

Accordingly, for each nucleic acid sequence listed in SEQ ID NOS 1-124,031, this disclosure includes the corresponding sense mismatch, antisense match, and antisense mismatch probes. The position of the mismatch is preferably located at the central position of the probe, for example, for a probe of 25 nucleotides, the mismatch position would be position 13. In another embodiment the mismatch position may be located anywhere in the nucleic acid sequence and may comprise one or more bases. Generally the sequences correspond to SNPs present in Table 1 and the sequence immediately surrounding the SNP, for example 12-25 bases upstream and downstream of the SNP. The SNPs are preferably biallelic but may be triallelic and the probes in a preferred embodiment are used to distinguish between different alleles of a SNP. Frequency of SNPs vary between populations so a SNP that is biallelic in one population may not be polymorphic in another population or may be represented by different alleles. The sequences in SEQ ID NOS 1-124,031 correspond to the perfect match probes for 12,450 SNPs listed in Table 1. In one embodiment, for each SNP there are 10 perfect match probes that are each 25 nucleotides. Some probes were omitted from the sequence listing because they were duplicates of other probes. The probes correspond to perfect match probes for each allele for each SNP. In general there are 5 perfect match probes for each allele which vary according to the position of the polymorphic base. In some probes the polymorphic base is in the center of the 25 nucleotide probe, corresponding to the 13$^{th}$ nucleotide from the 5' end. In the other probes the polymorphic base is shifted from the center, or 0, position. The polymorphic position may be shifted toward the 5' end of the probe or toward the 3' end of the probe. For example, in SEQ ID NOS 1-5 the polymorphic base corresponds to the A at position 17, (+4), in SEQ ID NO 1; the polymorphic base is shifted to position 15, (+2) in SEQ ID NO 2; to position 14, (+1), in SEQ ID NO 3, it is in position 13, (0), in SEQ ID NO 4 and in position 12, (−1), in SEQ ID NO 5. SEQ ID NOS 6-10 are identical to SEQ ID NOs 1-5 except the polymorphic base corresponds to a G. The polymorphic base may also be shifted further from the 0 position, for example, it may be located from −10 to +10. In a preferred embodiment the mismatch position remains at position 13.

The present invention includes: the sequences listed in SEQ ID NOS 1-124,031 and the complement of these sequences as well as mismatch probes, longer nucleotide sequences which include the nucleic acid sequences listed in SEQ ID NOS 1-124,031 and the complement of these sequences and sub-sequences greater than 9 nucleotides in length of the target nucleic acid sequences listed in SEQ ID NOS 1-124,031 and the complement of these sequences.

The nucleic acid sequences listed in SEQ ID NOS 1-124, 031 correspond to regions of the human genome containing SNPs. SNPs represented by SEQ ID NOS 1-124,031 are identified in Table 1. Each of the numbers in Table 1 is a reference SNP ID or "rs" ID that identifies a SNP in the NCBI (National Center for Biotechnology Information) SNP database (dbSNP). A reference SNP ID, or 'rs' ID is an identification tag assigned by NCBI to SNPs that appear to be unique in the database. The rs ID number, or tag, is assigned at submission. For example, 1000018A, refers to the A allele of a SNP at position 62126003 of chromosome 2. The observed alleles are A and T. A search of the dbSNP database for rs1000018 provides available information about the SNP.

SNPs were selected from the publicly available database of human SNPs. The selected SNPs are from the group of SNPs that are present on XbaI fragments of 300 to 1000 base pairs. A computer system was used to predict fragments that would result when the human genome is digested with XbaI. Those fragments in a selected size range, 300-1000 base pairs, were selected for further analysis. Of those fragments those that carried a SNP were selected as potential target sequences. SNPs were selected from these potential target sequences and the selected SNPs are represented by SEQ ID NOS 1-124,031 and in Table 1. In some embodiments the present invention provides a pool of unique nucleotide sequences complementary to SNPs and sequence surrounding SNPs which alone, or in combinations of 2 or more, 10 or more, 100 or more, 1,000 or more, 10,000 or more or 100,000 or more can be used for a variety of applications.

In one embodiment, the present invention provides for a pool of unique nucleotide sequences which are complementary to Human SNPs and sequence surrounding SNPs formed into a high density array of probes suitable for array based massive parallel gene expression. Array based methods for SNP analysis and genotyping are disclosed and discussed in detail in U.S. Pat. Nos. 6,361,947 and 6,368, 799 which are incorporated herein by reference for all purposes. Generally those methods of SNP analysis involve: (1) providing a pool of target nucleic acids comprising one or more target sequence(s), (2) amplifying a collection of target sequences, (3) hybridizing the amplified nucleic acid sample to a high density array of probes, and (4) detecting the hybridized nucleic acids and determining the presence or absence of one or more alleles for one or more SNPs.

The development of Very Large Scale Immobilized Polymer Synthesis or VLSIPS™ technology has provided methods for making very large arrays of nucleic acid probes in very small arrays. See U.S. Pat. No. 5,143,854 and PCT Nos. WO 90/15070 and 92/10092, and Fodor et al., *Science*, 251:767-77 (1991), each of which is incorporated herein by reference. U.S. Pat. No. 5,800,992 and 6,040,138 describe methods for making arrays of nucleic acid probes that can be used to detect the presence of a nucleic acid containing a specific nucleotide sequence. Methods of forming high-density arrays of nucleic acids, peptides and other polymer sequences with a minimal number of synthetic steps are known. The nucleic acid array can be synthesized on a solid substrate by a variety of methods, including, but not limited to, light-directed chemical coupling, and mechanically directed coupling.

In one embodiment probes are present on the array so that each SNP is represented by a collection of probes. The array may comprise between 8 and 80 probes for each SNP. In one embodiment the collection comprises about 56 probes for each SNP. In a preferred embodiment the collection comprises about 40 probes for each SNP, 20 for each allele. The probes may be present in sets of 8 probes that correspond to a PM probe for each of two alleles, a MM probe for each of 2 alleles, and the corresponding probes for the opposite strand. So for each allele there may be a perfect match, a perfect mismatch, an antisense match and an antisense mismatch probe. The polymorphic position may be the central position of the probe region, for example, the probe region may be 25 nucleotides and the polymorphic allele may be in the middle with 12 nucleotides on either side. In other probe sets the polymorphic position may be offset from the center. For example, the polymorphic position may be from 1 to 5 bases from the central position on either the 5' or 3' side of the probe. The interrogation position, which is changed in the mismatch probes, may remain at the center position. In one embodiment there are 56 probes for each SNP: the 8 probes corresponding to the polymorphic position at the center or 0 position and 8 probes for the polymorphic position at each of the following positions: −4, −2, −1, +1, +3 and +4 relative to the central or 0 position. In another embodiment 40 probes are used, 8 for the 0 position and 8 for each of 4 additional positions selected from: −4, −2, −1, +1, +3 and +4 relative to the central or 0 position. The probes sets used may vary depending on the SNP, for example, for one SNP the probes may be −4, −2, 0, +1 and +4 and for another SNP they may be −2, −1, 0, +1 and +4. Empirical data may be used to choose which probe sets to use on an array. In another embodiment 24 or 32 probes may be used for one or more SNPs.

In many embodiments pairs are present in perfect match and mismatch pairs, one probe in each pair being a perfect match to the target sequence and the other probe being identical to the perfect match probe except that the central base is a homo-mismatch. Mismatch probes provide a control for non-specific binding or cross-hybridization to a nucleic acid in the sample other than the target to which the probe is directed. Thus, mismatch probes indicate whether hybridization is or is not specific. For example, if the target is present, the perfect match probes should be consistently brighter than the mismatch probes because fluorescence intensity, or brightness, corresponds to binding affinity. (See e.g., U.S. Pat. No. 5,324,633, which is incorporated herein for all purposes.) Finally, the difference in intensity between the perfect match and the mismatch probe (I(PM)-I(MM)) provides a good measure of the concentration of the hybridized material. See PCT No. WO 98/11223, which is incorporated herein by reference for all purposes.

In another embodiment, the current invention provides a pool of sequences that may be used as probes. Methods for making probes are well known. See e.g., MOLECULAR CLONING A LABORATORY MANUAL, Sambrook and Russell Eds., CSLH Press, ($3^{rd}$ ed. 2001), which is hereby incorporated in its entirety by reference for all purposes. Sambrook describes a number of uses for nucleic acid probes of defined sequence. Some of the uses described by Sambrook include: (1) screening cDNA or genomic DNA libraries, or subclones derived from them, for additional clones containing segments of DNA that have been isolated and previously sequenced; (2) identifying or detect the sequences of specific genes; (3) detecting specific mutations in genes of known sequence; to detect specific mutations generated by site-directed mutagenesis of cloned genes; (4) and mapping the 5' termini of mRNA molecules by primer extensions. Sambrook describes other uses for probes throughout. See also Alberts et al., MOLECULAR BIOLOGY OF THE CELL ($3^{rd}$ ed. 1994) at 307 and Lodish et al., MOLECULAR CELL BIOLOGY, ($4^{th}$ ed. 2000) at 285-286, each of which is hereby incorporated by reference in its entirety for all purposes, for a brief discussion of the use of nucleic acid probes in in situ hybridization. Other uses for probes derived from the sequences disclosed in this invention will be readily apparent to those of skill in the art. See e.g., Lodish et al., MOLECULAR CELL BIOLOGY, ($3^{rd}$ ed. 1995) at 229-233, incorporated above, for a description of the construction of genomic libraries.

In another embodiment, the current invention may be combined with known methods to genotype polymorphism in a wide variety of contexts. For example, the methods may be used to do association studies, identify candidate genes associated with a phenotype, genotype SNPs in clinical populations, or correlate genotype information to clinical phenotypes. The SNPs of Table 1 have been selected based on a number of criteria that make them suitable for complex genetic analysis, for example, linkage analysis and association studies. The SNPs of Table 1 are spaced throughout the genome at an average distance of 210 Kb from one another and they are known to be polymorphic in multiple populations. The panel of SNPs or a subset of these SNPs may be genotyped by any method available. See, Color Atlas of Genetics ($2^{nd}$ ed), Ed. Passarge (2001) Thieme, NY, N.Y., which is incorporated by reference.

For a discussion of genotyping analysis methods see, for example, Elena and Lenski Nature Reviews, Genetics 4:457469 (2003), Twyman and Primrose, Pharmacogenomics 4:67-79 (2003), Hirschhorn et al. Genetics in Medicine 4:45-61 (2002) and Glazier et al. *Science* 298:2345-2349 (2002) each of which is incorporated herein by references for all purposes. For a discussion of high throughput genotyping approaches see, for example, Jenkins and Gibson, *Comp Funct Genom* 2002; 3:57-66 which is incorporated herein by reference. For a review of methods of haplotype analysis in population genetics and association studies see, for example, Zhao et al. Pharmacogenomics 4:171-178 (2003), which is incorporated herein by reference.

One skilled in the art will appreciate that a wide range of applications will be available using 2 or more, 10 or more, 100 or more, 1000 or more, 10,000 or more, 100,000 or more, or more of the SEQ ID NOS 1-124,031 sequences as probes for polymorphism detection and analysis. The combination of the DNA array technology and the Human SNP specific probes in this disclosure is a powerful tool for genotyping and mapping disease loci.

In many embodiments the target sequences are a subset that is representative of a larger set. For example, the target sequences may be 1,000, 5,000, 10,000 or 100,000 to 10,000, 20,000, 100,000, 1,500,000 or 3,000,000 SNPs that may be representative of a larger population of SNPs present in a population of individuals. The target sequences may be dispersed throughout a genome, including for example, sequences from each chromosome, or each arm of each chromosome. Target sequences may be representative of haplotypes or particular phenotypes or collections of phenotypes. For a description of haplotypes see, for example, Gabriel et al., Science, 296:2225-9 (2002), Daly et al. Nat Genet., 29:229-32 (2001) and Rioux et al., Nat Genet., 29:223-8 (2001), each of which is incorporated herein by reference in its entirety.

In another embodiment, the present invention may be used for cross-species comparisons. One skilled in the art will appreciate that it is often useful to determine whether a SNP present in one species, for example human, is present in a conserved format in another species, including, without limitation, gorilla, chimp, mouse, rat, chicken, zebrafish, *Drosophila*, or yeast. See e.g. Andersson et al., *Mamm. Genome,* 7(10):717-734 (1996), which is hereby incorporated by reference for all purposes, which describes the utility of cross-species comparisons. The use of 2 or more, 10 or more, 100 or more, 1000 or more, 10,000 or more, 100,000 or more of the sequences disclosed in this invention in an array can be used to determine whether any sequence from one or more of the Human genes represented by the sequences disclosed in this invention is conserved in another species by, for example, hybridizing genomic nucleic acid samples from another species to an array comprised of the sequences disclosed in this invention.

In another embodiment of the invention, the sequences of this invention may be used to generate primers directed to their corresponding genes as disclosed in the GenBank or any other public database. The sequences provided in the sequence listing and the reference numbers provided in Table 1 may be used to identify the region of the genome containing the associated SNP. Primers may be used in such basic techniques as sequencing or PCR, see e.g., Sambrook, incorporated by reference above. In one embodiment PCR is allele specific.

In a preferred embodiment, the hybridized nucleic acids are detected by detecting one or more labels attached to the sample nucleic acids. The labels may be incorporated by any of a number of means well known to those of skill in the art. In one embodiment, the label is simultaneously incorporated during the amplification step in the preparation of the sample nucleic acids. Thus, for example, polymerase chain reaction (PCR) with labeled primers or labeled nucleotides will provide a labeled amplification product. In another embodiment, transcription amplification using a labeled nucleotide (e.g. fluorescein-labeled UTP and/or CTP) incorporates a label into the transcribed nucleic acids.

Alternatively, a label may be added directly to the original nucleic acid sample (e.g., mRNA, polyA mRNA, cDNA, etc.) or to the amplification product after the amplification is completed. Means of attaching labels to nucleic acids are well known to those of skill in the art and include, for example, nick translation or end-labeling (e.g. with a labeled RNA) by kinasing the nucleic acid and subsequent attachment (ligation) of a nucleic acid linker joining the sample nucleic acid to a label (e.g., a fluorophore). In another embodiment label is added to the end of fragments using terminal deoxytransferase (TdT).

Detectable labels suitable for use in the present invention include any composition detectable by spectroscopic, photochemical, biochemical, immunochemical, electrical, optical or chemical means. Useful labels in the present invention include, but are not limited to: biotin for staining with labeled streptavidin conjugate; anti-biotin antibodies, magnetic beads (e.g., Dynabeads™); fluorescent dyes (e.g., fluorescein, texas red, rhodamine, green fluorescent protein, and the like); radiolabels (e.g., $^3H$, $^{125}I$, $^{35}S$, $^{14}C$, or $^{32}P$); phosphorescent labels; enzymes (e.g., horse radish peroxidase, alkaline phosphatase and others commonly used in an ELISA); and calorimetric labels such as colloidal gold or colored glass or plastic (e.g., polystyrene, polypropylene, latex, etc.) beads. Patents teaching the use of such labels include U.S. Pat. Nos. 3,817,837; 3,850,752; 3,939,350; 3,996,345; 4,277,437; 4,275,149; and 4,366,241, each of which is hereby incorporated by reference in its entirety for all purposes.

Means of detecting such labels are well known to those of skill in the art. Thus, for example, radiolabels may be detected using photographic film or scintillation counters; fluorescent markers may be detected using a photodetector to detect emitted light. Enzymatic labels are typically detected by providing the enzyme with a substrate and detecting the reaction product produced by the action of the enzyme on the substrate, and calorimetric labels are detected by simply visualizing the colored label.

The label may be added to the target nucleic acid(s) prior to, or after the hybridization. So called "direct labels" are detectable labels that are directly attached to or incorporated into the target nucleic acid prior to hybridization. In contrast, so called "indirect labels" are joined to the hybrid duplex after hybridization. Often, the indirect label is attached to a binding moiety that has been attached to the target nucleic acid prior to the hybridization. Thus, for example, the target nucleic acid may be biotinylated before the hybridization. After hybridization, an avidin-conjugated fluorophore will bind the biotin bearing hybrid duplexes providing a label that is easily detected. For a detailed review of methods of labeling nucleic acids and detecting labeled hybridized nucleic acids. See Tijssen, LABORATORY TECHNIQUES IN BIOCHEMISTRY AND MOLECULAR BIOLOGY, VOL. 24: HYBRIDIZATION WITH NUCLEIC ACID PROBES (1993) which is hereby incorporated by reference in its entirety for all purposes.

D. Methods of Use

The methods of the presently claimed invention can be used for a wide variety of applications including, for example, linkage and association studies, identification of candidate gene regions, genotyping clinical populations, correlation of genotype information to phenotype information, loss of heterozygosity analysis, and identification of the source of an organism or sample, or the population from which an organism or sample originates. Any analysis of genomic DNA may be benefited by a reproducible method of polymorphism analysis.

Furthermore, the probes, sequences, arrays and collections of SNPs of the presently claimed invention are particularly well suited for study and characterization of extremely large regions of genomic DNA in individual samples and in populations.

In a preferred embodiment, the methods of the presently claimed invention are used to genotype individuals, populations or samples. For example, any of the procedures described above, alone or in combination, could be used to interrogate SNPs present in Table 1. The disclosed arrays could be used in conjunction with methods of reducing the complexity of a sample in a reproducible and predictable manner. For example, complexity reduction methods may be designed to amplify a collection of target sequences that correspond to fragments containing SNPs from Table 1. Arrays may be designed and manufactured on a large scale basis to interrogate those fragments with probes comprising sequences from SEQ ID NOS 1-124,031. Thereafter, a sample from one or more individuals would be obtained and prepared using the same techniques which were used to prepare the selection probes or to design the array. Each sample can then be hybridized to an array and the hybridization pattern can be analyzed to determine the genotype of each individual or a population of individuals. Methods of use for polymorphisms and SNP discovery can be found in, for example, U.S. Pat. No. 6,361,947 which is herein incorporated by reference in its entirety for all purposes.

Correlation of Polymorphisms with Phenotypic Traits

Most human sequence variation is attributable to or correlated with SNPs, with the rest attributable to insertions or deletions of one or more bases, repeat length polymorphisms and rearrangements. On average, SNPs occur every 1,000-2,000 bases when two human chromosomes are compared, resulting in an estimated 3,000,000 SNPs in the human genome. (See, The International SNP Map Working Group, Science 409: 928-933 (2001) incorporated herein by reference in its entirety for all purposes.) Human diversity is limited not only by the number of SNPs occurring in the genome but further by the observation that specific combinations of alleles are found at closely linked sites, generating haplotypes. For a description of haplotypes see, for example, Gabriel et al., Science, 296:2225-9 (2002), Daly et al. Nat Genet., 29:229-32 (2001) and Rioux et al., Nat Genet., 29:223-8 (2001), each of which is incorporated herein by reference in its entirety.

Correlation of individual polymorphisms or groups of polymorphisms with phenotypic characteristics is a valuable tool in the effort to identify DNA variation that contributes to population variation in phenotypic traits. Phenotypic traits include, for example, physical characteristics, risk for disease, and response to the environment. Polymorphisms that correlate with disease are particularly interesting because they represent mechanisms to accurately diagnose disease and targets for drug treatment. Hundreds of human diseases have already been correlated with individual polymorphisms but there are many diseases that are known to have an, as yet unidentified, genetic component and many diseases for which a component is or may be genetic. Large scale association studies using large groups of SNPs provides additional tools for disease association studies.

Many diseases may correlate with multiple genetic changes making identification of the polymorphisms associated with a given disease more difficult. One approach to overcome this difficulty is to systematically explore the limited set of common gene variants for association with disease.

To identify correlation between one or more alleles and one or more phenotypic traits, individuals are tested for the presence or absence of polymorphic markers or marker sets and for the phenotypic trait or traits of interest. The presence or absence of a set of polymorphisms is compared for individuals who exhibit a particular trait and individuals who exhibit lack of the particular trait to determine if the presence or absence of a particular allele is associated with the trait of interest. For example, it might be found that the presence of allele A1 at polymorphism A correlates with heart disease. As an example of a correlation between a phenotypic trait and more than one polymorphism, it might be found that allele A1 at polymorphism A and allele B1 at polymorphism B correlate with a phenotypic trait of interest.

Diagnosis of Disease and Predisposition to Disease

Markers or groups of markers that correlate with the symptoms or occurrence of disease can be used to diagnose disease or predisposition to disease without regard to phenotypic manifestation. To diagnose disease or predisposition to disease, individuals are tested for the presence or absence of polymorphic markers or marker sets that correlate with one or more diseases. If, for example, the presence of allele A1 at polymorphism A correlates with coronary artery disease then individuals with allele A1 at polymorphism A may be at an increased risk for the condition.

Individuals can be tested before symptoms of the disease develop. Infants, for example, can be tested for genetic diseases such as phenylketonuria at birth. Individuals of any age could be tested to determine risk profiles for the occurrence of future disease. Often early diagnosis can lead to more effective treatment and prevention of disease through dietary, behavior or pharmaceutical interventions. Individuals can also be tested to determine carrier status for genetic disorders. Potential parents can use this information to make family planning decisions.

Individuals who develop symptoms of disease that are consistent with more than one diagnosis can be tested to make a more accurate diagnosis. If, for example, symptom S is consistent with diseases X, Y or Z but allele A1 at polymorphism A correlates with disease X but not with diseases Y or Z an individual with symptom S is tested for the presence or absence of allele A1 at polymorphism A. Presence of allele A1 at polymorphism A is consistent with a diagnosis of disease X. Genetic expression information discovered through the use of arrays has been used to determine the specific type of cancer a particular patient has. (See, Golub et al. Science 286: 531-537 (2001) hereby incorporated by reference in its entirety for all purposes.)

Pharmacogenomics

Pharmacogenomics refers to the study of how genes affect response to drugs. There is great heterogeneity in the way individuals respond to medications, in terms of both host toxicity and treatment efficacy. There are many causes of this variability, including: severity of the disease being treated; drug interactions; and the individuals age and nutritional status. Despite the importance of these clinical variables, inherited differences in the form of genetic polymorphisms can have an even greater influence on the efficacy and toxicity of medications. Genetic polymorphisms in drug-metabolizing enzymes, transporters, receptors, and other drug targets have been linked to interindividual differences in the efficacy and toxicity of many medications. (See, Evans and Relling, Science 286: 487-491 (2001) which is herein incorporated by reference for all purposes).

An individual patient has an inherited ability to metabolize, eliminate and respond to specific drugs. Correlation of polymorphisms with pharmacogenomic traits identifies those polymorphisms that impact drug toxicity and treatment efficacy. This information can be used by doctors to determine what course of medicine is best for a particular patient and by pharmaceutical companies to develop new drugs that target a particular disease or particular individuals within the population, while decreasing the likelihood of adverse affects. Drugs can be targeted to groups of individuals who carry a specific allele or group of alleles. For example, individuals who carry allele A1 at polymorphism A may respond best to medication X while individuals who carry allele A2 respond best to medication Y. A trait may be the result of a single polymorphism but will often be determined by the interplay of several genes.

In addition some drugs that are highly effective for a large percentage of the population, prove dangerous or even lethal for a very small percentage of the population. These drugs typically are not available to anyone. Pharmacogenomics can be used to correlate a specific genotype with an adverse drug response. If pharmaceutical companies and physicians can accurately identify those patients who would suffer adverse responses to a particular drug, the drug can be made available on a limited basis to those who would benefit from the drug.

Similarly, some medications may be highly effective for only a very small percentage of the population while proving only slightly effective or even ineffective to a large percentage of patients. Pharmacogenomics allows pharamaceutical companies to predict which patients would be the ideal candidate for a particular drug, thereby dramatically reducing failure rates and providing greater incentive to companies to continue to conduct research into those drugs.

Determination of Relatedness

There are many circumstances where relatedness between individuals is the subject of genotype analysis and the present invention can be applied to these procedures.

Paternity testing is commonly used to establish a biological relationship between a child and the putative parent or relative of that child. Genetic material from the child can be analyzed for occurrence of polymorphisms and compared to a similar analysis of the putative father's genetic material. Determination of relatedness is not limited to the relationship between father and child but can also be done to determine the relatedness between mother and child, (see e.g. Staub et al., U.S. Pat. No. 6,187,540) or more broadly, to determine how related one individual is to another, for example, between races or species or between individuals from geographically separated populations, (see for example H. Kaessmann, et al. Nature Genet. 22, 78 (1999)). The SNPs of Table 1 may be used for paternity analysis in groups of 100 or more, 1000 or more or 10,000 or more. The SNPs may be used for anthropological studies.

Forensics

The capacity to identify a distinguishing or unique set of forensic markers in an individual is useful for forensic analysis. For example, one can determine whether a blood sample from a suspect matches a blood or other tissue sample from a crime scene by determining whether the set of polymorphic forms occupying selected polymorphic sites is the same in the suspect and the sample. If the set of polymorphic markers does not match between a suspect and a sample, it can be concluded (barring experimental error) that the suspect was not the source of the sample. If the set of markers does match, one can conclude that the DNA from the suspect is consistent with that found at the crime scene. If frequencies of the polymorphic forms at the loci tested have been determined (e.g., by analysis of a suitable population of individuals), one can perform a statistical analysis to determine the probability that a match of suspect and crime scene sample would occur by chance. A similar comparison of markers can be used to identify an individual's remains. For example the U.S. armed forces collect and archive a tissue sample for each service member. If unidentified human remains are suspected to be those of an individual a sample from the remains can be analyzed for markers and compared to the markers present in the tissue sample initially collected from that individual. The disclosed arrays, probes and SNPs may be used for forensic analysis.

Allele Frequency Determination

Large numbers of individuals, for example, 20, 40, 60, 100, 1000, 10,000, Or 100,000 or more may be genotyped at a particular SNP to determine the frequency of each of the possible alleles. Results from different populations may be compared to determine if some alleles are present at higher or lower frequencies in distinct populations. Some SNPs may be identified that are monomorphic (zero-heterozygosity) in one population but not in another population. Allele frequencies may be used to study phenomenon such as natural selection, random genetic drift, demographic evens such as population bottlenecks or expansions or combinations of these.

Genetic Mapping

The SNPs and arrays disclosed may be used to generate information useful for genetic mapping.

EXAMPLE

The following example serves to illustrate the type of experiment that could be conducted using the invention.

Polymorphism Detection by Hybridization to High Density Oligonucleotide Arrays

Arrays containing the desired number of probes can be synthesized using the method described in U.S. Pat. No. 5,143,854, incorporated by reference above. Nucleic acid may be amplified so that a collection of target sequences is preferentially amplified. The amplified fragments may be fragmented and end labeled with terminal deoxytransferase and biotin labeled nucleotides. Hybridizations are carried out in a flow cell that contains the two-dimensional DNA probe arrays. Following a brief washing step to remove unhybridized RNA, the arrays are scanned using a scanning confocal microscope.

Genomic DNA was digested with XbaI by mixing 5 µl 50 ng/µl human genomic DNA (Coriell Cell Repositories) with 10.5 µl H$_2$O (Accugene), 2 µl 10×RE buffer 2 (NEB, Beverly, Mass.), 2 µl 10×BSA (NEB, Beverly, Mass.), and 0.5 µl XbaI (NEB, Beverly, Mass.). The reaction was incubated at 30° C. for 2 hours, then the enzyme was inactivated by incubation at 70° C. for 20 min and then to 4° C. The reaction may be stored at −20° C.

For ligation of the adapters the digested DNA was then mixed with 1.25 µl 5 µM adaptor in TE pH 8.0, 2.5 µl T4 DNA ligation buffer and 1.25 µl T4 DNA Ligase (NEB, Beverly, Mass.) which is added last. The reaction was incubated at 16° C. for 2 hours then at 70° C. for 20 min and then to 4° C. The 25 µl ligation mixture is then diluted with 75 µl H$_2$O and may be stored at −20° C.

For PCR 10 µl of the diluted ligated DNA is mixed with 10 µl PCR buffer II (Perkin Elmer, Boston, Mass.), 10 µl 2.5 mM dNTP (PanVera Takara, Madison, Wis.), 10 µl 25 mM MgCl$_2$, 7.5 µl 10 µM primer (for a final concentration of 0.75 µM), 2 µl 5 U/µl Taq Gold (Perkin Elmer, Boston, Mass.) and 50.5 µl H$_2$O. For each array four 100 µl reactions were prepared. Amplification was done using the following program: 95° C. for 3 min; 35 cycles of 95° C. for 20 sec, 59° C. for 15 sec and 72° C. for 15 sec; and a final incubation at 72° C. for 7 min. The reactions were then held at 4° C. The lid heating option was selected.

The PCR reactions were then purified by mixing the 100 µl PCR reaction with 500 µl PB or PM buffer into Qiagen columns (Valencia, Calif.) and the column was centrifuged at 13,000 rpm for 1 min. Flow through was discarded and 750 µl PE buffer with ethanol was added into the column to wash the sample and the column was spun at 13,000 rpm for 1 min. The flow through was discarded and the column was spun at 13,000 rpm for another 1 min. The flow through was discarded and the column was placed in a new collection tube. For 2 of the 4 samples 30 µl of EB elution buffer pH 8.5 was added to the center of the QIAquick membrane to elute the sample and the columns were allowed to stand at room temperature for 5 min and then centrifuged at 13,000 for 1 min. The elution buffer from the first 2 samples was then used to elute the other 2 samples and the eluates were combined. The DNA was quantified and diluted so that 48 µl contains 20 µg DNA.

The DNA was fragmented by mixing 48 µl DNA (20 µg), 5 µl RE Buffer 4, and 2 µl 0.09 U/µl DNase in a total volume of 55 µl. The reaction was incubated at 37° C. for 30 min then 95° C. for 15 min and then held at 4° C.

Fragments were labeled by incubating 50 µl fragmented DNA, 13 µl 5×TdT buffer (Promega, Madison, Wis.), 1 µl 1 mM biotinolated-ddATP (NEN Life Sciences, Boston, Mass.), and 1 µl TdT (Promega, Madison, Wis.) at 37° C. overnight then at 95° C. for 10 min, then held at 4° C.

Hybridization mix is 12 µl 1.22 M MES, 13 µl DMSO, 13 µl 50× Denharts, 3 µl 0.5M EDTA, 3 µl 10 mg/ml herring sperm DNA, 3 µl 10 nM oligo B2, 3 µl 1 mg/ml Human Cot-1, 3 µl 1% Tween-20, and 140 µl 5M TMACL. 70 µl labeled DNA was mixed with 190 µl hybridization mix. The mixture was incubated at 95° C. for 10 min, spun briefly and held at 47.5° C. 200 µl of the denatured mixture was hybridized to an array at 47.5° C. for 16 to 18 hours at 60 rpm. The array comprised SEQ ID NOS. 1-124,031 tiled on an array along with mismatch, antisense match and antisense mismatch probes for each of the sequences. Each probe is present in a spatially addressable location.

Staining mix was 990 µl $H_2O$, 450 µl 20×SSPE, 15 µl Tween-20, 30 µl 50% Denharts. For the first stain mix 495 µl staining mix with 5 µl 1 mg/ml streptavidin (Pierce Scientific, Rockford, Ill.), for the second stain mix 495 µl staining mix with 5 µl 0.5 mg/ml biotinylated anti-streptavidin antibody (Vector Labs, Burlingame, Calif.) and for the third stain mix 495 µl staining mix with 5 µl 1 mg/ml streptavidin, R-phycoerythrin conjugate (Molecular Probes, Eugene, Oreg.). Wash and stain under standard conditions.

Hybridized samples were analyzed with a computer system to determine which alleles were present for a particular SNP.

CONCLUSION

The inventions herein provide a pool of unique nucleic acid sequences, which may be used to genotype a collection of Human SNPs. These sequences can be used for a variety of types of analyses.

The above description is illustrative and not restrictive. Many variations of the invention will become apparent to those of skill in the art upon review of this disclosure. The scope of the invention should, therefore, be determined not with reference to the above description, but instead be determined with reference to the appended claims along with their full scope of equivalents.

SEQUENCE LISTING (124031 sequences)

SEQ ID NO: 1 - DNA, 25 bp, Homo sapien
aaaaaaaaaaatcgcaaacaaatct

SEQ ID NO: 2 - DNA, 25 bp, Homo sapien
aaaaaaaaaaatcgcagacaaatct

SEQ ID NO: 3 - DNA, 25 bp, Homo sapien
aaaaaaaaaactaaagcttgatctt

SEQ ID NO: 4 - DNA, 25 bp, Homo sapien
aaaaaaaaaactatagcttgatctt

SEQ ID NO: 5 - DNA, 25 bp, Homo sapien
aaaaaaaaaagcatgactgtgacac

SEQ ID NO: 6 - DNA, 25 bp, Homo sapien
aaaaaaaaaagcatgattgtgacac

SEQ ID NO: 7 - DNA, 25 bp, Homo sapien
aaaaaaaaaagtcccaattcagata

SEQ ID NO: 8 - DNA, 25 bp, Homo sapien
aaaaaaaaaagttccaattcagata

SEQ ID NO: 9 - DNA, 25 bp, Homo sapien
aaaaaaaaaccttcatcatttaaac

SEQ ID NO: 10 - DNA, 25 bp, Homo sapien
aaaaaaaaactaaagcttgatcttc

SEQ ID NO: 11 - DNA, 25 bp, Homo sapien
aaaaaaaaactatagcttgatcttc

SEQ ID NO: 12 - DNA, 25 bp, Homo sapien
aaaaaaaaagaatgtctcataggta

SEQ ID NO: 13 - DNA, 25 bp, Homo sapien
aaaaaaaaagggaatgaggaatgaa

SEQ ID NO: 14 - DNA, 25 bp, Homo sapien
aaaaaaaaagtcccaattcagatag

SEQ ID NO: 15 - DNA, 25 bp, Homo sapien
aaaaaaaaagttccaattcagatag

SEQ ID NO: 16 - DNA, 25 bp, Homo sapien
aaaaaaaaatcgcaaacaaatctca

SEQ ID NO: 17 - DNA, 25 bp, Homo sapien
aaaaaaaaatcgcagacaaatctca

SEQ ID NO: 18 - DNA, 25 bp, Homo sapien
aaaaaaaaatcttcatcatttaaac

SEQ ID NO: 19 - DNA, 25 bp, Homo sapien
aaaaaaaaccttcatcatttaaaca

SEQ ID NO: 20 - DNA, 25 bp, Homo sapien
aaaaaaaactaaagcttgatcttca

SEQ ID NO: 21 - DNA, 25 bp, Homo sapien
aaaaaaaactatagcttgatcttca

SEQ ID NO: 22 - DNA, 25 bp, Homo sapien
aaaaaaaaggagtttccctcaaaca

SEQ ID NO: 23 - DNA, 25 bp, Homo sapien
aaaaaaaaggagtttctctcaaaca

SEQ ID NO: 24 - DNA, 25 bp, Homo sapien
aaaaaaaaggggaatgaggaatgaa

SEQ ID NO: 25 - DNA, 25 bp, Homo sapien
aaaaaaaatactaggaaactgaatt

SEQ ID NO: 26 - DNA, 25 bp, Homo sapien
aaaaaaaatcgcaaacaaatctcat

SEQ ID NO: 27 - DNA, 25 bp, Homo sapien
aaaaaaaatcgcagacaaatctcat

SEQ ID NO: 28 - DNA, 25 bp, Homo sapien
aaaaaaaatcttcatcatttaaaca

SEQ ID NO: 29 - DNA, 25 bp, Homo sapien
aaaaaaaatgaatgtctcataggta

SEQ ID NO: 30 - DNA, 25 bp, Homo sapien
aaaaaaaatgatgacgggcacagtc

SEQ ID NO: 31 - DNA, 25 bp, Homo sapien
aaaaaaaatgatgatgggcacagtc

SEQ ID NO: 32 - DNA, 25 bp, Homo sapien
aaaaaaaatgctaggaaactgaatt

SEQ ID NO: 33 - DNA, 25 bp, Homo sapien
aaaaaaaatgctgagaatgtaaaat

SEQ ID NO: 34 - DNA, 25 bp, Homo sapien
aaaaaaaatgctgagagtgtaaaat

SEQ ID NO: 35 - DNA, 25 bp, Homo sapien
aaaaaaacatcacttgacattcgga

SEQ ID NO: 36 - DNA, 25 bp, Homo sapien
aaaaaaacatcccttgacattcgga

SEQ ID NO: 37 - DNA, 25 bp, Homo sapien
aaaaaaagagcatgaattcaaagag

SEQ ID NO: 38 - DNA, 25 bp, Homo sapien
aaaaaaagatcatgaattcaaagag

SEQ ID NO: 39 - DNA, 25 bp, Homo sapien
aaaaaaagcaacggtaatgagccaa

SEQ ID NO: 40 - DNA, 25 bp, Homo sapien
aaaaaaagcaactgtaatgagccaa

SEQ ID NO: 41 - DNA, 25 bp, Homo sapien
aaaaaaagcatgactgtgacacctg

SEQ ID NO: 42 - DNA, 25 bp, Homo sapien
aaaaaaagcatgattgtgacacctg

SEQ ID NO: 43 - DNA, 25 bp, Homo sapien
aaaaaaagccatccgtctggcattg

SEQ ID NO: 44 - DNA, 25 bp, Homo sapien
aaaaaaagccatctgtctggcattg

SEQ ID NO: 45 - DNA, 25 bp, Homo sapien
aaaaaaaggagggactcgccacttc

SEQ ID NO: 46 - DNA, 25 bp, Homo sapien
aaaaaaaggagggacttgccacttc

SEQ ID NO: 47 - DNA, 25 bp, Homo sapien
aaaaaaatactaggaaactgaattc

SEQ ID NO: 48 - DNA, 25 bp, Homo sapien
aaaaaaatactcattggaaacagag

SEQ ID NO: 49 - DNA, 25 bp, Homo sapien
aaaaaaatactcgttggaaacagag

SEQ ID NO: 50 - DNA, 25 bp, Homo sapien
aaaaaaatagaaacgaactaataac

SEQ ID NO: 51 - DNA, 25 bp, Homo sapien
aaaaaaatagaaacgacctaataac

SEQ ID NO: 52 - DNA, 25 bp, Homo sapien
aaaaaaatatcacacaaattccaat

SEQ ID NO: 53 - DNA, 25 bp, Homo sapien
aaaaaaatatcagacaaattccaat

SEQ ID NO: 54 - DNA, 25 bp, Homo sapien
aaaaaaatatgtgattcctgccctg

SEQ ID NO: 55 - DNA, 25 bp, Homo sapien
aaaaaaatatgttattcctgccctg

SEQ ID NO: 56 - DNA, 25 bp, Homo sapien
aaaaaaatcataaactcattgtgag

SEQ ID NO: 57 - DNA, 25 bp, Homo sapien
aaaaaaatcgcaaacaaatctcata

SEQ ID NO: 58 - DNA, 25 bp, Homo sapien
aaaaaaatcgcagacaaatctcata

SEQ ID NO: 59 - DNA, 25 bp, Homo sapien
aaaaaaatgaccaagaatagccaac

SEQ ID NO: 60 - DNA, 25 bp, Homo sapien
aaaaaaatgaccgagaatagccaac

SEQ ID NO: 61 - DNA, 25 bp, Homo sapien
aaaaaaatgataaactcattgtgag

SEQ ID NO: 62 - DNA, 25 bp, Homo sapien
aaaaaaatgatgacgggcacagtct

SEQ ID NO: 63 - DNA, 25 bp, Homo sapien
aaaaaaatgatgatgggcacagtct

SEQ ID NO: 64 - DNA, 25 bp, Homo sapien
aaaaaaatgctaggaaactgaattc

SEQ ID NO: 65 - DNA, 25 bp, Homo sapien
aaaaaaattatgaaagtgtctagag

SEQ ID NO: 66 - DNA, 25 bp, Homo sapien
aaaaaaattatggaagtgtctagag

SEQ ID NO: 67 - DNA, 25 bp, Homo sapien
aaaaaaatttaccaacttctaggcc

SEQ ID NO: 68 - DNA, 25 bp, Homo sapien
aaaaaaatttaccgacttctaggcc

SEQ ID NO: 69 - DNA, 25 bp, Homo sapien
aaaaaacaagtccaaggtgaaatag

SEQ ID NO: 70 - DNA, 25 bp, Homo sapien
aaaaaacaagtccagggtgaaatag

SEQ ID NO: 71 - DNA, 25 bp, Homo sapien
aaaaaacacagaggcaggtcccgtg

SEQ ID NO: 72 - DNA, 25 bp, Homo sapien
aaaaaacacagagtcaggtcccgtg

SEQ ID NO: 73 - DNA, 25 bp, Homo sapien
aaaaaacagaaaggcgttgcttaca

SEQ ID NO: 74 - DNA, 25 bp, Homo sapien
aaaaaacagaaaggtgttgcttaca

SEQ ID NO: 75 - DNA, 25 bp, Homo sapien
aaaaaacaggaaacaatgtcatatt

SEQ ID NO: 76 - DNA, 25 bp, Homo sapien
aaaaaacaggaaactatgtcatatt

SEQ ID NO: 77 - DNA, 25 bp, Homo sapien
aaaaaacatcacaactctaaattat

SEQ ID NO: 78 - DNA, 25 bp, Homo sapien
aaaaaacatcacgactctaaattat

SEQ ID NO: 79 - DNA, 25 bp, Homo sapien
aaaaaacatctatcagcataactga

SEQ ID NO: 80 - DNA, 25 bp, Homo sapien
aaaaaacatctttcagcataactga

SEQ ID NO: 81 - DNA, 25 bp, Homo sapien
aaaaaaccacgttttccagacttgc

SEQ ID NO: 82 - DNA, 25 bp, Homo sapien
aaaaaaccatgttttccagacttgc

SEQ ID NO: 83 - DNA, 25 bp, Homo sapien
aaaaaacccaacatatagtaattaa

SEQ ID NO: 84 - DNA, 25 bp, Homo sapien
aaaaaacccaacatatggtaattaa

SEQ ID NO: 85 - DNA, 25 bp, Homo sapien
aaaaaactcaaacatgatataaaca

SEQ ID NO: 86 - DNA, 25 bp, Homo sapien
aaaaaactcaaacatggtataaaca

SEQ ID NO: 87 - DNA, 25 bp, Homo sapien
aaaaaactgctgtgccttttgtatt

SEQ ID NO: 88 - DNA, 25 bp, Homo sapien
aaaaaactgctttgccttttgtatt

SEQ ID NO: 89 - DNA, 25 bp, Homo sapien
aaaaaagaaaatagccaggcatggt

SEQ ID NO: 90 - DNA, 25 bp, Homo sapien
aaaaaagaaaatcgccaggcatggt

SEQ ID NO: 91 - DNA, 25 bp, Homo sapien
aaaaaagaaagccgaataacagatg

SEQ ID NO: 92 - DNA, 25 bp, Homo sapien
aaaaaagaaagctgaataacagatg

SEQ ID NO: 93 - DNA, 25 bp, Homo sapien
aaaaaagaacgtgaagactcaggac

SEQ ID NO: 94 - DNA, 25 bp, Homo sapien
aaaaaagaatgtgaagactcaggac

SEQ ID NO: 95 - DNA, 25 bp, Homo sapien
aaaaaagaccacatgtgaagaatgc

SEQ ID NO: 96 - DNA, 25 bp, Homo sapien
aaaaaagactgtattgacatgaata

SEQ ID NO: 97 - DNA, 25 bp, Homo sapien
aaaaaagactgtattgtcatgaata

SEQ ID NO: 98 - DNA, 25 bp, Homo sapien
aaaaaagagcatgaattcaaagagc

SEQ ID NO: 99 - DNA, 25 bp, Homo sapien
aaaaaagagttactacacaatgggg

SEQ ID NO: 100 - DNA, 25 bp, Homo sapien
aaaaaagagttacttcacaatgggg

SEQ ID NO: 101 - DNA, 25 bp, Homo sapien
aaaaaagatacatttgaattttata

SEQ ID NO: 102 - DNA, 25 bp, Homo sapien
aaaaaagatacatttggattttata

SEQ ID NO: 103 - DNA, 25 bp, Homo sapien
aaaaaagatcacatgtgaagaatgc

SEQ ID NO: 104 - DNA, 25 bp, Homo sapien
aaaaaagatcatgaattcaaagagc

SEQ ID NO: 105 - DNA, 25 bp, Homo sapien
aaaaaagattctcaaaaatgaagtt

SEQ ID NO: 106 - DNA, 25 bp, Homo sapien
aaaaaagattctcgaaaatgaagtt

SEQ ID NO: 107 - DNA, 25 bp, Homo sapien
aaaaaagcaacggtaatgagccaaa

SEQ ID NO: 108 - DNA, 25 bp, Homo sapien
aaaaaagcaactgtaatgagccaaa

SEQ ID NO: 109 - DNA, 25 bp, Homo sapien
aaaaaagcacagatagtcctctgaa

SEQ ID NO: 110 - DNA, 25 bp, Homo sapien
aaaaaagcacagctagtcctctgaa

SEQ ID NO: 111 - DNA, 25 bp, Homo sapien
aaaaaagcacattcaaattaaagag

SEQ ID NO: 112 - DNA, 25 bp, Homo sapien
aaaaaagcacattcaagttaaagag

SEQ ID NO: 113 - DNA, 25 bp, Homo sapien
aaaaaagcatgactgtgacacctgg

SEQ ID NO: 114 - DNA, 25 bp, Homo sapien
aaaaaagcatgatattagtacaaag

SEQ ID NO: 115 - DNA, 25 bp, Homo sapien
aaaaaagcatgattgtgacacctgg

SEQ ID NO: 116 - DNA, 25 bp, Homo sapien
aaaaaagcatggtattagtacaaag

SEQ ID NO: 117 - DNA, 25 bp, Homo sapien
aaaaaagccatccgtctggcattgc

SEQ ID NO: 118 - DNA, 25 bp, Homo sapien
aaaaaagccatctgtctggcattgc

SEQ ID NO: 119 - DNA, 25 bp, Homo sapien
aaaaaagccattcgtcagacagtgt

SEQ ID NO: 120 - DNA, 25 bp, Homo sapien
aaaaaagccattcgtcggacagtgt

SEQ ID NO: 121 - DNA, 25 bp, Homo sapien
aaaaaaggaataaatacctatcaaa

SEQ ID NO: 122 - DNA, 25 bp, Homo sapien
aaaaaaggaataagtacctatcaaa

SEQ ID NO: 123 - DNA, 25 bp, Homo sapien
aaaaaaggagtttccctcaaacagc

SEQ ID NO: 124 - DNA, 25 bp, Homo sapien
aaaaaaggagtttctctcaaacagc

SEQ ID NO: 125 - DNA, 25 bp, Homo sapien
aaaaaagggcacaaagaaaagagta

SEQ ID NO: 126 - DNA, 25 bp, Homo sapien
aaaaaagggcaccaagaaaagagta

SEQ ID NO: 127 - DNA, 25 bp, Homo sapien
aaaaaaggttatatgacgatttgca

SEQ ID NO: 128 - DNA, 25 bp, Homo sapien
aaaaaaggttatatgatgatttgca

SEQ ID NO: 129 - DNA, 25 bp, Homo sapien
aaaaaagtagaactaataagtggaa

SEQ ID NO: 130 - DNA, 25 bp, Homo sapien
aaaaaagtagacctaataagtggaa

SEQ ID NO: 131 - DNA, 25 bp, Homo sapien
aaaaaagtcccaattcagatagagg

SEQ ID NO: 132 - DNA, 25 bp, Homo sapien
aaaaaagtgtgccttcacaataatg

SEQ ID NO: 133 - DNA, 25 bp, Homo sapien
aaaaaagtgtggcttcacaataatg

SEQ ID NO: 134 - DNA, 25 bp, Homo sapien
aaaaaagttccaattcagatagagg

SEQ ID NO: 135 - DNA, 25 bp, Homo sapien
aaaaaagttgagtacaaaaggattt

SEQ ID NO: 136 - DNA, 25 bp, Homo sapien
aaaaaagttgagtccaaaaggattt

SEQ ID NO: 137 - DNA, 25 bp, Homo sapien
aaaaaataatacgagccagaaggca

SEQ ID NO: 138 - DNA, 25 bp, Homo sapien
aaaaaataatatgagccagaaggca

SEQ ID NO: 139 - DNA, 25 bp, Homo sapien
aaaaaataatgttacggaagcacag

SEQ ID NO: 140 - DNA, 25 bp, Homo sapien
aaaaaataatgttatggaagcacag

SEQ ID NO: 141 - DNA, 25 bp, Homo sapien
aaaaaatacaaggacttgaaagtga

SEQ ID NO: 142 - DNA, 25 bp, Homo sapien
aaaaaatacaaggtcttgaaagtga

SEQ ID NO: 143 - DNA, 25 bp, Homo sapien
aaaaaatactcattggaaacagagc

SEQ ID NO: 144 - DNA, 25 bp, Homo sapien
aaaaaatactcgttggaaacagagc

SEQ ID NO: 145 - DNA, 25 bp, Homo sapien
aaaaaatactgaatttgaaaaggaa

SEQ ID NO: 146 - DNA, 25 bp, Homo sapien
aaaaaatatataatacaaaaaacgc

SEQ ID NO: 147 - DNA, 25 bp, Homo sapien
aaaaaatatataatacgaaaaacgc

SEQ ID NO: 148 - DNA, 25 bp, Homo sapien
aaaaaatatctccgaaacttcactt

SEQ ID NO: 149 - DNA, 25 bp, Homo sapien
aaaaaatatctctgaaacttcactt

SEQ ID NO: 150 - DNA, 25 bp, Homo sapien
aaaaaatattgaatttgaaaaggaa

SEQ ID NO: 151 - DNA, 25 bp, Homo sapien
aaaaaatcaagctataaagaagtgt

SEQ ID NO: 152 - DNA, 25 bp, Homo sapien
aaaaaatcaagctatatagaagtgt

SEQ ID NO: 153 - DNA, 25 bp, Homo sapien
aaaaaatcagtatgcctagcaatag

SEQ ID NO: 154 - DNA, 25 bp, Homo sapien
aaaaaatcagtatgtctagcaatag

SEQ ID NO: 155 - DNA, 25 bp, Homo sapien
aaaaaatccatgtaaaagtgaatct

SEQ ID NO: 156 - DNA, 25 bp, Homo sapien
aaaaaatccatgtacaagtgaatct

SEQ ID NO: 157 - DNA, 25 bp, Homo sapien
aaaaaatcgcaaacaaatctcataa

SEQ ID NO: 158 - DNA, 25 bp, Homo sapien
aaaaaatcgcagacaaatctcataa

SEQ ID NO: 159 - DNA, 25 bp, Homo sapien
aaaaaatgaagagtctgtcaaaacc

SEQ ID NO: 160 - DNA, 25 bp, Homo sapien
aaaaaatgaccaagaatagccaaca

SEQ ID NO: 161 - DNA, 25 bp, Homo sapien
aaaaaatgaccgagaatagccaaca

SEQ ID NO: 162 - DNA, 25 bp, Homo sapien
aaaaaatgacgagtctgtcaaaacc

SEQ ID NO: 163 - DNA, 25 bp, Homo sapien
aaaaaatgagttaaaccaatcaatg

SEQ ID NO: 164 - DNA, 25 bp, Homo sapien
aaaaaatgagttgaaccaatcaatg

SEQ ID NO: 165 - DNA, 25 bp, Homo sapien
aaaaaatgatgacgggcacagtctc

SEQ ID NO: 166 - DNA, 25 bp, Homo sapien
aaaaaatgatgatgggcacagtctc

SEQ ID NO: 167 - DNA, 25 bp, Homo sapien
aaaaaatgtaagtgatagataagct

SEQ ID NO: 168 - DNA, 25 bp, Homo sapien
aaaaaatgtaagtgctagataagct

SEQ ID NO: 169 - DNA, 25 bp, Homo sapien
aaaaaattaaccagacatggtacta

SEQ ID NO: 170 - DNA, 25 bp, Homo sapien
aaaaaattaaccaggcatggtacta

SEQ ID NO: 171 - DNA, 25 bp, Homo sapien
aaaaaattacacgatttgtgcaggc

SEQ ID NO: 172 - DNA, 25 bp, Homo sapien
aaaaaattacatgatttgtgcaggc

SEQ ID NO: 173 - DNA, 25 bp, Homo sapien
aaaaaattatgaaagtgtctagaga

SEQ ID NO: 174 - DNA, 25 bp, Homo sapien
aaaaaattatggaagtgtctagaga

SEQ ID NO: 175 - DNA, 25 bp, Homo sapien
aaaaaattgtgaaatttgggcaagt

SEQ ID NO: 176 - DNA, 25 bp, Homo sapien
aaaaaattgtggaatttgggcaagt

SEQ ID NO: 177 - DNA, 25 bp, Homo sapien
aaaaaatttaccaacttctaggcca

SEQ ID NO: 178 - DNA, 25 bp, Homo sapien
aaaaaatttaccgacttctaggcca

SEQ ID NO: 179 - DNA, 25 bp, Homo sapien
aaaaaatttcatgctaagccagcca

SEQ ID NO: 180 - DNA, 25 bp, Homo sapien
aaaaaatttcatgttaagccagcca

SEQ ID NO: 181 - DNA, 25 bp, Homo sapien
aaaaacaaaaaccacgtgacccttc

SEQ ID NO: 182 - DNA, 25 bp, Homo sapien
aaaaacaaaaactacgtgacccttc

SEQ ID NO: 183 - DNA, 25 bp, Homo sapien
aaaaacaaacaaaggacatcgaaac

SEQ ID NO: 184 - DNA, 25 bp, Homo sapien
aaaaacaaacaacggacatcgaaac

SEQ ID NO: 185 - DNA, 25 bp, Homo sapien
aaaaacaaatgtacgtatgaggcac

SEQ ID NO: 186 - DNA, 25 bp, Homo sapien
aaaaacaaatgtatgtatgaggcac

SEQ ID NO: 187 - DNA, 25 bp, Homo sapien
aaaaacaacacaggacgaagagatt

SEQ ID NO: 188 - DNA, 25 bp, Homo sapien
aaaaacaacacatgacgaagagatt

SEQ ID NO: 189 - DNA, 25 bp, Homo sapien
aaaaacaagtccaaggtgaaatagt

SEQ ID NO: 190 - DNA, 25 bp, Homo sapien
aaaaacaagtccagggtgaaatagt

SEQ ID NO: 191 - DNA, 25 bp, Homo sapien
aaaaacacagaggcaggtcccgtgt

SEQ ID NO: 192 - DNA, 25 bp, Homo sapien
aaaaacacagagtcaggtcccgtgt

SEQ ID NO: 193 - DNA, 25 bp, Homo sapien
aaaaacagaaaggcgttgcttacat

SEQ ID NO: 194 - DNA, 25 bp, Homo sapien
aaaaacagaaaggtgttgcttacat

SEQ ID NO: 195 - DNA, 25 bp, Homo sapien
aaaaacagactgagcccctaggagt

SEQ ID NO: 196 - DNA, 25 bp, Homo sapien
aaaaacagatgaacaatgtaaaagt

SEQ ID NO: 197 - DNA, 25 bp, Homo sapien
aaaaacagattgagcccctaggagt

SEQ ID NO: 198 - DNA, 25 bp, Homo sapien
aaaaacagcaaaatgccacagtgga

SEQ ID NO: 199 - DNA, 25 bp, Homo sapien
aaaaacagcaagatgccacagtgga

SEQ ID NO: 200 - DNA, 25 bp, Homo sapien
aaaaacagccaatataacattcagt

SEQ ID NO: 201 - DNA, 25 bp, Homo sapien
aaaaacagccaatgtaacattcagt

SEQ ID NO: 202 - DNA, 25 bp, Homo sapien
aaaaacaggaaacaatgtcatattc

SEQ ID NO: 203 - DNA, 25 bp, Homo sapien
aaaaacaggaaactatgtcatattc

SEQ ID NO: 204 - DNA, 25 bp, Homo sapien
aaaaacaggcaaccaaagcaacaat

SEQ ID NO: 205 - DNA, 25 bp, Homo sapien
aaaaacaggcaacccaagcaacaat

SEQ ID NO: 206 - DNA, 25 bp, Homo sapien
aaaaacaggtgaacaatgtaaaagt

SEQ ID NO: 207 - DNA, 25 bp, Homo sapien
aaaaacagtacagattattggtcta

SEQ ID NO: 208 - DNA, 25 bp, Homo sapien
aaaaacagtacagtttattggtcta

SEQ ID NO: 209 - DNA, 25 bp, Homo sapien
aaaaacagtgccatgttactcaata

SEQ ID NO: 210 - DNA, 25 bp, Homo sapien
aaaaacagtgccgtgttactcaata

SEQ ID NO: 211 - DNA, 25 bp, Homo sapien
aaaaacataagcacagccagttgct

SEQ ID NO: 212 - DNA, 25 bp, Homo sapien
aaaaacataagcacagtcagttgct

SEQ ID NO: 213 - DNA, 25 bp, Homo sapien
aaaaacatagctcaagaactccaac

SEQ ID NO: 214 - DNA, 25 bp, Homo sapien
aaaaacatagctcgagaactccaac

SEQ ID NO: 215 - DNA, 25 bp, Homo sapien
aaaaacatattaaccaggtgcaacg

SEQ ID NO: 216 - DNA, 25 bp, Homo sapien
aaaaacatattaagcaggtgcaacg

SEQ ID NO: 217 - DNA, 25 bp, Homo sapien
aaaaacatcacttgacattcggact

SEQ ID NO: 218 - DNA, 25 bp, Homo sapien
aaaaacatcccttgacattcggact

SEQ ID NO: 219 - DNA, 25 bp, Homo sapien
aaaaacatctatacgaacaacaaaa

SEQ ID NO: 220 - DNA, 25 bp, Homo sapien
aaaaacatctatatgaacaacaaaa

SEQ ID NO: 221 - DNA, 25 bp, Homo sapien
aaaaacatgaaaacgagagacaggc

SEQ ID NO: 222 - DNA, 25 bp, Homo sapien
aaaaacatgaaaaggagagacaggc

SEQ ID NO: 223 - DNA, 25 bp, Homo sapien
aaaaaccaactgtttgcttcactga

SEQ ID NO: 224 - DNA, 25 bp, Homo sapien
aaaaaccaactttttgcttcactga

SEQ ID NO: 225 - DNA, 25 bp, Homo sapien
aaaaaccaaggtagcgaggttggcc

SEQ ID NO: 226 - DNA, 25 bp, Homo sapien
aaaaaccaaggtagtgaggttggcc

SEQ ID NO: 227 - DNA, 25 bp, Homo sapien
aaaaaccacagagaacaatgtaata

SEQ ID NO: 228 - DNA, 25 bp, Homo sapien
aaaaaccacagagagcaatgtaata

SEQ ID NO: 229 - DNA, 25 bp, Homo sapien
aaaaaccacgttttccagacttgct

SEQ ID NO: 230 - DNA, 25 bp, Homo sapien
aaaaaccagttcagagaaatttgta

SEQ ID NO: 231 - DNA, 25 bp, Homo sapien
aaaaaccagttgagagaaatttgta

SEQ ID NO: 232 - DNA, 25 bp, Homo sapien
aaaaaccatgtagactttgaaccag

SEQ ID NO: 233 - DNA, 25 bp, Homo sapien
aaaaaccatgtaggctttgaaccag

SEQ ID NO: 234 - DNA, 25 bp, Homo sapien
aaaaaccatgttttccagacttgct

SEQ ID NO: 235 - DNA, 25 bp, Homo sapien
aaaaaccctgcatctatgagcttta

SEQ ID NO: 236 - DNA, 25 bp, Homo sapien
aaaaaccctgcgtctatgagcttta

SEQ ID NO: 237 - DNA, 25 bp, Homo sapien
aaaaacctaaaatattagatgagat

SEQ ID NO: 238 - DNA, 25 bp, Homo sapien
aaaaacctacaatattagatgagat

SEQ ID NO: 239 - DNA, 25 bp, Homo sapien
aaaaacctcaacatcactgattagt

SEQ ID NO: 240 - DNA, 25 bp, Homo sapien
aaaaacctcaacatcattgattagt

SEQ ID NO: 241 - DNA, 25 bp, Homo sapien
aaaaacctcagatctccttcacgcc

SEQ ID NO: 242 - DNA, 25 bp, Homo sapien
aaaaacctcaggtctccttcacgcc

SEQ ID NO: 243 - DNA, 25 bp, Homo sapien
aaaaacgaaacaacccagtgtccgt

SEQ ID NO: 244 - DNA, 25 bp, Homo sapien
aaaaacgaaacagcccagtgtccgt

SEQ ID NO: 245 - DNA, 25 bp, Homo sapien
aaaaacgagttgagtcaaaggccat

SEQ ID NO: 246 - DNA, 25 bp, Homo sapien
aaaaacgagttgagtccaaggccat

SEQ ID NO: 247 - DNA, 25 bp, Homo sapien
aaaaacgccatgttatataaatatg

SEQ ID NO: 248 - DNA, 25 bp, Homo sapien
aaaaacgccatgttatgtaaatatg

SEQ ID NO: 249 - DNA, 25 bp, Homo sapien
aaaaacgtgacctcatcaaatgaac

SEQ ID NO: 250 - DNA, 25 bp, Homo sapien
aaaaacgtgacctcgtcaaatgaac

SEQ ID NO: 251 - DNA, 25 bp, Homo sapien
aaaaactaaagcttgatcttcagga

SEQ ID NO: 252 - DNA, 25 bp, Homo sapien
aaaaactaacttggctatccaggaa

SEQ ID NO: 253 - DNA, 25 bp, Homo sapien
aaaaactaacttggctttccaggaa

SEQ ID NO: 254 - DNA, 25 bp, Homo sapien
aaaaactaagatccatatgccaaat

SEQ ID NO: 255 - DNA, 25 bp, Homo sapien
aaaaactaagatccctatgccaaat

SEQ ID NO: 256 - DNA, 25 bp, Homo sapien
aaaaactagacgaaactttcttttg

SEQ ID NO: 257 - DNA, 25 bp, Homo sapien
aaaaactagacgagactttcttttg

SEQ ID NO: 258 - DNA, 25 bp, Homo sapien
aaaaactatagcttgatcttcagga

SEQ ID NO: 259 - DNA, 25 bp, Homo sapien
aaaaactcaaaatgaccgtgaaagg

SEQ ID NO: 260 - DNA, 25 bp, Homo sapien
aaaaactcaaaatgacggtgaaagg

SEQ ID NO: 261 - DNA, 25 bp, Homo sapien
aaaaactcaagccacaatattcaca

SEQ ID NO: 262 - DNA, 25 bp, Homo sapien
aaaaactcaagccacagtattcaca

SEQ ID NO: 263 - DNA, 25 bp, Homo sapien
aaaaactcacaaaatgcccaaagaa

SEQ ID NO: 264 - DNA, 25 bp, Homo sapien
aaaaactcacaaagaacaagaggga

SEQ ID NO: 265 - DNA, 25 bp, Homo sapien
aaaaactcacacaatgcccaaagaa

SEQ ID NO: 266 - DNA, 25 bp, Homo sapien
aaaaactcaggctaggatgagaata

SEQ ID NO: 267 - DNA, 25 bp, Homo sapien
aaaaactcaggttaggatgagaata

SEQ ID NO: 268 - DNA, 25 bp, Homo sapien
aaaaactccaatacagcacatttct

SEQ ID NO: 269 - DNA, 25 bp, Homo sapien
aaaaactcccaaagaacaagaggga

SEQ ID NO: 270 - DNA, 25 bp, Homo sapien
aaaaactccgatacagcacatttct

SEQ ID NO: 271 - DNA, 25 bp, Homo sapien
aaaaactggagagttcatcaccaat

SEQ ID NO: 272 - DNA, 25 bp, Homo sapien
aaaaactggagagttcgtcaccaat

SEQ ID NO: 273 - DNA, 25 bp, Homo sapien
aaaaacttaactttcaactagtatc

SEQ ID NO: 274 - DNA, 25 bp, Homo sapien
aaaaacttaactttcatctagtatc

SEQ ID NO: 275 - DNA, 25 bp, Homo sapien
aaaaacttctggtactcattaggcc

SEQ ID NO: 276 - DNA, 25 bp, Homo sapien
aaaaacttctgttactcattaggcc

SEQ ID NO: 277 - DNA, 25 bp, Homo sapien
aaaaacttctttttgcccaatttgt

SEQ ID NO: 278 - DNA, 25 bp, Homo sapien
aaaaacttctttttgcgcaatttgt

SEQ ID NO: 279 - DNA, 25 bp, Homo sapien
aaaaagaaaccactaaacgataaat

SEQ ID NO: 280 - DNA, 25 bp, Homo sapien
aaaaagaaaccactaagcgataaat

SEQ ID NO: 281 - DNA, 25 bp, Homo sapien
aaaaagaaagccgaataacagatgc

SEQ ID NO: 282 - DNA, 25 bp, Homo sapien
aaaaagaaagctgaataacagatgc

SEQ ID NO: 283 - DNA, 25 bp, Homo sapien
aaaaagaaccagataaatgatggaa

SEQ ID NO: 284 - DNA, 25 bp, Homo sapien
aaaaagaacgtgaagactcaggact

SEQ ID NO: 285 - DNA, 25 bp, Homo sapien
aaaaagaagaatttgggatctactc

SEQ ID NO: 286 - DNA, 25 bp, Homo sapien
aaaaagaagcagtagatgattaagt

SEQ ID NO: 287 - DNA, 25 bp, Homo sapien
aaaaagaagtagtagatgattaagt

SEQ ID NO: 288 - DNA, 25 bp, Homo sapien
aaaaagaagtatcaaggtatatatg

SEQ ID NO: 289 - DNA, 25 bp, Homo sapien
aaaaagaagtatcagggtatatatg

SEQ ID NO: 290 - DNA, 25 bp, Homo sapien
aaaaagaagtatttgggatctactc

SEQ ID NO: 291 - DNA, 25 bp, Homo sapien
aaaaagaatcagataaatgatggaa

SEQ ID NO: 292 - DNA, 25 bp, Homo sapien
aaaaagaatgtgaagactcaggact

SEQ ID NO: 293 - DNA, 25 bp, Homo sapien
aaaaagacattctaaaaggcagttt

SEQ ID NO: 294 - DNA, 25 bp, Homo sapien
aaaaagacattctaaagggcagttt

SEQ ID NO: 295 - DNA, 25 bp, Homo sapien
aaaaagaccacctaagatcagggca

SEQ ID NO: 296 - DNA, 25 bp, Homo sapien
aaaaagaccgcctaagatcagggca

SEQ ID NO: 297 - DNA, 25 bp, Homo sapien
aaaaagagagccagaaaccagtatg

SEQ ID NO: 298 - DNA, 25 bp, Homo sapien
aaaaagagagcccgaaaccagtatg

SEQ ID NO: 299 - DNA, 25 bp, Homo sapien
aaaaagagattgacagtctaagcat

SEQ ID NO: 300 - DNA, 25 bp, Homo sapien
aaaaagagattggcagtctaagcat

SEQ ID NO: 301 - DNA, 25 bp, Homo sapien
aaaaagaggtaccgagatttcctca

SEQ ID NO: 302 - DNA, 25 bp, Homo sapien
aaaaagaggtactgagatttcctca

SEQ ID NO: 303 - DNA, 25 bp, Homo sapien
aaaaagagttactacacaatgggga

SEQ ID NO: 304 - DNA, 25 bp, Homo sapien
aaaaagagttacttcacaatgggga

SEQ ID NO: 305 - DNA, 25 bp, Homo sapien
aaaaagatctaaaaattgcaccatg

SEQ ID NO: 306 - DNA, 25 bp, Homo sapien
aaaaagatctaaacattgcaccatg

SEQ ID NO: 307 - DNA, 25 bp, Homo sapien
aaaaagatctgcaacgtctcaacag

SEQ ID NO: 308 - DNA, 25 bp, Homo sapien
aaaaagatctgcagcgtctcaacag

SEQ ID NO: 309 - DNA, 25 bp, Homo sapien
aaaaagattctcaaaaatgaagttt

SEQ ID NO: 310 - DNA, 25 bp, Homo sapien
aaaaagattctcgaaaatgaagttt

SEQ ID NO: 311 - DNA, 25 bp, Homo sapien
aaaaagcacttcatagcttggagag

SEQ ID NO: 312 - DNA, 25 bp, Homo sapien
aaaaagcagactcgcagcacaatgc

SEQ ID NO: 313 - DNA, 25 bp, Homo sapien
aaaaagcaggctcgcagcacaatgc

SEQ ID NO: 314 - DNA, 25 bp, Homo sapien
aaaaagcagttcatagcttggagag

SEQ ID NO: 315 - DNA, 25 bp, Homo sapien
aaaaagcatgactgtgacacctgga

SEQ ID NO: 316 - DNA, 25 bp, Homo sapien
aaaaagcatgattgtgacacctgga

SEQ ID NO: 317 - DNA, 25 bp, Homo sapien
aaaaagccatccgtctggcattgca

SEQ ID NO: 318 - DNA, 25 bp, Homo sapien
aaaaagccatctgtctggcattgca

SEQ ID NO: 319 - DNA, 25 bp, Homo sapien
aaaaagcgaagaataaggcaccact

SEQ ID NO: 320 - DNA, 25 bp, Homo sapien
aaaaagcgaggaataaggcaccact

SEQ ID NO: 321 - DNA, 25 bp, Homo sapien
aaaaagctgagggttaggagaagct

SEQ ID NO: 322 - DNA, 25 bp, Homo sapien
aaaaagctgagtgttaggagaagct

SEQ ID NO: 323 - DNA, 25 bp, Homo sapien
aaaaaggaagggacgagaccaaaaa

SEQ ID NO: 324 - DNA, 25 bp, Homo sapien
aaaaaggaagggatgagaccaaaaa

SEQ ID NO: 325 - DNA, 25 bp, Homo sapien
aaaaaggaataaatacctatcaaag

SEQ ID NO: 326 - DNA, 25 bp, Homo sapien
aaaaaggaataagtacctatcaaag

SEQ ID NO: 327 - DNA, 25 bp, Homo sapien
aaaaaggagaataatgtggagaaaa

SEQ ID NO: 328 - DNA, 25 bp, Homo sapien
aaaaaggagaatattgtggagaaaa

SEQ ID NO: 329 - DNA, 25 bp, Homo sapien
aaaaaggagaggtgcgatcatagcc

SEQ ID NO: 330 - DNA, 25 bp, Homo sapien
aaaaaggagaggtgtgatcatagcc

SEQ ID NO: 331 - DNA, 25 bp, Homo sapien
aaaaaggagggactcgccacttctt

SEQ ID NO: 332 - DNA, 25 bp, Homo sapien
aaaaaggagggacttgccacttctt

SEQ ID NO: 333 - DNA, 25 bp, Homo sapien
aaaaaggagtttccctcaaacagca

SEQ ID NO: 334 - DNA, 25 bp, Homo sapien
aaaaaggagtttctctcaaacagca

SEQ ID NO: 335 - DNA, 25 bp, Homo sapien
aaaaaggcccttagagactcaatgc

SEQ ID NO: 336 - DNA, 25 bp, Homo sapien
aaaaaggcctttagagactcaatgc

SEQ ID NO: 337 - DNA, 25 bp, Homo sapien
aaaaaggctctagctattattaaca

SEQ ID NO: 338 - DNA, 25 bp, Homo sapien
aaaaaggctctaggtattattaaca

SEQ ID NO: 339 - DNA, 25 bp, Homo sapien
aaaaagggaaaaattaaagcataac

SEQ ID NO: 340 - DNA, 25 bp, Homo sapien
aaaaagggaaaatttaaagcataac

SEQ ID NO: 341 - DNA, 25 bp, Homo sapien
aaaaagggaagtcattatccactcc

SEQ ID NO: 342 - DNA, 25 bp, Homo sapien
aaaaagggaagttattatccactcc

SEQ ID NO: 343 - DNA, 25 bp, Homo sapien
aaaaagggttaaatggtgactaatc

SEQ ID NO: 344 - DNA, 25 bp, Homo sapien
aaaaagggttaaattgtgactaatc

SEQ ID NO: 345 - DNA, 25 bp, Homo sapien
aaaaaggttagaagagatcagcgct

SEQ ID NO: 346 - DNA, 25 bp, Homo sapien
aaaaaggtttgaagagatcagcgct

SEQ ID NO: 347 - DNA, 25 bp, Homo sapien
aaaaagtaaagcaagtgtgagcaaa

SEQ ID NO: 348 - DNA, 25 bp, Homo sapien
aaaaagtaaggcaagtgtgagcaaa

SEQ ID NO: 349 - DNA, 25 bp, Homo sapien
aaaaagtatacacatattttgaaac

SEQ ID NO: 350 - DNA, 25 bp, Homo sapien
aaaaagtatacgcatattttgaaac

SEQ ID NO: 351 - DNA, 25 bp, Homo sapien
aaaaagtatttaatagcaattacgt

SEQ ID NO: 352 - DNA, 25 bp, Homo sapien
aaaaagtatttagtagcaattacgt

SEQ ID NO: 353 - DNA, 25 bp, Homo sapien
aaaaagtcatagatctaaataaatg

SEQ ID NO: 354 - DNA, 25 bp, Homo sapien
aaaaagtcatagatttaaataaatg

SEQ ID NO: 355 - DNA, 25 bp, Homo sapien
aaaaagtcatccggtcctttgtcac

SEQ ID NO: 356 - DNA, 25 bp, Homo sapien
aaaaagtcatcgggtcctttgtcac

SEQ ID NO: 357 - DNA, 25 bp, Homo sapien
aaaaagtctactaaaaattcagtga

SEQ ID NO: 358 - DNA, 25 bp, Homo sapien
aaaaagtctactaagaattcagtga

SEQ ID NO: 359 - DNA, 25 bp, Homo sapien
aaaaagtctgcttgaaaacccatca

SEQ ID NO: 360 - DNA, 25 bp, Homo sapien
aaaaagtctgcttggaaacccatca

SEQ ID NO: 361 - DNA, 25 bp, Homo sapien
aaaaagtcttcccatggcttctctt

SEQ ID NO: 362 - DNA, 25 bp, Homo sapien
aaaaagtcttcctatggcttctctt

SEQ ID NO: 363 - DNA, 25 bp, Homo sapien
aaaaagtgagtcagtgagacatatt

SEQ ID NO: 364 - DNA, 25 bp, Homo sapien
aaaaagtgagttagtgagacatatt

SEQ ID NO: 365 - DNA, 25 bp, Homo sapien
aaaaagtggatcataactggatgtc

SEQ ID NO: 366 - DNA, 25 bp, Homo sapien
aaaaagtggatcgtaactggatgtc

SEQ ID NO: 367 - DNA, 25 bp, Homo sapien
aaaaagtggcgacggtatgactcag

SEQ ID NO: 368 - DNA, 25 bp, Homo sapien
aaaaagtggcgatggtatgactcag

SEQ ID NO: 369 - DNA, 25 bp, Homo sapien
aaaaagttaaaagttgcgatgatac

SEQ ID NO: 370 - DNA, 25 bp, Homo sapien
aaaaagttaaaagttgtgatgatac

SEQ ID NO: 371 - DNA, 25 bp, Homo sapien
aaaaagttcaagcctatcatcatta

SEQ ID NO: 372 - DNA, 25 bp, Homo sapien
aaaaagttcaagtctatcatcatta

SEQ ID NO: 373 - DNA, 25 bp, Homo sapien
aaaaagttgagtacaaaaggattta

SEQ ID NO: 374 - DNA, 25 bp, Homo sapien
aaaaagttgagtccaaaaggattta

SEQ ID NO: 375 - DNA, 25 bp, Homo sapien
aaaaataacgtcaatgctttttctg

SEQ ID NO: 376 - DNA, 25 bp, Homo sapien
aaaaataagaggtacagtctctgtc

SEQ ID NO: 377 - DNA, 25 bp, Homo sapien
aaaaataagagttacagtctctgtc

SEQ ID NO: 378 - DNA, 25 bp, Homo sapien
aaaaataataaagttcaaaagccag

SEQ ID NO: 379 - DNA, 25 bp, Homo sapien
aaaaataataaggttcaaaagccag

SEQ ID NO: 380 - DNA, 25 bp, Homo sapien
aaaaataatgctacagatcccttag

SEQ ID NO: 381 - DNA, 25 bp, Homo sapien
aaaaataatgctagagatcccttag

SEQ ID NO: 382 - DNA, 25 bp, Homo sapien
aaaaataatgtcaatgctttttctg

SEQ ID NO: 383 - DNA, 25 bp, Homo sapien
aaaaataatgtcctggaatttgtta

SEQ ID NO: 384 - DNA, 25 bp, Homo sapien
aaaaataatgtcttggaatttgtta

SEQ ID NO: 385 - DNA, 25 bp, Homo sapien
aaaaataatgttacggaagcacagg

SEQ ID NO: 386 - DNA, 25 bp, Homo sapien
aaaaataatgttatggaagcacagg

SEQ ID NO: 387 - DNA, 25 bp, Homo sapien
aaaaataatttagataactgaccaa

SEQ ID NO: 388 - DNA, 25 bp, Homo sapien
aaaaataatttagatatctgaccaa

SEQ ID NO: 389 - DNA, 25 bp, Homo sapien
aaaaatacaaggacttgaaagtgat

SEQ ID NO: 390 - DNA, 25 bp, Homo sapien
aaaaatacaaggtcttgaaagtgat

SEQ ID NO: 391 - DNA, 25 bp, Homo sapien
aaaaatacaattaggcagaactctg

SEQ ID NO: 392 - DNA, 25 bp, Homo sapien
aaaaatacacaaaaagggataaaga

SEQ ID NO: 393 - DNA, 25 bp, Homo sapien
aaaaatacacaaaatgggataaaga

SEQ ID NO: 394 - DNA, 25 bp, Homo sapien
aaaaatacagttaggcagaactctg

SEQ ID NO: 395 - DNA, 25 bp, Homo sapien
aaaaatacatctacaccaaaaaaga

SEQ ID NO: 396 - DNA, 25 bp, Homo sapien
aaaaatacatctacgccaaaaaaga

SEQ ID NO: 397 - DNA, 25 bp, Homo sapien
aaaaatacctgcgcaaatcgctatc

SEQ ID NO: 398 - DNA, 25 bp, Homo sapien
aaaaatacctgctcaaatcgctatc

SEQ ID NO: 399 - DNA, 25 bp, Homo sapien
aaaaatagaaacgaactaataacta

SEQ ID NO: 400 - DNA, 25 bp, Homo sapien
aaaaatagaaacgacctaataacta

SEQ ID NO: 401 - DNA, 25 bp, Homo sapien
aaaaatagaccctaggttttctctt

SEQ ID NO: 402 - DNA, 25 bp, Homo sapien
aaaaatagattcagcattaaaatac

SEQ ID NO: 403 - DNA, 25 bp, Homo sapien
aaaaatagattccgcattaaaatac

SEQ ID NO: 404 - DNA, 25 bp, Homo sapien
aaaaataggcaacgcagattcaatt

SEQ ID NO: 405 - DNA, 25 bp, Homo sapien
aaaaataggcaatgcagattcaatt

SEQ ID NO: 406 - DNA, 25 bp, Homo sapien
aaaaataggccctaggttttctctt

SEQ ID NO: 407 - DNA, 25 bp, Homo sapien
aaaaatataaaacgtgatatgtaag

SEQ ID NO: 408 - DNA, 25 bp, Homo sapien
aaaaatataaaatgtgatatgtaag

SEQ ID NO: 409 - DNA, 25 bp, Homo sapien
aaaaatataatgtggcccacagcag

SEQ ID NO: 410 - DNA, 25 bp, Homo sapien
aaaaatataatgtgtcccacagcag

SEQ ID NO: 411 - DNA, 25 bp, Homo sapien
aaaaatatagaaggaaactgaagga

SEQ ID NO: 412 - DNA, 25 bp, Homo sapien
aaaaatatagagggaaactgaagga

SEQ ID NO: 413 - DNA, 25 bp, Homo sapien
aaaaatatagccctgaggattgaca

SEQ ID NO: 414 - DNA, 25 bp, Homo sapien
aaaaatatctccgaaacttcactta

SEQ ID NO: 415 - DNA, 25 bp, Homo sapien
aaaaatatctctgaaacttcactta

SEQ ID NO: 416 - DNA, 25 bp, Homo sapien
aaaaatatgaacccaatttgtggta

SEQ ID NO: 417 - DNA, 25 bp, Homo sapien
aaaaatatgaacctaatttgtggta

SEQ ID NO: 418 - DNA, 25 bp, Homo sapien
aaaaatatggccctgaggattgaca

SEQ ID NO: 419 - DNA, 25 bp, Homo sapien
aaaaatatgtccgtaagttaaattc

SEQ ID NO: 420 - DNA, 25 bp, Homo sapien
aaaaatatgtctgtaagttaaattc

SEQ ID NO: 421 - DNA, 25 bp, Homo sapien
aaaaatcaattggacttagtgtggc

SEQ ID NO: 422 - DNA, 25 bp, Homo sapien
aaaaatcacttggacttagtgtggc

SEQ ID NO: 423 - DNA, 25 bp, Homo sapien
aaaaatcacttgggcatcatccttg

SEQ ID NO: 424 - DNA, 25 bp, Homo sapien
aaaaatcagtatgcctagcaatagg

SEQ ID NO: 425 - DNA, 25 bp, Homo sapien
aaaaatcagtatgtctagcaatagg

SEQ ID NO: 426 - DNA, 25 bp, Homo sapien
aaaaatcagtcgtacttagttggct

SEQ ID NO: 427 - DNA, 25 bp, Homo sapien
aaaaatcagtcttacttagttggct

SEQ ID NO: 428 - DNA, 25 bp, Homo sapien
aaaaatcatttgggcatcatccttg

SEQ ID NO: 429 - DNA, 25 bp, Homo sapien
aaaaatccataggcccagtctaatc

SEQ ID NO: 430 - DNA, 25 bp, Homo sapien
aaaaatccatagtcccagtctaatc

SEQ ID NO: 431 - DNA, 25 bp, Homo sapien
aaaaatccatcaacttataatttaa

SEQ ID NO: 432 - DNA, 25 bp, Homo sapien
aaaaatccatcagcttataatttaa

SEQ ID NO: 433 - DNA, 25 bp, Homo sapien
aaaaatcctgattcacttagctttg

SEQ ID NO: 434 - DNA, 25 bp, Homo sapien
aaaaatcctgattcgcttagctttg

SEQ ID NO: 435 - DNA, 25 bp, Homo sapien
aaaaatcgaatgtagctctgattgc

SEQ ID NO: 436 - DNA, 25 bp, Homo sapien
aaaaatcgagcagaaagcacagaga

SEQ ID NO: 437 - DNA, 25 bp, Homo sapien
aaaaatcgagcggaaagcacagaga

SEQ ID NO: 438 - DNA, 25 bp, Homo sapien
aaaaatcgagtgtagctctgattgc

SEQ ID NO: 439 - DNA, 25 bp, Homo sapien
aaaaatcgtataccctgtgatgaaa

SEQ ID NO: 440 - DNA, 25 bp, Homo sapien
aaaaatcgtataccttgtgatgaaa

SEQ ID NO: 441 - DNA, 25 bp, Homo sapien
aaaaatctctgccctcgtcgatctt

SEQ ID NO: 442 - DNA, 25 bp, Homo sapien
aaaaatctctgccttcgtcgatctt

SEQ ID NO: 443 - DNA, 25 bp, Homo sapien
aaaaatgaagactgccacatcagtt

SEQ ID NO: 444 - DNA, 25 bp, Homo sapien
aaaaatgaagattgccacatcagtt

SEQ ID NO: 445 - DNA, 25 bp, Homo sapien
aaaaatgaatgacaaaataaggaat

SEQ ID NO: 446 - DNA, 25 bp, Homo sapien
aaaaatgaatgagaaaataaggaat

SEQ ID NO: 447 - DNA, 25 bp, Homo sapien
aaaaatgactcaacaatggcctact

SEQ ID NO: 448 - DNA, 25 bp, Homo sapien
aaaaatgagagatgctggttttaag

SEQ ID NO: 449 - DNA, 25 bp, Homo sapien
aaaaatgagagatgttggttttaag

SEQ ID NO: 450 - DNA, 25 bp, Homo sapien
aaaaatgagtcaacaatggcctact

SEQ ID NO: 451 - DNA, 25 bp, Homo sapien
aaaaatgatgacgggcacagtctca

SEQ ID NO: 452 - DNA, 25 bp, Homo sapien
aaaaatgatgatgggcacagtctca

SEQ ID NO: 453 - DNA, 25 bp, Homo sapien
aaaaatgattagcagagtctattga

SEQ ID NO: 454 - DNA, 25 bp, Homo sapien
aaaaatgattatcagagtctattga

SEQ ID NO: 455 - DNA, 25 bp, Homo sapien
aaaaatgcaaatactatcatcgtaa

SEQ ID NO: 456 - DNA, 25 bp, Homo sapien
aaaaatgcaaatattatcatcgtaa

SEQ ID NO: 457 - DNA, 25 bp, Homo sapien
aaaaatgccctggagaaattgtctc

SEQ ID NO: 458 - DNA, 25 bp, Homo sapien
aaaaatgctctagtctcattcttga

SEQ ID NO: 459 - DNA, 25 bp, Homo sapien
aaaaatgctctggagaaattgtctc

SEQ ID NO: 460 - DNA, 25 bp, Homo sapien
aaaaatgctgagaatgtaaaatact

SEQ ID NO: 461 - DNA, 25 bp, Homo sapien
aaaaatgctgagagtgtaaaatact

SEQ ID NO: 462 - DNA, 25 bp, Homo sapien
aaaaatgctgataatcatgcaaggc

SEQ ID NO: 463 - DNA, 25 bp, Homo sapien
aaaaatgctgatgatcatgcaaggc

SEQ ID NO: 464 - DNA, 25 bp, Homo sapien
aaaaatgctgtagtctcattcttga

SEQ ID NO: 465 - DNA, 25 bp, Homo sapien
aaaaatggaccacgcagtgttggag

SEQ ID NO: 466 - DNA, 25 bp, Homo sapien
aaaaatggaccatgcagtgttggag

SEQ ID NO: 467 - DNA, 25 bp, Homo sapien
aaaaatggctacaaccagaacgatt

SEQ ID NO: 468 - DNA, 25 bp, Homo sapien
aaaaatggctacaatcagaacgatt

SEQ ID NO: 469 - DNA, 25 bp, Homo sapien
aaaaatgtcaagagtatgttgtgaa

SEQ ID NO: 470 - DNA, 25 bp, Homo sapien
aaaaatgtcgagagtatgttgtgaa

SEQ ID NO: 471 - DNA, 25 bp, Homo sapien
aaaaatgtgaaaatggtacttacaa

SEQ ID NO: 472 - DNA, 25 bp, Homo sapien
aaaaatgtgaacatggtacttacaa

SEQ ID NO: 473 - DNA, 25 bp, Homo sapien
aaaaatgtggtttccagtttagcag

SEQ ID NO: 474 - DNA, 25 bp, Homo sapien
aaaaatgtggtttctagtttagcag

SEQ ID NO: 475 - DNA, 25 bp, Homo sapien
aaaaatgttgcaacaatgaataact

SEQ ID NO: 476 - DNA, 25 bp, Homo sapien
aaaaatgttgcaataatgaataact

SEQ ID NO: 477 - DNA, 25 bp, Homo sapien
aaaaattacaccagtcattcaaaaa

SEQ ID NO: 478 - DNA, 25 bp, Homo sapien
aaaaattacaccagtcgttcaaaaa

SEQ ID NO: 479 - DNA, 25 bp, Homo sapien
aaaaattagcttacaagcaacttaa

SEQ ID NO: 480 - DNA, 25 bp, Homo sapien
aaaaattagcttactagcaacttaa

SEQ ID NO: 481 - DNA, 25 bp, Homo sapien
aaaaattagtagcgtttctacatgc

SEQ ID NO: 482 - DNA, 25 bp, Homo sapien
aaaaattagtagtgtttctacatgc

SEQ ID NO: 483 - DNA, 25 bp, Homo sapien
aaaaattcacaaggaaatgtaaagg

SEQ ID NO: 484 - DNA, 25 bp, Homo sapien
aaaaattcacacggaaatgtaaagg

SEQ ID NO: 485 - DNA, 25 bp, Homo sapien
aaaaattgttcaactatacagagag

SEQ ID NO: 486 - DNA, 25 bp, Homo sapien
aaaaattgttcagctatacagagag

SEQ ID NO: 487 - DNA, 25 bp, Homo sapien
aaaaatttaaaaaccatagcgacac

SEQ ID NO: 488 - DNA, 25 bp, Homo sapien
aaaaatttaaaaagcatagcgacac

SEQ ID NO: 489 - DNA, 25 bp, Homo sapien
aaaaatttaagtggtacatcagtga

SEQ ID NO: 490 - DNA, 25 bp, Homo sapien
aaaaatttaagtggtatatcagtga

SEQ ID NO: 491 - DNA, 25 bp, Homo sapien
aaaaatttcatgctaagccagccag

SEQ ID NO: 492 - DNA, 25 bp, Homo sapien
aaaaatttcatgttaagccagccag

SEQ ID NO: 493 - DNA, 25 bp, Homo sapien
aaaaatttcctcattgggtgttcta

SEQ ID NO: 494 - DNA, 25 bp, Homo sapien
aaaaatttcttcattgggtgttcta

SEQ ID NO: 495 - DNA, 25 bp, Homo sapien
aaaaatttgaaaactcctcatttgt

SEQ ID NO: 496 - DNA, 25 bp, Homo sapien
aaaaatttgaaagctcctcatttgt

SEQ ID NO: 497 - DNA, 25 bp, Homo sapien
aaaacaaaaaaacttgagtgcttac

SEQ ID NO: 498 - DNA, 25 bp, Homo sapien
aaaacaaaaaaagttgagtgcttac

SEQ ID NO: 499 - DNA, 25 bp, Homo sapien
aaaacaaaaaccacgtgacccttca

SEQ ID NO: 500 - DNA, 25 bp, Homo sapien
aaaacaaaaactacgtgacccttca

SEQ ID NO: 501 - DNA, 25 bp, Homo sapien
aaaacaaaataaaacctccaagaaa

SEQ ID NO: 502 - DNA, 25 bp, Homo sapien
aaaacaaaataatacctccaagaaa

SEQ ID NO: 503 - DNA, 25 bp, Homo sapien
aaaacaaaatccacagatgttcaag

SEQ ID NO: 504 - DNA, 25 bp, Homo sapien
aaaacaaaatccacggatgttcaag

SEQ ID NO: 505 - DNA, 25 bp, Homo sapien
aaaacaaacaaaaaattctaatata

SEQ ID NO: 506 - DNA, 25 bp, Homo sapien
aaaacaaacaaaattcaaacttccc

SEQ ID NO: 507 - DNA, 25 bp, Homo sapien
aaaacaaacaaacttcaaacttccc

SEQ ID NO: 508 - DNA, 25 bp, Homo sapien
aaaacaaacaaaggacatcgaaaca

SEQ ID NO: 509 - DNA, 25 bp, Homo sapien
aaaacaaacaaatgcaattacatca

SEQ ID NO: 510 - DNA, 25 bp, Homo sapien
aaaacaaacaaatggaattacatca

SEQ ID NO: 511 - DNA, 25 bp, Homo sapien
aaaacaaacaacggacatcgaaaca

SEQ ID NO: 512 - DNA, 25 bp, Homo sapien
aaaacaaacatcatgctcaaatgag

SEQ ID NO: 513 - DNA, 25 bp, Homo sapien
aaaacaaaccgactcaaaacattgg

SEQ ID NO: 514 - DNA, 25 bp, Homo sapien
aaaacaaaccgactcagaacattgg

SEQ ID NO: 515 - DNA, 25 bp, Homo sapien
aaaacaaacgaaaaattctaatata

SEQ ID NO: 516 - DNA, 25 bp, Homo sapien
aaaacaaacgtcatgctcaaatgag

SEQ ID NO: 517 - DNA, 25 bp, Homo sapien
aaaacaaagcaacaggattggatga

SEQ ID NO: 518 - DNA, 25 bp, Homo sapien
aaaacaaagcaacagggttggatga

SEQ ID NO: 519 - DNA, 25 bp, Homo sapien
aaaacaaatgtacgtatgaggcaca

SEQ ID NO: 520 - DNA, 25 bp, Homo sapien
aaaacaaatgtatgtatgaggcaca

SEQ ID NO: 521 - DNA, 25 bp, Homo sapien
aaaacaaattcgtgaacaatgtgga

SEQ ID NO: 522 - DNA, 25 bp, Homo sapien
aaaacaaattcgtgcacaatgtgga

SEQ ID NO: 523 - DNA, 25 bp, Homo sapien
aaaacaacacaggacgaagagatta

SEQ ID NO: 524 - DNA, 25 bp, Homo sapien
aaaacaacacatgacgaagagatta

SEQ ID NO: 525 - DNA, 25 bp, Homo sapien
aaaacaagaaaaggagaatgtagca

SEQ ID NO: 526 - DNA, 25 bp, Homo sapien
aaaacaagaaaatgagaatgtagca

SEQ ID NO: 527 - DNA, 25 bp, Homo sapien
aaaacaagtccaaggtgaaatagtg

SEQ ID NO: 528 - DNA, 25 bp, Homo sapien
aaaacaagtccagggtgaaatagtg

SEQ ID NO: 529 - DNA, 25 bp, Homo sapien
aaaacaataaaagtagtaacctcta

SEQ ID NO: 530 - DNA, 25 bp, Homo sapien
aaaacaataaacgcatctcttttct

SEQ ID NO: 531 - DNA, 25 bp, Homo sapien
aaaacaataaaggtagtaacctcta

SEQ ID NO: 532 - DNA, 25 bp, Homo sapien
aaaacaataaatgcatctcttttct

SEQ ID NO: 533 - DNA, 25 bp, Homo sapien
aaaacaatatgaaatgctctttcag

SEQ ID NO: 534 - DNA, 25 bp, Homo sapien
aaaacaatatgaaatggtctttcag

SEQ ID NO: 535 - DNA, 25 bp, Homo sapien
aaaacaatctgatttccttaccaac

SEQ ID NO: 536 - DNA, 25 bp, Homo sapien
aaaacaatctgctttccttaccaac

SEQ ID NO: 537 - DNA, 25 bp, Homo sapien
aaaacaatgactcactcatgaagga

SEQ ID NO: 538 - DNA, 25 bp, Homo sapien
aaaacaatgacttactcatgaagga

SEQ ID NO: 539 - DNA, 25 bp, Homo sapien
aaaacaattaaataataagcacaag

SEQ ID NO: 540 - DNA, 25 bp, Homo sapien
aaaacaattaaatagtaagcacaag

SEQ ID NO: 541 - DNA, 25 bp, Homo sapien
aaaacacaatcgaagctatcaatat

SEQ ID NO: 542 - DNA, 25 bp, Homo sapien
aaaacacaatggttgcatgagtact

SEQ ID NO: 543 - DNA, 25 bp, Homo sapien
aaaacacactagcaggtatatttgg

SEQ ID NO: 544 - DNA, 25 bp, Homo sapien
aaaacacactagcatgtatatttgg

SEQ ID NO: 545 - DNA, 25 bp, Homo sapien
aaaacacagatgctgagccccaccc

SEQ ID NO: 546 - DNA, 25 bp, Homo sapien
aaaacacagatggtgagccccaccc

SEQ ID NO: 547 - DNA, 25 bp, Homo sapien
aaaacacaggtgctaacaagctaac

SEQ ID NO: 548 - DNA, 25 bp, Homo sapien
aaaacacaggtgctgacaagctaac

SEQ ID NO: 549 - DNA, 25 bp, Homo sapien
aaaacacagtcgaagctatcaatat

SEQ ID NO: 550 - DNA, 25 bp, Homo sapien
aaaacacagtggttgcatgagtact

SEQ ID NO: 551 - DNA, 25 bp, Homo sapien
aaaacaccagtcacagccatgttct

SEQ ID NO: 552 - DNA, 25 bp, Homo sapien
aaaacaccatttatagtcatgccac

SEQ ID NO: 553 - DNA, 25 bp, Homo sapien
aaaacaccctttatagtcatgccac

SEQ ID NO: 554 - DNA, 25 bp, Homo sapien
aaaacacctgagtaatacagtgacc

SEQ ID NO: 555 - DNA, 25 bp, Homo sapien
aaaacacctgagtcatacagtgacc

SEQ ID NO: 556 - DNA, 25 bp, Homo sapien
aaaacacctgtcacagccatgttct

SEQ ID NO: 557 - DNA, 25 bp, Homo sapien
aaaacactcacaaataggttcagtg

SEQ ID NO: 558 - DNA, 25 bp, Homo sapien
aaaacactcagaagatatttccttg

SEQ ID NO: 559 - DNA, 25 bp, Homo sapien
aaaacactcagaaggtatttccttg

SEQ ID NO: 560 - DNA, 25 bp, Homo sapien
aaaacactcttaacaagcttgagat

SEQ ID NO: 561 - DNA, 25 bp, Homo sapien
aaaacactcttaataagcttgagat

SEQ ID NO: 562 - DNA, 25 bp, Homo sapien
aaaacacttacaaataggttcagtg

SEQ ID NO: 563 - DNA, 25 bp, Homo sapien
aaaacagaaaagcccagtattactt

SEQ ID NO: 564 - DNA, 25 bp, Homo sapien
aaaacagaaaatcccagtattactt

SEQ ID NO: 565 - DNA, 25 bp, Homo sapien
aaaacagaaaggcgttgcttacatt

SEQ ID NO: 566 - DNA, 25 bp, Homo sapien
aaaacagaaaggtgttgcttacatt

SEQ ID NO: 567 - DNA, 25 bp, Homo sapien
aaaacagaactaaattatgattata

SEQ ID NO: 568 - DNA, 25 bp, Homo sapien
aaaacagaactaaattctgattata

SEQ ID NO: 569 - DNA, 25 bp, Homo sapien
aaaacagaaggaccctttagactct

SEQ ID NO: 570 - DNA, 25 bp, Homo sapien
aaaacagaaggaccttttagactct

SEQ ID NO: 571 - DNA, 25 bp, Homo sapien
aaaacagaagtggatgagcagtaaa

SEQ ID NO: 572 - DNA, 25 bp, Homo sapien
aaaacagaagtggatgtgcagtaaa

SEQ ID NO: 573 - DNA, 25 bp, Homo sapien
aaaacagagaccttgtttatgtgta

SEQ ID NO: 574 - DNA, 25 bp, Homo sapien
aaaacagaggccttgtttatgtgta

SEQ ID NO: 575 - DNA, 25 bp, Homo sapien
aaaacagaggtatcagactatataa

SEQ ID NO: 576 - DNA, 25 bp, Homo sapien
aaaacagaggtatcggactatataa

SEQ ID NO: 577 - DNA, 25 bp, Homo sapien
aaaacagataaaccatagagaaaat

SEQ ID NO: 578 - DNA, 25 bp, Homo sapien
aaaacagataaaccatggagaaaat

SEQ ID NO: 579 - DNA, 25 bp, Homo sapien
aaaacagatgtaacgctctcccttg

SEQ ID NO: 580 - DNA, 25 bp, Homo sapien
aaaacagatgtaactctctcccttg

SEQ ID NO: 581 - DNA, 25 bp, Homo sapien
aaaacagccaatataacattcagtg

SEQ ID NO: 582 - DNA, 25 bp, Homo sapien
aaaacagccaatgtaacattcagtg

SEQ ID NO: 583 - DNA, 25 bp, Homo sapien
aaaacagctttgatagaatcagatt

SEQ ID NO: 584 - DNA, 25 bp, Homo sapien
aaaacagctttgatggaatcagatt

SEQ ID NO: 585 - DNA, 25 bp, Homo sapien
aaaacaggaaacaatgtcatattca

SEQ ID NO: 586 - DNA, 25 bp, Homo sapien
aaaacaggaaactatgtcatattca

SEQ ID NO: 587 - DNA, 25 bp, Homo sapien
aaaacagtacagattattggtctat

SEQ ID NO: 588 - DNA, 25 bp, Homo sapien
aaaacagtacagtttattggtctat

SEQ ID NO: 589 - DNA, 25 bp, Homo sapien
aaaacagtagagtgccaagcacaga

SEQ ID NO: 590 - DNA, 25 bp, Homo sapien
aaaacagtagagtgtcaagcacaga

SEQ ID NO: 591 - DNA, 25 bp, Homo sapien
aaaacagtcatagaatggataaccc

SEQ ID NO: 592 - DNA, 25 bp, Homo sapien
aaaacagtcgtagaatggataaccc

SEQ ID NO: 593 - DNA, 25 bp, Homo sapien
aaaacagtgtacaacatttcccttt

SEQ ID NO: 594 - DNA, 25 bp, Homo sapien
aaaacagtgtacaatatttcccttt

SEQ ID NO: 595 - DNA, 25 bp, Homo sapien
aaaacagttgcataaagcagaatgc

SEQ ID NO: 596 - DNA, 25 bp, Homo sapien
aaaacagttgcgtaaagcagaatgc

SEQ ID NO: 597 - DNA, 25 bp, Homo sapien
aaaacagttgtgcattaaatagtta

SEQ ID NO: 598 - DNA, 25 bp, Homo sapien
aaaacagttgtgcgttaaatagtta

SEQ ID NO: 599 - DNA, 25 bp, Homo sapien
aaaacagtttgcagattcctgatct

SEQ ID NO: 600 - DNA, 25 bp, Homo sapien
aaaacagtttgcatattcctgatct

SEQ ID NO: 601 - DNA, 25 bp, Homo sapien
aaaacatacagtctacaaggaacag

SEQ ID NO: 602 - DNA, 25 bp, Homo sapien
aaaacatacagtctacgaggaacag

SEQ ID NO: 603 - DNA, 25 bp, Homo sapien
aaaacatagcatggaagacaggtca

SEQ ID NO: 604 - DNA, 25 bp, Homo sapien
aaaacatagctcaagaactccaaca

SEQ ID NO: 605 - DNA, 25 bp, Homo sapien
aaaacatagctcgagaactccaaca

SEQ ID NO: 606 - DNA, 25 bp, Homo sapien
aaaacatagtatggaagacaggtca

SEQ ID NO: 607 - DNA, 25 bp, Homo sapien
aaaacatattaaccaggtgcaacgt

SEQ ID NO: 608 - DNA, 25 bp, Homo sapien
aaaacatattaagcaggtgcaacgt

SEQ ID NO: 609 - DNA, 25 bp, Homo sapien
aaaacatctatacgaacaacaaaaa

SEQ ID NO: 610 - DNA, 25 bp, Homo sapien
aaaacatctatatgaacaacaaaaa

SEQ ID NO: 611 - DNA, 25 bp, Homo sapien
aaaacatctatcagcataactgaga

SEQ ID NO: 612 - DNA, 25 bp, Homo sapien
aaaacatctttcagcataactgaga

SEQ ID NO: 613 - DNA, 25 bp, Homo sapien
aaaacatgaaaacgagagacaggcc

SEQ ID NO: 614 - DNA, 25 bp, Homo sapien
aaaacatgaaaaggagagacaggcc

SEQ ID NO: 615 - DNA, 25 bp, Homo sapien
aaaacatgcaactcaatgatattca

SEQ ID NO: 616 - DNA, 25 bp, Homo sapien
aaaacatgcaattcaatgatattca

SEQ ID NO: 617 - DNA, 25 bp, Homo sapien
aaaacattgctatgaacataggata

SEQ ID NO: 618 - DNA, 25 bp, Homo sapien
aaaacattgctgtgaacataggata

SEQ ID NO: 619 - DNA, 25 bp, Homo sapien
aaaacattttcaactgtgggaatca

SEQ ID NO: 620 - DNA, 25 bp, Homo sapien
aaaacattttcaattgtgggaatca

SEQ ID NO: 621 - DNA, 25 bp, Homo sapien
aaaaccaaaaactgggcgcagtaat

SEQ ID NO: 622 - DNA, 25 bp, Homo sapien
aaaaccaaaaactgggtgcagtaat

SEQ ID NO: 623 - DNA, 25 bp, Homo sapien
aaaaccaacgctttgtctctgaaat

SEQ ID NO: 624 - DNA, 25 bp, Homo sapien
aaaaccaatgctttgtctctgaaat

SEQ ID NO: 625 - DNA, 25 bp, Homo sapien
aaaaccaatttaccatagacatgta

SEQ ID NO: 626 - DNA, 25 bp, Homo sapien
aaaaccaatttaccgtagacatgta

SEQ ID NO: 627 - DNA, 25 bp, Homo sapien
aaaaccacaaaacgaggagaaacca

SEQ ID NO: 628 - DNA, 25 bp, Homo sapien
aaaaccacaaaatgaggagaaacca

SEQ ID NO: 629 - DNA, 25 bp, Homo sapien
aaaaccacaacaaaagtgatgcttt

SEQ ID NO: 630 - DNA, 25 bp, Homo sapien
aaaaccacaacaaacagctttactt

SEQ ID NO: 631 - DNA, 25 bp, Homo sapien
aaaaccacaacgaaagtgatgcttt

SEQ ID NO: 632 - DNA, 25 bp, Homo sapien
aaaaccacagacacatttcacaaca

SEQ ID NO: 633 - DNA, 25 bp, Homo sapien
aaaaccacagagaacaatgtaatag

SEQ ID NO: 634 - DNA, 25 bp, Homo sapien
aaaaccacagagagcaatgtaatag

SEQ ID NO: 635 - DNA, 25 bp, Homo sapien
aaaaccacagcaaacagctttactt

SEQ ID NO: 636 - DNA, 25 bp, Homo sapien
aaaaccacctttactatgtaagtta

SEQ ID NO: 637 - DNA, 25 bp, Homo sapien
aaaaccacctttattatgtaagtta

SEQ ID NO: 638 - DNA, 25 bp, Homo sapien
aaaaccacggacacatttcacaaca

SEQ ID NO: 639 - DNA, 25 bp, Homo sapien
aaaaccagcataagcaacagacccc

SEQ ID NO: 640 - DNA, 25 bp, Homo sapien
aaaaccagcataggcaacagacccc

SEQ ID NO: 641 - DNA, 25 bp, Homo sapien
aaaaccagcgttagagtaaaatgcc

SEQ ID NO: 642 - DNA, 25 bp, Homo sapien
aaaaccagctttagagtaaaatgcc

SEQ ID NO: 643 - DNA, 25 bp, Homo sapien
aaaaccaggagcagcaccttcaaga

SEQ ID NO: 644 - DNA, 25 bp, Homo sapien
aaaaccaggagcagcatcttcaaga

SEQ ID NO: 645 - DNA, 25 bp, Homo sapien
aaaaccatgagacaattcaaactct

SEQ ID NO: 646 - DNA, 25 bp, Homo sapien
aaaaccatgagccaattcaaactct

SEQ ID NO: 647 - DNA, 25 bp, Homo sapien
aaaaccatgtagactttgaaccagg

SEQ ID NO: 648 - DNA, 25 bp, Homo sapien
aaaaccatgtaggctttgaaccagg

SEQ ID NO: 649 - DNA, 25 bp, Homo sapien
aaaaccattgcaaataccaacacca

SEQ ID NO: 650 - DNA, 25 bp, Homo sapien
aaaaccattgcaaatatcaacacca

SEQ ID NO: 651 - DNA, 25 bp, Homo sapien
aaaaccatttctctgtcaagggaaa

SEQ ID NO: 652 - DNA, 25 bp, Homo sapien
aaaaccatttctttgtcaagggaaa

SEQ ID NO: 653 - DNA, 25 bp, Homo sapien
aaaacccaaaactaggcatttggtt

SEQ ID NO: 654 - DNA, 25 bp, Homo sapien
aaaacccaaaactatgcatttggtt

SEQ ID NO: 655 - DNA, 25 bp, Homo sapien
aaaacccaacaaatcatcgattagg

SEQ ID NO: 656 - DNA, 25 bp, Homo sapien
aaaacccaacatatagtaattaagg

SEQ ID NO: 657 - DNA, 25 bp, Homo sapien
aaaacccaacatatggtaattaagg

SEQ ID NO: 658 - DNA, 25 bp, Homo sapien
aaaacccagcaaatcatcgattagg

SEQ ID NO: 659 - DNA, 25 bp, Homo sapien
aaaacccatagaatatacaacatga

SEQ ID NO: 660 - DNA, 25 bp, Homo sapien
aaaacccatagactatacaacatga

SEQ ID NO: 661 - DNA, 25 bp, Homo sapien
aaaaccctgtgcatacttcaagcct

SEQ ID NO: 662 - DNA, 25 bp, Homo sapien
aaaaccctgtgcgtacttcaagcct

SEQ ID NO: 663 - DNA, 25 bp, Homo sapien
aaaaccgaaatcaaacagaagtgtc

SEQ ID NO: 664 - DNA, 25 bp, Homo sapien
aaaaccgaaatcaagcagaagtgtc

SEQ ID NO: 665 - DNA, 25 bp, Homo sapien
aaaacctaaaatattagatgagatt

SEQ ID NO: 666 - DNA, 25 bp, Homo sapien
aaaacctacaatattagatgagatt

SEQ ID NO: 667 - DNA, 25 bp, Homo sapien
aaaacctagagaacgtctttgcata

SEQ ID NO: 668 - DNA, 25 bp, Homo sapien
aaaacctagagaatgtctttgcata

SEQ ID NO: 669 - DNA, 25 bp, Homo sapien
aaaacctcacacatctcagtgccag

SEQ ID NO: 670 - DNA, 25 bp, Homo sapien
aaaacctcatacatctcagtgccag

SEQ ID NO: 671 - DNA, 25 bp, Homo sapien
aaaacctcatgatggcctgcagagg

SEQ ID NO: 672 - DNA, 25 bp, Homo sapien
aaaacctcatgttggcctgcagagg

SEQ ID NO: 673 - DNA, 25 bp, Homo sapien
aaaacctcgaacattgctatggtct

SEQ ID NO: 674 - DNA, 25 bp, Homo sapien
aaaacctcgaacattgttatggtct

SEQ ID NO: 675 - DNA, 25 bp, Homo sapien
aaaacctgaagacttgaagattcac

SEQ ID NO: 676 - DNA, 25 bp, Homo sapien
aaaacctgaagtcttgaagattcac

SEQ ID NO: 677 - DNA, 25 bp, Homo sapien
aaaacctggagatgacaactttaat

SEQ ID NO: 678 - DNA, 25 bp, Homo sapien
aaaacctggagatggcaactttaat

SEQ ID NO: 679 - DNA, 25 bp, Homo sapien
aaaaccttcgatttatgtccatttc

SEQ ID NO: 680 - DNA, 25 bp, Homo sapien
aaaaccttcgtgacgcaacagcagg

SEQ ID NO: 681 - DNA, 25 bp, Homo sapien
aaaaccttcgtgatgcaacagcagg

SEQ ID NO: 682 - DNA, 25 bp, Homo sapien
aaaaccttctgtagaaatatagtgt

SEQ ID NO: 683 - DNA, 25 bp, Homo sapien
aaaaccttctgtaggaatatagtgt

SEQ ID NO: 684 - DNA, 25 bp, Homo sapien
aaaaccttggaagaaaatggacact

SEQ ID NO: 685 - DNA, 25 bp, Homo sapien
aaaaccttggaagaaattggacact

SEQ ID NO: 686 - DNA, 25 bp, Homo sapien
aaaaccttggatttatgtccatttc

SEQ ID NO: 687 - DNA, 25 bp, Homo sapien
aaaacgaaagtgagatgtgaaatcg

SEQ ID NO: 688 - DNA, 25 bp, Homo sapien
aaaacgaaagtgtgatgtgaaatcg

SEQ ID NO: 689 - DNA, 25 bp, Homo sapien
aaaacgaggtccattgtggccactg

SEQ ID NO: 690 - DNA, 25 bp, Homo sapien
aaaacgaggtctattgtggccactg

SEQ ID NO: 691 - DNA, 25 bp, Homo sapien
aaaacgagttataaccgctgcacct

SEQ ID NO: 692 - DNA, 25 bp, Homo sapien
aaaacgagttataacctctgcacct

SEQ ID NO: 693 - DNA, 25 bp, Homo sapien
aaaacgattgtcaaagaaagaggta

SEQ ID NO: 694 - DNA, 25 bp, Homo sapien
aaaacgattgttaaagaaagaggta

SEQ ID NO: 695 - DNA, 25 bp, Homo sapien
aaaacggacctctatgggccaaatc

SEQ ID NO: 696 - DNA, 25 bp, Homo sapien
aaaacggatctctatgggccaaatc

SEQ ID NO: 697 - DNA, 25 bp, Homo sapien
aaaacgtgaagctcaagggatagaa

SEQ ID NO: 698 - DNA, 25 bp, Homo sapien
aaaacgtgaagttcaagggatagaa

SEQ ID NO: 699 - DNA, 25 bp, Homo sapien
aaaacgtgattaagtcctgagggca

SEQ ID NO: 700 - DNA, 25 bp, Homo sapien
aaaacgtggttaagtcctgagggca

SEQ ID NO: 701 - DNA, 25 bp, Homo sapien
aaaactaaagtaggaattgaaaagc

SEQ ID NO: 702 - DNA, 25 bp, Homo sapien
aaaactaaattattccactccatga

SEQ ID NO: 703 - DNA, 25 bp, Homo sapien
aaaactaaattattccgctccatga

SEQ ID NO: 704 - DNA, 25 bp, Homo sapien
aaaactaatgtaggaattgaaaagc

SEQ ID NO: 705 - DNA, 25 bp, Homo sapien
aaaactacaagtcaatcttcctgat

SEQ ID NO: 706 - DNA, 25 bp, Homo sapien
aaaactacaagtcagtcttcctgat

SEQ ID NO: 707 - DNA, 25 bp, Homo sapien
aaaactaccgaaaacacaaatttgg

SEQ ID NO: 708 - DNA, 25 bp, Homo sapien
aaaactacggaaaacacaaatttgg

SEQ ID NO: 709 - DNA, 25 bp, Homo sapien
aaaactagacgaaactttcttttga

SEQ ID NO: 710 - DNA, 25 bp, Homo sapien
aaaactagacgagactttcttttga

SEQ ID NO: 711 - DNA, 25 bp, Homo sapien
aaaactagccattaattttagaaag

SEQ ID NO: 712 - DNA, 25 bp, Homo sapien
aaaactagccattgattttagaaag

SEQ ID NO: 713 - DNA, 25 bp, Homo sapien
aaaactataacttatctcccagcct

SEQ ID NO: 714 - DNA, 25 bp, Homo sapien
aaaactataacttgtctcccagcct

SEQ ID NO: 715 - DNA, 25 bp, Homo sapien
aaaactatgagcgtccaggcagcta

SEQ ID NO: 716 - DNA, 25 bp, Homo sapien
aaaactatgagggtccaggcagcta

SEQ ID NO: 717 - DNA, 25 bp, Homo sapien
aaaactattttgccatctatcaagg

SEQ ID NO: 718 - DNA, 25 bp, Homo sapien
aaaactattttgccgtctatcaagg

SEQ ID NO: 719 - DNA, 25 bp, Homo sapien
aaaactcaaacatgatataaacagt

SEQ ID NO: 720 - DNA, 25 bp, Homo sapien
aaaactcaaacatggtataaacagt

SEQ ID NO: 721 - DNA, 25 bp, Homo sapien
aaaactcaaacgagtagtaacaaag

SEQ ID NO: 722 - DNA, 25 bp, Homo sapien
aaaactcaagcgagtagtaacaaag

SEQ ID NO: 723 - DNA, 25 bp, Homo sapien
aaaactcagatctaacaaagtaaca

SEQ ID NO: 724 - DNA, 25 bp, Homo sapien
aaaactcatatctaacaaagtaaca

SEQ ID NO: 725 - DNA, 25 bp, Homo sapien
aaaactccagccaaaaagaggagag

SEQ ID NO: 726 - DNA, 25 bp, Homo sapien
aaaactccagccacaaagaggagag

SEQ ID NO: 727 - DNA, 25 bp, Homo sapien
aaaactcccaattgcataagaccgt

SEQ ID NO: 728 - DNA, 25 bp, Homo sapien
aaaactcccatttcgacattctgaa

SEQ ID NO: 729 - DNA, 25 bp, Homo sapien
aaaactcccgtttcgacattctgaa

SEQ ID NO: 730 - DNA, 25 bp, Homo sapien
aaaactcctaattgcataagaccgt

SEQ ID NO: 731 - DNA, 25 bp, Homo sapien
aaaactctttttccagtggactcaa

SEQ ID NO: 732 - DNA, 25 bp, Homo sapien
aaaactctttttcccgtggactcaa

SEQ ID NO: 733 - DNA, 25 bp, Homo sapien
aaaactgaaacatctgtactgtaaa

SEQ ID NO: 734 - DNA, 25 bp, Homo sapien
aaaactgaaacgtctgtactgtaaa

SEQ ID NO: 735 - DNA, 25 bp, Homo sapien
aaaactgaacaggaactcaagtcac

SEQ ID NO: 736 - DNA, 25 bp, Homo sapien
aaaactgaataggaactcaagtcac

SEQ ID NO: 737 - DNA, 25 bp, Homo sapien
aaaactgagacttacgagattcgct

SEQ ID NO: 738 - DNA, 25 bp, Homo sapien
aaaactgagacttatgagattcgct

SEQ ID NO: 739 - DNA, 25 bp, Homo sapien
aaaactgcatgatcttctgctgagc

SEQ ID NO: 740 - DNA, 25 bp, Homo sapien
aaaactgcgtgatcttctgctgagc

SEQ ID NO: 741 - DNA, 25 bp, Homo sapien
aaaactgctgtgccttttgtattat

SEQ ID NO: 742 - DNA, 25 bp, Homo sapien
aaaactgctttgccttttgtattat

SEQ ID NO: 743 - DNA, 25 bp, Homo sapien
aaaactggacggaaaccgtctccga

SEQ ID NO: 744 - DNA, 25 bp, Homo sapien
aaaactggacggaagccgtctccga

SEQ ID NO: 745 - DNA, 25 bp, Homo sapien
aaaactggatatgctttctacattg

SEQ ID NO: 746 - DNA, 25 bp, Homo sapien
aaaactggatattctttctacattg

SEQ ID NO: 747 - DNA, 25 bp, Homo sapien
aaaactggctgtccataattggtaa

SEQ ID NO: 748 - DNA, 25 bp, Homo sapien
aaaactggctgtccgtaattggtaa

SEQ ID NO: 749 - DNA, 25 bp, Homo sapien
aaaactgggcgcagtaatgagaaga

SEQ ID NO: 750 - DNA, 25 bp, Homo sapien
aaaactgggtgcagtaatgagaaga

SEQ ID NO: 751 - DNA, 25 bp, Homo sapien
aaaactgtttttacatgaatgaagg

SEQ ID NO: 752 - DNA, 25 bp, Homo sapien
aaaactgtttttacgtgaatgaagg

SEQ ID NO: 753 - DNA, 25 bp, Homo sapien
aaaacttacagagctagcatgaggc

SEQ ID NO: 754 - DNA, 25 bp, Homo sapien
aaaacttagaatgatgtcacattgt

SEQ ID NO: 755 - DNA, 25 bp, Homo sapien
aaaacttagaatgctgtcacattgt

SEQ ID NO: 756 - DNA, 25 bp, Homo sapien
aaaacttatagagctagcatgaggc

SEQ ID NO: 757 - DNA, 25 bp, Homo sapien
aaaacttattcaaatcagtgagttc

SEQ ID NO: 758 - DNA, 25 bp, Homo sapien
aaaacttattcaaatctgtgagttc

SEQ ID NO: 759 - DNA, 25 bp, Homo sapien
aaaacttcataacaccttggaatgc

SEQ ID NO: 760 - DNA, 25 bp, Homo sapien
aaaacttcctaacaccttggaatgc

SEQ ID NO: 761 - DNA, 25 bp, Homo sapien
aaaacttcttgcgccaaactggcat

SEQ ID NO: 762 - DNA, 25 bp, Homo sapien
aaaacttcttgctccaaactggcat

SEQ ID NO: 763 - DNA, 25 bp, Homo sapien
aaaactttcattaaacatggtgaat

SEQ ID NO: 764 - DNA, 25 bp, Homo sapien
aaaactttcccaatgtatttattga

SEQ ID NO: 765 - DNA, 25 bp, Homo sapien
aaaactttcgttaaacatggtgaat

SEQ ID NO: 766 - DNA, 25 bp, Homo sapien
aaaactttgccaatgtatttattga

SEQ ID NO: 767 - DNA, 25 bp, Homo sapien
aaaagaaaatctatcccatgctcta

SEQ ID NO: 768 - DNA, 25 bp, Homo sapien
aaaagaaaatctattccatgctcta

SEQ ID NO: 769 - DNA, 25 bp, Homo sapien
aaaagaaaatgccttcagtaccaca

SEQ ID NO: 770 - DNA, 25 bp, Homo sapien
aaaagaaaatggcttcagtaccaca

SEQ ID NO: 771 - DNA, 25 bp, Homo sapien
aaaagaaaatttcgatgaggttcct

SEQ ID NO: 772 - DNA, 25 bp, Homo sapien
aaaagaaaattttgatgaggttcct

SEQ ID NO: 773 - DNA, 25 bp, Homo sapien
aaaagaaataagatcggagaagaac

SEQ ID NO: 774 - DNA, 25 bp, Homo sapien
aaaagaaataagattggagaagaac

SEQ ID NO: 775 - DNA, 25 bp, Homo sapien
aaaagaaatcttatacccactagct

SEQ ID NO: 776 - DNA, 25 bp, Homo sapien
aaaagaaatcttatactcactagct

SEQ ID NO: 777 - DNA, 25 bp, Homo sapien
aaaagaacagctcagccaactataa

SEQ ID NO: 778 - DNA, 25 bp, Homo sapien
aaaagaacccagatactctggagga

SEQ ID NO: 779 - DNA, 25 bp, Homo sapien
aaaagaaccgctcagccaactataa

SEQ ID NO: 780 - DNA, 25 bp, Homo sapien
aaaagaacctagatactctggagga

SEQ ID NO: 781 - DNA, 25 bp, Homo sapien
aaaagaagaatttgggatctactcc

SEQ ID NO: 782 - DNA, 25 bp, Homo sapien
aaaagaagagtaacaaaccagatgt

SEQ ID NO: 783 - DNA, 25 bp, Homo sapien
aaaagaagcagtagatgattaagta

SEQ ID NO: 784 - DNA, 25 bp, Homo sapien
aaaagaaggcatgaagacatttatg

SEQ ID NO: 785 - DNA, 25 bp, Homo sapien
aaaagaaggcatgaaggcatttatg

SEQ ID NO: 786 - DNA, 25 bp, Homo sapien
aaaagaagtagtagatgattaagta

SEQ ID NO: 787 - DNA, 25 bp, Homo sapien
aaaagaagtatttgggatctactcc

SEQ ID NO: 788 - DNA, 25 bp, Homo sapien
aaaagaagtgaaacaggataaaatg

SEQ ID NO: 789 - DNA, 25 bp, Homo sapien
aaaagaagtgaaacgggataaaatg

SEQ ID NO: 790 - DNA, 25 bp, Homo sapien
aaaagaagtgtaacaaaccagatgt

SEQ ID NO: 791 - DNA, 25 bp, Homo sapien
aaaagaataaaaatacggtcatagt

SEQ ID NO: 792 - DNA, 25 bp, Homo sapien
aaaagaataaaaatgcggtcatagt

SEQ ID NO: 793 - DNA, 25 bp, Homo sapien
aaaagaataatttaaaacacctcca

SEQ ID NO: 794 - DNA, 25 bp, Homo sapien
aaaagaatacacagctatacaggga

SEQ ID NO: 795 - DNA, 25 bp, Homo sapien
aaaagaatatacagctatacaggga

SEQ ID NO: 796 - DNA, 25 bp, Homo sapien
aaaagaatattttaaaacacctcca

SEQ ID NO: 797 - DNA, 25 bp, Homo sapien
aaaagaatctgaagctaggtatgcc

SEQ ID NO: 798 - DNA, 25 bp, Homo sapien
aaaagaatctgacgctaggtatgcc

SEQ ID NO: 799 - DNA, 25 bp, Homo sapien
aaaagaatgtataaattgatgtgtt

SEQ ID NO: 800 - DNA, 25 bp, Homo sapien
aaaagaatgtataagttgatgtgtt

SEQ ID NO: 801 - DNA, 25 bp, Homo sapien
aaaagaattaaactgatggtaagaa

SEQ ID NO: 802 - DNA, 25 bp, Homo sapien
aaaagaattaaattgatggtaagaa

SEQ ID NO: 803 - DNA, 25 bp, Homo sapien
aaaagaattcttcactgtcaaatta

SEQ ID NO: 804 - DNA, 25 bp, Homo sapien
aaaagaattcttcgctgtcaaatta

SEQ ID NO: 805 - DNA, 25 bp, Homo sapien
aaaagacagagggaggtttacaaat

SEQ ID NO: 806 - DNA, 25 bp, Homo sapien
aaaagacagagggatgtttacaaat

SEQ ID NO: 807 - DNA, 25 bp, Homo sapien
aaaagacagtattttcaacaagcca

SEQ ID NO: 808 - DNA, 25 bp, Homo sapien
aaaagacatgtacgagaataatcac

SEQ ID NO: 809 - DNA, 25 bp, Homo sapien
aaaagacatgtatgagaataatcac

SEQ ID NO: 810 - DNA, 25 bp, Homo sapien
aaaagacattattttcaacaagcca

SEQ ID NO: 811 - DNA, 25 bp, Homo sapien
aaaagaccacctaagatcagggcaa

SEQ ID NO: 812 - DNA, 25 bp, Homo sapien
aaaagaccgcctaagatcagggcaa

SEQ ID NO: 813 - DNA, 25 bp, Homo sapien
aaaagactgatgagtactgtgattt

SEQ ID NO: 814 - DNA, 25 bp, Homo sapien
aaaagactggtgagtactgtgattt

SEQ ID NO: 815 - DNA, 25 bp, Homo sapien
aaaagagaaaagtatgcaaaacatt

SEQ ID NO: 816 - DNA, 25 bp, Homo sapien
aaaagagaaaagtgtgcaaaacatt

SEQ ID NO: 817 - DNA, 25 bp, Homo sapien
aaaagagaacaagacccaatactac

SEQ ID NO: 818 - DNA, 25 bp, Homo sapien
aaaagagaacaaggcccaatactac

SEQ ID NO: 819 - DNA, 25 bp, Homo sapien
aaaagagagccagaaaccagtatgc

SEQ ID NO: 820 - DNA, 25 bp, Homo sapien
aaaagagagcccgaaaccagtatgc

SEQ ID NO: 821 - DNA, 25 bp, Homo sapien
aaaagagatttcagtaggtgcattg

SEQ ID NO: 822 - DNA, 25 bp, Homo sapien
aaaagagatttcattaggtgcattg

SEQ ID NO: 823 - DNA, 25 bp, Homo sapien
aaaagagcaacacacgattcttgcg

SEQ ID NO: 824 - DNA, 25 bp, Homo sapien
aaaagagcaacacaggattcttgcg

SEQ ID NO: 825 - DNA, 25 bp, Homo sapien
aaaagagccatcagtgagaaagtgg

SEQ ID NO: 826 - DNA, 25 bp, Homo sapien
aaaagagccatccgtgagaaagtgg

SEQ ID NO: 827 - DNA, 25 bp, Homo sapien
aaaagagccctgacgtacatacttg

SEQ ID NO: 828 - DNA, 25 bp, Homo sapien
aaaagagccctgacgtgcatacttg

SEQ ID NO: 829 - DNA, 25 bp, Homo sapien
aaaagagcctgtgaacaagataagg

SEQ ID NO: 830 - DNA, 25 bp, Homo sapien
aaaagagcctgtgaacgagataagg

SEQ ID NO: 831 - DNA, 25 bp, Homo sapien
aaaagagctattacgttgtgaagaa

SEQ ID NO: 832 - DNA, 25 bp, Homo sapien
aaaagagctattaggttgtgaagaa

SEQ ID NO: 833 - DNA, 25 bp, Homo sapien
aaaagagggatatacactgtagcta

SEQ ID NO: 834 - DNA, 25 bp, Homo sapien
aaaagagggatatacattgtagcta

SEQ ID NO: 835 - DNA, 25 bp, Homo sapien
aaaagaggtaccgagatttcctcac

SEQ ID NO: 836 - DNA, 25 bp, Homo sapien
aaaagaggtactgagatttcctcac

SEQ ID NO: 837 - DNA, 25 bp, Homo sapien
aaaagaggtggcagatgtgaagtgg

SEQ ID NO: 838 - DNA, 25 bp, Homo sapien
aaaagaggtggcagatttgaagtgg

SEQ ID NO: 839 - DNA, 25 bp, Homo sapien
aaaagagttaataaattgcattccc

SEQ ID NO: 840 - DNA, 25 bp, Homo sapien
aaaagagttaatacattgcattccc

SEQ ID NO: 841 - DNA, 25 bp, Homo sapien
aaaagagttactacacaatggggaa

SEQ ID NO: 842 - DNA, 25 bp, Homo sapien
aaaagagttacttcacaatggggaa

SEQ ID NO: 843 - DNA, 25 bp, Homo sapien
aaaagataaacagctgaagaatctg

SEQ ID NO: 844 - DNA, 25 bp, Homo sapien
aaaagataaacagttgaagaatctg

SEQ ID NO: 845 - DNA, 25 bp, Homo sapien
aaaagataagccagtacatctctga

SEQ ID NO: 846 - DNA, 25 bp, Homo sapien
aaaagataggccagtacatctctga

SEQ ID NO: 847 - DNA, 25 bp, Homo sapien
aaaagatcatctataaaccgtaata

SEQ ID NO: 848 - DNA, 25 bp, Homo sapien
aaaagatcgtctataaaccgtaata

SEQ ID NO: 849 - DNA, 25 bp, Homo sapien
aaaagatctaaaaattgcaccatgt

SEQ ID NO: 850 - DNA, 25 bp, Homo sapien
aaaagatctaaacattgcaccatgt

SEQ ID NO: 851 - DNA, 25 bp, Homo sapien
aaaagatctgcaacgtctcaacagg

SEQ ID NO: 852 - DNA, 25 bp, Homo sapien
aaaagatctgcagcgtctcaacagg

SEQ ID NO: 853 - DNA, 25 bp, Homo sapien
aaaagatgctagaggagcatagagg

SEQ ID NO: 854 - DNA, 25 bp, Homo sapien
aaaagatggcaactcagcattgaat

SEQ ID NO: 855 - DNA, 25 bp, Homo sapien
aaaagatgggaactcagcattgaat

SEQ ID NO: 856 - DNA, 25 bp, Homo sapien
aaaagatgttagaggagcatagagg

SEQ ID NO: 857 - DNA, 25 bp, Homo sapien
aaaagatgtttcctgttgatagtac

SEQ ID NO: 858 - DNA, 25 bp, Homo sapien
aaaagatgttttctgttgatagtac

SEQ ID NO: 859 - DNA, 25 bp, Homo sapien
aaaagattacatttccatacaagaa

SEQ ID NO: 860 - DNA, 25 bp, Homo sapien
aaaagattacatttccgtacaagaa

SEQ ID NO: 861 - DNA, 25 bp, Homo sapien
aaaagattacgacacaacaacttga

SEQ ID NO: 862 - DNA, 25 bp, Homo sapien
aaaagattacgacacagcaacttga

SEQ ID NO: 863 - DNA, 25 bp, Homo sapien
aaaagattttccgacatgataatta

SEQ ID NO: 864 - DNA, 25 bp, Homo sapien
aaaagattttcggacatgataatta

SEQ ID NO: 865 - DNA, 25 bp, Homo sapien
aaaagcaaatggccatctggaccag

SEQ ID NO: 866 - DNA, 25 bp, Homo sapien
aaaagcaaatggccgtctggaccag

SEQ ID NO: 867 - DNA, 25 bp, Homo sapien
aaaagcaacataagcaacaaaagct

SEQ ID NO: 868 - DNA, 25 bp, Homo sapien
aaaagcaacggtaatgagccaaaaa

SEQ ID NO: 869 - DNA, 25 bp, Homo sapien
aaaagcaacgtaagcaacaaaagct

SEQ ID NO: 870 - DNA, 25 bp, Homo sapien
aaaagcaactgtaatgagccaaaaa

SEQ ID NO: 871 - DNA, 25 bp, Homo sapien
aaaagcaagaactacagagacagag

SEQ ID NO: 872 - DNA, 25 bp, Homo sapien
aaaagcaagaactccagagacagag

SEQ ID NO: 873 - DNA, 25 bp, Homo sapien
aaaagcacaccaatgtgaggtcatg

SEQ ID NO: 874 - DNA, 25 bp, Homo sapien
aaaagcacaccagtgtgaggtcatg

SEQ ID NO: 875 - DNA, 25 bp, Homo sapien
aaaagcacactgtctcattgttcca

SEQ ID NO: 876 - DNA, 25 bp, Homo sapien
aaaagcacactgtttcattgttcca

SEQ ID NO: 877 - DNA, 25 bp, Homo sapien
aaaagcacggttggctgtagccatc

SEQ ID NO: 878 - DNA, 25 bp, Homo sapien
aaaagcactaggaaaagtccaagtt

SEQ ID NO: 879 - DNA, 25 bp, Homo sapien
aaaagcactaggcaaagtccaagtt

SEQ ID NO: 880 - DNA, 25 bp, Homo sapien
aaaagcactgttggctgtagccatc

SEQ ID NO: 881 - DNA, 25 bp, Homo sapien
aaaagcacttatcatgagatctata

SEQ ID NO: 882 - DNA, 25 bp, Homo sapien
aaaagcacttatgatgagatctata

SEQ ID NO: 883 - DNA, 25 bp, Homo sapien
aaaagcagactcgcagcacaatgct

SEQ ID NO: 884 - DNA, 25 bp, Homo sapien
aaaagcagattttactcaggaacta

SEQ ID NO: 885 - DNA, 25 bp, Homo sapien
aaaagcagattttattcaggaacta

SEQ ID NO: 886 - DNA, 25 bp, Homo sapien
aaaagcagcagacgtgagcttatat

SEQ ID NO: 887 - DNA, 25 bp, Homo sapien
aaaagcagcagatgtgagcttatat

SEQ ID NO: 888 - DNA, 25 bp, Homo sapien
aaaagcagcagcactgcaaacatag

SEQ ID NO: 889 - DNA, 25 bp, Homo sapien
aaaagcagcagcattgcaaacatag

SEQ ID NO: 890 - DNA, 25 bp, Homo sapien
aaaagcaggctcgcagcacaatgct

SEQ ID NO: 891 - DNA, 25 bp, Homo sapien
aaaagcatagtatcgtcattaataa

SEQ ID NO: 892 - DNA, 25 bp, Homo sapien
aaaagcatagtattgtcattaataa

SEQ ID NO: 893 - DNA, 25 bp, Homo sapien
aaaagcatctgacaattggcctaac

SEQ ID NO: 894 - DNA, 25 bp, Homo sapien
aaaagcatctgacagttggcctaac

SEQ ID NO: 895 - DNA, 25 bp, Homo sapien
aaaagcatgatattagtacaaagac

SEQ ID NO: 896 - DNA, 25 bp, Homo sapien
aaaagcatggtattagtacaaagac

SEQ ID NO: 897 - DNA, 25 bp, Homo sapien
aaaagcattcaatatcattgttcat

SEQ ID NO: 898 - DNA, 25 bp, Homo sapien
aaaagcattcaatatcgttgttcat

SEQ ID NO: 899 - DNA, 25 bp, Homo sapien
aaaagccaaatatccaggttcctct

SEQ ID NO: 900 - DNA, 25 bp, Homo sapien
aaaagccacctcacttcctggcatg

SEQ ID NO: 901 - DNA, 25 bp, Homo sapien
aaaagccacctcatttcctggcatg

SEQ ID NO: 902 - DNA, 25 bp, Homo sapien
aaaagccacgacatagaacaaccag

SEQ ID NO: 903 - DNA, 25 bp, Homo sapien
aaaagccagaggatggctcccacta

SEQ ID NO: 904 - DNA, 25 bp, Homo sapien
aaaagccagaggatggttcccacta

SEQ ID NO: 905 - DNA, 25 bp, Homo sapien
aaaagccagatatccaggttcctct

SEQ ID NO: 906 - DNA, 25 bp, Homo sapien
aaaagccagcgatggtgcaacaccc

SEQ ID NO: 907 - DNA, 25 bp, Homo sapien
aaaagccagggatggtgcaacaccc

SEQ ID NO: 908 - DNA, 25 bp, Homo sapien
aaaagccatgacatagaacaaccag

SEQ ID NO: 909 - DNA, 25 bp, Homo sapien
aaaagccattcgtcagacagtgtca

SEQ ID NO: 910 - DNA, 25 bp, Homo sapien
aaaagccattcgtcggacagtgtca

SEQ ID NO: 911 - DNA, 25 bp, Homo sapien
aaaagccattgcaaaatttgaaacc

SEQ ID NO: 912 - DNA, 25 bp, Homo sapien
aaaagccattgtaaaatttgaaacc

SEQ ID NO: 913 - DNA, 25 bp, Homo sapien
aaaagcccaatttaactatggaagg

SEQ ID NO: 914 - DNA, 25 bp, Homo sapien
aaaagcccaatttagctatggaagg

SEQ ID NO: 915 - DNA, 25 bp, Homo sapien
aaaagcccagacattttaatgccta

SEQ ID NO: 916 - DNA, 25 bp, Homo sapien
aaaagcccggacattttaatgccta

SEQ ID NO: 917 - DNA, 25 bp, Homo sapien
aaaagcctagtctcaacacatgagg

SEQ ID NO: 918 - DNA, 25 bp, Homo sapien
aaaagcctagtcttaacacatgagg

SEQ ID NO: 919 - DNA, 25 bp, Homo sapien
aaaagcctgcttgatactctacccc

SEQ ID NO: 920 - DNA, 25 bp, Homo sapien
aaaagcctgcttggtactctacccc

SEQ ID NO: 921 - DNA, 25 bp, Homo sapien
aaaagcgaagaataaggcaccactc

SEQ ID NO: 922 - DNA, 25 bp, Homo sapien
aaaagcgaagtgaaaagaatgcatt

SEQ ID NO: 923 - DNA, 25 bp, Homo sapien
aaaagcgaagtgaaaataatgcatt

SEQ ID NO: 924 - DNA, 25 bp, Homo sapien
aaaagcgaggaataaggcaccactc

SEQ ID NO: 925 - DNA, 25 bp, Homo sapien
aaaagcgaggagataaaatgccctg

SEQ ID NO: 926 - DNA, 25 bp, Homo sapien
aaaagcgaggaggtaaaatgccctg

SEQ ID NO: 927 - DNA, 25 bp, Homo sapien
aaaagctatattcctacatttcatt

SEQ ID NO: 928 - DNA, 25 bp, Homo sapien
aaaagctatatttctacatttcatt

SEQ ID NO: 929 - DNA, 25 bp, Homo sapien
aaaagctattcatctgaaaacttga

SEQ ID NO: 930 - DNA, 25 bp, Homo sapien
aaaagctattcatttgaaaacttga

SEQ ID NO: 931 - DNA, 25 bp, Homo sapien
aaaagctcactgtacaatcaggacg

SEQ ID NO: 932 - DNA, 25 bp, Homo sapien
aaaagctcactgtataatcaggacg

SEQ ID NO: 933 - DNA, 25 bp, Homo sapien
aaaagctgaagtagtaattcaacac

SEQ ID NO: 934 - DNA, 25 bp, Homo sapien
aaaagctgaagttgtaattcaacac

SEQ ID NO: 935 - DNA, 25 bp, Homo sapien
aaaagctgcaacataaccatatcag

SEQ ID NO: 936 - DNA, 25 bp, Homo sapien
aaaagctgcaatataaccatatcag

SEQ ID NO: 937 - DNA, 25 bp, Homo sapien
aaaagctgcaggaccttgaattaac

SEQ ID NO: 938 - DNA, 25 bp, Homo sapien
aaaagctgcgggaccttgaattaac

SEQ ID NO: 939 - DNA, 25 bp, Homo sapien
aaaagcttcataatagtttctccat

SEQ ID NO: 940 - DNA, 25 bp, Homo sapien
aaaagcttcatagtagtttctccat

SEQ ID NO: 941 - DNA, 25 bp, Homo sapien
aaaaggaaaagagaaaaagatgagt

SEQ ID NO: 942 - DNA, 25 bp, Homo sapien
aaaaggaaaagagaaagagatgagt

SEQ ID NO: 943 - DNA, 25 bp, Homo sapien
aaaaggaaaaggcttaaatgcccta

SEQ ID NO: 944 - DNA, 25 bp, Homo sapien
aaaaggaaaagtcttaaatgcccta

SEQ ID NO: 945 - DNA, 25 bp, Homo sapien
aaaaggaagggacgagaccaaaaag

SEQ ID NO: 946 - DNA, 25 bp, Homo sapien
aaaaggaagggatgagaccaaaaag

SEQ ID NO: 947 - DNA, 25 bp, Homo sapien
aaaaggaataaatacctatcaaagt

SEQ ID NO: 948 - DNA, 25 bp, Homo sapien
aaaaggaataagtacctatcaaagt

SEQ ID NO: 949 - DNA, 25 bp, Homo sapien
aaaaggaatgcatatacactatcaa

SEQ ID NO: 950 - DNA, 25 bp, Homo sapien
aaaaggaatgcatgtacactatcaa

SEQ ID NO: 951 - DNA, 25 bp, Homo sapien
aaaaggaattataaaaacagtcata

SEQ ID NO: 952 - DNA, 25 bp, Homo sapien
aaaaggaattataagaacagtcata

SEQ ID NO: 953 - DNA, 25 bp, Homo sapien
aaaaggaatttcactgtgttcagag

SEQ ID NO: 954 - DNA, 25 bp, Homo sapien
aaaaggaatttcattgtgttcagag

SEQ ID NO: 955 - DNA, 25 bp, Homo sapien
aaaaggacaaaaagaactgtaaagg

SEQ ID NO: 956 - DNA, 25 bp, Homo sapien
aaaaggacaaaaagaattgtaaagg

SEQ ID NO: 957 - DNA, 25 bp, Homo sapien
aaaaggagaataatgtggagaaaaa

SEQ ID NO: 958 - DNA, 25 bp, Homo sapien
aaaaggagaatattgtggagaaaaa

SEQ ID NO: 959 - DNA, 25 bp, Homo sapien
aaaaggagacaaaaatagagctgtt

SEQ ID NO: 960 - DNA, 25 bp, Homo sapien
aaaaggagacaacaatagagctgtt

SEQ ID NO: 961 - DNA, 25 bp, Homo sapien
aaaaggagactacatgaggttttga

SEQ ID NO: 962 - DNA, 25 bp, Homo sapien
aaaaggagattacatgaggttttga

SEQ ID NO: 963 - DNA, 25 bp, Homo sapien
aaaaggagggactcgccacttcttc

SEQ ID NO: 964 - DNA, 25 bp, Homo sapien
aaaaggagggacttgccacttcttc

SEQ ID NO: 965 - DNA, 25 bp, Homo sapien
aaaaggagtttcatgagatacaata

SEQ ID NO: 966 - DNA, 25 bp, Homo sapien
aaaaggagtttccctcaaacagcag

SEQ ID NO: 967 - DNA, 25 bp, Homo sapien
aaaaggagtttctctcaaacagcag

SEQ ID NO: 968 - DNA, 25 bp, Homo sapien
aaaaggagtttcttgagatacaata

SEQ ID NO: 969 - DNA, 25 bp, Homo sapien
aaaaggatacgcactggctttttct

SEQ ID NO: 970 - DNA, 25 bp, Homo sapien
aaaaggatatgcactggctttttct

SEQ ID NO: 971 - DNA, 25 bp, Homo sapien
aaaaggattcgatacactagtcaga

SEQ ID NO: 972 - DNA, 25 bp, Homo sapien
aaaaggatttgatacactagtcaga

SEQ ID NO: 973 - DNA, 25 bp, Homo sapien
aaaaggcaagcagacatatattatt

SEQ ID NO: 974 - DNA, 25 bp, Homo sapien
aaaaggcaagcagtcatatattatt

SEQ ID NO: 975 - DNA, 25 bp, Homo sapien
aaaaggcatgatatatctgtctact

SEQ ID NO: 976 - DNA, 25 bp, Homo sapien
aaaaggcatgatatatttgtctact

SEQ ID NO: 977 - DNA, 25 bp, Homo sapien
aaaaggcccttagagactcaatgcc

SEQ ID NO: 978 - DNA, 25 bp, Homo sapien
aaaaggcctttagagactcaatgcc

SEQ ID NO: 979 - DNA, 25 bp, Homo sapien
aaaaggcgaatccgatcatgtggtt

SEQ ID NO: 980 - DNA, 25 bp, Homo sapien
aaaaggcgaatctgatcatgtggtt

SEQ ID NO: 981 - DNA, 25 bp, Homo sapien
aaaaggctccatggaccctaagcag

SEQ ID NO: 982 - DNA, 25 bp, Homo sapien
aaaaggctctagctattattaacag

SEQ ID NO: 983 - DNA, 25 bp, Homo sapien
aaaaggctctaggtattattaacag

SEQ ID NO: 984 - DNA, 25 bp, Homo sapien
aaaaggcttcatggaccctaagcag

SEQ ID NO: 985 - DNA, 25 bp, Homo sapien
aaaagggaaaaattaaagcataact

SEQ ID NO: 986 - DNA, 25 bp, Homo sapien
aaaagggaaaatttaaagcataact

SEQ ID NO: 987 - DNA, 25 bp, Homo sapien
aaaagggaagaatttagactcatag

SEQ ID NO: 988 - DNA, 25 bp, Homo sapien
aaaagggaagaatttatactcatag

SEQ ID NO: 989 - DNA, 25 bp, Homo sapien
aaaagggaagtcattatccactcct

SEQ ID NO: 990 - DNA, 25 bp, Homo sapien
aaaagggaagttattatccactcct

SEQ ID NO: 991 - DNA, 25 bp, Homo sapien
aaaagggcctgacaaatgatgccct

SEQ ID NO: 992 - DNA, 25 bp, Homo sapien
aaaagggcttgacaaatgatgccct

SEQ ID NO: 993 - DNA, 25 bp, Homo sapien
aaaagggggaacagccatgtcttct

SEQ ID NO: 994 - DNA, 25 bp, Homo sapien
aaaagggggaacagccgtgtcttct

SEQ ID NO: 995 - DNA, 25 bp, Homo sapien
aaaagggttaaatggtgactaatcg

SEQ ID NO: 996 - DNA, 25 bp, Homo sapien
aaaagggttaaattgtgactaatcg

SEQ ID NO: 997 - DNA, 25 bp, Homo sapien
aaaaggtcaaaaagctaaatacagg

SEQ ID NO: 998 - DNA, 25 bp, Homo sapien
aaaaggtcacaaagctaaatacagg

SEQ ID NO: 999 - DNA, 25 bp, Homo sapien
aaaaggtgaacctcgcatattctta

SEQ ID NO: 1000 - DNA, 25 bp, Homo sapien
aaaaggtgaaccttgcatattctta

SEQ ID NO: 1001 - DNA, 25 bp, Homo sapien
aaaaggtgaagactacagtttacac

SEQ ID NO: 1002 - DNA, 25 bp, Homo sapien
aaaaggtgaagactacggtttacac

SEQ ID NO: 1003 - DNA, 25 bp, Homo sapien
aaaaggttatatgacgatttgcaga

SEQ ID NO: 1004 - DNA, 25 bp, Homo sapien
aaaaggttatatgatgatttgcaga

SEQ ID NO: 1005 - DNA, 25 bp, Homo sapien
aaaagtaagaggatgccaaaaatga

SEQ ID NO: 1006 - DNA, 25 bp, Homo sapien
aaaagtaagagggtgccaaaaatga

SEQ ID NO: 1007 - DNA, 25 bp, Homo sapien
aaaagtacaaaagaaaagagagata

SEQ ID NO: 1008 - DNA, 25 bp, Homo sapien
aaaagtacaaaaggaaagagagata

SEQ ID NO: 1009 - DNA, 25 bp, Homo sapien
aaaagtacataggttaatgacaagt

SEQ ID NO: 1010 - DNA, 25 bp, Homo sapien
aaaagtacatagtttaatgacaagt

SEQ ID NO: 1011 - DNA, 25 bp, Homo sapien
aaaagtagaactaataagtggaaag

SEQ ID NO: 1012 - DNA, 25 bp, Homo sapien
aaaagtagacctaataagtggaaag

SEQ ID NO: 1013 - DNA, 25 bp, Homo sapien
aaaagtaggttatacaatggaaaac

SEQ ID NO: 1014 - DNA, 25 bp, Homo sapien
aaaagtaggttatacagtggaaaac

SEQ ID NO: 1015 - DNA, 25 bp, Homo sapien
aaaagtagtctctacaaacacaggg

SEQ ID NO: 1016 - DNA, 25 bp, Homo sapien
aaaagtagtctctataaacacaggg

SEQ ID NO: 1017 - DNA, 25 bp, Homo sapien
aaaagtatccttgcagttttcctta

SEQ ID NO: 1018 - DNA, 25 bp, Homo sapien
aaaagtatctttgcagttttcctta

SEQ ID NO: 1019 - DNA, 25 bp, Homo sapien
aaaagtattcttttcaatatgtcag

SEQ ID NO: 1020 - DNA, 25 bp, Homo sapien
aaaagtattcttttcagtatgtcag

SEQ ID NO: 1021 - DNA, 25 bp, Homo sapien
aaaagtatttaatagcaattacgtg

SEQ ID NO: 1022 - DNA, 25 bp, Homo sapien
aaaagtatttagtagcaattacgtg

SEQ ID NO: 1023 - DNA, 25 bp, Homo sapien
aaaagtcaaaaatttaccatcctgg

SEQ ID NO: 1024 - DNA, 25 bp, Homo sapien
aaaagtcaaaagtttaccatcctgg

SEQ ID NO: 1025 - DNA, 25 bp, Homo sapien
aaaagtcaagtgctgaatgggagaa

SEQ ID NO: 1026 - DNA, 25 bp, Homo sapien
aaaagtcagagtttgccgcccaaaa

SEQ ID NO: 1027 - DNA, 25 bp, Homo sapien
aaaagtcagagtttgctgcccaaaa

SEQ ID NO: 1028 - DNA, 25 bp, Homo sapien
aaaagtcaggcaggttttcttgcag

SEQ ID NO: 1029 - DNA, 25 bp, Homo sapien
aaaagtcaggtgctgaatgggagaa

SEQ ID NO: 1030 - DNA, 25 bp, Homo sapien
aaaagtcagtcaggttttcttgcag

SEQ ID NO: 1031 - DNA, 25 bp, Homo sapien
aaaagtcatagatctaaataaatgg

SEQ ID NO: 1032 - DNA, 25 bp, Homo sapien
aaaagtcatagatttaaataaatgg

SEQ ID NO: 1033 - DNA, 25 bp, Homo sapien
aaaagtcattgctagagaggcttta

SEQ ID NO: 1034 - DNA, 25 bp, Homo sapien
aaaagtcattgctggagaggcttta

SEQ ID NO: 1035 - DNA, 25 bp, Homo sapien
aaaagtcatttccacttaaaaaaat

SEQ ID NO: 1036 - DNA, 25 bp, Homo sapien
aaaagtcatttccagttaaaaaaat

SEQ ID NO: 1037 - DNA, 25 bp, Homo sapien
aaaagtccagtcaagtcacttgtgt

SEQ ID NO: 1038 - DNA, 25 bp, Homo sapien
aaaagtcccacatgtcctcattatt

SEQ ID NO: 1039 - DNA, 25 bp, Homo sapien
aaaagtcccgcatgtcctcattatt

SEQ ID NO: 1040 - DNA, 25 bp, Homo sapien
aaaagtccggtcaagtcacttgtgt

SEQ ID NO: 1041 - DNA, 25 bp, Homo sapien
aaaagtcctatataacatcttccaa

SEQ ID NO: 1042 - DNA, 25 bp, Homo sapien
aaaagtcctatataacgtcttccaa

SEQ ID NO: 1043 - DNA, 25 bp, Homo sapien
aaaagtctactaaaaattcagtgaa

SEQ ID NO: 1044 - DNA, 25 bp, Homo sapien
aaaagtctactaagaattcagtgaa

SEQ ID NO: 1045 - DNA, 25 bp, Homo sapien
aaaagtctactcgtggtccctgaaa

SEQ ID NO: 1046 - DNA, 25 bp, Homo sapien
aaaagtctactcgttgtccctgaaa

SEQ ID NO: 1047 - DNA, 25 bp, Homo sapien
aaaagtctcagtgttttaggataca

SEQ ID NO: 1048 - DNA, 25 bp, Homo sapien
aaaagtctcggtgttttaggataca

SEQ ID NO: 1049 - DNA, 25 bp, Homo sapien
aaaagtctgactcaaaagcgcactg

SEQ ID NO: 1050 - DNA, 25 bp, Homo sapien
aaaagtctgactcaaaggcgcactg

SEQ ID NO: 1051 - DNA, 25 bp, Homo sapien
aaaagtctgcttgaaaacccatcaa

SEQ ID NO: 1052 - DNA, 25 bp, Homo sapien
aaaagtctgcttggaaacccatcaa

SEQ ID NO: 1053 - DNA, 25 bp, Homo sapien
aaaagtctgtatacgagtttaagtc

SEQ ID NO: 1054 - DNA, 25 bp, Homo sapien
aaaagtctgtatatgagtttaagtc

SEQ ID NO: 1055 - DNA, 25 bp, Homo sapien
aaaagtgaagtatatcaagcagaag

SEQ ID NO: 1056 - DNA, 25 bp, Homo sapien
aaaagtgaagtatatcgagcagaag

SEQ ID NO: 1057 - DNA, 25 bp, Homo sapien
aaaagtgaataatgactgactaaca

SEQ ID NO: 1058 - DNA, 25 bp, Homo sapien
aaaagtgactaatgactgactaaca

SEQ ID NO: 1059 - DNA, 25 bp, Homo sapien
aaaagtgcacgatttccatcagaga

SEQ ID NO: 1060 - DNA, 25 bp, Homo sapien
aaaagtgcatgatttccatcagaga

SEQ ID NO: 1061 - DNA, 25 bp, Homo sapien
aaaagtggatcataactggatgtcg

SEQ ID NO: 1062 - DNA, 25 bp, Homo sapien
aaaagtggatcgtaactggatgtcg

SEQ ID NO: 1063 - DNA, 25 bp, Homo sapien
aaaagtggcgacggtatgactcagg

SEQ ID NO: 1064 - DNA, 25 bp, Homo sapien
aaaagtggcgatggtatgactcagg

SEQ ID NO: 1065 - DNA, 25 bp, Homo sapien
aaaagtggctatcggccaggaatct

SEQ ID NO: 1066 - DNA, 25 bp, Homo sapien
aaaagtggctattggccaggaatct

SEQ ID NO: 1067 - DNA, 25 bp, Homo sapien
aaaagtggctgctgattggagtgag

SEQ ID NO: 1068 - DNA, 25 bp, Homo sapien
aaaagtggttgctgattggagtgag

SEQ ID NO: 1069 - DNA, 25 bp, Homo sapien
aaaagtgtgccttcacaataatggg

SEQ ID NO: 1070 - DNA, 25 bp, Homo sapien
aaaagtgtggcttcacaataatggg

SEQ ID NO: 1071 - DNA, 25 bp, Homo sapien
aaaagtgtggttcaactatgtgaga

SEQ ID NO: 1072 - DNA, 25 bp, Homo sapien
aaaagtgtggttcacctatgtgaga

SEQ ID NO: 1073 - DNA, 25 bp, Homo sapien
aaaagttaatgttgttggttctatt

SEQ ID NO: 1074 - DNA, 25 bp, Homo sapien
aaaagttaatgttgtttgttctatt

SEQ ID NO: 1075 - DNA, 25 bp, Homo sapien
aaaagttagctcattacagatttca

SEQ ID NO: 1076 - DNA, 25 bp, Homo sapien
aaaagttagctcgttacagatttca

SEQ ID NO: 1077 - DNA, 25 bp, Homo sapien
aaaagttattccaaaattgtataag

SEQ ID NO: 1078 - DNA, 25 bp, Homo sapien
aaaagttattccgaaattgtataag

SEQ ID NO: 1079 - DNA, 25 bp, Homo sapien
aaaagttccaagagagtgtaaaagc

SEQ ID NO: 1080 - DNA, 25 bp, Homo sapien
aaaagttccaagggagtgtaaaagc

SEQ ID NO: 1081 - DNA, 25 bp, Homo sapien
aaaagttgcccaaaatttgcatgtg

SEQ ID NO: 1082 - DNA, 25 bp, Homo sapien
aaaagttgcccagaatttgcatgtg

SEQ ID NO: 1083 - DNA, 25 bp, Homo sapien
aaaagttgcgatgatacaaaatgta

SEQ ID NO: 1084 - DNA, 25 bp, Homo sapien
aaaagttgtctcattctctccttat

SEQ ID NO: 1085 - DNA, 25 bp, Homo sapien
aaaagttgtctcgttctctccttat

SEQ ID NO: 1086 - DNA, 25 bp, Homo sapien
aaaagttgtgatgatacaaaatgta

SEQ ID NO: 1087 - DNA, 25 bp, Homo sapien
aaaagttgtgtaatcattgtgtttc

SEQ ID NO: 1088 - DNA, 25 bp, Homo sapien
aaaagttgtgtcatcattgtgtttc

SEQ ID NO: 1089 - DNA, 25 bp, Homo sapien
aaaagtttaagaacaaatgcataag

SEQ ID NO: 1090 - DNA, 25 bp, Homo sapien
aaaagtttaagatcaaatgcataag

SEQ ID NO: 1091 - DNA, 25 bp, Homo sapien
aaaagtttaagctgaatatgttgga

SEQ ID NO: 1092 - DNA, 25 bp, Homo sapien
aaaagtttaagctggatatgttgga

SEQ ID NO: 1093 - DNA, 25 bp, Homo sapien
aaaataaaacctttgtggtctaatt

SEQ ID NO: 1094 - DNA, 25 bp, Homo sapien
aaaataaaacgttagggtgaatgct

SEQ ID NO: 1095 - DNA, 25 bp, Homo sapien
aaaataaaatctttgtggtctaatt

SEQ ID NO: 1096 - DNA, 25 bp, Homo sapien
aaaataaaatgttagggtgaatgct

SEQ ID NO: 1097 - DNA, 25 bp, Homo sapien
aaaataaacatatatgccatgagtg

SEQ ID NO: 1098 - DNA, 25 bp, Homo sapien
aaaataaaccaaggaaagaaaggaa

SEQ ID NO: 1099 - DNA, 25 bp, Homo sapien
aaaataaacgtatatgccatgagtg

SEQ ID NO: 1100 - DNA, 25 bp, Homo sapien
aaaataaagagctgatttctgaaac

SEQ ID NO: 1101 - DNA, 25 bp, Homo sapien
aaaataaagagctgctttctgaaac

SEQ ID NO: 1102 - DNA, 25 bp, Homo sapien
aaaataaagcaaggaaagaaaggaa

SEQ ID NO: 1103 - DNA, 25 bp, Homo sapien
aaaataaaggaagttggtaagagat

SEQ ID NO: 1104 - DNA, 25 bp, Homo sapien
aaaataaaggaatttggtaagagat

SEQ ID NO: 1105 - DNA, 25 bp, Homo sapien
aaaataaataactgaagaaatttct

SEQ ID NO: 1106 - DNA, 25 bp, Homo sapien
aaaataaatcactgaagaaatttct

SEQ ID NO: 1107 - DNA, 25 bp, Homo sapien
aaaataaatgatccctaaggagaac

SEQ ID NO: 1108 - DNA, 25 bp, Homo sapien
aaaataaatgattcctaaggagaac

SEQ ID NO: 1109 - DNA, 25 bp, Homo sapien
aaaataacatcgcaggaaactactt

SEQ ID NO: 1110 - DNA, 25 bp, Homo sapien
aaaataacatcgcgggaaactactt

SEQ ID NO: 1111 - DNA, 25 bp, Homo sapien
aaaataactacatgcacatactggt

SEQ ID NO: 1112 - DNA, 25 bp, Homo sapien
aaaataactacattcacatactggt

SEQ ID NO: 1113 - DNA, 25 bp, Homo sapien
aaaataacttacaaaaattgagaaa

SEQ ID NO: 1114 - DNA, 25 bp, Homo sapien
aaaataacttacagaaattgagaaa

SEQ ID NO: 1115 - DNA, 25 bp, Homo sapien
aaaataacttaggaccaaagctgga

SEQ ID NO: 1116 - DNA, 25 bp, Homo sapien
aaaataacttagggccaaagctgga

SEQ ID NO: 1117 - DNA, 25 bp, Homo sapien
aaaataagcaagttaccaaagcttc

SEQ ID NO: 1118 - DNA, 25 bp, Homo sapien
aaaataagcacgtcctgtgtgattg

SEQ ID NO: 1119 - DNA, 25 bp, Homo sapien
aaaataagcgagttaccaaagcttc

SEQ ID NO: 1120 - DNA, 25 bp, Homo sapien
aaaataagcgcgtcctgtgtgattg

SEQ ID NO: 1121 - DNA, 25 bp, Homo sapien
aaaataaggcaagtgttcaaaagca

SEQ ID NO: 1122 - DNA, 25 bp, Homo sapien
aaaataaggggacatgatggattat

SEQ ID NO: 1123 - DNA, 25 bp, Homo sapien
aaaataaggggagatgatggattat

SEQ ID NO: 1124 - DNA, 25 bp, Homo sapien
aaaataaggtaagtgttcaaaagca

SEQ ID NO: 1125 - DNA, 25 bp, Homo sapien
aaaataataagcagtaaagatggaa

SEQ ID NO: 1126 - DNA, 25 bp, Homo sapien
aaaataataagcagtacagatggaa

SEQ ID NO: 1127 - DNA, 25 bp, Homo sapien
aaaataatatagatggacgaagggg

SEQ ID NO: 1128 - DNA, 25 bp, Homo sapien
aaaataatatagattgacgaagggg

SEQ ID NO: 1129 - DNA, 25 bp, Homo sapien
aaaataatgctacagatcccttaga

SEQ ID NO: 1130 - DNA, 25 bp, Homo sapien
aaaataatgctagagatcccttaga

SEQ ID NO: 1131 - DNA, 25 bp, Homo sapien
aaaataatgtcctggaatttgttag

SEQ ID NO: 1132 - DNA, 25 bp, Homo sapien
aaaataatgtcttggaatttgttag

SEQ ID NO: 1133 - DNA, 25 bp, Homo sapien
aaaataatgttacggaagcacaggg

SEQ ID NO: 1134 - DNA, 25 bp, Homo sapien
aaaataatgttatggaagcacaggg

SEQ ID NO: 1135 - DNA, 25 bp, Homo sapien
aaaataattcagtaaatcatgctat

SEQ ID NO: 1136 - DNA, 25 bp, Homo sapien
aaaataattcagttaatcatgctat

SEQ ID NO: 1137 - DNA, 25 bp, Homo sapien
aaaataattctggatgatcccacaa

SEQ ID NO: 1138 - DNA, 25 bp, Homo sapien
aaaataattctggatgctcccacaa

SEQ ID NO: 1139 - DNA, 25 bp, Homo sapien
aaaataattgttctcatagagttcc

SEQ ID NO: 1140 - DNA, 25 bp, Homo sapien
aaaataattgttgtcatagagttcc

SEQ ID NO: 1141 - DNA, 25 bp, Homo sapien
aaaatacaaggacttgaaagtgatt

SEQ ID NO: 1142 - DNA, 25 bp, Homo sapien
aaaatacaaggtcttgaaagtgatt

SEQ ID NO: 1143 - DNA, 25 bp, Homo sapien
aaaatacactgtgtaagtccccatg

SEQ ID NO: 1144 - DNA, 25 bp, Homo sapien
aaaatacactgtttaagtccccatg

SEQ ID NO: 1145 - DNA, 25 bp, Homo sapien
aaaatacctgcgcaaatcgctatca

SEQ ID NO: 1146 - DNA, 25 bp, Homo sapien
aaaatacctgctcaaatcgctatca

SEQ ID NO: 1147 - DNA, 25 bp, Homo sapien
aaaatactataacacaatgataagg

SEQ ID NO: 1148 - DNA, 25 bp, Homo sapien
aaaatactcagatagctttactagt

SEQ ID NO: 1149 - DNA, 25 bp, Homo sapien
aaaatactcgaaaattgcatttgac

SEQ ID NO: 1150 - DNA, 25 bp, Homo sapien
aaaatactgagatagctttactagt

SEQ ID NO: 1151 - DNA, 25 bp, Homo sapien
aaaatactgtaacacaatgataagg

SEQ ID NO: 1152 - DNA, 25 bp, Homo sapien
aaaatacttgaaaattgcatttgac

SEQ ID NO: 1153 - DNA, 25 bp, Homo sapien
aaaatagaaagcgtaggttgattga

SEQ ID NO: 1154 - DNA, 25 bp, Homo sapien
aaaatagaaagggtaggttgattga

SEQ ID NO: 1155 - DNA, 25 bp, Homo sapien
aaaatagaacgatgaatgctaaaat

SEQ ID NO: 1156 - DNA, 25 bp, Homo sapien
aaaatagaatgatgaatgctaaaat

SEQ ID NO: 1157 - DNA, 25 bp, Homo sapien
aaaatagagataagacagaggaaat

SEQ ID NO: 1158 - DNA, 25 bp, Homo sapien
aaaatagagataagactgaggaaat

SEQ ID NO: 1159 - DNA, 25 bp, Homo sapien
aaaatagagctgatcaaagaagtgg

SEQ ID NO: 1160 - DNA, 25 bp, Homo sapien
aaaatagagctgatgaaagaagtgg

SEQ ID NO: 1161 - DNA, 25 bp, Homo sapien
aaaatagattcagcattaaaataca

SEQ ID NO: 1162 - DNA, 25 bp, Homo sapien
aaaatagattccgcattaaaataca

SEQ ID NO: 1163 - DNA, 25 bp, Homo sapien
aaaatagcacaaaacgctgaaaatt

SEQ ID NO: 1164 - DNA, 25 bp, Homo sapien
aaaatagcagaaaacgctgaaaatt

SEQ ID NO: 1165 - DNA, 25 bp, Homo sapien
aaaatagcagtcaaaaaaatcaaga

SEQ ID NO: 1166 - DNA, 25 bp, Homo sapien
aaaatagcagtccaaaaaatcaaga

SEQ ID NO: 1167 - DNA, 25 bp, Homo sapien
aaaataggataagtgtctcgatgag

SEQ ID NO: 1168 - DNA, 25 bp, Homo sapien
aaaataggatttgaatgtaagcatt

SEQ ID NO: 1169 - DNA, 25 bp, Homo sapien
aaaataggatttgagtgtaagcatt

SEQ ID NO: 1170 - DNA, 25 bp, Homo sapien
aaaataggcaacgcagattcaattc

SEQ ID NO: 1171 - DNA, 25 bp, Homo sapien
aaaataggcaatgcagattcaattc

SEQ ID NO: 1172 - DNA, 25 bp, Homo sapien
aaaataggttaagtgtctcgatgag

SEQ ID NO: 1173 - DNA, 25 bp, Homo sapien
aaaatagtatgtgtctcagaatgta

SEQ ID NO: 1174 - DNA, 25 bp, Homo sapien
aaaatagtatgtgtcttagaatgta

SEQ ID NO: 1175 - DNA, 25 bp, Homo sapien
aaaatagtcagtgccaattgaaaca

SEQ ID NO: 1176 - DNA, 25 bp, Homo sapien
aaaatagtcagtgccagttgaaaca

SEQ ID NO: 1177 - DNA, 25 bp, Homo sapien
aaaatagttcaaactacttagacgt

SEQ ID NO: 1178 - DNA, 25 bp, Homo sapien
aaaatagttcaacctacttagacgt

SEQ ID NO: 1179 - DNA, 25 bp, Homo sapien
aaaatagttctctaagttgctctcc

SEQ ID NO: 1180 - DNA, 25 bp, Homo sapien
aaaatagttggttcacccaaaattg

SEQ ID NO: 1181 - DNA, 25 bp, Homo sapien
aaaatagttggttcacgcaaaattg

SEQ ID NO: 1182 - DNA, 25 bp, Homo sapien
aaaatagttttctaagttgctctcc

SEQ ID NO: 1183 - DNA, 25 bp, Homo sapien
aaaatataaaacgtgatatgtaagt

SEQ ID NO: 1184 - DNA, 25 bp, Homo sapien
aaaatataaaatgtgatatgtaagt

SEQ ID NO: 1185 - DNA, 25 bp, Homo sapien
aaaatataatgtggcccacagcagc

SEQ ID NO: 1186 - DNA, 25 bp, Homo sapien
aaaatataatgtgtcccacagcagc

SEQ ID NO: 1187 - DNA, 25 bp, Homo sapien
aaaatatacctgattacatttttgc

SEQ ID NO: 1188 - DNA, 25 bp, Homo sapien
aaaatatacctgtttacatttttgc

SEQ ID NO: 1189 - DNA, 25 bp, Homo sapien
aaaatatacgctatcacaggaacac

SEQ ID NO: 1190 - DNA, 25 bp, Homo sapien
aaaatatacggttggaaggaagaaa

SEQ ID NO: 1191 - DNA, 25 bp, Homo sapien
aaaatatatgctatcacaggaacac

SEQ ID NO: 1192 - DNA, 25 bp, Homo sapien
aaaatatatggttggaaggaagaaa

SEQ ID NO: 1193 - DNA, 25 bp, Homo sapien
aaaatatcacacaaattccaattgg

SEQ ID NO: 1194 - DNA, 25 bp, Homo sapien
aaaatatcagacaaattccaattgg

SEQ ID NO: 1195 - DNA, 25 bp, Homo sapien
aaaatatgaacaaaaatatcctagt

SEQ ID NO: 1196 - DNA, 25 bp, Homo sapien
aaaatatgaacagaaatatcctagt

SEQ ID NO: 1197 - DNA, 25 bp, Homo sapien
aaaatatgaacccaatttgtggtag

SEQ ID NO: 1198 - DNA, 25 bp, Homo sapien
aaaatatgaacctaatttgtggtag

SEQ ID NO: 1199 - DNA, 25 bp, Homo sapien
aaaatatgaagcagccaccttacag

SEQ ID NO: 1200 - DNA, 25 bp, Homo sapien
aaaatatgaggcagccaccttacag

SEQ ID NO: 1201 - DNA, 25 bp, Homo sapien
aaaatatgcaaagaactcttacaag

SEQ ID NO: 1202 - DNA, 25 bp, Homo sapien
aaaatatgcaaataactcttacaag

SEQ ID NO: 1203 - DNA, 25 bp, Homo sapien
aaaatatgccgtgactagtcacaga

SEQ ID NO: 1204 - DNA, 25 bp, Homo sapien
aaaatatgcctgcacttcctagaag

SEQ ID NO: 1205 - DNA, 25 bp, Homo sapien
aaaatatgcctgcgcttcctagaag

SEQ ID NO: 1206 - DNA, 25 bp, Homo sapien
aaaatatgctgtgactagtcacaga

SEQ ID NO: 1207 - DNA, 25 bp, Homo sapien
aaaatatggaccaaaactcaggtgg

SEQ ID NO: 1208 - DNA, 25 bp, Homo sapien
aaaatatggctaaagagtatacaag

SEQ ID NO: 1209 - DNA, 25 bp, Homo sapien
aaaatatggctaaagattatacaag

SEQ ID NO: 1210 - DNA, 25 bp, Homo sapien
aaaatatgggccaaaactcaggtgg

SEQ ID NO: 1211 - DNA, 25 bp, Homo sapien
aaaatatgtcaaagaaatacacttt

SEQ ID NO: 1212 - DNA, 25 bp, Homo sapien
aaaatatgtcaaataaatacacttt

SEQ ID NO: 1213 - DNA, 25 bp, Homo sapien
aaaatatgtgattcctgccctgatt

SEQ ID NO: 1214 - DNA, 25 bp, Homo sapien
aaaatatgttattcctgccctgatt

SEQ ID NO: 1215 - DNA, 25 bp, Homo sapien
aaaatattaatcacaactagtttca

SEQ ID NO: 1216 - DNA, 25 bp, Homo sapien
aaaatattaatcacgactagtttca

SEQ ID NO: 1217 - DNA, 25 bp, Homo sapien
aaaatattaccaatgctactgataa

SEQ ID NO: 1218 - DNA, 25 bp, Homo sapien
aaaatattaccagtgctactgataa

SEQ ID NO: 1219 - DNA, 25 bp, Homo sapien
aaaatatttgaaaggaaagccagaa

SEQ ID NO: 1220 - DNA, 25 bp, Homo sapien
aaaatatttgaatggaaagccagaa

SEQ ID NO: 1221 - DNA, 25 bp, Homo sapien
aaaatattttacgtcctttgcatat

SEQ ID NO: 1222 - DNA, 25 bp, Homo sapien
aaaatattttatgtcctttgcatat

SEQ ID NO: 1223 - DNA, 25 bp, Homo sapien
aaaatattttcaaatgatgtggtat

SEQ ID NO: 1224 - DNA, 25 bp, Homo sapien
aaaatattttcaagtgatgtggtat

SEQ ID NO: 1225 - DNA, 25 bp, Homo sapien
aaaatcaaaacgttgaaatttagcg

SEQ ID NO: 1226 - DNA, 25 bp, Homo sapien
aaaatcaacagatagaaattgtcct

SEQ ID NO: 1227 - DNA, 25 bp, Homo sapien
aaaatcaacggatagaaattgtcct

SEQ ID NO: 1228 - DNA, 25 bp, Homo sapien
aaaatcaagacgttgaaatttagcg

SEQ ID NO: 1229 - DNA, 25 bp, Homo sapien
aaaatcacctgatgaagcatttata

SEQ ID NO: 1230 - DNA, 25 bp, Homo sapien
aaaatcacttgatgaagcatttata

SEQ ID NO: 1231 - DNA, 25 bp, Homo sapien
aaaatcaggatattggtggaactag

SEQ ID NO: 1232 - DNA, 25 bp, Homo sapien
aaaatcaggatatttgtggaactag

SEQ ID NO: 1233 - DNA, 25 bp, Homo sapien
aaaatcagtatgcctagcaatagga

SEQ ID NO: 1234 - DNA, 25 bp, Homo sapien
aaaatcagtatgtctagcaatagga

SEQ ID NO: 1235 - DNA, 25 bp, Homo sapien
aaaatcatcttcagacagctaatga

SEQ ID NO: 1236 - DNA, 25 bp, Homo sapien
aaaatcatgtccatttaatagcagt

SEQ ID NO: 1237 - DNA, 25 bp, Homo sapien
aaaatcatgtccgtttaatagcagt

SEQ ID NO: 1238 - DNA, 25 bp, Homo sapien
aaaatcattttcagacagctaatga

SEQ ID NO: 1239 - DNA, 25 bp, Homo sapien
aaaatccaaccaaccacaaaattcc

SEQ ID NO: 1240 - DNA, 25 bp, Homo sapien
aaaatccaaccaaccataaaattcc

SEQ ID NO: 1241 - DNA, 25 bp, Homo sapien
aaaatccaacttcctaaacaccagc

SEQ ID NO: 1242 - DNA, 25 bp, Homo sapien
aaaatccaagttcctaaacaccagc

SEQ ID NO: 1243 - DNA, 25 bp, Homo sapien
aaaatccacagatgttcaagccatt

SEQ ID NO: 1244 - DNA, 25 bp, Homo sapien
aaaatccacctaaccaagaaggctg

SEQ ID NO: 1245 - DNA, 25 bp, Homo sapien
aaaatccacctaagcaagaaggctg

SEQ ID NO: 1246 - DNA, 25 bp, Homo sapien
aaaatccacggatgttcaagccatt

SEQ ID NO: 1247 - DNA, 25 bp, Homo sapien
aaaatccacttaacttcctgaagac

SEQ ID NO: 1248 - DNA, 25 bp, Homo sapien
aaaatccacttcacttcctgaagac

SEQ ID NO: 1249 - DNA, 25 bp, Homo sapien
aaaatccataagtcatttaggagca

SEQ ID NO: 1250 - DNA, 25 bp, Homo sapien
aaaatccataagtcgtttaggagca

SEQ ID NO: 1251 - DNA, 25 bp, Homo sapien
aaaatccataggcccagtctaatca

SEQ ID NO: 1252 - DNA, 25 bp, Homo sapien
aaaatccatagtcccagtctaatca

SEQ ID NO: 1253 - DNA, 25 bp, Homo sapien
aaaatccatcaacttataatttaat

SEQ ID NO: 1254 - DNA, 25 bp, Homo sapien
aaaatccatcagcttataatttaat

SEQ ID NO: 1255 - DNA, 25 bp, Homo sapien
aaaatccatgtaaaagtgaatctat

SEQ ID NO: 1256 - DNA, 25 bp, Homo sapien
aaaatccatgtacaagtgaatctat

SEQ ID NO: 1257 - DNA, 25 bp, Homo sapien
aaaatcctgattcacttagctttgg

SEQ ID NO: 1258 - DNA, 25 bp, Homo sapien
aaaatcctgattcgcttagctttgg

SEQ ID NO: 1259 - DNA, 25 bp, Homo sapien
aaaatcgaatgtagctctgattgcc

SEQ ID NO: 1260 - DNA, 25 bp, Homo sapien
aaaatcgagtgtagctctgattgcc

SEQ ID NO: 1261 - DNA, 25 bp, Homo sapien
aaaatcgtataccctgtgatgaaaa

SEQ ID NO: 1262 - DNA, 25 bp, Homo sapien
aaaatcgtataccttgtgatgaaaa

SEQ ID NO: 1263 - DNA, 25 bp, Homo sapien
aaaatctacaaattgcccagggaag

SEQ ID NO: 1264 - DNA, 25 bp, Homo sapien
aaaatctacaaattgctcagggaag

SEQ ID NO: 1265 - DNA, 25 bp, Homo sapien
aaaatctagcatcgctttatgataa

SEQ ID NO: 1266 - DNA, 25 bp, Homo sapien
aaaatctagcatggctttatgataa

SEQ ID NO: 1267 - DNA, 25 bp, Homo sapien
aaaatctaggaaaaaaagaacacaa

SEQ ID NO: 1268 - DNA, 25 bp, Homo sapien
aaaatctaggaaaaaaggaacacaa

SEQ ID NO: 1269 - DNA, 25 bp, Homo sapien
aaaatctatcccatgctctatcttt

SEQ ID NO: 1270 - DNA, 25 bp, Homo sapien
aaaatctattccatgctctatcttt

SEQ ID NO: 1271 - DNA, 25 bp, Homo sapien
aaaatctccttgctgaatcctcgat

SEQ ID NO: 1272 - DNA, 25 bp, Homo sapien
aaaatctccttgttgaatcctcgat

SEQ ID NO: 1273 - DNA, 25 bp, Homo sapien
aaaatctctgccctcgtcgatctta

SEQ ID NO: 1274 - DNA, 25 bp, Homo sapien
aaaatctctgccttcgtcgatctta

SEQ ID NO: 1275 - DNA, 25 bp, Homo sapien
aaaatctggataatctccccatcac

SEQ ID NO: 1276 - DNA, 25 bp, Homo sapien
aaaatctggatagtctccccatcac

SEQ ID NO: 1277 - DNA, 25 bp, Homo sapien
aaaatctgtacaatgtgttacccaa

SEQ ID NO: 1278 - DNA, 25 bp, Homo sapien
aaaatctgtacagtgtgttacccaa

SEQ ID NO: 1279 - DNA, 25 bp, Homo sapien
aaaatcttgacagaaaaacctcaca

SEQ ID NO: 1280 - DNA, 25 bp, Homo sapien
aaaatcttgacaggaaaacctcaca

SEQ ID NO: 1281 - DNA, 25 bp, Homo sapien
aaaatcttgatatgctaaatgagta

SEQ ID NO: 1282 - DNA, 25 bp, Homo sapien
aaaatcttgctcttaaacctaaatc

SEQ ID NO: 1283 - DNA, 25 bp, Homo sapien
aaaatcttgctcttaagcctaaatc

SEQ ID NO: 1284 - DNA, 25 bp, Homo sapien
aaaatcttggtatgctaaatgagta

SEQ ID NO: 1285 - DNA, 25 bp, Homo sapien
aaaatgaacgaatgtgccttgaaag

SEQ ID NO: 1286 - DNA, 25 bp, Homo sapien
aaaatgaatataagtgtggtatggg

SEQ ID NO: 1287 - DNA, 25 bp, Homo sapien
aaaatgaatgaatgtgccttgaaag

SEQ ID NO: 1288 - DNA, 25 bp, Homo sapien
aaaatgaatgacaaaataaggaata

SEQ ID NO: 1289 - DNA, 25 bp, Homo sapien
aaaatgaatgagaaaataaggaata

SEQ ID NO: 1290 - DNA, 25 bp, Homo sapien
aaaatgaatgtaagtgtggtatggg

SEQ ID NO: 1291 - DNA, 25 bp, Homo sapien
aaaatgacactcgggtgattacaaa

SEQ ID NO: 1292 - DNA, 25 bp, Homo sapien
aaaatgacactctggtgattacaaa

SEQ ID NO: 1293 - DNA, 25 bp, Homo sapien
aaaatgaccagttcttcctaagtct

SEQ ID NO: 1294 - DNA, 25 bp, Homo sapien
aaaatgaccagttctttctaagtct

SEQ ID NO: 1295 - DNA, 25 bp, Homo sapien
aaaatgaccgtgaaaggagatttca

SEQ ID NO: 1296 - DNA, 25 bp, Homo sapien
aaaatgaccttcagctcccagttcc

SEQ ID NO: 1297 - DNA, 25 bp, Homo sapien
aaaatgaccttcagcttccagttcc

SEQ ID NO: 1298 - DNA, 25 bp, Homo sapien
aaaatgacggtgaaaggagatttca

SEQ ID NO: 1299 - DNA, 25 bp, Homo sapien
aaaatgagagatgctggttttaagt

SEQ ID NO: 1300 - DNA, 25 bp, Homo sapien
aaaatgagagatgttggttttaagt

SEQ ID NO: 1301 - DNA, 25 bp, Homo sapien
aaaatgagcattttcttttgccaaa

SEQ ID NO: 1302 - DNA, 25 bp, Homo sapien
aaaatgagcattttgttttgccaaa

SEQ ID NO: 1303 - DNA, 25 bp, Homo sapien
aaaatgaggacagaaactgtgattt

SEQ ID NO: 1304 - DNA, 25 bp, Homo sapien
aaaatgaggacatgtcaaaatcaca

SEQ ID NO: 1305 - DNA, 25 bp, Homo sapien
aaaatgaggacatgtcgaaatcaca

SEQ ID NO: 1306 - DNA, 25 bp, Homo sapien
aaaatgagggcagaaactgtgattt

SEQ ID NO: 1307 - DNA, 25 bp, Homo sapien
aaaatgatcagataatatttctgtc

SEQ ID NO: 1308 - DNA, 25 bp, Homo sapien
aaaatgatccgataatatttctgtc

SEQ ID NO: 1309 - DNA, 25 bp, Homo sapien
aaaatgatcgtttaaatttagtttt

SEQ ID NO: 1310 - DNA, 25 bp, Homo sapien
aaaatgatctttatgtgactctttt

SEQ ID NO: 1311 - DNA, 25 bp, Homo sapien
aaaatgatctttgtgtgactctttt

SEQ ID NO: 1312 - DNA, 25 bp, Homo sapien
aaaatgatggcaaataaggcaatat

SEQ ID NO: 1313 - DNA, 25 bp, Homo sapien
aaaatgatgtcaaataaggcaatat

SEQ ID NO: 1314 - DNA, 25 bp, Homo sapien
aaaatgattgttacagccaatgaac

SEQ ID NO: 1315 - DNA, 25 bp, Homo sapien
aaaatgattgttatagccaatgaac

SEQ ID NO: 1316 - DNA, 25 bp, Homo sapien
aaaatgattgtttaaatttagtttt

SEQ ID NO: 1317 - DNA, 25 bp, Homo sapien
aaaatgcaaataccccaaagcacat

SEQ ID NO: 1318 - DNA, 25 bp, Homo sapien
aaaatgcaaatactatcatcgtaaa

SEQ ID NO: 1319 - DNA, 25 bp, Homo sapien
aaaatgcaaatatcccaaagcacat

SEQ ID NO: 1320 - DNA, 25 bp, Homo sapien
aaaatgcaaatattatcatcgtaaa

SEQ ID NO: 1321 - DNA, 25 bp, Homo sapien
aaaatgcagctactgagagagatgc

SEQ ID NO: 1322 - DNA, 25 bp, Homo sapien
aaaatgcagctattgagagagatgc

SEQ ID NO: 1323 - DNA, 25 bp, Homo sapien
aaaatgcaggaaacgctgaggcttt

SEQ ID NO: 1324 - DNA, 25 bp, Homo sapien
aaaatgcaggaaatgctgaggcttt

SEQ ID NO: 1325 - DNA, 25 bp, Homo sapien
aaaatgcagtatgcacaaagggcaa

SEQ ID NO: 1326 - DNA, 25 bp, Homo sapien
aaaatgcagtatgcacgaagggcaa

SEQ ID NO: 1327 - DNA, 25 bp, Homo sapien
aaaatgccaactgacttgtgttttt

SEQ ID NO: 1328 - DNA, 25 bp, Homo sapien
aaaatgccagctgacttgtgttttt

SEQ ID NO: 1329 - DNA, 25 bp, Homo sapien
aaaatgccatcccattctcttctga

SEQ ID NO: 1330 - DNA, 25 bp, Homo sapien
aaaatgccatcccattgtcttctga

SEQ ID NO: 1331 - DNA, 25 bp, Homo sapien
aaaatgcctagcaaaatgtacgtac

SEQ ID NO: 1332 - DNA, 25 bp, Homo sapien
aaaatgcctaggaaaatgtacgtac

SEQ ID NO: 1333 - DNA, 25 bp, Homo sapien
aaaatgctctaatctgaaagaaaaa

SEQ ID NO: 1334 - DNA, 25 bp, Homo sapien
aaaatgctctaatttgaaagaaaaa

SEQ ID NO: 1335 - DNA, 25 bp, Homo sapien
aaaatgctgagaatgtaaaatactg

SEQ ID NO: 1336 - DNA, 25 bp, Homo sapien
aaaatgctgagagtgtaaaatactg

SEQ ID NO: 1337 - DNA, 25 bp, Homo sapien
aaaatgctgataatcatgcaaggct

SEQ ID NO: 1338 - DNA, 25 bp, Homo sapien
aaaatgctgatgatcatgcaaggct

SEQ ID NO: 1339 - DNA, 25 bp, Homo sapien
aaaatggaaaaacctggacaaataa

SEQ ID NO: 1340 - DNA, 25 bp, Homo sapien
aaaatggaccacgcagtgttggagc

SEQ ID NO: 1341 - DNA, 25 bp, Homo sapien
aaaatggaccatgcagtgttggagc

SEQ ID NO: 1342 - DNA, 25 bp, Homo sapien
aaaatggagaaacctggacaaataa

SEQ ID NO: 1343 - DNA, 25 bp, Homo sapien
aaaatggagaccgcctgaacttggg

SEQ ID NO: 1344 - DNA, 25 bp, Homo sapien
aaaatggagactgcctgaacttggg

SEQ ID NO: 1345 - DNA, 25 bp, Homo sapien
aaaatggaggcacaatggtgagaaa

SEQ ID NO: 1346 - DNA, 25 bp, Homo sapien
aaaatggaggcacgatggtgagaaa

SEQ ID NO: 1347 - DNA, 25 bp, Homo sapien
aaaatggagtgaccatgagtgaatg

SEQ ID NO: 1348 - DNA, 25 bp, Homo sapien
aaaatggagtgaccgtgagtgaatg

SEQ ID NO: 1349 - DNA, 25 bp, Homo sapien
aaaatggatgctgaacagattttta

SEQ ID NO: 1350 - DNA, 25 bp, Homo sapien
aaaatggatgctgagcagattttta

SEQ ID NO: 1351 - DNA, 25 bp, Homo sapien
aaaatggcacatcccgccccagcac

SEQ ID NO: 1352 - DNA, 25 bp, Homo sapien
aaaatggctacaaccagaacgatta

SEQ ID NO: 1353 - DNA, 25 bp, Homo sapien
aaaatggctacaatcagaacgatta

SEQ ID NO: 1354 - DNA, 25 bp, Homo sapien
aaaatggctcatcccgccccagcac

SEQ ID NO: 1355 - DNA, 25 bp, Homo sapien
aaaatggctgttcgtaggaatggaa

SEQ ID NO: 1356 - DNA, 25 bp, Homo sapien
aaaatggctgtttgtaggaatggaa

SEQ ID NO: 1357 - DNA, 25 bp, Homo sapien
aaaatggggacatgcggaacactga

SEQ ID NO: 1358 - DNA, 25 bp, Homo sapien
aaaatggggacatgcgtaacactga

SEQ ID NO: 1359 - DNA, 25 bp, Homo sapien
aaaatggtcaacacatcataaatga

SEQ ID NO: 1360 - DNA, 25 bp, Homo sapien
aaaatggtcaacacctcataaatga

SEQ ID NO: 1361 - DNA, 25 bp, Homo sapien
aaaatggtcaataataggagagtat

SEQ ID NO: 1362 - DNA, 25 bp, Homo sapien
aaaatggtcgataataggagagtat

SEQ ID NO: 1363 - DNA, 25 bp, Homo sapien
aaaatggtggtgtgcgtccaagatg

SEQ ID NO: 1364 - DNA, 25 bp, Homo sapien
aaaatggtggtgtgtgtccaagatg

SEQ ID NO: 1365 - DNA, 25 bp, Homo sapien
aaaatgtaagtgatagataagctta

SEQ ID NO: 1366 - DNA, 25 bp, Homo sapien
aaaatgtaagtgctagataagctta

SEQ ID NO: 1367 - DNA, 25 bp, Homo sapien
aaaatgtaccttggaggagttttcg

SEQ ID NO: 1368 - DNA, 25 bp, Homo sapien
aaaatgtaccttggtggagttttcg

SEQ ID NO: 1369 - DNA, 25 bp, Homo sapien
aaaatgtatcctaaaataagccaac

SEQ ID NO: 1370 - DNA, 25 bp, Homo sapien
aaaatgtatcctaagataagccaac

SEQ ID NO: 1371 - DNA, 25 bp, Homo sapien
aaaatgtattcaaagtgatggagta

SEQ ID NO: 1372 - DNA, 25 bp, Homo sapien
aaaatgtattcacagtgatggagta

SEQ ID NO: 1373 - DNA, 25 bp, Homo sapien
aaaatgtcaaatccaaaggaatgta

SEQ ID NO: 1374 - DNA, 25 bp, Homo sapien
aaaatgtcaagattttaaatatgga

SEQ ID NO: 1375 - DNA, 25 bp, Homo sapien
aaaatgtcacacaacttgttgttct

SEQ ID NO: 1376 - DNA, 25 bp, Homo sapien
aaaatgtcacacaatttgttgttct

SEQ ID NO: 1377 - DNA, 25 bp, Homo sapien
aaaatgtcacatccaaaggaatgta

SEQ ID NO: 1378 - DNA, 25 bp, Homo sapien
aaaatgtcaggattttaaatatgga

SEQ ID NO: 1379 - DNA, 25 bp, Homo sapien
aaaatgtcatattgaatcaagctgt

SEQ ID NO: 1380 - DNA, 25 bp, Homo sapien
aaaatgtccaggtataggagaggac

SEQ ID NO: 1381 - DNA, 25 bp, Homo sapien
aaaatgtccgggtataggagaggac

SEQ ID NO: 1382 - DNA, 25 bp, Homo sapien
aaaatgtcctattgaatcaagctgt

SEQ ID NO: 1383 - DNA, 25 bp, Homo sapien
aaaatgtcttccatttgcattttaa

SEQ ID NO: 1384 - DNA, 25 bp, Homo sapien
aaaatgtcttccgtttgcattttaa

SEQ ID NO: 1385 - DNA, 25 bp, Homo sapien
aaaatgtgattcaaatataatctcc

SEQ ID NO: 1386 - DNA, 25 bp, Homo sapien
aaaatgtgattcagatataatctcc

SEQ ID NO: 1387 - DNA, 25 bp, Homo sapien
aaaatgtgccctaactcaggcagat

SEQ ID NO: 1388 - DNA, 25 bp, Homo sapien
aaaatgtgccctagctcaggcagat

SEQ ID NO: 1389 - DNA, 25 bp, Homo sapien
aaaatgtgcctacgtccttccaact

SEQ ID NO: 1390 - DNA, 25 bp, Homo sapien
aaaatgtgcctatgtccttccaact

SEQ ID NO: 1391 - DNA, 25 bp, Homo sapien
aaaatgtgctgttatcagatgtgca

SEQ ID NO: 1392 - DNA, 25 bp, Homo sapien
aaaatgtgctgttttcagatgtgca

SEQ ID NO: 1393 - DNA, 25 bp, Homo sapien
aaaatgtgtctgcaaatataaagtt

SEQ ID NO: 1394 - DNA, 25 bp, Homo sapien
aaaatgtgtctggaaatataaagtt

SEQ ID NO: 1395 - DNA, 25 bp, Homo sapien
aaaatgttaccacgcctcgacagcc

SEQ ID NO: 1396 - DNA, 25 bp, Homo sapien
aaaatgttaccatgcctcgacagcc

SEQ ID NO: 1397 - DNA, 25 bp, Homo sapien
aaaatgttacctctgatcccttatt

SEQ ID NO: 1398 - DNA, 25 bp, Homo sapien
aaaatgttacctttgatcccttatt

SEQ ID NO: 1399 - DNA, 25 bp, Homo sapien
aaaatgttagcctatcaatatttca

SEQ ID NO: 1400 - DNA, 25 bp, Homo sapien
aaaatgttagcgtatcaatatttca

SEQ ID NO: 1401 - DNA, 25 bp, Homo sapien
aaaatgttcacgaattaagtgagag

SEQ ID NO: 1402 - DNA, 25 bp, Homo sapien
aaaatgttcctatctactttttctg

SEQ ID NO: 1403 - DNA, 25 bp, Homo sapien
aaaatgttcgcgaattaagtgagag

SEQ ID NO: 1404 - DNA, 25 bp, Homo sapien
aaaatgttgcaacaatgaataactg

SEQ ID NO: 1405 - DNA, 25 bp, Homo sapien
aaaatgttgcaataatgaataactg

SEQ ID NO: 1406 - DNA, 25 bp, Homo sapien
aaaatgtttctatctactttttctg

SEQ ID NO: 1407 - DNA, 25 bp, Homo sapien
aaaatgttttggaatacgactcttg

SEQ ID NO: 1408 - DNA, 25 bp, Homo sapien
aaaatgttttgggatacgactcttg

SEQ ID NO: 1409 - DNA, 25 bp, Homo sapien
aaaattaaaatgtgtcatagagctg

SEQ ID NO: 1410 - DNA, 25 bp, Homo sapien
aaaattaaaatgtgtcgtagagctg

SEQ ID NO: 1411 - DNA, 25 bp, Homo sapien
aaaattaaacagtgaccggaagagc

SEQ ID NO: 1412 - DNA, 25 bp, Homo sapien
aaaattaaacagtgactggaagagc

SEQ ID NO: 1413 - DNA, 25 bp, Homo sapien
aaaattaaccagacatggtactata

SEQ ID NO: 1414 - DNA, 25 bp, Homo sapien
aaaattaaccaggcatggtactata

SEQ ID NO: 1415 - DNA, 25 bp, Homo sapien
aaaattaaccctgtgtgtattgagg

SEQ ID NO: 1416 - DNA, 25 bp, Homo sapien
aaaattaacgcttagcttcagtaaa

SEQ ID NO: 1417 - DNA, 25 bp, Homo sapien
aaaattaactctgtgtgtattgagg

SEQ ID NO: 1418 - DNA, 25 bp, Homo sapien
aaaattaatgcttagcttcagtaaa

SEQ ID NO: 1419 - DNA, 25 bp, Homo sapien
aaaattacaccctatgctgtgatgg

SEQ ID NO: 1420 - DNA, 25 bp, Homo sapien
aaaattacgccctatgctgtgatgg

SEQ ID NO: 1421 - DNA, 25 bp, Homo sapien
aaaattagtagcgtttctacatgct

SEQ ID NO: 1422 - DNA, 25 bp, Homo sapien
aaaattagtagtgtttctacatgct

SEQ ID NO: 1423 - DNA, 25 bp, Homo sapien
aaaattatactaatatccctgaaac

SEQ ID NO: 1424 - DNA, 25 bp, Homo sapien
aaaattatcctaatatccctgaaac

SEQ ID NO: 1425 - DNA, 25 bp, Homo sapien
aaaattatctgcacgatggaaacgt

SEQ ID NO: 1426 - DNA, 25 bp, Homo sapien
aaaattatctgcatgatggaaacgt

SEQ ID NO: 1427 - DNA, 25 bp, Homo sapien
aaaattatgatttcggttagtaatg

SEQ ID NO: 1428 - DNA, 25 bp, Homo sapien
aaaattatgattttggttagtaatg

SEQ ID NO: 1429 - DNA, 25 bp, Homo sapien
aaaattatggaaaaccagacacgag

SEQ ID NO: 1430 - DNA, 25 bp, Homo sapien
aaaattatggagaaccagacacgag

SEQ ID NO: 1431 - DNA, 25 bp, Homo sapien
aaaattcatatcagaacatacagat

SEQ ID NO: 1432 - DNA, 25 bp, Homo sapien
aaaattcatatcagcacatacagat

SEQ ID NO: 1433 - DNA, 25 bp, Homo sapien
aaaattccaaaatataaaggcagtc

SEQ ID NO: 1434 - DNA, 25 bp, Homo sapien
aaaattccagaatggttccctaaga

SEQ ID NO: 1435 - DNA, 25 bp, Homo sapien
aaaattccagaattgttccctaaga

SEQ ID NO: 1436 - DNA, 25 bp, Homo sapien
aaaattccctcaaacttggaaatcc

SEQ ID NO: 1437 - DNA, 25 bp, Homo sapien
aaaattccctcgaacttggaaatcc

SEQ ID NO: 1438 - DNA, 25 bp, Homo sapien
aaaattccgaaatataaaggcagtc

SEQ ID NO: 1439 - DNA, 25 bp, Homo sapien
aaaattcctaaatcatgatcccagt

SEQ ID NO: 1440 - DNA, 25 bp, Homo sapien
aaaattcctaaattatgatcccagt

SEQ ID NO: 1441 - DNA, 25 bp, Homo sapien
aaaattctgctgctaaaacagttat

SEQ ID NO: 1442 - DNA, 25 bp, Homo sapien
aaaattctgcttctaaaacagttat

SEQ ID NO: 1443 - DNA, 25 bp, Homo sapien
aaaattcttaccaaactagagagag

SEQ ID NO: 1444 - DNA, 25 bp, Homo sapien
aaaattcttaccacactagagagag

SEQ ID NO: 1445 - DNA, 25 bp, Homo sapien
aaaattctttcatgggctaagctcc

SEQ ID NO: 1446 - DNA, 25 bp, Homo sapien
aaaattctttcgtgggctaagctcc

SEQ ID NO: 1447 - DNA, 25 bp, Homo sapien
aaaattgaccacatacttaaccata

SEQ ID NO: 1448 - DNA, 25 bp, Homo sapien
aaaattgaccacatgcttaaccata

SEQ ID NO: 1449 - DNA, 25 bp, Homo sapien
aaaattgagaccgagaggaagtaga

SEQ ID NO: 1450 - DNA, 25 bp, Homo sapien
aaaattgagactgagaggaagtaga

SEQ ID NO: 1451 - DNA, 25 bp, Homo sapien
aaaattgaggactgcgtatcaacaa

SEQ ID NO: 1452 - DNA, 25 bp, Homo sapien
aaaattgaggactgtgtatcaacaa

SEQ ID NO: 1453 - DNA, 25 bp, Homo sapien
aaaattgagttccagggcagtaagt

SEQ ID NO: 1454 - DNA, 25 bp, Homo sapien
aaaattgagtttcagggcagtaagt

SEQ ID NO: 1455 - DNA, 25 bp, Homo sapien
aaaattgccatatattctctatggt

SEQ ID NO: 1456 - DNA, 25 bp, Homo sapien
aaaattgccatggttatctctgtct

SEQ ID NO: 1457 - DNA, 25 bp, Homo sapien
aaaattgccttggttatctctgtct

SEQ ID NO: 1458 - DNA, 25 bp, Homo sapien
aaaattgctatatattctctatggt

SEQ ID NO: 1459 - DNA, 25 bp, Homo sapien
aaaattggatgacagcatactaaga

SEQ ID NO: 1460 - DNA, 25 bp, Homo sapien
aaaattggatgacagcgtactaaga

SEQ ID NO: 1461 - DNA, 25 bp, Homo sapien
aaaattggcacttatgaaagtggag

SEQ ID NO: 1462 - DNA, 25 bp, Homo sapien
aaaattggcacttgtgaaagtggag

SEQ ID NO: 1463 - DNA, 25 bp, Homo sapien
aaaattgtaaaatgcaagggagaaa

SEQ ID NO: 1464 - DNA, 25 bp, Homo sapien
aaaattgtagaatgcaagggagaaa

SEQ ID NO: 1465 - DNA, 25 bp, Homo sapien
aaaattgtcataattaatagaaaca

SEQ ID NO: 1466 - DNA, 25 bp, Homo sapien
aaaattgtcatcattaatagaaaca

SEQ ID NO: 1467 - DNA, 25 bp, Homo sapien
aaaattgtgcgaaattaatattggc

SEQ ID NO: 1468 - DNA, 25 bp, Homo sapien
aaaattgtgtgaaattaatattggc

SEQ ID NO: 1469 - DNA, 25 bp, Homo sapien
aaaattgttcaactatacagagagt

SEQ ID NO: 1470 - DNA, 25 bp, Homo sapien
aaaattgttcagctatacagagagt

SEQ ID NO: 1471 - DNA, 25 bp, Homo sapien
aaaatttaaaaaccatagcgacact

SEQ ID NO: 1472 - DNA, 25 bp, Homo sapien
aaaatttaaaaagcatagcgacact

SEQ ID NO: 1473 - DNA, 25 bp, Homo sapien
aaaatttacatgctaaagaactgta

SEQ ID NO: 1474 - DNA, 25 bp, Homo sapien
aaaatttagatgctaaagaactgta

SEQ ID NO: 1475 - DNA, 25 bp, Homo sapien
aaaatttattctgcttaatgggtcg

SEQ ID NO: 1476 - DNA, 25 bp, Homo sapien
aaaatttattctgtttaatgggtcg

SEQ ID NO: 1477 - DNA, 25 bp, Homo sapien
aaaatttcactattttgtcatcatg

SEQ ID NO: 1478 - DNA, 25 bp, Homo sapien
aaaatttcatgctaagccagccagg

SEQ ID NO: 1479 - DNA, 25 bp, Homo sapien
aaaatttcatgttaagccagccagg

SEQ ID NO: 1480 - DNA, 25 bp, Homo sapien
aaaatttccctattttgtcatcatg

SEQ ID NO: 1481 - DNA, 25 bp, Homo sapien
aaaatttcctcattgggtgttctag

SEQ ID NO: 1482 - DNA, 25 bp, Homo sapien
aaaatttctctcctaaacgctggta

SEQ ID NO: 1483 - DNA, 25 bp, Homo sapien
aaaatttctctcttaaacgctggta

SEQ ID NO: 1484 - DNA, 25 bp, Homo sapien
aaaatttcttcattgggtgttctag

SEQ ID NO: 1485 - DNA, 25 bp, Homo sapien
aaaatttcttgaactttatacttaa

SEQ ID NO: 1486 - DNA, 25 bp, Homo sapien
aaaatttcttgagctttatacttaa

SEQ ID NO: 1487 - DNA, 25 bp, Homo sapien
aaaatttgaaaactcctcatttgtg

SEQ ID NO: 1488 - DNA, 25 bp, Homo sapien
aaaatttgaaagctcctcatttgtg

SEQ ID NO: 1489 - DNA, 25 bp, Homo sapien
aaaatttgcacactatattaccgga

SEQ ID NO: 1490 - DNA, 25 bp, Homo sapien
aaaatttgcacactgtattaccgga

SEQ ID NO: 1491 - DNA, 25 bp, Homo sapien
aaaatttgcaggatatggttgaagt

SEQ ID NO: 1492 - DNA, 25 bp, Homo sapien
aaaatttgccagcctttttcacttc

SEQ ID NO: 1493 - DNA, 25 bp, Homo sapien
aaaatttgccagtctttttcacttc

SEQ ID NO: 1494 - DNA, 25 bp, Homo sapien
aaaatttgtaggatatggttgaagt

SEQ ID NO: 1495 - DNA, 25 bp, Homo sapien
aaaatttgttatacgcacaattcta

SEQ ID NO: 1496 - DNA, 25 bp, Homo sapien
aaaatttgttatatgcacaattcta

SEQ ID NO: 1497 - DNA, 25 bp, Homo sapien
aaaattttatggatacgaattcaga

SEQ ID NO: 1498 - DNA, 25 bp, Homo sapien
aaaattttcaagatggctttgatgc

SEQ ID NO: 1499 - DNA, 25 bp, Homo sapien
aaaattttgaagatggctttgatgc

SEQ ID NO: 1500 - DNA, 25 bp, Homo sapien
aaaattttgcccaaatgttatcagt

SEQ ID NO: 1501 - DNA, 25 bp, Homo sapien
aaaattttgcccagatgttatcagt

SEQ ID NO: 1502 - DNA, 25 bp, Homo sapien
aaaattttgtggatacgaattcaga

SEQ ID NO: 1503 - DNA, 25 bp, Homo sapien
aaacaaaaaaacttgagtgcttact

SEQ ID NO: 1504 - DNA, 25 bp, Homo sapien
aaacaaaaaaagttgagtgcttact

SEQ ID NO: 1505 - DNA, 25 bp, Homo sapien
aaacaaaaaccagcgttagagtaaa

SEQ ID NO: 1506 - DNA, 25 bp, Homo sapien
aaacaaaaaccagctttagagtaaa

SEQ ID NO: 1507 - DNA, 25 bp, Homo sapien
aaacaaaactgaacaggaactcaag

SEQ ID NO: 1508 - DNA, 25 bp, Homo sapien
aaacaaaactgaataggaactcaag

SEQ ID NO: 1509 - DNA, 25 bp, Homo sapien
aaacaaaacttcataacaccttgga

SEQ ID NO: 1510 - DNA, 25 bp, Homo sapien
aaacaaaacttcctaacaccttgga

SEQ ID NO: 1511 - DNA, 25 bp, Homo sapien
aaacaaaagaaattcaaaactgtgc

SEQ ID NO: 1512 - DNA, 25 bp, Homo sapien
aaacaaaagtccagtcaagtcactt

SEQ ID NO: 1513 - DNA, 25 bp, Homo sapien
aaacaaaagtccggtcaagtcactt

SEQ ID NO: 1514 - DNA, 25 bp, Homo sapien
aaacaaaataaaacctccaagaaac

SEQ ID NO: 1515 - DNA, 25 bp, Homo sapien
aaacaaaataaattcaaaactgtgc

SEQ ID NO: 1516 - DNA, 25 bp, Homo sapien
aaacaaaataatacctccaagaaac

SEQ ID NO: 1517 - DNA, 25 bp, Homo sapien
aaacaaacaaaattcaaacttccca

SEQ ID NO: 1518 - DNA, 25 bp, Homo sapien
aaacaaacaaacttcaaacttccca

SEQ ID NO: 1519 - DNA, 25 bp, Homo sapien
aaacaaacatcatgctcaaatgagg

SEQ ID NO: 1520 - DNA, 25 bp, Homo sapien
aaacaaaccagaaaatggtatacca

SEQ ID NO: 1521 - DNA, 25 bp, Homo sapien
aaacaaaccaggaaatggtatacca

SEQ ID NO: 1522 - DNA, 25 bp, Homo sapien
aaacaaacgtcatgctcaaatgagg

SEQ ID NO: 1523 - DNA, 25 bp, Homo sapien
aaacaaactttgtcaacaaatttgg

SEQ ID NO: 1524 - DNA, 25 bp, Homo sapien
aaacaaactttgtcaataaatttgg

SEQ ID NO: 1525 - DNA, 25 bp, Homo sapien
aaacaaagaattgcctaatatcata

SEQ ID NO: 1526 - DNA, 25 bp, Homo sapien
aaacaaagaattgcctgatatcata

SEQ ID NO: 1527 - DNA, 25 bp, Homo sapien
aaacaaaggaacagagacagtcaaa

SEQ ID NO: 1528 - DNA, 25 bp, Homo sapien
aaacaaaggaaccgagacagtcaaa

SEQ ID NO: 1529 - DNA, 25 bp, Homo sapien
aaacaaagggagcatgacatggaag

SEQ ID NO: 1530 - DNA, 25 bp, Homo sapien
aaacaaagtgagcatgacatggaag

SEQ ID NO: 1531 - DNA, 25 bp, Homo sapien
aaacaaagtttcagcatcacttatc

SEQ ID NO: 1532 - DNA, 25 bp, Homo sapien
aaacaaagtttcggcatcacttatc

SEQ ID NO: 1533 - DNA, 25 bp, Homo sapien
aaacaaataaacaaatacaagacat

SEQ ID NO: 1534 - DNA, 25 bp, Homo sapien
aaacaaataaacaactacaagacat

SEQ ID NO: 1535 - DNA, 25 bp, Homo sapien
aaacaaatcagtaactaccactctc

SEQ ID NO: 1536 - DNA, 25 bp, Homo sapien
aaacaaatctgtaactaccactctc

SEQ ID NO: 1537 - DNA, 25 bp, Homo sapien
aaacaaatgcaattacatcaggtta

SEQ ID NO: 1538 - DNA, 25 bp, Homo sapien
aaacaaatggaaaaaaagacacttt

SEQ ID NO: 1539 - DNA, 25 bp, Homo sapien
aaacaaatggaaacaaagacacttt

SEQ ID NO: 1540 - DNA, 25 bp, Homo sapien
aaacaaatggaattacatcaggtta

SEQ ID NO: 1541 - DNA, 25 bp, Homo sapien
aaacaaatgtacgtatgaggcacat

SEQ ID NO: 1542 - DNA, 25 bp, Homo sapien
aaacaaatgtatgtatgaggcacat

SEQ ID NO: 1543 - DNA, 25 bp, Homo sapien
aaacaaattcgtgaacaatgtggaa

SEQ ID NO: 1544 - DNA, 25 bp, Homo sapien
aaacaaattcgtgcacaatgtggaa

SEQ ID NO: 1545 - DNA, 25 bp, Homo sapien
aaacaaatttccatacatgtcaaac

SEQ ID NO: 1546 - DNA, 25 bp, Homo sapien
aaacaaatttccatacgtgtcaaac

SEQ ID NO: 1547 - DNA, 25 bp, Homo sapien
aaacaacaacttctgagttaacaat

SEQ ID NO: 1548 - DNA, 25 bp, Homo sapien
aaacaacaatttctgagttaacaat

SEQ ID NO: 1549 - DNA, 25 bp, Homo sapien
aaacaacacaaatgtactgtatttc

SEQ ID NO: 1550 - DNA, 25 bp, Homo sapien
aaacaacacaaatttactgtatttc

SEQ ID NO: 1551 - DNA, 25 bp, Homo sapien
aaacaacagtctctaatttttttat

SEQ ID NO: 1552 - DNA, 25 bp, Homo sapien
aaacaacagtctctgatttttttat

SEQ ID NO: 1553 - DNA, 25 bp, Homo sapien
aaacaaccagaccgttagaagtgtt

SEQ ID NO: 1554 - DNA, 25 bp, Homo sapien
aaacaaccagactgttagaagtgtt

SEQ ID NO: 1555 - DNA, 25 bp, Homo sapien
aaacaaccagacttcggaatagttg

SEQ ID NO: 1556 - DNA, 25 bp, Homo sapien
aaacaaccagactttggaatagttg

SEQ ID NO: 1557 - DNA, 25 bp, Homo sapien
aaacaacccattcaagacaatcaac

SEQ ID NO: 1558 - DNA, 25 bp, Homo sapien
aaacaacccgttcaagacaatcaac

SEQ ID NO: 1559 - DNA, 25 bp, Homo sapien
aaacaactggtttaggaaaagctac

SEQ ID NO: 1560 - DNA, 25 bp, Homo sapien
aaacaactggtttatgaaaagctac

SEQ ID NO: 1561 - DNA, 25 bp, Homo sapien
aaacaagaaaaggagaatgtagcaa

SEQ ID NO: 1562 - DNA, 25 bp, Homo sapien
aaacaagaaaatgagaatgtagcaa

SEQ ID NO: 1563 - DNA, 25 bp, Homo sapien
aaacaagaagcagtaaattactttt

SEQ ID NO: 1564 - DNA, 25 bp, Homo sapien
aaacaagaagcattaaattactttt

SEQ ID NO: 1565 - DNA, 25 bp, Homo sapien
aaacaagcaaacaacaaatacctgg

SEQ ID NO: 1566 - DNA, 25 bp, Homo sapien
aaacaagcaaccaaaaaagcttctc

SEQ ID NO: 1567 - DNA, 25 bp, Homo sapien
aaacaagcaaccacaaaagcttctc

SEQ ID NO: 1568 - DNA, 25 bp, Homo sapien
aaacaagcacgtacaaaggagaagg

SEQ ID NO: 1569 - DNA, 25 bp, Homo sapien
aaacaagcatgtacaaaggagaagg

SEQ ID NO: 1570 - DNA, 25 bp, Homo sapien
aaacaagccaagtgagtaagccaag

SEQ ID NO: 1571 - DNA, 25 bp, Homo sapien
aaacaagcccggacagtgaagacta

SEQ ID NO: 1572 - DNA, 25 bp, Homo sapien
aaacaagccgagtgagtaagccaag

SEQ ID NO: 1573 - DNA, 25 bp, Homo sapien
aaacaagcctggacagtgaagacta

SEQ ID NO: 1574 - DNA, 25 bp, Homo sapien
aaacaagcgaacaacaaatacctgg

SEQ ID NO: 1575 - DNA, 25 bp, Homo sapien
aaacaaggaaggcatgagagacagc

SEQ ID NO: 1576 - DNA, 25 bp, Homo sapien
aaacaaggaaggcgtgagagacagc

SEQ ID NO: 1577 - DNA, 25 bp, Homo sapien
aaacaaggattcctaaatctcaaaa

SEQ ID NO: 1578 - DNA, 25 bp, Homo sapien
aaacaaggattcttaaatctcaaaa

SEQ ID NO: 1579 - DNA, 25 bp, Homo sapien
aaacaagtaagaagtttcccaagca

SEQ ID NO: 1580 - DNA, 25 bp, Homo sapien
aaacaagtcacacccttcttcctgc

SEQ ID NO: 1581 - DNA, 25 bp, Homo sapien
aaacaagtcagaagtttcccaagca

SEQ ID NO: 1582 - DNA, 25 bp, Homo sapien
aaacaagtccaaggtgaaatagtgt

SEQ ID NO: 1583 - DNA, 25 bp, Homo sapien
aaacaagtccagggtgaaatagtgt

SEQ ID NO: 1584 - DNA, 25 bp, Homo sapien
aaacaagtcgcacccttcttcctgc

SEQ ID NO: 1585 - DNA, 25 bp, Homo sapien
aaacaataagctgtagaacgaacat

SEQ ID NO: 1586 - DNA, 25 bp, Homo sapien
aaacaataagctgtggaacgaacat

SEQ ID NO: 1587 - DNA, 25 bp, Homo sapien
aaacaatacgtgcaactccaagtct

SEQ ID NO: 1588 - DNA, 25 bp, Homo sapien
aaacaatagacctctttggggagca

SEQ ID NO: 1589 - DNA, 25 bp, Homo sapien
aaacaatagacctttttggggagca

SEQ ID NO: 1590 - DNA, 25 bp, Homo sapien
aaacaatatgtgcaactccaagtct

SEQ ID NO: 1591 - DNA, 25 bp, Homo sapien
aaacaatattccacttttacctaga

SEQ ID NO: 1592 - DNA, 25 bp, Homo sapien
aaacaatattcgacttttacctaga

SEQ ID NO: 1593 - DNA, 25 bp, Homo sapien
aaacaatatttgaactaacataaag

SEQ ID NO: 1594 - DNA, 25 bp, Homo sapien
aaacaatatttgaactgacataaag

SEQ ID NO: 1595 - DNA, 25 bp, Homo sapien
aaacaatcataaagaaggcaatgtt

SEQ ID NO: 1596 - DNA, 25 bp, Homo sapien
aaacaatcctaaactgctgaaattt

SEQ ID NO: 1597 - DNA, 25 bp, Homo sapien
aaacaatcgtaaagaaggcaatgtt

SEQ ID NO: 1598 - DNA, 25 bp, Homo sapien
aaacaatcttaaactgctgaaattt

SEQ ID NO: 1599 - DNA, 25 bp, Homo sapien
aaacaatgactcactcatgaaggat

SEQ ID NO: 1600 - DNA, 25 bp, Homo sapien
aaacaatgacttactcatgaaggat

SEQ ID NO: 1601 - DNA, 25 bp, Homo sapien
aaacaattaaataataagcacaagg

SEQ ID NO: 1602 - DNA, 25 bp, Homo sapien
aaacaattaaatagtaagcacaagg

SEQ ID NO: 1603 - DNA, 25 bp, Homo sapien
aaacaattaacaatatggcgttaac

SEQ ID NO: 1604 - DNA, 25 bp, Homo sapien
aaacaattaaccatatggcgttaac

SEQ ID NO: 1605 - DNA, 25 bp, Homo sapien
aaacaattgtcgatggtggaaataa

SEQ ID NO: 1606 - DNA, 25 bp, Homo sapien
aaacaattgtcggtggtggaaataa

SEQ ID NO: 1607 - DNA, 25 bp, Homo sapien
aaacaatttttacaaagaccaaaga

SEQ ID NO: 1608 - DNA, 25 bp, Homo sapien
aaacaatttttacagagaccaaaga

SEQ ID NO: 1609 - DNA, 25 bp, Homo sapien
aaacacaaaatgagggtgacaaaag

SEQ ID NO: 1610 - DNA, 25 bp, Homo sapien
aaacacaaaggcttcaccggttttg

SEQ ID NO: 1611 - DNA, 25 bp, Homo sapien
aaacacaaaggcttcatcggttttg

SEQ ID NO: 1612 - DNA, 25 bp, Homo sapien
aaacacaaattgagggtgacaaaag

SEQ ID NO: 1613 - DNA, 25 bp, Homo sapien
aaacacaagcgcaataaagatgttt

SEQ ID NO: 1614 - DNA, 25 bp, Homo sapien
aaacacaaggataatgaatcaggaa

SEQ ID NO: 1615 - DNA, 25 bp, Homo sapien
aaacacaagtataatgaatcaggaa

SEQ ID NO: 1616 - DNA, 25 bp, Homo sapien
aaacacaagtgcaataaagatgttt

SEQ ID NO: 1617 - DNA, 25 bp, Homo sapien
aaacacacccagtgctcaaatcata

SEQ ID NO: 1618 - DNA, 25 bp, Homo sapien
aaacacacctagtgctcaaatcata

SEQ ID NO: 1619 - DNA, 25 bp, Homo sapien
aaacacactcaatgagaaaaggaca

SEQ ID NO: 1620 - DNA, 25 bp, Homo sapien
aaacacactcagtgagaaaaggaca

SEQ ID NO: 1621 - DNA, 25 bp, Homo sapien
aaacacactctcttgacccgaggtg

SEQ ID NO: 1622 - DNA, 25 bp, Homo sapien
aaacacactgtcttgacccgaggtg

SEQ ID NO: 1623 - DNA, 25 bp, Homo sapien
aaacacactttaaaaacacagaata

SEQ ID NO: 1624 - DNA, 25 bp, Homo sapien
aaacacactttagaaacacagaata

SEQ ID NO: 1625 - DNA, 25 bp, Homo sapien
aaacacagaaaagcacggttggctg

SEQ ID NO: 1626 - DNA, 25 bp, Homo sapien
aaacacagaaaagcactgttggctg

SEQ ID NO: 1627 - DNA, 25 bp, Homo sapien
aaacacagatgctgagccccacccc

SEQ ID NO: 1628 - DNA, 25 bp, Homo sapien
aaacacagatggtgagccccacccc

SEQ ID NO: 1629 - DNA, 25 bp, Homo sapien
aaacacagattatatcctatttgga

SEQ ID NO: 1630 - DNA, 25 bp, Homo sapien
aaacacaggcaataaaaggacaaag

SEQ ID NO: 1631 - DNA, 25 bp, Homo sapien
aaacacaggcagtaaaaggacaaag

SEQ ID NO: 1632 - DNA, 25 bp, Homo sapien
aaacacaggctgaagagagagattg

SEQ ID NO: 1633 - DNA, 25 bp, Homo sapien
aaacacaggctggagagagagattg

SEQ ID NO: 1634 - DNA, 25 bp, Homo sapien
aaacacaggttatatcctatttgga

SEQ ID NO: 1635 - DNA, 25 bp, Homo sapien
aaacacatcaacactccaagtggga

SEQ ID NO: 1636 - DNA, 25 bp, Homo sapien
aaacacatcatatcaaaatgcatgg

SEQ ID NO: 1637 - DNA, 25 bp, Homo sapien
aaacacatcatgtcaaaatgcatgg

SEQ ID NO: 1638 - DNA, 25 bp, Homo sapien
aaacacatcgacactccaagtggga

SEQ ID NO: 1639 - DNA, 25 bp, Homo sapien
aaacaccacagatgccagagcctta

SEQ ID NO: 1640 - DNA, 25 bp, Homo sapien
aaacaccacagctgccagagcctta

SEQ ID NO: 1641 - DNA, 25 bp, Homo sapien
aaacaccagtcaggaacggatggta

SEQ ID NO: 1642 - DNA, 25 bp, Homo sapien
aaacaccagtcaggaatggatggta

SEQ ID NO: 1643 - DNA, 25 bp, Homo sapien
aaacaccatcatgcctaactcggga

SEQ ID NO: 1644 - DNA, 25 bp, Homo sapien
aaacaccatcatggctaactcggga

SEQ ID NO: 1645 - DNA, 25 bp, Homo sapien
aaacacctgagtaatacagtgacca

SEQ ID NO: 1646 - DNA, 25 bp, Homo sapien
aaacacctgagtcatacagtgacca

SEQ ID NO: 1647 - DNA, 25 bp, Homo sapien
aaacaccttccactggggtcttcag

SEQ ID NO: 1648 - DNA, 25 bp, Homo sapien
aaacaccttccgctggggtcttcag

SEQ ID NO: 1649 - DNA, 25 bp, Homo sapien
aaacacgactactgatttgataaca

SEQ ID NO: 1650 - DNA, 25 bp, Homo sapien
aaacacgattactgatttgataaca

SEQ ID NO: 1651 - DNA, 25 bp, Homo sapien
aaacacgtatttgttgaatgttgtt

SEQ ID NO: 1652 - DNA, 25 bp, Homo sapien
aaacacgtatttgttgcatgttgtt

SEQ ID NO: 1653 - DNA, 25 bp, Homo sapien
aaacactcagaagatatttccttgg

SEQ ID NO: 1654 - DNA, 25 bp, Homo sapien
aaacactcagaaggtatttccttgg

SEQ ID NO: 1655 - DNA, 25 bp, Homo sapien
aaacactccaaatacccagaacaat

SEQ ID NO: 1656 - DNA, 25 bp, Homo sapien
aaacactccgaatacccagaacaat

SEQ ID NO: 1657 - DNA, 25 bp, Homo sapien
aaacactcttaacaagcttgagata

SEQ ID NO: 1658 - DNA, 25 bp, Homo sapien
aaacactcttaataagcttgagata

SEQ ID NO: 1659 - DNA, 25 bp, Homo sapien
aaacactcttcatgtaatttgtgtg

SEQ ID NO: 1660 - DNA, 25 bp, Homo sapien
aaacactcttcgtgtaatttgtgtg

SEQ ID NO: 1661 - DNA, 25 bp, Homo sapien
aaacactgatccaaaagccatttct

SEQ ID NO: 1662 - DNA, 25 bp, Homo sapien
aaacactgatccagaagccatttct

SEQ ID NO: 1663 - DNA, 25 bp, Homo sapien
aaacacttatgccagctcttgaggc

SEQ ID NO: 1664 - DNA, 25 bp, Homo sapien
aaacacttatgtcagctcttgaggc

SEQ ID NO: 1665 - DNA, 25 bp, Homo sapien
aaacacttgcgtcaggacaagaatc

SEQ ID NO: 1666 - DNA, 25 bp, Homo sapien
aaacacttgtgtcaggacaagaatc

SEQ ID NO: 1667 - DNA, 25 bp, Homo sapien
aaacactttttgtgacatgtaataa

SEQ ID NO: 1668 - DNA, 25 bp, Homo sapien
aaacactttttgtgacgtgtaataa

SEQ ID NO: 1669 - DNA, 25 bp, Homo sapien
aaacagaaaacactagtcagccatc

SEQ ID NO: 1670 - DNA, 25 bp, Homo sapien
aaacagaaaacgctagtcagccatc

SEQ ID NO: 1671 - DNA, 25 bp, Homo sapien
aaacagaaacaatacgtgcaactcc

SEQ ID NO: 1672 - DNA, 25 bp, Homo sapien
aaacagaaacaatatgtgcaactcc

SEQ ID NO: 1673 - DNA, 25 bp, Homo sapien
aaacagaagatatggaggtgaagac

SEQ ID NO: 1674 - DNA, 25 bp, Homo sapien
aaacagaaggtatggaggtgaagac

SEQ ID NO: 1675 - DNA, 25 bp, Homo sapien
aaacagacctgggtcgcaacgtgcc

SEQ ID NO: 1676 - DNA, 25 bp, Homo sapien
aaacagacctgggttgcaacgtgcc

SEQ ID NO: 1677 - DNA, 25 bp, Homo sapien
aaacagaggaaactctaatattctt

SEQ ID NO: 1678 - DNA, 25 bp, Homo sapien
aaacagaggaagctctaatattctt

SEQ ID NO: 1679 - DNA, 25 bp, Homo sapien
aaacagaggtatcagactatataaa

SEQ ID NO: 1680 - DNA, 25 bp, Homo sapien
aaacagaggtatcggactatataaa

SEQ ID NO: 1681 - DNA, 25 bp, Homo sapien
aaacagatatagtcaaatgtttgtc

SEQ ID NO: 1682 - DNA, 25 bp, Homo sapien
aaacagatatattcaaatgtttgtc

SEQ ID NO: 1683 - DNA, 25 bp, Homo sapien
aaacagatgaaagctatccctaaac

SEQ ID NO: 1684 - DNA, 25 bp, Homo sapien
aaacagatgaaggctatccctaaac

SEQ ID NO: 1685 - DNA, 25 bp, Homo sapien
aaacagatgcaggatgatccgcact

SEQ ID NO: 1686 - DNA, 25 bp, Homo sapien
aaacagattcaggatgatccgcact

SEQ ID NO: 1687 - DNA, 25 bp, Homo sapien
aaacagcaaaatgccacagtggagc

SEQ ID NO: 1688 - DNA, 25 bp, Homo sapien
aaacagcaagatgccacagtggagc

SEQ ID NO: 1689 - DNA, 25 bp, Homo sapien
aaacagcacttaagccttctatata

SEQ ID NO: 1690 - DNA, 25 bp, Homo sapien
aaacagcacttaaggcttctatata

SEQ ID NO: 1691 - DNA, 25 bp, Homo sapien
aaacagccaatataacattcagtgg

SEQ ID NO: 1692 - DNA, 25 bp, Homo sapien
aaacagccaatgtaacattcagtgg

SEQ ID NO: 1693 - DNA, 25 bp, Homo sapien
aaacagccaggatacagtgaccagg

SEQ ID NO: 1694 - DNA, 25 bp, Homo sapien
aaacagccaggtatcacagagtgct

SEQ ID NO: 1695 - DNA, 25 bp, Homo sapien
aaacagccaggtatcatagagtgct

SEQ ID NO: 1696 - DNA, 25 bp, Homo sapien
aaacagccgggatacagtgaccagg

SEQ ID NO: 1697 - DNA, 25 bp, Homo sapien
aaacagcgagccacacctggatcac

SEQ ID NO: 1698 - DNA, 25 bp, Homo sapien
aaacagcgagccacgcctggatcac

SEQ ID NO: 1699 - DNA, 25 bp, Homo sapien
aaacagctcatggtaccattgcaat

SEQ ID NO: 1700 - DNA, 25 bp, Homo sapien
aaacagctcatggtactattgcaat

SEQ ID NO: 1701 - DNA, 25 bp, Homo sapien
aaacagctttgatagaatcagattc

SEQ ID NO: 1702 - DNA, 25 bp, Homo sapien
aaacagctttgatggaatcagattc

SEQ ID NO: 1703 - DNA, 25 bp, Homo sapien
aaacaggagggatcgcagaaagaag

SEQ ID NO: 1704 - DNA, 25 bp, Homo sapien
aaacaggagggatcgcggaaagaag

SEQ ID NO: 1705 - DNA, 25 bp, Homo sapien
aaacaggatttagtcacccttgatg

SEQ ID NO: 1706 - DNA, 25 bp, Homo sapien
aaacaggatttagttacccttgatg

SEQ ID NO: 1707 - DNA, 25 bp, Homo sapien
aaacaggcaaccaaagcaacaattg

SEQ ID NO: 1708 - DNA, 25 bp, Homo sapien
aaacaggcaacccaagcaacaattg

SEQ ID NO: 1709 - DNA, 25 bp, Homo sapien
aaacaggcaagacagggagattagg

SEQ ID NO: 1710 - DNA, 25 bp, Homo sapien
aaacaggcaaggcagggagattagg

SEQ ID NO: 1711 - DNA, 25 bp, Homo sapien
aaacaggcagttaagaagatgaagc

SEQ ID NO: 1712 - DNA, 25 bp, Homo sapien
aaacaggcagttatgaagatgaagc

SEQ ID NO: 1713 - DNA, 25 bp, Homo sapien
aaacaggccatctatccgcagagct

SEQ ID NO: 1714 - DNA, 25 bp, Homo sapien
aaacaggccatctatcggcagagct

SEQ ID NO: 1715 - DNA, 25 bp, Homo sapien
aaacagggaagatatacaacagaat

SEQ ID NO: 1716 - DNA, 25 bp, Homo sapien
aaacagggaagatatagaacagaat

SEQ ID NO: 1717 - DNA, 25 bp, Homo sapien
aaacagggcttcctttatggacacc

SEQ ID NO: 1718 - DNA, 25 bp, Homo sapien
aaacagggctttctttatggacacc

SEQ ID NO: 1719 - DNA, 25 bp, Homo sapien
aaacagtacagattattggtctatt

SEQ ID NO: 1720 - DNA, 25 bp, Homo sapien
aaacagtacagtttattggtctatt

SEQ ID NO: 1721 - DNA, 25 bp, Homo sapien
aaacagtacatgcagaggccacagg

SEQ ID NO: 1722 - DNA, 25 bp, Homo sapien
aaacagtacgtgcagaggccacagg

SEQ ID NO: 1723 - DNA, 25 bp, Homo sapien
aaacagtagagtgccaagcacagaa

SEQ ID NO: 1724 - DNA, 25 bp, Homo sapien
aaacagtagagtgtcaagcacagaa

SEQ ID NO: 1725 - DNA, 25 bp, Homo sapien
aaacagtatgtgaatttctccttta

SEQ ID NO: 1726 - DNA, 25 bp, Homo sapien
aaacagtatgtgagtttctccttta

SEQ ID NO: 1727 - DNA, 25 bp, Homo sapien
aaacagtgtacaacatttccctttc

SEQ ID NO: 1728 - DNA, 25 bp, Homo sapien
aaacagtgtacaatatttccctttc

SEQ ID NO: 1729 - DNA, 25 bp, Homo sapien
aaacagttactttcggacagtctat

SEQ ID NO: 1730 - DNA, 25 bp, Homo sapien
aaacagttactttgggacagtctat

SEQ ID NO: 1731 - DNA, 25 bp, Homo sapien
aaacagttgtgcattaaatagttac

SEQ ID NO: 1732 - DNA, 25 bp, Homo sapien
aaacagttgtgcgttaaatagttac

SEQ ID NO: 1733 - DNA, 25 bp, Homo sapien
aaacagtttgcagattcctgatcta

SEQ ID NO: 1734 - DNA, 25 bp, Homo sapien
aaacagtttgcatattcctgatcta

SEQ ID NO: 1735 - DNA, 25 bp, Homo sapien
aaacataaaatcaatacacagtgga

SEQ ID NO: 1736 - DNA, 25 bp, Homo sapien
aaacataaaatcagtacacagtgga

SEQ ID NO: 1737 - DNA, 25 bp, Homo sapien
aaacataaaggacaagttaggcata

SEQ ID NO: 1738 - DNA, 25 bp, Homo sapien
aaacataaaggataagttaggcata

SEQ ID NO: 1739 - DNA, 25 bp, Homo sapien
aaacataaagttcacctcatcatgt

SEQ ID NO: 1740 - DNA, 25 bp, Homo sapien
aaacataaagttcatctcatcatgt

SEQ ID NO: 1741 - DNA, 25 bp, Homo sapien
aaacataacggctaaagccacaaaa

SEQ ID NO: 1742 - DNA, 25 bp, Homo sapien
aaacataactgccattttttgctat

SEQ ID NO: 1743 - DNA, 25 bp, Homo sapien
aaacataagcacagccagttgctct

SEQ ID NO: 1744 - DNA, 25 bp, Homo sapien
aaacataagcacagtcagttgctct

SEQ ID NO: 1745 - DNA, 25 bp, Homo sapien
aaacataatggctaaagccacaaaa

SEQ ID NO: 1746 - DNA, 25 bp, Homo sapien
aaacataatgggtaaatggtatggt

SEQ ID NO: 1747 - DNA, 25 bp, Homo sapien
aaacataatgggtcaatggtatggt

SEQ ID NO: 1748 - DNA, 25 bp, Homo sapien
aaacataattgccattttttgctat

SEQ ID NO: 1749 - DNA, 25 bp, Homo sapien
aaacatacactttcattactgagat

SEQ ID NO: 1750 - DNA, 25 bp, Homo sapien
aaacatacactttctttactgagat

SEQ ID NO: 1751 - DNA, 25 bp, Homo sapien
aaacatacatccatcatgctagtct

SEQ ID NO: 1752 - DNA, 25 bp, Homo sapien
aaacatacatccgtcatgctagtct

SEQ ID NO: 1753 - DNA, 25 bp, Homo sapien
aaacatacattatgaaacacaggct

SEQ ID NO: 1754 - DNA, 25 bp, Homo sapien
aaacatacattatgaaccacaggct

SEQ ID NO: 1755 - DNA, 25 bp, Homo sapien
aaacatactacacattcaattctgt

SEQ ID NO: 1756 - DNA, 25 bp, Homo sapien
aaacatactgcacattcaattctgt

SEQ ID NO: 1757 - DNA, 25 bp, Homo sapien
aaacatagcatggaagacaggtcaa

SEQ ID NO: 1758 - DNA, 25 bp, Homo sapien
aaacatagtatggaagacaggtcaa

SEQ ID NO: 1759 - DNA, 25 bp, Homo sapien
aaacatatgcaaatggaaatggtaa

SEQ ID NO: 1760 - DNA, 25 bp, Homo sapien
aaacatatgcaaatggcaatggtaa

SEQ ID NO: 1761 - DNA, 25 bp, Homo sapien
aaacatatgccctgcagtaaacata

SEQ ID NO: 1762 - DNA, 25 bp, Homo sapien
aaacatatgtcctcacaaagatatg

SEQ ID NO: 1763 - DNA, 25 bp, Homo sapien
aaacatatgtcctcacgaagatatg

SEQ ID NO: 1764 - DNA, 25 bp, Homo sapien
aaacatatgtcctgcagtaaacata

SEQ ID NO: 1765 - DNA, 25 bp, Homo sapien
aaacatattaaccaggtgcaacgta

SEQ ID NO: 1766 - DNA, 25 bp, Homo sapien
aaacatattaagcaggtgcaacgta

SEQ ID NO: 1767 - DNA, 25 bp, Homo sapien
aaacatattttcaatctctgattca

SEQ ID NO: 1768 - DNA, 25 bp, Homo sapien
aaacatattttctatctctgattca

SEQ ID NO: 1769 - DNA, 25 bp, Homo sapien
aaacatcaaacacaatgctccgctc

SEQ ID NO: 1770 - DNA, 25 bp, Homo sapien
aaacatcaaacacagtgctccgctc

SEQ ID NO: 1771 - DNA, 25 bp, Homo sapien
aaacatcacaactctaaattataaa

SEQ ID NO: 1772 - DNA, 25 bp, Homo sapien
aaacatcacagtttagcctagccta

SEQ ID NO: 1773 - DNA, 25 bp, Homo sapien
aaacatcacagtttagtctagccta

SEQ ID NO: 1774 - DNA, 25 bp, Homo sapien
aaacatcacgactctaaattataaa

SEQ ID NO: 1775 - DNA, 25 bp, Homo sapien
aaacatcacgcaggaaagtggggga

SEQ ID NO: 1776 - DNA, 25 bp, Homo sapien
aaacatcacgcagtaaagtggggga

SEQ ID NO: 1777 - DNA, 25 bp, Homo sapien
aaacatcagaataatcataaatgga

SEQ ID NO: 1778 - DNA, 25 bp, Homo sapien
aaacatcagaattatcataaatgga

SEQ ID NO: 1779 - DNA, 25 bp, Homo sapien
aaacatcgctaaaatgattttcaat

SEQ ID NO: 1780 - DNA, 25 bp, Homo sapien
aaacatcgttaaaatgattttcaat

SEQ ID NO: 1781 - DNA, 25 bp, Homo sapien
aaacatctatcagcataactgagac

SEQ ID NO: 1782 - DNA, 25 bp, Homo sapien
aaacatctttcagcataactgagac

SEQ ID NO: 1783 - DNA, 25 bp, Homo sapien
aaacatgaaaacgagagacaggcct

SEQ ID NO: 1784 - DNA, 25 bp, Homo sapien
aaacatgaaaaggagagacaggcct

SEQ ID NO: 1785 - DNA, 25 bp, Homo sapien
aaacatgaacaggatactatgaaaa

SEQ ID NO: 1786 - DNA, 25 bp, Homo sapien
aaacatgaacaggatattatgaaaa

SEQ ID NO: 1787 - DNA, 25 bp, Homo sapien
aaacatgatctgatcctagaaatca

SEQ ID NO: 1788 - DNA, 25 bp, Homo sapien
aaacatgatttgatcctagaaatca

SEQ ID NO: 1789 - DNA, 25 bp, Homo sapien
aaacatggaaattacgggtagaaat

SEQ ID NO: 1790 - DNA, 25 bp, Homo sapien
aaacatggaaattatgggtagaaat

SEQ ID NO: 1791 - DNA, 25 bp, Homo sapien
aaacatggtagattggagtaagttc

SEQ ID NO: 1792 - DNA, 25 bp, Homo sapien
aaacatggtaggttggagtaagttc

SEQ ID NO: 1793 - DNA, 25 bp, Homo sapien
aaacatgtgtagaagtctccttggt

SEQ ID NO: 1794 - DNA, 25 bp, Homo sapien
aaacatgtgtagacgtctccttggt

SEQ ID NO: 1795 - DNA, 25 bp, Homo sapien
aaacattagagcaataaggtgacca

SEQ ID NO: 1796 - DNA, 25 bp, Homo sapien
aaacattagggcaataaggtgacca

SEQ ID NO: 1797 - DNA, 25 bp, Homo sapien
aaacattcccaaagctgagcagcca

SEQ ID NO: 1798 - DNA, 25 bp, Homo sapien
aaacattcccaacgctgagcagcca

SEQ ID NO: 1799 - DNA, 25 bp, Homo sapien
aaacattctcccaggccattctaac

SEQ ID NO: 1800 - DNA, 25 bp, Homo sapien
aaacattctcccaggcgattctaac

SEQ ID NO: 1801 - DNA, 25 bp, Homo sapien
aaacattcttcattatgatcctcat

SEQ ID NO: 1802 - DNA, 25 bp, Homo sapien
aaacattcttcgttatgatcctcat

SEQ ID NO: 1803 - DNA, 25 bp, Homo sapien
aaacattgagccaccatttaagaaa

SEQ ID NO: 1804 - DNA, 25 bp, Homo sapien
aaacattgagccatcatttaagaaa

SEQ ID NO: 1805 - DNA, 25 bp, Homo sapien
aaacattgattacctgagttgcaaa

SEQ ID NO: 1806 - DNA, 25 bp, Homo sapien
aaacattgattacctgggttgcaaa

SEQ ID NO: 1807 - DNA, 25 bp, Homo sapien
aaacattggattagacaaacatttc

SEQ ID NO: 1808 - DNA, 25 bp, Homo sapien
aaacattggattatacaaacatttc

SEQ ID NO: 1809 - DNA, 25 bp, Homo sapien
aaacatttagattggtgtaagcctt

SEQ ID NO: 1810 - DNA, 25 bp, Homo sapien
aaacatttagattgttgtaagcctt

SEQ ID NO: 1811 - DNA, 25 bp, Homo sapien
aaacatttatactcaacttgcctgt

SEQ ID NO: 1812 - DNA, 25 bp, Homo sapien
aaacatttatattcaacttgcctgt

SEQ ID NO: 1813 - DNA, 25 bp, Homo sapien
aaacatttatttgaaccttttttga

SEQ ID NO: 1814 - DNA, 25 bp, Homo sapien
aaacatttatttgaactttttttga

SEQ ID NO: 1815 - DNA, 25 bp, Homo sapien
aaacatttcctgcaaagatattttt

SEQ ID NO: 1816 - DNA, 25 bp, Homo sapien
aaacatttcctgcgaagatattttt

SEQ ID NO: 1817 - DNA, 25 bp, Homo sapien
aaacatttgctagaagaattgtctt

SEQ ID NO: 1818 - DNA, 25 bp, Homo sapien
aaacatttgctagacgaattgtctt

SEQ ID NO: 1819 - DNA, 25 bp, Homo sapien
aaacatttggaaagtgacagttcaa

SEQ ID NO: 1820 - DNA, 25 bp, Homo sapien
aaacatttgttgatttggcctattg

SEQ ID NO: 1821 - DNA, 25 bp, Homo sapien
aaacatttgttggtttggcctattg

SEQ ID NO: 1822 - DNA, 25 bp, Homo sapien
aaacattttcaactgtgggaatcaa

SEQ ID NO: 1823 - DNA, 25 bp, Homo sapien
aaacattttcaattgtgggaatcaa

SEQ ID NO: 1824 - DNA, 25 bp, Homo sapien
aaacattttcagcaagttcattagt

SEQ ID NO: 1825 - DNA, 25 bp, Homo sapien
aaacattttcagtaagttcattagt

SEQ ID NO: 1826 - DNA, 25 bp, Homo sapien
aaacattttgaaagtgacagttcaa

SEQ ID NO: 1827 - DNA, 25 bp, Homo sapien
aaacatttttgaaaatacggtctct

SEQ ID NO: 1828 - DNA, 25 bp, Homo sapien
aaacatttttgaagatacggtctct

SEQ ID NO: 1829 - DNA, 25 bp, Homo sapien
aaaccaaaacgtgaagctcaaggga

SEQ ID NO: 1830 - DNA, 25 bp, Homo sapien
aaaccaaaacgtgaagttcaaggga

SEQ ID NO: 1831 - DNA, 25 bp, Homo sapien
aaaccaaagagccaaagcagtgatt

SEQ ID NO: 1832 - DNA, 25 bp, Homo sapien
aaaccaaagagccgaagcagtgatt

SEQ ID NO: 1833 - DNA, 25 bp, Homo sapien
aaaccaaatgcttaaagtttcaaat

SEQ ID NO: 1834 - DNA, 25 bp, Homo sapien
aaaccaaatgcttgaagtttcaaat

SEQ ID NO: 1835 - DNA, 25 bp, Homo sapien
aaaccaaatgtgttaaggcactagg

SEQ ID NO: 1836 - DNA, 25 bp, Homo sapien
aaaccaaatgtgttgaggcactagg

SEQ ID NO: 1837 - DNA, 25 bp, Homo sapien
aaaccaagaccctggagatacaaac

SEQ ID NO: 1838 - DNA, 25 bp, Homo sapien
aaaccaagatcctggagatacaaac

SEQ ID NO: 1839 - DNA, 25 bp, Homo sapien
aaaccaaggtagcgaggttggccaa

SEQ ID NO: 1840 - DNA, 25 bp, Homo sapien
aaaccaaggtagtgaggttggccaa

SEQ ID NO: 1841 - DNA, 25 bp, Homo sapien
aaaccaatctgaactagaacctcac

SEQ ID NO: 1842 - DNA, 25 bp, Homo sapien
aaaccaatctgagctagaacctcac

SEQ ID NO: 1843 - DNA, 25 bp, Homo sapien
aaaccaatttaccatagacatgtag

SEQ ID NO: 1844 - DNA, 25 bp, Homo sapien
aaaccaatttaccgtagacatgtag

SEQ ID NO: 1845 - DNA, 25 bp, Homo sapien
aaaccacaaaacgaggagaaaccag

SEQ ID NO: 1846 - DNA, 25 bp, Homo sapien
aaaccacaaaatgaggagaaaccag

SEQ ID NO: 1847 - DNA, 25 bp, Homo sapien
aaaccacaacaaacagctttacttc

SEQ ID NO: 1848 - DNA, 25 bp, Homo sapien
aaaccacagagaacaatgtaatagg

SEQ ID NO: 1849 - DNA, 25 bp, Homo sapien
aaaccacagagagcaatgtaatagg

SEQ ID NO: 1850 - DNA, 25 bp, Homo sapien
aaaccacagataaacttaccattag

SEQ ID NO: 1851 - DNA, 25 bp, Homo sapien
aaaccacagataagcttaccattag

SEQ ID NO: 1852 - DNA, 25 bp, Homo sapien
aaaccacagcaaacagctttacttc

SEQ ID NO: 1853 - DNA, 25 bp, Homo sapien
aaaccacctttactatgtaagttaa

SEQ ID NO: 1854 - DNA, 25 bp, Homo sapien
aaaccacctttattatgtaagttaa

SEQ ID NO: 1855 - DNA, 25 bp, Homo sapien
aaaccactactaattccaggtcaga

SEQ ID NO: 1856 - DNA, 25 bp, Homo sapien
aaaccactactacttccaggtcaga

SEQ ID NO: 1857 - DNA, 25 bp, Homo sapien
aaaccacttatccgagtctgctcat

SEQ ID NO: 1858 - DNA, 25 bp, Homo sapien
aaaccacttatctgagtctgctcat

SEQ ID NO: 1859 - DNA, 25 bp, Homo sapien
aaaccactttcaaatacagagaggc

SEQ ID NO: 1860 - DNA, 25 bp, Homo sapien
aaaccactttcaaatagagagaggc

SEQ ID NO: 1861 - DNA, 25 bp, Homo sapien
aaaccagcataagcaacagaccccc

SEQ ID NO: 1862 - DNA, 25 bp, Homo sapien
aaaccagcataggcaacagaccccc

SEQ ID NO: 1863 - DNA, 25 bp, Homo sapien
aaaccagctcgtggacaaacatatc

SEQ ID NO: 1864 - DNA, 25 bp, Homo sapien
aaaccagcttgtggacaaacatatc

SEQ ID NO: 1865 - DNA, 25 bp, Homo sapien
aaaccagtgtctcatacttcttacc

SEQ ID NO: 1866 - DNA, 25 bp, Homo sapien
aaaccagtgtctcatatttcttacc

SEQ ID NO: 1867 - DNA, 25 bp, Homo sapien
aaaccataaactggaaggtaaatag

SEQ ID NO: 1868 - DNA, 25 bp, Homo sapien
aaaccataaccagtttataaaagga

SEQ ID NO: 1869 - DNA, 25 bp, Homo sapien
aaaccataaccagtttctaaaagga

SEQ ID NO: 1870 - DNA, 25 bp, Homo sapien
aaaccataatctggaaggtaaatag

SEQ ID NO: 1871 - DNA, 25 bp, Homo sapien
aaaccatagacttcgtagtatgtat

SEQ ID NO: 1872 - DNA, 25 bp, Homo sapien
aaaccatagccttcgtagtatgtat

SEQ ID NO: 1873 - DNA, 25 bp, Homo sapien
aaaccatatctattacattacccag

SEQ ID NO: 1874 - DNA, 25 bp, Homo sapien
aaaccatatctattacgttacccag

SEQ ID NO: 1875 - DNA, 25 bp, Homo sapien
aaaccatctgcacatctagtccacc

SEQ ID NO: 1876 - DNA, 25 bp, Homo sapien
aaaccatctgcagatctagtccacc

SEQ ID NO: 1877 - DNA, 25 bp, Homo sapien
aaaccattatcaactcttgcttcac

SEQ ID NO: 1878 - DNA, 25 bp, Homo sapien
aaaccattatcatctcttgcttcac

SEQ ID NO: 1879 - DNA, 25 bp, Homo sapien
aaaccatttctctgtcaagggaaaa

SEQ ID NO: 1880 - DNA, 25 bp, Homo sapien
aaaccatttctttgtcaagggaaaa

SEQ ID NO: 1881 - DNA, 25 bp, Homo sapien
aaacccaacatatagtaattaaggt

SEQ ID NO: 1882 - DNA, 25 bp, Homo sapien
aaacccaacatatggtaattaaggt

SEQ ID NO: 1883 - DNA, 25 bp, Homo sapien
aaacccagatgacatcttagctggg

SEQ ID NO: 1884 - DNA, 25 bp, Homo sapien
aaacccagatgatatcttagctggg

SEQ ID NO: 1885 - DNA, 25 bp, Homo sapien
aaacccatagaatatacaacatgat

SEQ ID NO: 1886 - DNA, 25 bp, Homo sapien
aaacccatagactatacaacatgat

SEQ ID NO: 1887 - DNA, 25 bp, Homo sapien
aaaccctggagtatcgcaatcatga

SEQ ID NO: 1888 - DNA, 25 bp, Homo sapien
aaaccctggagtattgcaatcatga

SEQ ID NO: 1889 - DNA, 25 bp, Homo sapien
aaaccctgtgcatacttcaagcctc

SEQ ID NO: 1890 - DNA, 25 bp, Homo sapien
aaaccctgtgcgtacttcaagcctc

SEQ ID NO: 1891 - DNA, 25 bp, Homo sapien
aaaccgaaatcaaacagaagtgtct

SEQ ID NO: 1892 - DNA, 25 bp, Homo sapien
aaaccgaaatcaagcagaagtgtct

SEQ ID NO: 1893 - DNA, 25 bp, Homo sapien
aaaccgatacagggaagctctcttg

SEQ ID NO: 1894 - DNA, 25 bp, Homo sapien
aaaccgatatagggaagctctcttg

SEQ ID NO: 1895 - DNA, 25 bp, Homo sapien
aaaccgggtaatctacttctaagcc

SEQ ID NO: 1896 - DNA, 25 bp, Homo sapien
aaaccgggtaatctgcttctaagcc

SEQ ID NO: 1897 - DNA, 25 bp, Homo sapien
aaaccgtttctcagctctgtttgcc

SEQ ID NO: 1898 - DNA, 25 bp, Homo sapien
aaaccgtttctcagttctgtttgcc

SEQ ID NO: 1899 - DNA, 25 bp, Homo sapien
aaacctagagaacgtctttgcataa

SEQ ID NO: 1900 - DNA, 25 bp, Homo sapien
aaacctagagaatgtctttgcataa

SEQ ID NO: 1901 - DNA, 25 bp, Homo sapien
aaacctcaaattttcaaagttgaag

SEQ ID NO: 1902 - DNA, 25 bp, Homo sapien
aaacctcaatctccctgttatagaa

SEQ ID NO: 1903 - DNA, 25 bp, Homo sapien
aaacctcaatcttcctgttatagaa

SEQ ID NO: 1904 - DNA, 25 bp, Homo sapien
aaacctcacacatctcagtgccaga

SEQ ID NO: 1905 - DNA, 25 bp, Homo sapien
aaacctcaccttagaggccataaaa

SEQ ID NO: 1906 - DNA, 25 bp, Homo sapien
aaacctcaccttaggggccataaaa

SEQ ID NO: 1907 - DNA, 25 bp, Homo sapien
aaacctcactgcaggaagaaactca

SEQ ID NO: 1908 - DNA, 25 bp, Homo sapien
aaacctcactgtaggaagaaactca

SEQ ID NO: 1909 - DNA, 25 bp, Homo sapien
aaacctcatacatctcagtgccaga

SEQ ID NO: 1910 - DNA, 25 bp, Homo sapien
aaacctcatattttcaaagttgaag

SEQ ID NO: 1911 - DNA, 25 bp, Homo sapien
aaacctccaaacatcagcaaaggaa

SEQ ID NO: 1912 - DNA, 25 bp, Homo sapien
aaacctccgaacatcagcaaaggaa

SEQ ID NO: 1913 - DNA, 25 bp, Homo sapien
aaacctgaagaatattatgtgaagt

SEQ ID NO: 1914 - DNA, 25 bp, Homo sapien
aaacctgaagagtattatgtgaagt

SEQ ID NO: 1915 - DNA, 25 bp, Homo sapien
aaacctgcaaatatgttatcttacg

SEQ ID NO: 1916 - DNA, 25 bp, Homo sapien
aaacctgcgaatatgttatcttacg

SEQ ID NO: 1917 - DNA, 25 bp, Homo sapien
aaacctgctccaccagctcatgttg

SEQ ID NO: 1918 - DNA, 25 bp, Homo sapien
aaacctgctccaccagttcatgttg

SEQ ID NO: 1919 - DNA, 25 bp, Homo sapien
aaacctggagatgacaactttaatt

SEQ ID NO: 1920 - DNA, 25 bp, Homo sapien
aaacctggagatggcaactttaatt

SEQ ID NO: 1921 - DNA, 25 bp, Homo sapien
aaacctgtacagcatcatactgtgc

SEQ ID NO: 1922 - DNA, 25 bp, Homo sapien
aaacctgtacagtatcatactgtgc

SEQ ID NO: 1923 - DNA, 25 bp, Homo sapien
aaacctgtccctaacaaaaattgcc

SEQ ID NO: 1924 - DNA, 25 bp, Homo sapien
aaacctgtccctaacacaaattgcc

SEQ ID NO: 1925 - DNA, 25 bp, Homo sapien
aaacctgtgtacacaaaaagttgaa

SEQ ID NO: 1926 - DNA, 25 bp, Homo sapien
aaacctgtgtacagaaaaagttgaa

SEQ ID NO: 1927 - DNA, 25 bp, Homo sapien
aaaccttcgtgacgcaacagcagga

SEQ ID NO: 1928 - DNA, 25 bp, Homo sapien
aaaccttcgtgatgcaacagcagga

SEQ ID NO: 1929 - DNA, 25 bp, Homo sapien
aaaccttttcttcagacgtagaatg

SEQ ID NO: 1930 - DNA, 25 bp, Homo sapien
aaaccttttcttccgacgtagaatg

SEQ ID NO: 1931 - DNA, 25 bp, Homo sapien
aaacgaaggtcagccgaagaagtag

SEQ ID NO: 1932 - DNA, 25 bp, Homo sapien
aaacgaaggtcagctgaagaagtag

SEQ ID NO: 1933 - DNA, 25 bp, Homo sapien
aaacgagtcctgcggctgattgctt

SEQ ID NO: 1934 - DNA, 25 bp, Homo sapien
aaacgagtcctgctgctgattgctt

SEQ ID NO: 1935 - DNA, 25 bp, Homo sapien
aaacgagttgagtcaaaggccatag

SEQ ID NO: 1936 - DNA, 25 bp, Homo sapien
aaacgagttgagtccaaggccatag

SEQ ID NO: 1937 - DNA, 25 bp, Homo sapien
aaacgatactgggcagcgaaacaac

SEQ ID NO: 1938 - DNA, 25 bp, Homo sapien
aaacgatactgggcagtgaaacaac

SEQ ID NO: 1939 - DNA, 25 bp, Homo sapien
aaacgatttttctaccaatcaacga

SEQ ID NO: 1940 - DNA, 25 bp, Homo sapien
aaacgatttttctaccgatcaacga

SEQ ID NO: 1941 - DNA, 25 bp, Homo sapien
aaacgccaatgccaaaaatatgctc

SEQ ID NO: 1942 - DNA, 25 bp, Homo sapien
aaacgccaatgccaaacatatgctc

SEQ ID NO: 1943 - DNA, 25 bp, Homo sapien
aaacgccatgttatataaatatgca

SEQ ID NO: 1944 - DNA, 25 bp, Homo sapien
aaacgccatgttatgtaaatatgca

SEQ ID NO: 1945 - DNA, 25 bp, Homo sapien
aaacgctcctagtggccaatgaaca

SEQ ID NO: 1946 - DNA, 25 bp, Homo sapien
aaacgctcctagtggctaatgaaca

SEQ ID NO: 1947 - DNA, 25 bp, Homo sapien
aaacggacccagcagagcaggacca

SEQ ID NO: 1948 - DNA, 25 bp, Homo sapien
aaacggactcagcagagcaggacca

SEQ ID NO: 1949 - DNA, 25 bp, Homo sapien
aaacgggcacgtcaatgagtggctg

SEQ ID NO: 1950 - DNA, 25 bp, Homo sapien
aaacgggcacgtccatgagtggctg

SEQ ID NO: 1951 - DNA, 25 bp, Homo sapien
aaacgtagccggtaagcctgagtat

SEQ ID NO: 1952 - DNA, 25 bp, Homo sapien
aaacgtagctggtaagcctgagtat

SEQ ID NO: 1953 - DNA, 25 bp, Homo sapien
aaacgtattctcacctacagaaaag

SEQ ID NO: 1954 - DNA, 25 bp, Homo sapien
aaacgtattctcatctacagaaaag

SEQ ID NO: 1955 - DNA, 25 bp, Homo sapien
aaacgtctatactcagcaaaatgac

SEQ ID NO: 1956 - DNA, 25 bp, Homo sapien
aaacgtctatacttagcaaaatgac

SEQ ID NO: 1957 - DNA, 25 bp, Homo sapien
aaacgtgacctcatcaaatgaacta

SEQ ID NO: 1958 - DNA, 25 bp, Homo sapien
aaacgtgacctcgtcaaatgaacta

SEQ ID NO: 1959 - DNA, 25 bp, Homo sapien
aaacgtggccccaatgcaagggtgc

SEQ ID NO: 1960 - DNA, 25 bp, Homo sapien
aaacgtggccccagtgcaagggtgc

SEQ ID NO: 1961 - DNA, 25 bp, Homo sapien
aaacgttacctaaaactcaaacaat

SEQ ID NO: 1962 - DNA, 25 bp, Homo sapien
aaacgttatctaaaactcaaacaat

SEQ ID NO: 1963 - DNA, 25 bp, Homo sapien
aaacgttttctatatttgcaccaac

SEQ ID NO: 1964 - DNA, 25 bp, Homo sapien
aaacgttttctgtatttgcaccaac

SEQ ID NO: 1965 - DNA, 25 bp, Homo sapien
aaactaaagaactcctacatagcaa

SEQ ID NO: 1966 - DNA, 25 bp, Homo sapien
aaactaaagaagtcctacatagcaa

SEQ ID NO: 1967 - DNA, 25 bp, Homo sapien
aaactaacagaaaaattggcaaagg

SEQ ID NO: 1968 - DNA, 25 bp, Homo sapien
aaactaacagagaaattggcaaagg

SEQ ID NO: 1969 - DNA, 25 bp, Homo sapien
aaactaacgcagccataactggtat

SEQ ID NO: 1970 - DNA, 25 bp, Homo sapien
aaactaacgcagccgtaactggtat

SEQ ID NO: 1971 - DNA, 25 bp, Homo sapien
aaactaagagacgatacaattttaa

SEQ ID NO: 1972 - DNA, 25 bp, Homo sapien
aaactaagagaggatacaattttaa

SEQ ID NO: 1973 - DNA, 25 bp, Homo sapien
aaactaagatccatatgccaaatct

SEQ ID NO: 1974 - DNA, 25 bp, Homo sapien
aaactaagatccctatgccaaatct

SEQ ID NO: 1975 - DNA, 25 bp, Homo sapien
aaactaatcttatgagaccactatt

SEQ ID NO: 1976 - DNA, 25 bp, Homo sapien
aaactaatcttatgaggccactatt

SEQ ID NO: 1977 - DNA, 25 bp, Homo sapien
aaactaccaaggaccaatactggag

SEQ ID NO: 1978 - DNA, 25 bp, Homo sapien
aaactaccagggaccaatactggag

SEQ ID NO: 1979 - DNA, 25 bp, Homo sapien
aaactactgtccttgttgttcaaaa

SEQ ID NO: 1980 - DNA, 25 bp, Homo sapien
aaactactgtcgttgttgttcaaaa

SEQ ID NO: 1981 - DNA, 25 bp, Homo sapien
aaactagagcaatttgagataaaca

SEQ ID NO: 1982 - DNA, 25 bp, Homo sapien
aaactagagcactttgagataaaca

SEQ ID NO: 1983 - DNA, 25 bp, Homo sapien
aaactagccattaattttagaaaga

SEQ ID NO: 1984 - DNA, 25 bp, Homo sapien
aaactagccattgattttagaaaga

SEQ ID NO: 1985 - DNA, 25 bp, Homo sapien
aaactaggaactccagctgctgctg

SEQ ID NO: 1986 - DNA, 25 bp, Homo sapien
aaactaggaactctagctgctgctg

SEQ ID NO: 1987 - DNA, 25 bp, Homo sapien
aaactagttcactcgaaaatgcagg

SEQ ID NO: 1988 - DNA, 25 bp, Homo sapien
aaactagttcacttgaaaatgcagg

SEQ ID NO: 1989 - DNA, 25 bp, Homo sapien
aaactataacttatctcccagcctt

SEQ ID NO: 1990 - DNA, 25 bp, Homo sapien
aaactataacttgtctcccagcctt

SEQ ID NO: 1991 - DNA, 25 bp, Homo sapien
aaactatgcccaacatgttttcatt

SEQ ID NO: 1992 - DNA, 25 bp, Homo sapien
aaactatgcccaatatgttttcatt

SEQ ID NO: 1993 - DNA, 25 bp, Homo sapien
aaactatggaagaggtaattgcccc

SEQ ID NO: 1994 - DNA, 25 bp, Homo sapien
aaactatggaagaggtcattgcccc

SEQ ID NO: 1995 - DNA, 25 bp, Homo sapien
aaactatggtctctgagtgatagtg

SEQ ID NO: 1996 - DNA, 25 bp, Homo sapien
aaactatggtctcttagtgatagtg

SEQ ID NO: 1997 - DNA, 25 bp, Homo sapien
aaactattacacatttgccaaggta

SEQ ID NO: 1998 - DNA, 25 bp, Homo sapien
aaactattatacatttgccaaggta

SEQ ID NO: 1999 - DNA, 25 bp, Homo sapien
aaactcaaaacatccacgggtaaca

SEQ ID NO: 2000 - DNA, 25 bp, Homo sapien
aaactcaaaatgaccgtgaaaggag

SEQ ID NO: 2001 - DNA, 25 bp, Homo sapien
aaactcaaaatgacggtgaaaggag

SEQ ID NO: 2002 - DNA, 25 bp, Homo sapien
aaactcaaagcatccacgggtaaca

SEQ ID NO: 2003 - DNA, 25 bp, Homo sapien
aaactcaagacttcctcatagcatc

SEQ ID NO: 2004 - DNA, 25 bp, Homo sapien
aaactcaagccacaatattcacatt

SEQ ID NO: 2005 - DNA, 25 bp, Homo sapien
aaactcaagccacagtattcacatt

SEQ ID NO: 2006 - DNA, 25 bp, Homo sapien
aaactcaaggcacggtataaataaa

SEQ ID NO: 2007 - DNA, 25 bp, Homo sapien
aaactcaaggcatggtataaataaa

SEQ ID NO: 2008 - DNA, 25 bp, Homo sapien
aaactcaagtcttcctcatagcatc

SEQ ID NO: 2009 - DNA, 25 bp, Homo sapien
aaactcacaaaatgcccaaagaatc

SEQ ID NO: 2010 - DNA, 25 bp, Homo sapien
aaactcacacaatgcccaaagaatc

SEQ ID NO: 2011 - DNA, 25 bp, Homo sapien
aaactcacaccaccaatgaggcagt

SEQ ID NO: 2012 - DNA, 25 bp, Homo sapien
aaactcacaccgccaatgaggcagt

SEQ ID NO: 2013 - DNA, 25 bp, Homo sapien
aaactcacatatacggaaatgtatt

SEQ ID NO: 2014 - DNA, 25 bp, Homo sapien
aaactcacgtatacggaaatgtatt

SEQ ID NO: 2015 - DNA, 25 bp, Homo sapien
aaactcatataaatgtaggaggaat

SEQ ID NO: 2016 - DNA, 25 bp, Homo sapien
aaactcatatagatgtaggaggaat

SEQ ID NO: 2017 - DNA, 25 bp, Homo sapien
aaactcatcatcgcatttgctttat

SEQ ID NO: 2018 - DNA, 25 bp, Homo sapien
aaactcatcattgcatttgctttat

SEQ ID NO: 2019 - DNA, 25 bp, Homo sapien
aaactccaatctcaccattggctga

SEQ ID NO: 2020 - DNA, 25 bp, Homo sapien
aaactccaatctcaccgttggctga

SEQ ID NO: 2021 - DNA, 25 bp, Homo sapien
aaactccagccaaaaagaggagaga

SEQ ID NO: 2022 - DNA, 25 bp, Homo sapien
aaactccagccacaaagaggagaga

SEQ ID NO: 2023 - DNA, 25 bp, Homo sapien
aaactcccatttcgacattctgaac

SEQ ID NO: 2024 - DNA, 25 bp, Homo sapien
aaactcccgtttcgacattctgaac

SEQ ID NO: 2025 - DNA, 25 bp, Homo sapien
aaactccctggcctagtatttaagg

SEQ ID NO: 2026 - DNA, 25 bp, Homo sapien
aaactccctggcctggtatttaagg

SEQ ID NO: 2027 - DNA, 25 bp, Homo sapien
aaactcgctgtaaggtgaaggcctg

SEQ ID NO: 2028 - DNA, 25 bp, Homo sapien
aaactcgctgtaagttgaaggcctg

SEQ ID NO: 2029 - DNA, 25 bp, Homo sapien
aaactcggattgaggtctcaatatc

SEQ ID NO: 2030 - DNA, 25 bp, Homo sapien
aaactcggattgaggtttcaatatc

SEQ ID NO: 2031 - DNA, 25 bp, Homo sapien
aaactctaagatacttctcttttat

SEQ ID NO: 2032 - DNA, 25 bp, Homo sapien
aaactctaagatacttttcttttat

SEQ ID NO: 2033 - DNA, 25 bp, Homo sapien
aaactctacagaagatgttggaagc

SEQ ID NO: 2034 - DNA, 25 bp, Homo sapien
aaactctacagaagattttggaagc

SEQ ID NO: 2035 - DNA, 25 bp, Homo sapien
aaactctacctattattgataaact

SEQ ID NO: 2036 - DNA, 25 bp, Homo sapien
aaactctacctatttttgataaact

SEQ ID NO: 2037 - DNA, 25 bp, Homo sapien
aaactctgaaggggcccattctcaa

SEQ ID NO: 2038 - DNA, 25 bp, Homo sapien
aaactctgaatatgcaatattttcc

SEQ ID NO: 2039 - DNA, 25 bp, Homo sapien
aaactctgagggggcccattctcaa

SEQ ID NO: 2040 - DNA, 25 bp, Homo sapien
aaactctgcctaagacaccacactc

SEQ ID NO: 2041 - DNA, 25 bp, Homo sapien
aaactctgcctaagacgccacactc

SEQ ID NO: 2042 - DNA, 25 bp, Homo sapien
aaactctgcttgcctgagattggta

SEQ ID NO: 2043 - DNA, 25 bp, Homo sapien
aaactctgcttgcctgggattggta

SEQ ID NO: 2044 - DNA, 25 bp, Homo sapien
aaactctgtatatgcaatattttcc

SEQ ID NO: 2045 - DNA, 25 bp, Homo sapien
aaactcttaattctttcctctgagt

SEQ ID NO: 2046 - DNA, 25 bp, Homo sapien
aaactcttacttctttcctctgagt

SEQ ID NO: 2047 - DNA, 25 bp, Homo sapien
aaactcttccctttggagcagcagc

SEQ ID NO: 2048 - DNA, 25 bp, Homo sapien
aaactcttcgctttggagcagcagc

SEQ ID NO: 2049 - DNA, 25 bp, Homo sapien
aaactgaacaaaggattgtttctcc

SEQ ID NO: 2050 - DNA, 25 bp, Homo sapien
aaactgaacaaatgattgtttctcc

SEQ ID NO: 2051 - DNA, 25 bp, Homo sapien
aaactgaacaggaactcaagtcact

SEQ ID NO: 2052 - DNA, 25 bp, Homo sapien
aaactgaataggaactcaagtcact

SEQ ID NO: 2053 - DNA, 25 bp, Homo sapien
aaactgacaatatctatgggtatct

SEQ ID NO: 2054 - DNA, 25 bp, Homo sapien
aaactgacaggcttgaataaagaat

SEQ ID NO: 2055 - DNA, 25 bp, Homo sapien
aaactgacagtatctatgggtatct

SEQ ID NO: 2056 - DNA, 25 bp, Homo sapien
aaactgactcaacgttcccaactgg

SEQ ID NO: 2057 - DNA, 25 bp, Homo sapien
aaactgactcaatgttcccaactgg

SEQ ID NO: 2058 - DNA, 25 bp, Homo sapien
aaactgactggcttgaataaagaat

SEQ ID NO: 2059 - DNA, 25 bp, Homo sapien
aaactgacttgaatacttctgagca

SEQ ID NO: 2060 - DNA, 25 bp, Homo sapien
aaactgacttgagtacttctgagca

SEQ ID NO: 2061 - DNA, 25 bp, Homo sapien
aaactgagacttacgagattcgctt

SEQ ID NO: 2062 - DNA, 25 bp, Homo sapien
aaactgagacttatgagattcgctt

SEQ ID NO: 2063 - DNA, 25 bp, Homo sapien
aaactgagccagctgtgatactatt

SEQ ID NO: 2064 - DNA, 25 bp, Homo sapien
aaactgagccagttgtgatactatt

SEQ ID NO: 2065 - DNA, 25 bp, Homo sapien
aaactgaggatcattcacctgaaga

SEQ ID NO: 2066 - DNA, 25 bp, Homo sapien
aaactgaggattattcacctgaaga

SEQ ID NO: 2067 - DNA, 25 bp, Homo sapien
aaactgattgcccttattcaatctg

SEQ ID NO: 2068 - DNA, 25 bp, Homo sapien
aaactgatttcccttattcaatctg

SEQ ID NO: 2069 - DNA, 25 bp, Homo sapien
aaactgcaatgagcgttgattgatc

SEQ ID NO: 2070 - DNA, 25 bp, Homo sapien
aaactgcaattcctccagaatctga

SEQ ID NO: 2071 - DNA, 25 bp, Homo sapien
aaactgcacttcctccagaatctga

SEQ ID NO: 2072 - DNA, 25 bp, Homo sapien
aaactgcagtgagcgttgattgatc

SEQ ID NO: 2073 - DNA, 25 bp, Homo sapien
aaactggaataatgcaagaggtagt

SEQ ID NO: 2074 - DNA, 25 bp, Homo sapien
aaactggaataatgcaggaggtagt

SEQ ID NO: 2075 - DNA, 25 bp, Homo sapien
aaactggactatacgaatgcatttt

SEQ ID NO: 2076 - DNA, 25 bp, Homo sapien
aaactggactatatgaatgcatttt

SEQ ID NO: 2077 - DNA, 25 bp, Homo sapien
aaactggagagttcatcaccaatag

SEQ ID NO: 2078 - DNA, 25 bp, Homo sapien
aaactggagagttcgtcaccaatag

SEQ ID NO: 2079 - DNA, 25 bp, Homo sapien
aaactggagcaaaaaaccctatgga

SEQ ID NO: 2080 - DNA, 25 bp, Homo sapien
aaactggagtaaaaaaccctatgga

SEQ ID NO: 2081 - DNA, 25 bp, Homo sapien
aaactggatatgctttctacattgt

SEQ ID NO: 2082 - DNA, 25 bp, Homo sapien
aaactggatattctttctacattgt

SEQ ID NO: 2083 - DNA, 25 bp, Homo sapien
aaactggattaatcccatgtgtttg

SEQ ID NO: 2084 - DNA, 25 bp, Homo sapien
aaactggattaatcccttgtgtttg

SEQ ID NO: 2085 - DNA, 25 bp, Homo sapien
aaactggcctggattgacaagcgca

SEQ ID NO: 2086 - DNA, 25 bp, Homo sapien
aaactggcctgggttgacaagcgca

SEQ ID NO: 2087 - DNA, 25 bp, Homo sapien
aaactgggcatcttgagttttagct

SEQ ID NO: 2088 - DNA, 25 bp, Homo sapien
aaactgggcattttgagttttagct

SEQ ID NO: 2089 - DNA, 25 bp, Homo sapien
aaactggggtactactatacaactg

SEQ ID NO: 2090 - DNA, 25 bp, Homo sapien
aaactggggtactgctatacaactg

SEQ ID NO: 2091 - DNA, 25 bp, Homo sapien
aaactggtaaccgtaagtaaatgtt

SEQ ID NO: 2092 - DNA, 25 bp, Homo sapien
aaactggtaactgtaagtaaatgtt

SEQ ID NO: 2093 - DNA, 25 bp, Homo sapien
aaactggtccccgataaaaactggt

SEQ ID NO: 2094 - DNA, 25 bp, Homo sapien
aaactggtccctgataaaaactggt

SEQ ID NO: 2095 - DNA, 25 bp, Homo sapien
aaactgtacactttccacatttgtg

SEQ ID NO: 2096 - DNA, 25 bp, Homo sapien
aaactgtacgctttccacatttgtg

SEQ ID NO: 2097 - DNA, 25 bp, Homo sapien
aaactgtggagcaaccaagcatcct

SEQ ID NO: 2098 - DNA, 25 bp, Homo sapien
aaactgtggagcaagcaagcatcct

SEQ ID NO: 2099 - DNA, 25 bp, Homo sapien
aaactgtttttacatgaatgaaggc

SEQ ID NO: 2100 - DNA, 25 bp, Homo sapien
aaactgtttttacgtgaatgaaggc

SEQ ID NO: 2101 - DNA, 25 bp, Homo sapien
aaacttaaagaaaacatacaaggag

SEQ ID NO: 2102 - DNA, 25 bp, Homo sapien
aaacttaaagaacacatacaaggag

SEQ ID NO: 2103 - DNA, 25 bp, Homo sapien
aaacttaactactaatagcccactc

SEQ ID NO: 2104 - DNA, 25 bp, Homo sapien
aaacttaactactgatagcccactc

SEQ ID NO: 2105 - DNA, 25 bp, Homo sapien
aaacttaactccaccccagactgct

SEQ ID NO: 2106 - DNA, 25 bp, Homo sapien
aaacttaactccacccgagactgct

SEQ ID NO: 2107 - DNA, 25 bp, Homo sapien
aaacttaagctcatagacatgttta

SEQ ID NO: 2108 - DNA, 25 bp, Homo sapien
aaacttaagctcataggcatgttta

SEQ ID NO: 2109 - DNA, 25 bp, Homo sapien
aaacttacaaaaagatgataaattc

SEQ ID NO: 2110 - DNA, 25 bp, Homo sapien
aaacttacaaatgctaccagtgtgg

SEQ ID NO: 2111 - DNA, 25 bp, Homo sapien
aaacttacaaatgttaccagtgtgg

SEQ ID NO: 2112 - DNA, 25 bp, Homo sapien
aaacttacacccattgattagtagc

SEQ ID NO: 2113 - DNA, 25 bp, Homo sapien
aaacttacgaaaagatgataaattc

SEQ ID NO: 2114 - DNA, 25 bp, Homo sapien
aaacttacgcccattgattagtagc

SEQ ID NO: 2115 - DNA, 25 bp, Homo sapien
aaacttagaatgatgtcacattgtc

SEQ ID NO: 2116 - DNA, 25 bp, Homo sapien
aaacttagaatgctgtcacattgtc

SEQ ID NO: 2117 - DNA, 25 bp, Homo sapien
aaacttagccggaaagcccacatag

SEQ ID NO: 2118 - DNA, 25 bp, Homo sapien
aaacttagctggaaagcccacatag

SEQ ID NO: 2119 - DNA, 25 bp, Homo sapien
aaacttaggaacatattttatgaga

SEQ ID NO: 2120 - DNA, 25 bp, Homo sapien
aaacttaggaacgtattttatgaga

SEQ ID NO: 2121 - DNA, 25 bp, Homo sapien
aaacttcaacccatgcctatggaat

SEQ ID NO: 2122 - DNA, 25 bp, Homo sapien
aaacttcaacccatgcttatggaat

SEQ ID NO: 2123 - DNA, 25 bp, Homo sapien
aaacttcaataaactatcctgatgg

SEQ ID NO: 2124 - DNA, 25 bp, Homo sapien
aaacttcaataacctatcctgatgg

SEQ ID NO: 2125 - DNA, 25 bp, Homo sapien
aaacttcacgatcgggtagtattac

SEQ ID NO: 2126 - DNA, 25 bp, Homo sapien
aaacttcagagaacgatttcttaag

SEQ ID NO: 2127 - DNA, 25 bp, Homo sapien
aaacttcagagaatgatttcttaag

SEQ ID NO: 2128 - DNA, 25 bp, Homo sapien
aaacttcatctcatattcacagaga

SEQ ID NO: 2129 - DNA, 25 bp, Homo sapien
aaacttcatcttatattcacagaga

SEQ ID NO: 2130 - DNA, 25 bp, Homo sapien
aaacttcatgatcgggtagtattac

SEQ ID NO: 2131 - DNA, 25 bp, Homo sapien
aaacttctagagacatcacgaatcc

SEQ ID NO: 2132 - DNA, 25 bp, Homo sapien
aaacttctagagacttcacgaatcc

SEQ ID NO: 2133 - DNA, 25 bp, Homo sapien
aaacttctagtagcaaaaacagcag

SEQ ID NO: 2134 - DNA, 25 bp, Homo sapien
aaacttctagtagcaataacagcag

SEQ ID NO: 2135 - DNA, 25 bp, Homo sapien
aaacttctcaaagtccataacattt

SEQ ID NO: 2136 - DNA, 25 bp, Homo sapien
aaacttctcaaagtccctaacattt

SEQ ID NO: 2137 - DNA, 25 bp, Homo sapien
aaacttctccagatagcaggatagc

SEQ ID NO: 2138 - DNA, 25 bp, Homo sapien
aaacttctccagatcgcaggatagc

SEQ ID NO: 2139 - DNA, 25 bp, Homo sapien
aaacttctggtactcattaggccca

SEQ ID NO: 2140 - DNA, 25 bp, Homo sapien
aaacttctgttactcattaggccca

SEQ ID NO: 2141 - DNA, 25 bp, Homo sapien
aaacttcttgcatgttatatggctt

SEQ ID NO: 2142 - DNA, 25 bp, Homo sapien
aaacttcttgcatgttttatggctt

SEQ ID NO: 2143 - DNA, 25 bp, Homo sapien
aaacttctttttgcccaatttgtaa

SEQ ID NO: 2144 - DNA, 25 bp, Homo sapien
aaacttctttttgcgcaatttgtaa

SEQ ID NO: 2145 - DNA, 25 bp, Homo sapien
aaacttggaacccatgctgtggtat

SEQ ID NO: 2146 - DNA, 25 bp, Homo sapien
aaacttggaacccgtgctgtggtat

SEQ ID NO: 2147 - DNA, 25 bp, Homo sapien
aaacttgtactaacgttatgacatg

SEQ ID NO: 2148 - DNA, 25 bp, Homo sapien
aaacttgtactaatgttatgacatg

SEQ ID NO: 2149 - DNA, 25 bp, Homo sapien
aaacttgtgtttcatgaatcctctc

SEQ ID NO: 2150 - DNA, 25 bp, Homo sapien
aaacttgtgttttatgaatcctctc

SEQ ID NO: 2151 - DNA, 25 bp, Homo sapien
aaacttgttcatcgcctatcaagca

SEQ ID NO: 2152 - DNA, 25 bp, Homo sapien
aaacttgttcattgcctatcaagca

SEQ ID NO: 2153 - DNA, 25 bp, Homo sapien
aaactttaattgatgtaattaacgc

SEQ ID NO: 2154 - DNA, 25 bp, Homo sapien
aaactttacagaagactagtaacat

SEQ ID NO: 2155 - DNA, 25 bp, Homo sapien
aaactttactatctgaatgtgtact

SEQ ID NO: 2156 - DNA, 25 bp, Homo sapien
aaactttactatgtgaatgtgtact

SEQ ID NO: 2157 - DNA, 25 bp, Homo sapien
aaactttagagaagactagtaacat

SEQ ID NO: 2158 - DNA, 25 bp, Homo sapien
aaactttagttgatgtaattaacgc

SEQ ID NO: 2159 - DNA, 25 bp, Homo sapien
aaactttatggctaatcatttgtct

SEQ ID NO: 2160 - DNA, 25 bp, Homo sapien
aaactttatggctagtcatttgtct

SEQ ID NO: 2161 - DNA, 25 bp, Homo sapien
aaactttatttctcagcacataatt

SEQ ID NO: 2162 - DNA, 25 bp, Homo sapien
aaactttatttgtcagcacataatt

SEQ ID NO: 2163 - DNA, 25 bp, Homo sapien
aaactttccttccgataggtttttc

SEQ ID NO: 2164 - DNA, 25 bp, Homo sapien
aaactttccttctgataggtttttc

SEQ ID NO: 2165 - DNA, 25 bp, Homo sapien
aaactttctactccgaagctgtttt

SEQ ID NO: 2166 - DNA, 25 bp, Homo sapien
aaactttctactcctaagctgtttt

SEQ ID NO: 2167 - DNA, 25 bp, Homo sapien
aaactttctccataacaataggctg

SEQ ID NO: 2168 - DNA, 25 bp, Homo sapien
aaactttctccatatcaataggctg

SEQ ID NO: 2169 - DNA, 25 bp, Homo sapien
aaactttggttttcccatcagcaga

SEQ ID NO: 2170 - DNA, 25 bp, Homo sapien
aaactttggttttctcatcagcaga

SEQ ID NO: 2171 - DNA, 25 bp, Homo sapien
aaactttgtcaacaaatttggacac

SEQ ID NO: 2172 - DNA, 25 bp, Homo sapien
aaactttgtcaataaatttggacac

SEQ ID NO: 2173 - DNA, 25 bp, Homo sapien
aaacttttacaatgatggcagaatt

SEQ ID NO: 2174 - DNA, 25 bp, Homo sapien
aaacttttacaatggtggcagaatt

SEQ ID NO: 2175 - DNA, 25 bp, Homo sapien
aaactttttctgcgcagctcatcaa

SEQ ID NO: 2176 - DNA, 25 bp, Homo sapien
aaactttttctgctcagctcatcaa

SEQ ID NO: 2177 - DNA, 25 bp, Homo sapien
aaagaaaaaaattatgaaagtgtct

SEQ ID NO: 2178 - DNA, 25 bp, Homo sapien
aaagaaaaaaattatggaagtgtct

SEQ ID NO: 2179 - DNA, 25 bp, Homo sapien
aaagaaaaaaggacagtgagtagta

SEQ ID NO: 2180 - DNA, 25 bp, Homo sapien
aaagaaaaaagggcagtgagtagta

SEQ ID NO: 2181 - DNA, 25 bp, Homo sapien
aaagaaaaaatactgaatttgaaaa

SEQ ID NO: 2182 - DNA, 25 bp, Homo sapien
aaagaaaaaatattgaatttgaaaa

SEQ ID NO: 2183 - DNA, 25 bp, Homo sapien
aaagaaaactattcttggctgaggc

SEQ ID NO: 2184 - DNA, 25 bp, Homo sapien
aaagaaaagtaagaggatgccaaaa

SEQ ID NO: 2185 - DNA, 25 bp, Homo sapien
aaagaaaagtaagagggtgccaaaa

SEQ ID NO: 2186 - DNA, 25 bp, Homo sapien
aaagaaaagtattcttggctgaggc

SEQ ID NO: 2187 - DNA, 25 bp, Homo sapien
aaagaaaatacactgtgtaagtccc

SEQ ID NO: 2188 - DNA, 25 bp, Homo sapien
aaagaaaatacactgtttaagtccc

SEQ ID NO: 2189 - DNA, 25 bp, Homo sapien
aaagaaaatactcagatagctttac

SEQ ID NO: 2190 - DNA, 25 bp, Homo sapien
aaagaaaatactgagatagctttac

SEQ ID NO: 2191 - DNA, 25 bp, Homo sapien
aaagaaaatgaaagcacctttctgg

SEQ ID NO: 2192 - DNA, 25 bp, Homo sapien
aaagaaaattaaagcacctttctgg

SEQ ID NO: 2193 - DNA, 25 bp, Homo sapien
aaagaaaattcaccatatagttgaa

SEQ ID NO: 2194 - DNA, 25 bp, Homo sapien
aaagaaaattcaccgtatagttgaa

SEQ ID NO: 2195 - DNA, 25 bp, Homo sapien
aaagaaaatttcgatgaggttccta

SEQ ID NO: 2196 - DNA, 25 bp, Homo sapien
aaagaaaattttgatgaggttccta

SEQ ID NO: 2197 - DNA, 25 bp, Homo sapien
aaagaaacaaacggagaccaaaata

SEQ ID NO: 2198 - DNA, 25 bp, Homo sapien
aaagaaacaaatggagaccaaaata

SEQ ID NO: 2199 - DNA, 25 bp, Homo sapien
aaagaaaccaagaccctggagatac

SEQ ID NO: 2200 - DNA, 25 bp, Homo sapien
aaagaaaccaagatcctggagatac

SEQ ID NO: 2201 - DNA, 25 bp, Homo sapien
aaagaaactcaggtttggcatgtca

SEQ ID NO: 2202 - DNA, 25 bp, Homo sapien
aaagaaactcagttttggcatgtca

SEQ ID NO: 2203 - DNA, 25 bp, Homo sapien
aaagaaagaaggagcacaagagggt

SEQ ID NO: 2204 - DNA, 25 bp, Homo sapien
aaagaaagaaggaggacaagagggt

SEQ ID NO: 2205 - DNA, 25 bp, Homo sapien
aaagaaagccgaataacagatgcat

SEQ ID NO: 2206 - DNA, 25 bp, Homo sapien
aaagaaagctcctgccatgtgttca

SEQ ID NO: 2207 - DNA, 25 bp, Homo sapien
aaagaaagctcctgccgtgtgttca

SEQ ID NO: 2208 - DNA, 25 bp, Homo sapien
aaagaaagctgaataacagatgcat

SEQ ID NO: 2209 - DNA, 25 bp, Homo sapien
aaagaaaggacatgcgagtgagaaa

SEQ ID NO: 2210 - DNA, 25 bp, Homo sapien
aaagaaagggcatgcgagtgagaaa

SEQ ID NO: 2211 - DNA, 25 bp, Homo sapien
aaagaaataaaagtggctgctgatt

SEQ ID NO: 2212 - DNA, 25 bp, Homo sapien
aaagaaataaaagtggttgctgatt

SEQ ID NO: 2213 - DNA, 25 bp, Homo sapien
aaagaaataagatcggagaagaaca

SEQ ID NO: 2214 - DNA, 25 bp, Homo sapien
aaagaaataagattggagaagaaca

SEQ ID NO: 2215 - DNA, 25 bp, Homo sapien
aaagaaatgaagatttgtgaattgc

SEQ ID NO: 2216 - DNA, 25 bp, Homo sapien
aaagaaatgaccatggctctttgat

SEQ ID NO: 2217 - DNA, 25 bp, Homo sapien
aaagaaatgaccatggttctttgat

SEQ ID NO: 2218 - DNA, 25 bp, Homo sapien
aaagaaatggagatttgtgaattgc

SEQ ID NO: 2219 - DNA, 25 bp, Homo sapien
aaagaaatttcccagaacaaaagac

SEQ ID NO: 2220 - DNA, 25 bp, Homo sapien
aaagaaatttcccataacaaaagac

SEQ ID NO: 2221 - DNA, 25 bp, Homo sapien
aaagaacaactctaccaactaattc

SEQ ID NO: 2222 - DNA, 25 bp, Homo sapien
aaagaacaatgacgactataacagg

SEQ ID NO: 2223 - DNA, 25 bp, Homo sapien
aaagaacaatgatgactataacagg

SEQ ID NO: 2224 - DNA, 25 bp, Homo sapien
aaagaacaattctaccaactaattc

SEQ ID NO: 2225 - DNA, 25 bp, Homo sapien
aaagaacacacagctacagggacaa

SEQ ID NO: 2226 - DNA, 25 bp, Homo sapien
aaagaacacctcatttattatattg

SEQ ID NO: 2227 - DNA, 25 bp, Homo sapien
aaagaacacgcagctacagggacaa

SEQ ID NO: 2228 - DNA, 25 bp, Homo sapien
aaagaacatatatataaaggacctt

SEQ ID NO: 2229 - DNA, 25 bp, Homo sapien
aaagaacatatgtataaaggacctt

SEQ ID NO: 2230 - DNA, 25 bp, Homo sapien
aaagaacatctcatttattatattg

SEQ ID NO: 2231 - DNA, 25 bp, Homo sapien
aaagaaccacgcagaagtgctcagg

SEQ ID NO: 2232 - DNA, 25 bp, Homo sapien
aaagaaccatgcagaagtgctcagg

SEQ ID NO: 2233 - DNA, 25 bp, Homo sapien
aaagaacccagatactctggaggaa

SEQ ID NO: 2234 - DNA, 25 bp, Homo sapien
aaagaacctagatactctggaggaa

SEQ ID NO: 2235 - DNA, 25 bp, Homo sapien
aaagaacgaagaagatggcaaagat

SEQ ID NO: 2236 - DNA, 25 bp, Homo sapien
aaagaacgaagaaggtggcaaagat

SEQ ID NO: 2237 - DNA, 25 bp, Homo sapien
aaagaacgtggcttaacgaacctca

SEQ ID NO: 2238 - DNA, 25 bp, Homo sapien
aaagaacgtggcttaatgaacctca

SEQ ID NO: 2239 - DNA, 25 bp, Homo sapien
aaagaagaaattgaagatgttgaca

SEQ ID NO: 2240 - DNA, 25 bp, Homo sapien
aaagaagagattgaagatgttgaca

SEQ ID NO: 2241 - DNA, 25 bp, Homo sapien
aaagaagcaacatggtagacatcat

SEQ ID NO: 2242 - DNA, 25 bp, Homo sapien
aaagaagcaccatggtagacatcat

SEQ ID NO: 2243 - DNA, 25 bp, Homo sapien
aaagaagcttcatctatttctccag

SEQ ID NO: 2244 - DNA, 25 bp, Homo sapien
aaagaagcttcatttatttctccag

SEQ ID NO: 2245 - DNA, 25 bp, Homo sapien
aaagaaggtttgggtcattctgtca

SEQ ID NO: 2246 - DNA, 25 bp, Homo sapien
aaagaaggtttgggtcgttctgtca

SEQ ID NO: 2247 - DNA, 25 bp, Homo sapien
aaagaagtatcaaggtatatatgaa

SEQ ID NO: 2248 - DNA, 25 bp, Homo sapien
aaagaagtatcagggtatatatgaa

SEQ ID NO: 2249 - DNA, 25 bp, Homo sapien
aaagaagtgaaacaggataaaatga

SEQ ID NO: 2250 - DNA, 25 bp, Homo sapien
aaagaagtgaaacgggataaaatga

SEQ ID NO: 2251 - DNA, 25 bp, Homo sapien
aaagaataaaaatacggtcatagtc

SEQ ID NO: 2252 - DNA, 25 bp, Homo sapien
aaagaataaaaatgcggtcatagtc

SEQ ID NO: 2253 - DNA, 25 bp, Homo sapien
aaagaataatttaaaacacctccaa

SEQ ID NO: 2254 - DNA, 25 bp, Homo sapien
aaagaatacacagctatacagggac

SEQ ID NO: 2255 - DNA, 25 bp, Homo sapien
aaagaatacccaaagaaaccatgaa

SEQ ID NO: 2256 - DNA, 25 bp, Homo sapien
aaagaatacccagagaaaccatgaa

SEQ ID NO: 2257 - DNA, 25 bp, Homo sapien
aaagaatacgagtaaacataaaatg

SEQ ID NO: 2258 - DNA, 25 bp, Homo sapien
aaagaatatacagctatacagggac

SEQ ID NO: 2259 - DNA, 25 bp, Homo sapien
aaagaatatgagtaaacataaaatg

SEQ ID NO: 2260 - DNA, 25 bp, Homo sapien
aaagaatattttaaaacacctccaa

SEQ ID NO: 2261 - DNA, 25 bp, Homo sapien
aaagaatcagagttttttcagaatt

SEQ ID NO: 2262 - DNA, 25 bp, Homo sapien
aaagaatcgatctgatttccacagg

SEQ ID NO: 2263 - DNA, 25 bp, Homo sapien
aaagaatcggagttttttcagaatt

SEQ ID NO: 2264 - DNA, 25 bp, Homo sapien
aaagaatctatctgatttccacagg

SEQ ID NO: 2265 - DNA, 25 bp, Homo sapien
aaagaatctgaagctaggtatgcct

SEQ ID NO: 2266 - DNA, 25 bp, Homo sapien
aaagaatctgacgctaggtatgcct

SEQ ID NO: 2267 - DNA, 25 bp, Homo sapien
aaagaatggagtgtcggcatgaaat

SEQ ID NO: 2268 - DNA, 25 bp, Homo sapien
aaagaatggagtgttggcatgaaat

SEQ ID NO: 2269 - DNA, 25 bp, Homo sapien
aaagaatggtagatgggaacatcca

SEQ ID NO: 2270 - DNA, 25 bp, Homo sapien
aaagaatggtaggtgggaacatcca

SEQ ID NO: 2271 - DNA, 25 bp, Homo sapien
aaagaattaaactgatggtaagaaa

SEQ ID NO: 2272 - DNA, 25 bp, Homo sapien
aaagaattaaattgatggtaagaaa

SEQ ID NO: 2273 - DNA, 25 bp, Homo sapien
aaagaattcttcactgtcaaattat

SEQ ID NO: 2274 - DNA, 25 bp, Homo sapien
aaagaattcttcgctgtcaaattat

SEQ ID NO: 2275 - DNA, 25 bp, Homo sapien
aaagaattgcctaatatcataaaaa

SEQ ID NO: 2276 - DNA, 25 bp, Homo sapien
aaagaattgcctgatatcataaaaa

SEQ ID NO: 2277 - DNA, 25 bp, Homo sapien
aaagaatttttgacagattttaatg

SEQ ID NO: 2278 - DNA, 25 bp, Homo sapien
aaagaatttttgacggattttaatg

SEQ ID NO: 2279 - DNA, 25 bp, Homo sapien
aaagacaaatgagaacagatctacc

SEQ ID NO: 2280 - DNA, 25 bp, Homo sapien
aaagacaaatgataacagatctacc

SEQ ID NO: 2281 - DNA, 25 bp, Homo sapien
aaagacaacacacatagcaatttaa

SEQ ID NO: 2282 - DNA, 25 bp, Homo sapien
aaagacaacacacgtagcaatttaa

SEQ ID NO: 2283 - DNA, 25 bp, Homo sapien
aaagacaacttttccacggactgag

SEQ ID NO: 2284 - DNA, 25 bp, Homo sapien
aaagacaacttttccatggactgag

SEQ ID NO: 2285 - DNA, 25 bp, Homo sapien
aaagacacaactatggctcacgact

SEQ ID NO: 2286 - DNA, 25 bp, Homo sapien
aaagacacaagggaataatatgtgc

SEQ ID NO: 2287 - DNA, 25 bp, Homo sapien
aaagacacaagggagtaatatgtgc

SEQ ID NO: 2288 - DNA, 25 bp, Homo sapien
aaagacacagctatggctcacgact

SEQ ID NO: 2289 - DNA, 25 bp, Homo sapien
aaagacaccataaataggatacagc

SEQ ID NO: 2290 - DNA, 25 bp, Homo sapien
aaagacactataaataggatacagc

SEQ ID NO: 2291 - DNA, 25 bp, Homo sapien
aaagacactgtgctcaatatttact

SEQ ID NO: 2292 - DNA, 25 bp, Homo sapien
aaagacactgtgctcagtatttact

SEQ ID NO: 2293 - DNA, 25 bp, Homo sapien
aaagacacttttcgtaaggaatgag

SEQ ID NO: 2294 - DNA, 25 bp, Homo sapien
aaagacacttttcttaaggaatgag

SEQ ID NO: 2295 - DNA, 25 bp, Homo sapien
aaagacaggcccggagggagaagag

SEQ ID NO: 2296 - DNA, 25 bp, Homo sapien
aaagacaggcctggagggagaagag

SEQ ID NO: 2297 - DNA, 25 bp, Homo sapien
aaagacattccatgaacaaggattg

SEQ ID NO: 2298 - DNA, 25 bp, Homo sapien
aaagacattctaaaaggcagtttat

SEQ ID NO: 2299 - DNA, 25 bp, Homo sapien
aaagacattctaaagggcagtttat

SEQ ID NO: 2300 - DNA, 25 bp, Homo sapien
aaagacattgtagcatcagagatat

SEQ ID NO: 2301 - DNA, 25 bp, Homo sapien
aaagacattgtagcgtcagagatat

SEQ ID NO: 2302 - DNA, 25 bp, Homo sapien
aaagacatttcatgaacaaggattg

SEQ ID NO: 2303 - DNA, 25 bp, Homo sapien
aaagaccaaaaaatcttacgaactg

SEQ ID NO: 2304 - DNA, 25 bp, Homo sapien
aaagaccaaaaagtcttacgaactg

SEQ ID NO: 2305 - DNA, 25 bp, Homo sapien
aaagaccatttgactctatttgtat

SEQ ID NO: 2306 - DNA, 25 bp, Homo sapien
aaagaccattttactctatttgtat

SEQ ID NO: 2307 - DNA, 25 bp, Homo sapien
aaagacctcatatttctgcagggcc

SEQ ID NO: 2308 - DNA, 25 bp, Homo sapien
aaagaccttatatttctgcagggcc

SEQ ID NO: 2309 - DNA, 25 bp, Homo sapien
aaagactaaataagtagtgtctgaa

SEQ ID NO: 2310 - DNA, 25 bp, Homo sapien
aaagactaagtaagtagtgtctgaa

SEQ ID NO: 2311 - DNA, 25 bp, Homo sapien
aaagactctctttaaaaaatgaaaa

SEQ ID NO: 2312 - DNA, 25 bp, Homo sapien
aaagactctctttgaaaaatgaaaa

SEQ ID NO: 2313 - DNA, 25 bp, Homo sapien
aaagactgagcatagggttcccagt

SEQ ID NO: 2314 - DNA, 25 bp, Homo sapien
aaagactgagcgtagggttcccagt

SEQ ID NO: 2315 - DNA, 25 bp, Homo sapien
aaagactgtcacagcagaaagtgtc

SEQ ID NO: 2316 - DNA, 25 bp, Homo sapien
aaagactgtcacggcagaaagtgtc

SEQ ID NO: 2317 - DNA, 25 bp, Homo sapien
aaagacttgcccacaaatagtcaca

SEQ ID NO: 2318 - DNA, 25 bp, Homo sapien
aaagacttgcccaccaatagtcaca

SEQ ID NO: 2319 - DNA, 25 bp, Homo sapien
aaagactttaatcttaacctctaat

SEQ ID NO: 2320 - DNA, 25 bp, Homo sapien
aaagactttaattttaacctctaat

SEQ ID NO: 2321 - DNA, 25 bp, Homo sapien
aaagagaaaaagatgagtaagcatt

SEQ ID NO: 2322 - DNA, 25 bp, Homo sapien
aaagagaaaagtatgcaaaacatta

SEQ ID NO: 2323 - DNA, 25 bp, Homo sapien
aaagagaaaagtgtgcaaaacatta

SEQ ID NO: 2324 - DNA, 25 bp, Homo sapien
aaagagaaagagatgagtaagcatt

SEQ ID NO: 2325 - DNA, 25 bp, Homo sapien
aaagagaacaagacccaatactaca

SEQ ID NO: 2326 - DNA, 25 bp, Homo sapien
aaagagaacaaggcccaatactaca

SEQ ID NO: 2327 - DNA, 25 bp, Homo sapien
aaagagaacagtatattatggaccc

SEQ ID NO: 2328 - DNA, 25 bp, Homo sapien
aaagagaacagtgtattatggaccc

SEQ ID NO: 2329 - DNA, 25 bp, Homo sapien
aaagagaaccagatttctgctttct

SEQ ID NO: 2330 - DNA, 25 bp, Homo sapien
aaagagaaccaggtttctgctttct

SEQ ID NO: 2331 - DNA, 25 bp, Homo sapien
aaagagaataagacccaggaaaaat

SEQ ID NO: 2332 - DNA, 25 bp, Homo sapien
aaagagaataagacccgggaaaaat

SEQ ID NO: 2333 - DNA, 25 bp, Homo sapien
aaagagacacgtaggctaagaaaat

SEQ ID NO: 2334 - DNA, 25 bp, Homo sapien
aaagagacaggtaaatcgaatttta

SEQ ID NO: 2335 - DNA, 25 bp, Homo sapien
aaagagacagtgctatctggcccag

SEQ ID NO: 2336 - DNA, 25 bp, Homo sapien
aaagagacgcgtaggctaagaaaat

SEQ ID NO: 2337 - DNA, 25 bp, Homo sapien
aaagagacgggtaaatcgaatttta

SEQ ID NO: 2338 - DNA, 25 bp, Homo sapien
aaagagacggtgctatctggcccag

SEQ ID NO: 2339 - DNA, 25 bp, Homo sapien
aaagagactgtgaaagaacagctag

SEQ ID NO: 2340 - DNA, 25 bp, Homo sapien
aaagagactgtgaaggaacagctag

SEQ ID NO: 2341 - DNA, 25 bp, Homo sapien
aaagagagacacattgagctagaga

SEQ ID NO: 2342 - DNA, 25 bp, Homo sapien
aaagagagacatattgagctagaga

SEQ ID NO: 2343 - DNA, 25 bp, Homo sapien
aaagagagcagcattagccagacct

SEQ ID NO: 2344 - DNA, 25 bp, Homo sapien
aaagagagcagcgttagccagacct

SEQ ID NO: 2345 - DNA, 25 bp, Homo sapien
aaagagagcttatctactgaatgac

SEQ ID NO: 2346 - DNA, 25 bp, Homo sapien
aaagagagcttatctattgaatgac

SEQ ID NO: 2347 - DNA, 25 bp, Homo sapien
aaagagaggacatcgctactattat

SEQ ID NO: 2348 - DNA, 25 bp, Homo sapien
aaagagaggacattgctactattat

SEQ ID NO: 2349 - DNA, 25 bp, Homo sapien
aaagagaggaggcacattgtactca

SEQ ID NO: 2350 - DNA, 25 bp, Homo sapien
aaagagaggaggcatattgtactca

SEQ ID NO: 2351 - DNA, 25 bp, Homo sapien
aaagagaggcctacgaaaaggttcc

SEQ ID NO: 2352 - DNA, 25 bp, Homo sapien
aaagagaggcctatgaaaaggttcc

SEQ ID NO: 2353 - DNA, 25 bp, Homo sapien
aaagagataaacaccaaataaatgc

SEQ ID NO: 2354 - DNA, 25 bp, Homo sapien
aaagagataaacagcaaataaatgc

SEQ ID NO: 2355 - DNA, 25 bp, Homo sapien
aaagagatgcaggttaatttcctac

SEQ ID NO: 2356 - DNA, 25 bp, Homo sapien
aaagagattcaggttaatttcctac

SEQ ID NO: 2357 - DNA, 25 bp, Homo sapien
aaagagatttcagtaggtgcattgg

SEQ ID NO: 2358 - DNA, 25 bp, Homo sapien
aaagagatttcattaggtgcattgg

SEQ ID NO: 2359 - DNA, 25 bp, Homo sapien
aaagagcaaccaggaagctgtgagc

SEQ ID NO: 2360 - DNA, 25 bp, Homo sapien
aaagagcaaccagggagctgtgagc

SEQ ID NO: 2361 - DNA, 25 bp, Homo sapien
aaagagcaactagttatgggaaaag

SEQ ID NO: 2362 - DNA, 25 bp, Homo sapien
aaagagcaagtatgatacaatgcct

SEQ ID NO: 2363 - DNA, 25 bp, Homo sapien
aaagagcaagtatgatccaatgcct

SEQ ID NO: 2364 - DNA, 25 bp, Homo sapien
aaagagcaattagttatgggaaaag

SEQ ID NO: 2365 - DNA, 25 bp, Homo sapien
aaagagcagatagaaataggtgaga

SEQ ID NO: 2366 - DNA, 25 bp, Homo sapien
aaagagcatacctcaaaataataaa

SEQ ID NO: 2367 - DNA, 25 bp, Homo sapien
aaagagcatacctcgaaataataaa

SEQ ID NO: 2368 - DNA, 25 bp, Homo sapien
aaagagcatatagaaataggtgaga

SEQ ID NO: 2369 - DNA, 25 bp, Homo sapien
aaagagcatcaaatgtgctttgaac

SEQ ID NO: 2370 - DNA, 25 bp, Homo sapien
aaagagcatcagatgtgctttgaac

SEQ ID NO: 2371 - DNA, 25 bp, Homo sapien
aaagagcatgtcaggaaaatgaaaa

SEQ ID NO: 2372 - DNA, 25 bp, Homo sapien
aaagagcatgttaggaaaatgaaaa

SEQ ID NO: 2373 - DNA, 25 bp, Homo sapien
aaagagccaaagcagtgattatctg

SEQ ID NO: 2374 - DNA, 25 bp, Homo sapien
aaagagccacatgttcagtgagact

SEQ ID NO: 2375 - DNA, 25 bp, Homo sapien
aaagagccagatgttcagtgagact

SEQ ID NO: 2376 - DNA, 25 bp, Homo sapien
aaagagccagctccacaaccagaca

SEQ ID NO: 2377 - DNA, 25 bp, Homo sapien
aaagagccagcttcacaaccagaca

SEQ ID NO: 2378 - DNA, 25 bp, Homo sapien
aaagagccatcagtgagaaagtggc

SEQ ID NO: 2379 - DNA, 25 bp, Homo sapien
aaagagccatccgtgagaaagtggc

SEQ ID NO: 2380 - DNA, 25 bp, Homo sapien
aaagagccatttatttcttgcattg

SEQ ID NO: 2381 - DNA, 25 bp, Homo sapien
aaagagccatttatttgttgcattg

SEQ ID NO: 2382 - DNA, 25 bp, Homo sapien
aaagagccgaagcagtgattatctg

SEQ ID NO: 2383 - DNA, 25 bp, Homo sapien
aaagagccttgaaagtactatttca

SEQ ID NO: 2384 - DNA, 25 bp, Homo sapien
aaagagccttgaatgtactatttca

SEQ ID NO: 2385 - DNA, 25 bp, Homo sapien
aaagagctagttctcctcagtttca

SEQ ID NO: 2386 - DNA, 25 bp, Homo sapien
aaagagctattacgttgtgaagaaa

SEQ ID NO: 2387 - DNA, 25 bp, Homo sapien
aaagagctattaggttgtgaagaaa

SEQ ID NO: 2388 - DNA, 25 bp, Homo sapien
aaagagctgagcccgcaagtttgcc

SEQ ID NO: 2389 - DNA, 25 bp, Homo sapien
aaagagctgagccggcaagtttgcc

SEQ ID NO: 2390 - DNA, 25 bp, Homo sapien
aaagagctgatttctgaaacataac

SEQ ID NO: 2391 - DNA, 25 bp, Homo sapien
aaagagctgctttctgaaacataac

SEQ ID NO: 2392 - DNA, 25 bp, Homo sapien
aaagagctggttctcctcagtttca

SEQ ID NO: 2393 - DNA, 25 bp, Homo sapien
aaagagcttagtcggatttgaggga

SEQ ID NO: 2394 - DNA, 25 bp, Homo sapien
aaagagcttagttggatttgaggga

SEQ ID NO: 2395 - DNA, 25 bp, Homo sapien
aaagaggaacattgccaaattctag

SEQ ID NO: 2396 - DNA, 25 bp, Homo sapien
aaagaggaatagctacagtggctca

SEQ ID NO: 2397 - DNA, 25 bp, Homo sapien
aaagaggagcattgccaaattctag

SEQ ID NO: 2398 - DNA, 25 bp, Homo sapien
aaagaggagtagctacagtggctca

SEQ ID NO: 2399 - DNA, 25 bp, Homo sapien
aaagaggattttattaaacgtattc

SEQ ID NO: 2400 - DNA, 25 bp, Homo sapien
aaagaggattttgttaaacgtattc

SEQ ID NO: 2401 - DNA, 25 bp, Homo sapien
aaagaggctgtgctttcataagagc

SEQ ID NO: 2402 - DNA, 25 bp, Homo sapien
aaagaggctgtgcttttataagagc

SEQ ID NO: 2403 - DNA, 25 bp, Homo sapien
aaagagggaaggacatgataggatc

SEQ ID NO: 2404 - DNA, 25 bp, Homo sapien
aaagagggaaggccatgataggatc

SEQ ID NO: 2405 - DNA, 25 bp, Homo sapien
aaagagggctgccattctctctgtt

SEQ ID NO: 2406 - DNA, 25 bp, Homo sapien
aaagagggctgccattgtctctgtt

SEQ ID NO: 2407 - DNA, 25 bp, Homo sapien
aaagaggtacgtcaaagatagaatc

SEQ ID NO: 2408 - DNA, 25 bp, Homo sapien
aaagaggtatgtcaaagatagaatc

SEQ ID NO: 2409 - DNA, 25 bp, Homo sapien
aaagaggtcactttactttcctaaa

SEQ ID NO: 2410 - DNA, 25 bp, Homo sapien
aaagaggtcgctttactttcctaaa

SEQ ID NO: 2411 - DNA, 25 bp, Homo sapien
aaagagtaatgttctcatctttccc

SEQ ID NO: 2412 - DNA, 25 bp, Homo sapien
aaagagtagcatatgattctaataa

SEQ ID NO: 2413 - DNA, 25 bp, Homo sapien
aaagagtagcatgcgattctaataa

SEQ ID NO: 2414 - DNA, 25 bp, Homo sapien
aaagagtagcatgtgattctaataa

SEQ ID NO: 2415 - DNA, 25 bp, Homo sapien
aaagagtagtgttctcatctttccc

SEQ ID NO: 2416 - DNA, 25 bp, Homo sapien
aaagagttaataaattgcattccct

SEQ ID NO: 2417 - DNA, 25 bp, Homo sapien
aaagagttaatacattgcattccct

SEQ ID NO: 2418 - DNA, 25 bp, Homo sapien
aaagagttatgatctctcaagtcac

SEQ ID NO: 2419 - DNA, 25 bp, Homo sapien
aaagagttatgttctctcaagtcac

SEQ ID NO: 2420 - DNA, 25 bp, Homo sapien
aaagagttctgaattcaaaggtcag

SEQ ID NO: 2421 - DNA, 25 bp, Homo sapien
aaagagttctgaattcgaaggtcag

SEQ ID NO: 2422 - DNA, 25 bp, Homo sapien
aaagagtttgcagtttgctccttac

SEQ ID NO: 2423 - DNA, 25 bp, Homo sapien
aaagagtttgccgtttgctccttac

SEQ ID NO: 2424 - DNA, 25 bp, Homo sapien
aaagataaaagtcgggtcgaaaaag

SEQ ID NO: 2425 - DNA, 25 bp, Homo sapien
aaagataaaagttgggtcgaaaaag

SEQ ID NO: 2426 - DNA, 25 bp, Homo sapien
aaagataaacagctgaagaatctgg

SEQ ID NO: 2427 - DNA, 25 bp, Homo sapien
aaagataaacagttgaagaatctgg

SEQ ID NO: 2428 - DNA, 25 bp, Homo sapien
aaagataatgtgctaaaggcagatc

SEQ ID NO: 2429 - DNA, 25 bp, Homo sapien
aaagataatgtggtaaaggcagatc

SEQ ID NO: 2430 - DNA, 25 bp, Homo sapien
aaagatagctggcaggctaaaattg

SEQ ID NO: 2431 - DNA, 25 bp, Homo sapien
aaagatagctggcatgctaaaattg

SEQ ID NO: 2432 - DNA, 25 bp, Homo sapien
aaagatatttacagagaccaacagc

SEQ ID NO: 2433 - DNA, 25 bp, Homo sapien
aaagatatttacagaggccaacagc

SEQ ID NO: 2434 - DNA, 25 bp, Homo sapien
aaagatcaatgaagaaagtttccaa

SEQ ID NO: 2435 - DNA, 25 bp, Homo sapien
aaagatcaatgaaggaagtttccaa

SEQ ID NO: 2436 - DNA, 25 bp, Homo sapien
aaagatcacaaacagtgcaaattga

SEQ ID NO: 2437 - DNA, 25 bp, Homo sapien
aaagatcaccatgcatgcactggag

SEQ ID NO: 2438 - DNA, 25 bp, Homo sapien
aaagatcactgaagatttgagaaac

SEQ ID NO: 2439 - DNA, 25 bp, Homo sapien
aaagatcactgaaggtttgagaaac

SEQ ID NO: 2440 - DNA, 25 bp, Homo sapien
aaagatcagtaacgtaggataaacc

SEQ ID NO: 2441 - DNA, 25 bp, Homo sapien
aaagatcagtaatgtaggataaacc

SEQ ID NO: 2442 - DNA, 25 bp, Homo sapien
aaagatcataaacagtgcaaattga

SEQ ID NO: 2443 - DNA, 25 bp, Homo sapien
aaagatcatcatgcatgcactggag

SEQ ID NO: 2444 - DNA, 25 bp, Homo sapien
aaagatcatgatcgggtaaagagat

SEQ ID NO: 2445 - DNA, 25 bp, Homo sapien
aaagatcatgatcgtgtaaagagat

SEQ ID NO: 2446 - DNA, 25 bp, Homo sapien
aaagatccctcacttggagatgtgg

SEQ ID NO: 2447 - DNA, 25 bp, Homo sapien
aaagatccctcgcttggagatgtgg

SEQ ID NO: 2448 - DNA, 25 bp, Homo sapien
aaagatctaaaaattgcaccatgtc

SEQ ID NO: 2449 - DNA, 25 bp, Homo sapien
aaagatctaaacattgcaccatgtc

SEQ ID NO: 2450 - DNA, 25 bp, Homo sapien
aaagatctatcaagcaaaactgaac

SEQ ID NO: 2451 - DNA, 25 bp, Homo sapien
aaagatctatcatgcaaaactgaac

SEQ ID NO: 2452 - DNA, 25 bp, Homo sapien
aaagatctgatgaaacccagcgtgt

SEQ ID NO: 2453 - DNA, 25 bp, Homo sapien
aaagatctgatgaagcccagcgtgt

SEQ ID NO: 2454 - DNA, 25 bp, Homo sapien
aaagatctgcaacgtctcaacaggg

SEQ ID NO: 2455 - DNA, 25 bp, Homo sapien
aaagatctgcagcgtctcaacaggg

SEQ ID NO: 2456 - DNA, 25 bp, Homo sapien
aaagatcttttacttgtggttaggc

SEQ ID NO: 2457 - DNA, 25 bp, Homo sapien
aaagatcttttatttgtggttaggc

SEQ ID NO: 2458 - DNA, 25 bp, Homo sapien
aaagatgaaaacagaattcctagta

SEQ ID NO: 2459 - DNA, 25 bp, Homo sapien
aaagatgaaaagagaattcctagta

SEQ ID NO: 2460 - DNA, 25 bp, Homo sapien
aaagatgaaacaagaatgaaaacaa

SEQ ID NO: 2461 - DNA, 25 bp, Homo sapien
aaagatgaaagtgaattgagactgt

SEQ ID NO: 2462 - DNA, 25 bp, Homo sapien
aaagatgaagcaagaatgaaaacaa

SEQ ID NO: 2463 - DNA, 25 bp, Homo sapien
aaagatgagagctacaggcatcctt

SEQ ID NO: 2464 - DNA, 25 bp, Homo sapien
aaagatgagagctagaggcatcctt

SEQ ID NO: 2465 - DNA, 25 bp, Homo sapien
aaagatgagagtgaattgagactgt

SEQ ID NO: 2466 - DNA, 25 bp, Homo sapien
aaagatgagtaaaacaaactgtagc

SEQ ID NO: 2467 - DNA, 25 bp, Homo sapien
aaagatgagtaaatcaaactgtagc

SEQ ID NO: 2468 - DNA, 25 bp, Homo sapien
aaagatggaatgaatatggtttctg

SEQ ID NO: 2469 - DNA, 25 bp, Homo sapien
aaagatggaatggatatggtttctg

SEQ ID NO: 2470 - DNA, 25 bp, Homo sapien
aaagatggaggccaaaagactaagc

SEQ ID NO: 2471 - DNA, 25 bp, Homo sapien
aaagatggaggtcaaaagactaagc

SEQ ID NO: 2472 - DNA, 25 bp, Homo sapien
aaagatggcaactcagcattgaata

SEQ ID NO: 2473 - DNA, 25 bp, Homo sapien
aaagatgggaactcagcattgaata

SEQ ID NO: 2474 - DNA, 25 bp, Homo sapien
aaagatgggctgctcgaaccttgta

SEQ ID NO: 2475 - DNA, 25 bp, Homo sapien
aaagatgggctgcttgaaccttgta

SEQ ID NO: 2476 - DNA, 25 bp, Homo sapien
aaagatgtaaaacagggaagccttg

SEQ ID NO: 2477 - DNA, 25 bp, Homo sapien
aaagatgtcaaacagggaagccttg

SEQ ID NO: 2478 - DNA, 25 bp, Homo sapien
aaagattcttcatacgtaggcaaaa

SEQ ID NO: 2479 - DNA, 25 bp, Homo sapien
aaagattcttcatatgtaggcaaaa

SEQ ID NO: 2480 - DNA, 25 bp, Homo sapien
aaagatttcccaattttactggact

SEQ ID NO: 2481 - DNA, 25 bp, Homo sapien
aaagatttctcaattttactggact

SEQ ID NO: 2482 - DNA, 25 bp, Homo sapien
aaagatttgaactacatataattcc

SEQ ID NO: 2483 - DNA, 25 bp, Homo sapien
aaagatttgaagtacatataattcc

SEQ ID NO: 2484 - DNA, 25 bp, Homo sapien
aaagattttcagccttctggaagta

SEQ ID NO: 2485 - DNA, 25 bp, Homo sapien
aaagattttgagccttctggaagta

SEQ ID NO: 2486 - DNA, 25 bp, Homo sapien
aaagcaaaaaaccacgttttccaga

SEQ ID NO: 2487 - DNA, 25 bp, Homo sapien
aaagcaaaaaaccatgttttccaga

SEQ ID NO: 2488 - DNA, 25 bp, Homo sapien
aaagcaaaaagtagaggaaatggga

SEQ ID NO: 2489 - DNA, 25 bp, Homo sapien
aaagcaaacaaaccagaaaatggta

SEQ ID NO: 2490 - DNA, 25 bp, Homo sapien
aaagcaaacaaaccaggaaatggta

SEQ ID NO: 2491 - DNA, 25 bp, Homo sapien
aaagcaaagaacaacgaagtagttg

SEQ ID NO: 2492 - DNA, 25 bp, Homo sapien
aaagcaaagaacaatgaagtagttg

SEQ ID NO: 2493 - DNA, 25 bp, Homo sapien
aaagcaaagagtagaggaaatggga

SEQ ID NO: 2494 - DNA, 25 bp, Homo sapien
aaagcaacaatatcaaagaatgctt

SEQ ID NO: 2495 - DNA, 25 bp, Homo sapien
aaagcaacagtatcaaagaatgctt

SEQ ID NO: 2496 - DNA, 25 bp, Homo sapien
aaagcaagaactacagagacagagt

SEQ ID NO: 2497 - DNA, 25 bp, Homo sapien
aaagcaagaactccagagacagagt

SEQ ID NO: 2498 - DNA, 25 bp, Homo sapien
aaagcaagacaccctagtaaaatgt

SEQ ID NO: 2499 - DNA, 25 bp, Homo sapien
aaagcaagacaggaaaatacagttt

SEQ ID NO: 2500 - DNA, 25 bp, Homo sapien
aaagcaagacagggaaatacagttt

SEQ ID NO: 2501 - DNA, 25 bp, Homo sapien
aaagcaaggcaccctagtaaaatgt

SEQ ID NO: 2502 - DNA, 25 bp, Homo sapien
aaagcaataaaaacatacccctaaa

SEQ ID NO: 2503 - DNA, 25 bp, Homo sapien
aaagcaataaagtcaagacagtggg

SEQ ID NO: 2504 - DNA, 25 bp, Homo sapien
aaagcaatagaaacatacccctaaa

SEQ ID NO: 2505 - DNA, 25 bp, Homo sapien
aaagcaatgaaggtacaaaaatgac

SEQ ID NO: 2506 - DNA, 25 bp, Homo sapien
aaagcaatgaaggtaccaaaatgac

SEQ ID NO: 2507 - DNA, 25 bp, Homo sapien
aaagcaatgaagtcaagacagtggg

SEQ ID NO: 2508 - DNA, 25 bp, Homo sapien
aaagcacaaaagacatggaaaaacg

SEQ ID NO: 2509 - DNA, 25 bp, Homo sapien
aaagcacaaaagagatggaaaaacg

SEQ ID NO: 2510 - DNA, 25 bp, Homo sapien
aaagcacacattgctgggcctcatt

SEQ ID NO: 2511 - DNA, 25 bp, Homo sapien
aaagcacaccaatgtgaggtcatgt

SEQ ID NO: 2512 - DNA, 25 bp, Homo sapien
aaagcacaccagtgtgaggtcatgt

SEQ ID NO: 2513 - DNA, 25 bp, Homo sapien
aaagcacactgtctcattgttccac

SEQ ID NO: 2514 - DNA, 25 bp, Homo sapien
aaagcacactgtttcattgttccac

SEQ ID NO: 2515 - DNA, 25 bp, Homo sapien
aaagcacagatagtcctctgaattg

SEQ ID NO: 2516 - DNA, 25 bp, Homo sapien
aaagcacagattgctgggcctcatt

SEQ ID NO: 2517 - DNA, 25 bp, Homo sapien
aaagcacagctagtcctctgaattg

SEQ ID NO: 2518 - DNA, 25 bp, Homo sapien
aaagcacagtgcagaaatggttata

SEQ ID NO: 2519 - DNA, 25 bp, Homo sapien
aaagcacagtgcatttgagtaactg

SEQ ID NO: 2520 - DNA, 25 bp, Homo sapien
aaagcacagtgccgaaatggttata

SEQ ID NO: 2521 - DNA, 25 bp, Homo sapien
aaagcacagtgcctttgagtaactg

SEQ ID NO: 2522 - DNA, 25 bp, Homo sapien
aaagcacatggaaaattagggagaa

SEQ ID NO: 2523 - DNA, 25 bp, Homo sapien
aaagcacatggagaattagggagaa

SEQ ID NO: 2524 - DNA, 25 bp, Homo sapien
aaagcacattcaaattaaagagaaa

SEQ ID NO: 2525 - DNA, 25 bp, Homo sapien
aaagcacattcaagttaaagagaaa

SEQ ID NO: 2526 - DNA, 25 bp, Homo sapien
aaagcacatttcacggaccgtgcat

SEQ ID NO: 2527 - DNA, 25 bp, Homo sapien
aaagcacatttcatggaccgtgcat

SEQ ID NO: 2528 - DNA, 25 bp, Homo sapien
aaagcaccctataccaaagctctct

SEQ ID NO: 2529 - DNA, 25 bp, Homo sapien
aaagcaccctattccaaagctctct

SEQ ID NO: 2530 - DNA, 25 bp, Homo sapien
aaagcactaagagataacaatcttg

SEQ ID NO: 2531 - DNA, 25 bp, Homo sapien
aaagcactaatactgtaaaacttag

SEQ ID NO: 2532 - DNA, 25 bp, Homo sapien
aaagcactactactgtaaaacttag

SEQ ID NO: 2533 - DNA, 25 bp, Homo sapien
aaagcactgagagataacaatcttg

SEQ ID NO: 2534 - DNA, 25 bp, Homo sapien
aaagcagaagtattaatttgaccct

SEQ ID NO: 2535 - DNA, 25 bp, Homo sapien
aaagcagaattattaatttgaccct

SEQ ID NO: 2536 - DNA, 25 bp, Homo sapien
aaagcagactactgcaagaagggga

SEQ ID NO: 2537 - DNA, 25 bp, Homo sapien
aaagcagagtactgcaagaagggga

SEQ ID NO: 2538 - DNA, 25 bp, Homo sapien
aaagcagattttactcaggaactat

SEQ ID NO: 2539 - DNA, 25 bp, Homo sapien
aaagcagattttattcaggaactat

SEQ ID NO: 2540 - DNA, 25 bp, Homo sapien
aaagcagcagacgtgagcttatatg

SEQ ID NO: 2541 - DNA, 25 bp, Homo sapien
aaagcagcagatgtgagcttatatg

SEQ ID NO: 2542 - DNA, 25 bp, Homo sapien
aaagcagcagcactgcaaacatagt

SEQ ID NO: 2543 - DNA, 25 bp, Homo sapien
aaagcagcagcattgcaaacatagt

SEQ ID NO: 2544 - DNA, 25 bp, Homo sapien
aaagcagtccttcctttctgagaag

SEQ ID NO: 2545 - DNA, 25 bp, Homo sapien
aaagcagtctttcctttctgagaag

SEQ ID NO: 2546 - DNA, 25 bp, Homo sapien
aaagcagttcaacagtcaaaagaca

SEQ ID NO: 2547 - DNA, 25 bp, Homo sapien
aaagcagttcaacagtgaaaagaca

SEQ ID NO: 2548 - DNA, 25 bp, Homo sapien
aaagcataaaatccaaatctcgagt

SEQ ID NO: 2549 - DNA, 25 bp, Homo sapien
aaagcataaaatccgaatctcgagt

SEQ ID NO: 2550 - DNA, 25 bp, Homo sapien
aaagcataacaggtcggatgacatg

SEQ ID NO: 2551 - DNA, 25 bp, Homo sapien
aaagcataacaggttggatgacatg

SEQ ID NO: 2552 - DNA, 25 bp, Homo sapien
aaagcatagcgaaggatggggaagt

SEQ ID NO: 2553 - DNA, 25 bp, Homo sapien
aaagcatagtatcgtcattaataaa

SEQ ID NO: 2554 - DNA, 25 bp, Homo sapien
aaagcatagtattgtcattaataaa

SEQ ID NO: 2555 - DNA, 25 bp, Homo sapien
aaagcatagtgaaggatggggaagt

SEQ ID NO: 2556 - DNA, 25 bp, Homo sapien
aaagcatcataataatgtgggtgat

SEQ ID NO: 2557 - DNA, 25 bp, Homo sapien
aaagcatcatagtaatgtgggtgat

SEQ ID NO: 2558 - DNA, 25 bp, Homo sapien
aaagcatcccttacgttcttttagc

SEQ ID NO: 2559 - DNA, 25 bp, Homo sapien
aaagcatcccttatgttcttttagc

SEQ ID NO: 2560 - DNA, 25 bp, Homo sapien
aaagcatctgacaattggcctaaca

SEQ ID NO: 2561 - DNA, 25 bp, Homo sapien
aaagcatctgacagttggcctaaca

SEQ ID NO: 2562 - DNA, 25 bp, Homo sapien
aaagcatgcactgtaataccagtcc

SEQ ID NO: 2563 - DNA, 25 bp, Homo sapien
aaagcatgcactttaataccagtcc

SEQ ID NO: 2564 - DNA, 25 bp, Homo sapien
aaagcatgcatacactcacaaaacc

SEQ ID NO: 2565 - DNA, 25 bp, Homo sapien
aaagcatgcctaggaacactagcac

SEQ ID NO: 2566 - DNA, 25 bp, Homo sapien
aaagcatgcctagggacactagcac

SEQ ID NO: 2567 - DNA, 25 bp, Homo sapien
aaagcatgcgtacactcacaaaacc

SEQ ID NO: 2568 - DNA, 25 bp, Homo sapien
aaagcatgctactactaatcaatta

SEQ ID NO: 2569 - DNA, 25 bp, Homo sapien
aaagcatgctactgctaatcaatta

SEQ ID NO: 2570 - DNA, 25 bp, Homo sapien
aaagcatggcaagccaatcttacac

SEQ ID NO: 2571 - DNA, 25 bp, Homo sapien
aaagcatggcaagccagtcttacac

SEQ ID NO: 2572 - DNA, 25 bp, Homo sapien
aaagcatttgcccgtacagcattgt

SEQ ID NO: 2573 - DNA, 25 bp, Homo sapien
aaagcatttgcctgtacagcattgt

SEQ ID NO: 2574 - DNA, 25 bp, Homo sapien
aaagccaaatattactcctacatac

SEQ ID NO: 2575 - DNA, 25 bp, Homo sapien
aaagccaaatattgctcctacatac

SEQ ID NO: 2576 - DNA, 25 bp, Homo sapien
aaagccaagacaatattaggatttc

SEQ ID NO: 2577 - DNA, 25 bp, Homo sapien
aaagccaaggcaatattaggatttc

SEQ ID NO: 2578 - DNA, 25 bp, Homo sapien
aaagccacctcacttcctggcatgg

SEQ ID NO: 2579 - DNA, 25 bp, Homo sapien
aaagccacctcatttcctggcatgg

SEQ ID NO: 2580 - DNA, 25 bp, Homo sapien
aaagccagcgatggtgcaacacccc

SEQ ID NO: 2581 - DNA, 25 bp, Homo sapien
aaagccagctcatagacagtatctg

SEQ ID NO: 2582 - DNA, 25 bp, Homo sapien
aaagccagctcgtagacagtatctg

SEQ ID NO: 2583 - DNA, 25 bp, Homo sapien
aaagccagggatggtgcaacacccc

SEQ ID NO: 2584 - DNA, 25 bp, Homo sapien
aaagccatccgtctggcattgcaca

SEQ ID NO: 2585 - DNA, 25 bp, Homo sapien
aaagccatctgtctggcattgcaca

SEQ ID NO: 2586 - DNA, 25 bp, Homo sapien
aaagccattcgtcagacagtgtcaa

SEQ ID NO: 2587 - DNA, 25 bp, Homo sapien
aaagccattcgtcggacagtgtcaa

SEQ ID NO: 2588 - DNA, 25 bp, Homo sapien
aaagcccaaaccaaaaaatcaaatg

SEQ ID NO: 2589 - DNA, 25 bp, Homo sapien
aaagcccaaagctctatgatgaccc

SEQ ID NO: 2590 - DNA, 25 bp, Homo sapien
aaagcccaaagctgtatgatgaccc

SEQ ID NO: 2591 - DNA, 25 bp, Homo sapien
aaagcccaacccaaaaaatcaaatg

SEQ ID NO: 2592 - DNA, 25 bp, Homo sapien
aaagcccacctaaaatgatgatcac

SEQ ID NO: 2593 - DNA, 25 bp, Homo sapien
aaagcccacctgaaatgatgatcac

SEQ ID NO: 2594 - DNA, 25 bp, Homo sapien
aaagccgatgattaacaccaggtca

SEQ ID NO: 2595 - DNA, 25 bp, Homo sapien
aaagccgatgattaccaccaggtca

SEQ ID NO: 2596 - DNA, 25 bp, Homo sapien
aaagcctagtctcaacacatgagga

SEQ ID NO: 2597 - DNA, 25 bp, Homo sapien
aaagcctagtcttaacacatgagga

SEQ ID NO: 2598 - DNA, 25 bp, Homo sapien
aaagcctatgcctgaataagtagca

SEQ ID NO: 2599 - DNA, 25 bp, Homo sapien
aaagcctattcctgaataagtagca

SEQ ID NO: 2600 - DNA, 25 bp, Homo sapien
aaagcctcagcaaagaaatagaagc

SEQ ID NO: 2601 - DNA, 25 bp, Homo sapien
aaagcctcatcaaagaaatagaagc

SEQ ID NO: 2602 - DNA, 25 bp, Homo sapien
aaagcctgcttgatactctacccca

SEQ ID NO: 2603 - DNA, 25 bp, Homo sapien
aaagcctgcttggtactctacccca

SEQ ID NO: 2604 - DNA, 25 bp, Homo sapien
aaagcctgtgcattataagcaggat

SEQ ID NO: 2605 - DNA, 25 bp, Homo sapien
aaagcctgtgcgttataagcaggat

SEQ ID NO: 2606 - DNA, 25 bp, Homo sapien
aaagccttgaacaagaaagcaagtt

SEQ ID NO: 2607 - DNA, 25 bp, Homo sapien
aaagccttgaagaagaaagcaagtt

SEQ ID NO: 2608 - DNA, 25 bp, Homo sapien
aaagcctttcaatgttacactatgc

SEQ ID NO: 2609 - DNA, 25 bp, Homo sapien
aaagcctttcattgttacactatgc

SEQ ID NO: 2610 - DNA, 25 bp, Homo sapien
aaagcgaactcaaaggaagaggctt

SEQ ID NO: 2611 - DNA, 25 bp, Homo sapien
aaagcgaactcaagggaagaggctt

SEQ ID NO: 2612 - DNA, 25 bp, Homo sapien
aaagcgaggagataaaatgccctgg

SEQ ID NO: 2613 - DNA, 25 bp, Homo sapien
aaagcgaggaggtaaaatgccctgg

SEQ ID NO: 2614 - DNA, 25 bp, Homo sapien
aaagctaaaatatgtctcattccaa

SEQ ID NO: 2615 - DNA, 25 bp, Homo sapien
aaagctaaaatgtgtctcattccaa

SEQ ID NO: 2616 - DNA, 25 bp, Homo sapien
aaagctaccaccaaatcactcaata

SEQ ID NO: 2617 - DNA, 25 bp, Homo sapien
aaagctactaccaaatcactcaata

SEQ ID NO: 2618 - DNA, 25 bp, Homo sapien
aaagctagaacaatgagcaacaaaa

SEQ ID NO: 2619 - DNA, 25 bp, Homo sapien
aaagctagaacactgagcaacaaaa

SEQ ID NO: 2620 - DNA, 25 bp, Homo sapien
aaagctagcattaattttccatcca

SEQ ID NO: 2621 - DNA, 25 bp, Homo sapien
aaagctaggattaattttccatcca

SEQ ID NO: 2622 - DNA, 25 bp, Homo sapien
aaagctatgcactgtgtttgtcagg

SEQ ID NO: 2623 - DNA, 25 bp, Homo sapien
aaagctatggtcacacctggcacaa

SEQ ID NO: 2624 - DNA, 25 bp, Homo sapien
aaagctatggtcacgcctggcacaa

SEQ ID NO: 2625 - DNA, 25 bp, Homo sapien
aaagctatgtactgtgtttgtcagg

SEQ ID NO: 2626 - DNA, 25 bp, Homo sapien
aaagctattaggactatgcactaga

SEQ ID NO: 2627 - DNA, 25 bp, Homo sapien
aaagctattcatctgaaaacttgaa

SEQ ID NO: 2628 - DNA, 25 bp, Homo sapien
aaagctattcatttgaaaacttgaa

SEQ ID NO: 2629 - DNA, 25 bp, Homo sapien
aaagctattgggactatgcactaga

SEQ ID NO: 2630 - DNA, 25 bp, Homo sapien
aaagctcaactctactaaaaataca

SEQ ID NO: 2631 - DNA, 25 bp, Homo sapien
aaagctcacctctactaaaaataca

SEQ ID NO: 2632 - DNA, 25 bp, Homo sapien
aaagctcacgtctgtagaagcgcat

SEQ ID NO: 2633 - DNA, 25 bp, Homo sapien
aaagctcactgtacaatcaggacgc

SEQ ID NO: 2634 - DNA, 25 bp, Homo sapien
aaagctcactgtataatcaggacgc

SEQ ID NO: 2635 - DNA, 25 bp, Homo sapien
aaagctcagagacgttaagcaattt

SEQ ID NO: 2636 - DNA, 25 bp, Homo sapien
aaagctcagagatgttaagcaattt

SEQ ID NO: 2637 - DNA, 25 bp, Homo sapien
aaagctcatgtctgtagaagcgcat

SEQ ID NO: 2638 - DNA, 25 bp, Homo sapien
aaagctcctgccatgtgttcactct

SEQ ID NO: 2639 - DNA, 25 bp, Homo sapien
aaagctcctgccgtgtgttcactct

SEQ ID NO: 2640 - DNA, 25 bp, Homo sapien
aaagctctggtctcaaagccccaaa

SEQ ID NO: 2641 - DNA, 25 bp, Homo sapien
aaagctctgttctcaaagccccaaa

SEQ ID NO: 2642 - DNA, 25 bp, Homo sapien
aaagctgaaactaccatctagccct

SEQ ID NO: 2643 - DNA, 25 bp, Homo sapien
aaagctgaaactactatctagccct

SEQ ID NO: 2644 - DNA, 25 bp, Homo sapien
aaagctgaaatgctgcaagtcaata

SEQ ID NO: 2645 - DNA, 25 bp, Homo sapien
aaagctgaaatgctgcgagtcaata

SEQ ID NO: 2646 - DNA, 25 bp, Homo sapien
aaagctgaagctatttgccagaagg

SEQ ID NO: 2647 - DNA, 25 bp, Homo sapien
aaagctgagagtgaatgaataaaca

SEQ ID NO: 2648 - DNA, 25 bp, Homo sapien
aaagctgagagttaatgaataaaca

SEQ ID NO: 2649 - DNA, 25 bp, Homo sapien
aaagctgaggctatttgccagaagg

SEQ ID NO: 2650 - DNA, 25 bp, Homo sapien
aaagctgagggttaggagaagctga

SEQ ID NO: 2651 - DNA, 25 bp, Homo sapien
aaagctgagtgttaggagaagctga

SEQ ID NO: 2652 - DNA, 25 bp, Homo sapien
aaagctgattggaacctttgaataa

SEQ ID NO: 2653 - DNA, 25 bp, Homo sapien
aaagctgattgggacctttgaataa

SEQ ID NO: 2654 - DNA, 25 bp, Homo sapien
aaagctgcaggaccttgaattaaca

SEQ ID NO: 2655 - DNA, 25 bp, Homo sapien
aaagctgcgggaccttgaattaaca

SEQ ID NO: 2656 - DNA, 25 bp, Homo sapien
aaagctgctagtactacagagatgt

SEQ ID NO: 2657 - DNA, 25 bp, Homo sapien
aaagctgctggtactacagagatgt

SEQ ID NO: 2658 - DNA, 25 bp, Homo sapien
aaagctggaaaatgcaactggcata

SEQ ID NO: 2659 - DNA, 25 bp, Homo sapien
aaagctggaaaatgtaactggcata

SEQ ID NO: 2660 - DNA, 25 bp, Homo sapien
aaagctgtttgtaggcatcgtacga

SEQ ID NO: 2661 - DNA, 25 bp, Homo sapien
aaagctgtttgtcggcatcgtacga

SEQ ID NO: 2662 - DNA, 25 bp, Homo sapien
aaagcttaaacattagctactctac

SEQ ID NO: 2663 - DNA, 25 bp, Homo sapien
aaagcttaaacgttagctactctac

SEQ ID NO: 2664 - DNA, 25 bp, Homo sapien
aaagcttagaccttatgggagctag

SEQ ID NO: 2665 - DNA, 25 bp, Homo sapien
aaagcttataccttatgggagctag

SEQ ID NO: 2666 - DNA, 25 bp, Homo sapien
aaagcttcataatagtttctccatg

SEQ ID NO: 2667 - DNA, 25 bp, Homo sapien
aaagcttcatagtagtttctccatg

SEQ ID NO: 2668 - DNA, 25 bp, Homo sapien
aaagcttcattttttttcctcagaa

SEQ ID NO: 2669 - DNA, 25 bp, Homo sapien
aaagcttcccatgtgatttgagtgt

SEQ ID NO: 2670 - DNA, 25 bp, Homo sapien
aaagcttcccatgttatttgagtgt

SEQ ID NO: 2671 - DNA, 25 bp, Homo sapien
aaagcttcgttttttttcctcagaa

SEQ ID NO: 2672 - DNA, 25 bp, Homo sapien
aaagcttggcagacctgtatgcatt

SEQ ID NO: 2673 - DNA, 25 bp, Homo sapien
aaagcttggcaggcctgtatgcatt

SEQ ID NO: 2674 - DNA, 25 bp, Homo sapien
aaagcttttaaaacaagccatgtgt

SEQ ID NO: 2675 - DNA, 25 bp, Homo sapien
aaagcttttaaaacaatccatgtgt

SEQ ID NO: 2676 - DNA, 25 bp, Homo sapien
aaaggaaaaccaaatgaagatcaag

SEQ ID NO: 2677 - DNA, 25 bp, Homo sapien
aaaggaaaagcaaatgaagatcaag

SEQ ID NO: 2678 - DNA, 25 bp, Homo sapien
aaaggaaagagtgcaatcagaggat

SEQ ID NO: 2679 - DNA, 25 bp, Homo sapien
aaaggaaagggtgcaatcagaggat

SEQ ID NO: 2680 - DNA, 25 bp, Homo sapien
aaaggaacagagacagtcaaagaac

SEQ ID NO: 2681 - DNA, 25 bp, Homo sapien
aaaggaaccgagacagtcaaagaac

SEQ ID NO: 2682 - DNA, 25 bp, Homo sapien
aaaggaagggacgagaccaaaaaga

SEQ ID NO: 2683 - DNA, 25 bp, Homo sapien
aaaggaagggatgagaccaaaaaga

SEQ ID NO: 2684 - DNA, 25 bp, Homo sapien
aaaggaaggtcacagtgattgtcac

SEQ ID NO: 2685 - DNA, 25 bp, Homo sapien
aaaggaaggtcagagtgattgtcac

SEQ ID NO: 2686 - DNA, 25 bp, Homo sapien
aaaggaagtaaagtacacttagaag

SEQ ID NO: 2687 - DNA, 25 bp, Homo sapien
aaaggaagtaaagtgcacttagaag

SEQ ID NO: 2688 - DNA, 25 bp, Homo sapien
aaaggaatcaaacaaatccaattgc

SEQ ID NO: 2689 - DNA, 25 bp, Homo sapien
aaaggaatcaaactaatccaattgc

SEQ ID NO: 2690 - DNA, 25 bp, Homo sapien
aaaggaatgcatatacactatcaaa

SEQ ID NO: 2691 - DNA, 25 bp, Homo sapien
aaaggaatgcatgtacactatcaaa

SEQ ID NO: 2692 - DNA, 25 bp, Homo sapien
aaaggaattataaaaacagtcatat

SEQ ID NO: 2693 - DNA, 25 bp, Homo sapien
aaaggaattataagaacagtcatat

SEQ ID NO: 2694 - DNA, 25 bp, Homo sapien
aaaggaatttcactgtgttcagagt

SEQ ID NO: 2695 - DNA, 25 bp, Homo sapien
aaaggaatttcattgtgttcagagt

SEQ ID NO: 2696 - DNA, 25 bp, Homo sapien
aaaggacaaggcacttcgtagcaca

SEQ ID NO: 2697 - DNA, 25 bp, Homo sapien
aaaggacaaggcactttgtagcaca

SEQ ID NO: 2698 - DNA, 25 bp, Homo sapien
aaaggacagtgaggccataaaatgt

SEQ ID NO: 2699 - DNA, 25 bp, Homo sapien
aaaggacagtgtggccataaaatgt

SEQ ID NO: 2700 - DNA, 25 bp, Homo sapien
aaaggagaaaaaaaactgaagattc

SEQ ID NO: 2701 - DNA, 25 bp, Homo sapien
aaaggagaaaaaaacctgaagattc

SEQ ID NO: 2702 - DNA, 25 bp, Homo sapien
aaaggagaaaggtccttgatttaga

SEQ ID NO: 2703 - DNA, 25 bp, Homo sapien
aaaggagaacaaaagacaggaataa

SEQ ID NO: 2704 - DNA, 25 bp, Homo sapien
aaaggagaacaagagacaggaataa

SEQ ID NO: 2705 - DNA, 25 bp, Homo sapien
aaaggagaagttctggctctgagat

SEQ ID NO: 2706 - DNA, 25 bp, Homo sapien
aaaggagaagttttggctctgagat

SEQ ID NO: 2707 - DNA, 25 bp, Homo sapien
aaaggagacaaaaatagagctgttg

SEQ ID NO: 2708 - DNA, 25 bp, Homo sapien
aaaggagacaacaatagagctgttg

SEQ ID NO: 2709 - DNA, 25 bp, Homo sapien
aaaggagacagttaacaaatccact

SEQ ID NO: 2710 - DNA, 25 bp, Homo sapien
aaaggagacagttgacaaatccact

SEQ ID NO: 2711 - DNA, 25 bp, Homo sapien
aaaggagactacatgaggttttgag

SEQ ID NO: 2712 - DNA, 25 bp, Homo sapien
aaaggagaggtgcgatcatagccca

SEQ ID NO: 2713 - DNA, 25 bp, Homo sapien
aaaggagaggtgtgatcatagccca

SEQ ID NO: 2714 - DNA, 25 bp, Homo sapien
aaaggagataggtccttgatttaga

SEQ ID NO: 2715 - DNA, 25 bp, Homo sapien
aaaggagattacatgaggttttgag

SEQ ID NO: 2716 - DNA, 25 bp, Homo sapien
aaaggagcagcaccatcctctttaa

SEQ ID NO: 2717 - DNA, 25 bp, Homo sapien
aaaggagcggcaccatcctctttaa

SEQ ID NO: 2718 - DNA, 25 bp, Homo sapien
aaaggagcttcaatgaataaaactt

SEQ ID NO: 2719 - DNA, 25 bp, Homo sapien
aaaggagcttcagtgaataaaactt

SEQ ID NO: 2720 - DNA, 25 bp, Homo sapien
aaaggaggactccacggtgcaggca

SEQ ID NO: 2721 - DNA, 25 bp, Homo sapien
aaaggaggactccatggtgcaggca

SEQ ID NO: 2722 - DNA, 25 bp, Homo sapien
aaaggaggcctttccttggttgaca

SEQ ID NO: 2723 - DNA, 25 bp, Homo sapien
aaaggaggcttttccttggttgaca

SEQ ID NO: 2724 - DNA, 25 bp, Homo sapien
aaaggagggactcgccacttcttct

SEQ ID NO: 2725 - DNA, 25 bp, Homo sapien
aaaggagggacttgccacttcttct

SEQ ID NO: 2726 - DNA, 25 bp, Homo sapien
aaaggagtcaaaacattgatctcac

SEQ ID NO: 2727 - DNA, 25 bp, Homo sapien
aaaggagtggccagaccatagaggc

SEQ ID NO: 2728 - DNA, 25 bp, Homo sapien
aaaggagtggccaggccatagaggc

SEQ ID NO: 2729 - DNA, 25 bp, Homo sapien
aaaggagttaaaacattgatctcac

SEQ ID NO: 2730 - DNA, 25 bp, Homo sapien
aaaggagtttcatgagatacaatat

SEQ ID NO: 2731 - DNA, 25 bp, Homo sapien
aaaggagtttcttgagatacaatat

SEQ ID NO: 2732 - DNA, 25 bp, Homo sapien
aaaggatacgcactggctttttctg

SEQ ID NO: 2733 - DNA, 25 bp, Homo sapien
aaaggatactagaaatgtatagcct

SEQ ID NO: 2734 - DNA, 25 bp, Homo sapien
aaaggatactagaaatttatagcct

SEQ ID NO: 2735 - DNA, 25 bp, Homo sapien
aaaggatatgcactggctttttctg

SEQ ID NO: 2736 - DNA, 25 bp, Homo sapien
aaaggatgaatacatttttcgggct

SEQ ID NO: 2737 - DNA, 25 bp, Homo sapien
aaaggatgattacatttttcgggct

SEQ ID NO: 2738 - DNA, 25 bp, Homo sapien
aaaggattaatgctgccatcatgaa

SEQ ID NO: 2739 - DNA, 25 bp, Homo sapien
aaaggattaatgttgccatcatgaa

SEQ ID NO: 2740 - DNA, 25 bp, Homo sapien
aaaggattcgatacactagtcagag

SEQ ID NO: 2741 - DNA, 25 bp, Homo sapien
aaaggatttgatacactagtcagag

SEQ ID NO: 2742 - DNA, 25 bp, Homo sapien
aaaggcaagcagacatatattatta

SEQ ID NO: 2743 - DNA, 25 bp, Homo sapien
aaaggcaagcagtcatatattatta

SEQ ID NO: 2744 - DNA, 25 bp, Homo sapien
aaaggcactgtctgacaaaacttta

SEQ ID NO: 2745 - DNA, 25 bp, Homo sapien
aaaggcactgtttgacaaaacttta

SEQ ID NO: 2746 - DNA, 25 bp, Homo sapien
aaaggcagactaactggagaacagg

SEQ ID NO: 2747 - DNA, 25 bp, Homo sapien
aaaggcagattaactggagaacagg

SEQ ID NO: 2748 - DNA, 25 bp, Homo sapien
aaaggcaggtggttctaaagaagga

SEQ ID NO: 2749 - DNA, 25 bp, Homo sapien
aaaggcagttggttctaaagaagga

SEQ ID NO: 2750 - DNA, 25 bp, Homo sapien
aaaggcataaactatctaaatgctc

SEQ ID NO: 2751 - DNA, 25 bp, Homo sapien
aaaggcatagactatctaaatgctc

SEQ ID NO: 2752 - DNA, 25 bp, Homo sapien
aaaggcattctcaggtagcagcatg

SEQ ID NO: 2753 - DNA, 25 bp, Homo sapien
aaaggcattctcgggtagcagcatg

SEQ ID NO: 2754 - DNA, 25 bp, Homo sapien
aaaggccagagaaaaatgtgaccta

SEQ ID NO: 2755 - DNA, 25 bp, Homo sapien
aaaggccagagacaaatgtgaccta

SEQ ID NO: 2756 - DNA, 25 bp, Homo sapien
aaaggccttcgatgcgttgaggatg

SEQ ID NO: 2757 - DNA, 25 bp, Homo sapien
aaaggccttcgctgcgttgaggatg

SEQ ID NO: 2758 - DNA, 25 bp, Homo sapien
aaaggctacaccaactacataagca

SEQ ID NO: 2759 - DNA, 25 bp, Homo sapien
aaaggctacaccacctacataagca

SEQ ID NO: 2760 - DNA, 25 bp, Homo sapien
aaaggctacatatcatctaattctg

SEQ ID NO: 2761 - DNA, 25 bp, Homo sapien
aaaggctacatatcgtctaattctg

SEQ ID NO: 2762 - DNA, 25 bp, Homo sapien
aaaggctagaataaaaacctccatg

SEQ ID NO: 2763 - DNA, 25 bp, Homo sapien
aaaggctagaatgaaaacctccatg

SEQ ID NO: 2764 - DNA, 25 bp, Homo sapien
aaaggctcacgcttcagtagaacgg

SEQ ID NO: 2765 - DNA, 25 bp, Homo sapien
aaaggctcatgcttcagtagaacgg

SEQ ID NO: 2766 - DNA, 25 bp, Homo sapien
aaaggctctagctattattaacagc

SEQ ID NO: 2767 - DNA, 25 bp, Homo sapien
aaaggctctaggtattattaacagc

SEQ ID NO: 2768 - DNA, 25 bp, Homo sapien
aaaggctctgttacaactctcctgg

SEQ ID NO: 2769 - DNA, 25 bp, Homo sapien
aaaggctctgttacgactctcctgg

SEQ ID NO: 2770 - DNA, 25 bp, Homo sapien
aaaggctgaaagtaagagtggcctc

SEQ ID NO: 2771 - DNA, 25 bp, Homo sapien
aaaggctgaaagtaggagtggcctc

SEQ ID NO: 2772 - DNA, 25 bp, Homo sapien
aaaggctgtattcagtgcagacctg

SEQ ID NO: 2773 - DNA, 25 bp, Homo sapien
aaaggctgttttcagtgcagacctg

SEQ ID NO: 2774 - DNA, 25 bp, Homo sapien
aaaggcttacctgactctttgaagg

SEQ ID NO: 2775 - DNA, 25 bp, Homo sapien
aaaggcttacctggctctttgaagg

SEQ ID NO: 2776 - DNA, 25 bp, Homo sapien
aaaggcttgcttgcagcttcccagg

SEQ ID NO: 2777 - DNA, 25 bp, Homo sapien
aaaggcttgcttgtagcttcccagg

SEQ ID NO: 2778 - DNA, 25 bp, Homo sapien
aaaggcttgttagcataagccactg

SEQ ID NO: 2779 - DNA, 25 bp, Homo sapien
aaaggcttgttagcgtaagccactg

SEQ ID NO: 2780 - DNA, 25 bp, Homo sapien
aaagggaacatgtacagagtggaac

SEQ ID NO: 2781 - DNA, 25 bp, Homo sapien
aaagggaacatgtatagagtggaac

SEQ ID NO: 2782 - DNA, 25 bp, Homo sapien
aaagggaagatgaagacattcaact

SEQ ID NO: 2783 - DNA, 25 bp, Homo sapien
aaagggaagatgaagatattcaact

SEQ ID NO: 2784 - DNA, 25 bp, Homo sapien
aaagggaaggtgctactgacatgtg

SEQ ID NO: 2785 - DNA, 25 bp, Homo sapien
aaagggaaggtggtactgacatgtg

SEQ ID NO: 2786 - DNA, 25 bp, Homo sapien
aaagggacatcgaaatctcgacatc

SEQ ID NO: 2787 - DNA, 25 bp, Homo sapien
aaagggacatcggaatctcgacatc

SEQ ID NO: 2788 - DNA, 25 bp, Homo sapien
aaagggacccgcagtcatgttcatt

SEQ ID NO: 2789 - DNA, 25 bp, Homo sapien
aaagggacctgcagtcatgttcatt

SEQ ID NO: 2790 - DNA, 25 bp, Homo sapien
aaagggagaccgcgtttagtttgag

SEQ ID NO: 2791 - DNA, 25 bp, Homo sapien
aaagggagacctcgtttagtttgag

SEQ ID NO: 2792 - DNA, 25 bp, Homo sapien
aaagggagagataggcttcaatgca

SEQ ID NO: 2793 - DNA, 25 bp, Homo sapien
aaagggagagatgggcttcaatgca

SEQ ID NO: 2794 - DNA, 25 bp, Homo sapien
aaagggaggttgacgaaatattatg

SEQ ID NO: 2795 - DNA, 25 bp, Homo sapien
aaagggaggttgatgaaatattatg

SEQ ID NO: 2796 - DNA, 25 bp, Homo sapien
aaagggatattaaccaagacccagc

SEQ ID NO: 2797 - DNA, 25 bp, Homo sapien
aaagggatattaatcaagacccagc

SEQ ID NO: 2798 - DNA, 25 bp, Homo sapien
aaagggcaagcttcaggatgttgtt

SEQ ID NO: 2799 - DNA, 25 bp, Homo sapien
aaagggcacaaagaaaagagtagtc

SEQ ID NO: 2800 - DNA, 25 bp, Homo sapien
aaagggcaccaagaaaagagtagtc

SEQ ID NO: 2801 - DNA, 25 bp, Homo sapien
aaagggcaccagagttggctttcag

SEQ ID NO: 2802 - DNA, 25 bp, Homo sapien
aaagggcaccagagtttgctttcag

SEQ ID NO: 2803 - DNA, 25 bp, Homo sapien
aaagggcacgcttcaggatgttgtt

SEQ ID NO: 2804 - DNA, 25 bp, Homo sapien
aaagggcataacaggaacattaatc

SEQ ID NO: 2805 - DNA, 25 bp, Homo sapien
aaagggcataacgggaacattaatc

SEQ ID NO: 2806 - DNA, 25 bp, Homo sapien
aaagggcataagcaaatgtcaaata

SEQ ID NO: 2807 - DNA, 25 bp, Homo sapien
aaagggcataagcacatgtcaaata

SEQ ID NO: 2808 - DNA, 25 bp, Homo sapien
aaaggggagttgccattttattggt

SEQ ID NO: 2809 - DNA, 25 bp, Homo sapien
aaaggggagttgccgttttattggt

SEQ ID NO: 2810 - DNA, 25 bp, Homo sapien
aaagggtaagatcggaaaccaactc

SEQ ID NO: 2811 - DNA, 25 bp, Homo sapien
aaagggtaagatctgaaaccaactc

SEQ ID NO: 2812 - DNA, 25 bp, Homo sapien
aaagggtcttacgagccattgaatc

SEQ ID NO: 2813 - DNA, 25 bp, Homo sapien
aaagggtcttatgagccattgaatc

SEQ ID NO: 2814 - DNA, 25 bp, Homo sapien
aaagggttaaagcagatagagatta

SEQ ID NO: 2815 - DNA, 25 bp, Homo sapien
aaagggttaaatggtgactaatcgt

SEQ ID NO: 2816 - DNA, 25 bp, Homo sapien
aaagggttaaattgtgactaatcgt

SEQ ID NO: 2817 - DNA, 25 bp, Homo sapien
aaagggttagagcagatagagatta

SEQ ID NO: 2818 - DNA, 25 bp, Homo sapien
aaaggtacagaaagcagagttattc

SEQ ID NO: 2819 - DNA, 25 bp, Homo sapien
aaaggtacagaaggcagagttattc

SEQ ID NO: 2820 - DNA, 25 bp, Homo sapien
aaaggtagcggtcagctgtggtatc

SEQ ID NO: 2821 - DNA, 25 bp, Homo sapien
aaaggtagtggtcagctgtggtatc

SEQ ID NO: 2822 - DNA, 25 bp, Homo sapien
aaaggtcagggaacggggtcacaat

SEQ ID NO: 2823 - DNA, 25 bp, Homo sapien
aaaggtcagggaatggggtcacaat

SEQ ID NO: 2824 - DNA, 25 bp, Homo sapien
aaaggtccagcagacagttgtgcaa

SEQ ID NO: 2825 - DNA, 25 bp, Homo sapien
aaaggtccagcggacagttgtgcaa

SEQ ID NO: 2826 - DNA, 25 bp, Homo sapien
aaaggtctcatccgtattttcatct

SEQ ID NO: 2827 - DNA, 25 bp, Homo sapien
aaaggtctcgtccgtattttcatct

SEQ ID NO: 2828 - DNA, 25 bp, Homo sapien
aaaggtcttgcattgctccctccaa

SEQ ID NO: 2829 - DNA, 25 bp, Homo sapien
aaaggtcttgcatttctccctccaa

SEQ ID NO: 2830 - DNA, 25 bp, Homo sapien
aaaggtgaacctcgcatattcttac

SEQ ID NO: 2831 - DNA, 25 bp, Homo sapien
aaaggtgaaccttgcatattcttac

SEQ ID NO: 2832 - DNA, 25 bp, Homo sapien
aaaggtgatagaagaaaaagacata

SEQ ID NO: 2833 - DNA, 25 bp, Homo sapien
aaaggtgatagaaggaaaagacata

SEQ ID NO: 2834 - DNA, 25 bp, Homo sapien
aaaggtgcataacggactcccttct

SEQ ID NO: 2835 - DNA, 25 bp, Homo sapien
aaaggtgcataatggactcccttct

SEQ ID NO: 2836 - DNA, 25 bp, Homo sapien
aaaggtgcttccgaaaggattctta

SEQ ID NO: 2837 - DNA, 25 bp, Homo sapien
aaaggtgcttccgcaaggattctta

SEQ ID NO: 2838 - DNA, 25 bp, Homo sapien
aaaggttacagataccaggtaccag

SEQ ID NO: 2839 - DNA, 25 bp, Homo sapien
aaaggttacagatatcaggtaccag

SEQ ID NO: 2840 - DNA, 25 bp, Homo sapien
aaaggttatatgacgatttgcagac

SEQ ID NO: 2841 - DNA, 25 bp, Homo sapien
aaaggttatatgatgatttgcagac

SEQ ID NO: 2842 - DNA, 25 bp, Homo sapien
aaaggttctaaagtacgaaaagatg

SEQ ID NO: 2843 - DNA, 25 bp, Homo sapien
aaaggttctaaggtacgaaaagatg

SEQ ID NO: 2844 - DNA, 25 bp, Homo sapien
aaaggttctcagtcacacctggcag

SEQ ID NO: 2845 - DNA, 25 bp, Homo sapien
aaaggttctcagtcccacctggcag

SEQ ID NO: 2846 - DNA, 25 bp, Homo sapien
aaaggttgggcacatggcatcagca

SEQ ID NO: 2847 - DNA, 25 bp, Homo sapien
aaaggttgggcacgtggcatcagca

SEQ ID NO: 2848 - DNA, 25 bp, Homo sapien
aaaggttggggcatgcatcctctga

SEQ ID NO: 2849 - DNA, 25 bp, Homo sapien
aaaggttggggcttgcatcctctga

SEQ ID NO: 2850 - DNA, 25 bp, Homo sapien
aaaggtttcctaattacttcaccaa

SEQ ID NO: 2851 - DNA, 25 bp, Homo sapien
aaaggtttcctaattatttcaccaa

SEQ ID NO: 2852 - DNA, 25 bp, Homo sapien
aaagtaaataaaatggaacactgtt

SEQ ID NO: 2853 - DNA, 25 bp, Homo sapien
aaagtaaataaagtggaacactgtt

SEQ ID NO: 2854 - DNA, 25 bp, Homo sapien
aaagtaaatgtcatcttgagtgtta

SEQ ID NO: 2855 - DNA, 25 bp, Homo sapien
aaagtaaatgtcattttgagtgtta

SEQ ID NO: 2856 - DNA, 25 bp, Homo sapien
aaagtaaattcacctgttcttagaa

SEQ ID NO: 2857 - DNA, 25 bp, Homo sapien
aaagtaaattcacttgttcttagaa

SEQ ID NO: 2858 - DNA, 25 bp, Homo sapien
aaagtaagaggatgccaaaaatgac

SEQ ID NO: 2859 - DNA, 25 bp, Homo sapien
aaagtaagagggtgccaaaaatgac

SEQ ID NO: 2860 - DNA, 25 bp, Homo sapien
aaagtaagtgaacacaataatagcc

SEQ ID NO: 2861 - DNA, 25 bp, Homo sapien
aaagtaagtgaacagaataatagcc

SEQ ID NO: 2862 - DNA, 25 bp, Homo sapien
aaagtaatgactgcgctttggcccc

SEQ ID NO: 2863 - DNA, 25 bp, Homo sapien
aaagtaatgactgtgctttggcccc

SEQ ID NO: 2864 - DNA, 25 bp, Homo sapien
aaagtacaaaagaaaagagagatat

SEQ ID NO: 2865 - DNA, 25 bp, Homo sapien
aaagtacaaaaggaaagagagatat

SEQ ID NO: 2866 - DNA, 25 bp, Homo sapien
aaagtacaaatgtcttcctgtaaac

SEQ ID NO: 2867 - DNA, 25 bp, Homo sapien
aaagtacaattgtcttcctgtaaac

SEQ ID NO: 2868 - DNA, 25 bp, Homo sapien
aaagtactattccggtattctagct

SEQ ID NO: 2869 - DNA, 25 bp, Homo sapien
aaagtactattcctgtattctagct

SEQ ID NO: 2870 - DNA, 25 bp, Homo sapien
aaagtacttgaaaccaggacctgga

SEQ ID NO: 2871 - DNA, 25 bp, Homo sapien
aaagtacttgaagccaggacctgga

SEQ ID NO: 2872 - DNA, 25 bp, Homo sapien
aaagtagaactaataagtggaaaga

SEQ ID NO: 2873 - DNA, 25 bp, Homo sapien
aaagtagaagctgcagaaaacacat

SEQ ID NO: 2874 - DNA, 25 bp, Homo sapien
aaagtagaagctgcagcaaacacat

SEQ ID NO: 2875 - DNA, 25 bp, Homo sapien
aaagtagacctaataagtggaaaga

SEQ ID NO: 2876 - DNA, 25 bp, Homo sapien
aaagtagactgagcatgtggaaata

SEQ ID NO: 2877 - DNA, 25 bp, Homo sapien
aaagtagactgagcgtgtggaaata

SEQ ID NO: 2878 - DNA, 25 bp, Homo sapien
aaagtaggtctgagcagtgaaaaag

SEQ ID NO: 2879 - DNA, 25 bp, Homo sapien
aaagtaggtttgagcagtgaaaaag

SEQ ID NO: 2880 - DNA, 25 bp, Homo sapien
aaagtagtttgcactgtgcctggca

SEQ ID NO: 2881 - DNA, 25 bp, Homo sapien
aaagtagtttgcattgtgcctggca

SEQ ID NO: 2882 - DNA, 25 bp, Homo sapien
aaagtatacaacaaagctcatcatt

SEQ ID NO: 2883 - DNA, 25 bp, Homo sapien
aaagtatacaacacagctcatcatt

SEQ ID NO: 2884 - DNA, 25 bp, Homo sapien
aaagtatacacatattttgaaacaa

SEQ ID NO: 2885 - DNA, 25 bp, Homo sapien
aaagtatacgcatattttgaaacaa

SEQ ID NO: 2886 - DNA, 25 bp, Homo sapien
aaagtatccttgcagttttccttaa

SEQ ID NO: 2887 - DNA, 25 bp, Homo sapien
aaagtatctccacgaggttggtcat

SEQ ID NO: 2888 - DNA, 25 bp, Homo sapien
aaagtatctccatgaggttggtcat

SEQ ID NO: 2889 - DNA, 25 bp, Homo sapien
aaagtatctttgcagttttccttaa

SEQ ID NO: 2890 - DNA, 25 bp, Homo sapien
aaagtatggagcatggaaaaatggg

SEQ ID NO: 2891 - DNA, 25 bp, Homo sapien
aaagtatggagcctggaaaaatggg

SEQ ID NO: 2892 - DNA, 25 bp, Homo sapien
aaagtattacctcacttgccgctta

SEQ ID NO: 2893 - DNA, 25 bp, Homo sapien
aaagtattacctcagttgccgctta

SEQ ID NO: 2894 - DNA, 25 bp, Homo sapien
aaagtcaacatgaaaaaaaataatg

SEQ ID NO: 2895 - DNA, 25 bp, Homo sapien
aaagtcaacatgagaaaaaataatg

SEQ ID NO: 2896 - DNA, 25 bp, Homo sapien
aaagtcaagccagtgcctgtgaaaa

SEQ ID NO: 2897 - DNA, 25 bp, Homo sapien
aaagtcaatccagtgcctgtgaaaa

SEQ ID NO: 2898 - DNA, 25 bp, Homo sapien
aaagtcacaagatgcccagttcaat

SEQ ID NO: 2899 - DNA, 25 bp, Homo sapien
aaagtcacaagttgaaattgaataa

SEQ ID NO: 2900 - DNA, 25 bp, Homo sapien
aaagtcacaagttgaagttgaataa

SEQ ID NO: 2901 - DNA, 25 bp, Homo sapien
aaagtcacaggaaggcatactacag

SEQ ID NO: 2902 - DNA, 25 bp, Homo sapien
aaagtcacaggagggcatactacag

SEQ ID NO: 2903 - DNA, 25 bp, Homo sapien
aaagtcacaggatgcccagttcaat

SEQ ID NO: 2904 - DNA, 25 bp, Homo sapien
aaagtcactcacggtctaaagaatt

SEQ ID NO: 2905 - DNA, 25 bp, Homo sapien
aaagtcactcatggtctaaagaatt

SEQ ID NO: 2906 - DNA, 25 bp, Homo sapien
aaagtcagcttgtgaggtaaaaaga

SEQ ID NO: 2907 - DNA, 25 bp, Homo sapien
aaagtcaggcaggttttcttgcagt

SEQ ID NO: 2908 - DNA, 25 bp, Homo sapien
aaagtcagtcaggttttcttgcagt

SEQ ID NO: 2909 - DNA, 25 bp, Homo sapien
aaagtcagtttgtgaggtaaaaaga

SEQ ID NO: 2910 - DNA, 25 bp, Homo sapien
aaagtcatagatctaaataaatgga

SEQ ID NO: 2911 - DNA, 25 bp, Homo sapien
aaagtcatagatttaaataaatgga

SEQ ID NO: 2912 - DNA, 25 bp, Homo sapien
aaagtcatccggtcctttgtcacta

SEQ ID NO: 2913 - DNA, 25 bp, Homo sapien
aaagtcatcgggtcctttgtcacta

SEQ ID NO: 2914 - DNA, 25 bp, Homo sapien
aaagtcattgctagagaggctttag

SEQ ID NO: 2915 - DNA, 25 bp, Homo sapien
aaagtcattgctggagaggctttag

SEQ ID NO: 2916 - DNA, 25 bp, Homo sapien
aaagtcatttccacttaaaaaaatg

SEQ ID NO: 2917 - DNA, 25 bp, Homo sapien
aaagtcatttccagttaaaaaaatg

SEQ ID NO: 2918 - DNA, 25 bp, Homo sapien
aaagtcattttcttcctgctgtttt

SEQ ID NO: 2919 - DNA, 25 bp, Homo sapien
aaagtcattttgttcctgctgtttt

SEQ ID NO: 2920 - DNA, 25 bp, Homo sapien
aaagtccacatgcaagttgagacct

SEQ ID NO: 2921 - DNA, 25 bp, Homo sapien
aaagtccacatgtaagttgagacct

SEQ ID NO: 2922 - DNA, 25 bp, Homo sapien
aaagtcctatctgctttaatcttta

SEQ ID NO: 2923 - DNA, 25 bp, Homo sapien
aaagtcctatcttctttaatcttta

SEQ ID NO: 2924 - DNA, 25 bp, Homo sapien
aaagtcctttgagaaaaacattgct

SEQ ID NO: 2925 - DNA, 25 bp, Homo sapien
aaagtcctttgggaaaaacattgct

SEQ ID NO: 2926 - DNA, 25 bp, Homo sapien
aaagtctaatagtgcaattctttcc

SEQ ID NO: 2927 - DNA, 25 bp, Homo sapien
aaagtctaatattgcaattctttcc

SEQ ID NO: 2928 - DNA, 25 bp, Homo sapien
aaagtctactaaaaattcagtgaat

SEQ ID NO: 2929 - DNA, 25 bp, Homo sapien
aaagtctactaagaattcagtgaat

SEQ ID NO: 2930 - DNA, 25 bp, Homo sapien
aaagtctcactttcgctgttcttcc

SEQ ID NO: 2931 - DNA, 25 bp, Homo sapien
aaagtctcacttttgctgttcttcc

SEQ ID NO: 2932 - DNA, 25 bp, Homo sapien
aaagtctcagtgttttaggatacag

SEQ ID NO: 2933 - DNA, 25 bp, Homo sapien
aaagtctcgcaaggatgttcaaatg

SEQ ID NO: 2934 - DNA, 25 bp, Homo sapien
aaagtctcgcaaggattttcaaatg

SEQ ID NO: 2935 - DNA, 25 bp, Homo sapien
aaagtctcggtgttttaggatacag

SEQ ID NO: 2936 - DNA, 25 bp, Homo sapien
aaagtctgcataaatgtgggatgcc

SEQ ID NO: 2937 - DNA, 25 bp, Homo sapien
aaagtctgcataactgtgggatgcc

SEQ ID NO: 2938 - DNA, 25 bp, Homo sapien
aaagtctgcatacatatagcctcct

SEQ ID NO: 2939 - DNA, 25 bp, Homo sapien
aaagtctgcgtacatatagcctcct

SEQ ID NO: 2940 - DNA, 25 bp, Homo sapien
aaagtctgcttgaaaacccatcaaa

SEQ ID NO: 2941 - DNA, 25 bp, Homo sapien
aaagtctgcttggaaacccatcaaa

SEQ ID NO: 2942 - DNA, 25 bp, Homo sapien
aaagtctgtacccagctacctcagt

SEQ ID NO: 2943 - DNA, 25 bp, Homo sapien
aaagtctgtactcagctacctcagt

SEQ ID NO: 2944 - DNA, 25 bp, Homo sapien
aaagtctgtatacgagtttaagtcc

SEQ ID NO: 2945 - DNA, 25 bp, Homo sapien
aaagtctgtatatgagtttaagtcc

SEQ ID NO: 2946 - DNA, 25 bp, Homo sapien
aaagtctgtgacctctgtgctttgt

SEQ ID NO: 2947 - DNA, 25 bp, Homo sapien
aaagtctgtgatctctgtgctttgt

SEQ ID NO: 2948 - DNA, 25 bp, Homo sapien
aaagtcttctctaatgctcatatag

SEQ ID NO: 2949 - DNA, 25 bp, Homo sapien
aaagtcttctctaatgttcatatag

SEQ ID NO: 2950 - DNA, 25 bp, Homo sapien
aaagtctttcgattgtttccatttt

SEQ ID NO: 2951 - DNA, 25 bp, Homo sapien
aaagtcttttagcccatcttaaaat

SEQ ID NO: 2952 - DNA, 25 bp, Homo sapien
aaagtcttttagtccatcttaaaat

SEQ ID NO: 2953 - DNA, 25 bp, Homo sapien
aaagtcttttgattgtttccatttt

SEQ ID NO: 2954 - DNA, 25 bp, Homo sapien
aaagtgaaagacagaaacagatatt

SEQ ID NO: 2955 - DNA, 25 bp, Homo sapien
aaagtgaaagacggaaacagatatt

SEQ ID NO: 2956 - DNA, 25 bp, Homo sapien
aaagtgaagagtaaatcagtgagga

SEQ ID NO: 2957 - DNA, 25 bp, Homo sapien
aaagtgaatagtaaatcagtgagga

SEQ ID NO: 2958 - DNA, 25 bp, Homo sapien
aaagtgacctcaaaatcaacccaca

SEQ ID NO: 2959 - DNA, 25 bp, Homo sapien
aaagtgacctcagaatcaacccaca

SEQ ID NO: 2960 - DNA, 25 bp, Homo sapien
aaagtgacttgtctgcttagcaaga

SEQ ID NO: 2961 - DNA, 25 bp, Homo sapien
aaagtgacttgtttgcttagcaaga

SEQ ID NO: 2962 - DNA, 25 bp, Homo sapien
aaagtgagaaatctacgctgccgct

SEQ ID NO: 2963 - DNA, 25 bp, Homo sapien
aaagtgagaaatctactctgccgct

SEQ ID NO: 2964 - DNA, 25 bp, Homo sapien
aaagtgagtcagtgagacatatttg

SEQ ID NO: 2965 - DNA, 25 bp, Homo sapien
aaagtgagttagtgagacatatttg

SEQ ID NO: 2966 - DNA, 25 bp, Homo sapien
aaagtgataaaacccaacaaatcat

SEQ ID NO: 2967 - DNA, 25 bp, Homo sapien
aaagtgataaaacccagcaaatcat

SEQ ID NO: 2968 - DNA, 25 bp, Homo sapien
aaagtgatcatcaatttaaatcagc

SEQ ID NO: 2969 - DNA, 25 bp, Homo sapien
aaagtgatcatcattttaaatcagc

SEQ ID NO: 2970 - DNA, 25 bp, Homo sapien
aaagtgcatcagtataaaacaaata

SEQ ID NO: 2971 - DNA, 25 bp, Homo sapien
aaagtgcatcattataaaacaaata

SEQ ID NO: 2972 - DNA, 25 bp, Homo sapien
aaagtgcccattaaactgtagtggg

SEQ ID NO: 2973 - DNA, 25 bp, Homo sapien
aaagtgcccattgaactgtagtggg

SEQ ID NO: 2974 - DNA, 25 bp, Homo sapien
aaagtgctgtgattgactggtcatg

SEQ ID NO: 2975 - DNA, 25 bp, Homo sapien
aaagtgctgtgattgattggtcatg

SEQ ID NO: 2976 - DNA, 25 bp, Homo sapien
aaagtggaaaaggataggctgagat

SEQ ID NO: 2977 - DNA, 25 bp, Homo sapien
aaagtggaaccgttagtccattcag

SEQ ID NO: 2978 - DNA, 25 bp, Homo sapien
aaagtggaataggataggctgagat

SEQ ID NO: 2979 - DNA, 25 bp, Homo sapien
aaagtggatccgttagtccattcag

SEQ ID NO: 2980 - DNA, 25 bp, Homo sapien
aaagtggatggacagaaggatgctg

SEQ ID NO: 2981 - DNA, 25 bp, Homo sapien
aaagtggatggatagaaggatgctg

SEQ ID NO: 2982 - DNA, 25 bp, Homo sapien
aaagtggcgctttctgctctgaggc

SEQ ID NO: 2983 - DNA, 25 bp, Homo sapien
aaagtggcgttttctgctctgaggc

SEQ ID NO: 2984 - DNA, 25 bp, Homo sapien
aaagtgggaagcacgtgagccaatg

SEQ ID NO: 2985 - DNA, 25 bp, Homo sapien
aaagtgggaagcatgtgagccaatg

SEQ ID NO: 2986 - DNA, 25 bp, Homo sapien
aaagtgggaatgtaacaatgttgga

SEQ ID NO: 2987 - DNA, 25 bp, Homo sapien
aaagtgggaatgtaaccatgttgga

SEQ ID NO: 2988 - DNA, 25 bp, Homo sapien
aaagtgtaaggaccaatgacacaga

SEQ ID NO: 2989 - DNA, 25 bp, Homo sapien
aaagtgtaaggaccgatgacacaga

SEQ ID NO: 2990 - DNA, 25 bp, Homo sapien
aaagtgtctacctaagataggcttt

SEQ ID NO: 2991 - DNA, 25 bp, Homo sapien
aaagtgtctgcctaagataggcttt

SEQ ID NO: 2992 - DNA, 25 bp, Homo sapien
aaagtgtgaattccgatttgaggat

SEQ ID NO: 2993 - DNA, 25 bp, Homo sapien
aaagtgtgaattctgatttgaggat

SEQ ID NO: 2994 - DNA, 25 bp, Homo sapien
aaagtgtggttcaactatgtgagat

SEQ ID NO: 2995 - DNA, 25 bp, Homo sapien
aaagtgtggttcacctatgtgagat

SEQ ID NO: 2996 - DNA, 25 bp, Homo sapien
aaagtgttactattcggccttttac

SEQ ID NO: 2997 - DNA, 25 bp, Homo sapien
aaagtgttactatttggccttttac

SEQ ID NO: 2998 - DNA, 25 bp, Homo sapien
aaagtgttcgtgttttttcttagaa

SEQ ID NO: 2999 - DNA, 25 bp, Homo sapien
aaagtgttgtgactatagttaaatg

SEQ ID NO: 3000 - DNA, 25 bp, Homo sapien
aaagtgttgtgattatagttaaatg

SEQ ID NO: 3001 - DNA, 25 bp, Homo sapien
aaagtgtttgtgttttttcttagaa

SEQ ID NO: 3002 - DNA, 25 bp, Homo sapien
aaagttagaggaaatttcagctcct

SEQ ID NO: 3003 - DNA, 25 bp, Homo sapien
aaagttagaggcaatttcagctcct

SEQ ID NO: 3004 - DNA, 25 bp, Homo sapien
aaagttagccagatctcaataaaaa

SEQ ID NO: 3005 - DNA, 25 bp, Homo sapien
aaagttagctcattacagatttcac

SEQ ID NO: 3006 - DNA, 25 bp, Homo sapien
aaagttagctcgttacagatttcac

SEQ ID NO: 3007 - DNA, 25 bp, Homo sapien
aaagttagcttatgtccttggaaat

SEQ ID NO: 3008 - DNA, 25 bp, Homo sapien
aaagttagcttatgtctttggaaat

SEQ ID NO: 3009 - DNA, 25 bp, Homo sapien
aaagttagtcagatctcaataaaaa

SEQ ID NO: 3010 - DNA, 25 bp, Homo sapien
aaagttatcgccaatagccagtgat

SEQ ID NO: 3011 - DNA, 25 bp, Homo sapien
aaagttattctcgtgttctccattt

SEQ ID NO: 3012 - DNA, 25 bp, Homo sapien
aaagttattctcgttttctccattt

SEQ ID NO: 3013 - DNA, 25 bp, Homo sapien
aaagttattgccaatagccagtgat

SEQ ID NO: 3014 - DNA, 25 bp, Homo sapien
aaagttcacataactgcaaagcatc

SEQ ID NO: 3015 - DNA, 25 bp, Homo sapien
aaagttcacctcatcatgtagtatg

SEQ ID NO: 3016 - DNA, 25 bp, Homo sapien
aaagttcagatagatcttaccaaac

SEQ ID NO: 3017 - DNA, 25 bp, Homo sapien
aaagttcagattgatcttaccaaac

SEQ ID NO: 3018 - DNA, 25 bp, Homo sapien
aaagttcatataactgcaaagcatc

SEQ ID NO: 3019 - DNA, 25 bp, Homo sapien
aaagttcatctcatcatgtagtatg

SEQ ID NO: 3020 - DNA, 25 bp, Homo sapien
aaagttccaagagagtgtaaaagct

SEQ ID NO: 3021 - DNA, 25 bp, Homo sapien
aaagttccaagggagtgtaaaagct

SEQ ID NO: 3022 - DNA, 25 bp, Homo sapien
aaagttccacgtacactactatggt

SEQ ID NO: 3023 - DNA, 25 bp, Homo sapien
aaagttccatgtacactactatggt

SEQ ID NO: 3024 - DNA, 25 bp, Homo sapien
aaagttcctctctgacattcaacca

SEQ ID NO: 3025 - DNA, 25 bp, Homo sapien
aaagttcctctctgacgttcaacca

SEQ ID NO: 3026 - DNA, 25 bp, Homo sapien
aaagttctacacctcattataaacc

SEQ ID NO: 3027 - DNA, 25 bp, Homo sapien
aaagttctatacctcattataaacc

SEQ ID NO: 3028 - DNA, 25 bp, Homo sapien
aaagttctcagtagattggtcgggg

SEQ ID NO: 3029 - DNA, 25 bp, Homo sapien
aaagttctcggtagattggtcgggg

SEQ ID NO: 3030 - DNA, 25 bp, Homo sapien
aaagttctctttgcgtggcatttct

SEQ ID NO: 3031 - DNA, 25 bp, Homo sapien
aaagttctctttgtgtggcatttct

SEQ ID NO: 3032 - DNA, 25 bp, Homo sapien
aaagttctgattacattgtagagtt

SEQ ID NO: 3033 - DNA, 25 bp, Homo sapien
aaagttctgattatattgtagagtt

SEQ ID NO: 3034 - DNA, 25 bp, Homo sapien
aaagttgaaattactccttactcca

SEQ ID NO: 3035 - DNA, 25 bp, Homo sapien
aaagttgaaattagtccttactcca

SEQ ID NO: 3036 - DNA, 25 bp, Homo sapien
aaagttgaacaaataacccaagttt

SEQ ID NO: 3037 - DNA, 25 bp, Homo sapien
aaagttgaacaaattacccaagttt

SEQ ID NO: 3038 - DNA, 25 bp, Homo sapien
aaagttgcccaaaatttgcatgtgc

SEQ ID NO: 3039 - DNA, 25 bp, Homo sapien
aaagttgcccagaatttgcatgtgc

SEQ ID NO: 3040 - DNA, 25 bp, Homo sapien
aaagttgctatattatttttcttct

SEQ ID NO: 3041 - DNA, 25 bp, Homo sapien
aaagttgctatattctttttcttct

SEQ ID NO: 3042 - DNA, 25 bp, Homo sapien
aaagttggcttcacctttgggctgg

SEQ ID NO: 3043 - DNA, 25 bp, Homo sapien
aaagttggcttcacgtttgggctgg

SEQ ID NO: 3044 - DNA, 25 bp, Homo sapien
aaagttgtaaatttgaagaaggtga

SEQ ID NO: 3045 - DNA, 25 bp, Homo sapien
aaagttgtacatttgaagaaggtga

SEQ ID NO: 3046 - DNA, 25 bp, Homo sapien
aaagttgtatacgttaatgattgtc

SEQ ID NO: 3047 - DNA, 25 bp, Homo sapien
aaagttgtatatgttaatgattgtc

SEQ ID NO: 3048 - DNA, 25 bp, Homo sapien
aaagttgtatgaaattatatgaaat

SEQ ID NO: 3049 - DNA, 25 bp, Homo sapien
aaagttgtatgagattatatgaaat

SEQ ID NO: 3050 - DNA, 25 bp, Homo sapien
aaagttgtctcattctctccttatt

SEQ ID NO: 3051 - DNA, 25 bp, Homo sapien
aaagttgtctcgttctctccttatt

SEQ ID NO: 3052 - DNA, 25 bp, Homo sapien
aaagttgttgcccctgactcagatt

SEQ ID NO: 3053 - DNA, 25 bp, Homo sapien
aaagttgttgcctctgactcagatt

SEQ ID NO: 3054 - DNA, 25 bp, Homo sapien
aaagtttaagaacaaatgcataagg

SEQ ID NO: 3055 - DNA, 25 bp, Homo sapien
aaagtttaagatcaaatgcataagg

SEQ ID NO: 3056 - DNA, 25 bp, Homo sapien
aaagtttacatcataaagtgtcaat

SEQ ID NO: 3057 - DNA, 25 bp, Homo sapien
aaagtttacgtcataaagtgtcaat

SEQ ID NO: 3058 - DNA, 25 bp, Homo sapien
aaagtttactctcaattttgtctcc

SEQ ID NO: 3059 - DNA, 25 bp, Homo sapien
aaagtttactctcacttttgtctcc

SEQ ID NO: 3060 - DNA, 25 bp, Homo sapien
aaagtttatggcaataataggtaga

SEQ ID NO: 3061 - DNA, 25 bp, Homo sapien
aaagtttatgggaataataggtaga

SEQ ID NO: 3062 - DNA, 25 bp, Homo sapien
aaagtttccaaaaagtctccagacc

SEQ ID NO: 3063 - DNA, 25 bp, Homo sapien
aaagtttccgaaaagtctccagacc

SEQ ID NO: 3064 - DNA, 25 bp, Homo sapien
aaagttttatctcggtgaactacct

SEQ ID NO: 3065 - DNA, 25 bp, Homo sapien
aaagttttatcttggtgaactacct

SEQ ID NO: 3066 - DNA, 25 bp, Homo sapien
aaagttttgtcggttcaaactagat

SEQ ID NO: 3067 - DNA, 25 bp, Homo sapien
aaagttttgtctgttcaaactagat

SEQ ID NO: 3068 - DNA, 25 bp, Homo sapien
aaataaaaaacagatgaacaatgta

SEQ ID NO: 3069 - DNA, 25 bp, Homo sapien
aaataaaaaacaggtgaacaatgta

SEQ ID NO: 3070 - DNA, 25 bp, Homo sapien
aaataaaaatctcaatgaatgggct

SEQ ID NO: 3071 - DNA, 25 bp, Homo sapien
aaataaaaccgatacaagcaattat

SEQ ID NO: 3072 - DNA, 25 bp, Homo sapien
aaataaaacctttgtggtctaattc

SEQ ID NO: 3073 - DNA, 25 bp, Homo sapien
aaataaaacgactgttgaaagaagg

SEQ ID NO: 3074 - DNA, 25 bp, Homo sapien
aaataaaacgggtagcagctctaag

SEQ ID NO: 3075 - DNA, 25 bp, Homo sapien
aaataaaacggttagcagctctaag

SEQ ID NO: 3076 - DNA, 25 bp, Homo sapien
aaataaaacgttagggtgaatgctg

SEQ ID NO: 3077 - DNA, 25 bp, Homo sapien
aaataaaactctcaatgaatgggct

SEQ ID NO: 3078 - DNA, 25 bp, Homo sapien
aaataaaactgatacaagcaattat

SEQ ID NO: 3079 - DNA, 25 bp, Homo sapien
aaataaaagtggctgctgattggag

SEQ ID NO: 3080 - DNA, 25 bp, Homo sapien
aaataaaagtggttgctgattggag

SEQ ID NO: 3081 - DNA, 25 bp, Homo sapien
aaataaaatctttgtggtctaattc

SEQ ID NO: 3082 - DNA, 25 bp, Homo sapien
aaataaaatgacactcgggtgatta

SEQ ID NO: 3083 - DNA, 25 bp, Homo sapien
aaataaaatgacactctggtgatta

SEQ ID NO: 3084 - DNA, 25 bp, Homo sapien
aaataaaatgactgttgaaagaagg

SEQ ID NO: 3085 - DNA, 25 bp, Homo sapien
aaataaaatggaaaaacctggacaa

SEQ ID NO: 3086 - DNA, 25 bp, Homo sapien
aaataaaatggagaaacctggacaa

SEQ ID NO: 3087 - DNA, 25 bp, Homo sapien
aaataaaatgttagggtgaatgctg

SEQ ID NO: 3088 - DNA, 25 bp, Homo sapien
aaataaacatatatgccatgagtgc

SEQ ID NO: 3089 - DNA, 25 bp, Homo sapien
aaataaacgtatatgccatgagtgc

SEQ ID NO: 3090 - DNA, 25 bp, Homo sapien
aaataaactaccaaggaccaatact

SEQ ID NO: 3091 - DNA, 25 bp, Homo sapien
aaataaactaccagggaccaatact

SEQ ID NO: 3092 - DNA, 25 bp, Homo sapien
aaataaactcacatatacggaaatg

SEQ ID NO: 3093 - DNA, 25 bp, Homo sapien
aaataaactcacgtatacggaaatg

SEQ ID NO: 3094 - DNA, 25 bp, Homo sapien
aaataaagcgatcctggtgtgttta

SEQ ID NO: 3095 - DNA, 25 bp, Homo sapien
aaataaagctatcctggtgtgttta

SEQ ID NO: 3096 - DNA, 25 bp, Homo sapien
aaataaaggaagttggtaagagatg

SEQ ID NO: 3097 - DNA, 25 bp, Homo sapien
aaataaaggaatttggtaagagatg

SEQ ID NO: 3098 - DNA, 25 bp, Homo sapien
aaataaagtcacaagatgcccagtt

SEQ ID NO: 3099 - DNA, 25 bp, Homo sapien
aaataaagtcacaggatgcccagtt

SEQ ID NO: 3100 - DNA, 25 bp, Homo sapien
aaataaatcaccaatgaatacaaag

SEQ ID NO: 3101 - DNA, 25 bp, Homo sapien
aaataaatcaccagtgaatacaaag

SEQ ID NO: 3102 - DNA, 25 bp, Homo sapien
aaataaatgatccctaaggagaaca

SEQ ID NO: 3103 - DNA, 25 bp, Homo sapien
aaataaatgattcctaaggagaaca

SEQ ID NO: 3104 - DNA, 25 bp, Homo sapien
aaataaatgtctgcgattaggttat

SEQ ID NO: 3105 - DNA, 25 bp, Homo sapien
aaataaatgtctgtgattaggttat

SEQ ID NO: 3106 - DNA, 25 bp, Homo sapien
aaataaattcctgcataacaagtac

SEQ ID NO: 3107 - DNA, 25 bp, Homo sapien
aaataaattcctgcgtaacaagtac

SEQ ID NO: 3108 - DNA, 25 bp, Homo sapien
aaataacaaaaactgaatgtgtctg

SEQ ID NO: 3109 - DNA, 25 bp, Homo sapien
aaataacaacaactgaatgtgtctg

SEQ ID NO: 3110 - DNA, 25 bp, Homo sapien
aaataacagcggttaaagggcaggt

SEQ ID NO: 3111 - DNA, 25 bp, Homo sapien
aaataacagtggttaaagggcaggt

SEQ ID NO: 3112 - DNA, 25 bp, Homo sapien
aaataacatcgcaggaaactacttt

SEQ ID NO: 3113 - DNA, 25 bp, Homo sapien
aaataacatcgcgggaaactacttt

SEQ ID NO: 3114 - DNA, 25 bp, Homo sapien
aaataacatgctgactctaaccaat

SEQ ID NO: 3115 - DNA, 25 bp, Homo sapien
aaataacatgctgactttaaccaat

SEQ ID NO: 3116 - DNA, 25 bp, Homo sapien
aaataacattaattttatctgcagc

SEQ ID NO: 3117 - DNA, 25 bp, Homo sapien
aaataacattaattttgtctgcagc

SEQ ID NO: 3118 - DNA, 25 bp, Homo sapien
aaataaccacaaacagaagtcccag

SEQ ID NO: 3119 - DNA, 25 bp, Homo sapien
aaataaccacaaagagaagtcccag

SEQ ID NO: 3120 - DNA, 25 bp, Homo sapien
aaataactacatgcacatactggtt

SEQ ID NO: 3121 - DNA, 25 bp, Homo sapien
aaataactacattcacatactggtt

SEQ ID NO: 3122 - DNA, 25 bp, Homo sapien
aaataactcatatattctttggtct

SEQ ID NO: 3123 - DNA, 25 bp, Homo sapien
aaataactcatatattttttggtct

SEQ ID NO: 3124 - DNA, 25 bp, Homo sapien
aaataactgggatcgtgcatcacgt

SEQ ID NO: 3125 - DNA, 25 bp, Homo sapien
aaataactgggattgtgcatcacgt

SEQ ID NO: 3126 - DNA, 25 bp, Homo sapien
aaataacttacaaaaattgagaaag

SEQ ID NO: 3127 - DNA, 25 bp, Homo sapien
aaataacttacagaaattgagaaag

SEQ ID NO: 3128 - DNA, 25 bp, Homo sapien
aaataacttaggaccaaagctggaa

SEQ ID NO: 3129 - DNA, 25 bp, Homo sapien
aaataacttagggccaaagctggaa

SEQ ID NO: 3130 - DNA, 25 bp, Homo sapien
aaataagatcggagaagaacaaaat

SEQ ID NO: 3131 - DNA, 25 bp, Homo sapien
aaataagattggagaagaacaaaat

SEQ ID NO: 3132 - DNA, 25 bp, Homo sapien
aaataagatttgaaagtccagatta

SEQ ID NO: 3133 - DNA, 25 bp, Homo sapien
aaataagatttggaagtccagatta

SEQ ID NO: 3134 - DNA, 25 bp, Homo sapien
aaataagcaagttaccaaagcttct

SEQ ID NO: 3135 - DNA, 25 bp, Homo sapien
aaataagcgagttaccaaagcttct

SEQ ID NO: 3136 - DNA, 25 bp, Homo sapien
aaataagctaagaaacaatgggata

SEQ ID NO: 3137 - DNA, 25 bp, Homo sapien
aaataagctaagcaacaatgggata

SEQ ID NO: 3138 - DNA, 25 bp, Homo sapien
aaataaggcaagtgttcaaaagcat

SEQ ID NO: 3139 - DNA, 25 bp, Homo sapien
aaataaggggacatgatggattatg

SEQ ID NO: 3140 - DNA, 25 bp, Homo sapien
aaataaggggagatgatggattatg

SEQ ID NO: 3141 - DNA, 25 bp, Homo sapien
aaataaggtaagtgttcaaaagcat

SEQ ID NO: 3142 - DNA, 25 bp, Homo sapien
aaataagtatgattacagagtgaag

SEQ ID NO: 3143 - DNA, 25 bp, Homo sapien
aaataagtatgattacggagtgaag

SEQ ID NO: 3144 - DNA, 25 bp, Homo sapien
aaataagtccaaattccccatcagt

SEQ ID NO: 3145 - DNA, 25 bp, Homo sapien
aaataagtccagattccccatcagt

SEQ ID NO: 3146 - DNA, 25 bp, Homo sapien
aaataagtgcacacaagacattcaa

SEQ ID NO: 3147 - DNA, 25 bp, Homo sapien
aaataagtgcacacgagacattcaa

SEQ ID NO: 3148 - DNA, 25 bp, Homo sapien
aaataagttttttaaaatgatcagg

SEQ ID NO: 3149 - DNA, 25 bp, Homo sapien
aaataagtttttttaaatgatcagg

SEQ ID NO: 3150 - DNA, 25 bp, Homo sapien
aaataataaagttcaaaagccagta

SEQ ID NO: 3151 - DNA, 25 bp, Homo sapien
aaataataaggttcaaaagccagta

SEQ ID NO: 3152 - DNA, 25 bp, Homo sapien
aaataatacaagagaaaaagaagac

SEQ ID NO: 3153 - DNA, 25 bp, Homo sapien
aaataatacgagccagaaggcaatg

SEQ ID NO: 3154 - DNA, 25 bp, Homo sapien
aaataatagaattagcgaaacagaa

SEQ ID NO: 3155 - DNA, 25 bp, Homo sapien
aaataatagaattagctaaacagaa

SEQ ID NO: 3156 - DNA, 25 bp, Homo sapien
aaataatataagagaaaaagaagac

SEQ ID NO: 3157 - DNA, 25 bp, Homo sapien
aaataatatgagccagaaggcaatg

SEQ ID NO: 3158 - DNA, 25 bp, Homo sapien
aaataatcatctgtgtactaagtca

SEQ ID NO: 3159 - DNA, 25 bp, Homo sapien
aaataatccctgaataacatatttt

SEQ ID NO: 3160 - DNA, 25 bp, Homo sapien
aaataatccttgaataacatatttt

SEQ ID NO: 3161 - DNA, 25 bp, Homo sapien
aaataatcgtctgtgtactaagtca

SEQ ID NO: 3162 - DNA, 25 bp, Homo sapien
aaataatgagaaacaacgaagcaag

SEQ ID NO: 3163 - DNA, 25 bp, Homo sapien
aaataatgagaaacaatgaagcaag

SEQ ID NO: 3164 - DNA, 25 bp, Homo sapien
aaataatgaggttctgctatgtaag

SEQ ID NO: 3165 - DNA, 25 bp, Homo sapien
aaataatgaggttttgctatgtaag

SEQ ID NO: 3166 - DNA, 25 bp, Homo sapien
aaataatgcacactccataatctca

SEQ ID NO: 3167 - DNA, 25 bp, Homo sapien
aaataatgcacattccataatctca

SEQ ID NO: 3168 - DNA, 25 bp, Homo sapien
aaataatgctacagatcccttagaa

SEQ ID NO: 3169 - DNA, 25 bp, Homo sapien
aaataatgctagagatcccttagaa

SEQ ID NO: 3170 - DNA, 25 bp, Homo sapien
aaataatggatgacaaatgctgagc

SEQ ID NO: 3171 - DNA, 25 bp, Homo sapien
aaataatggatggcaaatgctgagc

SEQ ID NO: 3172 - DNA, 25 bp, Homo sapien
aaataatgtcttcatcagtttattt

SEQ ID NO: 3173 - DNA, 25 bp, Homo sapien
aaataatgtcttcatcggtttattt

SEQ ID NO: 3174 - DNA, 25 bp, Homo sapien
aaataattattaagccatgttagca

SEQ ID NO: 3175 - DNA, 25 bp, Homo sapien
aaataattattaagtcatgttagca

SEQ ID NO: 3176 - DNA, 25 bp, Homo sapien
aaataattcagtaaatcatgctata

SEQ ID NO: 3177 - DNA, 25 bp, Homo sapien
aaataattcagttaatcatgctata

SEQ ID NO: 3178 - DNA, 25 bp, Homo sapien
aaataattgcaaccatttatctaat

SEQ ID NO: 3179 - DNA, 25 bp, Homo sapien
aaataattgcaaccgtttatctaat

SEQ ID NO: 3180 - DNA, 25 bp, Homo sapien
aaataattgctttactttatacaaa

SEQ ID NO: 3181 - DNA, 25 bp, Homo sapien
aaataattgctttgctttatacaaa

SEQ ID NO: 3182 - DNA, 25 bp, Homo sapien
aaataatttaaatcatatagcatgc

SEQ ID NO: 3183 - DNA, 25 bp, Homo sapien
aaataatttaaatcgtatagcatgc

SEQ ID NO: 3184 - DNA, 25 bp, Homo sapien
aaataatttacaagcacgtttcaaa

SEQ ID NO: 3185 - DNA, 25 bp, Homo sapien
aaataatttacaagcatgtttcaaa

SEQ ID NO: 3186 - DNA, 25 bp, Homo sapien
aaataatttagataactgaccaaag

SEQ ID NO: 3187 - DNA, 25 bp, Homo sapien
aaataatttagatatctgaccaaag

SEQ ID NO: 3188 - DNA, 25 bp, Homo sapien
aaatacaaaaacaatgacccatgga

SEQ ID NO: 3189 - DNA, 25 bp, Homo sapien
aaatacaaaaacattgacccatgga

SEQ ID NO: 3190 - DNA, 25 bp, Homo sapien
aaatacaaaagagcctaaataggta

SEQ ID NO: 3191 - DNA, 25 bp, Homo sapien
aaatacaaatgctggtttattattt

SEQ ID NO: 3192 - DNA, 25 bp, Homo sapien
aaatacaaatgttggtttattattt

SEQ ID NO: 3193 - DNA, 25 bp, Homo sapien
aaatacaacgaacaaatccaaaact

SEQ ID NO: 3194 - DNA, 25 bp, Homo sapien
aaatacaataatgcgctcaggagtg

SEQ ID NO: 3195 - DNA, 25 bp, Homo sapien
aaatacaataatgtgctcaggagtg

SEQ ID NO: 3196 - DNA, 25 bp, Homo sapien
aaatacaatagagcctaaataggta

SEQ ID NO: 3197 - DNA, 25 bp, Homo sapien
aaatacaatgaacaaatccaaaact

SEQ ID NO: 3198 - DNA, 25 bp, Homo sapien
aaatacacaaaaagggataaagaat

SEQ ID NO: 3199 - DNA, 25 bp, Homo sapien
aaatacacaaaatgggataaagaat

SEQ ID NO: 3200 - DNA, 25 bp, Homo sapien
aaatacaccagaaagtcccagcaat

SEQ ID NO: 3201 - DNA, 25 bp, Homo sapien
aaatacaccggaaagtcccagcaat

SEQ ID NO: 3202 - DNA, 25 bp, Homo sapien
aaatacactgcaacgatttaaggta

SEQ ID NO: 3203 - DNA, 25 bp, Homo sapien
aaatacactgcaatgatttaaggta

SEQ ID NO: 3204 - DNA, 25 bp, Homo sapien
aaatacactgtgtaagtccccatgt

SEQ ID NO: 3205 - DNA, 25 bp, Homo sapien
aaatacactgtttaagtccccatgt

SEQ ID NO: 3206 - DNA, 25 bp, Homo sapien
aaatacaggtcttaaattcctggtc

SEQ ID NO: 3207 - DNA, 25 bp, Homo sapien
aaatacaggtcttgaattcctggtc

SEQ ID NO: 3208 - DNA, 25 bp, Homo sapien
aaatacataaaaacagagaaacaac

SEQ ID NO: 3209 - DNA, 25 bp, Homo sapien
aaatacataaaaacagggaaacaac

SEQ ID NO: 3210 - DNA, 25 bp, Homo sapien
aaatacatatatttgaaaaaagact

SEQ ID NO: 3211 - DNA, 25 bp, Homo sapien
aaatacatatatttgataaaagact

SEQ ID NO: 3212 - DNA, 25 bp, Homo sapien
aaatacatctacaccaaaaaagaaa

SEQ ID NO: 3213 - DNA, 25 bp, Homo sapien
aaatacatctacgccaaaaaagaaa

SEQ ID NO: 3214 - DNA, 25 bp, Homo sapien
aaatacatgtgatcataagaagcaa

SEQ ID NO: 3215 - DNA, 25 bp, Homo sapien
aaatacatgtgatcgtaagaagcaa

SEQ ID NO: 3216 - DNA, 25 bp, Homo sapien
aaatacattgcctaagacttagtga

SEQ ID NO: 3217 - DNA, 25 bp, Homo sapien
aaatacattgcgtaagacttagtga

SEQ ID NO: 3218 - DNA, 25 bp, Homo sapien
aaataccaactaaaccacttatcca

SEQ ID NO: 3219 - DNA, 25 bp, Homo sapien
aaataccaactaaaccgcttatcca

SEQ ID NO: 3220 - DNA, 25 bp, Homo sapien
aaataccagaaagtgcaaaggaaaa

SEQ ID NO: 3221 - DNA, 25 bp, Homo sapien
aaataccagaaagtgcgaaggaaaa

SEQ ID NO: 3222 - DNA, 25 bp, Homo sapien
aaataccagacacacagtttcttga

SEQ ID NO: 3223 - DNA, 25 bp, Homo sapien
aaataccagacacgcagtttcttga

SEQ ID NO: 3224 - DNA, 25 bp, Homo sapien
aaatacccaaattgttcaaaccacc

SEQ ID NO: 3225 - DNA, 25 bp, Homo sapien
aaatacccagattgttcaaaccacc

SEQ ID NO: 3226 - DNA, 25 bp, Homo sapien
aaatacctcaatccttatgcttcag

SEQ ID NO: 3227 - DNA, 25 bp, Homo sapien
aaatacctcaattcttatgcttcag

SEQ ID NO: 3228 - DNA, 25 bp, Homo sapien
aaataccttatatcattctccagtc

SEQ ID NO: 3229 - DNA, 25 bp, Homo sapien
aaataccttgtatcattctccagtc

SEQ ID NO: 3230 - DNA, 25 bp, Homo sapien
aaatacgaatccctccttgtcagct

SEQ ID NO: 3231 - DNA, 25 bp, Homo sapien
aaatacgaatctctccttgtcagct

SEQ ID NO: 3232 - DNA, 25 bp, Homo sapien
aaatactacacatgaccgctatact

SEQ ID NO: 3233 - DNA, 25 bp, Homo sapien
aaatactacacatgcccgctatact

SEQ ID NO: 3234 - DNA, 25 bp, Homo sapien
aaatactagtagacattcataacca

SEQ ID NO: 3235 - DNA, 25 bp, Homo sapien
aaatactagtagtcattcataacca

SEQ ID NO: 3236 - DNA, 25 bp, Homo sapien
aaatactcattggaaacagagcaac

SEQ ID NO: 3237 - DNA, 25 bp, Homo sapien
aaatactcccagaatgttctgtata

SEQ ID NO: 3238 - DNA, 25 bp, Homo sapien
aaatactcccagactgttctgtata

SEQ ID NO: 3239 - DNA, 25 bp, Homo sapien
aaatactcgttggaaacagagcaac

SEQ ID NO: 3240 - DNA, 25 bp, Homo sapien
aaatactgactcacaggagagggcc

SEQ ID NO: 3241 - DNA, 25 bp, Homo sapien
aaatactgagtcacaggagagggcc

SEQ ID NO: 3242 - DNA, 25 bp, Homo sapien
aaatactgcaagccaatgaggtcca

SEQ ID NO: 3243 - DNA, 25 bp, Homo sapien
aaatactgcaagccgatgaggtcca

SEQ ID NO: 3244 - DNA, 25 bp, Homo sapien
aaatactgcgtttcatcccagcaac

SEQ ID NO: 3245 - DNA, 25 bp, Homo sapien
aaatactgtgtttcatcccagcaac

SEQ ID NO: 3246 - DNA, 25 bp, Homo sapien
aaatacttccagatccttatggagc

SEQ ID NO: 3247 - DNA, 25 bp, Homo sapien
aaatacttccaggtccttatggagc

SEQ ID NO: 3248 - DNA, 25 bp, Homo sapien
aaatactttccaacatcgattttga

SEQ ID NO: 3249 - DNA, 25 bp, Homo sapien
aaatactttccaacgtcgattttga

SEQ ID NO: 3250 - DNA, 25 bp, Homo sapien
aaatagaaaaaactgaattgccatt

SEQ ID NO: 3251 - DNA, 25 bp, Homo sapien
aaatagaaaaaattgaattgccatt

SEQ ID NO: 3252 - DNA, 25 bp, Homo sapien
aaatagaaacacctacatagcctat

SEQ ID NO: 3253 - DNA, 25 bp, Homo sapien
aaatagaaacgaactaataactaag

SEQ ID NO: 3254 - DNA, 25 bp, Homo sapien
aaatagaaacgacctaataactaag

SEQ ID NO: 3255 - DNA, 25 bp, Homo sapien
aaatagaaagacctacatagcctat

SEQ ID NO: 3256 - DNA, 25 bp, Homo sapien
aaatagaacaaacagggacaggttg

SEQ ID NO: 3257 - DNA, 25 bp, Homo sapien
aaatagaacaagcagggacaggttg

SEQ ID NO: 3258 - DNA, 25 bp, Homo sapien
aaatagaacgatgaatgctaaaatc

SEQ ID NO: 3259 - DNA, 25 bp, Homo sapien
aaatagaaggtacgtggattagaaa

SEQ ID NO: 3260 - DNA, 25 bp, Homo sapien
aaatagaaggtatgtggattagaaa

SEQ ID NO: 3261 - DNA, 25 bp, Homo sapien
aaatagaatgatgaatgctaaaatc

SEQ ID NO: 3262 - DNA, 25 bp, Homo sapien
aaatagacactaaaaaaaaatttga

SEQ ID NO: 3263 - DNA, 25 bp, Homo sapien
aaatagacactgaaaaaaaatttga

SEQ ID NO: 3264 - DNA, 25 bp, Homo sapien
aaatagactcacacggcaaaaggaa

SEQ ID NO: 3265 - DNA, 25 bp, Homo sapien
aaatagactcacatggcaaaaggaa

SEQ ID NO: 3266 - DNA, 25 bp, Homo sapien
aaatagagctgatcaaagaagtgga

SEQ ID NO: 3267 - DNA, 25 bp, Homo sapien
aaatagagctgatgaaagaagtgga

SEQ ID NO: 3268 - DNA, 25 bp, Homo sapien
aaatagagtatatgaccagcacagt

SEQ ID NO: 3269 - DNA, 25 bp, Homo sapien
aaatagagtatatgactagcacagt

SEQ ID NO: 3270 - DNA, 25 bp, Homo sapien
aaatagataactagataaacaaagt

SEQ ID NO: 3271 - DNA, 25 bp, Homo sapien
aaatagataactggataaacaaagt

SEQ ID NO: 3272 - DNA, 25 bp, Homo sapien
aaatagcaacaaagatttctacatc

SEQ ID NO: 3273 - DNA, 25 bp, Homo sapien
aaatagcaatacgtatctgtacact

SEQ ID NO: 3274 - DNA, 25 bp, Homo sapien
aaatagcaatatgtatctgtacact

SEQ ID NO: 3275 - DNA, 25 bp, Homo sapien
aaatagcacgtatggctcccaggca

SEQ ID NO: 3276 - DNA, 25 bp, Homo sapien
aaatagcacgtgtggctcccaggca

SEQ ID NO: 3277 - DNA, 25 bp, Homo sapien
aaatagcagaaacagagactcctgg

SEQ ID NO: 3278 - DNA, 25 bp, Homo sapien
aaatagcagaaacggagactcctgg

SEQ ID NO: 3279 - DNA, 25 bp, Homo sapien
aaatagcagataagacacaattaaa

SEQ ID NO: 3280 - DNA, 25 bp, Homo sapien
aaatagcagataatacacaattaaa

SEQ ID NO: 3281 - DNA, 25 bp, Homo sapien
aaatagcagcaaagatttctacatc

SEQ ID NO: 3282 - DNA, 25 bp, Homo sapien
aaatagcagtcaaaaaaatcaagac

SEQ ID NO: 3283 - DNA, 25 bp, Homo sapien
aaatagcagtccaaaaaatcaagac

SEQ ID NO: 3284 - DNA, 25 bp, Homo sapien
aaatagccaacccacactaaagcat

SEQ ID NO: 3285 - DNA, 25 bp, Homo sapien
aaatagccaactcacactaaagcat

SEQ ID NO: 3286 - DNA, 25 bp, Homo sapien
aaatagctgctcctccagaaaccgt

SEQ ID NO: 3287 - DNA, 25 bp, Homo sapien
aaatagcttacatttcagagccaga

SEQ ID NO: 3288 - DNA, 25 bp, Homo sapien
aaatagcttctcctccagaaaccgt

SEQ ID NO: 3289 - DNA, 25 bp, Homo sapien
aaatagcttgcatttcagagccaga

SEQ ID NO: 3290 - DNA, 25 bp, Homo sapien
aaataggatttgaatgtaagcatta

SEQ ID NO: 3291 - DNA, 25 bp, Homo sapien
aaataggatttgagtgtaagcatta

SEQ ID NO: 3292 - DNA, 25 bp, Homo sapien
aaataggcaaaaatttgttaagtgt

SEQ ID NO: 3293 - DNA, 25 bp, Homo sapien
aaataggcataaatttgttaagtgt

SEQ ID NO: 3294 - DNA, 25 bp, Homo sapien
aaataggcgttctccctccttcctt

SEQ ID NO: 3295 - DNA, 25 bp, Homo sapien
aaataggctgcaccgtactttgaga

SEQ ID NO: 3296 - DNA, 25 bp, Homo sapien
aaataggctgcactgtactttgaga

SEQ ID NO: 3297 - DNA, 25 bp, Homo sapien
aaataggctttctccctccttcctt

SEQ ID NO: 3298 - DNA, 25 bp, Homo sapien
aaataggtctgtatgtaaccacctg

SEQ ID NO: 3299 - DNA, 25 bp, Homo sapien
aaataggtctgtgtgtaaccacctg

SEQ ID NO: 3300 - DNA, 25 bp, Homo sapien
aaatagtcaaggaagaatcagcatt

SEQ ID NO: 3301 - DNA, 25 bp, Homo sapien
aaatagtcaaggaggaatcagcatt

SEQ ID NO: 3302 - DNA, 25 bp, Homo sapien
aaatagttctctaagttgctctcct

SEQ ID NO: 3303 - DNA, 25 bp, Homo sapien
aaatagttggagccacaatagaact

SEQ ID NO: 3304 - DNA, 25 bp, Homo sapien
aaatagttggagcctcaatagaact

SEQ ID NO: 3305 - DNA, 25 bp, Homo sapien
aaatagttttctaagttgctctcct

SEQ ID NO: 3306 - DNA, 25 bp, Homo sapien
aaatataacatcaattgactttcca

SEQ ID NO: 3307 - DNA, 25 bp, Homo sapien
aaatataacatcagttgactttcca

SEQ ID NO: 3308 - DNA, 25 bp, Homo sapien
aaatataacgttgaatttcagttat

SEQ ID NO: 3309 - DNA, 25 bp, Homo sapien
aaatataatgtggcccacagcagcc

SEQ ID NO: 3310 - DNA, 25 bp, Homo sapien
aaatataatgtgtcccacagcagcc

SEQ ID NO: 3311 - DNA, 25 bp, Homo sapien
aaatataatgttgaatttcagttat

SEQ ID NO: 3312 - DNA, 25 bp, Homo sapien
aaatataattgctaaatatggtttt

SEQ ID NO: 3313 - DNA, 25 bp, Homo sapien
aaatataattgttaaatatggtttt

SEQ ID NO: 3314 - DNA, 25 bp, Homo sapien
aaatatacaaacacaagcttttaaa

SEQ ID NO: 3315 - DNA, 25 bp, Homo sapien
aaatatacaaatacaagcttttaaa

SEQ ID NO: 3316 - DNA, 25 bp, Homo sapien
aaatataccaaaggccacccaagga

SEQ ID NO: 3317 - DNA, 25 bp, Homo sapien
aaatataccgaaggccacccaagga

SEQ ID NO: 3318 - DNA, 25 bp, Homo sapien
aaatatactcctcagtccatgaaac

SEQ ID NO: 3319 - DNA, 25 bp, Homo sapien
aaatatactcctgagtccatgaaac

SEQ ID NO: 3320 - DNA, 25 bp, Homo sapien
aaatatagatgctagaacttcactc

SEQ ID NO: 3321 - DNA, 25 bp, Homo sapien
aaatatagatgctagagcttcactc

SEQ ID NO: 3322 - DNA, 25 bp, Homo sapien
aaatatagcacattcgcaactcaca

SEQ ID NO: 3323 - DNA, 25 bp, Homo sapien
aaatataggaaaacaactaaggtct

SEQ ID NO: 3324 - DNA, 25 bp, Homo sapien
aaatataggaagacaactaaggtct

SEQ ID NO: 3325 - DNA, 25 bp, Homo sapien
aaatatagtacattcgcaactcaca

SEQ ID NO: 3326 - DNA, 25 bp, Homo sapien
aaatatatagtgaaaaaaactgggt

SEQ ID NO: 3327 - DNA, 25 bp, Homo sapien
aaatatatagtgtaaaaaactgggt

SEQ ID NO: 3328 - DNA, 25 bp, Homo sapien
aaatatatatttctcttaacgacct

SEQ ID NO: 3329 - DNA, 25 bp, Homo sapien
aaatatatatttttcttaacgacct

SEQ ID NO: 3330 - DNA, 25 bp, Homo sapien
aaatatatgaatagtcctaaaatag

SEQ ID NO: 3331 - DNA, 25 bp, Homo sapien
aaatatatgaatagtcgtaaaatag

SEQ ID NO: 3332 - DNA, 25 bp, Homo sapien
aaatatattaaacacagcaattaaa

SEQ ID NO: 3333 - DNA, 25 bp, Homo sapien
aaatatattaaccacagcaattaaa

SEQ ID NO: 3334 - DNA, 25 bp, Homo sapien
aaatatcacacaaattccaattggg

SEQ ID NO: 3335 - DNA, 25 bp, Homo sapien
aaatatcacactagccatttccaca

SEQ ID NO: 3336 - DNA, 25 bp, Homo sapien
aaatatcacactagtcatttccaca

SEQ ID NO: 3337 - DNA, 25 bp, Homo sapien
aaatatcactggttctcccctttaa

SEQ ID NO: 3338 - DNA, 25 bp, Homo sapien
aaatatcagacaaattccaattggg

SEQ ID NO: 3339 - DNA, 25 bp, Homo sapien
aaatatcattggttctcccctttaa

SEQ ID NO: 3340 - DNA, 25 bp, Homo sapien
aaatatctaggtacggagacagcct

SEQ ID NO: 3341 - DNA, 25 bp, Homo sapien
aaatatctaggtatggagacagcct

SEQ ID NO: 3342 - DNA, 25 bp, Homo sapien
aaatatctcatgcgtagtatgtaaa

SEQ ID NO: 3343 - DNA, 25 bp, Homo sapien
aaatatctcatgtgtagtatgtaaa

SEQ ID NO: 3344 - DNA, 25 bp, Homo sapien
aaatatctccgaaacttcacttaga

SEQ ID NO: 3345 - DNA, 25 bp, Homo sapien
aaatatctccggcatttcaaaggca

SEQ ID NO: 3346 - DNA, 25 bp, Homo sapien
aaatatctctgaaacttcacttaga

SEQ ID NO: 3347 - DNA, 25 bp, Homo sapien
aaatatctctggcatttcaaaggca

SEQ ID NO: 3348 - DNA, 25 bp, Homo sapien
aaatatctgcgcatgcaatagaggt

SEQ ID NO: 3349 - DNA, 25 bp, Homo sapien
aaatatctgtgcatgcaatagaggt

SEQ ID NO: 3350 - DNA, 25 bp, Homo sapien
aaatatgaacaaaaatatcctagtg

SEQ ID NO: 3351 - DNA, 25 bp, Homo sapien
aaatatgaacagaaatatcctagtg

SEQ ID NO: 3352 - DNA, 25 bp, Homo sapien
aaatatgaacagcttaacaaagatc

SEQ ID NO: 3353 - DNA, 25 bp, Homo sapien
aaatatgaacagcttaccaaagatc

SEQ ID NO: 3354 - DNA, 25 bp, Homo sapien
aaatatgaacccaatttgtggtagt

SEQ ID NO: 3355 - DNA, 25 bp, Homo sapien
aaatatgaacctaatttgtggtagt

SEQ ID NO: 3356 - DNA, 25 bp, Homo sapien
aaatatgaagcagccaccttacagt

SEQ ID NO: 3357 - DNA, 25 bp, Homo sapien
aaatatgagcatcaaaaaagatgga

SEQ ID NO: 3358 - DNA, 25 bp, Homo sapien
aaatatgagcatcagaaaagatgga

SEQ ID NO: 3359 - DNA, 25 bp, Homo sapien
aaatatgaggcagccaccttacagt

SEQ ID NO: 3360 - DNA, 25 bp, Homo sapien
aaatatgataccgacaggctattaa

SEQ ID NO: 3361 - DNA, 25 bp, Homo sapien
aaatatgatactgacaggctattaa

SEQ ID NO: 3362 - DNA, 25 bp, Homo sapien
aaatatgcctgcacttcctagaagg

SEQ ID NO: 3363 - DNA, 25 bp, Homo sapien
aaatatgcctgcgcttcctagaagg

SEQ ID NO: 3364 - DNA, 25 bp, Homo sapien
aaatatggagtacacattctgctgc

SEQ ID NO: 3365 - DNA, 25 bp, Homo sapien
aaatatggagtatacattctgctgc

SEQ ID NO: 3366 - DNA, 25 bp, Homo sapien
aaatatggatcgttaatacctcaat

SEQ ID NO: 3367 - DNA, 25 bp, Homo sapien
aaatatggatctttaatacctcaat

SEQ ID NO: 3368 - DNA, 25 bp, Homo sapien
aaatatggcaaaattacatatgagc

SEQ ID NO: 3369 - DNA, 25 bp, Homo sapien
aaatatggcaaaattatatatgagc

SEQ ID NO: 3370 - DNA, 25 bp, Homo sapien
aaatatggcagtttgcatgatgagc

SEQ ID NO: 3371 - DNA, 25 bp, Homo sapien
aaatatggcctaagaaaatgcagtt

SEQ ID NO: 3372 - DNA, 25 bp, Homo sapien
aaatatggcctaaggaaatgcagtt

SEQ ID NO: 3373 - DNA, 25 bp, Homo sapien
aaatatggcggtttgcatgatgagc

SEQ ID NO: 3374 - DNA, 25 bp, Homo sapien
aaatatggttaacgataatggtctc

SEQ ID NO: 3375 - DNA, 25 bp, Homo sapien
aaatatggttaatgataatggtctc

SEQ ID NO: 3376 - DNA, 25 bp, Homo sapien
aaatatgtacaactaggaagtatga

SEQ ID NO: 3377 - DNA, 25 bp, Homo sapien
aaatatgtacaactgggaagtatga

SEQ ID NO: 3378 - DNA, 25 bp, Homo sapien
aaatatgtcaaagaaatacactttg

SEQ ID NO: 3379 - DNA, 25 bp, Homo sapien
aaatatgtcaaataaatacactttg

SEQ ID NO: 3380 - DNA, 25 bp, Homo sapien
aaatatgtcatggagaagtaatatt

SEQ ID NO: 3381 - DNA, 25 bp, Homo sapien
aaatatgtctatgacgatttgcttg

SEQ ID NO: 3382 - DNA, 25 bp, Homo sapien
aaatatgtctatgatgatttgcttg

SEQ ID NO: 3383 - DNA, 25 bp, Homo sapien
aaatatgtgatggagaagtaatatt

SEQ ID NO: 3384 - DNA, 25 bp, Homo sapien
aaatatgtgtagagctattatcctc

SEQ ID NO: 3385 - DNA, 25 bp, Homo sapien
aaatatgtgtagatctattatcctc

SEQ ID NO: 3386 - DNA, 25 bp, Homo sapien
aaatattaacaggtcttgcatacac

SEQ ID NO: 3387 - DNA, 25 bp, Homo sapien
aaatattaataggtcttgcatacac

SEQ ID NO: 3388 - DNA, 25 bp, Homo sapien
aaatattccatgagtgttccaatta

SEQ ID NO: 3389 - DNA, 25 bp, Homo sapien
aaatattccgtgagtgttccaatta

SEQ ID NO: 3390 - DNA, 25 bp, Homo sapien
aaatattctttacatcaatgaagca

SEQ ID NO: 3391 - DNA, 25 bp, Homo sapien
aaatattctttacatcgatgaagca

SEQ ID NO: 3392 - DNA, 25 bp, Homo sapien
aaatattgaataacacatgacaact

SEQ ID NO: 3393 - DNA, 25 bp, Homo sapien
aaatattgacagaaattcaaaaaag

SEQ ID NO: 3394 - DNA, 25 bp, Homo sapien
aaatattgacagcaattcaaaaaag

SEQ ID NO: 3395 - DNA, 25 bp, Homo sapien
aaatattgactaacacatgacaact

SEQ ID NO: 3396 - DNA, 25 bp, Homo sapien
aaatattgcatgcctccgctgagct

SEQ ID NO: 3397 - DNA, 25 bp, Homo sapien
aaatattgcatgcctctgctgagct

SEQ ID NO: 3398 - DNA, 25 bp, Homo sapien
aaatattgtccttttaagttttttg

SEQ ID NO: 3399 - DNA, 25 bp, Homo sapien
aaatattgtccttttacgttttttg

SEQ ID NO: 3400 - DNA, 25 bp, Homo sapien
aaatatttaaaaaaatctcagcaaa

SEQ ID NO: 3401 - DNA, 25 bp, Homo sapien
aaatatttatcaatgtgcaaaacag

SEQ ID NO: 3402 - DNA, 25 bp, Homo sapien
aaatatttatcgatgtgcaaaacag

SEQ ID NO: 3403 - DNA, 25 bp, Homo sapien
aaatatttgaaaggaaagccagaaa

SEQ ID NO: 3404 - DNA, 25 bp, Homo sapien
aaatatttgaatggaaagccagaaa

SEQ ID NO: 3405 - DNA, 25 bp, Homo sapien
aaatattttaaaaaatctcagcaaa

SEQ ID NO: 3406 - DNA, 25 bp, Homo sapien
aaatattttagttatgcaatgctac

SEQ ID NO: 3407 - DNA, 25 bp, Homo sapien
aaatattttagttatgtaatgctac

SEQ ID NO: 3408 - DNA, 25 bp, Homo sapien
aaatattttcaaatgatgtggtatt

SEQ ID NO: 3409 - DNA, 25 bp, Homo sapien
aaatattttcaagtgatgtggtatt

SEQ ID NO: 3410 - DNA, 25 bp, Homo sapien
aaatcaaaaagtatacacatatttt

SEQ ID NO: 3411 - DNA, 25 bp, Homo sapien
aaatcaaaaagtatacgcatatttt

SEQ ID NO: 3412 - DNA, 25 bp, Homo sapien
aaatcaaaaatcaattggacttagt

SEQ ID NO: 3413 - DNA, 25 bp, Homo sapien
aaatcaaaaatcacttggacttagt

SEQ ID NO: 3414 - DNA, 25 bp, Homo sapien
aaatcaaaacgagtagaaatgaaac

SEQ ID NO: 3415 - DNA, 25 bp, Homo sapien
aaatcaaaacgagtggaaatgaaac

SEQ ID NO: 3416 - DNA, 25 bp, Homo sapien
aaatcaaaggattcttgtcttcatt

SEQ ID NO: 3417 - DNA, 25 bp, Homo sapien
aaatcaaaggattgttgtcttcatt

SEQ ID NO: 3418 - DNA, 25 bp, Homo sapien
aaatcaaagtggaatccacaagcca

SEQ ID NO: 3419 - DNA, 25 bp, Homo sapien
aaatcaaagtggagtccacaagcca

SEQ ID NO: 3420 - DNA, 25 bp, Homo sapien
aaatcaaatccattgaaggccaata

SEQ ID NO: 3421 - DNA, 25 bp, Homo sapien
aaatcaaatccatttaaggccaata

SEQ ID NO: 3422 - DNA, 25 bp, Homo sapien
aaatcaacagatagaaattgtcctg

SEQ ID NO: 3423 - DNA, 25 bp, Homo sapien
aaatcaacggatagaaattgtcctg

SEQ ID NO: 3424 - DNA, 25 bp, Homo sapien
aaatcaagctataaagaagtgtata

SEQ ID NO: 3425 - DNA, 25 bp, Homo sapien
aaatcaagctatatagaagtgtata

SEQ ID NO: 3426 - DNA, 25 bp, Homo sapien
aaatcaattttcgatgctcatggaa

SEQ ID NO: 3427 - DNA, 25 bp, Homo sapien
aaatcaatttttgatgctcatggaa

SEQ ID NO: 3428 - DNA, 25 bp, Homo sapien
aaatcacaactgctgacgatcacga

SEQ ID NO: 3429 - DNA, 25 bp, Homo sapien
aaatcacaactgctgatgatcacga

SEQ ID NO: 3430 - DNA, 25 bp, Homo sapien
aaatcacaatacaacattccctttg

SEQ ID NO: 3431 - DNA, 25 bp, Homo sapien
aaatcacaatacgacattccctttg

SEQ ID NO: 3432 - DNA, 25 bp, Homo sapien
aaatcacacaatctatctcaaataa

SEQ ID NO: 3433 - DNA, 25 bp, Homo sapien
aaatcacacaatctgtctcaaataa

SEQ ID NO: 3434 - DNA, 25 bp, Homo sapien
aaatcacacatgctgactagttgct

SEQ ID NO: 3435 - DNA, 25 bp, Homo sapien
aaatcacacatgctgattagttgct

SEQ ID NO: 3436 - DNA, 25 bp, Homo sapien
aaatcacatctgatacagaagctgc

SEQ ID NO: 3437 - DNA, 25 bp, Homo sapien
aaatcacatctggtacagaagctgc

SEQ ID NO: 3438 - DNA, 25 bp, Homo sapien
aaatcacattaagagagctactatt

SEQ ID NO: 3439 - DNA, 25 bp, Homo sapien
aaatcacattaatagagctactatt

SEQ ID NO: 3440 - DNA, 25 bp, Homo sapien
aaatcacattatatacatgacacat

SEQ ID NO: 3441 - DNA, 25 bp, Homo sapien
aaatcacattatgtacatgacacat

SEQ ID NO: 3442 - DNA, 25 bp, Homo sapien
aaatcaccaggggaatttctgaaac

SEQ ID NO: 3443 - DNA, 25 bp, Homo sapien
aaatcaccaggggagtttctgaaac

SEQ ID NO: 3444 - DNA, 25 bp, Homo sapien
aaatcacccgtcaaatctttactag

SEQ ID NO: 3445 - DNA, 25 bp, Homo sapien
aaatcacccgtcgaatctttactag

SEQ ID NO: 3446 - DNA, 25 bp, Homo sapien
aaatcaccctttgcaaactaatagt

SEQ ID NO: 3447 - DNA, 25 bp, Homo sapien
aaatcacccttttcaaactaatagt

SEQ ID NO: 3448 - DNA, 25 bp, Homo sapien
aaatcacggaaatatgattgcatca

SEQ ID NO: 3449 - DNA, 25 bp, Homo sapien
aaatcacggaaatatgtttgcatca

SEQ ID NO: 3450 - DNA, 25 bp, Homo sapien
aaatcacttatctgtgacaggtata

SEQ ID NO: 3451 - DNA, 25 bp, Homo sapien
aaatcacttatctgtggcaggtata

SEQ ID NO: 3452 - DNA, 25 bp, Homo sapien
aaatcactttgtcagagccttatcc

SEQ ID NO: 3453 - DNA, 25 bp, Homo sapien
aaatcactttgtcagatccttatcc

SEQ ID NO: 3454 - DNA, 25 bp, Homo sapien
aaatcagaaaaaaacagaagttgca

SEQ ID NO: 3455 - DNA, 25 bp, Homo sapien
aaatcagaaatgagcaggcttggtg

SEQ ID NO: 3456 - DNA, 25 bp, Homo sapien
aaatcagaaatgtgcaggcttggtg

SEQ ID NO: 3457 - DNA, 25 bp, Homo sapien
aaatcagaagaaaacagaagttgca

SEQ ID NO: 3458 - DNA, 25 bp, Homo sapien
aaatcagacagttctgcgtaggcgg

SEQ ID NO: 3459 - DNA, 25 bp, Homo sapien
aaatcagacagttctgtgtaggcgg

SEQ ID NO: 3460 - DNA, 25 bp, Homo sapien
aaatcagagaagacttttcctttga

SEQ ID NO: 3461 - DNA, 25 bp, Homo sapien
aaatcagagaagccttttcctttga

SEQ ID NO: 3462 - DNA, 25 bp, Homo sapien
aaatcagagtagagcaagtagcagt

SEQ ID NO: 3463 - DNA, 25 bp, Homo sapien
aaatcagagtagagtaagtagcagt

SEQ ID NO: 3464 - DNA, 25 bp, Homo sapien
aaatcagatcaaaacctgaaatgat

SEQ ID NO: 3465 - DNA, 25 bp, Homo sapien
aaatcagatcaaagcctgaaatgat

SEQ ID NO: 3466 - DNA, 25 bp, Homo sapien
aaatcagcatcactccctttaaagg

SEQ ID NO: 3467 - DNA, 25 bp, Homo sapien
aaatcagcatcactccttttaaagg

SEQ ID NO: 3468 - DNA, 25 bp, Homo sapien
aaatcagcctcagaataggaatagc

SEQ ID NO: 3469 - DNA, 25 bp, Homo sapien
aaatcagcctcagaattggaatagc

SEQ ID NO: 3470 - DNA, 25 bp, Homo sapien
aaatcagctgtgacattagactctc

SEQ ID NO: 3471 - DNA, 25 bp, Homo sapien
aaatcagctgtggcattagactctc

SEQ ID NO: 3472 - DNA, 25 bp, Homo sapien
aaatcaggatattggtggaactagg

SEQ ID NO: 3473 - DNA, 25 bp, Homo sapien
aaatcaggatatttgtggaactagg

SEQ ID NO: 3474 - DNA, 25 bp, Homo sapien
aaatcaggcattcgaggcaatcatc

SEQ ID NO: 3475 - DNA, 25 bp, Homo sapien
aaatcagggattgctacttcctgtc

SEQ ID NO: 3476 - DNA, 25 bp, Homo sapien
aaatcagggattgctagttcctgtc

SEQ ID NO: 3477 - DNA, 25 bp, Homo sapien
aaatcaggtaaggaatacaggtgtg

SEQ ID NO: 3478 - DNA, 25 bp, Homo sapien
aaatcaggtaatgaatacaggtgtg

SEQ ID NO: 3479 - DNA, 25 bp, Homo sapien
aaatcaggtattcgaggcaatcatc

SEQ ID NO: 3480 - DNA, 25 bp, Homo sapien
aaatcagtaacaaagcctatatgtt

SEQ ID NO: 3481 - DNA, 25 bp, Homo sapien
aaatcagtaaccaagcctatatgtt

SEQ ID NO: 3482 - DNA, 25 bp, Homo sapien
aaatcagtcgtacttagttggctgg

SEQ ID NO: 3483 - DNA, 25 bp, Homo sapien
aaatcagtcttacttagttggctgg

SEQ ID NO: 3484 - DNA, 25 bp, Homo sapien
aaatcagtttattttccttctattg

SEQ ID NO: 3485 - DNA, 25 bp, Homo sapien
aaatcagtttattttctttctattg

SEQ ID NO: 3486 - DNA, 25 bp, Homo sapien
aaatcagttttaaccttgctagcct

SEQ ID NO: 3487 - DNA, 25 bp, Homo sapien
aaatcagttttaacgttgctagcct

SEQ ID NO: 3488 - DNA, 25 bp, Homo sapien
aaatcataccaccttaagtttttca

SEQ ID NO: 3489 - DNA, 25 bp, Homo sapien
aaatcataccatcttaagtttttca

SEQ ID NO: 3490 - DNA, 25 bp, Homo sapien
aaatcataccctatagttaaaaaat

SEQ ID NO: 3491 - DNA, 25 bp, Homo sapien
aaatcataccctatggttaaaaaat

SEQ ID NO: 3492 - DNA, 25 bp, Homo sapien
aaatcatagaattcacataggattc

SEQ ID NO: 3493 - DNA, 25 bp, Homo sapien
aaatcatagaattcacgtaggattc

SEQ ID NO: 3494 - DNA, 25 bp, Homo sapien
aaatcatcaagagtaaaatgggagt

SEQ ID NO: 3495 - DNA, 25 bp, Homo sapien
aaatcatcgagagtaaaatgggagt

SEQ ID NO: 3496 - DNA, 25 bp, Homo sapien
aaatcatctcagagccagaaaaggg

SEQ ID NO: 3497 - DNA, 25 bp, Homo sapien
aaatcatctcagagccggaaaaggg

SEQ ID NO: 3498 - DNA, 25 bp, Homo sapien
aaatcatgagttccttgagtgtgag

SEQ ID NO: 3499 - DNA, 25 bp, Homo sapien
aaatcatgagtttcttgagtgtgag

SEQ ID NO: 3500 - DNA, 25 bp, Homo sapien
aaatcatgctagaaatcagtgacaa

SEQ ID NO: 3501 - DNA, 25 bp, Homo sapien
aaatcatgctaggaatcagtgacaa

SEQ ID NO: 3502 - DNA, 25 bp, Homo sapien
aaatcatgggtttctctagtgtgcc

SEQ ID NO: 3503 - DNA, 25 bp, Homo sapien
aaatcatggttttctctagtgtgcc

SEQ ID NO: 3504 - DNA, 25 bp, Homo sapien
aaatcatgtccatttaatagcagta

SEQ ID NO: 3505 - DNA, 25 bp, Homo sapien
aaatcatgtccgtttaatagcagta

SEQ ID NO: 3506 - DNA, 25 bp, Homo sapien
aaatcattcaaatccttactatgaa

SEQ ID NO: 3507 - DNA, 25 bp, Homo sapien
aaatcattcgaatccttactatgaa

SEQ ID NO: 3508 - DNA, 25 bp, Homo sapien
aaatccaaacgcagggagagtggcg

SEQ ID NO: 3509 - DNA, 25 bp, Homo sapien
aaatccaaatgcagggagagtggcg

SEQ ID NO: 3510 - DNA, 25 bp, Homo sapien
aaatccaacagttcattaaaaaggt

SEQ ID NO: 3511 - DNA, 25 bp, Homo sapien
aaatccaacggactctccagacaac

SEQ ID NO: 3512 - DNA, 25 bp, Homo sapien
aaatccaacggactgtccagacaac

SEQ ID NO: 3513 - DNA, 25 bp, Homo sapien
aaatccaacttcctaaacaccagcc

SEQ ID NO: 3514 - DNA, 25 bp, Homo sapien
aaatccaagagttcattaaaaaggt

SEQ ID NO: 3515 - DNA, 25 bp, Homo sapien
aaatccaaggctcccattctgagca

SEQ ID NO: 3516 - DNA, 25 bp, Homo sapien
aaatccaaggctcctattctgagca

SEQ ID NO: 3517 - DNA, 25 bp, Homo sapien
aaatccaagttcctaaacaccagcc

SEQ ID NO: 3518 - DNA, 25 bp, Homo sapien
aaatccaagttttacgagatgacaa

SEQ ID NO: 3519 - DNA, 25 bp, Homo sapien
aaatccaagttttatgagatgacaa

SEQ ID NO: 3520 - DNA, 25 bp, Homo sapien
aaatccaattataatccatttctca

SEQ ID NO: 3521 - DNA, 25 bp, Homo sapien
aaatccaattatagtccatttctca

SEQ ID NO: 3522 - DNA, 25 bp, Homo sapien
aaatccacacaaaaggtcaaggaaa

SEQ ID NO: 3523 - DNA, 25 bp, Homo sapien
aaatccacagatgttcaagccattg

SEQ ID NO: 3524 - DNA, 25 bp, Homo sapien
aaatccacataaaaggtcaaggaaa

SEQ ID NO: 3525 - DNA, 25 bp, Homo sapien
aaatccacctaaccaagaaggctgc

SEQ ID NO: 3526 - DNA, 25 bp, Homo sapien
aaatccacctaagcaagaaggctgc

SEQ ID NO: 3527 - DNA, 25 bp, Homo sapien
aaatccacggatgttcaagccattg

SEQ ID NO: 3528 - DNA, 25 bp, Homo sapien
aaatccacttgcaacaaaaactgta

SEQ ID NO: 3529 - DNA, 25 bp, Homo sapien
aaatccacttgcgacaaaaactgta

SEQ ID NO: 3530 - DNA, 25 bp, Homo sapien
aaatccagacacagacatgtgcacc

SEQ ID NO: 3531 - DNA, 25 bp, Homo sapien
aaatccagatacagacatgtgcacc

SEQ ID NO: 3532 - DNA, 25 bp, Homo sapien
aaatccatcaacactggagtagggt

SEQ ID NO: 3533 - DNA, 25 bp, Homo sapien
aaatccatcaacactgtagtagggt

SEQ ID NO: 3534 - DNA, 25 bp, Homo sapien
aaatccatgtgcaactatatctgca

SEQ ID NO: 3535 - DNA, 25 bp, Homo sapien
aaatccatgtgcaactgtatctgca

SEQ ID NO: 3536 - DNA, 25 bp, Homo sapien
aaatcctactacggaatggagagct

SEQ ID NO: 3537 - DNA, 25 bp, Homo sapien
aaatcctactatggaatggagagct

SEQ ID NO: 3538 - DNA, 25 bp, Homo sapien
aaatcctcatgaccctgagttaagc

SEQ ID NO: 3539 - DNA, 25 bp, Homo sapien
aaatcctcatgaccttgagttaagc

SEQ ID NO: 3540 - DNA, 25 bp, Homo sapien
aaatcctctcttaaccatcatgaga

SEQ ID NO: 3541 - DNA, 25 bp, Homo sapien
aaatcctctcttagccatcatgaga

SEQ ID NO: 3542 - DNA, 25 bp, Homo sapien
aaatcctgaatctctatgctgggag

SEQ ID NO: 3543 - DNA, 25 bp, Homo sapien
aaatcctgagttgactaagagcaca

SEQ ID NO: 3544 - DNA, 25 bp, Homo sapien
aaatcctgattcacttagctttggc

SEQ ID NO: 3545 - DNA, 25 bp, Homo sapien
aaatcctgattcgcttagctttggc

SEQ ID NO: 3546 - DNA, 25 bp, Homo sapien
aaatcctgatttgactaagagcaca

SEQ ID NO: 3547 - DNA, 25 bp, Homo sapien
aaatcctgcgccatttaattgagtg

SEQ ID NO: 3548 - DNA, 25 bp, Homo sapien
aaatcctgcgccttttaattgagtg

SEQ ID NO: 3549 - DNA, 25 bp, Homo sapien
aaatcctggagagacgtccgcaaac

SEQ ID NO: 3550 - DNA, 25 bp, Homo sapien
aaatcctggagagatgtccgcaaac

SEQ ID NO: 3551 - DNA, 25 bp, Homo sapien
aaatcctggctttgctactttctaa

SEQ ID NO: 3552 - DNA, 25 bp, Homo sapien
aaatcctgggtttgctactttctaa

SEQ ID NO: 3553 - DNA, 25 bp, Homo sapien
aaatcctgtatctctatgctgggag

SEQ ID NO: 3554 - DNA, 25 bp, Homo sapien
aaatcctgtcgttgtaggtaaaatt

SEQ ID NO: 3555 - DNA, 25 bp, Homo sapien
aaatcctgttgttgtaggtaaaatt

SEQ ID NO: 3556 - DNA, 25 bp, Homo sapien
aaatcctgtttacttcactcaggca

SEQ ID NO: 3557 - DNA, 25 bp, Homo sapien
aaatcctgttttcttcactcaggca

SEQ ID NO: 3558 - DNA, 25 bp, Homo sapien
aaatccttgaaagatcccactaggg

SEQ ID NO: 3559 - DNA, 25 bp, Homo sapien
aaatccttggaagatcccactaggg

SEQ ID NO: 3560 - DNA, 25 bp, Homo sapien
aaatcgtataccctgtgatgaaaac

SEQ ID NO: 3561 - DNA, 25 bp, Homo sapien
aaatcgtataccttgtgatgaaaac

SEQ ID NO: 3562 - DNA, 25 bp, Homo sapien
aaatcgtcctcaatgaaaaaccttc

SEQ ID NO: 3563 - DNA, 25 bp, Homo sapien
aaatcgtcctcagtgaaaaaccttc

SEQ ID NO: 3564 - DNA, 25 bp, Homo sapien
aaatcgtgaattggaaggagtccgc

SEQ ID NO: 3565 - DNA, 25 bp, Homo sapien
aaatcgtgagttggaaggagtccgc

SEQ ID NO: 3566 - DNA, 25 bp, Homo sapien
aaatcgtgtaatgtctcatggcttt

SEQ ID NO: 3567 - DNA, 25 bp, Homo sapien
aaatcgtgtaatgtcttatggcttt

SEQ ID NO: 3568 - DNA, 25 bp, Homo sapien
aaatctaaccagtgagagtcagcat

SEQ ID NO: 3569 - DNA, 25 bp, Homo sapien
aaatctaagctaatgctatctcgct

SEQ ID NO: 3570 - DNA, 25 bp, Homo sapien
aaatctaagctagtgctatctcgct

SEQ ID NO: 3571 - DNA, 25 bp, Homo sapien
aaatctaagttttgaacagaatcta

SEQ ID NO: 3572 - DNA, 25 bp, Homo sapien
aaatctaagttttgaatagaatcta

SEQ ID NO: 3573 - DNA, 25 bp, Homo sapien
aaatctaatcagtgagagtcagcat

SEQ ID NO: 3574 - DNA, 25 bp, Homo sapien
aaatctaatccaatgcaagacacta

SEQ ID NO: 3575 - DNA, 25 bp, Homo sapien
aaatctaatccagtgcaagacacta

SEQ ID NO: 3576 - DNA, 25 bp, Homo sapien
aaatctacagttaacaacatactta

SEQ ID NO: 3577 - DNA, 25 bp, Homo sapien
aaatctacagttaacatcatactta

SEQ ID NO: 3578 - DNA, 25 bp, Homo sapien
aaatctactattgaggtttactact

SEQ ID NO: 3579 - DNA, 25 bp, Homo sapien
aaatctactgttgaggtttactact

SEQ ID NO: 3580 - DNA, 25 bp, Homo sapien
aaatctagcttccgaaagctctgaa

SEQ ID NO: 3581 - DNA, 25 bp, Homo sapien
aaatctagtttccgaaagctctgaa

SEQ ID NO: 3582 - DNA, 25 bp, Homo sapien
aaatctataatgaacggttaatact

SEQ ID NO: 3583 - DNA, 25 bp, Homo sapien
aaatctataatgaatggttaatact

SEQ ID NO: 3584 - DNA, 25 bp, Homo sapien
aaatctatcccatgctctatctttc

SEQ ID NO: 3585 - DNA, 25 bp, Homo sapien
aaatctatgtgtatagtcgacacaa

SEQ ID NO: 3586 - DNA, 25 bp, Homo sapien
aaatctattccatgctctatctttc

SEQ ID NO: 3587 - DNA, 25 bp, Homo sapien
aaatctattccttctcctcctcttt

SEQ ID NO: 3588 - DNA, 25 bp, Homo sapien
aaatctattccttctcttcctcttt

SEQ ID NO: 3589 - DNA, 25 bp, Homo sapien
aaatctatttgtatagtcgacacaa

SEQ ID NO: 3590 - DNA, 25 bp, Homo sapien
aaatctcaaggagaataaattgata

SEQ ID NO: 3591 - DNA, 25 bp, Homo sapien
aaatctcaaggagtataaattgata

SEQ ID NO: 3592 - DNA, 25 bp, Homo sapien
aaatctccacttatctcttaacttt

SEQ ID NO: 3593 - DNA, 25 bp, Homo sapien
aaatctccatagggaaatagacaca

SEQ ID NO: 3594 - DNA, 25 bp, Homo sapien
aaatctcccgggcctacgcagcgct

SEQ ID NO: 3595 - DNA, 25 bp, Homo sapien
aaatctcccgggtctacgcagcgct

SEQ ID NO: 3596 - DNA, 25 bp, Homo sapien
aaatctccgcactgaataggactca

SEQ ID NO: 3597 - DNA, 25 bp, Homo sapien
aaatctccgcattgaataggactca

SEQ ID NO: 3598 - DNA, 25 bp, Homo sapien
aaatctccgcttatctcttaacttt

SEQ ID NO: 3599 - DNA, 25 bp, Homo sapien
aaatctccgtagggaaatagacaca

SEQ ID NO: 3600 - DNA, 25 bp, Homo sapien
aaatctccttgctgaatcctcgatt

SEQ ID NO: 3601 - DNA, 25 bp, Homo sapien
aaatctccttgttgaatcctcgatt

SEQ ID NO: 3602 - DNA, 25 bp, Homo sapien
aaatctctgcaacaaaatgccaggt

SEQ ID NO: 3603 - DNA, 25 bp, Homo sapien
aaatctctgcaacagaatgccaggt

SEQ ID NO: 3604 - DNA, 25 bp, Homo sapien
aaatctctgccctcgtcgatcttac

SEQ ID NO: 3605 - DNA, 25 bp, Homo sapien
aaatctctgccttcgtcgatcttac

SEQ ID NO: 3606 - DNA, 25 bp, Homo sapien
aaatctgaatttaatccatatgagc

SEQ ID NO: 3607 - DNA, 25 bp, Homo sapien
aaatctgaatttattccatatgagc

SEQ ID NO: 3608 - DNA, 25 bp, Homo sapien
aaatctgagtcactgattgatgtaa

SEQ ID NO: 3609 - DNA, 25 bp, Homo sapien
aaatctgagtcagtgattgatgtaa

SEQ ID NO: 3610 - DNA, 25 bp, Homo sapien
aaatctgctggcgggattaaagtat

SEQ ID NO: 3611 - DNA, 25 bp, Homo sapien
aaatctgctggtgggattaaagtat

SEQ ID NO: 3612 - DNA, 25 bp, Homo sapien
aaatctggcatttcgcccattattc

SEQ ID NO: 3613 - DNA, 25 bp, Homo sapien
aaatctggcatttctcccattattc

SEQ ID NO: 3614 - DNA, 25 bp, Homo sapien
aaatctgtacaatgtgttacccaaa

SEQ ID NO: 3615 - DNA, 25 bp, Homo sapien
aaatctgtacagtgtgttacccaaa

SEQ ID NO: 3616 - DNA, 25 bp, Homo sapien
aaatcttatacccactagctgtcac

SEQ ID NO: 3617 - DNA, 25 bp, Homo sapien
aaatcttatactcactagctgtcac

SEQ ID NO: 3618 - DNA, 25 bp, Homo sapien
aaatcttcaaaatgacaaggccatg

SEQ ID NO: 3619 - DNA, 25 bp, Homo sapien
aaatcttcaaagtgacaaggccatg

SEQ ID NO: 3620 - DNA, 25 bp, Homo sapien
aaatcttcacttatttatcatatta

SEQ ID NO: 3621 - DNA, 25 bp, Homo sapien
aaatcttcagttatttatcatatta

SEQ ID NO: 3622 - DNA, 25 bp, Homo sapien
aaatcttgacagaaaaacctcacag

SEQ ID NO: 3623 - DNA, 25 bp, Homo sapien
aaatcttgacaggaaaacctcacag

SEQ ID NO: 3624 - DNA, 25 bp, Homo sapien
aaatcttgacatactggattggaat

SEQ ID NO: 3625 - DNA, 25 bp, Homo sapien
aaatcttgacatattggattggaat

SEQ ID NO: 3626 - DNA, 25 bp, Homo sapien
aaatcttgatatgctaaatgagtac

SEQ ID NO: 3627 - DNA, 25 bp, Homo sapien
aaatcttggtatgctaaatgagtac

SEQ ID NO: 3628 - DNA, 25 bp, Homo sapien
aaatctttagaagcctcattggaga

SEQ ID NO: 3629 - DNA, 25 bp, Homo sapien
aaatctttagaagccttattggaga

SEQ ID NO: 3630 - DNA, 25 bp, Homo sapien
aaatctttctgcctaacctgtattt

SEQ ID NO: 3631 - DNA, 25 bp, Homo sapien
aaatctttctgtctaacctgtattt

SEQ ID NO: 3632 - DNA, 25 bp, Homo sapien
aaatctttctgtcttacgtttatac

SEQ ID NO: 3633 - DNA, 25 bp, Homo sapien
aaatctttctgtcttatgtttatac

SEQ ID NO: 3634 - DNA, 25 bp, Homo sapien
aaatctttttcccgttcaatctatc

SEQ ID NO: 3635 - DNA, 25 bp, Homo sapien
aaatctttttcccgttgaatctatc

SEQ ID NO: 3636 - DNA, 25 bp, Homo sapien
aaatcttttttcggacaaagggtaa

SEQ ID NO: 3637 - DNA, 25 bp, Homo sapien
aaatctttttttggacaaagggtaa

SEQ ID NO: 3638 - DNA, 25 bp, Homo sapien
aaatgaaacaataaaggcttgctaa

SEQ ID NO: 3639 - DNA, 25 bp, Homo sapien
aaatgaaacaataaagtcttgctaa

SEQ ID NO: 3640 - DNA, 25 bp, Homo sapien
aaatgaacctgcaggaaaaacagta

SEQ ID NO: 3641 - DNA, 25 bp, Homo sapien
aaatgaacgtgcaggaaaaacagta

SEQ ID NO: 3642 - DNA, 25 bp, Homo sapien
aaatgaactttccttcctggaattt

SEQ ID NO: 3643 - DNA, 25 bp, Homo sapien
aaatgaactttccttcttggaattt

SEQ ID NO: 3644 - DNA, 25 bp, Homo sapien
aaatgaagaagctgcataatgatga

SEQ ID NO: 3645 - DNA, 25 bp, Homo sapien
aaatgaagaagttgcataatgatga

SEQ ID NO: 3646 - DNA, 25 bp, Homo sapien
aaatgaagactgccacatcagttga

SEQ ID NO: 3647 - DNA, 25 bp, Homo sapien
aaatgaagattgccacatcagttga

SEQ ID NO: 3648 - DNA, 25 bp, Homo sapien
aaatgaagtcagttgcatcacaccc

SEQ ID NO: 3649 - DNA, 25 bp, Homo sapien
aaatgaagtcagttgcgtcacaccc

SEQ ID NO: 3650 - DNA, 25 bp, Homo sapien
aaatgaatataagtgtggtatggga

SEQ ID NO: 3651 - DNA, 25 bp, Homo sapien
aaatgaatcttttccctttttgctt

SEQ ID NO: 3652 - DNA, 25 bp, Homo sapien
aaatgaatcttttctctttttgctt

SEQ ID NO: 3653 - DNA, 25 bp, Homo sapien
aaatgaatgtaagtgtggtatggga

SEQ ID NO: 3654 - DNA, 25 bp, Homo sapien
aaatgacattttctctcagtgttct

SEQ ID NO: 3655 - DNA, 25 bp, Homo sapien
aaatgacattttctgtcagtgttct

SEQ ID NO: 3656 - DNA, 25 bp, Homo sapien
aaatgaccatagaaattagccttgg

SEQ ID NO: 3657 - DNA, 25 bp, Homo sapien
aaatgaccatggctctttgatatct

SEQ ID NO: 3658 - DNA, 25 bp, Homo sapien
aaatgaccatggttctttgatatct

SEQ ID NO: 3659 - DNA, 25 bp, Homo sapien
aaatgacccaaaagataagagggta

SEQ ID NO: 3660 - DNA, 25 bp, Homo sapien
aaatgaccgaaaagataagagggta

SEQ ID NO: 3661 - DNA, 25 bp, Homo sapien
aaatgaccgtagaaattagccttgg

SEQ ID NO: 3662 - DNA, 25 bp, Homo sapien
aaatgactaaaacaattgcatttaa

SEQ ID NO: 3663 - DNA, 25 bp, Homo sapien
aaatgactaaaacacttgcatttaa

SEQ ID NO: 3664 - DNA, 25 bp, Homo sapien
aaatgactcaaacaaagttaaataa

SEQ ID NO: 3665 - DNA, 25 bp, Homo sapien
aaatgactcaaagaaagttaaataa

SEQ ID NO: 3666 - DNA, 25 bp, Homo sapien
aaatgactttgtcacgattgtgttc

SEQ ID NO: 3667 - DNA, 25 bp, Homo sapien
aaatgactttgtcacggttgtgttc

SEQ ID NO: 3668 - DNA, 25 bp, Homo sapien
aaatgagaaaatcttgatatgctaa

SEQ ID NO: 3669 - DNA, 25 bp, Homo sapien
aaatgagaaaatcttggtatgctaa

SEQ ID NO: 3670 - DNA, 25 bp, Homo sapien
aaatgagagatgctggttttaagtc

SEQ ID NO: 3671 - DNA, 25 bp, Homo sapien
aaatgagagatgttggttttaagtc

SEQ ID NO: 3672 - DNA, 25 bp, Homo sapien
aaatgagagttattacagagctgtg

SEQ ID NO: 3673 - DNA, 25 bp, Homo sapien
aaatgagagttattacggagctgtg

SEQ ID NO: 3674 - DNA, 25 bp, Homo sapien
aaatgagataatcctcataaatccc

SEQ ID NO: 3675 - DNA, 25 bp, Homo sapien
aaatgagataatcctcgtaaatccc

SEQ ID NO: 3676 - DNA, 25 bp, Homo sapien
aaatgagatgttcactggaggattt

SEQ ID NO: 3677 - DNA, 25 bp, Homo sapien
aaatgagatgttcattggaggattt

SEQ ID NO: 3678 - DNA, 25 bp, Homo sapien
aaatgagattgattataaacctatg

SEQ ID NO: 3679 - DNA, 25 bp, Homo sapien
aaatgagattgattgtaaacctatg

SEQ ID NO: 3680 - DNA, 25 bp, Homo sapien
aaatgagcattttcttttgccaaaa

SEQ ID NO: 3681 - DNA, 25 bp, Homo sapien
aaatgagcattttgttttgccaaaa

SEQ ID NO: 3682 - DNA, 25 bp, Homo sapien
aaatgagcccagctgaacactctat

SEQ ID NO: 3683 - DNA, 25 bp, Homo sapien
aaatgagcccagttgaacactctat

SEQ ID NO: 3684 - DNA, 25 bp, Homo sapien
aaatgaggacagaaactgtgatttc

SEQ ID NO: 3685 - DNA, 25 bp, Homo sapien
aaatgaggcttcaagaagtctgttt

SEQ ID NO: 3686 - DNA, 25 bp, Homo sapien
aaatgaggcttcaggaagtctgttt

SEQ ID NO: 3687 - DNA, 25 bp, Homo sapien
aaatgagggaaccgaggtatagaaa

SEQ ID NO: 3688 - DNA, 25 bp, Homo sapien
aaatgagggaactgaggtatagaaa

SEQ ID NO: 3689 - DNA, 25 bp, Homo sapien
aaatgagggcagaaactgtgatttc

SEQ ID NO: 3690 - DNA, 25 bp, Homo sapien
aaatgagtaggtactgctaaaacaa

SEQ ID NO: 3691 - DNA, 25 bp, Homo sapien
aaatgagtgggtactgctaaaacaa

SEQ ID NO: 3692 - DNA, 25 bp, Homo sapien
aaatgagttaaaccaatcaatgcac

SEQ ID NO: 3693 - DNA, 25 bp, Homo sapien
aaatgagttgaaccaatcaatgcac

SEQ ID NO: 3694 - DNA, 25 bp, Homo sapien
aaatgagttgggaagaagttctctc

SEQ ID NO: 3695 - DNA, 25 bp, Homo sapien
aaatgagttgggtagaagttctctc

SEQ ID NO: 3696 - DNA, 25 bp, Homo sapien
aaatgagtttcagaagagttgttat

SEQ ID NO: 3697 - DNA, 25 bp, Homo sapien
aaatgagtttcggaagagttgttat

SEQ ID NO: 3698 - DNA, 25 bp, Homo sapien
aaatgataacagagtaccctggaaa

SEQ ID NO: 3699 - DNA, 25 bp, Homo sapien
aaatgataagagagtaccctggaaa

SEQ ID NO: 3700 - DNA, 25 bp, Homo sapien
aaatgatacttatgactttaaaagt

SEQ ID NO: 3701 - DNA, 25 bp, Homo sapien
aaatgatagctgcaatagaaagtaa

SEQ ID NO: 3702 - DNA, 25 bp, Homo sapien
aaatgatagctgcagtagaaagtaa

SEQ ID NO: 3703 - DNA, 25 bp, Homo sapien
aaatgatagttatgactttaaaagt

SEQ ID NO: 3704 - DNA, 25 bp, Homo sapien
aaatgatcagataatatttctgtct

SEQ ID NO: 3705 - DNA, 25 bp, Homo sapien
aaatgatcaggctaaatcgccaggt

SEQ ID NO: 3706 - DNA, 25 bp, Homo sapien
aaatgatcaggttaaatcgccaggt

SEQ ID NO: 3707 - DNA, 25 bp, Homo sapien
aaatgatccgataatatttctgtct

SEQ ID NO: 3708 - DNA, 25 bp, Homo sapien
aaatgatctgcgagcgtctaactgt

SEQ ID NO: 3709 - DNA, 25 bp, Homo sapien
aaatgatctgcgagtgtctaactgt

SEQ ID NO: 3710 - DNA, 25 bp, Homo sapien
aaatgatgctatacgctttatatat

SEQ ID NO: 3711 - DNA, 25 bp, Homo sapien
aaatgatgctatatgctttatatat

SEQ ID NO: 3712 - DNA, 25 bp, Homo sapien
aaatgatggcaaataaggcaatata

SEQ ID NO: 3713 - DNA, 25 bp, Homo sapien
aaatgatgggtagagtctaaaagag

SEQ ID NO: 3714 - DNA, 25 bp, Homo sapien
aaatgatggttagagtctaaaagag

SEQ ID NO: 3715 - DNA, 25 bp, Homo sapien
aaatgatgtcaaataaggcaatata

SEQ ID NO: 3716 - DNA, 25 bp, Homo sapien
aaatgattgttacagccaatgaaca

SEQ ID NO: 3717 - DNA, 25 bp, Homo sapien
aaatgattgttatagccaatgaaca

SEQ ID NO: 3718 - DNA, 25 bp, Homo sapien
aaatgcaaataccccaaagcacatg

SEQ ID NO: 3719 - DNA, 25 bp, Homo sapien
aaatgcaaatactatcatcgtaaat

SEQ ID NO: 3720 - DNA, 25 bp, Homo sapien
aaatgcaaatatcccaaagcacatg

SEQ ID NO: 3721 - DNA, 25 bp, Homo sapien
aaatgcaaatattatcatcgtaaat

SEQ ID NO: 3722 - DNA, 25 bp, Homo sapien
aaatgcaacaaacattcacatagaa

SEQ ID NO: 3723 - DNA, 25 bp, Homo sapien
aaatgcaacaaacgttcacatagaa

SEQ ID NO: 3724 - DNA, 25 bp, Homo sapien
aaatgcaacctattttctgggttcc

SEQ ID NO: 3725 - DNA, 25 bp, Homo sapien
aaatgcaacctcttttctgggttcc

SEQ ID NO: 3726 - DNA, 25 bp, Homo sapien
aaatgcaatacatttggaactggag

SEQ ID NO: 3727 - DNA, 25 bp, Homo sapien
aaatgcaatccatttggaactggag

SEQ ID NO: 3728 - DNA, 25 bp, Homo sapien
aaatgcaattccagctgaaatgggc

SEQ ID NO: 3729 - DNA, 25 bp, Homo sapien
aaatgcaattctagctgaaatgggc

SEQ ID NO: 3730 - DNA, 25 bp, Homo sapien
aaatgcacagaaacagggcagcaca

SEQ ID NO: 3731 - DNA, 25 bp, Homo sapien
aaatgcacagaaacggggcagcaca

SEQ ID NO: 3732 - DNA, 25 bp, Homo sapien
aaatgcaccttccagaatgtagcaa

SEQ ID NO: 3733 - DNA, 25 bp, Homo sapien
aaatgcactttccagaatgtagcaa

SEQ ID NO: 3734 - DNA, 25 bp, Homo sapien
aaatgcagcgagaagaatgagtaga

SEQ ID NO: 3735 - DNA, 25 bp, Homo sapien
aaatgcaggaaacgctgaggctttg

SEQ ID NO: 3736 - DNA, 25 bp, Homo sapien
aaatgcaggaaatgctgaggctttg

SEQ ID NO: 3737 - DNA, 25 bp, Homo sapien
aaatgcagtaggtagtctctttctc

SEQ ID NO: 3738 - DNA, 25 bp, Homo sapien
aaatgcagtaggtggtctctttctc

SEQ ID NO: 3739 - DNA, 25 bp, Homo sapien
aaatgcagtgagaagaatgagtaga

SEQ ID NO: 3740 - DNA, 25 bp, Homo sapien
aaatgcatgtgaaacactactgaat

SEQ ID NO: 3741 - DNA, 25 bp, Homo sapien
aaatgcatgtgaagcactactgaat

SEQ ID NO: 3742 - DNA, 25 bp, Homo sapien
aaatgcatttaagcagatgtcaagg

SEQ ID NO: 3743 - DNA, 25 bp, Homo sapien
aaatgcatttaaggagatgtcaagg

SEQ ID NO: 3744 - DNA, 25 bp, Homo sapien
aaatgccaaatatgctggagtccct

SEQ ID NO: 3745 - DNA, 25 bp, Homo sapien
aaatgccaaatctgctggagtccct

SEQ ID NO: 3746 - DNA, 25 bp, Homo sapien
aaatgccacaacaagaatgattagt

SEQ ID NO: 3747 - DNA, 25 bp, Homo sapien
aaatgccacaataagaatgattagt

SEQ ID NO: 3748 - DNA, 25 bp, Homo sapien
aaatgccacaggtaagctaagagca

SEQ ID NO: 3749 - DNA, 25 bp, Homo sapien
aaatgccacgggtaagctaagagca

SEQ ID NO: 3750 - DNA, 25 bp, Homo sapien
aaatgccaggttcatattcaaaata

SEQ ID NO: 3751 - DNA, 25 bp, Homo sapien
aaatgccaggttgatattcaaaata

SEQ ID NO: 3752 - DNA, 25 bp, Homo sapien
aaatgcctagaagctcctccaaatg

SEQ ID NO: 3753 - DNA, 25 bp, Homo sapien
aaatgcctagaagctcttccaaatg

SEQ ID NO: 3754 - DNA, 25 bp, Homo sapien
aaatgcctaggagtgaacaggttgg

SEQ ID NO: 3755 - DNA, 25 bp, Homo sapien
aaatgcctatgagtgaacaggttgg

SEQ ID NO: 3756 - DNA, 25 bp, Homo sapien
aaatgcctattagatagttgtggag

SEQ ID NO: 3757 - DNA, 25 bp, Homo sapien
aaatgcctattatatagttgtggag

SEQ ID NO: 3758 - DNA, 25 bp, Homo sapien
aaatgcctcctaaggatttagctgt

SEQ ID NO: 3759 - DNA, 25 bp, Homo sapien
aaatgcctcctaatgatttagctgt

SEQ ID NO: 3760 - DNA, 25 bp, Homo sapien
aaatgccttgcctttcaatctttca

SEQ ID NO: 3761 - DNA, 25 bp, Homo sapien
aaatgccttgcttttcaatctttca

SEQ ID NO: 3762 - DNA, 25 bp, Homo sapien
aaatgctacaggccggcgagctggg

SEQ ID NO: 3763 - DNA, 25 bp, Homo sapien
aaatgctacaggctggcgagctggg

SEQ ID NO: 3764 - DNA, 25 bp, Homo sapien
aaatgctctaatctgaaagaaaaag

SEQ ID NO: 3765 - DNA, 25 bp, Homo sapien
aaatgctctaatttgaaagaaaaag

SEQ ID NO: 3766 - DNA, 25 bp, Homo sapien
aaatgctctggttatcaggacagag

SEQ ID NO: 3767 - DNA, 25 bp, Homo sapien
aaatgctctggttatcgggacagag

SEQ ID NO: 3768 - DNA, 25 bp, Homo sapien
aaatgctgaatagctccccttgaag

SEQ ID NO: 3769 - DNA, 25 bp, Homo sapien
aaatgctgagaatgtaaaatactgg

SEQ ID NO: 3770 - DNA, 25 bp, Homo sapien
aaatgctgagagtgtaaaatactgg

SEQ ID NO: 3771 - DNA, 25 bp, Homo sapien
aaatgctgagataggaggttgaggc

SEQ ID NO: 3772 - DNA, 25 bp, Homo sapien
aaatgctgcaagtcaataatatcgt

SEQ ID NO: 3773 - DNA, 25 bp, Homo sapien
aaatgctgcatagctccccttgaag

SEQ ID NO: 3774 - DNA, 25 bp, Homo sapien
aaatgctgcgagtcaataatatcgt

SEQ ID NO: 3775 - DNA, 25 bp, Homo sapien
aaatgctgggataggaggttgaggc

SEQ ID NO: 3776 - DNA, 25 bp, Homo sapien
aaatgcttagaaacctgagaactgc

SEQ ID NO: 3777 - DNA, 25 bp, Homo sapien
aaatgcttagaatcctgagaactgc

SEQ ID NO: 3778 - DNA, 25 bp, Homo sapien
aaatgcttattgtaaattctaaaga

SEQ ID NO: 3779 - DNA, 25 bp, Homo sapien
aaatgcttattgttaattctaaaga

SEQ ID NO: 3780 - DNA, 25 bp, Homo sapien
aaatgcttcttactgatcatgtgac

SEQ ID NO: 3781 - DNA, 25 bp, Homo sapien
aaatgcttcttattgatcatgtgac

SEQ ID NO: 3782 - DNA, 25 bp, Homo sapien
aaatggaaaaaaagacactttgaaa

SEQ ID NO: 3783 - DNA, 25 bp, Homo sapien
aaatggaaacaaagacactttgaaa

SEQ ID NO: 3784 - DNA, 25 bp, Homo sapien
aaatggaaagaggtatctaaaatct

SEQ ID NO: 3785 - DNA, 25 bp, Homo sapien
aaatggaaagaggtatgtaaaatct

SEQ ID NO: 3786 - DNA, 25 bp, Homo sapien
aaatggaaagatatatatgcatctt

SEQ ID NO: 3787 - DNA, 25 bp, Homo sapien
aaatggaaagatatgtatgcatctt

SEQ ID NO: 3788 - DNA, 25 bp, Homo sapien
aaatggaacattacataccctcaac

SEQ ID NO: 3789 - DNA, 25 bp, Homo sapien
aaatggaacccttgcacagtgttag

SEQ ID NO: 3790 - DNA, 25 bp, Homo sapien
aaatggaacccttgcatagtgttag

SEQ ID NO: 3791 - DNA, 25 bp, Homo sapien
aaatggaatattacataccctcaac

SEQ ID NO: 3792 - DNA, 25 bp, Homo sapien
aaatggagaaagaaaccatgaacca

SEQ ID NO: 3793 - DNA, 25 bp, Homo sapien
aaatggagaaaggaaccatgaacca

SEQ ID NO: 3794 - DNA, 25 bp, Homo sapien
aaatggagaagaaatgagactgaga

SEQ ID NO: 3795 - DNA, 25 bp, Homo sapien
aaatggagaaggaatgagactgaga

SEQ ID NO: 3796 - DNA, 25 bp, Homo sapien
aaatggagctgtcctctgacctacc

SEQ ID NO: 3797 - DNA, 25 bp, Homo sapien
aaatggagctgtcttctgacctacc

SEQ ID NO: 3798 - DNA, 25 bp, Homo sapien
aaatggaggcacaatggtgagaaag

SEQ ID NO: 3799 - DNA, 25 bp, Homo sapien
aaatggaggcacgatggtgagaaag

SEQ ID NO: 3800 - DNA, 25 bp, Homo sapien
aaatggagtgaccatgagtgaatga

SEQ ID NO: 3801 - DNA, 25 bp, Homo sapien
aaatggagtgaccgtgagtgaatga

SEQ ID NO: 3802 - DNA, 25 bp, Homo sapien
aaatggatgctgaacagatttttaa

SEQ ID NO: 3803 - DNA, 25 bp, Homo sapien
aaatggatgctgagcagatttttaa

SEQ ID NO: 3804 - DNA, 25 bp, Homo sapien
aaatggcacatctgaaatttacata

SEQ ID NO: 3805 - DNA, 25 bp, Homo sapien
aaatggcacatctgaactttacata

SEQ ID NO: 3806 - DNA, 25 bp, Homo sapien
aaatggcaccgagagaaccatgtgc

SEQ ID NO: 3807 - DNA, 25 bp, Homo sapien
aaatggcactgagagaaccatgtgc

SEQ ID NO: 3808 - DNA, 25 bp, Homo sapien
aaatggcatgcccacttagtaatga

SEQ ID NO: 3809 - DNA, 25 bp, Homo sapien
aaatggcatgccctcttagtaatga

SEQ ID NO: 3810 - DNA, 25 bp, Homo sapien
aaatggccagggaagagagcagtac

SEQ ID NO: 3811 - DNA, 25 bp, Homo sapien
aaatggccagggaagatagcagtac

SEQ ID NO: 3812 - DNA, 25 bp, Homo sapien
aaatggccatctggaccagacagat

SEQ ID NO: 3813 - DNA, 25 bp, Homo sapien
aaatggccgtctggaccagacagat

SEQ ID NO: 3814 - DNA, 25 bp, Homo sapien
aaatggctaagtcaaaaaagtagga

SEQ ID NO: 3815 - DNA, 25 bp, Homo sapien
aaatggctacaaccagaacgattaa

SEQ ID NO: 3816 - DNA, 25 bp, Homo sapien
aaatggctacaatcagaacgattaa

SEQ ID NO: 3817 - DNA, 25 bp, Homo sapien
aaatggctacgtcaaaaaagtagga

SEQ ID NO: 3818 - DNA, 25 bp, Homo sapien
aaatgggaagacaagtaggactgaa

SEQ ID NO: 3819 - DNA, 25 bp, Homo sapien
aaatgggaagacaagtcggactgaa

SEQ ID NO: 3820 - DNA, 25 bp, Homo sapien
aaatggggacaaaaatgcactctga

SEQ ID NO: 3821 - DNA, 25 bp, Homo sapien
aaatggggacagaaatgcactctga

SEQ ID NO: 3822 - DNA, 25 bp, Homo sapien
aaatggggatgacaatgcttcctgt

SEQ ID NO: 3823 - DNA, 25 bp, Homo sapien
aaatggggatgacagtgcttcctgt

SEQ ID NO: 3824 - DNA, 25 bp, Homo sapien
aaatggggttcgctgaattattctt

SEQ ID NO: 3825 - DNA, 25 bp, Homo sapien
aaatggggttcgctgagttattctt

SEQ ID NO: 3826 - DNA, 25 bp, Homo sapien
aaatgggtctttcgcgaagcccaat

SEQ ID NO: 3827 - DNA, 25 bp, Homo sapien
aaatgggtcttttgcgaagcccaat

SEQ ID NO: 3828 - DNA, 25 bp, Homo sapien
aaatgggtgtgcaacactgggtttt

SEQ ID NO: 3829 - DNA, 25 bp, Homo sapien
aaatgggtgtgcaacattgggtttt

SEQ ID NO: 3830 - DNA, 25 bp, Homo sapien
aaatggtaaagaaaggacatgcgag

SEQ ID NO: 3831 - DNA, 25 bp, Homo sapien
aaatggtaaagaaagggcatgcgag

SEQ ID NO: 3832 - DNA, 25 bp, Homo sapien
aaatggtaaagtgggatgccaagtt

SEQ ID NO: 3833 - DNA, 25 bp, Homo sapien
aaatggtaacgtgggatgccaagtt

SEQ ID NO: 3834 - DNA, 25 bp, Homo sapien
aaatggtaattaaagtcatgagagt

SEQ ID NO: 3835 - DNA, 25 bp, Homo sapien
aaatggtaattaaagtgatgagagt

SEQ ID NO: 3836 - DNA, 25 bp, Homo sapien
aaatggtatgggtcctagcactgag

SEQ ID NO: 3837 - DNA, 25 bp, Homo sapien
aaatggtatgggtcttagcactgag

SEQ ID NO: 3838 - DNA, 25 bp, Homo sapien
aaatggtcaacacatcataaatgat

SEQ ID NO: 3839 - DNA, 25 bp, Homo sapien
aaatggtcaacacctcataaatgat

SEQ ID NO: 3840 - DNA, 25 bp, Homo sapien
aaatggtcaataataggagagtatg

SEQ ID NO: 3841 - DNA, 25 bp, Homo sapien
aaatggtcgataataggagagtatg

SEQ ID NO: 3842 - DNA, 25 bp, Homo sapien
aaatggtgccagcaaaagagaaggc

SEQ ID NO: 3843 - DNA, 25 bp, Homo sapien
aaatggtgccagcgaaagagaaggc

SEQ ID NO: 3844 - DNA, 25 bp, Homo sapien
aaatggtgtcacctgctctcaagta

SEQ ID NO: 3845 - DNA, 25 bp, Homo sapien
aaatggtgtcacttgctctcaagta

SEQ ID NO: 3846 - DNA, 25 bp, Homo sapien
aaatggttagaaagggaataaactg

SEQ ID NO: 3847 - DNA, 25 bp, Homo sapien
aaatggttagaaatggaataaactg

SEQ ID NO: 3848 - DNA, 25 bp, Homo sapien
aaatggttgttttacaccactgagt

SEQ ID NO: 3849 - DNA, 25 bp, Homo sapien
aaatggttgttttataccactgagt

SEQ ID NO: 3850 - DNA, 25 bp, Homo sapien
aaatgtaaatagtgaaacaccatta

SEQ ID NO: 3851 - DNA, 25 bp, Homo sapien
aaatgtaaatattgaaacaccatta

SEQ ID NO: 3852 - DNA, 25 bp, Homo sapien
aaatgtaagtgatagataagcttaa

SEQ ID NO: 3853 - DNA, 25 bp, Homo sapien
aaatgtaagtgctagataagcttaa

SEQ ID NO: 3854 - DNA, 25 bp, Homo sapien
aaatgtacagttgagtagtgttaag

SEQ ID NO: 3855 - DNA, 25 bp, Homo sapien
aaatgtacagtttaatgggttatgt

SEQ ID NO: 3856 - DNA, 25 bp, Homo sapien
aaatgtacagtttagtagtgttaag

SEQ ID NO: 3857 - DNA, 25 bp, Homo sapien
aaatgtacagtttagtgggttatgt

SEQ ID NO: 3858 - DNA, 25 bp, Homo sapien
aaatgtaccaggtaatcatcaatat

SEQ ID NO: 3859 - DNA, 25 bp, Homo sapien
aaatgtaccttggaggagttttcgt

SEQ ID NO: 3860 - DNA, 25 bp, Homo sapien
aaatgtaccttggtggagttttcgt

SEQ ID NO: 3861 - DNA, 25 bp, Homo sapien
aaatgtacgaggtaatcatcaatat

SEQ ID NO: 3862 - DNA, 25 bp, Homo sapien
aaatgtactacattgattgtcaact

SEQ ID NO: 3863 - DNA, 25 bp, Homo sapien
aaatgtactccattgattgtcaact

SEQ ID NO: 3864 - DNA, 25 bp, Homo sapien
aaatgtaggccttttaattccatat

SEQ ID NO: 3865 - DNA, 25 bp, Homo sapien
aaatgtagggcttttaattccatat

SEQ ID NO: 3866 - DNA, 25 bp, Homo sapien
aaatgtagtagaaacatagtcacac

SEQ ID NO: 3867 - DNA, 25 bp, Homo sapien
aaatgtagtctctaccctgaccatg

SEQ ID NO: 3868 - DNA, 25 bp, Homo sapien
aaatgtagtctctaccttgaccatg

SEQ ID NO: 3869 - DNA, 25 bp, Homo sapien
aaatgtagtggaaacatagtcacac

SEQ ID NO: 3870 - DNA, 25 bp, Homo sapien
aaatgtatcctaaaataagccaaca

SEQ ID NO: 3871 - DNA, 25 bp, Homo sapien
aaatgtatcctaagataagccaaca

SEQ ID NO: 3872 - DNA, 25 bp, Homo sapien
aaatgtatgtgtaataattcatgta

SEQ ID NO: 3873 - DNA, 25 bp, Homo sapien
aaatgtatgtgtagtaattcatgta

SEQ ID NO: 3874 - DNA, 25 bp, Homo sapien
aaatgtattcaaagtgatggagtat

SEQ ID NO: 3875 - DNA, 25 bp, Homo sapien
aaatgtattcacagtgatggagtat

SEQ ID NO: 3876 - DNA, 25 bp, Homo sapien
aaatgtatttgcatacctatagctc

SEQ ID NO: 3877 - DNA, 25 bp, Homo sapien
aaatgtatttgcatacttatagctc

SEQ ID NO: 3878 - DNA, 25 bp, Homo sapien
aaatgtcaacaatattatctctggg

SEQ ID NO: 3879 - DNA, 25 bp, Homo sapien
aaatgtcaagaatattatctctggg

SEQ ID NO: 3880 - DNA, 25 bp, Homo sapien
aaatgtcaagattttaaatatggac

SEQ ID NO: 3881 - DNA, 25 bp, Homo sapien
aaatgtcaataatcagttggaaatt

SEQ ID NO: 3882 - DNA, 25 bp, Homo sapien
aaatgtcaatttccatttttctact

SEQ ID NO: 3883 - DNA, 25 bp, Homo sapien
aaatgtcaatttccgtttttctact

SEQ ID NO: 3884 - DNA, 25 bp, Homo sapien
aaatgtcaatttcctctggcaacac

SEQ ID NO: 3885 - DNA, 25 bp, Homo sapien
aaatgtcacacaacttgttgttctt

SEQ ID NO: 3886 - DNA, 25 bp, Homo sapien
aaatgtcacacaatttgttgttctt

SEQ ID NO: 3887 - DNA, 25 bp, Homo sapien
aaatgtcaggattttaaatatggac

SEQ ID NO: 3888 - DNA, 25 bp, Homo sapien
aaatgtcagtaatcagttggaaatt

SEQ ID NO: 3889 - DNA, 25 bp, Homo sapien
aaatgtcagttactatcattaacat

SEQ ID NO: 3890 - DNA, 25 bp, Homo sapien
aaatgtcagttattatcattaacat

SEQ ID NO: 3891 - DNA, 25 bp, Homo sapien
aaatgtcagtttcctctggcaacac

SEQ ID NO: 3892 - DNA, 25 bp, Homo sapien
aaatgtcatcccactgtcatcttga

SEQ ID NO: 3893 - DNA, 25 bp, Homo sapien
aaatgtcatcccagtgtcatcttga

SEQ ID NO: 3894 - DNA, 25 bp, Homo sapien
aaatgtcatcttgagtgttaatgga

SEQ ID NO: 3895 - DNA, 25 bp, Homo sapien
aaatgtcattttgagtgttaatgga

SEQ ID NO: 3896 - DNA, 25 bp, Homo sapien
aaatgtccaaggattgccatttatt

SEQ ID NO: 3897 - DNA, 25 bp, Homo sapien
aaatgtccaagggttgccatttatt

SEQ ID NO: 3898 - DNA, 25 bp, Homo sapien
aaatgtccacatcctgatccccgga

SEQ ID NO: 3899 - DNA, 25 bp, Homo sapien
aaatgtccacattctgatccccgga

SEQ ID NO: 3900 - DNA, 25 bp, Homo sapien
aaatgtccagtaccaggtttgcttt

SEQ ID NO: 3901 - DNA, 25 bp, Homo sapien
aaatgtccataacatgaattaatac

SEQ ID NO: 3902 - DNA, 25 bp, Homo sapien
aaatgtccataatatgaattaatac

SEQ ID NO: 3903 - DNA, 25 bp, Homo sapien
aaatgtccggccgacgtttctgggg

SEQ ID NO: 3904 - DNA, 25 bp, Homo sapien
aaatgtccggccgatgtttctgggg

SEQ ID NO: 3905 - DNA, 25 bp, Homo sapien
aaatgtccggtaccaggtttgcttt

SEQ ID NO: 3906 - DNA, 25 bp, Homo sapien
aaatgtctgcgattaggttattcat

SEQ ID NO: 3907 - DNA, 25 bp, Homo sapien
aaatgtctgtgattaggttattcat

SEQ ID NO: 3908 - DNA, 25 bp, Homo sapien
aaatgtcttatcatatcttactctc

SEQ ID NO: 3909 - DNA, 25 bp, Homo sapien
aaatgtcttatcatgtcttactctc

SEQ ID NO: 3910 - DNA, 25 bp, Homo sapien
aaatgtcttccatttgcattttaaa

SEQ ID NO: 3911 - DNA, 25 bp, Homo sapien
aaatgtcttccgtttgcattttaaa

SEQ ID NO: 3912 - DNA, 25 bp, Homo sapien
aaatgtcttcctatacctaccacta

SEQ ID NO: 3913 - DNA, 25 bp, Homo sapien
aaatgtcttcctatacttaccacta

SEQ ID NO: 3914 - DNA, 25 bp, Homo sapien
aaatgtcttcttgctttgggaaata

SEQ ID NO: 3915 - DNA, 25 bp, Homo sapien
aaatgtcttcttgttttgggaaata

SEQ ID NO: 3916 - DNA, 25 bp, Homo sapien
aaatgtgacactcaagttttagcaa

SEQ ID NO: 3917 - DNA, 25 bp, Homo sapien
aaatgtgacactcaggttttagcaa

SEQ ID NO: 3918 - DNA, 25 bp, Homo sapien
aaatgtgaggaaaggatgcatttgg

SEQ ID NO: 3919 - DNA, 25 bp, Homo sapien
aaatgtgaggaagggatgcatttgg

SEQ ID NO: 3920 - DNA, 25 bp, Homo sapien
aaatgtgaggttgaagtccccacac

SEQ ID NO: 3921 - DNA, 25 bp, Homo sapien
aaatgtgaggtttaagtccccacac

SEQ ID NO: 3922 - DNA, 25 bp, Homo sapien
aaatgtgatgtttgatatggacgtg

SEQ ID NO: 3923 - DNA, 25 bp, Homo sapien
aaatgtgatgtttggtatggacgtg

SEQ ID NO: 3924 - DNA, 25 bp, Homo sapien
aaatgtgattcaaatataatctcct

SEQ ID NO: 3925 - DNA, 25 bp, Homo sapien
aaatgtgattcagatataatctcct

SEQ ID NO: 3926 - DNA, 25 bp, Homo sapien
aaatgtgcaaagaagtaactgcgag

SEQ ID NO: 3927 - DNA, 25 bp, Homo sapien
aaatgtgcaaaggagtaactgcgag

SEQ ID NO: 3928 - DNA, 25 bp, Homo sapien
aaatgtgcagtaaaaatatggtatt

SEQ ID NO: 3929 - DNA, 25 bp, Homo sapien
aaatgtgcagtggggactaaaattc

SEQ ID NO: 3930 - DNA, 25 bp, Homo sapien
aaatgtgcattaaaaatatggtatt

SEQ ID NO: 3931 - DNA, 25 bp, Homo sapien
aaatgtgccacattggatttaaaat

SEQ ID NO: 3932 - DNA, 25 bp, Homo sapien
aaatgtgccacattggttttaaaat

SEQ ID NO: 3933 - DNA, 25 bp, Homo sapien
aaatgtgccctaactcaggcagata

SEQ ID NO: 3934 - DNA, 25 bp, Homo sapien
aaatgtgccctagctcaggcagata

SEQ ID NO: 3935 - DNA, 25 bp, Homo sapien
aaatgtgccgtggggactaaaattc

SEQ ID NO: 3936 - DNA, 25 bp, Homo sapien
aaatgtgcctacgtccttccaactg

SEQ ID NO: 3937 - DNA, 25 bp, Homo sapien
aaatgtgcctatgtccttccaactg

SEQ ID NO: 3938 - DNA, 25 bp, Homo sapien
aaatgtgctgttatcagatgtgcag

SEQ ID NO: 3939 - DNA, 25 bp, Homo sapien
aaatgtgctgttttcagatgtgcag

SEQ ID NO: 3940 - DNA, 25 bp, Homo sapien
aaatgtgcttgcagagaggaaagat

SEQ ID NO: 3941 - DNA, 25 bp, Homo sapien
aaatgtgcttgcatagaggaaagat

SEQ ID NO: 3942 - DNA, 25 bp, Homo sapien
aaatgtggctagagttactggaaaa

SEQ ID NO: 3943 - DNA, 25 bp, Homo sapien
aaatgtggctagtgttactggaaaa

SEQ ID NO: 3944 - DNA, 25 bp, Homo sapien
aaatgtggttgaccaacatcatcag

SEQ ID NO: 3945 - DNA, 25 bp, Homo sapien
aaatgtggttgactaacatcatcag

SEQ ID NO: 3946 - DNA, 25 bp, Homo sapien
aaatgtggtttccagtttagcagtg

SEQ ID NO: 3947 - DNA, 25 bp, Homo sapien
aaatgtggtttctagtttagcagtg

SEQ ID NO: 3948 - DNA, 25 bp, Homo sapien
aaatgtgtcagcagagccagctcat

SEQ ID NO: 3949 - DNA, 25 bp, Homo sapien
aaatgtgtcagcagggccagctcat

SEQ ID NO: 3950 - DNA, 25 bp, Homo sapien
aaatgtgtctgcaaatataaagtta

SEQ ID NO: 3951 - DNA, 25 bp, Homo sapien
aaatgtgtctggaaatataaagtta

SEQ ID NO: 3952 - DNA, 25 bp, Homo sapien
aaatgtgtttaacttgaattgctct

SEQ ID NO: 3953 - DNA, 25 bp, Homo sapien
aaatgtgtttatcttgaattgctct

SEQ ID NO: 3954 - DNA, 25 bp, Homo sapien
aaatgtgtttccactaactccatgc

SEQ ID NO: 3955 - DNA, 25 bp, Homo sapien
aaatgtgtttccgctaactccatgc

SEQ ID NO: 3956 - DNA, 25 bp, Homo sapien
aaatgttacaaaatatagaccactt

SEQ ID NO: 3957 - DNA, 25 bp, Homo sapien
aaatgttacctctgatcccttattt

SEQ ID NO: 3958 - DNA, 25 bp, Homo sapien
aaatgttacctttgatcccttattt

SEQ ID NO: 3959 - DNA, 25 bp, Homo sapien
aaatgttagaaaatatagaccactt

SEQ ID NO: 3960 - DNA, 25 bp, Homo sapien
aaatgttcataccaaaaaaataaaa

SEQ ID NO: 3961 - DNA, 25 bp, Homo sapien
aaatgttcataccacaaaaataaaa

SEQ ID NO: 3962 - DNA, 25 bp, Homo sapien
aaatgttcgctgtctgcactgtctg

SEQ ID NO: 3963 - DNA, 25 bp, Homo sapien
aaatgttcgttgtctgcactgtctg

SEQ ID NO: 3964 - DNA, 25 bp, Homo sapien
aaatgttctaaaatggattaccagg

SEQ ID NO: 3965 - DNA, 25 bp, Homo sapien
aaatgttctaaaattgattaccagg

SEQ ID NO: 3966 - DNA, 25 bp, Homo sapien
aaatgttctaacagcgaattttgag

SEQ ID NO: 3967 - DNA, 25 bp, Homo sapien
aaatgttctaacagtgaattttgag

SEQ ID NO: 3968 - DNA, 25 bp, Homo sapien
aaatgttctatactcacacaaattt

SEQ ID NO: 3969 - DNA, 25 bp, Homo sapien
aaatgttctatacttacacaaattt

SEQ ID NO: 3970 - DNA, 25 bp, Homo sapien
aaatgttctgctttcctcttgacct

SEQ ID NO: 3971 - DNA, 25 bp, Homo sapien
aaatgttctgcttttctcttgacct

SEQ ID NO: 3972 - DNA, 25 bp, Homo sapien
aaatgttgaaggacatcagtcaatc

SEQ ID NO: 3973 - DNA, 25 bp, Homo sapien
aaatgttgaaggacgtcagtcaatc

SEQ ID NO: 3974 - DNA, 25 bp, Homo sapien
aaatgttgaatccagaagtagcagc

SEQ ID NO: 3975 - DNA, 25 bp, Homo sapien
aaatgttgaattcagaagtagcagc

SEQ ID NO: 3976 - DNA, 25 bp, Homo sapien
aaatgttgcaacaatgaataactga

SEQ ID NO: 3977 - DNA, 25 bp, Homo sapien
aaatgttgcaataatgaataactga

SEQ ID NO: 3978 - DNA, 25 bp, Homo sapien
aaatgttttcgtgcaccgctgacat

SEQ ID NO: 3979 - DNA, 25 bp, Homo sapien
aaatgttttcgtgcactgctgacat

SEQ ID NO: 3980 - DNA, 25 bp, Homo sapien
aaatgttttggaatacgactcttgg

SEQ ID NO: 3981 - DNA, 25 bp, Homo sapien
aaatgttttgggatacgactcttgg

SEQ ID NO: 3982 - DNA, 25 bp, Homo sapien
aaatgtttttgcatatggcttccaa

SEQ ID NO: 3983 - DNA, 25 bp, Homo sapien
aaatgtttttgcgtatggcttccaa

SEQ ID NO: 3984 - DNA, 25 bp, Homo sapien
aaattaaaacactgatgagacctta

SEQ ID NO: 3985 - DNA, 25 bp, Homo sapien
aaattaaaacattgatgagacctta

SEQ ID NO: 3986 - DNA, 25 bp, Homo sapien
aaattaaatgatatataggatttgc

SEQ ID NO: 3987 - DNA, 25 bp, Homo sapien
aaattaaatgatgtataggatttgc

SEQ ID NO: 3988 - DNA, 25 bp, Homo sapien
aaattaaattgcatgttcttggagg

SEQ ID NO: 3989 - DNA, 25 bp, Homo sapien
aaattaaattgcttgttcttggagg

SEQ ID NO: 3990 - DNA, 25 bp, Homo sapien
aaattaaccaaccctggatattagt

SEQ ID NO: 3991 - DNA, 25 bp, Homo sapien
aaattaaccaaccgtggatattagt

SEQ ID NO: 3992 - DNA, 25 bp, Homo sapien
aaattaaccagacatggtactatac

SEQ ID NO: 3993 - DNA, 25 bp, Homo sapien
aaattaaccaggcatggtactatac

SEQ ID NO: 3994 - DNA, 25 bp, Homo sapien
aaattaataaaacaaaaagatgcat

SEQ ID NO: 3995 - DNA, 25 bp, Homo sapien
aaattaataaaacaaagagatgcat

SEQ ID NO: 3996 - DNA, 25 bp, Homo sapien
aaattaataaacccctggtacataa

SEQ ID NO: 3997 - DNA, 25 bp, Homo sapien
aaattaataaacccttggtacataa

SEQ ID NO: 3998 - DNA, 25 bp, Homo sapien
aaattacacaatcatcagataaaaa

SEQ ID NO: 3999 - DNA, 25 bp, Homo sapien
aaattacacaatcgtcagataaaaa

SEQ ID NO: 4000 - DNA, 25 bp, Homo sapien
aaattacctcagcaggttcagtact

SEQ ID NO: 4001 - DNA, 25 bp, Homo sapien
aaattacctcagcatgttcagtact

SEQ ID NO: 4002 - DNA, 25 bp, Homo sapien
aaattactaatgcaaagtggccagt

SEQ ID NO: 4003 - DNA, 25 bp, Homo sapien
aaattactaatggaaagtggccagt

SEQ ID NO: 4004 - DNA, 25 bp, Homo sapien
aaattactatataatagaactgcag

SEQ ID NO: 4005 - DNA, 25 bp, Homo sapien
aaattactatatattagaactgcag

SEQ ID NO: 4006 - DNA, 25 bp, Homo sapien
aaattagaatccctgtcctagttct

SEQ ID NO: 4007 - DNA, 25 bp, Homo sapien
aaattagagtccctgtcctagttct

SEQ ID NO: 4008 - DNA, 25 bp, Homo sapien
aaattagatagtcgttatggcctca

SEQ ID NO: 4009 - DNA, 25 bp, Homo sapien
aaattagatagtggttatggcctca

SEQ ID NO: 4010 - DNA, 25 bp, Homo sapien
aaattagcttacaagcaacttaaat

SEQ ID NO: 4011 - DNA, 25 bp, Homo sapien
aaattagcttactagcaacttaaat

SEQ ID NO: 4012 - DNA, 25 bp, Homo sapien
aaattagcttcaaaaccttacatga

SEQ ID NO: 4013 - DNA, 25 bp, Homo sapien
aaattagcttcaaaactttacatga

SEQ ID NO: 4014 - DNA, 25 bp, Homo sapien
aaattaggactcatttatctattta

SEQ ID NO: 4015 - DNA, 25 bp, Homo sapien
aaattaggactcatttgtctattta

SEQ ID NO: 4016 - DNA, 25 bp, Homo sapien
aaattagtaaaaaaaatagtgtgtc

SEQ ID NO: 4017 - DNA, 25 bp, Homo sapien
aaattagtaaaacaaatagtgtgtc

SEQ ID NO: 4018 - DNA, 25 bp, Homo sapien
aaattatacctttgtgaatacataa

SEQ ID NO: 4019 - DNA, 25 bp, Homo sapien
aaattataggcctgatttctcctta

SEQ ID NO: 4020 - DNA, 25 bp, Homo sapien
aaattatagtcctgatttctcctta

SEQ ID NO: 4021 - DNA, 25 bp, Homo sapien
aaattatatctttgtgaatacataa

SEQ ID NO: 4022 - DNA, 25 bp, Homo sapien
aaattatcacacacttagcagatga

SEQ ID NO: 4023 - DNA, 25 bp, Homo sapien
aaattatcacacatttagcagatga

SEQ ID NO: 4024 - DNA, 25 bp, Homo sapien
aaattatctgcacgatggaaacgtc

SEQ ID NO: 4025 - DNA, 25 bp, Homo sapien
aaattatctgcatgatggaaacgtc

SEQ ID NO: 4026 - DNA, 25 bp, Homo sapien
aaattatgatttcggttagtaatgt

SEQ ID NO: 4027 - DNA, 25 bp, Homo sapien
aaattatgattttggttagtaatgt

SEQ ID NO: 4028 - DNA, 25 bp, Homo sapien
aaattatgtacgcacgagataaaac

SEQ ID NO: 4029 - DNA, 25 bp, Homo sapien
aaattatgtacgcatgagataaaac

SEQ ID NO: 4030 - DNA, 25 bp, Homo sapien
aaattatgtatagttcctgacttct

SEQ ID NO: 4031 - DNA, 25 bp, Homo sapien
aaattatgtgtagttcctgacttct

SEQ ID NO: 4032 - DNA, 25 bp, Homo sapien
aaattattcgtcattggcagagcgc

SEQ ID NO: 4033 - DNA, 25 bp, Homo sapien
aaattattctcaagcctatatccca

SEQ ID NO: 4034 - DNA, 25 bp, Homo sapien
aaattattctcaaggctatatccca

SEQ ID NO: 4035 - DNA, 25 bp, Homo sapien
aaattattctgcatcttgcattccc

SEQ ID NO: 4036 - DNA, 25 bp, Homo sapien
aaattattctgtatcttgcattccc

SEQ ID NO: 4037 - DNA, 25 bp, Homo sapien
aaattattgatgagtaaagagaaat

SEQ ID NO: 4038 - DNA, 25 bp, Homo sapien
aaattattggtgagtaaagagaaat

SEQ ID NO: 4039 - DNA, 25 bp, Homo sapien
aaattattgttttcattagctttat

SEQ ID NO: 4040 - DNA, 25 bp, Homo sapien
aaattatttgtcattggcagagcgc

SEQ ID NO: 4041 - DNA, 25 bp, Homo sapien
aaattatttttttcattagctttat

SEQ ID NO: 4042 - DNA, 25 bp, Homo sapien
aaattcaaaaatcagtcgggtgcag

SEQ ID NO: 4043 - DNA, 25 bp, Homo sapien
aaattcaaaaattagtcgggtgcag

SEQ ID NO: 4044 - DNA, 25 bp, Homo sapien
aaattcaaagacacggaggtatcag

SEQ ID NO: 4045 - DNA, 25 bp, Homo sapien
aaattcaaagacacggcggtatcag

SEQ ID NO: 4046 - DNA, 25 bp, Homo sapien
aaattcaacaggtgaaattagcatg

SEQ ID NO: 4047 - DNA, 25 bp, Homo sapien
aaattcaagaggtgaaattagcatg

SEQ ID NO: 4048 - DNA, 25 bp, Homo sapien
aaattcaattgtttaaagagcaaaa

SEQ ID NO: 4049 - DNA, 25 bp, Homo sapien
aaattcaattgtttcaagagcaaaa

SEQ ID NO: 4050 - DNA, 25 bp, Homo sapien
aaattcacaaggaaatgtaaaggac

SEQ ID NO: 4051 - DNA, 25 bp, Homo sapien
aaattcacacggaaatgtaaaggac

SEQ ID NO: 4052 - DNA, 25 bp, Homo sapien
aaattcaccatatagttgaaggatg

SEQ ID NO: 4053 - DNA, 25 bp, Homo sapien
aaattcaccgtatagttgaaggatg

SEQ ID NO: 4054 - DNA, 25 bp, Homo sapien
aaattcagcccagatgcggagtcac

SEQ ID NO: 4055 - DNA, 25 bp, Homo sapien
aaattcagcccagatgtggagtcac

SEQ ID NO: 4056 - DNA, 25 bp, Homo sapien
aaattcataacacacaaatgtaagg

SEQ ID NO: 4057 - DNA, 25 bp, Homo sapien
aaattcataacacgcaaatgtaagg

SEQ ID NO: 4058 - DNA, 25 bp, Homo sapien
aaattcatatgtactcattgcaaca

SEQ ID NO: 4059 - DNA, 25 bp, Homo sapien
aaattcatatgtactcgttgcaaca

SEQ ID NO: 4060 - DNA, 25 bp, Homo sapien
aaattcatcgccatatccaggctcc

SEQ ID NO: 4061 - DNA, 25 bp, Homo sapien
aaattcatcgccatgtccaggctcc

SEQ ID NO: 4062 - DNA, 25 bp, Homo sapien
aaattccacattaattcttagatct

SEQ ID NO: 4063 - DNA, 25 bp, Homo sapien
aaattccacgttaattcttagatct

SEQ ID NO: 4064 - DNA, 25 bp, Homo sapien
aaattccagaatggttccctaagat

SEQ ID NO: 4065 - DNA, 25 bp, Homo sapien
aaattccagaattgttccctaagat

SEQ ID NO: 4066 - DNA, 25 bp, Homo sapien
aaattcccatgcaaactcagatcta

SEQ ID NO: 4067 - DNA, 25 bp, Homo sapien
aaattcccatgcaacctcagatcta

SEQ ID NO: 4068 - DNA, 25 bp, Homo sapien
aaattcctaaatcatgatcccagtg

SEQ ID NO: 4069 - DNA, 25 bp, Homo sapien
aaattcctaaattatgatcccagtg

SEQ ID NO: 4070 - DNA, 25 bp, Homo sapien
aaattctaatagtgaaaatatgact

SEQ ID NO: 4071 - DNA, 25 bp, Homo sapien
aaattctaatagtggaaatatgact

SEQ ID NO: 4072 - DNA, 25 bp, Homo sapien
aaattctacaactagacctggttgg

SEQ ID NO: 4073 - DNA, 25 bp, Homo sapien
aaattctacaactagagctggttgg

SEQ ID NO: 4074 - DNA, 25 bp, Homo sapien
aaattctacggcacatcagtctgtg

SEQ ID NO: 4075 - DNA, 25 bp, Homo sapien
aaattctactgactttttcctaccc

SEQ ID NO: 4076 - DNA, 25 bp, Homo sapien
aaattctactgattttttcctaccc

SEQ ID NO: 4077 - DNA, 25 bp, Homo sapien
aaattctatggcacatcagtctgtg

SEQ ID NO: 4078 - DNA, 25 bp, Homo sapien
aaattctatgttgccatactcccat

SEQ ID NO: 4079 - DNA, 25 bp, Homo sapien
aaattctatgttgtcatactcccat

SEQ ID NO: 4080 - DNA, 25 bp, Homo sapien
aaattctcaactccataaaagtagt

SEQ ID NO: 4081 - DNA, 25 bp, Homo sapien
aaattctcaactccgtaaaagtagt

SEQ ID NO: 4082 - DNA, 25 bp, Homo sapien
aaattctcagccaaagaccctacac

SEQ ID NO: 4083 - DNA, 25 bp, Homo sapien
aaattctcattaaagtcaagactaa

SEQ ID NO: 4084 - DNA, 25 bp, Homo sapien
aaattctcattacagtcaagactaa

SEQ ID NO: 4085 - DNA, 25 bp, Homo sapien
aaattctcggccaaagaccctacac

SEQ ID NO: 4086 - DNA, 25 bp, Homo sapien
aaattctgacaatgcaagttcaaaa

SEQ ID NO: 4087 - DNA, 25 bp, Homo sapien
aaattctgacaggccttgtgttgtg

SEQ ID NO: 4088 - DNA, 25 bp, Homo sapien
aaattctgacaggtcttgtgttgtg

SEQ ID NO: 4089 - DNA, 25 bp, Homo sapien
aaattctgacagtgcaagttcaaaa

SEQ ID NO: 4090 - DNA, 25 bp, Homo sapien
aaattctgcctgacaaaggactcat

SEQ ID NO: 4091 - DNA, 25 bp, Homo sapien
aaattctgcctgaccaaggactcat

SEQ ID NO: 4092 - DNA, 25 bp, Homo sapien
aaattctgcttcaatgaaagtgagc

SEQ ID NO: 4093 - DNA, 25 bp, Homo sapien
aaattctgcttccatgaaagtgagc

SEQ ID NO: 4094 - DNA, 25 bp, Homo sapien
aaattcttaccaaactagagagaga

SEQ ID NO: 4095 - DNA, 25 bp, Homo sapien
aaattcttaccacactagagagaga

SEQ ID NO: 4096 - DNA, 25 bp, Homo sapien
aaattcttagccagtattatttcaa

SEQ ID NO: 4097 - DNA, 25 bp, Homo sapien
aaattcttagccattattatttcaa

SEQ ID NO: 4098 - DNA, 25 bp, Homo sapien
aaattctttctgttcctcaagacta

SEQ ID NO: 4099 - DNA, 25 bp, Homo sapien
aaattctttttgttcctcaagacta

SEQ ID NO: 4100 - DNA, 25 bp, Homo sapien
aaattgaacttacgcaaagcttcat

SEQ ID NO: 4101 - DNA, 25 bp, Homo sapien
aaattgaacttatgcaaagcttcat

SEQ ID NO: 4102 - DNA, 25 bp, Homo sapien
aaattgaatgatatattttcacatc

SEQ ID NO: 4103 - DNA, 25 bp, Homo sapien
aaattgaatgatgtattttcacatc

SEQ ID NO: 4104 - DNA, 25 bp, Homo sapien
aaattgaatgttcaatcactaacaa

SEQ ID NO: 4105 - DNA, 25 bp, Homo sapien
aaattgaatgttcagtcactaacaa

SEQ ID NO: 4106 - DNA, 25 bp, Homo sapien
aaattgaccacatacttaaccataa

SEQ ID NO: 4107 - DNA, 25 bp, Homo sapien
aaattgaccacatgcttaaccataa

SEQ ID NO: 4108 - DNA, 25 bp, Homo sapien
aaattgacccttgagcgattagacc

SEQ ID NO: 4109 - DNA, 25 bp, Homo sapien
aaattgacgcttgagcgattagacc

SEQ ID NO: 4110 - DNA, 25 bp, Homo sapien
aaattgactatggtaggagaattta

SEQ ID NO: 4111 - DNA, 25 bp, Homo sapien
aaattgactctggtaggagaattta

SEQ ID NO: 4112 - DNA, 25 bp, Homo sapien
aaattgaggactgcgtatcaacaaa

SEQ ID NO: 4113 - DNA, 25 bp, Homo sapien
aaattgaggactgtgtatcaacaaa

SEQ ID NO: 4114 - DNA, 25 bp, Homo sapien
aaattgaggatgcctaatgggtaac

SEQ ID NO: 4115 - DNA, 25 bp, Homo sapien
aaattgaggatggctaatgggtaac

SEQ ID NO: 4116 - DNA, 25 bp, Homo sapien
aaattgagtctgaattaatttctgc

SEQ ID NO: 4117 - DNA, 25 bp, Homo sapien
aaattgagtttgaattaatttctgc

SEQ ID NO: 4118 - DNA, 25 bp, Homo sapien
aaattgatatgcagatgaattatcc

SEQ ID NO: 4119 - DNA, 25 bp, Homo sapien
aaattgatatgcggatgaattatcc

SEQ ID NO: 4120 - DNA, 25 bp, Homo sapien
aaattgcacaaaatatcaaaataca

SEQ ID NO: 4121 - DNA, 25 bp, Homo sapien
aaattgcacgaaatatcaaaataca

SEQ ID NO: 4122 - DNA, 25 bp, Homo sapien
aaattgcacttttagacccaacact

SEQ ID NO: 4123 - DNA, 25 bp, Homo sapien
aaattgcacttttagatccaacact

SEQ ID NO: 4124 - DNA, 25 bp, Homo sapien
aaattgcagccacattccaggaagt

SEQ ID NO: 4125 - DNA, 25 bp, Homo sapien
aaattgcagccatattccaggaagt

SEQ ID NO: 4126 - DNA, 25 bp, Homo sapien
aaattgccatctgaaaaactaaaac

SEQ ID NO: 4127 - DNA, 25 bp, Homo sapien
aaattgccatcttaaaaactaaaac

SEQ ID NO: 4128 - DNA, 25 bp, Homo sapien
aaattgccatgtctttgaaaagtct

SEQ ID NO: 4129 - DNA, 25 bp, Homo sapien
aaattgccgtgtctttgaaaagtct

SEQ ID NO: 4130 - DNA, 25 bp, Homo sapien
aaattgcctcaagcatgctgaactt

SEQ ID NO: 4131 - DNA, 25 bp, Homo sapien
aaattgcctcaagcattctgaactt

SEQ ID NO: 4132 - DNA, 25 bp, Homo sapien
aaattgctctgtctatcggtctcac

SEQ ID NO: 4133 - DNA, 25 bp, Homo sapien
aaattgctctgtctatgggtctcac

SEQ ID NO: 4134 - DNA, 25 bp, Homo sapien
aaattgctgcaggtagagactacat

SEQ ID NO: 4135 - DNA, 25 bp, Homo sapien
aaattgctgcaggtggagactacat

SEQ ID NO: 4136 - DNA, 25 bp, Homo sapien
aaattgctgcgattacagttgtgag

SEQ ID NO: 4137 - DNA, 25 bp, Homo sapien
aaattgctgtgattacagttgtgag

SEQ ID NO: 4138 - DNA, 25 bp, Homo sapien
aaattggaaagacattccatgaaca

SEQ ID NO: 4139 - DNA, 25 bp, Homo sapien
aaattggaaagacatttcatgaaca

SEQ ID NO: 4140 - DNA, 25 bp, Homo sapien
aaattggcacttatgaaagtggagc

SEQ ID NO: 4141 - DNA, 25 bp, Homo sapien
aaattggcacttgtgaaagtggagc

SEQ ID NO: 4142 - DNA, 25 bp, Homo sapien
aaattgggaatgcagacaactagca

SEQ ID NO: 4143 - DNA, 25 bp, Homo sapien
aaattgggaatgtagacaactagca

SEQ ID NO: 4144 - DNA, 25 bp, Homo sapien
aaattgggatcatcaaaggagagaa

SEQ ID NO: 4145 - DNA, 25 bp, Homo sapien
aaattgggatcattaaaggagagaa

SEQ ID NO: 4146 - DNA, 25 bp, Homo sapien
aaattgggtcgctgaaaacaataga

SEQ ID NO: 4147 - DNA, 25 bp, Homo sapien
aaattgggtggctgaaaacaataga

SEQ ID NO: 4148 - DNA, 25 bp, Homo sapien
aaattggttgtcttatttcatctag

SEQ ID NO: 4149 - DNA, 25 bp, Homo sapien
aaattggttgttttatttcatctag

SEQ ID NO: 4150 - DNA, 25 bp, Homo sapien
aaattgtagcgccttctaaaaaaac

SEQ ID NO: 4151 - DNA, 25 bp, Homo sapien
aaattgtagtgccttctaaaaaaac

SEQ ID NO: 4152 - DNA, 25 bp, Homo sapien
aaattgtatggatttaatgtaagtc

SEQ ID NO: 4153 - DNA, 25 bp, Homo sapien
aaattgtatggatttagtgtaagtc

SEQ ID NO: 4154 - DNA, 25 bp, Homo sapien
aaattgtccagacttggctaaagaa

SEQ ID NO: 4155 - DNA, 25 bp, Homo sapien
aaattgtccagatttggctaaagaa

SEQ ID NO: 4156 - DNA, 25 bp, Homo sapien
aaattgtgaaatttgggcaagtctt

SEQ ID NO: 4157 - DNA, 25 bp, Homo sapien
aaattgtgcgaaattaatattggca

SEQ ID NO: 4158 - DNA, 25 bp, Homo sapien
aaattgtggaatttgggcaagtctt

SEQ ID NO: 4159 - DNA, 25 bp, Homo sapien
aaattgtggagctgagtaataccct

SEQ ID NO: 4160 - DNA, 25 bp, Homo sapien
aaattgtggagctgggtaataccct

SEQ ID NO: 4161 - DNA, 25 bp, Homo sapien
aaattgtgtaatagcacccctagca

SEQ ID NO: 4162 - DNA, 25 bp, Homo sapien
aaattgtgtaatagcatccctagca

SEQ ID NO: 4163 - DNA, 25 bp, Homo sapien
aaattgtgtgaaattaatattggca

SEQ ID NO: 4164 - DNA, 25 bp, Homo sapien
aaattgttttccacagcggctatgc

SEQ ID NO: 4165 - DNA, 25 bp, Homo sapien
aaattgttttccacagtggctatgc

SEQ ID NO: 4166 - DNA, 25 bp, Homo sapien
aaatttaaaaaaacattctagtctc

SEQ ID NO: 4167 - DNA, 25 bp, Homo sapien
aaatttaaaaaccatagcgacacta

SEQ ID NO: 4168 - DNA, 25 bp, Homo sapien
aaatttaaaaagcatagcgacacta

SEQ ID NO: 4169 - DNA, 25 bp, Homo sapien
aaatttaagaaaacattctagtctc

SEQ ID NO: 4170 - DNA, 25 bp, Homo sapien
aaatttaagtggtacatcagtgacc

SEQ ID NO: 4171 - DNA, 25 bp, Homo sapien
aaatttaagtggtatatcagtgacc

SEQ ID NO: 4172 - DNA, 25 bp, Homo sapien
aaatttaccaacttctaggccatga

SEQ ID NO: 4173 - DNA, 25 bp, Homo sapien
aaatttaccctgcatcattttgcat

SEQ ID NO: 4174 - DNA, 25 bp, Homo sapien
aaatttaccctgcgtcattttgcat

SEQ ID NO: 4175 - DNA, 25 bp, Homo sapien
aaatttaccgacttctaggccatga

SEQ ID NO: 4176 - DNA, 25 bp, Homo sapien
aaatttactagatccatctaattct

SEQ ID NO: 4177 - DNA, 25 bp, Homo sapien
aaatttactagattcatctaattct

SEQ ID NO: 4178 - DNA, 25 bp, Homo sapien
aaatttagccgagaacttctagaat

SEQ ID NO: 4179 - DNA, 25 bp, Homo sapien
aaatttagctgagaacttctagaat

SEQ ID NO: 4180 - DNA, 25 bp, Homo sapien
aaatttattaccacaaacctccagt

SEQ ID NO: 4181 - DNA, 25 bp, Homo sapien
aaatttattaccgcaaacctccagt

SEQ ID NO: 4182 - DNA, 25 bp, Homo sapien
aaatttattctgcttaatgggtcgc

SEQ ID NO: 4183 - DNA, 25 bp, Homo sapien
aaatttattctgtttaatgggtcgc

SEQ ID NO: 4184 - DNA, 25 bp, Homo sapien
aaatttccatacatgtcaaacaaat

SEQ ID NO: 4185 - DNA, 25 bp, Homo sapien
aaatttccatacgtgtcaaacaaat

SEQ ID NO: 4186 - DNA, 25 bp, Homo sapien
aaatttcctctgtagcttgtaaagg

SEQ ID NO: 4187 - DNA, 25 bp, Homo sapien
aaatttcctggagccacctctgggc

SEQ ID NO: 4188 - DNA, 25 bp, Homo sapien
aaatttcctggaggcacctctgggc

SEQ ID NO: 4189 - DNA, 25 bp, Homo sapien
aaatttcctgggcgatagaagcatc

SEQ ID NO: 4190 - DNA, 25 bp, Homo sapien
aaatttcctgggtgatagaagcatc

SEQ ID NO: 4191 - DNA, 25 bp, Homo sapien
aaatttcctttgtagcttgtaaagg

SEQ ID NO: 4192 - DNA, 25 bp, Homo sapien
aaatttctatagccaagtagtagga

SEQ ID NO: 4193 - DNA, 25 bp, Homo sapien
aaatttctataggcaagtagtagga

SEQ ID NO: 4194 - DNA, 25 bp, Homo sapien
aaatttctcagcccagaactgacac

SEQ ID NO: 4195 - DNA, 25 bp, Homo sapien
aaatttctcagtccagaactgacac

SEQ ID NO: 4196 - DNA, 25 bp, Homo sapien
aaatttctctcctaaacgctggtat

SEQ ID NO: 4197 - DNA, 25 bp, Homo sapien
aaatttctctcttaaacgctggtat

SEQ ID NO: 4198 - DNA, 25 bp, Homo sapien
aaatttcttgaactttatacttaaa

SEQ ID NO: 4199 - DNA, 25 bp, Homo sapien
aaatttcttgagctttatacttaaa

SEQ ID NO: 4200 - DNA, 25 bp, Homo sapien
aaatttgaagagctaggcaaattat

SEQ ID NO: 4201 - DNA, 25 bp, Homo sapien
aaatttgaagagttaggcaaattat

SEQ ID NO: 4202 - DNA, 25 bp, Homo sapien
aaatttgatggaagagaattgtccc

SEQ ID NO: 4203 - DNA, 25 bp, Homo sapien
aaatttgatggaagtgaattgtccc

SEQ ID NO: 4204 - DNA, 25 bp, Homo sapien
aaatttgccagcctttttcacttct

SEQ ID NO: 4205 - DNA, 25 bp, Homo sapien
aaatttgccagtctttttcacttct

SEQ ID NO: 4206 - DNA, 25 bp, Homo sapien
aaatttgctgatactttcttccgcc

SEQ ID NO: 4207 - DNA, 25 bp, Homo sapien
aaatttgctgatattttcttccgcc

SEQ ID NO: 4208 - DNA, 25 bp, Homo sapien
aaatttggagaatgcaaaaaaatca

SEQ ID NO: 4209 - DNA, 25 bp, Homo sapien
aaatttggagaatgcagaaaaatca

SEQ ID NO: 4210 - DNA, 25 bp, Homo sapien
aaatttggccttcaatattagaggt

SEQ ID NO: 4211 - DNA, 25 bp, Homo sapien
aaatttggcggacataggcaaaata

SEQ ID NO: 4212 - DNA, 25 bp, Homo sapien
aaatttggtcttcaatattagaggt

SEQ ID NO: 4213 - DNA, 25 bp, Homo sapien
aaatttggtggacataggcaaaata

SEQ ID NO: 4214 - DNA, 25 bp, Homo sapien
aaatttgtagacgtgaactgcatca

SEQ ID NO: 4215 - DNA, 25 bp, Homo sapien
aaatttgtagatgtgaactgcatca

SEQ ID NO: 4216 - DNA, 25 bp, Homo sapien
aaatttgtcgtagtctggaactatt

SEQ ID NO: 4217 - DNA, 25 bp, Homo sapien
aaatttgtcgtcgtctggaactatt

SEQ ID NO: 4218 - DNA, 25 bp, Homo sapien
aaatttgtctaatgggaatctctcc

SEQ ID NO: 4219 - DNA, 25 bp, Homo sapien
aaatttgttatacgcacaattctat

SEQ ID NO: 4220 - DNA, 25 bp, Homo sapien
aaatttgttatatgcacaattctat

SEQ ID NO: 4221 - DNA, 25 bp, Homo sapien
aaatttgttctcaccacaggcatct

SEQ ID NO: 4222 - DNA, 25 bp, Homo sapien
aaatttgttctgaccacaggcatct

SEQ ID NO: 4223 - DNA, 25 bp, Homo sapien
aaatttgtttaatgggaatctctcc

SEQ ID NO: 4224 - DNA, 25 bp, Homo sapien
aaatttgtttccaattctccagcat

SEQ ID NO: 4225 - DNA, 25 bp, Homo sapien
aaatttgtttccagttctccagcat

SEQ ID NO: 4226 - DNA, 25 bp, Homo sapien
aaattttatctcctttgagcaacat

SEQ ID NO: 4227 - DNA, 25 bp, Homo sapien
aaattttatctgctttgagcaacat

SEQ ID NO: 4228 - DNA, 25 bp, Homo sapien
aaattttgacacagagctacataca

SEQ ID NO: 4229 - DNA, 25 bp, Homo sapien
aaattttgacacggagctacataca

SEQ ID NO: 4230 - DNA, 25 bp, Homo sapien
aaattttgcaggcatactggaggaa

SEQ ID NO: 4231 - DNA, 25 bp, Homo sapien
aaattttgcagtcatactggaggaa

SEQ ID NO: 4232 - DNA, 25 bp, Homo sapien
aaattttgcccaaatgttatcagta

SEQ ID NO: 4233 - DNA, 25 bp, Homo sapien
aaattttgcccagatgttatcagta

SEQ ID NO: 4234 - DNA, 25 bp, Homo sapien
aaattttgtgtcacgtaaagtgcta

SEQ ID NO: 4235 - DNA, 25 bp, Homo sapien
aaattttgtgtcatgtaaagtgcta

SEQ ID NO: 4236 - DNA, 25 bp, Homo sapien
aacaaaaaaaaaaagggaatgagga

SEQ ID NO: 4237 - DNA, 25 bp, Homo sapien
aacaaaaaaaaaaggggaatgagga

SEQ ID NO: 4238 - DNA, 25 bp, Homo sapien
aacaaaaaagggctgcctttccatc

SEQ ID NO: 4239 - DNA, 25 bp, Homo sapien
aacaaaaacagagaaaaggcaaata

SEQ ID NO: 4240 - DNA, 25 bp, Homo sapien
aacaaaaaccagcgttagagtaaaa

SEQ ID NO: 4241 - DNA, 25 bp, Homo sapien
aacaaaaaccagctttagagtaaaa

SEQ ID NO: 4242 - DNA, 25 bp, Homo sapien
aacaaaaaggggctgcctttccatc

SEQ ID NO: 4243 - DNA, 25 bp, Homo sapien
aacaaaaatagagaaaaggcaaata

SEQ ID NO: 4244 - DNA, 25 bp, Homo sapien
aacaaaaatctgagccttgcatatt

SEQ ID NO: 4245 - DNA, 25 bp, Homo sapien
aacaaaaatctgagtcttgcatatt

SEQ ID NO: 4246 - DNA, 25 bp, Homo sapien
aacaaaaatgcaaatactatcatcg

SEQ ID NO: 4247 - DNA, 25 bp, Homo sapien
aacaaaaatgcaaatattatcatcg

SEQ ID NO: 4248 - DNA, 25 bp, Homo sapien
aacaaaaattgtaaaatgcaaggga

SEQ ID NO: 4249 - DNA, 25 bp, Homo sapien
aacaaaaattgtagaatgcaaggga

SEQ ID NO: 4250 - DNA, 25 bp, Homo sapien
aacaaaacactcttaacaagcttga

SEQ ID NO: 4251 - DNA, 25 bp, Homo sapien
aacaaaacactcttaataagcttga

SEQ ID NO: 4252 - DNA, 25 bp, Homo sapien
aacaaaaccgatagctgagtgttcg

SEQ ID NO: 4253 - DNA, 25 bp, Homo sapien
aacaaaactgaacaggaactcaagt

SEQ ID NO: 4254 - DNA, 25 bp, Homo sapien
aacaaaactgaataggaactcaagt

SEQ ID NO: 4255 - DNA, 25 bp, Homo sapien
aacaaaactgatagctgagtgttcg

SEQ ID NO: 4256 - DNA, 25 bp, Homo sapien
aacaaaacttcataacaccttggaa

SEQ ID NO: 4257 - DNA, 25 bp, Homo sapien
aacaaaacttcctaacaccttggaa

SEQ ID NO: 4258 - DNA, 25 bp, Homo sapien
aacaaaagacgacacaacccaaaag

SEQ ID NO: 4259 - DNA, 25 bp, Homo sapien
aacaaaagatgacacaacccaaaag

SEQ ID NO: 4260 - DNA, 25 bp, Homo sapien
aacaaaagctgcaacataaccatat

SEQ ID NO: 4261 - DNA, 25 bp, Homo sapien
aacaaaagctgcaatataaccatat

SEQ ID NO: 4262 - DNA, 25 bp, Homo sapien
aacaaaagtccagtcaagtcacttg

SEQ ID NO: 4263 - DNA, 25 bp, Homo sapien
aacaaaagtccggtcaagtcacttg

SEQ ID NO: 4264 - DNA, 25 bp, Homo sapien
aacaaaatactcgaaaattgcattt

SEQ ID NO: 4265 - DNA, 25 bp, Homo sapien
aacaaaatacttgaaaattgcattt

SEQ ID NO: 4266 - DNA, 25 bp, Homo sapien
aacaaaatcaaaacgttgaaattta

SEQ ID NO: 4267 - DNA, 25 bp, Homo sapien
aacaaaatcaagacgttgaaattta

SEQ ID NO: 4268 - DNA, 25 bp, Homo sapien
aacaaaatcattcaagcccatgaat

SEQ ID NO: 4269 - DNA, 25 bp, Homo sapien
aacaaaatccacagatgttcaagcc

SEQ ID NO: 4270 - DNA, 25 bp, Homo sapien
aacaaaatccacggatgttcaagcc

SEQ ID NO: 4271 - DNA, 25 bp, Homo sapien
aacaaaatcgttcaagcccatgaat

SEQ ID NO: 4272 - DNA, 25 bp, Homo sapien
aacaaaatggcaccgagagaaccat

SEQ ID NO: 4273 - DNA, 25 bp, Homo sapien
aacaaaatggcactgagagaaccat

SEQ ID NO: 4274 - DNA, 25 bp, Homo sapien
aacaaaattaaccctgtgtgtattg

SEQ ID NO: 4275 - DNA, 25 bp, Homo sapien
aacaaaattaactctgtgtgtattg

SEQ ID NO: 4276 - DNA, 25 bp, Homo sapien
aacaaacaaaggacatcgaaacaaa

SEQ ID NO: 4277 - DNA, 25 bp, Homo sapien
aacaaacaaatgcaattacatcagg

SEQ ID NO: 4278 - DNA, 25 bp, Homo sapien
aacaaacaaatggaattacatcagg

SEQ ID NO: 4279 - DNA, 25 bp, Homo sapien
aacaaacaacaagagctgcaactga

SEQ ID NO: 4280 - DNA, 25 bp, Homo sapien
aacaaacaacggacatcgaaacaaa

SEQ ID NO: 4281 - DNA, 25 bp, Homo sapien
aacaaacacaagtacaactaattgc

SEQ ID NO: 4282 - DNA, 25 bp, Homo sapien
aacaaacaccagtacaactaattgc

SEQ ID NO: 4283 - DNA, 25 bp, Homo sapien
aacaaacagatcttgcaagcactca

SEQ ID NO: 4284 - DNA, 25 bp, Homo sapien
aacaaacagatcttgcgagcactca

SEQ ID NO: 4285 - DNA, 25 bp, Homo sapien
aacaaacagcaagagctgcaactga

SEQ ID NO: 4286 - DNA, 25 bp, Homo sapien
aacaaacatgaataaaacctagtaa

SEQ ID NO: 4287 - DNA, 25 bp, Homo sapien
aacaaacatgaatgaaacctagtaa

SEQ ID NO: 4288 - DNA, 25 bp, Homo sapien
aacaaacctcaaattttcaaagttg

SEQ ID NO: 4289 - DNA, 25 bp, Homo sapien
aacaaacctcatattttcaaagttg

SEQ ID NO: 4290 - DNA, 25 bp, Homo sapien
aacaaacttaacatacagtaagcaa

SEQ ID NO: 4291 - DNA, 25 bp, Homo sapien
aacaaacttaacatacggtaagcaa

SEQ ID NO: 4292 - DNA, 25 bp, Homo sapien
aacaaagagtttgcagtttgctcct

SEQ ID NO: 4293 - DNA, 25 bp, Homo sapien
aacaaagagtttgccgtttgctcct

SEQ ID NO: 4294 - DNA, 25 bp, Homo sapien
aacaaagatgaaacaagaatgaaaa

SEQ ID NO: 4295 - DNA, 25 bp, Homo sapien
aacaaagatgaagcaagaatgaaaa

SEQ ID NO: 4296 - DNA, 25 bp, Homo sapien
aacaaaggaacagagacagtcaaag

SEQ ID NO: 4297 - DNA, 25 bp, Homo sapien
aacaaaggaaccgagacagtcaaag

SEQ ID NO: 4298 - DNA, 25 bp, Homo sapien
aacaaaggttctaaagtacgaaaag

SEQ ID NO: 4299 - DNA, 25 bp, Homo sapien
aacaaaggttctaaggtacgaaaag

SEQ ID NO: 4300 - DNA, 25 bp, Homo sapien
aacaaagtgcgaagttcagaagttc

SEQ ID NO: 4301 - DNA, 25 bp, Homo sapien
aacaaagtgtgaagttcagaagttc

SEQ ID NO: 4302 - DNA, 25 bp, Homo sapien
aacaaagtttcagcatcacttatct

SEQ ID NO: 4303 - DNA, 25 bp, Homo sapien
aacaaagtttcggcatcacttatct

SEQ ID NO: 4304 - DNA, 25 bp, Homo sapien
aacaaataaatcaccaatgaataca

SEQ ID NO: 4305 - DNA, 25 bp, Homo sapien
aacaaataaatcaccagtgaataca

SEQ ID NO: 4306 - DNA, 25 bp, Homo sapien
aacaaatacgaaatcttaacaaaga

SEQ ID NO: 4307 - DNA, 25 bp, Homo sapien
aacaaatactaaatcttaacaaaga

SEQ ID NO: 4308 - DNA, 25 bp, Homo sapien
aacaaatcaaacggtttattcctag

SEQ ID NO: 4309 - DNA, 25 bp, Homo sapien
aacaaatcaaatggtttattcctag

SEQ ID NO: 4310 - DNA, 25 bp, Homo sapien
aacaaatcagatcaaaacctgaaat

SEQ ID NO: 4311 - DNA, 25 bp, Homo sapien
aacaaatcagatcaaagcctgaaat

SEQ ID NO: 4312 - DNA, 25 bp, Homo sapien
aacaaatcagtaactaccactctca

SEQ ID NO: 4313 - DNA, 25 bp, Homo sapien
aacaaatctcaaggagaataaattg

SEQ ID NO: 4314 - DNA, 25 bp, Homo sapien
aacaaatctcaaggagtataaattg

SEQ ID NO: 4315 - DNA, 25 bp, Homo sapien
aacaaatctgtaactaccactctca

SEQ ID NO: 4316 - DNA, 25 bp, Homo sapien
aacaaatgaaaaatatgtttcccag

SEQ ID NO: 4317 - DNA, 25 bp, Homo sapien
aacaaatgaccggggaccaaccacc

SEQ ID NO: 4318 - DNA, 25 bp, Homo sapien
aacaaatgaccggtgaccaaccacc

SEQ ID NO: 4319 - DNA, 25 bp, Homo sapien
aacaaatgcaattacatcaggttaa

SEQ ID NO: 4320 - DNA, 25 bp, Homo sapien
aacaaatgcagcgaaatgttaattg

SEQ ID NO: 4321 - DNA, 25 bp, Homo sapien
aacaaatgcagtgaaatgttaattg

SEQ ID NO: 4322 - DNA, 25 bp, Homo sapien
aacaaatggaaaaaaagacactttg

SEQ ID NO: 4323 - DNA, 25 bp, Homo sapien
aacaaatggaaaatatgtttcccag

SEQ ID NO: 4324 - DNA, 25 bp, Homo sapien
aacaaatggaaacaaagacactttg

SEQ ID NO: 4325 - DNA, 25 bp, Homo sapien
aacaaatggaattacatcaggttaa

SEQ ID NO: 4326 - DNA, 25 bp, Homo sapien
aacaaattcgtgaacaatgtggaac

SEQ ID NO: 4327 - DNA, 25 bp, Homo sapien
aacaaattcgtgcacaatgtggaac

SEQ ID NO: 4328 - DNA, 25 bp, Homo sapien
aacaacaaaaaagggctgcctttcc

SEQ ID NO: 4329 - DNA, 25 bp, Homo sapien
aacaacaaaaaggggctgcctttcc

SEQ ID NO: 4330 - DNA, 25 bp, Homo sapien
aacaacaacttctgagttaacaata

SEQ ID NO: 4331 - DNA, 25 bp, Homo sapien
aacaacaatactggaagctgcaaga

SEQ ID NO: 4332 - DNA, 25 bp, Homo sapien
aacaacaatcctggaagctgcaaga

SEQ ID NO: 4333 - DNA, 25 bp, Homo sapien
aacaacaatttctgagttaacaata

SEQ ID NO: 4334 - DNA, 25 bp, Homo sapien
aacaacacaaatgtactgtatttca

SEQ ID NO: 4335 - DNA, 25 bp, Homo sapien
aacaacacaaatttactgtatttca

SEQ ID NO: 4336 - DNA, 25 bp, Homo sapien
aacaacacaggacgaagagattaat

SEQ ID NO: 4337 - DNA, 25 bp, Homo sapien
aacaacacatgacgaagagattaat

SEQ ID NO: 4338 - DNA, 25 bp, Homo sapien
aacaacactttcccaatatccctgg

SEQ ID NO: 4339 - DNA, 25 bp, Homo sapien
aacaacactttcccgatatccctgg

SEQ ID NO: 4340 - DNA, 25 bp, Homo sapien
aacaacatcattgcctgggttgcag

SEQ ID NO: 4341 - DNA, 25 bp, Homo sapien
aacaacatcattgcttgggttgcag

SEQ ID NO: 4342 - DNA, 25 bp, Homo sapien
aacaaccaaagtttgaacaactaga

SEQ ID NO: 4343 - DNA, 25 bp, Homo sapien
aacaaccaatgtttgaacaactaga

SEQ ID NO: 4344 - DNA, 25 bp, Homo sapien
aacaaccagaccgttagaagtgttg

SEQ ID NO: 4345 - DNA, 25 bp, Homo sapien
aacaaccagactgttagaagtgttg

SEQ ID NO: 4346 - DNA, 25 bp, Homo sapien
aacaacccaacaggctgtgcgtgga

SEQ ID NO: 4347 - DNA, 25 bp, Homo sapien
aacaacccattcaagacaatcaact

SEQ ID NO: 4348 - DNA, 25 bp, Homo sapien
aacaacccgttcaagacaatcaact

SEQ ID NO: 4349 - DNA, 25 bp, Homo sapien
aacaaccctacaggctgtgcgtgga

SEQ ID NO: 4350 - DNA, 25 bp, Homo sapien
aacaaccctgcagctaagtagtatt

SEQ ID NO: 4351 - DNA, 25 bp, Homo sapien
aacaaccctgcagctaggtagtatt

SEQ ID NO: 4352 - DNA, 25 bp, Homo sapien
aacaacctttcttacaatagaacca

SEQ ID NO: 4353 - DNA, 25 bp, Homo sapien
aacaacctttcttacagtagaacca

SEQ ID NO: 4354 - DNA, 25 bp, Homo sapien
aacaactaaagtaggtgatccttcc

SEQ ID NO: 4355 - DNA, 25 bp, Homo sapien
aacaactaaggtaggtgatccttcc

SEQ ID NO: 4356 - DNA, 25 bp, Homo sapien
aacaactatgaacgatattgaggtg

SEQ ID NO: 4357 - DNA, 25 bp, Homo sapien
aacaactatgaacgatgttgaggtg

SEQ ID NO: 4358 - DNA, 25 bp, Homo sapien
aacaactggctacatggcctgaacg

SEQ ID NO: 4359 - DNA, 25 bp, Homo sapien
aacaactgggtacatggcctgaacg

SEQ ID NO: 4360 - DNA, 25 bp, Homo sapien
aacaactggtttaggaaaagctact

SEQ ID NO: 4361 - DNA, 25 bp, Homo sapien
aacaactggtttatgaaaagctact

SEQ ID NO: 4362 - DNA, 25 bp, Homo sapien
aacaagaaacattgtccatataggt

SEQ ID NO: 4363 - DNA, 25 bp, Homo sapien
aacaagaagcagtaaattacttttt

SEQ ID NO: 4364 - DNA, 25 bp, Homo sapien
aacaagaagcattaaattacttttt

SEQ ID NO: 4365 - DNA, 25 bp, Homo sapien
aacaagaatcattgtccatataggt

SEQ ID NO: 4366 - DNA, 25 bp, Homo sapien
aacaagatcaataaccagtgtgatg

SEQ ID NO: 4367 - DNA, 25 bp, Homo sapien
aacaagatcaatagccagtgtgatg

SEQ ID NO: 4368 - DNA, 25 bp, Homo sapien
aacaagatgtctgcacctgccctga

SEQ ID NO: 4369 - DNA, 25 bp, Homo sapien
aacaagatgtctggacctgccctga

SEQ ID NO: 4370 - DNA, 25 bp, Homo sapien
aacaagatgtggcacaatgggaatt

SEQ ID NO: 4371 - DNA, 25 bp, Homo sapien
aacaagatgtggcataatgggaatt

SEQ ID NO: 4372 - DNA, 25 bp, Homo sapien
aacaagcaaagcctcaagacatttg

SEQ ID NO: 4373 - DNA, 25 bp, Homo sapien
aacaagcaaagcctcaggacatttg

SEQ ID NO: 4374 - DNA, 25 bp, Homo sapien
aacaagcaaccaaaaaagcttctca

SEQ ID NO: 4375 - DNA, 25 bp, Homo sapien
aacaagcaaccacaaaagcttctca

SEQ ID NO: 4376 - DNA, 25 bp, Homo sapien
aacaagcaatctatcctacaattct

SEQ ID NO: 4377 - DNA, 25 bp, Homo sapien
aacaagcacgtacaaaggagaaggt

SEQ ID NO: 4378 - DNA, 25 bp, Homo sapien
aacaagcacttaacaaaattcaaca

SEQ ID NO: 4379 - DNA, 25 bp, Homo sapien
aacaagcacttaataaaattcaaca

SEQ ID NO: 4380 - DNA, 25 bp, Homo sapien
aacaagcagtctatcctacaattct

SEQ ID NO: 4381 - DNA, 25 bp, Homo sapien
aacaagcatgtacaaaggagaaggt

SEQ ID NO: 4382 - DNA, 25 bp, Homo sapien
aacaagccaagtgagtaagccaaga

SEQ ID NO: 4383 - DNA, 25 bp, Homo sapien
aacaagccgagtgagtaagccaaga

SEQ ID NO: 4384 - DNA, 25 bp, Homo sapien
aacaagcctacctactgatgctact

SEQ ID NO: 4385 - DNA, 25 bp, Homo sapien
aacaagcctgcacatatacctcttc

SEQ ID NO: 4386 - DNA, 25 bp, Homo sapien
aacaagcctgcacgtatacctcttc

SEQ ID NO: 4387 - DNA, 25 bp, Homo sapien
aacaagccttcctactgatgctact

SEQ ID NO: 4388 - DNA, 25 bp, Homo sapien
aacaagctaagttgcacttgaattt

SEQ ID NO: 4389 - DNA, 25 bp, Homo sapien
aacaagctaagttgcatttgaattt

SEQ ID NO: 4390 - DNA, 25 bp, Homo sapien
aacaagctgactcttggtaagcaca

SEQ ID NO: 4391 - DNA, 25 bp, Homo sapien
aacaagctgaggttcacaaagtttg

SEQ ID NO: 4392 - DNA, 25 bp, Homo sapien
aacaagctgaggttcagaaagtttg

SEQ ID NO: 4393 - DNA, 25 bp, Homo sapien
aacaagctggctcttggtaagcaca

SEQ ID NO: 4394 - DNA, 25 bp, Homo sapien
aacaaggaagataatcttttttaag

SEQ ID NO: 4395 - DNA, 25 bp, Homo sapien
aacaaggaagattatcttttttaag

SEQ ID NO: 4396 - DNA, 25 bp, Homo sapien
aacaaggaaggcatgagagacagcg

SEQ ID NO: 4397 - DNA, 25 bp, Homo sapien
aacaaggaaggcgtgagagacagcg

SEQ ID NO: 4398 - DNA, 25 bp, Homo sapien
aacaaggatgatgtaattttgtata

SEQ ID NO: 4399 - DNA, 25 bp, Homo sapien
aacaaggattatgtaattttgtata

SEQ ID NO: 4400 - DNA, 25 bp, Homo sapien
aacaaggattcctaaatctcaaaat

SEQ ID NO: 4401 - DNA, 25 bp, Homo sapien
aacaaggattcttaaatctcaaaat

SEQ ID NO: 4402 - DNA, 25 bp, Homo sapien
aacaagggtgaaaactagctactca

SEQ ID NO: 4403 - DNA, 25 bp, Homo sapien
aacaagggttaaaactagctactca

SEQ ID NO: 4404 - DNA, 25 bp, Homo sapien
aacaaggtcttcaacattttaacct

SEQ ID NO: 4405 - DNA, 25 bp, Homo sapien
aacaaggtcttcagcattttaacct

SEQ ID NO: 4406 - DNA, 25 bp, Homo sapien
aacaagtatagtttctaagccttta

SEQ ID NO: 4407 - DNA, 25 bp, Homo sapien
aacaagtatagtttttaagccttta

SEQ ID NO: 4408 - DNA, 25 bp, Homo sapien
aacaagtcaatttggtgattttgat

SEQ ID NO: 4409 - DNA, 25 bp, Homo sapien
aacaagtcagtttggtgattttgat

SEQ ID NO: 4410 - DNA, 25 bp, Homo sapien
aacaagttacgacaaagcagcaatg

SEQ ID NO: 4411 - DNA, 25 bp, Homo sapien
aacaagttatgacaaagcagcaatg

SEQ ID NO: 4412 - DNA, 25 bp, Homo sapien
aacaagttgtcaaaaattaacagta

SEQ ID NO: 4413 - DNA, 25 bp, Homo sapien
aacaagttgtcagaaattaacagta

SEQ ID NO: 4414 - DNA, 25 bp, Homo sapien
aacaataaacgcatctcttttcttt

SEQ ID NO: 4415 - DNA, 25 bp, Homo sapien
aacaataaatgcatctcttttcttt

SEQ ID NO: 4416 - DNA, 25 bp, Homo sapien
aacaataagactttacttagtgcat

SEQ ID NO: 4417 - DNA, 25 bp, Homo sapien
aacaataagcctttacttagtgcat

SEQ ID NO: 4418 - DNA, 25 bp, Homo sapien
aacaataagctgtagaacgaacatt

SEQ ID NO: 4419 - DNA, 25 bp, Homo sapien
aacaataagctgtggaacgaacatt

SEQ ID NO: 4420 - DNA, 25 bp, Homo sapien
aacaataatgagtgacatgcctttg

SEQ ID NO: 4421 - DNA, 25 bp, Homo sapien
aacaataatgagtggcatgcctttg

SEQ ID NO: 4422 - DNA, 25 bp, Homo sapien
aacaatacatacgaaatttttggaa

SEQ ID NO: 4423 - DNA, 25 bp, Homo sapien
aacaatacatatgaaatttttggaa

SEQ ID NO: 4424 - DNA, 25 bp, Homo sapien
aacaataccctttcagaggagactg

SEQ ID NO: 4425 - DNA, 25 bp, Homo sapien
aacaataccctttcggaggagactg

SEQ ID NO: 4426 - DNA, 25 bp, Homo sapien
aacaatacctaacagcttatctgtc

SEQ ID NO: 4427 - DNA, 25 bp, Homo sapien
aacaatacctaatagcttatctgtc

SEQ ID NO: 4428 - DNA, 25 bp, Homo sapien
aacaatagacctctttggggagcag

SEQ ID NO: 4429 - DNA, 25 bp, Homo sapien
aacaatagacctttttggggagcag

SEQ ID NO: 4430 - DNA, 25 bp, Homo sapien
aacaataggatttactagaattagt

SEQ ID NO: 4431 - DNA, 25 bp, Homo sapien
aacaataggatttcctagaattagt

SEQ ID NO: 4432 - DNA, 25 bp, Homo sapien
aacaatattctcaacacggcaatga

SEQ ID NO: 4433 - DNA, 25 bp, Homo sapien
aacaatattctcaacatggcaatga

SEQ ID NO: 4434 - DNA, 25 bp, Homo sapien
aacaatatttaagcgtacaattcag

SEQ ID NO: 4435 - DNA, 25 bp, Homo sapien
aacaatatttaagtgtacaattcag

SEQ ID NO: 4436 - DNA, 25 bp, Homo sapien
aacaatcaaagaaagttcttgttgc

SEQ ID NO: 4437 - DNA, 25 bp, Homo sapien
aacaatcaatagaatatgatttagc

SEQ ID NO: 4438 - DNA, 25 bp, Homo sapien
aacaatcagagaaagttcttgttgc

SEQ ID NO: 4439 - DNA, 25 bp, Homo sapien
aacaatcaggtgtaaattctgaaac

SEQ ID NO: 4440 - DNA, 25 bp, Homo sapien
aacaatcaggtgtgaattctgaaac

SEQ ID NO: 4441 - DNA, 25 bp, Homo sapien
aacaatcagtagaatatgatttagc

SEQ ID NO: 4442 - DNA, 25 bp, Homo sapien
aacaatcccaacttcgttccactac

SEQ ID NO: 4443 - DNA, 25 bp, Homo sapien
aacaatcccaactttgttccactac

SEQ ID NO: 4444 - DNA, 25 bp, Homo sapien
aacaatctaaaatagtcatgttctt

SEQ ID NO: 4445 - DNA, 25 bp, Homo sapien
aacaatctaaactagtcatgttctt

SEQ ID NO: 4446 - DNA, 25 bp, Homo sapien
aacaatctcgtgtatctacagcttg

SEQ ID NO: 4447 - DNA, 25 bp, Homo sapien
aacaatctcttgtatctacagcttg

SEQ ID NO: 4448 - DNA, 25 bp, Homo sapien
aacaatctgatttccttaccaaccc

SEQ ID NO: 4449 - DNA, 25 bp, Homo sapien
aacaatctgctttccttaccaaccc

SEQ ID NO: 4450 - DNA, 25 bp, Homo sapien
aacaatcttaccagaagttatgtac

SEQ ID NO: 4451 - DNA, 25 bp, Homo sapien
aacaatcttaccagaatttatgtac

SEQ ID NO: 4452 - DNA, 25 bp, Homo sapien
aacaatgaatgtttacaacacattt

SEQ ID NO: 4453 - DNA, 25 bp, Homo sapien
aacaatgaatgtttacgacacattt

SEQ ID NO: 4454 - DNA, 25 bp, Homo sapien
aacaatgactcatacagtgagaaag

SEQ ID NO: 4455 - DNA, 25 bp, Homo sapien
aacaatgactcatatagtgagaaag

SEQ ID NO: 4456 - DNA, 25 bp, Homo sapien
aacaatgcagaaacgacacaaagat

SEQ ID NO: 4457 - DNA, 25 bp, Homo sapien
aacaatgcagaaactacacaaagat

SEQ ID NO: 4458 - DNA, 25 bp, Homo sapien
aacaatggagtctgccagatcaaca

SEQ ID NO: 4459 - DNA, 25 bp, Homo sapien
aacaatggagtctgtcagatcaaca

SEQ ID NO: 4460 - DNA, 25 bp, Homo sapien
aacaatggtaaagctccttggtctc

SEQ ID NO: 4461 - DNA, 25 bp, Homo sapien
aacaatggtaaagctctttggtctc

SEQ ID NO: 4462 - DNA, 25 bp, Homo sapien
aacaatgtcaaataacaatgatgat

SEQ ID NO: 4463 - DNA, 25 bp, Homo sapien
aacaatgtcaagtaacaatgatgat

SEQ ID NO: 4464 - DNA, 25 bp, Homo sapien
aacaatgtggagaattttttaggac

SEQ ID NO: 4465 - DNA, 25 bp, Homo sapien
aacaatgtggagatttttttaggac

SEQ ID NO: 4466 - DNA, 25 bp, Homo sapien
aacaatgttctaaattcgtcgtgcg

SEQ ID NO: 4467 - DNA, 25 bp, Homo sapien
aacaatgttctaaatttgtcgtgcg

SEQ ID NO: 4468 - DNA, 25 bp, Homo sapien
aacaattaaataataagcacaaggg

SEQ ID NO: 4469 - DNA, 25 bp, Homo sapien
aacaattaaatagtaagcacaaggg

SEQ ID NO: 4470 - DNA, 25 bp, Homo sapien
aacaattcatcaacgagcatttgtc

SEQ ID NO: 4471 - DNA, 25 bp, Homo sapien
aacaattcgtcaacgagcatttgtc

SEQ ID NO: 4472 - DNA, 25 bp, Homo sapien
aacaattctcattggttatctgaaa

SEQ ID NO: 4473 - DNA, 25 bp, Homo sapien
aacaattcttattggttatctgaaa

SEQ ID NO: 4474 - DNA, 25 bp, Homo sapien
aacaattgtcgatggtggaaataac

SEQ ID NO: 4475 - DNA, 25 bp, Homo sapien
aacaattgtcggtggtggaaataac

SEQ ID NO: 4476 - DNA, 25 bp, Homo sapien
aacaatttcacacgtatgatctcat

SEQ ID NO: 4477 - DNA, 25 bp, Homo sapien
aacaatttcacatgtatgatctcat

SEQ ID NO: 4478 - DNA, 25 bp, Homo sapien
aacaatttttacaaagaccaaagaa

SEQ ID NO: 4479 - DNA, 25 bp, Homo sapien
aacaatttttacagagaccaaagaa

SEQ ID NO: 4480 - DNA, 25 bp, Homo sapien
aacacaaaatgagggtgacaaaagt

SEQ ID NO: 4481 - DNA, 25 bp, Homo sapien
aacacaaaatgcagatgtgggacta

SEQ ID NO: 4482 - DNA, 25 bp, Homo sapien
aacacaaaatgctgatgtgggacta

SEQ ID NO: 4483 - DNA, 25 bp, Homo sapien
aacacaaacgaagagaaacacagcc

SEQ ID NO: 4484 - DNA, 25 bp, Homo sapien
aacacaaagatcaatggatgtttct

SEQ ID NO: 4485 - DNA, 25 bp, Homo sapien
aacacaaagttcaatggatgtttct

SEQ ID NO: 4486 - DNA, 25 bp, Homo sapien
aacacaaatagacctcaggaggaat

SEQ ID NO: 4487 - DNA, 25 bp, Homo sapien
aacacaaatagccctcaggaggaat

SEQ ID NO: 4488 - DNA, 25 bp, Homo sapien
aacacaaatgaagagaaacacagcc

SEQ ID NO: 4489 - DNA, 25 bp, Homo sapien
aacacaaatgtactgtatttcaggt

SEQ ID NO: 4490 - DNA, 25 bp, Homo sapien
aacacaaattgagggtgacaaaagt

SEQ ID NO: 4491 - DNA, 25 bp, Homo sapien
aacacaaatttactgtatttcaggt

SEQ ID NO: 4492 - DNA, 25 bp, Homo sapien
aacacaagcgcaataaagatgttta

SEQ ID NO: 4493 - DNA, 25 bp, Homo sapien
aacacaaggataatgaatcaggaac

SEQ ID NO: 4494 - DNA, 25 bp, Homo sapien
aacacaagtataatgaatcaggaac

SEQ ID NO: 4495 - DNA, 25 bp, Homo sapien
aacacaagtgcaataaagatgttta

SEQ ID NO: 4496 - DNA, 25 bp, Homo sapien
aacacaataccaatgaaggaaaaat

SEQ ID NO: 4497 - DNA, 25 bp, Homo sapien
aacacaataccgatgaaggaaaaat

SEQ ID NO: 4498 - DNA, 25 bp, Homo sapien
aacacacacaaaacatgaatttcta

SEQ ID NO: 4499 - DNA, 25 bp, Homo sapien
aacacacacgaaacatgaatttcta

SEQ ID NO: 4500 - DNA, 25 bp, Homo sapien
aacacacgtttttagtctctccact

SEQ ID NO: 4501 - DNA, 25 bp, Homo sapien
aacacacgtttttagtttctccact

SEQ ID NO: 4502 - DNA, 25 bp, Homo sapien
aacacactagcaggtatatttggca

SEQ ID NO: 4503 - DNA, 25 bp, Homo sapien
aacacactagcatgtatatttggca

SEQ ID NO: 4504 - DNA, 25 bp, Homo sapien
aacacactctaatgaatcttgttct

SEQ ID NO: 4505 - DNA, 25 bp, Homo sapien
aacacactctcttgacccgaggtga

SEQ ID NO: 4506 - DNA, 25 bp, Homo sapien
aacacactgtaatgaatcttgttct

SEQ ID NO: 4507 - DNA, 25 bp, Homo sapien
aacacactgtcttgacccgaggtga

SEQ ID NO: 4508 - DNA, 25 bp, Homo sapien
aacacagaatttcccacgtgtagca

SEQ ID NO: 4509 - DNA, 25 bp, Homo sapien
aacacagaatttcccatgtgtagca

SEQ ID NO: 4510 - DNA, 25 bp, Homo sapien
aacacagaggcaggtcccgtgtaag

SEQ ID NO: 4511 - DNA, 25 bp, Homo sapien
aacacagagtcaggtcccgtgtaag

SEQ ID NO: 4512 - DNA, 25 bp, Homo sapien
aacacagggttcatctattcagtac

SEQ ID NO: 4513 - DNA, 25 bp, Homo sapien
aacacagggttcatctgttcagtac

SEQ ID NO: 4514 - DNA, 25 bp, Homo sapien
aacacaggtgctaacaagctaacat

SEQ ID NO: 4515 - DNA, 25 bp, Homo sapien
aacacaggtgctgacaagctaacat

SEQ ID NO: 4516 - DNA, 25 bp, Homo sapien
aacacagtgacacgtttctgagtgt

SEQ ID NO: 4517 - DNA, 25 bp, Homo sapien
aacacagtgacacttttctgagtgt

SEQ ID NO: 4518 - DNA, 25 bp, Homo sapien
aacacagtttgaacagttggtcacc

SEQ ID NO: 4519 - DNA, 25 bp, Homo sapien
aacacagtttgaagagttggtcacc

SEQ ID NO: 4520 - DNA, 25 bp, Homo sapien
aacacataagaaatgcatactgatt

SEQ ID NO: 4521 - DNA, 25 bp, Homo sapien
aacacataagaaatgcttactgatt

SEQ ID NO: 4522 - DNA, 25 bp, Homo sapien
aacacatatgaatacacaacagaca

SEQ ID NO: 4523 - DNA, 25 bp, Homo sapien
aacacatatgactacacaacagaca

SEQ ID NO: 4524 - DNA, 25 bp, Homo sapien
aacacatcaacactccaagtgggag

SEQ ID NO: 4525 - DNA, 25 bp, Homo sapien
aacacatcgacactccaagtgggag

SEQ ID NO: 4526 - DNA, 25 bp, Homo sapien
aacacatgacattgggcctgctggt

SEQ ID NO: 4527 - DNA, 25 bp, Homo sapien
aacacatgactttaaccggtcgatc

SEQ ID NO: 4528 - DNA, 25 bp, Homo sapien
aacacatgactttaactggtcgatc

SEQ ID NO: 4529 - DNA, 25 bp, Homo sapien
aacacatgactttacctggtcgatc

SEQ ID NO: 4530 - DNA, 25 bp, Homo sapien
aacacatggcattgggcctgctggt

SEQ ID NO: 4531 - DNA, 25 bp, Homo sapien
aacacatgtattagattgaccaaaa

SEQ ID NO: 4532 - DNA, 25 bp, Homo sapien
aacacatgtgtctaatcttagctat

SEQ ID NO: 4533 - DNA, 25 bp, Homo sapien
aacacatgtgtctgatcttagctat

SEQ ID NO: 4534 - DNA, 25 bp, Homo sapien
aacacatgttttagattgaccaaaa

SEQ ID NO: 4535 - DNA, 25 bp, Homo sapien
aacacatgttttatgagcatatgca

SEQ ID NO: 4536 - DNA, 25 bp, Homo sapien
aacacatgttttgtgagcatatgca

SEQ ID NO: 4537 - DNA, 25 bp, Homo sapien
aacacattaatatcctagtacctct

SEQ ID NO: 4538 - DNA, 25 bp, Homo sapien
aacacattaatatccttgtacctct

SEQ ID NO: 4539 - DNA, 25 bp, Homo sapien
aacacattacgtggcgatcccaatt

SEQ ID NO: 4540 - DNA, 25 bp, Homo sapien
aacacattacgtggcggtcccaatt

SEQ ID NO: 4541 - DNA, 25 bp, Homo sapien
aacacattgattctctaacgctaac

SEQ ID NO: 4542 - DNA, 25 bp, Homo sapien
aacacattgttttcttgggatagca

SEQ ID NO: 4543 - DNA, 25 bp, Homo sapien
aacacattgttttctttggatagca

SEQ ID NO: 4544 - DNA, 25 bp, Homo sapien
aacacatttattctctaacgctaac

SEQ ID NO: 4545 - DNA, 25 bp, Homo sapien
aacaccaaaagtgagccctaatgta

SEQ ID NO: 4546 - DNA, 25 bp, Homo sapien
aacaccaagagtgagccctaatgta

SEQ ID NO: 4547 - DNA, 25 bp, Homo sapien
aacaccaagcaccatgtgttctcac

SEQ ID NO: 4548 - DNA, 25 bp, Homo sapien
aacaccaagcaccgtgtgttctcac

SEQ ID NO: 4549 - DNA, 25 bp, Homo sapien
aacaccaagtaattgcagcaatgcc

SEQ ID NO: 4550 - DNA, 25 bp, Homo sapien
aacaccaagtaattgcggcaatgcc

SEQ ID NO: 4551 - DNA, 25 bp, Homo sapien
aacaccacaccggtgatcgctttcg

SEQ ID NO: 4552 - DNA, 25 bp, Homo sapien
aacaccacagcggtgatcgctttcg

SEQ ID NO: 4553 - DNA, 25 bp, Homo sapien
aacaccacatacttttatcttttac

SEQ ID NO: 4554 - DNA, 25 bp, Homo sapien
aacaccacatacttttgtcttttac

SEQ ID NO: 4555 - DNA, 25 bp, Homo sapien
aacaccactttctctcttacctctt

SEQ ID NO: 4556 - DNA, 25 bp, Homo sapien
aacaccactttctttcttacctctt

SEQ ID NO: 4557 - DNA, 25 bp, Homo sapien
aacaccatcatgcctaactcgggac

SEQ ID NO: 4558 - DNA, 25 bp, Homo sapien
aacaccatcatggctaactcgggac

SEQ ID NO: 4559 - DNA, 25 bp, Homo sapien
aacacccaagtttagcagcagtact

SEQ ID NO: 4560 - DNA, 25 bp, Homo sapien
aacacccaggtttagcagcagtact

SEQ ID NO: 4561 - DNA, 25 bp, Homo sapien
aacaccctgagagcattttgagtgg

SEQ ID NO: 4562 - DNA, 25 bp, Homo sapien
aacaccctgagtgcattttgagtgg

SEQ ID NO: 4563 - DNA, 25 bp, Homo sapien
aacaccctgcaactgagcaaactac

SEQ ID NO: 4564 - DNA, 25 bp, Homo sapien
aacaccctgcaattgagcaaactac

SEQ ID NO: 4565 - DNA, 25 bp, Homo sapien
aacacctgagtaatacagtgaccaa

SEQ ID NO: 4566 - DNA, 25 bp, Homo sapien
aacacctgagtcatacagtgaccaa

SEQ ID NO: 4567 - DNA, 25 bp, Homo sapien
aacacgctaacaacgtaaacggctc

SEQ ID NO: 4568 - DNA, 25 bp, Homo sapien
aacacgctaacaatgtaaacggctc

SEQ ID NO: 4569 - DNA, 25 bp, Homo sapien
aacacggcacttttggccaccagta

SEQ ID NO: 4570 - DNA, 25 bp, Homo sapien
aacacggcgcttttggccaccagta

SEQ ID NO: 4571 - DNA, 25 bp, Homo sapien
aacacgtcaaaataacatgaatttt

SEQ ID NO: 4572 - DNA, 25 bp, Homo sapien
aacacgtcagaataacatgaatttt

SEQ ID NO: 4573 - DNA, 25 bp, Homo sapien
aacacgtgagaaacctaggccatta

SEQ ID NO: 4574 - DNA, 25 bp, Homo sapien
aacacgtgagaaacttaggccatta

SEQ ID NO: 4575 - DNA, 25 bp, Homo sapien
aacactaaatgtcggtgaagatgtt

SEQ ID NO: 4576 - DNA, 25 bp, Homo sapien
aacactaaatgttggtgaagatgtt

SEQ ID NO: 4577 - DNA, 25 bp, Homo sapien
aacactaccacctcagtaaagctgt

SEQ ID NO: 4578 - DNA, 25 bp, Homo sapien
aacactaccgcctcagtaaagctgt

SEQ ID NO: 4579 - DNA, 25 bp, Homo sapien
aacactactgctattcactttttgc

SEQ ID NO: 4580 - DNA, 25 bp, Homo sapien
aacactacttctattcactttttgc

SEQ ID NO: 4581 - DNA, 25 bp, Homo sapien
aacactagcagcgagaaagagtgag

SEQ ID NO: 4582 - DNA, 25 bp, Homo sapien
aacactagcggcgagaaagagtgag

SEQ ID NO: 4583 - DNA, 25 bp, Homo sapien
aacactagtatttaagacactattt

SEQ ID NO: 4584 - DNA, 25 bp, Homo sapien
aacactagtatttcagacactattt

SEQ ID NO: 4585 - DNA, 25 bp, Homo sapien
aacactatgccctttcactctttgt

SEQ ID NO: 4586 - DNA, 25 bp, Homo sapien
aacactatgccttttcactctttgt

SEQ ID NO: 4587 - DNA, 25 bp, Homo sapien
aacactattctctaatgaaaaggat

SEQ ID NO: 4588 - DNA, 25 bp, Homo sapien
aacactattctcttatgaaaaggat

SEQ ID NO: 4589 - DNA, 25 bp, Homo sapien
aacactcaccatagctcagaatgtt

SEQ ID NO: 4590 - DNA, 25 bp, Homo sapien
aacactcagaagatatttccttggg

SEQ ID NO: 4591 - DNA, 25 bp, Homo sapien
aacactcagaaggtatttccttggg

SEQ ID NO: 4592 - DNA, 25 bp, Homo sapien
aacactcatcatagctcagaatgtt

SEQ ID NO: 4593 - DNA, 25 bp, Homo sapien
aacactcatttttaaaaaagcacaa

SEQ ID NO: 4594 - DNA, 25 bp, Homo sapien
aacactcattttttaaaaagcacaa

SEQ ID NO: 4595 - DNA, 25 bp, Homo sapien
aacactccaaatacccagaacaatc

SEQ ID NO: 4596 - DNA, 25 bp, Homo sapien
aacactccgaatacccagaacaatc

SEQ ID NO: 4597 - DNA, 25 bp, Homo sapien
aacactcctaacacggcaagaaagt

SEQ ID NO: 4598 - DNA, 25 bp, Homo sapien
aacactcctaacatggcaagaaagt

SEQ ID NO: 4599 - DNA, 25 bp, Homo sapien
aacactctcaatttcccagatttaa

SEQ ID NO: 4600 - DNA, 25 bp, Homo sapien
aacactctccatttcccagatttaa

SEQ ID NO: 4601 - DNA, 25 bp, Homo sapien
aacactcttaacaagcttgagataa

SEQ ID NO: 4602 - DNA, 25 bp, Homo sapien
aacactcttaataagcttgagataa

SEQ ID NO: 4603 - DNA, 25 bp, Homo sapien
aacactcttgtgcagtaagcgttca

SEQ ID NO: 4604 - DNA, 25 bp, Homo sapien
aacactcttgttcagtaagcgttca

SEQ ID NO: 4605 - DNA, 25 bp, Homo sapien
aacactgaattaccatatgtcccag

SEQ ID NO: 4606 - DNA, 25 bp, Homo sapien
aacactgaattaccgtatgtcccag

SEQ ID NO: 4607 - DNA, 25 bp, Homo sapien
aacactgatccaaaagccatttcta

SEQ ID NO: 4608 - DNA, 25 bp, Homo sapien
aacactgatccagaagccatttcta

SEQ ID NO: 4609 - DNA, 25 bp, Homo sapien
aacactgcataattgacctgattca

SEQ ID NO: 4610 - DNA, 25 bp, Homo sapien
aacactgcatagttgacctgattca

SEQ ID NO: 4611 - DNA, 25 bp, Homo sapien
aacactgctcctcaggcgggtggtg

SEQ ID NO: 4612 - DNA, 25 bp, Homo sapien
aacactgctcctcgggcgggtggtg

SEQ ID NO: 4613 - DNA, 25 bp, Homo sapien
aacactgctttggttcacataagtg

SEQ ID NO: 4614 - DNA, 25 bp, Homo sapien
aacactgctttgtttcacataagtg

SEQ ID NO: 4615 - DNA, 25 bp, Homo sapien
aacactgtactatgcgtctgcctct

SEQ ID NO: 4616 - DNA, 25 bp, Homo sapien
aacactgtactgtgcgtctgcctct

SEQ ID NO: 4617 - DNA, 25 bp, Homo sapien
aacactgtgaaacgctgccaagaag

SEQ ID NO: 4618 - DNA, 25 bp, Homo sapien
aacactgtgaaatgctgccaagaag

SEQ ID NO: 4619 - DNA, 25 bp, Homo sapien
aacactgtgcccatttcatattata

SEQ ID NO: 4620 - DNA, 25 bp, Homo sapien
aacactgtgcctatttcatattata

SEQ ID NO: 4621 - DNA, 25 bp, Homo sapien
aacacttagaagagaccatatatga

SEQ ID NO: 4622 - DNA, 25 bp, Homo sapien
aacacttagaagaggccatatatga

SEQ ID NO: 4623 - DNA, 25 bp, Homo sapien
aacacttcaactgtaaccttttaag

SEQ ID NO: 4624 - DNA, 25 bp, Homo sapien
aacacttcaactgtaatcttttaag

SEQ ID NO: 4625 - DNA, 25 bp, Homo sapien
aacacttgcgtcaggacaagaatca

SEQ ID NO: 4626 - DNA, 25 bp, Homo sapien
aacacttgtgtcaggacaagaatca

SEQ ID NO: 4627 - DNA, 25 bp, Homo sapien
aacactttcccaatatccctggagg

SEQ ID NO: 4628 - DNA, 25 bp, Homo sapien
aacactttcccgatatccctggagg

SEQ ID NO: 4629 - DNA, 25 bp, Homo sapien
aacagaaaagcccagtattacttgg

SEQ ID NO: 4630 - DNA, 25 bp, Homo sapien
aacagaaaatcccagtattacttgg

SEQ ID NO: 4631 - DNA, 25 bp, Homo sapien
aacagaaacaatacgtgcaactcca

SEQ ID NO: 4632 - DNA, 25 bp, Homo sapien
aacagaaacaatatgtgcaactcca

SEQ ID NO: 4633 - DNA, 25 bp, Homo sapien
aacagaaacctattaagatcctttg

SEQ ID NO: 4634 - DNA, 25 bp, Homo sapien
aacagaaatctattaagatcctttg

SEQ ID NO: 4635 - DNA, 25 bp, Homo sapien
aacagaaggaccctttagactcttg

SEQ ID NO: 4636 - DNA, 25 bp, Homo sapien
aacagaaggaccttttagactcttg

SEQ ID NO: 4637 - DNA, 25 bp, Homo sapien
aacagaagtggatgagcagtaaaat

SEQ ID NO: 4638 - DNA, 25 bp, Homo sapien
aacagaagtggatgtgcagtaaaat

SEQ ID NO: 4639 - DNA, 25 bp, Homo sapien
aacagaatacggcactagatttcct

SEQ ID NO: 4640 - DNA, 25 bp, Homo sapien
aacagaatatggcactagatttcct

SEQ ID NO: 4641 - DNA, 25 bp, Homo sapien
aacagaattgtaatcatgcagaaat

SEQ ID NO: 4642 - DNA, 25 bp, Homo sapien
aacagaattttaatcatgcagaaat

SEQ ID NO: 4643 - DNA, 25 bp, Homo sapien
aacagacaactgttgcattcctgtc

SEQ ID NO: 4644 - DNA, 25 bp, Homo sapien
aacagacaagtgttgcattcctgtc

SEQ ID NO: 4645 - DNA, 25 bp, Homo sapien
aacagacaatttgcaaaagaagata

SEQ ID NO: 4646 - DNA, 25 bp, Homo sapien
aacagacaatttgcgaaagaagata

SEQ ID NO: 4647 - DNA, 25 bp, Homo sapien
aacagacactaactggtacagatca

SEQ ID NO: 4648 - DNA, 25 bp, Homo sapien
aacagacactaagtggtacagatca

SEQ ID NO: 4649 - DNA, 25 bp, Homo sapien
aacagacactgaggattgttccctg

SEQ ID NO: 4650 - DNA, 25 bp, Homo sapien
aacagacactgagtattgttccctg

SEQ ID NO: 4651 - DNA, 25 bp, Homo sapien
aacagacagtatctatcaacagggc

SEQ ID NO: 4652 - DNA, 25 bp, Homo sapien
aacagacagtatttatcaacagggc

SEQ ID NO: 4653 - DNA, 25 bp, Homo sapien
aacagaccaacaaacaacaagagct

SEQ ID NO: 4654 - DNA, 25 bp, Homo sapien
aacagaccaacaaacagcaagagct

SEQ ID NO: 4655 - DNA, 25 bp, Homo sapien
aacagacccgataatcctcagaaga

SEQ ID NO: 4656 - DNA, 25 bp, Homo sapien
aacagaccctataatcctcagaaga

SEQ ID NO: 4657 - DNA, 25 bp, Homo sapien
aacagacctgggtcgcaacgtgccc

SEQ ID NO: 4658 - DNA, 25 bp, Homo sapien
aacagacctgggttgcaacgtgccc

SEQ ID NO: 4659 - DNA, 25 bp, Homo sapien
aacagagaagtgtgaggagaaccat

SEQ ID NO: 4660 - DNA, 25 bp, Homo sapien
aacagagaccgtgtggcctgccaaa

SEQ ID NO: 4661 - DNA, 25 bp, Homo sapien
aacagagacggtgtggcctgccaaa

SEQ ID NO: 4662 - DNA, 25 bp, Homo sapien
aacagagagacagtcgtctgtgagc

SEQ ID NO: 4663 - DNA, 25 bp, Homo sapien
aacagagaggtgtgaggagaaccat

SEQ ID NO: 4664 - DNA, 25 bp, Homo sapien
aacagagatacagtcgtctgtgagc

SEQ ID NO: 4665 - DNA, 25 bp, Homo sapien
aacagagatgagaaataaatattaa

SEQ ID NO: 4666 - DNA, 25 bp, Homo sapien
aacagagatgagtaataaatattaa

SEQ ID NO: 4667 - DNA, 25 bp, Homo sapien
aacagagattagatcaccaatatta

SEQ ID NO: 4668 - DNA, 25 bp, Homo sapien
aacagagattagttcaccaatatta

SEQ ID NO: 4669 - DNA, 25 bp, Homo sapien
aacagagcataaaaaaatggtgttc

SEQ ID NO: 4670 - DNA, 25 bp, Homo sapien
aacagagcataaaaaattggtgttc

SEQ ID NO: 4671 - DNA, 25 bp, Homo sapien
aacagaggtatcagactatataaaa

SEQ ID NO: 4672 - DNA, 25 bp, Homo sapien
aacagaggtatcggactatataaaa

SEQ ID NO: 4673 - DNA, 25 bp, Homo sapien
aacagagtacgactcccttattcat

SEQ ID NO: 4674 - DNA, 25 bp, Homo sapien
aacagagtagtgttttatagtggct

SEQ ID NO: 4675 - DNA, 25 bp, Homo sapien
aacagagtagtgttttgtagtggct

SEQ ID NO: 4676 - DNA, 25 bp, Homo sapien
aacagagtatgactcccttattcat

SEQ ID NO: 4677 - DNA, 25 bp, Homo sapien
aacagagtcctaactgagctggttt

SEQ ID NO: 4678 - DNA, 25 bp, Homo sapien
aacagagtgaggacagaagtaaggg

SEQ ID NO: 4679 - DNA, 25 bp, Homo sapien
aacagagtgaggacaggagtaaggg

SEQ ID NO: 4680 - DNA, 25 bp, Homo sapien
aacagagttctaactgagctggttt

SEQ ID NO: 4681 - DNA, 25 bp, Homo sapien
aacagataaaccatagagaaaatta

SEQ ID NO: 4682 - DNA, 25 bp, Homo sapien
aacagataaaccatggagaaaatta

SEQ ID NO: 4683 - DNA, 25 bp, Homo sapien
aacagatcctcatgattttaccaaa

SEQ ID NO: 4684 - DNA, 25 bp, Homo sapien
aacagatcctcgtgattttaccaaa

SEQ ID NO: 4685 - DNA, 25 bp, Homo sapien
aacagatcttgcaagcactcactcg

SEQ ID NO: 4686 - DNA, 25 bp, Homo sapien
aacagatcttgcgagcactcactcg

SEQ ID NO: 4687 - DNA, 25 bp, Homo sapien
aacagatgcgtccatcccagcttct

SEQ ID NO: 4688 - DNA, 25 bp, Homo sapien
aacagatgcttccatcccagcttct

SEQ ID NO: 4689 - DNA, 25 bp, Homo sapien
aacagatgtaacgctctcccttgat

SEQ ID NO: 4690 - DNA, 25 bp, Homo sapien
aacagatgtaactctctcccttgat

SEQ ID NO: 4691 - DNA, 25 bp, Homo sapien
aacagatgtccttttgatcacattt

SEQ ID NO: 4692 - DNA, 25 bp, Homo sapien
aacagatgtccttttggtcacattt

SEQ ID NO: 4693 - DNA, 25 bp, Homo sapien
aacagattttcaaaagttttcattt

SEQ ID NO: 4694 - DNA, 25 bp, Homo sapien
aacagattttcagaagttttcattt

SEQ ID NO: 4695 - DNA, 25 bp, Homo sapien
aacagcaaaatgccacagtggagcc

SEQ ID NO: 4696 - DNA, 25 bp, Homo sapien
aacagcaaagaacaatgtctccaaa

SEQ ID NO: 4697 - DNA, 25 bp, Homo sapien
aacagcaaagagcaatgtctccaaa

SEQ ID NO: 4698 - DNA, 25 bp, Homo sapien
aacagcaacggcggctgctactatt

SEQ ID NO: 4699 - DNA, 25 bp, Homo sapien
aacagcaactgcggctgctactatt

SEQ ID NO: 4700 - DNA, 25 bp, Homo sapien
aacagcaagacttctttcctctcta

SEQ ID NO: 4701 - DNA, 25 bp, Homo sapien
aacagcaagatgccacagtggagcc

SEQ ID NO: 4702 - DNA, 25 bp, Homo sapien
aacagcaagcaaatcgtggtcctgg

SEQ ID NO: 4703 - DNA, 25 bp, Homo sapien
aacagcaagcaaattgtggtcctgg

SEQ ID NO: 4704 - DNA, 25 bp, Homo sapien
aacagcaagccttctttcctctcta

SEQ ID NO: 4705 - DNA, 25 bp, Homo sapien
aacagcaatgcatgtggtggtgtaa

SEQ ID NO: 4706 - DNA, 25 bp, Homo sapien
aacagcaatgcgtgtggtggtgtaa

SEQ ID NO: 4707 - DNA, 25 bp, Homo sapien
aacagcacatagttaatatgaagta

SEQ ID NO: 4708 - DNA, 25 bp, Homo sapien
aacagcacgtagttaatatgaagta

SEQ ID NO: 4709 - DNA, 25 bp, Homo sapien
aacagcacttaagccttctatatat

SEQ ID NO: 4710 - DNA, 25 bp, Homo sapien
aacagcacttaaggcttctatatat

SEQ ID NO: 4711 - DNA, 25 bp, Homo sapien
aacagcagagatattattaattcat

SEQ ID NO: 4712 - DNA, 25 bp, Homo sapien
aacagcagatatattattaattcat

SEQ ID NO: 4713 - DNA, 25 bp, Homo sapien
aacagcagctgtggaactcagagac

SEQ ID NO: 4714 - DNA, 25 bp, Homo sapien
aacagcagttgtggaactcagagac

SEQ ID NO: 4715 - DNA, 25 bp, Homo sapien
aacagcatcagcaacgagttggcac

SEQ ID NO: 4716 - DNA, 25 bp, Homo sapien
aacagcatcggcaacgagttggcac

SEQ ID NO: 4717 - DNA, 25 bp, Homo sapien
aacagcattcaccgacaggggagct

SEQ ID NO: 4718 - DNA, 25 bp, Homo sapien
aacagcattcactgacaggggagct

SEQ ID NO: 4719 - DNA, 25 bp, Homo sapien
aacagcgagccacacctggatcaca

SEQ ID NO: 4720 - DNA, 25 bp, Homo sapien
aacagcgagccacgcctggatcaca

SEQ ID NO: 4721 - DNA, 25 bp, Homo sapien
aacagctagcacagaagaaagaact

SEQ ID NO: 4722 - DNA, 25 bp, Homo sapien
aacagctagcacagtagaaagaact

SEQ ID NO: 4723 - DNA, 25 bp, Homo sapien
aacagctcaatcaagagaacagtca

SEQ ID NO: 4724 - DNA, 25 bp, Homo sapien
aacagctcaatcaagataacagtca

SEQ ID NO: 4725 - DNA, 25 bp, Homo sapien
aacagctgcaatggataacagcttc

SEQ ID NO: 4726 - DNA, 25 bp, Homo sapien
aacagctgcaatgtataacagcttc

SEQ ID NO: 4727 - DNA, 25 bp, Homo sapien
aacagcttaacaaagatcagtaagc

SEQ ID NO: 4728 - DNA, 25 bp, Homo sapien
aacagcttaccaaagatcagtaagc

SEQ ID NO: 4729 - DNA, 25 bp, Homo sapien
aacagctttaagtctaagtagaagc

SEQ ID NO: 4730 - DNA, 25 bp, Homo sapien
aacagctttaagtctatgtagaagc

SEQ ID NO: 4731 - DNA, 25 bp, Homo sapien
aacagctttgatagaatcagattcc

SEQ ID NO: 4732 - DNA, 25 bp, Homo sapien
aacagctttgatggaatcagattcc

SEQ ID NO: 4733 - DNA, 25 bp, Homo sapien
aacaggaactcttaatcattcctgg

SEQ ID NO: 4734 - DNA, 25 bp, Homo sapien
aacaggaactcttattcattcctgg

SEQ ID NO: 4735 - DNA, 25 bp, Homo sapien
aacaggaataattcttcagacctgc

SEQ ID NO: 4736 - DNA, 25 bp, Homo sapien
aacaggaattattcttcagacctgc

SEQ ID NO: 4737 - DNA, 25 bp, Homo sapien
aacaggactcggcaacttcttggat

SEQ ID NO: 4738 - DNA, 25 bp, Homo sapien
aacaggactcggtaacttcttggat

SEQ ID NO: 4739 - DNA, 25 bp, Homo sapien
aacaggagagaagtttatatatctg

SEQ ID NO: 4740 - DNA, 25 bp, Homo sapien
aacaggagagaagtttgtatatctg

SEQ ID NO: 4741 - DNA, 25 bp, Homo sapien
aacaggagagggaaacaaatgacca

SEQ ID NO: 4742 - DNA, 25 bp, Homo sapien
aacaggagagggaagcaaatgacca

SEQ ID NO: 4743 - DNA, 25 bp, Homo sapien
aacaggatactatgaaaaaagaaca

SEQ ID NO: 4744 - DNA, 25 bp, Homo sapien
aacaggatattatgaaaaaagaaca

SEQ ID NO: 4745 - DNA, 25 bp, Homo sapien
aacaggattatctcatgattaaatt

SEQ ID NO: 4746 - DNA, 25 bp, Homo sapien
aacaggattatctcgtgattaaatt

SEQ ID NO: 4747 - DNA, 25 bp, Homo sapien
aacaggcaaccaaagcaacaattga

SEQ ID NO: 4748 - DNA, 25 bp, Homo sapien
aacaggcaacccaagcaacaattga

SEQ ID NO: 4749 - DNA, 25 bp, Homo sapien
aacaggcagttaagaagatgaagca

SEQ ID NO: 4750 - DNA, 25 bp, Homo sapien
aacaggcagttatgaagatgaagca

SEQ ID NO: 4751 - DNA, 25 bp, Homo sapien
aacaggctaatgcttacttgtggta

SEQ ID NO: 4752 - DNA, 25 bp, Homo sapien
aacaggctaattcttacttgtggta

SEQ ID NO: 4753 - DNA, 25 bp, Homo sapien
aacaggctagtgctaaaagcaaagt

SEQ ID NO: 4754 - DNA, 25 bp, Homo sapien
aacaggctagtgctcaaagcaaagt

SEQ ID NO: 4755 - DNA, 25 bp, Homo sapien
aacaggctgcgaatctgtgtctttt

SEQ ID NO: 4756 - DNA, 25 bp, Homo sapien
aacaggctgtgaatctgtgtctttt

SEQ ID NO: 4757 - DNA, 25 bp, Homo sapien
aacagggaaaaactctgaaggactg

SEQ ID NO: 4758 - DNA, 25 bp, Homo sapien
aacagggaaataatgagtcccatgg

SEQ ID NO: 4759 - DNA, 25 bp, Homo sapien
aacagggaacaactctgaaggactg

SEQ ID NO: 4760 - DNA, 25 bp, Homo sapien
aacagggaattaatgagtcccatgg

SEQ ID NO: 4761 - DNA, 25 bp, Homo sapien
aacagggaccaccgggaagctcact

SEQ ID NO: 4762 - DNA, 25 bp, Homo sapien
aacagggaccactgggaagctcact

SEQ ID NO: 4763 - DNA, 25 bp, Homo sapien
aacagggagcaactggccttctaca

SEQ ID NO: 4764 - DNA, 25 bp, Homo sapien
aacagggagcaagtggccttctaca

SEQ ID NO: 4765 - DNA, 25 bp, Homo sapien
aacaggggagaagtcaatgtgaaaa

SEQ ID NO: 4766 - DNA, 25 bp, Homo sapien
aacaggggagaagtcactgtgaaaa

SEQ ID NO: 4767 - DNA, 25 bp, Homo sapien
aacaggtagaacatacacatttctc

SEQ ID NO: 4768 - DNA, 25 bp, Homo sapien
aacaggtagaacatacccatttctc

SEQ ID NO: 4769 - DNA, 25 bp, Homo sapien
aacaggtgaattcataaacaaactg

SEQ ID NO: 4770 - DNA, 25 bp, Homo sapien
aacaggtgaattcgtaaacaaactg

SEQ ID NO: 4771 - DNA, 25 bp, Homo sapien
aacaggtgataggtcctttctcttt

SEQ ID NO: 4772 - DNA, 25 bp, Homo sapien
aacaggtgttaggtcctttctcttt

SEQ ID NO: 4773 - DNA, 25 bp, Homo sapien
aacaggttccaattctgcacaaata

SEQ ID NO: 4774 - DNA, 25 bp, Homo sapien
aacaggttccaattcttcacaaata

SEQ ID NO: 4775 - DNA, 25 bp, Homo sapien
aacaggttttggtagtttgttcctt

SEQ ID NO: 4776 - DNA, 25 bp, Homo sapien
aacaggttttggtcgtttgttcctt

SEQ ID NO: 4777 - DNA, 25 bp, Homo sapien
aacagtaaaaatacgacctaaaatt

SEQ ID NO: 4778 - DNA, 25 bp, Homo sapien
aacagtaaaaatatgacctaaaatt

SEQ ID NO: 4779 - DNA, 25 bp, Homo sapien
aacagtaaatacaaataccctaagc

SEQ ID NO: 4780 - DNA, 25 bp, Homo sapien
aacagtaaataccaataccctaagc

SEQ ID NO: 4781 - DNA, 25 bp, Homo sapien
aacagtaagaaacaacataatgaag

SEQ ID NO: 4782 - DNA, 25 bp, Homo sapien
aacagtaagaaataacataatgaag

SEQ ID NO: 4783 - DNA, 25 bp, Homo sapien
aacagtagagtgccaagcacagaag

SEQ ID NO: 4784 - DNA, 25 bp, Homo sapien
aacagtagagtgtcaagcacagaag

SEQ ID NO: 4785 - DNA, 25 bp, Homo sapien
aacagtagattgtgccaccagctgc

SEQ ID NO: 4786 - DNA, 25 bp, Homo sapien
aacagtagattgtgccgccagctgc

SEQ ID NO: 4787 - DNA, 25 bp, Homo sapien
aacagtagccactagatatcagccc

SEQ ID NO: 4788 - DNA, 25 bp, Homo sapien
aacagtagccattagatatcagccc

SEQ ID NO: 4789 - DNA, 25 bp, Homo sapien
aacagtaggttaatactcagaatgt

SEQ ID NO: 4790 - DNA, 25 bp, Homo sapien
aacagtaggttagtactcagaatgt

SEQ ID NO: 4791 - DNA, 25 bp, Homo sapien
aacagtatgaagcttcccaaagttt

SEQ ID NO: 4792 - DNA, 25 bp, Homo sapien
aacagtatgaagcttctcaaagttt

SEQ ID NO: 4793 - DNA, 25 bp, Homo sapien
aacagtatgtgaatttctcctttaa

SEQ ID NO: 4794 - DNA, 25 bp, Homo sapien
aacagtatgtgagtttctcctttaa

SEQ ID NO: 4795 - DNA, 25 bp, Homo sapien
aacagtattagattgactaaaagca

SEQ ID NO: 4796 - DNA, 25 bp, Homo sapien
aacagtattagattgattaaaagca

SEQ ID NO: 4797 - DNA, 25 bp, Homo sapien
aacagtccaaaagcggtctctcaaa

SEQ ID NO: 4798 - DNA, 25 bp, Homo sapien
aacagtccaaaagctgtctctcaaa

SEQ ID NO: 4799 - DNA, 25 bp, Homo sapien
aacagtcccaaaagaaatgttgcct

SEQ ID NO: 4800 - DNA, 25 bp, Homo sapien
aacagtcccaaaataaatgttgcct

SEQ ID NO: 4801 - DNA, 25 bp, Homo sapien
aacagtcccatgagtaagaacagaa

SEQ ID NO: 4802 - DNA, 25 bp, Homo sapien
aacagtcccgtgagtaagaacagaa

SEQ ID NO: 4803 - DNA, 25 bp, Homo sapien
aacagtcctcaatacccaatatgat

SEQ ID NO: 4804 - DNA, 25 bp, Homo sapien
aacagtcctgaatacccaatatgat

SEQ ID NO: 4805 - DNA, 25 bp, Homo sapien
aacagtctgcatggctggattcaca

SEQ ID NO: 4806 - DNA, 25 bp, Homo sapien
aacagtctgcatggcttgattcaca

SEQ ID NO: 4807 - DNA, 25 bp, Homo sapien
aacagtgacactcgtgcctggcatg

SEQ ID NO: 4808 - DNA, 25 bp, Homo sapien
aacagtgacacttgtgcctggcatg

SEQ ID NO: 4809 - DNA, 25 bp, Homo sapien
aacagtggtaaaacgagattatgta

SEQ ID NO: 4810 - DNA, 25 bp, Homo sapien
aacagtggtaaaatgagattatgta

SEQ ID NO: 4811 - DNA, 25 bp, Homo sapien
aacagtggtagacacgaaaatggga

SEQ ID NO: 4812 - DNA, 25 bp, Homo sapien
aacagtggtagacatgaaaatggga

SEQ ID NO: 4813 - DNA, 25 bp, Homo sapien
aacagtgtacaacatttccctttct

SEQ ID NO: 4814 - DNA, 25 bp, Homo sapien
aacagtgtacaatatttccctttct

SEQ ID NO: 4815 - DNA, 25 bp, Homo sapien
aacagtgttggcaaaggcacgggga

SEQ ID NO: 4816 - DNA, 25 bp, Homo sapien
aacagtgttggcaacggcacgggga

SEQ ID NO: 4817 - DNA, 25 bp, Homo sapien
aacagttactttcggacagtctatg

SEQ ID NO: 4818 - DNA, 25 bp, Homo sapien
aacagttactttgggacagtctatg

SEQ ID NO: 4819 - DNA, 25 bp, Homo sapien
aacagttcaggcaactttacttagc

SEQ ID NO: 4820 - DNA, 25 bp, Homo sapien
aacagttcaggcagctttacttagc

SEQ ID NO: 4821 - DNA, 25 bp, Homo sapien
aacagttcattctccagtttacatc

SEQ ID NO: 4822 - DNA, 25 bp, Homo sapien
aacagttcattctccattttacatc

SEQ ID NO: 4823 - DNA, 25 bp, Homo sapien
aacagttctttgtagtctcataaca

SEQ ID NO: 4824 - DNA, 25 bp, Homo sapien
aacagttctttgtagtttcataaca

SEQ ID NO: 4825 - DNA, 25 bp, Homo sapien
aacagttgtaaggaatatacattgg

SEQ ID NO: 4826 - DNA, 25 bp, Homo sapien
aacagttgtaaggagtatacattgg

SEQ ID NO: 4827 - DNA, 25 bp, Homo sapien
aacataaaacgatacacaaaccaag

SEQ ID NO: 4828 - DNA, 25 bp, Homo sapien
aacataaaatcaatacacagtggat

SEQ ID NO: 4829 - DNA, 25 bp, Homo sapien
aacataaaatcagtacacagtggat

SEQ ID NO: 4830 - DNA, 25 bp, Homo sapien
aacataaaatctccatagggaaata

SEQ ID NO: 4831 - DNA, 25 bp, Homo sapien
aacataaaatctccgtagggaaata

SEQ ID NO: 4832 - DNA, 25 bp, Homo sapien
aacataaaatgatacacaaaccaag

SEQ ID NO: 4833 - DNA, 25 bp, Homo sapien
aacataaactttatttctcagcaca

SEQ ID NO: 4834 - DNA, 25 bp, Homo sapien
aacataaactttatttgtcagcaca

SEQ ID NO: 4835 - DNA, 25 bp, Homo sapien
aacataaagatggaaacgatgctga

SEQ ID NO: 4836 - DNA, 25 bp, Homo sapien
aacataaagatggtaacgatgctga

SEQ ID NO: 4837 - DNA, 25 bp, Homo sapien
aacataaaggacaagttaggcatag

SEQ ID NO: 4838 - DNA, 25 bp, Homo sapien
aacataaaggataagttaggcatag

SEQ ID NO: 4839 - DNA, 25 bp, Homo sapien
aacataaagttcacctcatcatgta

SEQ ID NO: 4840 - DNA, 25 bp, Homo sapien
aacataaagttcatctcatcatgta

SEQ ID NO: 4841 - DNA, 25 bp, Homo sapien
aacataacaccttgacaccaggatg

SEQ ID NO: 4842 - DNA, 25 bp, Homo sapien
aacataacaccttgtcaccaggatg

SEQ ID NO: 4843 - DNA, 25 bp, Homo sapien
aacataagacctagatagcccatgg

SEQ ID NO: 4844 - DNA, 25 bp, Homo sapien
aacataagacctagctagcccatgg

SEQ ID NO: 4845 - DNA, 25 bp, Homo sapien
aacataagcagaaaaagtgaccaga

SEQ ID NO: 4846 - DNA, 25 bp, Homo sapien
aacataagcagagaaagtgaccaga

SEQ ID NO: 4847 - DNA, 25 bp, Homo sapien
aacataaggacctgtcactatcatt

SEQ ID NO: 4848 - DNA, 25 bp, Homo sapien
aacataaggacctttcactatcatt

SEQ ID NO: 4849 - DNA, 25 bp, Homo sapien
aacataagtgtccaggagctggctg

SEQ ID NO: 4850 - DNA, 25 bp, Homo sapien
aacataagtgtccaggcgctggctg

SEQ ID NO: 4851 - DNA, 25 bp, Homo sapien
aacataatgggtaaatggtatggta

SEQ ID NO: 4852 - DNA, 25 bp, Homo sapien
aacataatgggtcaatggtatggta

SEQ ID NO: 4853 - DNA, 25 bp, Homo sapien
aacataatttaccaactcaacattg

SEQ ID NO: 4854 - DNA, 25 bp, Homo sapien
aacataatttatcaactcaacattg

SEQ ID NO: 4855 - DNA, 25 bp, Homo sapien
aacatacaaaattacaaatagcaat

SEQ ID NO: 4856 - DNA, 25 bp, Homo sapien
aacatacaaaattagaaatagcaat

SEQ ID NO: 4857 - DNA, 25 bp, Homo sapien
aacatacaactgaggtgatggaact

SEQ ID NO: 4858 - DNA, 25 bp, Homo sapien
aacatacagacatagaagaaacacc

SEQ ID NO: 4859 - DNA, 25 bp, Homo sapien
aacatacagacatggaagaaacacc

SEQ ID NO: 4860 - DNA, 25 bp, Homo sapien
aacatacagctgaggtgatggaact

SEQ ID NO: 4861 - DNA, 25 bp, Homo sapien
aacatacagtctacaaggaacagta

SEQ ID NO: 4862 - DNA, 25 bp, Homo sapien
aacatacagtctacgaggaacagta

SEQ ID NO: 4863 - DNA, 25 bp, Homo sapien
aacatacatccatcatgctagtctc

SEQ ID NO: 4864 - DNA, 25 bp, Homo sapien
aacatacatccgtcatgctagtctc

SEQ ID NO: 4865 - DNA, 25 bp, Homo sapien
aacatactcaaatataagtagacat

SEQ ID NO: 4866 - DNA, 25 bp, Homo sapien
aacatactcaaatgtaagtagacat

SEQ ID NO: 4867 - DNA, 25 bp, Homo sapien
aacatagaaaaagataatcaaagtg

SEQ ID NO: 4868 - DNA, 25 bp, Homo sapien
aacatagaaaaggataatcaaagtg

SEQ ID NO: 4869 - DNA, 25 bp, Homo sapien
aacatagaaagcctcagcaaagaaa

SEQ ID NO: 4870 - DNA, 25 bp, Homo sapien
aacatagaaagcctcatcaaagaaa

SEQ ID NO: 4871 - DNA, 25 bp, Homo sapien
aacatagagcatagctaattggcct

SEQ ID NO: 4872 - DNA, 25 bp, Homo sapien
aacatagagcatagcttattggcct

SEQ ID NO: 4873 - DNA, 25 bp, Homo sapien
aacatagctataactctgggagtga

SEQ ID NO: 4874 - DNA, 25 bp, Homo sapien
aacatagctataattctgggagtga

SEQ ID NO: 4875 - DNA, 25 bp, Homo sapien
aacataggtgactgagtgtgcaaga

SEQ ID NO: 4876 - DNA, 25 bp, Homo sapien
aacataggtgactgtgtgtgcaaga

SEQ ID NO: 4877 - DNA, 25 bp, Homo sapien
aacatagtgggaaaactagtcagga

SEQ ID NO: 4878 - DNA, 25 bp, Homo sapien
aacatagtggggaaactagtcagga

SEQ ID NO: 4879 - DNA, 25 bp, Homo sapien
aacatatcacataattgtgcctagt

SEQ ID NO: 4880 - DNA, 25 bp, Homo sapien
aacatatcccataattgtgcctagt

SEQ ID NO: 4881 - DNA, 25 bp, Homo sapien
aacatatccgctcctccaggacaat

SEQ ID NO: 4882 - DNA, 25 bp, Homo sapien
aacatatctgctcctccaggacaat

SEQ ID NO: 4883 - DNA, 25 bp, Homo sapien
aacatatgccctgcagtaaacatat

SEQ ID NO: 4884 - DNA, 25 bp, Homo sapien
aacatatgtcctgcagtaaacatat

SEQ ID NO: 4885 - DNA, 25 bp, Homo sapien
aacatattaccatcatattgattcc

SEQ ID NO: 4886 - DNA, 25 bp, Homo sapien
aacatattatcatcatattgattcc

SEQ ID NO: 4887 - DNA, 25 bp, Homo sapien
aacatattcctcaacaacagcatgc

SEQ ID NO: 4888 - DNA, 25 bp, Homo sapien
aacatattcctcagcaacagcatgc

SEQ ID NO: 4889 - DNA, 25 bp, Homo sapien
aacatatttgaagaagaagcccttg

SEQ ID NO: 4890 - DNA, 25 bp, Homo sapien
aacatatttgaggaagaagcccttg

SEQ ID NO: 4891 - DNA, 25 bp, Homo sapien
aacatattttcaatctctgattcat

SEQ ID NO: 4892 - DNA, 25 bp, Homo sapien
aacatattttctatctctgattcat

SEQ ID NO: 4893 - DNA, 25 bp, Homo sapien
aacatcaagcttctaggatagtttg

SEQ ID NO: 4894 - DNA, 25 bp, Homo sapien
aacatcaagcttgtaggatagtttg

SEQ ID NO: 4895 - DNA, 25 bp, Homo sapien
aacatcacaactctaaattataaac

SEQ ID NO: 4896 - DNA, 25 bp, Homo sapien
aacatcacatactctctgcgatggc

SEQ ID NO: 4897 - DNA, 25 bp, Homo sapien
aacatcacatactgtctgcgatggc

SEQ ID NO: 4898 - DNA, 25 bp, Homo sapien
aacatcacgactctaaattataaac

SEQ ID NO: 4899 - DNA, 25 bp, Homo sapien
aacatcacgcaggaaagtgggggaa

SEQ ID NO: 4900 - DNA, 25 bp, Homo sapien
aacatcacgcagtaaagtgggggaa

SEQ ID NO: 4901 - DNA, 25 bp, Homo sapien
aacatcagaataatcataaatggag

SEQ ID NO: 4902 - DNA, 25 bp, Homo sapien
aacatcagaattatcataaatggag

SEQ ID NO: 4903 - DNA, 25 bp, Homo sapien
aacatcagcactagccaggcagtat

SEQ ID NO: 4904 - DNA, 25 bp, Homo sapien
aacatcagcactaggcaggcagtat

SEQ ID NO: 4905 - DNA, 25 bp, Homo sapien
aacatcatcaaacagattttttttc

SEQ ID NO: 4906 - DNA, 25 bp, Homo sapien
aacatcatcaatataatttgctaat

SEQ ID NO: 4907 - DNA, 25 bp, Homo sapien
aacatcatcgatataatttgctaat

SEQ ID NO: 4908 - DNA, 25 bp, Homo sapien
aacatcattaaacagattttttttc

SEQ ID NO: 4909 - DNA, 25 bp, Homo sapien
aacatcattcgctatgctgagctgc

SEQ ID NO: 4910 - DNA, 25 bp, Homo sapien
aacatcattgcctgggttgcagtct

SEQ ID NO: 4911 - DNA, 25 bp, Homo sapien
aacatcattgcttgggttgcagtct

SEQ ID NO: 4912 - DNA, 25 bp, Homo sapien
aacatcattggctatgctgagctgc

SEQ ID NO: 4913 - DNA, 25 bp, Homo sapien
aacatcatttgtgagacgcacaatt

SEQ ID NO: 4914 - DNA, 25 bp, Homo sapien
aacatcatttgtgagatgcacaatt

SEQ ID NO: 4915 - DNA, 25 bp, Homo sapien
aacatccaaacaaacttgcagtcta

SEQ ID NO: 4916 - DNA, 25 bp, Homo sapien
aacatccaaacaggtgagcaaaaga

SEQ ID NO: 4917 - DNA, 25 bp, Homo sapien
aacatccaagcaaacttgcagtcta

SEQ ID NO: 4918 - DNA, 25 bp, Homo sapien
aacatccacaagcgtcaagaccatt

SEQ ID NO: 4919 - DNA, 25 bp, Homo sapien
aacatccacaagtgtcaagaccatt

SEQ ID NO: 4920 - DNA, 25 bp, Homo sapien
aacatccatacaggtgagcaaaaga

SEQ ID NO: 4921 - DNA, 25 bp, Homo sapien
aacatccctacgcagcgatgttggc

SEQ ID NO: 4922 - DNA, 25 bp, Homo sapien
aacatccctacgcagctatgttggc

SEQ ID NO: 4923 - DNA, 25 bp, Homo sapien
aacatccgtaacttagcaaaataaa

SEQ ID NO: 4924 - DNA, 25 bp, Homo sapien
aacatccgtaacttggcaaaataaa

SEQ ID NO: 4925 - DNA, 25 bp, Homo sapien
aacatctactcaaccttctaatcat

SEQ ID NO: 4926 - DNA, 25 bp, Homo sapien
aacatctactcaatcttctaatcat

SEQ ID NO: 4927 - DNA, 25 bp, Homo sapien
aacatctcaaaaccaaagttcgctt

SEQ ID NO: 4928 - DNA, 25 bp, Homo sapien
aacatctcaaaaccgaagttcgctt

SEQ ID NO: 4929 - DNA, 25 bp, Homo sapien
aacatctcattacatctgaatttat

SEQ ID NO: 4930 - DNA, 25 bp, Homo sapien
aacatctcattgcatctgaatttat

SEQ ID NO: 4931 - DNA, 25 bp, Homo sapien
aacatctgcgacggtttggatatgg

SEQ ID NO: 4932 - DNA, 25 bp, Homo sapien
aacatctgctacggtttggatatgg

SEQ ID NO: 4933 - DNA, 25 bp, Homo sapien
aacatctggataatttagaacttct

SEQ ID NO: 4934 - DNA, 25 bp, Homo sapien
aacatctggatagtttagaacttct

SEQ ID NO: 4935 - DNA, 25 bp, Homo sapien
aacatcttaactcactacagcttca

SEQ ID NO: 4936 - DNA, 25 bp, Homo sapien
aacatcttaactcattacagcttca

SEQ ID NO: 4937 - DNA, 25 bp, Homo sapien
aacatcttcattttagccacatgag

SEQ ID NO: 4938 - DNA, 25 bp, Homo sapien
aacatcttcattttcgccacatgag

SEQ ID NO: 4939 - DNA, 25 bp, Homo sapien
aacatgaaagttgcctaaaaaccac

SEQ ID NO: 4940 - DNA, 25 bp, Homo sapien
aacatgaaagtttcctaaaaaccac

SEQ ID NO: 4941 - DNA, 25 bp, Homo sapien
aacatgaaattcagtcaaggcagct

SEQ ID NO: 4942 - DNA, 25 bp, Homo sapien
aacatgaaattgagtcaaggcagct

SEQ ID NO: 4943 - DNA, 25 bp, Homo sapien
aacatgaataaaacctagtaaaatc

SEQ ID NO: 4944 - DNA, 25 bp, Homo sapien
aacatgaatgaaacctagtaaaatc

SEQ ID NO: 4945 - DNA, 25 bp, Homo sapien
aacatgagatggaaataatgccaag

SEQ ID NO: 4946 - DNA, 25 bp, Homo sapien
aacatgagatggaaatcatgccaag

SEQ ID NO: 4947 - DNA, 25 bp, Homo sapien
aacatgataaaagcttgcttattta

SEQ ID NO: 4948 - DNA, 25 bp, Homo sapien
aacatgataaaaggttgcttattta

SEQ ID NO: 4949 - DNA, 25 bp, Homo sapien
aacatgatgttcttattccaatcca

SEQ ID NO: 4950 - DNA, 25 bp, Homo sapien
aacatgatgttcttgttccaatcca

SEQ ID NO: 4951 - DNA, 25 bp, Homo sapien
aacatgcaactcaatgatattcaaa

SEQ ID NO: 4952 - DNA, 25 bp, Homo sapien
aacatgcaattcaatgatattcaaa

SEQ ID NO: 4953 - DNA, 25 bp, Homo sapien
aacatgcaccctttagctgctcttc

SEQ ID NO: 4954 - DNA, 25 bp, Homo sapien
aacatgcactctttagctgctcttc

SEQ ID NO: 4955 - DNA, 25 bp, Homo sapien
aacatgcagattcgttttcaccctt

SEQ ID NO: 4956 - DNA, 25 bp, Homo sapien
aacatgcagatttgttttcaccctt

SEQ ID NO: 4957 - DNA, 25 bp, Homo sapien
aacatgcatatacccatcacctcca

SEQ ID NO: 4958 - DNA, 25 bp, Homo sapien
aacatgcatatacctatcacctcca

SEQ ID NO: 4959 - DNA, 25 bp, Homo sapien
aacatgctgactctaaccaattgaa

SEQ ID NO: 4960 - DNA, 25 bp, Homo sapien
aacatgctgactttaaccaattgaa

SEQ ID NO: 4961 - DNA, 25 bp, Homo sapien
aacatgctgccactgagatgttgac

SEQ ID NO: 4962 - DNA, 25 bp, Homo sapien
aacatgctgtcactgagatgttgac

SEQ ID NO: 4963 - DNA, 25 bp, Homo sapien
aacatggaaagactagacttgctga

SEQ ID NO: 4964 - DNA, 25 bp, Homo sapien
aacatggaaagactaggcttgctga

SEQ ID NO: 4965 - DNA, 25 bp, Homo sapien
aacatggaaattacgggtagaaatt

SEQ ID NO: 4966 - DNA, 25 bp, Homo sapien
aacatggaaattatgggtagaaatt

SEQ ID NO: 4967 - DNA, 25 bp, Homo sapien
aacatggaagaaatctattattaag

SEQ ID NO: 4968 - DNA, 25 bp, Homo sapien
aacatggaagaagtctattattaag

SEQ ID NO: 4969 - DNA, 25 bp, Homo sapien
aacatggaggaaatatctactgggt

SEQ ID NO: 4970 - DNA, 25 bp, Homo sapien
aacatggaggaaatgtctactgggt

SEQ ID NO: 4971 - DNA, 25 bp, Homo sapien
aacatggagtgcacgtcatagccac

SEQ ID NO: 4972 - DNA, 25 bp, Homo sapien
aacatggagtgcatgtcatagccac

SEQ ID NO: 4973 - DNA, 25 bp, Homo sapien
aacatggatgtacaagcatctgagt

SEQ ID NO: 4974 - DNA, 25 bp, Homo sapien
aacatggatgtacaagtatctgagt

SEQ ID NO: 4975 - DNA, 25 bp, Homo sapien
aacatggcaagaggcatcatccata

SEQ ID NO: 4976 - DNA, 25 bp, Homo sapien
aacatggcaagaggtatcatccata

SEQ ID NO: 4977 - DNA, 25 bp, Homo sapien
aacatggccataattctctccccat

SEQ ID NO: 4978 - DNA, 25 bp, Homo sapien
aacatggctataattctctccccat

SEQ ID NO: 4979 - DNA, 25 bp, Homo sapien
aacatgggctatctctccgtttact

SEQ ID NO: 4980 - DNA, 25 bp, Homo sapien
aacatgggctatctcttcgtttact

SEQ ID NO: 4981 - DNA, 25 bp, Homo sapien
aacatggttaagcatcagcattcca

SEQ ID NO: 4982 - DNA, 25 bp, Homo sapien
aacatggttaaggatcagcattcca

SEQ ID NO: 4983 - DNA, 25 bp, Homo sapien
aacatgtacagagtggaactttgcc

SEQ ID NO: 4984 - DNA, 25 bp, Homo sapien
aacatgtaccgtacctcaccataca

SEQ ID NO: 4985 - DNA, 25 bp, Homo sapien
aacatgtactgtacctcaccataca

SEQ ID NO: 4986 - DNA, 25 bp, Homo sapien
aacatgtatagagtggaactttgcc

SEQ ID NO: 4987 - DNA, 25 bp, Homo sapien
aacatgtccttcccggtgtctcagg

SEQ ID NO: 4988 - DNA, 25 bp, Homo sapien
aacatgtccttcctggtgtctcagg

SEQ ID NO: 4989 - DNA, 25 bp, Homo sapien
aacatgtggtatttagcgtgtagta

SEQ ID NO: 4990 - DNA, 25 bp, Homo sapien
aacatgtgtagaagtctccttggtt

SEQ ID NO: 4991 - DNA, 25 bp, Homo sapien
aacatgtgtagacgtctccttggtt

SEQ ID NO: 4992 - DNA, 25 bp, Homo sapien
aacatgtgttatttagcgtgtagta

SEQ ID NO: 4993 - DNA, 25 bp, Homo sapien
aacatgttacatacaccatgagaat

SEQ ID NO: 4994 - DNA, 25 bp, Homo sapien
aacatgttacatagaccatgagaat

SEQ ID NO: 4995 - DNA, 25 bp, Homo sapien
aacatgttatacacccttttcatgg

SEQ ID NO: 4996 - DNA, 25 bp, Homo sapien
aacatgttatatacccttttcatgg

SEQ ID NO: 4997 - DNA, 25 bp, Homo sapien
aacatgttgacaaatcaaaattagt

SEQ ID NO: 4998 - DNA, 25 bp, Homo sapien
aacatgttgacaaatccaaattagt

SEQ ID NO: 4999 - DNA, 25 bp, Homo sapien
aacattaaaatgcagccaatttctc

SEQ ID NO: 5000 - DNA, 25 bp, Homo sapien
aacattaagatgcagccaatttctc

SEQ ID NO: 5001 - DNA, 25 bp, Homo sapien
aacattaattttatctgcagcatcc

SEQ ID NO: 5002 - DNA, 25 bp, Homo sapien
aacattaattttgtctgcagcatcc

SEQ ID NO: 5003 - DNA, 25 bp, Homo sapien
aacattagagcaataaggtgaccag

SEQ ID NO: 5004 - DNA, 25 bp, Homo sapien
aacattagatcataccctgtttgtc

SEQ ID NO: 5005 - DNA, 25 bp, Homo sapien
aacattagatcataccgtgtttgtc

SEQ ID NO: 5006 - DNA, 25 bp, Homo sapien
aacattagggcaataaggtgaccag

SEQ ID NO: 5007 - DNA, 25 bp, Homo sapien
aacattatgatcaaaggtgaaagtt

SEQ ID NO: 5008 - DNA, 25 bp, Homo sapien
aacattatgccaaatgaaacaaatc

SEQ ID NO: 5009 - DNA, 25 bp, Homo sapien
aacattatgccaagtgaaacaaatc

SEQ ID NO: 5010 - DNA, 25 bp, Homo sapien
aacattatgctcaaaggtgaaagtt

SEQ ID NO: 5011 - DNA, 25 bp, Homo sapien
aacattcaaattcaggaaacattca

SEQ ID NO: 5012 - DNA, 25 bp, Homo sapien
aacattcaaatttaggaaacattca

SEQ ID NO: 5013 - DNA, 25 bp, Homo sapien
aacattcactgactctacactatat

SEQ ID NO: 5014 - DNA, 25 bp, Homo sapien
aacattcactggctctacactatat

SEQ ID NO: 5015 - DNA, 25 bp, Homo sapien
aacattcatctcctctgagtccagg

SEQ ID NO: 5016 - DNA, 25 bp, Homo sapien
aacattcatgtcctctgagtccagg

SEQ ID NO: 5017 - DNA, 25 bp, Homo sapien
aacattccaccatagttcagactat

SEQ ID NO: 5018 - DNA, 25 bp, Homo sapien
aacattccaccgtagttcagactat

SEQ ID NO: 5019 - DNA, 25 bp, Homo sapien
aacattccttattatacaagagagg

SEQ ID NO: 5020 - DNA, 25 bp, Homo sapien
aacattccttattctacaagagagg

SEQ ID NO: 5021 - DNA, 25 bp, Homo sapien
aacattctgaacagtaccatttaga

SEQ ID NO: 5022 - DNA, 25 bp, Homo sapien
aacattctgaaccgtaccatttaga

SEQ ID NO: 5023 - DNA, 25 bp, Homo sapien
aacattgacaaaacgcagaaggggt

SEQ ID NO: 5024 - DNA, 25 bp, Homo sapien
aacattgacaaaatgcagaaggggt

SEQ ID NO: 5025 - DNA, 25 bp, Homo sapien
aacattgagccaccatttaagaaat

SEQ ID NO: 5026 - DNA, 25 bp, Homo sapien
aacattgagccatcatttaagaaat

SEQ ID NO: 5027 - DNA, 25 bp, Homo sapien
aacattgatcaccagagttaaggag

SEQ ID NO: 5028 - DNA, 25 bp, Homo sapien
aacattgatcatcagagttaaggag

SEQ ID NO: 5029 - DNA, 25 bp, Homo sapien
aacattgctgtcatgaaaagtagta

SEQ ID NO: 5030 - DNA, 25 bp, Homo sapien
aacattgctgtcattaaaagtagta

SEQ ID NO: 5031 - DNA, 25 bp, Homo sapien
aacattggaaagccagatgggagtg

SEQ ID NO: 5032 - DNA, 25 bp, Homo sapien
aacattggaaagccaggtgggagtg

SEQ ID NO: 5033 - DNA, 25 bp, Homo sapien
aacattggattacatacttcgaagt

SEQ ID NO: 5034 - DNA, 25 bp, Homo sapien
aacattggattacatatttcgaagt

SEQ ID NO: 5035 - DNA, 25 bp, Homo sapien
aacattggattagacaaacatttct

SEQ ID NO: 5036 - DNA, 25 bp, Homo sapien
aacattggattatacaaacatttct

SEQ ID NO: 5037 - DNA, 25 bp, Homo sapien
aacattgtcactccaagggctgagg

SEQ ID NO: 5038 - DNA, 25 bp, Homo sapien
aacattgtcactccgagggctgagg

SEQ ID NO: 5039 - DNA, 25 bp, Homo sapien
aacatttaaagtatctgtcagttaa

SEQ ID NO: 5040 - DNA, 25 bp, Homo sapien
aacatttaaggtatctgtcagttaa

SEQ ID NO: 5041 - DNA, 25 bp, Homo sapien
aacatttagattggtgtaagccttt

SEQ ID NO: 5042 - DNA, 25 bp, Homo sapien
aacatttagattgttgtaagccttt

SEQ ID NO: 5043 - DNA, 25 bp, Homo sapien
aacatttatcacttctacattttta

SEQ ID NO: 5044 - DNA, 25 bp, Homo sapien
aacatttatcatttctacattttta

SEQ ID NO: 5045 - DNA, 25 bp, Homo sapien
aacatttattacacgtcacaaaaag

SEQ ID NO: 5046 - DNA, 25 bp, Homo sapien
aacatttattacatgtcacaaaaag

SEQ ID NO: 5047 - DNA, 25 bp, Homo sapien
aacatttcagaagatctcgtttaaa

SEQ ID NO: 5048 - DNA, 25 bp, Homo sapien
aacatttcagaaggtctcgtttaaa

SEQ ID NO: 5049 - DNA, 25 bp, Homo sapien
aacatttcaggcaatctgacatact

SEQ ID NO: 5050 - DNA, 25 bp, Homo sapien
aacatttcaggcgatctgacatact

SEQ ID NO: 5051 - DNA, 25 bp, Homo sapien
aacatttcatttctgtgttgggtca

SEQ ID NO: 5052 - DNA, 25 bp, Homo sapien
aacatttcatttctgttttgggtca

SEQ ID NO: 5053 - DNA, 25 bp, Homo sapien
aacatttccatcagaatttgagtag

SEQ ID NO: 5054 - DNA, 25 bp, Homo sapien
aacatttccatcggaatttgagtag

SEQ ID NO: 5055 - DNA, 25 bp, Homo sapien
aacatttcccttcgggttccagcct

SEQ ID NO: 5056 - DNA, 25 bp, Homo sapien
aacatttccctttgggttccagcct

SEQ ID NO: 5057 - DNA, 25 bp, Homo sapien
aacatttcctgcaaagatatttttc

SEQ ID NO: 5058 - DNA, 25 bp, Homo sapien
aacatttcctgcgaagatatttttc

SEQ ID NO: 5059 - DNA, 25 bp, Homo sapien
aacatttcttccctggatttcaatt

SEQ ID NO: 5060 - DNA, 25 bp, Homo sapien
aacatttcttccctgggtttcaatt

SEQ ID NO: 5061 - DNA, 25 bp, Homo sapien
aacatttgaacaatgatgaagtcac

SEQ ID NO: 5062 - DNA, 25 bp, Homo sapien
aacatttggacaatgatgaagtcac

SEQ ID NO: 5063 - DNA, 25 bp, Homo sapien
aacatttgtatttcagttgcatcag

SEQ ID NO: 5064 - DNA, 25 bp, Homo sapien
aacatttgtattttagttgcatcag

SEQ ID NO: 5065 - DNA, 25 bp, Homo sapien
aacatttgtgggagatattgaatat

SEQ ID NO: 5066 - DNA, 25 bp, Homo sapien
aacatttgttgatttggcctattgt

SEQ ID NO: 5067 - DNA, 25 bp, Homo sapien
aacatttgttggagatattgaatat

SEQ ID NO: 5068 - DNA, 25 bp, Homo sapien
aacatttgttggtttggcctattgt

SEQ ID NO: 5069 - DNA, 25 bp, Homo sapien
aacattttatcttaaatggtaaaag

SEQ ID NO: 5070 - DNA, 25 bp, Homo sapien
aacattttctaccacgctcccttac

SEQ ID NO: 5071 - DNA, 25 bp, Homo sapien
aacattttctaccatgctcccttac

SEQ ID NO: 5072 - DNA, 25 bp, Homo sapien
aacattttctcagatacaggacata

SEQ ID NO: 5073 - DNA, 25 bp, Homo sapien
aacattttctcagatataggacata

SEQ ID NO: 5074 - DNA, 25 bp, Homo sapien
aacattttgccactatcttcttagg

SEQ ID NO: 5075 - DNA, 25 bp, Homo sapien
aacattttgccactgtcttcttagg

SEQ ID NO: 5076 - DNA, 25 bp, Homo sapien
aacattttgtcttaaatggtaaaag

SEQ ID NO: 5077 - DNA, 25 bp, Homo sapien
aacatttttgaaaatacggtctctg

SEQ ID NO: 5078 - DNA, 25 bp, Homo sapien
aacatttttgaagatacggtctctg

SEQ ID NO: 5079 - DNA, 25 bp, Homo sapien
aacatttttgtgaacttcccaaaat

SEQ ID NO: 5080 - DNA, 25 bp, Homo sapien
aacatttttgtggacttcccaaaat

SEQ ID NO: 5081 - DNA, 25 bp, Homo sapien
aaccaaaatcatgtccatttaatag

SEQ ID NO: 5082 - DNA, 25 bp, Homo sapien
aaccaaaatcatgtccgtttaatag

SEQ ID NO: 5083 - DNA, 25 bp, Homo sapien
aaccaaagaaggagcttttacacca

SEQ ID NO: 5084 - DNA, 25 bp, Homo sapien
aaccaaagagatgcaggttaatttc

SEQ ID NO: 5085 - DNA, 25 bp, Homo sapien
aaccaaagagattcaggttaatttc

SEQ ID NO: 5086 - DNA, 25 bp, Homo sapien
aaccaaagagccaaagcagtgatta

SEQ ID NO: 5087 - DNA, 25 bp, Homo sapien
aaccaaagagccgaagcagtgatta

SEQ ID NO: 5088 - DNA, 25 bp, Homo sapien
aaccaaagagcttagtcggatttga

SEQ ID NO: 5089 - DNA, 25 bp, Homo sapien
aaccaaagagcttagttggatttga

SEQ ID NO: 5090 - DNA, 25 bp, Homo sapien
aaccaaagagggagcttttacacca

SEQ ID NO: 5091 - DNA, 25 bp, Homo sapien
aaccaaataaaatttgaggattgtc

SEQ ID NO: 5092 - DNA, 25 bp, Homo sapien
aaccaaatacaatttgaggattgtc

SEQ ID NO: 5093 - DNA, 25 bp, Homo sapien
aaccaaatccaacagttcattaaaa

SEQ ID NO: 5094 - DNA, 25 bp, Homo sapien
aaccaaatccaagagttcattaaaa

SEQ ID NO: 5095 - DNA, 25 bp, Homo sapien
aaccaaatgcttaaagtttcaaatg

SEQ ID NO: 5096 - DNA, 25 bp, Homo sapien
aaccaaatgcttgaagtttcaaatg

SEQ ID NO: 5097 - DNA, 25 bp, Homo sapien
aaccaaatgtgttaaggcactaggc

SEQ ID NO: 5098 - DNA, 25 bp, Homo sapien
aaccaaatgtgttgaggcactaggc

SEQ ID NO: 5099 - DNA, 25 bp, Homo sapien
aaccaaattcaacacaagttttaga

SEQ ID NO: 5100 - DNA, 25 bp, Homo sapien
aaccaaattcaacagaagttttaga

SEQ ID NO: 5101 - DNA, 25 bp, Homo sapien
aaccaaatttatgacccaaacttag

SEQ ID NO: 5102 - DNA, 25 bp, Homo sapien
aaccaaatttatgatccaaacttag

SEQ ID NO: 5103 - DNA, 25 bp, Homo sapien
aaccaacatcgaccctttgagcagg

SEQ ID NO: 5104 - DNA, 25 bp, Homo sapien
aaccaacattgaccctttgagcagg

SEQ ID NO: 5105 - DNA, 25 bp, Homo sapien
aaccaaccacaaaattccacagaaa

SEQ ID NO: 5106 - DNA, 25 bp, Homo sapien
aaccaaccataaaattccacagaaa

SEQ ID NO: 5107 - DNA, 25 bp, Homo sapien
aaccaaccctggatattagtatagc

SEQ ID NO: 5108 - DNA, 25 bp, Homo sapien
aaccaaccgtggatattagtatagc

SEQ ID NO: 5109 - DNA, 25 bp, Homo sapien
aaccaaggtaaggcccaaagtattg

SEQ ID NO: 5110 - DNA, 25 bp, Homo sapien
aaccaaggtaaggcccgaagtattg

SEQ ID NO: 5111 - DNA, 25 bp, Homo sapien
aaccaaggtagcgaggttggccaat

SEQ ID NO: 5112 - DNA, 25 bp, Homo sapien
aaccaaggtagtgaggttggccaat

SEQ ID NO: 5113 - DNA, 25 bp, Homo sapien
aaccaatacggtaatggcatgtgag

SEQ ID NO: 5114 - DNA, 25 bp, Homo sapien
aaccaatatggtaatggcatgtgag

SEQ ID NO: 5115 - DNA, 25 bp, Homo sapien
aaccaatccactgaataagagagac

SEQ ID NO: 5116 - DNA, 25 bp, Homo sapien
aaccaatccgctgaataagagagac

SEQ ID NO: 5117 - DNA, 25 bp, Homo sapien
aaccaatctgaactagaacctcaca

SEQ ID NO: 5118 - DNA, 25 bp, Homo sapien
aaccaatctgagctagaacctcaca

SEQ ID NO: 5119 - DNA, 25 bp, Homo sapien
aaccaatgctcatccagcacgtatt

SEQ ID NO: 5120 - DNA, 25 bp, Homo sapien
aaccaatgttcatccagcacgtatt

SEQ ID NO: 5121 - DNA, 25 bp, Homo sapien
aaccaattgtttccctatactctaa

SEQ ID NO: 5122 - DNA, 25 bp, Homo sapien
aaccaattgtttccctgtactctaa

SEQ ID NO: 5123 - DNA, 25 bp, Homo sapien
aaccaatttaccatagacatgtagg

SEQ ID NO: 5124 - DNA, 25 bp, Homo sapien
aaccaatttaccgtagacatgtagg

SEQ ID NO: 5125 - DNA, 25 bp, Homo sapien
aaccaatttgggccagatttctgtg

SEQ ID NO: 5126 - DNA, 25 bp, Homo sapien
aaccaatttgggtcagatttctgtg

SEQ ID NO: 5127 - DNA, 25 bp, Homo sapien
aaccacaaacaagcaaacaacaaat

SEQ ID NO: 5128 - DNA, 25 bp, Homo sapien
aaccacaaacaagcgaacaacaaat

SEQ ID NO: 5129 - DNA, 25 bp, Homo sapien
aaccacaaattactggagcagaaac

SEQ ID NO: 5130 - DNA, 25 bp, Homo sapien
aaccacaacaaaagtgatgctttta

SEQ ID NO: 5131 - DNA, 25 bp, Homo sapien
aaccacaacgaaagtgatgctttta

SEQ ID NO: 5132 - DNA, 25 bp, Homo sapien
aaccacaacttactggagcagaaac

SEQ ID NO: 5133 - DNA, 25 bp, Homo sapien
aaccacacaaaaagcttagcaaatg

SEQ ID NO: 5134 - DNA, 25 bp, Homo sapien
aaccacacacaaaatgcatttcatt

SEQ ID NO: 5135 - DNA, 25 bp, Homo sapien
aaccacacacaaagtgcatttcatt

SEQ ID NO: 5136 - DNA, 25 bp, Homo sapien
aaccacacgaaaagcttagcaaatg

SEQ ID NO: 5137 - DNA, 25 bp, Homo sapien
aaccacagataaacttaccattaga

SEQ ID NO: 5138 - DNA, 25 bp, Homo sapien
aaccacagataagcttaccattaga

SEQ ID NO: 5139 - DNA, 25 bp, Homo sapien
aaccacagcagagaatacatgtgtt

SEQ ID NO: 5140 - DNA, 25 bp, Homo sapien
aaccacagcagagaatgcatgtgtt

SEQ ID NO: 5141 - DNA, 25 bp, Homo sapien
aaccacattcacatacatgccataa

SEQ ID NO: 5142 - DNA, 25 bp, Homo sapien
aaccacattcacatacgtgccataa

SEQ ID NO: 5143 - DNA, 25 bp, Homo sapien
aaccacccagaatatagcacagaga

SEQ ID NO: 5144 - DNA, 25 bp, Homo sapien
aaccacccagaatgtagcacagaga

SEQ ID NO: 5145 - DNA, 25 bp, Homo sapien
aaccaccgatattcatgagatatgc

SEQ ID NO: 5146 - DNA, 25 bp, Homo sapien
aaccaccgatattcgtgagatatgc

SEQ ID NO: 5147 - DNA, 25 bp, Homo sapien
aaccacctttactatgtaagttaat

SEQ ID NO: 5148 - DNA, 25 bp, Homo sapien
aaccacctttattatgtaagttaat

SEQ ID NO: 5149 - DNA, 25 bp, Homo sapien
aaccactaaacgataaataattgag

SEQ ID NO: 5150 - DNA, 25 bp, Homo sapien
aaccactaagcgataaataattgag

SEQ ID NO: 5151 - DNA, 25 bp, Homo sapien
aaccactactaattccaggtcagac

SEQ ID NO: 5152 - DNA, 25 bp, Homo sapien
aaccactactacttccaggtcagac

SEQ ID NO: 5153 - DNA, 25 bp, Homo sapien
aaccacttctacaacatttaattta

SEQ ID NO: 5154 - DNA, 25 bp, Homo sapien
aaccacttctactacatttaattta

SEQ ID NO: 5155 - DNA, 25 bp, Homo sapien
aaccagaaggaacctcagcaaattt

SEQ ID NO: 5156 - DNA, 25 bp, Homo sapien
aaccagaaggaacctcggcaaattt

SEQ ID NO: 5157 - DNA, 25 bp, Homo sapien
aaccagacaaccaacgccaattttt

SEQ ID NO: 5158 - DNA, 25 bp, Homo sapien
aaccagacaaccaatgccaattttt

SEQ ID NO: 5159 - DNA, 25 bp, Homo sapien
aaccagatactgagccttcaggagg

SEQ ID NO: 5160 - DNA, 25 bp, Homo sapien
aaccagatattgagccttcaggagg

SEQ ID NO: 5161 - DNA, 25 bp, Homo sapien
aaccagcaagggagcaacatggcac

SEQ ID NO: 5162 - DNA, 25 bp, Homo sapien
aaccagcaagggagcagcatggcac

SEQ ID NO: 5163 - DNA, 25 bp, Homo sapien
aaccagctcgtggacaaacatatct

SEQ ID NO: 5164 - DNA, 25 bp, Homo sapien
aaccagcttgtggacaaacatatct

SEQ ID NO: 5165 - DNA, 25 bp, Homo sapien
aaccaggagaagcctcagcataggc

SEQ ID NO: 5166 - DNA, 25 bp, Homo sapien
aaccaggagcagcctcagcataggc

SEQ ID NO: 5167 - DNA, 25 bp, Homo sapien
aaccagggctgcgctaattagattg

SEQ ID NO: 5168 - DNA, 25 bp, Homo sapien
aaccagggctgctctaattagattg

SEQ ID NO: 5169 - DNA, 25 bp, Homo sapien
aaccagtctccgggacatggaagtg

SEQ ID NO: 5170 - DNA, 25 bp, Homo sapien
aaccagtcttcgggacatggaagtg

SEQ ID NO: 5171 - DNA, 25 bp, Homo sapien
aaccagtgaaaacataaacagactg

SEQ ID NO: 5172 - DNA, 25 bp, Homo sapien
aaccagtgacccttctaagcattca

SEQ ID NO: 5173 - DNA, 25 bp, Homo sapien
aaccagtgagaacataaacagactg

SEQ ID NO: 5174 - DNA, 25 bp, Homo sapien
aaccagtggcccttctaagcattca

SEQ ID NO: 5175 - DNA, 25 bp, Homo sapien
aaccagttagcaccaatcttgtaca

SEQ ID NO: 5176 - DNA, 25 bp, Homo sapien
aaccagttagcaccgatcttgtaca

SEQ ID NO: 5177 - DNA, 25 bp, Homo sapien
aaccagttataaccatgccaagtgg

SEQ ID NO: 5178 - DNA, 25 bp, Homo sapien
aaccagttataaccgtgccaagtgg

SEQ ID NO: 5179 - DNA, 25 bp, Homo sapien
aaccagtttataaaaggaggatggg

SEQ ID NO: 5180 - DNA, 25 bp, Homo sapien
aaccagtttcctcacacggcaccat

SEQ ID NO: 5181 - DNA, 25 bp, Homo sapien
aaccagtttcctcacagggcaccat

SEQ ID NO: 5182 - DNA, 25 bp, Homo sapien
aaccagtttctaaaaggaggatggg

SEQ ID NO: 5183 - DNA, 25 bp, Homo sapien
aaccagtttgcccatgatgtggtgg

SEQ ID NO: 5184 - DNA, 25 bp, Homo sapien
aaccagtttgcccatggtgtggtgg

SEQ ID NO: 5185 - DNA, 25 bp, Homo sapien
aaccataaactggaaggtaaatagt

SEQ ID NO: 5186 - DNA, 25 bp, Homo sapien
aaccataacatctacgaacaggtga

SEQ ID NO: 5187 - DNA, 25 bp, Homo sapien
aaccataacgtctacgaacaggtga

SEQ ID NO: 5188 - DNA, 25 bp, Homo sapien
aaccataatctggaaggtaaatagt

SEQ ID NO: 5189 - DNA, 25 bp, Homo sapien
aaccatagacttcgtagtatgtatt

SEQ ID NO: 5190 - DNA, 25 bp, Homo sapien
aaccatagccttcgtagtatgtatt

SEQ ID NO: 5191 - DNA, 25 bp, Homo sapien
aaccatagtcaacgtaagaaaaaaa

SEQ ID NO: 5192 - DNA, 25 bp, Homo sapien
aaccatagtcaatgtaagaaaaaaa

SEQ ID NO: 5193 - DNA, 25 bp, Homo sapien
aaccatatcatcaatgtcatgtgac

SEQ ID NO: 5194 - DNA, 25 bp, Homo sapien
aaccatatcgtcaatgtcatgtgac

SEQ ID NO: 5195 - DNA, 25 bp, Homo sapien
aaccatctaagaactgtaaatcaga

SEQ ID NO: 5196 - DNA, 25 bp, Homo sapien
aaccatctaagaattgtaaatcaga

SEQ ID NO: 5197 - DNA, 25 bp, Homo sapien
aaccatctgcacatctagtccaccc

SEQ ID NO: 5198 - DNA, 25 bp, Homo sapien
aaccatctgcagatctagtccaccc

SEQ ID NO: 5199 - DNA, 25 bp, Homo sapien
aaccatctttacatcctccaggcct

SEQ ID NO: 5200 - DNA, 25 bp, Homo sapien
aaccatctttacgtcctccaggcct

SEQ ID NO: 5201 - DNA, 25 bp, Homo sapien
aaccatgaaaataaagtgggctcct

SEQ ID NO: 5202 - DNA, 25 bp, Homo sapien
aaccatgaagacatcattgcagcat

SEQ ID NO: 5203 - DNA, 25 bp, Homo sapien
aaccatgaagacgtcattgcagcat

SEQ ID NO: 5204 - DNA, 25 bp, Homo sapien
aaccatgaatataaagtgggctcct

SEQ ID NO: 5205 - DNA, 25 bp, Homo sapien
aaccatgagacaattcaaactcttt

SEQ ID NO: 5206 - DNA, 25 bp, Homo sapien
aaccatgagccaattcaaactcttt

SEQ ID NO: 5207 - DNA, 25 bp, Homo sapien
aaccatgatgttcgtgttgcaattt

SEQ ID NO: 5208 - DNA, 25 bp, Homo sapien
aaccatgatgtttgtgttgcaattt

SEQ ID NO: 5209 - DNA, 25 bp, Homo sapien
aaccatgcaaaactggcactgatgg

SEQ ID NO: 5210 - DNA, 25 bp, Homo sapien
aaccatgcaaaattggcactgatgg

SEQ ID NO: 5211 - DNA, 25 bp, Homo sapien
aaccatgccatgtcggacttcagaa

SEQ ID NO: 5212 - DNA, 25 bp, Homo sapien
aaccatgccatgttggacttcagaa

SEQ ID NO: 5213 - DNA, 25 bp, Homo sapien
aaccatgctacaaatgtttattgag

SEQ ID NO: 5214 - DNA, 25 bp, Homo sapien
aaccatgctacagatgtttattgag

SEQ ID NO: 5215 - DNA, 25 bp, Homo sapien
aaccatggaatacttgagtgggagt

SEQ ID NO: 5216 - DNA, 25 bp, Homo sapien
aaccatggagtacttgagtgggagt

SEQ ID NO: 5217 - DNA, 25 bp, Homo sapien
aaccatggatttcattcccactgct

SEQ ID NO: 5218 - DNA, 25 bp, Homo sapien
aaccatggattttattcccactgct

SEQ ID NO: 5219 - DNA, 25 bp, Homo sapien
aaccatggctgcttttaaggcatta

SEQ ID NO: 5220 - DNA, 25 bp, Homo sapien
aaccatggctgtttttaaggcatta

SEQ ID NO: 5221 - DNA, 25 bp, Homo sapien
aaccatgtaaccttctcggtcttgt

SEQ ID NO: 5222 - DNA, 25 bp, Homo sapien
aaccatgtaaccttcttggtcttgt

SEQ ID NO: 5223 - DNA, 25 bp, Homo sapien
aaccatgtcaccttactttgcccca

SEQ ID NO: 5224 - DNA, 25 bp, Homo sapien
aaccatgtcgccttactttgcccca

SEQ ID NO: 5225 - DNA, 25 bp, Homo sapien
aaccattatcaactcttgcttcact

SEQ ID NO: 5226 - DNA, 25 bp, Homo sapien
aaccattatcatctcttgcttcact

SEQ ID NO: 5227 - DNA, 25 bp, Homo sapien
aaccattattaatattcaatatcca

SEQ ID NO: 5228 - DNA, 25 bp, Homo sapien
aaccattattaatattgaatatcca

SEQ ID NO: 5229 - DNA, 25 bp, Homo sapien
aaccattgaccatattggacatgaa

SEQ ID NO: 5230 - DNA, 25 bp, Homo sapien
aaccattgaccgtattggacatgaa

SEQ ID NO: 5231 - DNA, 25 bp, Homo sapien
aaccattgcaaataccaacaccagc

SEQ ID NO: 5232 - DNA, 25 bp, Homo sapien
aaccattgcaaatatcaacaccagc

SEQ ID NO: 5233 - DNA, 25 bp, Homo sapien
aaccattgtattgattaactagtat

SEQ ID NO: 5234 - DNA, 25 bp, Homo sapien
aaccattgtattgattgactagtat

SEQ ID NO: 5235 - DNA, 25 bp, Homo sapien
aacccaaaactaggcatttggtttc

SEQ ID NO: 5236 - DNA, 25 bp, Homo sapien
aacccaaaactatgcatttggtttc

SEQ ID NO: 5237 - DNA, 25 bp, Homo sapien
aacccaacatatagtaattaaggta

SEQ ID NO: 5238 - DNA, 25 bp, Homo sapien
aacccaacatatggtaattaaggta

SEQ ID NO: 5239 - DNA, 25 bp, Homo sapien
aacccaaggttacgcatctagcaag

SEQ ID NO: 5240 - DNA, 25 bp, Homo sapien
aacccaaggttactcatctagcaag

SEQ ID NO: 5241 - DNA, 25 bp, Homo sapien
aacccacacagagaactgagacatt

SEQ ID NO: 5242 - DNA, 25 bp, Homo sapien
aacccacacagcgaactgagacatt

SEQ ID NO: 5243 - DNA, 25 bp, Homo sapien
aacccacgaattgggcagtttgtac

SEQ ID NO: 5244 - DNA, 25 bp, Homo sapien
aacccacgatttgggcagtttgtac

SEQ ID NO: 5245 - DNA, 25 bp, Homo sapien
aacccagaatacagaagtacatcgg

SEQ ID NO: 5246 - DNA, 25 bp, Homo sapien
aacccagaatacggaagtacatcgg

SEQ ID NO: 5247 - DNA, 25 bp, Homo sapien
aacccagatccttcactggcaaccc

SEQ ID NO: 5248 - DNA, 25 bp, Homo sapien
aacccagatccttcgctggcaaccc

SEQ ID NO: 5249 - DNA, 25 bp, Homo sapien
aacccagatgacatcttagctggga

SEQ ID NO: 5250 - DNA, 25 bp, Homo sapien
aacccagatgatatcttagctggga

SEQ ID NO: 5251 - DNA, 25 bp, Homo sapien
aacccaggtcttgcatctgccaccg

SEQ ID NO: 5252 - DNA, 25 bp, Homo sapien
aacccaggtcttgtatctgccaccg

SEQ ID NO: 5253 - DNA, 25 bp, Homo sapien
aacccagtcattttgtagcccagat

SEQ ID NO: 5254 - DNA, 25 bp, Homo sapien
aacccagtcgttttgtagcccagat

SEQ ID NO: 5255 - DNA, 25 bp, Homo sapien
aacccatgattacttgtccattaag

SEQ ID NO: 5256 - DNA, 25 bp, Homo sapien
aacccatgattatttgtccattaag

SEQ ID NO: 5257 - DNA, 25 bp, Homo sapien
aacccatgcaaaagaggaactgcaa

SEQ ID NO: 5258 - DNA, 25 bp, Homo sapien
aacccatgcaaaggaggaactgcaa

SEQ ID NO: 5259 - DNA, 25 bp, Homo sapien
aacccatgcctatggaatttcatcc

SEQ ID NO: 5260 - DNA, 25 bp, Homo sapien
aacccatgcttatggaatttcatcc

SEQ ID NO: 5261 - DNA, 25 bp, Homo sapien
aacccattctcaggctgttatgaag

SEQ ID NO: 5262 - DNA, 25 bp, Homo sapien
aacccattctcatgctgttatgaag

SEQ ID NO: 5263 - DNA, 25 bp, Homo sapien
aaccccaaaagagtgatggcgtctc

SEQ ID NO: 5264 - DNA, 25 bp, Homo sapien
aaccccaaaagattgatggcgtctc

SEQ ID NO: 5265 - DNA, 25 bp, Homo sapien
aaccccagggcctcccaacatgtgg

SEQ ID NO: 5266 - DNA, 25 bp, Homo sapien
aaccccagggcctcccgacatgtgg

SEQ ID NO: 5267 - DNA, 25 bp, Homo sapien
aacccctgtaaccagtcgtcaactc

SEQ ID NO: 5268 - DNA, 25 bp, Homo sapien
aacccctgtaaccagttgtcaactc

SEQ ID NO: 5269 - DNA, 25 bp, Homo sapien
aacccggcatcatggagaaaaatac

SEQ ID NO: 5270 - DNA, 25 bp, Homo sapien
aacccggcatcctggagaaaaatac

SEQ ID NO: 5271 - DNA, 25 bp, Homo sapien
aacccgttcaggatgaaaagagcca

SEQ ID NO: 5272 - DNA, 25 bp, Homo sapien
aacccgttcagggtgaaaagagcca

SEQ ID NO: 5273 - DNA, 25 bp, Homo sapien
aacccgtttctctagcgctttattt

SEQ ID NO: 5274 - DNA, 25 bp, Homo sapien
aacccgtttctctagctctttattt

SEQ ID NO: 5275 - DNA, 25 bp, Homo sapien
aaccctaattttgcaccggagaaaa

SEQ ID NO: 5276 - DNA, 25 bp, Homo sapien
aaccctaattttgcacgggagaaaa

SEQ ID NO: 5277 - DNA, 25 bp, Homo sapien
aaccctcaacggacggctgcagaag

SEQ ID NO: 5278 - DNA, 25 bp, Homo sapien
aaccctcaatggacggctgcagaag

SEQ ID NO: 5279 - DNA, 25 bp, Homo sapien
aaccctgcagctaagtagtattagc

SEQ ID NO: 5280 - DNA, 25 bp, Homo sapien
aaccctgcagctaggtagtattagc

SEQ ID NO: 5281 - DNA, 25 bp, Homo sapien
aaccctgcatctatgagctttacct

SEQ ID NO: 5282 - DNA, 25 bp, Homo sapien
aaccctgcgtctatgagctttacct

SEQ ID NO: 5283 - DNA, 25 bp, Homo sapien
aaccctgcttctgagttagacacac

SEQ ID NO: 5284 - DNA, 25 bp, Homo sapien
aaccctgcttctgggttagacacac

SEQ ID NO: 5285 - DNA, 25 bp, Homo sapien
aaccctggagtatcgcaatcatgac

SEQ ID NO: 5286 - DNA, 25 bp, Homo sapien
aaccctggagtattgcaatcatgac

SEQ ID NO: 5287 - DNA, 25 bp, Homo sapien
aaccctggagtcgagtttcacaaag

SEQ ID NO: 5288 - DNA, 25 bp, Homo sapien
aaccctggagttgagtttcacaaag

SEQ ID NO: 5289 - DNA, 25 bp, Homo sapien
aaccctgtgaggtccaaattattat

SEQ ID NO: 5290 - DNA, 25 bp, Homo sapien
aaccctgtgaggtccagattattat

SEQ ID NO: 5291 - DNA, 25 bp, Homo sapien
aacccttactttcactttgcatttt

SEQ ID NO: 5292 - DNA, 25 bp, Homo sapien
aacccttactttcattttgcatttt

SEQ ID NO: 5293 - DNA, 25 bp, Homo sapien
aacccttccagctctacaactcact

SEQ ID NO: 5294 - DNA, 25 bp, Homo sapien
aacccttccagctttacaactcact

SEQ ID NO: 5295 - DNA, 25 bp, Homo sapien
aacccttctatgccatacttatcac

SEQ ID NO: 5296 - DNA, 25 bp, Homo sapien
aacccttctatgccgtacttatcac

SEQ ID NO: 5297 - DNA, 25 bp, Homo sapien
aacccttggcttatggccacatcat

SEQ ID NO: 5298 - DNA, 25 bp, Homo sapien
aacccttggcttatggtcacatcat

SEQ ID NO: 5299 - DNA, 25 bp, Homo sapien
aacccttgggccatgactgaacatc

SEQ ID NO: 5300 - DNA, 25 bp, Homo sapien
aacccttgggccatgattgaacatc

SEQ ID NO: 5301 - DNA, 25 bp, Homo sapien
aacccttgggtgcagagtagatatg

SEQ ID NO: 5302 - DNA, 25 bp, Homo sapien
aacccttgggtgcggagtagatatg

SEQ ID NO: 5303 - DNA, 25 bp, Homo sapien
aaccctttattgtgcaagactgccc

SEQ ID NO: 5304 - DNA, 25 bp, Homo sapien
aaccctttattgtgtaagactgccc

SEQ ID NO: 5305 - DNA, 25 bp, Homo sapien
aaccgaaatcaaacagaagtgtcta

SEQ ID NO: 5306 - DNA, 25 bp, Homo sapien
aaccgaaatcaagcagaagtgtcta

SEQ ID NO: 5307 - DNA, 25 bp, Homo sapien
aaccgaaattttatctcctttgagc

SEQ ID NO: 5308 - DNA, 25 bp, Homo sapien
aaccgaaattttatctgctttgagc

SEQ ID NO: 5309 - DNA, 25 bp, Homo sapien
aaccgatacagggaagctctcttgt

SEQ ID NO: 5310 - DNA, 25 bp, Homo sapien
aaccgatatagggaagctctcttgt

SEQ ID NO: 5311 - DNA, 25 bp, Homo sapien
aaccgatcaaaccttaaccgtctgg

SEQ ID NO: 5312 - DNA, 25 bp, Homo sapien
aaccgatcaaactttaaccgtctgg

SEQ ID NO: 5313 - DNA, 25 bp, Homo sapien
aaccgattgaaattcaactcttttt

SEQ ID NO: 5314 - DNA, 25 bp, Homo sapien
aaccgattgaagttcaactcttttt

SEQ ID NO: 5315 - DNA, 25 bp, Homo sapien
aaccgcatcaaaagaaaggtgaggc

SEQ ID NO: 5316 - DNA, 25 bp, Homo sapien
aaccgcatcaaaaggaaggtgaggc

SEQ ID NO: 5317 - DNA, 25 bp, Homo sapien
aaccgccagccaggtttgagcacct

SEQ ID NO: 5318 - DNA, 25 bp, Homo sapien
aaccgccagccatgtttgagcacct

SEQ ID NO: 5319 - DNA, 25 bp, Homo sapien
aaccgggcataaagacttgacattc

SEQ ID NO: 5320 - DNA, 25 bp, Homo sapien
aaccgggcataaaggcttgacattc

SEQ ID NO: 5321 - DNA, 25 bp, Homo sapien
aaccgggtaatctacttctaagcct

SEQ ID NO: 5322 - DNA, 25 bp, Homo sapien
aaccgggtaatctgcttctaagcct

SEQ ID NO: 5323 - DNA, 25 bp, Homo sapien
aaccgtattcagatttccccagttg

SEQ ID NO: 5324 - DNA, 25 bp, Homo sapien
aaccgtattcagattttcccagttg

SEQ ID NO: 5325 - DNA, 25 bp, Homo sapien
aaccgtcacagttaaccattacgca

SEQ ID NO: 5326 - DNA, 25 bp, Homo sapien
aaccgtcactgttaaccattacgca

SEQ ID NO: 5327 - DNA, 25 bp, Homo sapien
aaccgtcatttcaaatacttcctct

SEQ ID NO: 5328 - DNA, 25 bp, Homo sapien
aaccgtcatttcgaatacttcctct

SEQ ID NO: 5329 - DNA, 25 bp, Homo sapien
aaccgtttctcagctctgtttgccc

SEQ ID NO: 5330 - DNA, 25 bp, Homo sapien
aaccgtttctcagttctgtttgccc

SEQ ID NO: 5331 - DNA, 25 bp, Homo sapien
aacctaaaaatacttctcccatgga

SEQ ID NO: 5332 - DNA, 25 bp, Homo sapien
aacctaaaaatgcttctcccatgga

SEQ ID NO: 5333 - DNA, 25 bp, Homo sapien
aacctaagagatgccggatgttcct

SEQ ID NO: 5334 - DNA, 25 bp, Homo sapien
aacctaagagatgctggatgttcct

SEQ ID NO: 5335 - DNA, 25 bp, Homo sapien
aacctaagtaatgtccattttacct

SEQ ID NO: 5336 - DNA, 25 bp, Homo sapien
aacctaagtaatgttcattttacct

SEQ ID NO: 5337 - DNA, 25 bp, Homo sapien
aacctacataatctgcctactatca

SEQ ID NO: 5338 - DNA, 25 bp, Homo sapien
aacctacataatctgcttactatca

SEQ ID NO: 5339 - DNA, 25 bp, Homo sapien
aacctaccactgaagccaaaattac

SEQ ID NO: 5340 - DNA, 25 bp, Homo sapien
aacctaccattgaagccaaaattac

SEQ ID NO: 5341 - DNA, 25 bp, Homo sapien
aacctactagagcagaaaagaatgg

SEQ ID NO: 5342 - DNA, 25 bp, Homo sapien
aacctactagagcagagaagaatgg

SEQ ID NO: 5343 - DNA, 25 bp, Homo sapien
aacctactattttgacaggtatacc

SEQ ID NO: 5344 - DNA, 25 bp, Homo sapien
aacctactgttttgacaggtatacc

SEQ ID NO: 5345 - DNA, 25 bp, Homo sapien
aacctaggctgcctggcttcagggt

SEQ ID NO: 5346 - DNA, 25 bp, Homo sapien
aacctaggctgcttggcttcagggt

SEQ ID NO: 5347 - DNA, 25 bp, Homo sapien
aacctataaaactcctagatcataa

SEQ ID NO: 5348 - DNA, 25 bp, Homo sapien
aacctataaaactcttagatcataa

SEQ ID NO: 5349 - DNA, 25 bp, Homo sapien
aacctatcaaaaaattgtgtcttac

SEQ ID NO: 5350 - DNA, 25 bp, Homo sapien
aacctatcaaagaattgtgtcttac

SEQ ID NO: 5351 - DNA, 25 bp, Homo sapien
aacctatcttgactagagctttgca

SEQ ID NO: 5352 - DNA, 25 bp, Homo sapien
aacctatcttgagtagagctttgca

SEQ ID NO: 5353 - DNA, 25 bp, Homo sapien
aacctatgcacgtcatgctttactt

SEQ ID NO: 5354 - DNA, 25 bp, Homo sapien
aacctatgcccgtcatgctttactt

SEQ ID NO: 5355 - DNA, 25 bp, Homo sapien
aacctatgctcaattccaagcctca

SEQ ID NO: 5356 - DNA, 25 bp, Homo sapien
aacctatgctcagttccaagcctca

SEQ ID NO: 5357 - DNA, 25 bp, Homo sapien
aacctatttatacacataagccact

SEQ ID NO: 5358 - DNA, 25 bp, Homo sapien
aacctatttatatacataagccact

SEQ ID NO: 5359 - DNA, 25 bp, Homo sapien
aacctcaacatcactgattagtaga

SEQ ID NO: 5360 - DNA, 25 bp, Homo sapien
aacctcaacatcattgattagtaga

SEQ ID NO: 5361 - DNA, 25 bp, Homo sapien
aacctcaaccaattctatgaaaaca

SEQ ID NO: 5362 - DNA, 25 bp, Homo sapien
aacctcaaccaattctgtgaaaaca

SEQ ID NO: 5363 - DNA, 25 bp, Homo sapien
aacctcaatctccctgttatagaaa

SEQ ID NO: 5364 - DNA, 25 bp, Homo sapien
aacctcaatcttcctgttatagaaa

SEQ ID NO: 5365 - DNA, 25 bp, Homo sapien
aacctcaccttagaggccataaaaa

SEQ ID NO: 5366 - DNA, 25 bp, Homo sapien
aacctcaccttaggggccataaaaa

SEQ ID NO: 5367 - DNA, 25 bp, Homo sapien
aacctcactcttcacatgaagaatt

SEQ ID NO: 5368 - DNA, 25 bp, Homo sapien
aacctcactctttacatgaagaatt

SEQ ID NO: 5369 - DNA, 25 bp, Homo sapien
aacctcagactacatattacagaag

SEQ ID NO: 5370 - DNA, 25 bp, Homo sapien
aacctcagactagatattacagaag

SEQ ID NO: 5371 - DNA, 25 bp, Homo sapien
aacctcagatctccttcacgccact

SEQ ID NO: 5372 - DNA, 25 bp, Homo sapien
aacctcaggcaagactgatgaggga

SEQ ID NO: 5373 - DNA, 25 bp, Homo sapien
aacctcaggcaagtctgatgaggga

SEQ ID NO: 5374 - DNA, 25 bp, Homo sapien
aacctcaggtctccttcacgccact

SEQ ID NO: 5375 - DNA, 25 bp, Homo sapien
aacctcattaagaaggtggaacagg

SEQ ID NO: 5376 - DNA, 25 bp, Homo sapien
aacctcattaagatggtggaacagg

SEQ ID NO: 5377 - DNA, 25 bp, Homo sapien
aacctcattcttcctggatgcggca

SEQ ID NO: 5378 - DNA, 25 bp, Homo sapien
aacctcattgttcctggatgcggca

SEQ ID NO: 5379 - DNA, 25 bp, Homo sapien
aacctcgacgtcctggccttaggtg

SEQ ID NO: 5380 - DNA, 25 bp, Homo sapien
aacctcgacgtcttggccttaggtg

SEQ ID NO: 5381 - DNA, 25 bp, Homo sapien
aacctctaccatgcttacagaatat

SEQ ID NO: 5382 - DNA, 25 bp, Homo sapien
aacctctaccatgtttacagaatat

SEQ ID NO: 5383 - DNA, 25 bp, Homo sapien
aacctctggattcagtaattggtag

SEQ ID NO: 5384 - DNA, 25 bp, Homo sapien
aacctctggattcggtaattggtag

SEQ ID NO: 5385 - DNA, 25 bp, Homo sapien
aacctctgtaacagcacatagcaca

SEQ ID NO: 5386 - DNA, 25 bp, Homo sapien
aacctctgtaacaggacatagcaca

SEQ ID NO: 5387 - DNA, 25 bp, Homo sapien
aacctcttgaaactttctatttagt

SEQ ID NO: 5388 - DNA, 25 bp, Homo sapien
aacctcttgaaactttgtatttagt

SEQ ID NO: 5389 - DNA, 25 bp, Homo sapien
aacctgaagacttgaagattcactt

SEQ ID NO: 5390 - DNA, 25 bp, Homo sapien
aacctgaagtcttgaagattcactt

SEQ ID NO: 5391 - DNA, 25 bp, Homo sapien
aacctgacgcctctgctttccttcc

SEQ ID NO: 5392 - DNA, 25 bp, Homo sapien
aacctgacgcctgtgctttccttcc

SEQ ID NO: 5393 - DNA, 25 bp, Homo sapien
aacctgataggactttagcctttta

SEQ ID NO: 5394 - DNA, 25 bp, Homo sapien
aacctgataggattttagcctttta

SEQ ID NO: 5395 - DNA, 25 bp, Homo sapien
aacctgatcgcaggctcgtgttaac

SEQ ID NO: 5396 - DNA, 25 bp, Homo sapien
aacctgatctcaggctcgtgttaac

SEQ ID NO: 5397 - DNA, 25 bp, Homo sapien
aacctgattttacgaatagtttcca

SEQ ID NO: 5398 - DNA, 25 bp, Homo sapien
aacctgattttatgaatagtttcca

SEQ ID NO: 5399 - DNA, 25 bp, Homo sapien
aacctggagaacataaacctaagtg

SEQ ID NO: 5400 - DNA, 25 bp, Homo sapien
aacctggagaacataatcctaagtg

SEQ ID NO: 5401 - DNA, 25 bp, Homo sapien
aacctggagatgacaactttaatta

SEQ ID NO: 5402 - DNA, 25 bp, Homo sapien
aacctggagatggcaactttaatta

SEQ ID NO: 5403 - DNA, 25 bp, Homo sapien
aacctggcagagacaacagaaaaaa

SEQ ID NO: 5404 - DNA, 25 bp, Homo sapien
aacctggcagagataacagaaaaaa

SEQ ID NO: 5405 - DNA, 25 bp, Homo sapien
aacctgggatactcgagtttggtgg

SEQ ID NO: 5406 - DNA, 25 bp, Homo sapien
aacctgggatacttgagtttggtgg

SEQ ID NO: 5407 - DNA, 25 bp, Homo sapien
aacctgggtcatgggcagagatggt

SEQ ID NO: 5408 - DNA, 25 bp, Homo sapien
aacctgggtcatggtcagagatggt

SEQ ID NO: 5409 - DNA, 25 bp, Homo sapien
aacctggttcctaacacgtctattc

SEQ ID NO: 5410 - DNA, 25 bp, Homo sapien
aacctggtttctaacacgtctattc

SEQ ID NO: 5411 - DNA, 25 bp, Homo sapien
aacctgtaacagccagaacacagtc

SEQ ID NO: 5412 - DNA, 25 bp, Homo sapien
aacctgtaacagccggaacacagtc

SEQ ID NO: 5413 - DNA, 25 bp, Homo sapien
aacctgtacagcatcatactgtgct

SEQ ID NO: 5414 - DNA, 25 bp, Homo sapien
aacctgtacagtatcatactgtgct

SEQ ID NO: 5415 - DNA, 25 bp, Homo sapien
aacctgtatcttcagtagaaaacat

SEQ ID NO: 5416 - DNA, 25 bp, Homo sapien
aacctgtatcttgagtagaaaacat

SEQ ID NO: 5417 - DNA, 25 bp, Homo sapien
aacctgtgaacattttatcttaaat

SEQ ID NO: 5418 - DNA, 25 bp, Homo sapien
aacctgtgaacattttgtcttaaat

SEQ ID NO: 5419 - DNA, 25 bp, Homo sapien
aacctgtggatatgcaccttgtgtg

SEQ ID NO: 5420 - DNA, 25 bp, Homo sapien
aacctgtggatatgtaccttgtgtg

SEQ ID NO: 5421 - DNA, 25 bp, Homo sapien
aacctgtgtacacaaaaagttgaaa

SEQ ID NO: 5422 - DNA, 25 bp, Homo sapien
aacctgtgtacagaaaaagttgaaa

SEQ ID NO: 5423 - DNA, 25 bp, Homo sapien
aacctgtgtggcaatatgattagtt

SEQ ID NO: 5424 - DNA, 25 bp, Homo sapien
aacctgtgtggcgatatgattagtt

SEQ ID NO: 5425 - DNA, 25 bp, Homo sapien
aaccttaacatatgcaaataataag

SEQ ID NO: 5426 - DNA, 25 bp, Homo sapien
aaccttaacatgtgcaaataataag

SEQ ID NO: 5427 - DNA, 25 bp, Homo sapien
aaccttagaatgtgaacgcctaata

SEQ ID NO: 5428 - DNA, 25 bp, Homo sapien
aaccttagagtgtgaacgcctaata

SEQ ID NO: 5429 - DNA, 25 bp, Homo sapien
aaccttatcaaaacctaatcacctc

SEQ ID NO: 5430 - DNA, 25 bp, Homo sapien
aaccttatcaaaacctcatcacctc

SEQ ID NO: 5431 - DNA, 25 bp, Homo sapien
aaccttcaatgaagaaaatgtgttg

SEQ ID NO: 5432 - DNA, 25 bp, Homo sapien
aaccttcattgaagaaaatgtgttg

SEQ ID NO: 5433 - DNA, 25 bp, Homo sapien
aaccttcctttccttaacgtaccaa

SEQ ID NO: 5434 - DNA, 25 bp, Homo sapien
aaccttcctttctttaacgtaccaa

SEQ ID NO: 5435 - DNA, 25 bp, Homo sapien
aaccttctcggtcttgtaaaatatc

SEQ ID NO: 5436 - DNA, 25 bp, Homo sapien
aaccttctgtagaaatatagtgtca

SEQ ID NO: 5437 - DNA, 25 bp, Homo sapien
aaccttctgtaggaatatagtgtca

SEQ ID NO: 5438 - DNA, 25 bp, Homo sapien
aaccttcttggtcttgtaaaatatc

SEQ ID NO: 5439 - DNA, 25 bp, Homo sapien
aaccttgagatcaaaaacataaaag

SEQ ID NO: 5440 - DNA, 25 bp, Homo sapien
aaccttgagatcagaaacataaaag

SEQ ID NO: 5441 - DNA, 25 bp, Homo sapien
aaccttgatcacatctgaaaaatct

SEQ ID NO: 5442 - DNA, 25 bp, Homo sapien
aaccttgatcatatctgaaaaatct

SEQ ID NO: 5443 - DNA, 25 bp, Homo sapien
aaccttgcctaacgcaaggcaatcc

SEQ ID NO: 5444 - DNA, 25 bp, Homo sapien
aaccttgcctaatgcaaggcaatcc

SEQ ID NO: 5445 - DNA, 25 bp, Homo sapien
aaccttggaagaaaatggacactct

SEQ ID NO: 5446 - DNA, 25 bp, Homo sapien
aaccttggaagaaattggacactct

SEQ ID NO: 5447 - DNA, 25 bp, Homo sapien
aaccttggtatcattagtttctgtg

SEQ ID NO: 5448 - DNA, 25 bp, Homo sapien
aaccttggtatcattattttctgtg

SEQ ID NO: 5449 - DNA, 25 bp, Homo sapien
aaccttgttggtccttccagatctt

SEQ ID NO: 5450 - DNA, 25 bp, Homo sapien
aaccttgttggttcttccagatctt

SEQ ID NO: 5451 - DNA, 25 bp, Homo sapien
aacctttctctcaggctgctctctg

SEQ ID NO: 5452 - DNA, 25 bp, Homo sapien
aacctttctctccggctgctctctg

SEQ ID NO: 5453 - DNA, 25 bp, Homo sapien
aacctttgtcagtcatcacctttgt

SEQ ID NO: 5454 - DNA, 25 bp, Homo sapien
aacctttgtcagtcgtcacctttgt

SEQ ID NO: 5455 - DNA, 25 bp, Homo sapien
aaccttttcttcagacgtagaatgc

SEQ ID NO: 5456 - DNA, 25 bp, Homo sapien
aaccttttcttccgacgtagaatgc

SEQ ID NO: 5457 - DNA, 25 bp, Homo sapien
aacgaaaaagcacttcatagcttgg

SEQ ID NO: 5458 - DNA, 25 bp, Homo sapien
aacgaaaaagcagttcatagcttgg

SEQ ID NO: 5459 - DNA, 25 bp, Homo sapien
aacgaaacaacccagtgtccgtgag

SEQ ID NO: 5460 - DNA, 25 bp, Homo sapien
aacgaaacagcccagtgtccgtgag

SEQ ID NO: 5461 - DNA, 25 bp, Homo sapien
aacgaacctactattttgacaggta

SEQ ID NO: 5462 - DNA, 25 bp, Homo sapien
aacgaacctactgttttgacaggta

SEQ ID NO: 5463 - DNA, 25 bp, Homo sapien
aacgaaggtcagccgaagaagtaga

SEQ ID NO: 5464 - DNA, 25 bp, Homo sapien
aacgaaggtcagctgaagaagtaga

SEQ ID NO: 5465 - DNA, 25 bp, Homo sapien
aacgaataaatagatggatctttga

SEQ ID NO: 5466 - DNA, 25 bp, Homo sapien
aacgaataaatggatggatctttga

SEQ ID NO: 5467 - DNA, 25 bp, Homo sapien
aacgaattatgtcagaagcagagag

SEQ ID NO: 5468 - DNA, 25 bp, Homo sapien
aacgaattgtgtcagaagcagagag

SEQ ID NO: 5469 - DNA, 25 bp, Homo sapien
aacgacttaaaatcatctgcatctc

SEQ ID NO: 5470 - DNA, 25 bp, Homo sapien
aacgacttacaatcatctgcatctc

SEQ ID NO: 5471 - DNA, 25 bp, Homo sapien
aacgagcctacaacatcttgttcta

SEQ ID NO: 5472 - DNA, 25 bp, Homo sapien
aacgagcctacaatatcttgttcta

SEQ ID NO: 5473 - DNA, 25 bp, Homo sapien
aacgaggacacagggtctgacacta

SEQ ID NO: 5474 - DNA, 25 bp, Homo sapien
aacgaggacacatggtctgacacta

SEQ ID NO: 5475 - DNA, 25 bp, Homo sapien
aacgaggtgcaatgataagttaaca

SEQ ID NO: 5476 - DNA, 25 bp, Homo sapien
aacgaggtgcaattataagttaaca

SEQ ID NO: 5477 - DNA, 25 bp, Homo sapien
aacgagtcctgcggctgattgctta

SEQ ID NO: 5478 - DNA, 25 bp, Homo sapien
aacgagtcctgctgctgattgctta

SEQ ID NO: 5479 - DNA, 25 bp, Homo sapien
aacgagttataaccgctgcacctta

SEQ ID NO: 5480 - DNA, 25 bp, Homo sapien
aacgagttataacctctgcacctta

SEQ ID NO: 5481 - DNA, 25 bp, Homo sapien
aacgataattcatctggtagattgg

SEQ ID NO: 5482 - DNA, 25 bp, Homo sapien
aacgataattcgtctggtagattgg

SEQ ID NO: 5483 - DNA, 25 bp, Homo sapien
aacgatactataaggcactagttac

SEQ ID NO: 5484 - DNA, 25 bp, Homo sapien
aacgatactgtaaggcactagttac

SEQ ID NO: 5485 - DNA, 25 bp, Homo sapien
aacgatttgtctacataagatcctg

SEQ ID NO: 5486 - DNA, 25 bp, Homo sapien
aacgatttgtctatataagatcctg

SEQ ID NO: 5487 - DNA, 25 bp, Homo sapien
aacgcagcaagaaaggcctggggca

SEQ ID NO: 5488 - DNA, 25 bp, Homo sapien
aacgcagcaagaaaggtctggggca

SEQ ID NO: 5489 - DNA, 25 bp, Homo sapien
aacgcagggatgcagcatccaatac

SEQ ID NO: 5490 - DNA, 25 bp, Homo sapien
aacgcagggatgcggcatccaatac

SEQ ID NO: 5491 - DNA, 25 bp, Homo sapien
aacgcagtaacagtacaaagatgaa

SEQ ID NO: 5492 - DNA, 25 bp, Homo sapien
aacgcagtgacagtacaaagatgaa

SEQ ID NO: 5493 - DNA, 25 bp, Homo sapien
aacgcatagaacagttgtgaggctg

SEQ ID NO: 5494 - DNA, 25 bp, Homo sapien
aacgcatataacagttgtgaggctg

SEQ ID NO: 5495 - DNA, 25 bp, Homo sapien
aacgccaaagtgtttcaggaaaaat

SEQ ID NO: 5496 - DNA, 25 bp, Homo sapien
aacgccaaagtgtttcgggaaaaat

SEQ ID NO: 5497 - DNA, 25 bp, Homo sapien
aacgccatgttatataaatatgcac

SEQ ID NO: 5498 - DNA, 25 bp, Homo sapien
aacgccatgttatgtaaatatgcac

SEQ ID NO: 5499 - DNA, 25 bp, Homo sapien
aacgcctagatacaataagtttctc

SEQ ID NO: 5500 - DNA, 25 bp, Homo sapien
aacgcctaggtacaataagtttctc

SEQ ID NO: 5501 - DNA, 25 bp, Homo sapien
aacgccttcgtggtgcttccatata

SEQ ID NO: 5502 - DNA, 25 bp, Homo sapien
aacgccttcttggtgcttccatata

SEQ ID NO: 5503 - DNA, 25 bp, Homo sapien
aacgctaaacatgggatcaaaagag

SEQ ID NO: 5504 - DNA, 25 bp, Homo sapien
aacgctaagcatgggatcaaaagag

SEQ ID NO: 5505 - DNA, 25 bp, Homo sapien
aacgctaagtcagaccaaggctggc

SEQ ID NO: 5506 - DNA, 25 bp, Homo sapien
aacgctaagtcagaccgaggctggc

SEQ ID NO: 5507 - DNA, 25 bp, Homo sapien
aacgcttgcatgattgcttctttgc

SEQ ID NO: 5508 - DNA, 25 bp, Homo sapien
aacgcttgtatgattgcttctttgc

SEQ ID NO: 5509 - DNA, 25 bp, Homo sapien
aacggaaattccacccaccaaggag

SEQ ID NO: 5510 - DNA, 25 bp, Homo sapien
aacggaaattccacccgccaaggag

SEQ ID NO: 5511 - DNA, 25 bp, Homo sapien
aacggacaacgaactggaagaaatg

SEQ ID NO: 5512 - DNA, 25 bp, Homo sapien
aacggacaaggaactggaagaaatg

SEQ ID NO: 5513 - DNA, 25 bp, Homo sapien
aacggactctccagacaactctcaa

SEQ ID NO: 5514 - DNA, 25 bp, Homo sapien
aacggactgtccagacaactctcaa

SEQ ID NO: 5515 - DNA, 25 bp, Homo sapien
aacggagcagcaccttcgtagtgcc

SEQ ID NO: 5516 - DNA, 25 bp, Homo sapien
aacggagcagcatcttcgtagtgcc

SEQ ID NO: 5517 - DNA, 25 bp, Homo sapien
aacggagtttgagacaaaagctaga

SEQ ID NO: 5518 - DNA, 25 bp, Homo sapien
aacggagtttgggacaaaagctaga

SEQ ID NO: 5519 - DNA, 25 bp, Homo sapien
aacggcagacaaaaacaaagttttc

SEQ ID NO: 5520 - DNA, 25 bp, Homo sapien
aacggcagacaaaagcaaagttttc

SEQ ID NO: 5521 - DNA, 25 bp, Homo sapien
aacggctgtaatacagggataataa

SEQ ID NO: 5522 - DNA, 25 bp, Homo sapien
aacggctgtaatacggggataataa

SEQ ID NO: 5523 - DNA, 25 bp, Homo sapien
aacgggaaggataacagtcatacct

SEQ ID NO: 5524 - DNA, 25 bp, Homo sapien
aacgggaatgataacagtcatacct

SEQ ID NO: 5525 - DNA, 25 bp, Homo sapien
aacgggataaaagataggaagagac

SEQ ID NO: 5526 - DNA, 25 bp, Homo sapien
aacgggataaaagatatgaagagac

SEQ ID NO: 5527 - DNA, 25 bp, Homo sapien
aacgggcacgtcaatgagtggctgg

SEQ ID NO: 5528 - DNA, 25 bp, Homo sapien
aacgggcacgtccatgagtggctgg

SEQ ID NO: 5529 - DNA, 25 bp, Homo sapien
aacggtagagtaataaactatgatg

SEQ ID NO: 5530 - DNA, 25 bp, Homo sapien
aacggtagagtaatgaactatgatg

SEQ ID NO: 5531 - DNA, 25 bp, Homo sapien
aacggtctccatctctttggtcttg

SEQ ID NO: 5532 - DNA, 25 bp, Homo sapien
aacggtctccatctgtttggtcttg

SEQ ID NO: 5533 - DNA, 25 bp, Homo sapien
aacgtagccggtaagcctgagtatc

SEQ ID NO: 5534 - DNA, 25 bp, Homo sapien
aacgtagctggtaagcctgagtatc

SEQ ID NO: 5535 - DNA, 25 bp, Homo sapien
aacgtatcaaaagctatgggataca

SEQ ID NO: 5536 - DNA, 25 bp, Homo sapien
aacgtatcgaaagctatgggataca

SEQ ID NO: 5537 - DNA, 25 bp, Homo sapien
aacgtattctcacctacagaaaaga

SEQ ID NO: 5538 - DNA, 25 bp, Homo sapien
aacgtattctcatctacagaaaaga

SEQ ID NO: 5539 - DNA, 25 bp, Homo sapien
aacgtctatactcagcaaaatgaca

SEQ ID NO: 5540 - DNA, 25 bp, Homo sapien
aacgtctatacttagcaaaatgaca

SEQ ID NO: 5541 - DNA, 25 bp, Homo sapien
aacgtctttcgatgccacattgtcc

SEQ ID NO: 5542 - DNA, 25 bp, Homo sapien
aacgtcttttgatgccacattgtcc

SEQ ID NO: 5543 - DNA, 25 bp, Homo sapien
aacgtgacctcatcaaatgaactaa

SEQ ID NO: 5544 - DNA, 25 bp, Homo sapien
aacgtgacctcgtcaaatgaactaa

SEQ ID NO: 5545 - DNA, 25 bp, Homo sapien
aacgtgactctaccatgaccctaga

SEQ ID NO: 5546 - DNA, 25 bp, Homo sapien
aacgtgactctaccgtgaccctaga

SEQ ID NO: 5547 - DNA, 25 bp, Homo sapien
aacgtgcaacataggactctgattc

SEQ ID NO: 5548 - DNA, 25 bp, Homo sapien
aacgtgcaatataggactctgattc

SEQ ID NO: 5549 - DNA, 25 bp, Homo sapien
aacgtgcactttgccgaacatggat

SEQ ID NO: 5550 - DNA, 25 bp, Homo sapien
aacgtgcactttgctgaacatggat

SEQ ID NO: 5551 - DNA, 25 bp, Homo sapien
aacgtggagactcagaagcaagcgc

SEQ ID NO: 5552 - DNA, 25 bp, Homo sapien
aacgtggagactgagaagcaagcgc

SEQ ID NO: 5553 - DNA, 25 bp, Homo sapien
aacgtggcaacacggcaggactgtg

SEQ ID NO: 5554 - DNA, 25 bp, Homo sapien
aacgtggcaacactgcaggactgtg

SEQ ID NO: 5555 - DNA, 25 bp, Homo sapien
aacgtggccccaatgcaagggtgct

SEQ ID NO: 5556 - DNA, 25 bp, Homo sapien
aacgtggccccagtgcaagggtgct

SEQ ID NO: 5557 - DNA, 25 bp, Homo sapien
aacgtggcttaacgaacctcatata

SEQ ID NO: 5558 - DNA, 25 bp, Homo sapien
aacgtggcttaatgaacctcatata

SEQ ID NO: 5559 - DNA, 25 bp, Homo sapien
aactaaaaaatttattggaggctct

SEQ ID NO: 5560 - DNA, 25 bp, Homo sapien
aactaaaaagtttattggaggctct

SEQ ID NO: 5561 - DNA, 25 bp, Homo sapien
aactaaaatttagcccacattgcca

SEQ ID NO: 5562 - DNA, 25 bp, Homo sapien
aactaaaatttagctcacattgcca

SEQ ID NO: 5563 - DNA, 25 bp, Homo sapien
aactaaacagctccatagtggggag

SEQ ID NO: 5564 - DNA, 25 bp, Homo sapien
aactaaaccacttatccacttctcg

SEQ ID NO: 5565 - DNA, 25 bp, Homo sapien
aactaaaccgcttatccacttctcg

SEQ ID NO: 5566 - DNA, 25 bp, Homo sapien
aactaaacgatacgtgttttgcagt

SEQ ID NO: 5567 - DNA, 25 bp, Homo sapien
aactaaacgatatgtgttttgcagt

SEQ ID NO: 5568 - DNA, 25 bp, Homo sapien
aactaaacggctccatagtggggag

SEQ ID NO: 5569 - DNA, 25 bp, Homo sapien
aactaaactggcaaaatgtcttatg

SEQ ID NO: 5570 - DNA, 25 bp, Homo sapien
aactaaactggcacaatgtcttatg

SEQ ID NO: 5571 - DNA, 25 bp, Homo sapien
aactaaataactgcacaggcttaga

SEQ ID NO: 5572 - DNA, 25 bp, Homo sapien
aactaaatagcctttcatctttcct

SEQ ID NO: 5573 - DNA, 25 bp, Homo sapien
aactaaatagctgcacaggcttaga

SEQ ID NO: 5574 - DNA, 25 bp, Homo sapien
aactaaatagcttttcatctttcct

SEQ ID NO: 5575 - DNA, 25 bp, Homo sapien
aactaaattatgattatatctgtct

SEQ ID NO: 5576 - DNA, 25 bp, Homo sapien
aactaaattattccactccatgacc

SEQ ID NO: 5577 - DNA, 25 bp, Homo sapien
aactaaattattccgctccatgacc

SEQ ID NO: 5578 - DNA, 25 bp, Homo sapien
aactaaattcagagaagagctgaag

SEQ ID NO: 5579 - DNA, 25 bp, Homo sapien
aactaaattctgattatatctgtct

SEQ ID NO: 5580 - DNA, 25 bp, Homo sapien
aactaaatttagagaagagctgaag

SEQ ID NO: 5581 - DNA, 25 bp, Homo sapien
aactaacacaccggaacgcaaaaag

SEQ ID NO: 5582 - DNA, 25 bp, Homo sapien
aactaacataccggaacgcaaaaag

SEQ ID NO: 5583 - DNA, 25 bp, Homo sapien
aactaacgcagccataactggtatg

SEQ ID NO: 5584 - DNA, 25 bp, Homo sapien
aactaacgcagccgtaactggtatg

SEQ ID NO: 5585 - DNA, 25 bp, Homo sapien
aactaactgcctcatgttctgtggc

SEQ ID NO: 5586 - DNA, 25 bp, Homo sapien
aactaactgcctcgtgttctgtggc

SEQ ID NO: 5587 - DNA, 25 bp, Homo sapien
aactaacttgccaagaatcatgcat

SEQ ID NO: 5588 - DNA, 25 bp, Homo sapien
aactaacttgccaataatcatgcat

SEQ ID NO: 5589 - DNA, 25 bp, Homo sapien
aactaacttggctatccaggaaaac

SEQ ID NO: 5590 - DNA, 25 bp, Homo sapien
aactaacttggctttccaggaaaac

SEQ ID NO: 5591 - DNA, 25 bp, Homo sapien
aactaactttacaactgaagggagg

SEQ ID NO: 5592 - DNA, 25 bp, Homo sapien
aactaactttacaattgaagggagg

SEQ ID NO: 5593 - DNA, 25 bp, Homo sapien
aactaagatccatatgccaaatctg

SEQ ID NO: 5594 - DNA, 25 bp, Homo sapien
aactaagatccctatgccaaatctg

SEQ ID NO: 5595 - DNA, 25 bp, Homo sapien
aactaagggcacactggtttctgga

SEQ ID NO: 5596 - DNA, 25 bp, Homo sapien
aactaagggcacattggtttctgga

SEQ ID NO: 5597 - DNA, 25 bp, Homo sapien
aactaagggctatttgtgactcagc

SEQ ID NO: 5598 - DNA, 25 bp, Homo sapien
aactaaggtctatttgtgactcagc

SEQ ID NO: 5599 - DNA, 25 bp, Homo sapien
aactaagttgttctctaacattcca

SEQ ID NO: 5600 - DNA, 25 bp, Homo sapien
aactaagttgttgtctaacattcca

SEQ ID NO: 5601 - DNA, 25 bp, Homo sapien
aactaataccaaccatactcaaact

SEQ ID NO: 5602 - DNA, 25 bp, Homo sapien
aactaataccaaccgtactcaaact

SEQ ID NO: 5603 - DNA, 25 bp, Homo sapien
aactaatatcacaaagagatgttct

SEQ ID NO: 5604 - DNA, 25 bp, Homo sapien
aactaatatcacagagagatgttct

SEQ ID NO: 5605 - DNA, 25 bp, Homo sapien
aactaatgaaggccagaagccaatg

SEQ ID NO: 5606 - DNA, 25 bp, Homo sapien
aactaatggaggccagaagccaatg

SEQ ID NO: 5607 - DNA, 25 bp, Homo sapien
aactacaaatataatgcttattgcc

SEQ ID NO: 5608 - DNA, 25 bp, Homo sapien
aactacaagtataatgcttattgcc

SEQ ID NO: 5609 - DNA, 25 bp, Homo sapien
aactacaagtcaatcttcctgatga

SEQ ID NO: 5610 - DNA, 25 bp, Homo sapien
aactacaagtcagtcttcctgatga

SEQ ID NO: 5611 - DNA, 25 bp, Homo sapien
aactacataatttcagcagtatgcc

SEQ ID NO: 5612 - DNA, 25 bp, Homo sapien
aactacatcatttcagcagtatgcc

SEQ ID NO: 5613 - DNA, 25 bp, Homo sapien
aactacatcgtctgaaaggaagtag

SEQ ID NO: 5614 - DNA, 25 bp, Homo sapien
aactacatcttatttttattccttg

SEQ ID NO: 5615 - DNA, 25 bp, Homo sapien
aactacatgcacatactggttattg

SEQ ID NO: 5616 - DNA, 25 bp, Homo sapien
aactacattcacatactggttattg

SEQ ID NO: 5617 - DNA, 25 bp, Homo sapien
aactacattgtctgaaaggaagtag

SEQ ID NO: 5618 - DNA, 25 bp, Homo sapien
aactacattttatttttattccttg

SEQ ID NO: 5619 - DNA, 25 bp, Homo sapien
aactacctaccccattcaaattctg

SEQ ID NO: 5620 - DNA, 25 bp, Homo sapien
aactacctatcccattcaaattctg

SEQ ID NO: 5621 - DNA, 25 bp, Homo sapien
aactacctgctatattcaagagacc

SEQ ID NO: 5622 - DNA, 25 bp, Homo sapien
aactacctgctatcttcaagagacc

SEQ ID NO: 5623 - DNA, 25 bp, Homo sapien
aactacgaaatccaaacgcagggag

SEQ ID NO: 5624 - DNA, 25 bp, Homo sapien
aactacgaaatccaaatgcagggag

SEQ ID NO: 5625 - DNA, 25 bp, Homo sapien
aactacgaacgtttcgtctttggtg

SEQ ID NO: 5626 - DNA, 25 bp, Homo sapien
aactacgaacgttttgtctttggtg

SEQ ID NO: 5627 - DNA, 25 bp, Homo sapien
aactactaaaattacgaaatatctc

SEQ ID NO: 5628 - DNA, 25 bp, Homo sapien
aactactaaaattatgaaatatctc

SEQ ID NO: 5629 - DNA, 25 bp, Homo sapien
aactactacgggagtttcagatgta

SEQ ID NO: 5630 - DNA, 25 bp, Homo sapien
aactactatgggagtttcagatgta

SEQ ID NO: 5631 - DNA, 25 bp, Homo sapien
aactactgatttgcactacaaaagg

SEQ ID NO: 5632 - DNA, 25 bp, Homo sapien
aactactgatttgcgctacaaaagg

SEQ ID NO: 5633 - DNA, 25 bp, Homo sapien
aactactgcagggtaatcagagtag

SEQ ID NO: 5634 - DNA, 25 bp, Homo sapien
aactactgcggggtaatcagagtag

SEQ ID NO: 5635 - DNA, 25 bp, Homo sapien
aactactggaataaggacacaggga

SEQ ID NO: 5636 - DNA, 25 bp, Homo sapien
aactactggaatgaggacacaggga

SEQ ID NO: 5637 - DNA, 25 bp, Homo sapien
aactactggggaatcccttacattt

SEQ ID NO: 5638 - DNA, 25 bp, Homo sapien
aactactggggaatcctttacattt

SEQ ID NO: 5639 - DNA, 25 bp, Homo sapien
aactactgtgccaatgtattaacca

SEQ ID NO: 5640 - DNA, 25 bp, Homo sapien
aactactgtgccattgtattaacca

SEQ ID NO: 5641 - DNA, 25 bp, Homo sapien
aactagaactaggtttcatctacct

SEQ ID NO: 5642 - DNA, 25 bp, Homo sapien
aactagaagtaggtttcatctacct

SEQ ID NO: 5643 - DNA, 25 bp, Homo sapien
aactagccagcggacaaatggcaga

SEQ ID NO: 5644 - DNA, 25 bp, Homo sapien
aactagccagcggccaaatggcaga

SEQ ID NO: 5645 - DNA, 25 bp, Homo sapien
aactagccatcctgtattttatcca

SEQ ID NO: 5646 - DNA, 25 bp, Homo sapien
aactagccatcttgtattttatcca

SEQ ID NO: 5647 - DNA, 25 bp, Homo sapien
aactaggaactccagctgctgctgt

SEQ ID NO: 5648 - DNA, 25 bp, Homo sapien
aactaggaactctagctgctgctgt

SEQ ID NO: 5649 - DNA, 25 bp, Homo sapien
aactaggaggcaacggcgagggagc

SEQ ID NO: 5650 - DNA, 25 bp, Homo sapien
aactaggaggcaatggcgagggagc

SEQ ID NO: 5651 - DNA, 25 bp, Homo sapien
aactaggggtcatgtcttgaagcta

SEQ ID NO: 5652 - DNA, 25 bp, Homo sapien
aactaggggtcgtgtcttgaagcta

SEQ ID NO: 5653 - DNA, 25 bp, Homo sapien
aactaggtcaagcaatattatcctc

SEQ ID NO: 5654 - DNA, 25 bp, Homo sapien
aactaggtcaagcaatgttatcctc

SEQ ID NO: 5655 - DNA, 25 bp, Homo sapien
aactagttcactcgaaaatgcagga

SEQ ID NO: 5656 - DNA, 25 bp, Homo sapien
aactagttcacttgaaaatgcagga

SEQ ID NO: 5657 - DNA, 25 bp, Homo sapien
aactataactccaaagctcatttga

SEQ ID NO: 5658 - DNA, 25 bp, Homo sapien
aactataactccaatgctcatttga

SEQ ID NO: 5659 - DNA, 25 bp, Homo sapien
aactatacatggtaggatactctct

SEQ ID NO: 5660 - DNA, 25 bp, Homo sapien
aactatacgtggtaggatactctct

SEQ ID NO: 5661 - DNA, 25 bp, Homo sapien
aactatagatacaaattcaggaaag

SEQ ID NO: 5662 - DNA, 25 bp, Homo sapien
aactatagatacgaattcaggaaag

SEQ ID NO: 5663 - DNA, 25 bp, Homo sapien
aactatagggtgcctttcattaaaa

SEQ ID NO: 5664 - DNA, 25 bp, Homo sapien
aactataggtgtgctagaatgtact

SEQ ID NO: 5665 - DNA, 25 bp, Homo sapien
aactataggtgtgttagaatgtact

SEQ ID NO: 5666 - DNA, 25 bp, Homo sapien
aactatagtgggaccaaagagagag

SEQ ID NO: 5667 - DNA, 25 bp, Homo sapien
aactatagtgggatcaaagagagag

SEQ ID NO: 5668 - DNA, 25 bp, Homo sapien
aactatagtgtgcctttcattaaaa

SEQ ID NO: 5669 - DNA, 25 bp, Homo sapien
aactatatacgtttatggccttcag

SEQ ID NO: 5670 - DNA, 25 bp, Homo sapien
aactatatatgtttatggccttcag

SEQ ID NO: 5671 - DNA, 25 bp, Homo sapien
aactatcaagcacgttcatgaggag

SEQ ID NO: 5672 - DNA, 25 bp, Homo sapien
aactatcaagcactttcatgaggag

SEQ ID NO: 5673 - DNA, 25 bp, Homo sapien
aactatccaaagaaggcataagttg

SEQ ID NO: 5674 - DNA, 25 bp, Homo sapien
aactatccaaagatggcataagttg

SEQ ID NO: 5675 - DNA, 25 bp, Homo sapien
aactatccataattctgtttctttt

SEQ ID NO: 5676 - DNA, 25 bp, Homo sapien
aactatccataattttgtttctttt

SEQ ID NO: 5677 - DNA, 25 bp, Homo sapien
aactatctaactcagaccaatgggt

SEQ ID NO: 5678 - DNA, 25 bp, Homo sapien
aactatctaactcataccaatgggt

SEQ ID NO: 5679 - DNA, 25 bp, Homo sapien
aactatgaacgatattgaggtgact

SEQ ID NO: 5680 - DNA, 25 bp, Homo sapien
aactatgaacgatgttgaggtgact

SEQ ID NO: 5681 - DNA, 25 bp, Homo sapien
aactatgatgcctcagcggtgacca

SEQ ID NO: 5682 - DNA, 25 bp, Homo sapien
aactatgatgcttcagcggtgacca

SEQ ID NO: 5683 - DNA, 25 bp, Homo sapien
aactatgcccaacatgttttcattt

SEQ ID NO: 5684 - DNA, 25 bp, Homo sapien
aactatgcccaatatgttttcattt

SEQ ID NO: 5685 - DNA, 25 bp, Homo sapien
aactatgcctacccgattctgatag

SEQ ID NO: 5686 - DNA, 25 bp, Homo sapien
aactatgcctacctgattctgatag

SEQ ID NO: 5687 - DNA, 25 bp, Homo sapien
aactatggctcacgactccacataa

SEQ ID NO: 5688 - DNA, 25 bp, Homo sapien
aactatggctcgcgactccacataa

SEQ ID NO: 5689 - DNA, 25 bp, Homo sapien
aactattacacatttgccaaggtat

SEQ ID NO: 5690 - DNA, 25 bp, Homo sapien
aactattatacatttgccaaggtat

SEQ ID NO: 5691 - DNA, 25 bp, Homo sapien
aactattgctcagttattctcattc

SEQ ID NO: 5692 - DNA, 25 bp, Homo sapien
aactattgctcatttattctcattc

SEQ ID NO: 5693 - DNA, 25 bp, Homo sapien
aactattgttgtgttagaaaggcat

SEQ ID NO: 5694 - DNA, 25 bp, Homo sapien
aactattgttgtgttataaaggcat

SEQ ID NO: 5695 - DNA, 25 bp, Homo sapien
aactatttaagaaggctactttgca

SEQ ID NO: 5696 - DNA, 25 bp, Homo sapien
aactatttaagcaggctactttgca

SEQ ID NO: 5697 - DNA, 25 bp, Homo sapien
aactatttcatttaattgaatcacc

SEQ ID NO: 5698 - DNA, 25 bp, Homo sapien
aactatttcatttatttgaatcacc

SEQ ID NO: 5699 - DNA, 25 bp, Homo sapien
aactattttgccatctatcaaggta

SEQ ID NO: 5700 - DNA, 25 bp, Homo sapien
aactattttgccgtctatcaaggta

SEQ ID NO: 5701 - DNA, 25 bp, Homo sapien
aactcaaaaaaagtctgaagaagag

SEQ ID NO: 5702 - DNA, 25 bp, Homo sapien
aactcaaaacaagtctgaagaagag

SEQ ID NO: 5703 - DNA, 25 bp, Homo sapien
aactcaaaacatccacgggtaacag

SEQ ID NO: 5704 - DNA, 25 bp, Homo sapien
aactcaaaatgaccgtgaaaggaga

SEQ ID NO: 5705 - DNA, 25 bp, Homo sapien
aactcaaaatgacggtgaaaggaga

SEQ ID NO: 5706 - DNA, 25 bp, Homo sapien
aactcaaacatgatataaacagtga

SEQ ID NO: 5707 - DNA, 25 bp, Homo sapien
aactcaaacatggtataaacagtga

SEQ ID NO: 5708 - DNA, 25 bp, Homo sapien
aactcaaaccgccaaatttcaaaac

SEQ ID NO: 5709 - DNA, 25 bp, Homo sapien
aactcaaactgccaaatttcaaaac

SEQ ID NO: 5710 - DNA, 25 bp, Homo sapien
aactcaaagcatccacgggtaacag

SEQ ID NO: 5711 - DNA, 25 bp, Homo sapien
aactcaaatacgaatccctccttgt

SEQ ID NO: 5712 - DNA, 25 bp, Homo sapien
aactcaaatacgaatctctccttgt

SEQ ID NO: 5713 - DNA, 25 bp, Homo sapien
aactcaacaaaaccgatagctgagt

SEQ ID NO: 5714 - DNA, 25 bp, Homo sapien
aactcaacaaaactgatagctgagt

SEQ ID NO: 5715 - DNA, 25 bp, Homo sapien
aactcaagacttcctcatagcatcc

SEQ ID NO: 5716 - DNA, 25 bp, Homo sapien
aactcaagccacaatattcacatta

SEQ ID NO: 5717 - DNA, 25 bp, Homo sapien
aactcaagccacagtattcacatta

SEQ ID NO: 5718 - DNA, 25 bp, Homo sapien
aactcaaggcacggtataaataaag

SEQ ID NO: 5719 - DNA, 25 bp, Homo sapien
aactcaaggcatggtataaataaag

SEQ ID NO: 5720 - DNA, 25 bp, Homo sapien
aactcaaggctacataagacctaga

SEQ ID NO: 5721 - DNA, 25 bp, Homo sapien
aactcaaggctacatacgacctaga

SEQ ID NO: 5722 - DNA, 25 bp, Homo sapien
aactcaagtcttcctcatagcatcc

SEQ ID NO: 5723 - DNA, 25 bp, Homo sapien
aactcaataaatacttgctagttga

SEQ ID NO: 5724 - DNA, 25 bp, Homo sapien
aactcaatacggcggcaggttctgc

SEQ ID NO: 5725 - DNA, 25 bp, Homo sapien
aactcaatacggtggcaggttctgc

SEQ ID NO: 5726 - DNA, 25 bp, Homo sapien
aactcaatgaaaccaaagtctttga

SEQ ID NO: 5727 - DNA, 25 bp, Homo sapien
aactcaatgaagccaaagtctttga

SEQ ID NO: 5728 - DNA, 25 bp, Homo sapien
aactcaatgaatacttgctagttga

SEQ ID NO: 5729 - DNA, 25 bp, Homo sapien
aactcacacaaaactactgcttcat

SEQ ID NO: 5730 - DNA, 25 bp, Homo sapien
aactcacacaaaattactgcttcat

SEQ ID NO: 5731 - DNA, 25 bp, Homo sapien
aactcacatgcaagtattgacatag

SEQ ID NO: 5732 - DNA, 25 bp, Homo sapien
aactcacatgcaattattgacatag

SEQ ID NO: 5733 - DNA, 25 bp, Homo sapien
aactcacctgatctagcacctgggt

SEQ ID NO: 5734 - DNA, 25 bp, Homo sapien
aactcacctgatttagcacctgggt

SEQ ID NO: 5735 - DNA, 25 bp, Homo sapien
aactcactacaagtactacagtgtt

SEQ ID NO: 5736 - DNA, 25 bp, Homo sapien
aactcactgcaagtactacagtgtt

SEQ ID NO: 5737 - DNA, 25 bp, Homo sapien
aactcagatctacctcacatttaaa

SEQ ID NO: 5738 - DNA, 25 bp, Homo sapien
aactcagatctatctcacatttaaa

SEQ ID NO: 5739 - DNA, 25 bp, Homo sapien
aactcagcattggaagtttttctag

SEQ ID NO: 5740 - DNA, 25 bp, Homo sapien
aactcagcgttggaagtttttctag

SEQ ID NO: 5741 - DNA, 25 bp, Homo sapien
aactcaggctaggatgagaataatg

SEQ ID NO: 5742 - DNA, 25 bp, Homo sapien
aactcaggttaggatgagaataatg

SEQ ID NO: 5743 - DNA, 25 bp, Homo sapien
aactcagttgaaccattcagataat

SEQ ID NO: 5744 - DNA, 25 bp, Homo sapien
aactcagttgagccattcagataat

SEQ ID NO: 5745 - DNA, 25 bp, Homo sapien
aactcataaaaattacaaataaaac

SEQ ID NO: 5746 - DNA, 25 bp, Homo sapien
aactcataaaagttacaaataaaac

SEQ ID NO: 5747 - DNA, 25 bp, Homo sapien
aactcatatattctttggtctgcta

SEQ ID NO: 5748 - DNA, 25 bp, Homo sapien
aactcatatattttttggtctgcta

SEQ ID NO: 5749 - DNA, 25 bp, Homo sapien
aactcatgaacaattttaagaatta

SEQ ID NO: 5750 - DNA, 25 bp, Homo sapien
aactcatgaacacttttaagaatta

SEQ ID NO: 5751 - DNA, 25 bp, Homo sapien
aactcattacgtttaacatgcaaga

SEQ ID NO: 5752 - DNA, 25 bp, Homo sapien
aactcattatgtttaacatgcaaga

SEQ ID NO: 5753 - DNA, 25 bp, Homo sapien
aactcattggactctagtctcataa

SEQ ID NO: 5754 - DNA, 25 bp, Homo sapien
aactcattggagtctagtctcataa

SEQ ID NO: 5755 - DNA, 25 bp, Homo sapien
aactcatttaccctgagttagtgtt

SEQ ID NO: 5756 - DNA, 25 bp, Homo sapien
aactcatttaccgtgagttagtgtt

SEQ ID NO: 5757 - DNA, 25 bp, Homo sapien
aactccaactcagtagccaaacaca

SEQ ID NO: 5758 - DNA, 25 bp, Homo sapien
aactccaactcggtagccaaacaca

SEQ ID NO: 5759 - DNA, 25 bp, Homo sapien
aactccactatccttcagaccttct

SEQ ID NO: 5760 - DNA, 25 bp, Homo sapien
aactccactctccttcagaccttct

SEQ ID NO: 5761 - DNA, 25 bp, Homo sapien
aactccagccaaaaagaggagagag

SEQ ID NO: 5762 - DNA, 25 bp, Homo sapien
aactccagccacaaagaggagagag

SEQ ID NO: 5763 - DNA, 25 bp, Homo sapien
aactccatcgatgtctcctgaatat

SEQ ID NO: 5764 - DNA, 25 bp, Homo sapien
aactccatggatgtctcctgaatat

SEQ ID NO: 5765 - DNA, 25 bp, Homo sapien
aactccattcttgcagctgttcagg

SEQ ID NO: 5766 - DNA, 25 bp, Homo sapien
aactccattcttgcagttgttcagg

SEQ ID NO: 5767 - DNA, 25 bp, Homo sapien
aactccattgagacagtagttagac

SEQ ID NO: 5768 - DNA, 25 bp, Homo sapien
aactccattgagacggtagttagac

SEQ ID NO: 5769 - DNA, 25 bp, Homo sapien
aactccatttgaaaaaaacaatcat

SEQ ID NO: 5770 - DNA, 25 bp, Homo sapien
aactccatttgaagaaaacaatcat

SEQ ID NO: 5771 - DNA, 25 bp, Homo sapien
aactcccacatgtccttcttttctg

SEQ ID NO: 5772 - DNA, 25 bp, Homo sapien
aactcccacgtgtccttcttttctg

SEQ ID NO: 5773 - DNA, 25 bp, Homo sapien
aactccctagattatgttgaggatt

SEQ ID NO: 5774 - DNA, 25 bp, Homo sapien
aactccctagcaaaaggagcctcgc

SEQ ID NO: 5775 - DNA, 25 bp, Homo sapien
aactccctagcagaaggagcctcgc

SEQ ID NO: 5776 - DNA, 25 bp, Homo sapien
aactccctggattatgttgaggatt

SEQ ID NO: 5777 - DNA, 25 bp, Homo sapien
aactcctgaggcagaagtattacca

SEQ ID NO: 5778 - DNA, 25 bp, Homo sapien
aactcctgagtgattgcctcagcta

SEQ ID NO: 5779 - DNA, 25 bp, Homo sapien
aactcctgattgattgcctcagcta

SEQ ID NO: 5780 - DNA, 25 bp, Homo sapien
aactcctgcggcagaagtattacca

SEQ ID NO: 5781 - DNA, 25 bp, Homo sapien
aactcctggctactactgtgtatct

SEQ ID NO: 5782 - DNA, 25 bp, Homo sapien
aactcctggctgctactgtgtatct

SEQ ID NO: 5783 - DNA, 25 bp, Homo sapien
aactcctttcggatgtcacactgtc

SEQ ID NO: 5784 - DNA, 25 bp, Homo sapien
aactccttttggatgtcacactgtc

SEQ ID NO: 5785 - DNA, 25 bp, Homo sapien
aactcggatccttaaaaataggaat

SEQ ID NO: 5786 - DNA, 25 bp, Homo sapien
aactcggatccttagaaataggaat

SEQ ID NO: 5787 - DNA, 25 bp, Homo sapien
aactctaaggtccgaagagaagttg

SEQ ID NO: 5788 - DNA, 25 bp, Homo sapien
aactctaaggtccggagagaagttg

SEQ ID NO: 5789 - DNA, 25 bp, Homo sapien
aactctacctattattgataaactc

SEQ ID NO: 5790 - DNA, 25 bp, Homo sapien
aactctacctatttttgataaactc

SEQ ID NO: 5791 - DNA, 25 bp, Homo sapien
aactctccaaacggacccaggttgt

SEQ ID NO: 5792 - DNA, 25 bp, Homo sapien
aactctccaaatggacccaggttgt

SEQ ID NO: 5793 - DNA, 25 bp, Homo sapien
aactctgaagatttttatggcaatt

SEQ ID NO: 5794 - DNA, 25 bp, Homo sapien
aactctgaagatttttgtggcaatt

SEQ ID NO: 5795 - DNA, 25 bp, Homo sapien
aactctgaaggggcccattctcaac

SEQ ID NO: 5796 - DNA, 25 bp, Homo sapien
aactctgaatcccatttcatttatt

SEQ ID NO: 5797 - DNA, 25 bp, Homo sapien
aactctgaatcctatttcatttatt

SEQ ID NO: 5798 - DNA, 25 bp, Homo sapien
aactctgaatttctgaaatcccatt

SEQ ID NO: 5799 - DNA, 25 bp, Homo sapien
aactctgaggacattacgctagtga

SEQ ID NO: 5800 - DNA, 25 bp, Homo sapien
aactctgaggacattatgctagtga

SEQ ID NO: 5801 - DNA, 25 bp, Homo sapien
aactctgagggggcccattctcaac

SEQ ID NO: 5802 - DNA, 25 bp, Homo sapien
aactctgaggtttaagcactctgct

SEQ ID NO: 5803 - DNA, 25 bp, Homo sapien
aactctgaggtttgagcactctgct

SEQ ID NO: 5804 - DNA, 25 bp, Homo sapien
aactctgataaacaatatgtttggc

SEQ ID NO: 5805 - DNA, 25 bp, Homo sapien
aactctgataaacagtatgtttggc

SEQ ID NO: 5806 - DNA, 25 bp, Homo sapien
aactctgattttctgaaatcccatt

SEQ ID NO: 5807 - DNA, 25 bp, Homo sapien
aactctgcgatgttggaaaggcttg

SEQ ID NO: 5808 - DNA, 25 bp, Homo sapien
aactctgcgctgttggaaaggcttg

SEQ ID NO: 5809 - DNA, 25 bp, Homo sapien
aactctggatgactgatatgggtta

SEQ ID NO: 5810 - DNA, 25 bp, Homo sapien
aactctggatgtctgatatgggtta

SEQ ID NO: 5811 - DNA, 25 bp, Homo sapien
aactctggccccagaacaaccagga

SEQ ID NO: 5812 - DNA, 25 bp, Homo sapien
aactctgggcccagaacaaccagga

SEQ ID NO: 5813 - DNA, 25 bp, Homo sapien
aactcttaattctttcctctgagta

SEQ ID NO: 5814 - DNA, 25 bp, Homo sapien
aactcttacttctttcctctgagta

SEQ ID NO: 5815 - DNA, 25 bp, Homo sapien
aactcttccctttggagcagcagca

SEQ ID NO: 5816 - DNA, 25 bp, Homo sapien
aactcttcgctttggagcagcagca

SEQ ID NO: 5817 - DNA, 25 bp, Homo sapien
aactctttgacaccaggttatttct

SEQ ID NO: 5818 - DNA, 25 bp, Homo sapien
aactctttgacatcaggttatttct

SEQ ID NO: 5819 - DNA, 25 bp, Homo sapien
aactcttttgaacatacaattcggt

SEQ ID NO: 5820 - DNA, 25 bp, Homo sapien
aactcttttgaacgtacaattcggt

SEQ ID NO: 5821 - DNA, 25 bp, Homo sapien
aactctttttcaattaaaacctgaa

SEQ ID NO: 5822 - DNA, 25 bp, Homo sapien
aactctttttccagtggactcaagt

SEQ ID NO: 5823 - DNA, 25 bp, Homo sapien
aactctttttcccgtggactcaagt

SEQ ID NO: 5824 - DNA, 25 bp, Homo sapien
aactctttttcgattaaaacctgaa

SEQ ID NO: 5825 - DNA, 25 bp, Homo sapien
aactgaaaaaaagtcctgaaattgc

SEQ ID NO: 5826 - DNA, 25 bp, Homo sapien
aactgaaaaaatgtcctgaaattgc

SEQ ID NO: 5827 - DNA, 25 bp, Homo sapien
aactgaaataaaaatctcaatgaat

SEQ ID NO: 5828 - DNA, 25 bp, Homo sapien
aactgaaataaaactctcaatgaat

SEQ ID NO: 5829 - DNA, 25 bp, Homo sapien
aactgaacaaaggattgtttctcca

SEQ ID NO: 5830 - DNA, 25 bp, Homo sapien
aactgaacaaatgattgtttctcca

SEQ ID NO: 5831 - DNA, 25 bp, Homo sapien
aactgaagagaatgtcctactcagc

SEQ ID NO: 5832 - DNA, 25 bp, Homo sapien
aactgaagagaatttcctactcagc

SEQ ID NO: 5833 - DNA, 25 bp, Homo sapien
aactgaagctggtgcactctgaaaa

SEQ ID NO: 5834 - DNA, 25 bp, Homo sapien
aactgaagctggtgcattctgaaaa

SEQ ID NO: 5835 - DNA, 25 bp, Homo sapien
aactgaagttcagttgctttgcaga

SEQ ID NO: 5836 - DNA, 25 bp, Homo sapien
aactgaagttcatttgctttgcaga

SEQ ID NO: 5837 - DNA, 25 bp, Homo sapien
aactgaatcataggaacagacttgc

SEQ ID NO: 5838 - DNA, 25 bp, Homo sapien
aactgaatcatgggaacagacttgc

SEQ ID NO: 5839 - DNA, 25 bp, Homo sapien
aactgaatcctgagttctaactaac

SEQ ID NO: 5840 - DNA, 25 bp, Homo sapien
aactgaatcttgagttctaactaac

SEQ ID NO: 5841 - DNA, 25 bp, Homo sapien
aactgacaatatctatgggtatctc

SEQ ID NO: 5842 - DNA, 25 bp, Homo sapien
aactgacagtatctatgggtatctc

SEQ ID NO: 5843 - DNA, 25 bp, Homo sapien
aactgacgttagtaataggccttaa

SEQ ID NO: 5844 - DNA, 25 bp, Homo sapien
aactgacgttagtattaggccttaa

SEQ ID NO: 5845 - DNA, 25 bp, Homo sapien
aactgactcaacgttcccaactgga

SEQ ID NO: 5846 - DNA, 25 bp, Homo sapien
aactgactcaatgttcccaactgga

SEQ ID NO: 5847 - DNA, 25 bp, Homo sapien
aactgactgagataataaatctatg

SEQ ID NO: 5848 - DNA, 25 bp, Homo sapien
aactgactgagataatgaatctatg

SEQ ID NO: 5849 - DNA, 25 bp, Homo sapien
aactgacttgaatacttctgagcat

SEQ ID NO: 5850 - DNA, 25 bp, Homo sapien
aactgacttgagtacttctgagcat

SEQ ID NO: 5851 - DNA, 25 bp, Homo sapien
aactgagaaccacaaactgagtggc

SEQ ID NO: 5852 - DNA, 25 bp, Homo sapien
aactgagaaccataaactgagtggc

SEQ ID NO: 5853 - DNA, 25 bp, Homo sapien
aactgagacttacgagattcgcttg

SEQ ID NO: 5854 - DNA, 25 bp, Homo sapien
aactgagacttatgagattcgcttg

SEQ ID NO: 5855 - DNA, 25 bp, Homo sapien
aactgagagatcattaagcatcact

SEQ ID NO: 5856 - DNA, 25 bp, Homo sapien
aactgagagattattaagcatcact

SEQ ID NO: 5857 - DNA, 25 bp, Homo sapien
aactgagccacaaacgcctacaact

SEQ ID NO: 5858 - DNA, 25 bp, Homo sapien
aactgagccacaaatgcctacaact

SEQ ID NO: 5859 - DNA, 25 bp, Homo sapien
aactgagccagctgtgatactattt

SEQ ID NO: 5860 - DNA, 25 bp, Homo sapien
aactgagccagttgtgatactattt

SEQ ID NO: 5861 - DNA, 25 bp, Homo sapien
aactgaggctagcaagcaaaacacc

SEQ ID NO: 5862 - DNA, 25 bp, Homo sapien
aactgaggctagcacgcaaaacacc

SEQ ID NO: 5863 - DNA, 25 bp, Homo sapien
aactgaggttaaacagccagcaagg

SEQ ID NO: 5864 - DNA, 25 bp, Homo sapien
aactgaggttaaacggccagcaagg

SEQ ID NO: 5865 - DNA, 25 bp, Homo sapien
aactgagtattgctaacatacatta

SEQ ID NO: 5866 - DNA, 25 bp, Homo sapien
aactgagtattggtaacatacatta

SEQ ID NO: 5867 - DNA, 25 bp, Homo sapien
aactgagttctacatgagcctctca

SEQ ID NO: 5868 - DNA, 25 bp, Homo sapien
aactgagttcttcatgagcctctca

SEQ ID NO: 5869 - DNA, 25 bp, Homo sapien
aactgataatagacttggcaaaaac

SEQ ID NO: 5870 - DNA, 25 bp, Homo sapien
aactgataatagatttggcaaaaac

SEQ ID NO: 5871 - DNA, 25 bp, Homo sapien
aactgataatttgaacaagacagcc

SEQ ID NO: 5872 - DNA, 25 bp, Homo sapien
aactgatacaatcatgtcaaaggta

SEQ ID NO: 5873 - DNA, 25 bp, Homo sapien
aactgatacgatcatgtcaaaggta

SEQ ID NO: 5874 - DNA, 25 bp, Homo sapien
aactgatattttgaacaagacagcc

SEQ ID NO: 5875 - DNA, 25 bp, Homo sapien
aactgatgaaaccaggaattgccat

SEQ ID NO: 5876 - DNA, 25 bp, Homo sapien
aactgatgaaactaggaattgccat

SEQ ID NO: 5877 - DNA, 25 bp, Homo sapien
aactgatgatgtggtttctttagca

SEQ ID NO: 5878 - DNA, 25 bp, Homo sapien
aactgatgcacaaaaccaatggtga

SEQ ID NO: 5879 - DNA, 25 bp, Homo sapien
aactgatgctgtggtttctttagca

SEQ ID NO: 5880 - DNA, 25 bp, Homo sapien
aactgatgctttctgtacgtgcttc

SEQ ID NO: 5881 - DNA, 25 bp, Homo sapien
aactgatgctttgtgtacgtgcttc

SEQ ID NO: 5882 - DNA, 25 bp, Homo sapien
aactgatggacaaaaccaatggtga

SEQ ID NO: 5883 - DNA, 25 bp, Homo sapien
aactgatggggaatctggacttatt

SEQ ID NO: 5884 - DNA, 25 bp, Homo sapien
aactgatggggaatttggacttatt

SEQ ID NO: 5885 - DNA, 25 bp, Homo sapien
aactgattgcccttattcaatctgc

SEQ ID NO: 5886 - DNA, 25 bp, Homo sapien
aactgatttcccttattcaatctgc

SEQ ID NO: 5887 - DNA, 25 bp, Homo sapien
aactgcaaaaaacagtcaattgtgc

SEQ ID NO: 5888 - DNA, 25 bp, Homo sapien
aactgcaacaatctgacttgacaac

SEQ ID NO: 5889 - DNA, 25 bp, Homo sapien
aactgcaacaatttgacttgacaac

SEQ ID NO: 5890 - DNA, 25 bp, Homo sapien
aactgcaagaaacagtcaattgtgc

SEQ ID NO: 5891 - DNA, 25 bp, Homo sapien
aactgcaatagcataaaccagtaca

SEQ ID NO: 5892 - DNA, 25 bp, Homo sapien
aactgcaatagcatgaaccagtaca

SEQ ID NO: 5893 - DNA, 25 bp, Homo sapien
aactgcacctatgccctgctagaaa

SEQ ID NO: 5894 - DNA, 25 bp, Homo sapien
aactgcacttatgccctgctagaaa

SEQ ID NO: 5895 - DNA, 25 bp, Homo sapien
aactgcaggattcgggcagccagga

SEQ ID NO: 5896 - DNA, 25 bp, Homo sapien
aactgcaggatttgggcagccagga

SEQ ID NO: 5897 - DNA, 25 bp, Homo sapien
aactgcattcgagtcaacacattct

SEQ ID NO: 5898 - DNA, 25 bp, Homo sapien
aactgcattcgattcaacacattct

SEQ ID NO: 5899 - DNA, 25 bp, Homo sapien
aactgccaataggtaagttcttact

SEQ ID NO: 5900 - DNA, 25 bp, Homo sapien
aactgccaatagttaagttcttact

SEQ ID NO: 5901 - DNA, 25 bp, Homo sapien
aactgccactaattcgagttttcat

SEQ ID NO: 5902 - DNA, 25 bp, Homo sapien
aactgccactaatttgagttttcat

SEQ ID NO: 5903 - DNA, 25 bp, Homo sapien
aactgccagcatcatgagattatag

SEQ ID NO: 5904 - DNA, 25 bp, Homo sapien
aactgccagcatcgtgagattatag

SEQ ID NO: 5905 - DNA, 25 bp, Homo sapien
aactgcgaaccgccagctctgtgaa

SEQ ID NO: 5906 - DNA, 25 bp, Homo sapien
aactgcgagccgccagctctgtgaa

SEQ ID NO: 5907 - DNA, 25 bp, Homo sapien
aactgctgacgatcacgagataatc

SEQ ID NO: 5908 - DNA, 25 bp, Homo sapien
aactgctgatgatcacgagataatc

SEQ ID NO: 5909 - DNA, 25 bp, Homo sapien
aactggaaaatgaaacacttaaagg

SEQ ID NO: 5910 - DNA, 25 bp, Homo sapien
aactggaaagtgaaacacttaaagg

SEQ ID NO: 5911 - DNA, 25 bp, Homo sapien
aactggacaacgctaaagaggttgg

SEQ ID NO: 5912 - DNA, 25 bp, Homo sapien
aactggacatcgctaaagaggttgg

SEQ ID NO: 5913 - DNA, 25 bp, Homo sapien
aactggacggaaaccgtctccgaaa

SEQ ID NO: 5914 - DNA, 25 bp, Homo sapien
aactggacggaagccgtctccgaaa

SEQ ID NO: 5915 - DNA, 25 bp, Homo sapien
aactggactaatgagctgtgtgaac

SEQ ID NO: 5916 - DNA, 25 bp, Homo sapien
aactggactatacgaatgcattttg

SEQ ID NO: 5917 - DNA, 25 bp, Homo sapien
aactggactatatgaatgcattttg

SEQ ID NO: 5918 - DNA, 25 bp, Homo sapien
aactggactgaaactgaaaggaaac

SEQ ID NO: 5919 - DNA, 25 bp, Homo sapien
aactggactgaaattgaaaggaaac

SEQ ID NO: 5920 - DNA, 25 bp, Homo sapien
aactggactgggtactccctattgt

SEQ ID NO: 5921 - DNA, 25 bp, Homo sapien
aactggactgggtattccctattgt

SEQ ID NO: 5922 - DNA, 25 bp, Homo sapien
aactggacttatgagctgtgtgaac

SEQ ID NO: 5923 - DNA, 25 bp, Homo sapien
aactggactttcttggaggtagatg

SEQ ID NO: 5924 - DNA, 25 bp, Homo sapien
aactggactttcttggcggtagatg

SEQ ID NO: 5925 - DNA, 25 bp, Homo sapien
aactggagagttcatcaccaataga

SEQ ID NO: 5926 - DNA, 25 bp, Homo sapien
aactggagagttcgtcaccaataga

SEQ ID NO: 5927 - DNA, 25 bp, Homo sapien
aactggagcaaaaaaccctatggaa

SEQ ID NO: 5928 - DNA, 25 bp, Homo sapien
aactggagtaaaaaaccctatggaa

SEQ ID NO: 5929 - DNA, 25 bp, Homo sapien
aactggattaattggatgctttaca

SEQ ID NO: 5930 - DNA, 25 bp, Homo sapien
aactggattgattggatgctttaca

SEQ ID NO: 5931 - DNA, 25 bp, Homo sapien
aactggcaaaatgtcttatgagtcc

SEQ ID NO: 5932 - DNA, 25 bp, Homo sapien
aactggcaagactgaaatttgaact

SEQ ID NO: 5933 - DNA, 25 bp, Homo sapien
aactggcaagactggaatttgaact

SEQ ID NO: 5934 - DNA, 25 bp, Homo sapien
aactggcacaatgtcttatgagtcc

SEQ ID NO: 5935 - DNA, 25 bp, Homo sapien
aactggccagtcagataagaaatac

SEQ ID NO: 5936 - DNA, 25 bp, Homo sapien
aactggccagtcaggtaagaaatac

SEQ ID NO: 5937 - DNA, 25 bp, Homo sapien
aactggcctggattgacaagcgcaa

SEQ ID NO: 5938 - DNA, 25 bp, Homo sapien
aactggcctgggttgacaagcgcaa

SEQ ID NO: 5939 - DNA, 25 bp, Homo sapien
aactggctcatgactcatactaggg

SEQ ID NO: 5940 - DNA, 25 bp, Homo sapien
aactggctcatggctcatactaggg

SEQ ID NO: 5941 - DNA, 25 bp, Homo sapien
aactggctgtccataattggtaaac

SEQ ID NO: 5942 - DNA, 25 bp, Homo sapien
aactggctgtccgtaattggtaaac

SEQ ID NO: 5943 - DNA, 25 bp, Homo sapien
aactgggaaccacattaaggtatat

SEQ ID NO: 5944 - DNA, 25 bp, Homo sapien
aactgggaaccacgttaaggtatat

SEQ ID NO: 5945 - DNA, 25 bp, Homo sapien
aactgggaggttccgattttgttgt

SEQ ID NO: 5946 - DNA, 25 bp, Homo sapien
aactgggaggttctgattttgttgt

SEQ ID NO: 5947 - DNA, 25 bp, Homo sapien
aactgggatccaaggaccgtacatt

SEQ ID NO: 5948 - DNA, 25 bp, Homo sapien
aactgggatccagggaccgtacatt

SEQ ID NO: 5949 - DNA, 25 bp, Homo sapien
aactgggcatccgtttctccatttg

SEQ ID NO: 5950 - DNA, 25 bp, Homo sapien
aactgggcatctgtttctccatttg

SEQ ID NO: 5951 - DNA, 25 bp, Homo sapien
aactgggccaaagttcatcaggtag

SEQ ID NO: 5952 - DNA, 25 bp, Homo sapien
aactgggccaaggttcatcaggtag

SEQ ID NO: 5953 - DNA, 25 bp, Homo sapien
aactggggtactactatacaactga

SEQ ID NO: 5954 - DNA, 25 bp, Homo sapien
aactggggtactgctatacaactga

SEQ ID NO: 5955 - DNA, 25 bp, Homo sapien
aactggtcaacatatccatcactcc

SEQ ID NO: 5956 - DNA, 25 bp, Homo sapien
aactggtcaacgtatccatcactcc

SEQ ID NO: 5957 - DNA, 25 bp, Homo sapien
aactggtgataccgtttgacctaag

SEQ ID NO: 5958 - DNA, 25 bp, Homo sapien
aactggtgatactgtttgacctaag

SEQ ID NO: 5959 - DNA, 25 bp, Homo sapien
aactggtggacctacaagtaagtaa

SEQ ID NO: 5960 - DNA, 25 bp, Homo sapien
aactggtggccctacaagtaagtaa

SEQ ID NO: 5961 - DNA, 25 bp, Homo sapien
aactggtggttctgaacactggagt

SEQ ID NO: 5962 - DNA, 25 bp, Homo sapien
aactggtggttctgaatactggagt

SEQ ID NO: 5963 - DNA, 25 bp, Homo sapien
aactgtaaatgtctttttacctagt

SEQ ID NO: 5964 - DNA, 25 bp, Homo sapien
aactgtaaccttttaagagacccta

SEQ ID NO: 5965 - DNA, 25 bp, Homo sapien
aactgtaagctattattatatggtc

SEQ ID NO: 5966 - DNA, 25 bp, Homo sapien
aactgtaagctcttattatatggtc

SEQ ID NO: 5967 - DNA, 25 bp, Homo sapien
aactgtaatcttttaagagacccta

SEQ ID NO: 5968 - DNA, 25 bp, Homo sapien
aactgtaattgtctttttacctagt

SEQ ID NO: 5969 - DNA, 25 bp, Homo sapien
aactgtacctgagcagtgctgaaaa

SEQ ID NO: 5970 - DNA, 25 bp, Homo sapien
aactgtacctgggcagtgctgaaaa

SEQ ID NO: 5971 - DNA, 25 bp, Homo sapien
aactgtagaggcagcaaagctctgt

SEQ ID NO: 5972 - DNA, 25 bp, Homo sapien
aactgtagatcattcttcagaggtc

SEQ ID NO: 5973 - DNA, 25 bp, Homo sapien
aactgtagatcatttttcagaggtc

SEQ ID NO: 5974 - DNA, 25 bp, Homo sapien
aactgtagcggcagcaaagctctgt

SEQ ID NO: 5975 - DNA, 25 bp, Homo sapien
aactgtccacttcttcaatctcacc

SEQ ID NO: 5976 - DNA, 25 bp, Homo sapien
aactgtccgcttcttcaatctcacc

SEQ ID NO: 5977 - DNA, 25 bp, Homo sapien
aactgtctaaaacataagtgctatt

SEQ ID NO: 5978 - DNA, 25 bp, Homo sapien
aactgtctaaaacgtaagtgctatt

SEQ ID NO: 5979 - DNA, 25 bp, Homo sapien
aactgtctgtatgttaactactttg

SEQ ID NO: 5980 - DNA, 25 bp, Homo sapien
aactgtctgtattttaactactttg

SEQ ID NO: 5981 - DNA, 25 bp, Homo sapien
aactgtgaaaggtagcatcatcaaa

SEQ ID NO: 5982 - DNA, 25 bp, Homo sapien
aactgtgaaaggtagcgtcatcaaa

SEQ ID NO: 5983 - DNA, 25 bp, Homo sapien
aactgtgatggcaaaattctccttc

SEQ ID NO: 5984 - DNA, 25 bp, Homo sapien
aactgtgatggccaaattctccttc

SEQ ID NO: 5985 - DNA, 25 bp, Homo sapien
aactgtgcacaacgtgctgaatatg

SEQ ID NO: 5986 - DNA, 25 bp, Homo sapien
aactgtgcgcaacgtgctgaatatg

SEQ ID NO: 5987 - DNA, 25 bp, Homo sapien
aactgtggaaaaattatttcattgc

SEQ ID NO: 5988 - DNA, 25 bp, Homo sapien
aactgtgggaaaattatttcattgc

SEQ ID NO: 5989 - DNA, 25 bp, Homo sapien
aactgtgtcctgctatgcctgactg

SEQ ID NO: 5990 - DNA, 25 bp, Homo sapien
aactgtgtcttgctatgcctgactg

SEQ ID NO: 5991 - DNA, 25 bp, Homo sapien
aactgtgttcagaaacctctcacat

SEQ ID NO: 5992 - DNA, 25 bp, Homo sapien
aactgtgttcagaaccctctcacat

SEQ ID NO: 5993 - DNA, 25 bp, Homo sapien
aactgtgttggggtctagcatgtat

SEQ ID NO: 5994 - DNA, 25 bp, Homo sapien
aactgtgttgggttctagcatgtat

SEQ ID NO: 5995 - DNA, 25 bp, Homo sapien
aactgttaccatgaaaagagggcct

SEQ ID NO: 5996 - DNA, 25 bp, Homo sapien
aactgttaccatgagaagagggcct

SEQ ID NO: 5997 - DNA, 25 bp, Homo sapien
aactgttcacacacttgagaccaac

SEQ ID NO: 5998 - DNA, 25 bp, Homo sapien
aactgttcacacatttgagaccaac

SEQ ID NO: 5999 - DNA, 25 bp, Homo sapien
aactgttcagatagctcttggtctc

SEQ ID NO: 6000 - DNA, 25 bp, Homo sapien
aactgttcagatagctgttggtctc

SEQ ID NO: 6001 - DNA, 25 bp, Homo sapien
aactgttcattacatgttactatga

SEQ ID NO: 6002 - DNA, 25 bp, Homo sapien
aactgttcatttcatgttactatga

SEQ ID NO: 6003 - DNA, 25 bp, Homo sapien
aactgttgacagagctgtcgtcctc

SEQ ID NO: 6004 - DNA, 25 bp, Homo sapien
aactgttgacagtgctgtcgtcctc

SEQ ID NO: 6005 - DNA, 25 bp, Homo sapien
aactgttgaccacacattttcactc

SEQ ID NO: 6006 - DNA, 25 bp, Homo sapien
aactgttgacctcacattttcactc

SEQ ID NO: 6007 - DNA, 25 bp, Homo sapien
aactgttgagactaaggtttagaaa

SEQ ID NO: 6008 - DNA, 25 bp, Homo sapien
aactgttgggactaaggtttagaaa

SEQ ID NO: 6009 - DNA, 25 bp, Homo sapien
aactgttgttgcctataactgtaag

SEQ ID NO: 6010 - DNA, 25 bp, Homo sapien
aactgttgttgcctgtaactgtaag

SEQ ID NO: 6011 - DNA, 25 bp, Homo sapien
aactgttttcaacgaggtttgatta

SEQ ID NO: 6012 - DNA, 25 bp, Homo sapien
aactgttttcaatgaggtttgatta

SEQ ID NO: 6013 - DNA, 25 bp, Homo sapien
aactgtttttacatgaatgaaggcc

SEQ ID NO: 6014 - DNA, 25 bp, Homo sapien
aactgtttttacgtgaatgaaggcc

SEQ ID NO: 6015 - DNA, 25 bp, Homo sapien
aacttaaagaaaacatacaaggagt

SEQ ID NO: 6016 - DNA, 25 bp, Homo sapien
aacttaaagaacacatacaaggagt

SEQ ID NO: 6017 - DNA, 25 bp, Homo sapien
aacttaacatacagtaagcaatcaa

SEQ ID NO: 6018 - DNA, 25 bp, Homo sapien
aacttaacatacggtaagcaatcaa

SEQ ID NO: 6019 - DNA, 25 bp, Homo sapien
aacttaactactaatagcccactct

SEQ ID NO: 6020 - DNA, 25 bp, Homo sapien
aacttaactactgatagcccactct

SEQ ID NO: 6021 - DNA, 25 bp, Homo sapien
aacttaactcatcccaggctgaagg

SEQ ID NO: 6022 - DNA, 25 bp, Homo sapien
aacttaactcatgccaggctgaagg

SEQ ID NO: 6023 - DNA, 25 bp, Homo sapien
aacttaactttcaactagtatccag

SEQ ID NO: 6024 - DNA, 25 bp, Homo sapien
aacttaactttcatctagtatccag

SEQ ID NO: 6025 - DNA, 25 bp, Homo sapien
aacttaagaaacttgtccaagatat

SEQ ID NO: 6026 - DNA, 25 bp, Homo sapien
aacttaagaaatttgtccaagatat

SEQ ID NO: 6027 - DNA, 25 bp, Homo sapien
aacttaaggttacgtacagcagtca

SEQ ID NO: 6028 - DNA, 25 bp, Homo sapien
aacttaaggttaggtacagcagtca

SEQ ID NO: 6029 - DNA, 25 bp, Homo sapien
aacttaaggttctcaatcggtgtac

SEQ ID NO: 6030 - DNA, 25 bp, Homo sapien
aacttaaggttttcaatcggtgtac

SEQ ID NO: 6031 - DNA, 25 bp, Homo sapien
aacttaatatccataagcaaaatca

SEQ ID NO: 6032 - DNA, 25 bp, Homo sapien
aacttaatatccgtaagcaaaatca

SEQ ID NO: 6033 - DNA, 25 bp, Homo sapien
aacttaatcattacagttgtgggga

SEQ ID NO: 6034 - DNA, 25 bp, Homo sapien
aacttaatcattacggttgtgggga

SEQ ID NO: 6035 - DNA, 25 bp, Homo sapien
aacttacaaaaattgagaaaggtac

SEQ ID NO: 6036 - DNA, 25 bp, Homo sapien
aacttacaaatgctaccagtgtgga

SEQ ID NO: 6037 - DNA, 25 bp, Homo sapien
aacttacaaatgttaccagtgtgga

SEQ ID NO: 6038 - DNA, 25 bp, Homo sapien
aacttacaagcacgaagcacaaagt

SEQ ID NO: 6039 - DNA, 25 bp, Homo sapien
aacttacaagcatgaagcacaaagt

SEQ ID NO: 6040 - DNA, 25 bp, Homo sapien
aacttacacgacaattttcagacag

SEQ ID NO: 6041 - DNA, 25 bp, Homo sapien
aacttacactgactctctcagttcc

SEQ ID NO: 6042 - DNA, 25 bp, Homo sapien
aacttacactgagtctctcagttcc

SEQ ID NO: 6043 - DNA, 25 bp, Homo sapien
aacttacagaaattgagaaaggtac

SEQ ID NO: 6044 - DNA, 25 bp, Homo sapien
aacttacatcggttttcagatttaa

SEQ ID NO: 6045 - DNA, 25 bp, Homo sapien
aacttacatgacaattttcagacag

SEQ ID NO: 6046 - DNA, 25 bp, Homo sapien
aacttacattggttttcagatttaa

SEQ ID NO: 6047 - DNA, 25 bp, Homo sapien
aacttacgaattatatattgcaagt

SEQ ID NO: 6048 - DNA, 25 bp, Homo sapien
aacttacgaattgtatattgcaagt

SEQ ID NO: 6049 - DNA, 25 bp, Homo sapien
aacttagaaaagactcttcaaaaga

SEQ ID NO: 6050 - DNA, 25 bp, Homo sapien
aacttagaaaatactcttcaaaaga

SEQ ID NO: 6051 - DNA, 25 bp, Homo sapien
aacttagaatgatgtcacattgtcc

SEQ ID NO: 6052 - DNA, 25 bp, Homo sapien
aacttagaatgctgtcacattgtcc

SEQ ID NO: 6053 - DNA, 25 bp, Homo sapien
aacttagactctagttagggaatat

SEQ ID NO: 6054 - DNA, 25 bp, Homo sapien
aacttagagtctagttagggaatat

SEQ ID NO: 6055 - DNA, 25 bp, Homo sapien
aacttagcacctgtttatgtaaata

SEQ ID NO: 6056 - DNA, 25 bp, Homo sapien
aacttagcacctgtttttgtaaata

SEQ ID NO: 6057 - DNA, 25 bp, Homo sapien
aacttagccggaaagcccacatagc

SEQ ID NO: 6058 - DNA, 25 bp, Homo sapien
aacttagcctcttcctctatggaga

SEQ ID NO: 6059 - DNA, 25 bp, Homo sapien
aacttagctggaaagcccacatagc

SEQ ID NO: 6060 - DNA, 25 bp, Homo sapien
aacttagcttcttcctctatggaga

SEQ ID NO: 6061 - DNA, 25 bp, Homo sapien
aacttaggaacatattttatgagaa

SEQ ID NO: 6062 - DNA, 25 bp, Homo sapien
aacttaggaacgtattttatgagaa

SEQ ID NO: 6063 - DNA, 25 bp, Homo sapien
aacttaggatgcctgcagttgtcaa

SEQ ID NO: 6064 - DNA, 25 bp, Homo sapien
aacttaggatgcctgcggttgtcaa

SEQ ID NO: 6065 - DNA, 25 bp, Homo sapien
aacttaggcaggctatcccaagaaa

SEQ ID NO: 6066 - DNA, 25 bp, Homo sapien
aacttaggcaggttatcccaagaaa

SEQ ID NO: 6067 - DNA, 25 bp, Homo sapien
aacttagtgaaagttaagataacac

SEQ ID NO: 6068 - DNA, 25 bp, Homo sapien
aacttagtgaaatttaagataacac

SEQ ID NO: 6069 - DNA, 25 bp, Homo sapien
aacttatgaggataactaatacatt

SEQ ID NO: 6070 - DNA, 25 bp, Homo sapien
aacttatgaggatagctaatacatt

SEQ ID NO: 6071 - DNA, 25 bp, Homo sapien
aacttatgcaagtaacaatccagga

SEQ ID NO: 6072 - DNA, 25 bp, Homo sapien
aacttatgcgagtaacaatccagga

SEQ ID NO: 6073 - DNA, 25 bp, Homo sapien
aacttattcaaatcagtgagttcaa

SEQ ID NO: 6074 - DNA, 25 bp, Homo sapien
aacttattcaaatctgtgagttcaa

SEQ ID NO: 6075 - DNA, 25 bp, Homo sapien
aacttcaaaaggctccatggaccct

SEQ ID NO: 6076 - DNA, 25 bp, Homo sapien
aacttcaaaaggcttcatggaccct

SEQ ID NO: 6077 - DNA, 25 bp, Homo sapien
aacttcaagagttcacacaagtatt

SEQ ID NO: 6078 - DNA, 25 bp, Homo sapien
aacttcaagagttcacgcaagtatt

SEQ ID NO: 6079 - DNA, 25 bp, Homo sapien
aacttcaccatgatagcacaaaagc

SEQ ID NO: 6080 - DNA, 25 bp, Homo sapien
aacttcactatgatagcacaaaagc

SEQ ID NO: 6081 - DNA, 25 bp, Homo sapien
aacttcagacataaacaacataagc

SEQ ID NO: 6082 - DNA, 25 bp, Homo sapien
aacttcagacataaacgacataagc

SEQ ID NO: 6083 - DNA, 25 bp, Homo sapien
aacttcagagaacgatttcttaagc

SEQ ID NO: 6084 - DNA, 25 bp, Homo sapien
aacttcagagaatgatttcttaagc

SEQ ID NO: 6085 - DNA, 25 bp, Homo sapien
aacttcatcattaattctgcactaa

SEQ ID NO: 6086 - DNA, 25 bp, Homo sapien
aacttcatcattaattttgcactaa

SEQ ID NO: 6087 - DNA, 25 bp, Homo sapien
aacttcatggtcttcagaataaaac

SEQ ID NO: 6088 - DNA, 25 bp, Homo sapien
aacttcattgcacttttccctatct

SEQ ID NO: 6089 - DNA, 25 bp, Homo sapien
aacttcattgtcttcagaataaaac

SEQ ID NO: 6090 - DNA, 25 bp, Homo sapien
aacttcatttcacttttccctatct

SEQ ID NO: 6091 - DNA, 25 bp, Homo sapien
aacttccaaccaccaccatctgggt

SEQ ID NO: 6092 - DNA, 25 bp, Homo sapien
aacttccaaccaccgccatctgggt

SEQ ID NO: 6093 - DNA, 25 bp, Homo sapien
aacttccagggcttgcattttttag

SEQ ID NO: 6094 - DNA, 25 bp, Homo sapien
aacttccagggtttgcattttttag

SEQ ID NO: 6095 - DNA, 25 bp, Homo sapien
aacttcctataagctgaaagtattt

SEQ ID NO: 6096 - DNA, 25 bp, Homo sapien
aacttcctgtaagctgaaagtattt

SEQ ID NO: 6097 - DNA, 25 bp, Homo sapien
aacttctaacaaaacaaacatatct

SEQ ID NO: 6098 - DNA, 25 bp, Homo sapien
aacttctaacaaaagaaacatatct

SEQ ID NO: 6099 - DNA, 25 bp, Homo sapien
aacttctagagacatcacgaatcct

SEQ ID NO: 6100 - DNA, 25 bp, Homo sapien
aacttctagagacttcacgaatcct

SEQ ID NO: 6101 - DNA, 25 bp, Homo sapien
aacttctgaatcacttctttctgtg

SEQ ID NO: 6102 - DNA, 25 bp, Homo sapien
aacttctgaatcgcttctttctgtg

SEQ ID NO: 6103 - DNA, 25 bp, Homo sapien
aacttctgattaggtgccttttcat

SEQ ID NO: 6104 - DNA, 25 bp, Homo sapien
aacttctgattaggtgtcttttcat

SEQ ID NO: 6105 - DNA, 25 bp, Homo sapien
aacttctggaatacttatgcaggac

SEQ ID NO: 6106 - DNA, 25 bp, Homo sapien
aacttctggaatacttgtgcaggac

SEQ ID NO: 6107 - DNA, 25 bp, Homo sapien
aacttctggtactcattaggcccat

SEQ ID NO: 6108 - DNA, 25 bp, Homo sapien
aacttctgttactcattaggcccat

SEQ ID NO: 6109 - DNA, 25 bp, Homo sapien
aacttcttcatataatagtcagata

SEQ ID NO: 6110 - DNA, 25 bp, Homo sapien
aacttcttcatatgatagtcagata

SEQ ID NO: 6111 - DNA, 25 bp, Homo sapien
aacttcttccaaatgcattagcctc

SEQ ID NO: 6112 - DNA, 25 bp, Homo sapien
aacttcttccaaatgcgttagcctc

SEQ ID NO: 6113 - DNA, 25 bp, Homo sapien
aacttcttgttaaacgctaatctcc

SEQ ID NO: 6114 - DNA, 25 bp, Homo sapien
aacttcttgttaaatgctaatctcc

SEQ ID NO: 6115 - DNA, 25 bp, Homo sapien
aacttcttttgcaccttaaaatact

SEQ ID NO: 6116 - DNA, 25 bp, Homo sapien
aacttcttttgctccttaaaatact

SEQ ID NO: 6117 - DNA, 25 bp, Homo sapien
aacttgacaaaggtagcggtcagct

SEQ ID NO: 6118 - DNA, 25 bp, Homo sapien
aacttgacaaaggtagtggtcagct

SEQ ID NO: 6119 - DNA, 25 bp, Homo sapien
aacttgaggactgtaagtaacacaa

SEQ ID NO: 6120 - DNA, 25 bp, Homo sapien
aacttgaggactttaagtaacacaa

SEQ ID NO: 6121 - DNA, 25 bp, Homo sapien
aacttgagtttgtcattattgtggt

SEQ ID NO: 6122 - DNA, 25 bp, Homo sapien
aacttgagtttgtcgttattgtggt

SEQ ID NO: 6123 - DNA, 25 bp, Homo sapien
aacttgatcaacgaaatattaaaca

SEQ ID NO: 6124 - DNA, 25 bp, Homo sapien
aacttgatcaatgaaatattaaaca

SEQ ID NO: 6125 - DNA, 25 bp, Homo sapien
aacttgcagagcaccaacccagtca

SEQ ID NO: 6126 - DNA, 25 bp, Homo sapien
aacttgcagagtaccaacccagtca

SEQ ID NO: 6127 - DNA, 25 bp, Homo sapien
aacttgctctcactttatggacttg

SEQ ID NO: 6128 - DNA, 25 bp, Homo sapien
aacttgctctcagtttatggacttg

SEQ ID NO: 6129 - DNA, 25 bp, Homo sapien
aacttggaacccatgctgtggtatc

SEQ ID NO: 6130 - DNA, 25 bp, Homo sapien
aacttggaacccgtgctgtggtatc

SEQ ID NO: 6131 - DNA, 25 bp, Homo sapien
aacttggaaggccagacaagccagc

SEQ ID NO: 6132 - DNA, 25 bp, Homo sapien
aacttggaaggccagagaagccagc

SEQ ID NO: 6133 - DNA, 25 bp, Homo sapien
aacttggaatctgaacccaacagga

SEQ ID NO: 6134 - DNA, 25 bp, Homo sapien
aacttggaatctgaactcaacagga

SEQ ID NO: 6135 - DNA, 25 bp, Homo sapien
aacttggagcctcgtgagtgctggc

SEQ ID NO: 6136 - DNA, 25 bp, Homo sapien
aacttggagccttgtgagtgctggc

SEQ ID NO: 6137 - DNA, 25 bp, Homo sapien
aacttggccttccaggtggagacta

SEQ ID NO: 6138 - DNA, 25 bp, Homo sapien
aacttggcctttcaggtggagacta

SEQ ID NO: 6139 - DNA, 25 bp, Homo sapien
aacttggtatttcgttcattcttag

SEQ ID NO: 6140 - DNA, 25 bp, Homo sapien
aacttggtatttctttcattcttag

SEQ ID NO: 6141 - DNA, 25 bp, Homo sapien
aacttggtgagcatcatcactaagg

SEQ ID NO: 6142 - DNA, 25 bp, Homo sapien
aacttggtgagcgtcatcactaagg

SEQ ID NO: 6143 - DNA, 25 bp, Homo sapien
aacttggttttatacattgaaggag

SEQ ID NO: 6144 - DNA, 25 bp, Homo sapien
aacttggttttatgcattgaaggag

SEQ ID NO: 6145 - DNA, 25 bp, Homo sapien
aacttgtactaacgttatgacatgt

SEQ ID NO: 6146 - DNA, 25 bp, Homo sapien
aacttgtactaatgttatgacatgt

SEQ ID NO: 6147 - DNA, 25 bp, Homo sapien
aacttgtagtcaactggagaagaca

SEQ ID NO: 6148 - DNA, 25 bp, Homo sapien
aacttgtagtcaattggagaagaca

SEQ ID NO: 6149 - DNA, 25 bp, Homo sapien
aacttgtgtttcatgaatcctctct

SEQ ID NO: 6150 - DNA, 25 bp, Homo sapien
aacttgtgttttatgaatcctctct

SEQ ID NO: 6151 - DNA, 25 bp, Homo sapien
aacttgtttggctcttcctcaacaa

SEQ ID NO: 6152 - DNA, 25 bp, Homo sapien
aacttgtttggttcttcctcaacaa

SEQ ID NO: 6153 - DNA, 25 bp, Homo sapien
aactttaaccttccatttctatgat

SEQ ID NO: 6154 - DNA, 25 bp, Homo sapien
aactttaaccttccgtttctatgat

SEQ ID NO: 6155 - DNA, 25 bp, Homo sapien
aactttaaggaatggccgatgccca

SEQ ID NO: 6156 - DNA, 25 bp, Homo sapien
aactttaaggaatggctgatgccca

SEQ ID NO: 6157 - DNA, 25 bp, Homo sapien
aactttacgtcttagtcaacactta

SEQ ID NO: 6158 - DNA, 25 bp, Homo sapien
aactttacgtcttagtgaacactta

SEQ ID NO: 6159 - DNA, 25 bp, Homo sapien
aactttaggaatatactgtgtactt

SEQ ID NO: 6160 - DNA, 25 bp, Homo sapien
aactttagggatatactgtgtactt

SEQ ID NO: 6161 - DNA, 25 bp, Homo sapien
aactttatggctaatcatttgtctc

SEQ ID NO: 6162 - DNA, 25 bp, Homo sapien
aactttatggctagtcatttgtctc

SEQ ID NO: 6163 - DNA, 25 bp, Homo sapien
aactttcaactagtatccagtatgt

SEQ ID NO: 6164 - DNA, 25 bp, Homo sapien
aactttcatatgctgtactggcttg

SEQ ID NO: 6165 - DNA, 25 bp, Homo sapien
aactttcatctagtatccagtatgt

SEQ ID NO: 6166 - DNA, 25 bp, Homo sapien
aactttcatgtgctgtactggcttg

SEQ ID NO: 6167 - DNA, 25 bp, Homo sapien
aactttccttccgataggtttttcc

SEQ ID NO: 6168 - DNA, 25 bp, Homo sapien
aactttccttctgataggtttttcc

SEQ ID NO: 6169 - DNA, 25 bp, Homo sapien
aactttctactccgaagctgtttta

SEQ ID NO: 6170 - DNA, 25 bp, Homo sapien
aactttctactcctaagctgtttta

SEQ ID NO: 6171 - DNA, 25 bp, Homo sapien
aactttctccataacaataggctgt

SEQ ID NO: 6172 - DNA, 25 bp, Homo sapien
aactttctccatatcaataggctgt

SEQ ID NO: 6173 - DNA, 25 bp, Homo sapien
aactttctgaaccaactaacgatgg

SEQ ID NO: 6174 - DNA, 25 bp, Homo sapien
aactttctgaaccagctaacgatgg

SEQ ID NO: 6175 - DNA, 25 bp, Homo sapien
aactttcttaaattgtatgaaggct

SEQ ID NO: 6176 - DNA, 25 bp, Homo sapien
aactttcttaagttgtatgaaggct

SEQ ID NO: 6177 - DNA, 25 bp, Homo sapien
aactttggaaagaactgagccagcc

SEQ ID NO: 6178 - DNA, 25 bp, Homo sapien
aactttggaaagaattgagccagcc

SEQ ID NO: 6179 - DNA, 25 bp, Homo sapien
aactttggctgcatgttggtgtctc

SEQ ID NO: 6180 - DNA, 25 bp, Homo sapien
aactttggctgcctgttggtgtctc

SEQ ID NO: 6181 - DNA, 25 bp, Homo sapien
aactttgtgcacttaacccatctgt

SEQ ID NO: 6182 - DNA, 25 bp, Homo sapien
aactttgtgcacttgacccatctgt

SEQ ID NO: 6183 - DNA, 25 bp, Homo sapien
aacttttacaatgatggcagaattg

SEQ ID NO: 6184 - DNA, 25 bp, Homo sapien
aacttttacaatggtggcagaattg

SEQ ID NO: 6185 - DNA, 25 bp, Homo sapien
aacttttccaggcttttgatccatc

SEQ ID NO: 6186 - DNA, 25 bp, Homo sapien
aacttttcccggcttttgatccatc

SEQ ID NO: 6187 - DNA, 25 bp, Homo sapien
aacttttcctcaaacagttcctgct

SEQ ID NO: 6188 - DNA, 25 bp, Homo sapien
aacttttcctcaaacatttcctgct

SEQ ID NO: 6189 - DNA, 25 bp, Homo sapien
aacttttgcataaattcactgctaa

SEQ ID NO: 6190 - DNA, 25 bp, Homo sapien
aacttttgcgttccttcttggatag

SEQ ID NO: 6191 - DNA, 25 bp, Homo sapien
aacttttgtataaattcactgctaa

SEQ ID NO: 6192 - DNA, 25 bp, Homo sapien
aacttttgtgttccttcttggatag

SEQ ID NO: 6193 - DNA, 25 bp, Homo sapien
aacttttgttgtcctccgattttat

SEQ ID NO: 6194 - DNA, 25 bp, Homo sapien
aacttttgttgtcctctgattttat

SEQ ID NO: 6195 - DNA, 25 bp, Homo sapien
aactttttaaaaaatcaagcagaaa

SEQ ID NO: 6196 - DNA, 25 bp, Homo sapien
aactttttaaaatatcaagcagaaa

SEQ ID NO: 6197 - DNA, 25 bp, Homo sapien
aactttttccttgcatactattcca

SEQ ID NO: 6198 - DNA, 25 bp, Homo sapien
aactttttctgataccacaccctgg

SEQ ID NO: 6199 - DNA, 25 bp, Homo sapien
aactttttctgatatcacaccctgg

SEQ ID NO: 6200 - DNA, 25 bp, Homo sapien
aactttttctgcgcagctcatcaat

SEQ ID NO: 6201 - DNA, 25 bp, Homo sapien
aactttttctgctcagctcatcaat

SEQ ID NO: 6202 - DNA, 25 bp, Homo sapien
aacttttttcttgcatactattcca

SEQ ID NO: 6203 - DNA, 25 bp, Homo sapien
aagaaaaaaggacagtgagtagtat

SEQ ID NO: 6204 - DNA, 25 bp, Homo sapien
aagaaaaaagggcagtgagtagtat

SEQ ID NO: 6205 - DNA, 25 bp, Homo sapien
aagaaaaacagtacagattattggt

SEQ ID NO: 6206 - DNA, 25 bp, Homo sapien
aagaaaaacagtacagtttattggt

SEQ ID NO: 6207 - DNA, 25 bp, Homo sapien
aagaaaaaccatgtagactttgaac

SEQ ID NO: 6208 - DNA, 25 bp, Homo sapien
aagaaaaaccatgtaggctttgaac

SEQ ID NO: 6209 - DNA, 25 bp, Homo sapien
aagaaaaatgctctagtctcattct

SEQ ID NO: 6210 - DNA, 25 bp, Homo sapien
aagaaaaatgctgtagtctcattct

SEQ ID NO: 6211 - DNA, 25 bp, Homo sapien
aagaaaacaaacaaaaaattctaat

SEQ ID NO: 6212 - DNA, 25 bp, Homo sapien
aagaaaacaaacgaaaaattctaat

SEQ ID NO: 6213 - DNA, 25 bp, Homo sapien
aagaaaacagaaaagcccagtatta

SEQ ID NO: 6214 - DNA, 25 bp, Homo sapien
aagaaaacagaaaatcccagtatta

SEQ ID NO: 6215 - DNA, 25 bp, Homo sapien
aagaaaaccagacttagagaaggac

SEQ ID NO: 6216 - DNA, 25 bp, Homo sapien
aagaaaacctgaagacttgaagatt

SEQ ID NO: 6217 - DNA, 25 bp, Homo sapien
aagaaaacctgaagtcttgaagatt

SEQ ID NO: 6218 - DNA, 25 bp, Homo sapien
aagaaaactagacttagagaaggac

SEQ ID NO: 6219 - DNA, 25 bp, Homo sapien
aagaaaagaacccagatactctgga

SEQ ID NO: 6220 - DNA, 25 bp, Homo sapien
aagaaaagaacctagatactctgga

SEQ ID NO: 6221 - DNA, 25 bp, Homo sapien
aagaaaagcaacataagcaacaaaa

SEQ ID NO: 6222 - DNA, 25 bp, Homo sapien
aagaaaagcaacgtaagcaacaaaa

SEQ ID NO: 6223 - DNA, 25 bp, Homo sapien
aagaaaataaaagttggcattagca

SEQ ID NO: 6224 - DNA, 25 bp, Homo sapien
aagaaaatacaagttggcattagca

SEQ ID NO: 6225 - DNA, 25 bp, Homo sapien
aagaaaatactcagttaattataag

SEQ ID NO: 6226 - DNA, 25 bp, Homo sapien
aagaaaatagccaggcatggtggtg

SEQ ID NO: 6227 - DNA, 25 bp, Homo sapien
aagaaaatattcagttaattataag

SEQ ID NO: 6228 - DNA, 25 bp, Homo sapien
aagaaaatcgccaggcatggtggtg

SEQ ID NO: 6229 - DNA, 25 bp, Homo sapien
aagaaaatctatcccatgctctatc

SEQ ID NO: 6230 - DNA, 25 bp, Homo sapien
aagaaaatctattccatgctctatc

SEQ ID NO: 6231 - DNA, 25 bp, Homo sapien
aagaaaatgaatataagtgtggtat

SEQ ID NO: 6232 - DNA, 25 bp, Homo sapien
aagaaaatgaatgtaagtgtggtat

SEQ ID NO: 6233 - DNA, 25 bp, Homo sapien
aagaaaatggagtccttgctggctg

SEQ ID NO: 6234 - DNA, 25 bp, Homo sapien
aagaaaatgtcaagattttaaatat

SEQ ID NO: 6235 - DNA, 25 bp, Homo sapien
aagaaaatgtcaggattttaaatat

SEQ ID NO: 6236 - DNA, 25 bp, Homo sapien
aagaaaattgagtccttgctggctg

SEQ ID NO: 6237 - DNA, 25 bp, Homo sapien
aagaaaattgagttccagggcagta

SEQ ID NO: 6238 - DNA, 25 bp, Homo sapien
aagaaaattgagtttcagggcagta

SEQ ID NO: 6239 - DNA, 25 bp, Homo sapien
aagaaacactgatccaaaagccatt

SEQ ID NO: 6240 - DNA, 25 bp, Homo sapien
aagaaacactgatccagaagccatt

SEQ ID NO: 6241 - DNA, 25 bp, Homo sapien
aagaaacacttctgccaccctccat

SEQ ID NO: 6242 - DNA, 25 bp, Homo sapien
aagaaacagcagtatcatgaaaaca

SEQ ID NO: 6243 - DNA, 25 bp, Homo sapien
aagaaacaggagtatcatgaaaaca

SEQ ID NO: 6244 - DNA, 25 bp, Homo sapien
aagaaacatttctgccaccctccat

SEQ ID NO: 6245 - DNA, 25 bp, Homo sapien
aagaaaccaagaccctggagataca

SEQ ID NO: 6246 - DNA, 25 bp, Homo sapien
aagaaaccaagatcctggagataca

SEQ ID NO: 6247 - DNA, 25 bp, Homo sapien
aagaaaccactaaacgataaataat

SEQ ID NO: 6248 - DNA, 25 bp, Homo sapien
aagaaaccactaagcgataaataat

SEQ ID NO: 6249 - DNA, 25 bp, Homo sapien
aagaaaccataaactggaaggtaaa

SEQ ID NO: 6250 - DNA, 25 bp, Homo sapien
aagaaaccataatctggaaggtaaa

SEQ ID NO: 6251 - DNA, 25 bp, Homo sapien
aagaaacgttttctatatttgcacc

SEQ ID NO: 6252 - DNA, 25 bp, Homo sapien
aagaaacgttttctgtatttgcacc

SEQ ID NO: 6253 - DNA, 25 bp, Homo sapien
aagaaactcaggtttggcatgtcat

SEQ ID NO: 6254 - DNA, 25 bp, Homo sapien
aagaaactcagttttggcatgtcat

SEQ ID NO: 6255 - DNA, 25 bp, Homo sapien
aagaaactggagcaaaaaaccctat

SEQ ID NO: 6256 - DNA, 25 bp, Homo sapien
aagaaactggagtaaaaaaccctat

SEQ ID NO: 6257 - DNA, 25 bp, Homo sapien
aagaaagaaaaaatcttaaaagcaa

SEQ ID NO: 6258 - DNA, 25 bp, Homo sapien
aagaaagaagcaacatggtagacat

SEQ ID NO: 6259 - DNA, 25 bp, Homo sapien
aagaaagaagcaccatggtagacat

SEQ ID NO: 6260 - DNA, 25 bp, Homo sapien
aagaaagaaggagcacaagagggtc

SEQ ID NO: 6261 - DNA, 25 bp, Homo sapien
aagaaagaaggaggacaagagggtc

SEQ ID NO: 6262 - DNA, 25 bp, Homo sapien
aagaaagagaaaatcttaaaagcaa

SEQ ID NO: 6263 - DNA, 25 bp, Homo sapien
aagaaagagggcacgcgagtcccac

SEQ ID NO: 6264 - DNA, 25 bp, Homo sapien
aagaaagagggcatgcgagtcccac

SEQ ID NO: 6265 - DNA, 25 bp, Homo sapien
aagaaagcatcataataatgtgggt

SEQ ID NO: 6266 - DNA, 25 bp, Homo sapien
aagaaagcatcatagtaatgtgggt

SEQ ID NO: 6267 - DNA, 25 bp, Homo sapien
aagaaagcccgggtgtttccttctg

SEQ ID NO: 6268 - DNA, 25 bp, Homo sapien
aagaaagccgaataacagatgcatt

SEQ ID NO: 6269 - DNA, 25 bp, Homo sapien
aagaaagcctgctcttgaatcatgt

SEQ ID NO: 6270 - DNA, 25 bp, Homo sapien
aagaaagcctgggtgtttccttctg

SEQ ID NO: 6271 - DNA, 25 bp, Homo sapien
aagaaagcctgttcttgaatcatgt

SEQ ID NO: 6272 - DNA, 25 bp, Homo sapien
aagaaagctcttgaattcgtttcct

SEQ ID NO: 6273 - DNA, 25 bp, Homo sapien
aagaaagctcttgcattcgtttcct

SEQ ID NO: 6274 - DNA, 25 bp, Homo sapien
aagaaagctgaataacagatgcatt

SEQ ID NO: 6275 - DNA, 25 bp, Homo sapien
aagaaaggaattcaagctgtacatt

SEQ ID NO: 6276 - DNA, 25 bp, Homo sapien
aagaaaggaattcgagctgtacatt

SEQ ID NO: 6277 - DNA, 25 bp, Homo sapien
aagaaaggacatgcgagtgagaaaa

SEQ ID NO: 6278 - DNA, 25 bp, Homo sapien
aagaaagggcatgcgagtgagaaaa

SEQ ID NO: 6279 - DNA, 25 bp, Homo sapien
aagaaaggttctcaatccagtccgt

SEQ ID NO: 6280 - DNA, 25 bp, Homo sapien
aagaaaggttctcgatccagtccgt

SEQ ID NO: 6281 - DNA, 25 bp, Homo sapien
aagaaagtaatgactgcgctttggc

SEQ ID NO: 6282 - DNA, 25 bp, Homo sapien
aagaaagtaatgactgtgctttggc

SEQ ID NO: 6283 - DNA, 25 bp, Homo sapien
aagaaagtacaaatgtcttcctgta

SEQ ID NO: 6284 - DNA, 25 bp, Homo sapien
aagaaagtacaattgtcttcctgta

SEQ ID NO: 6285 - DNA, 25 bp, Homo sapien
aagaaagtctcagaagaatttacca

SEQ ID NO: 6286 - DNA, 25 bp, Homo sapien
aagaaagtctcagcagaatttacca

SEQ ID NO: 6287 - DNA, 25 bp, Homo sapien
aagaaataagatcggagaagaacaa

SEQ ID NO: 6288 - DNA, 25 bp, Homo sapien
aagaaataagattggagaagaacaa

SEQ ID NO: 6289 - DNA, 25 bp, Homo sapien
aagaaatagccaacccacactaaag

SEQ ID NO: 6290 - DNA, 25 bp, Homo sapien
aagaaatagccaactcacactaaag

SEQ ID NO: 6291 - DNA, 25 bp, Homo sapien
aagaaataggcaaaaatttgttaag

SEQ ID NO: 6292 - DNA, 25 bp, Homo sapien
aagaaataggcataaatttgttaag

SEQ ID NO: 6293 - DNA, 25 bp, Homo sapien
aagaaatataccaaaggccacccaa

SEQ ID NO: 6294 - DNA, 25 bp, Homo sapien
aagaaatataccgaaggccacccaa

SEQ ID NO: 6295 - DNA, 25 bp, Homo sapien
aagaaatcaacaaaggatgcacggg

SEQ ID NO: 6296 - DNA, 25 bp, Homo sapien
aagaaatcagcaaaggatgcacggg

SEQ ID NO: 6297 - DNA, 25 bp, Homo sapien
aagaaatgaagatttgtgaattgcc

SEQ ID NO: 6298 - DNA, 25 bp, Homo sapien
aagaaatgacaattgactttgaaat

SEQ ID NO: 6299 - DNA, 25 bp, Homo sapien
aagaaatgataattgactttgaaat

SEQ ID NO: 6300 - DNA, 25 bp, Homo sapien
aagaaatgcaagatttatgagtcat

SEQ ID NO: 6301 - DNA, 25 bp, Homo sapien
aagaaatgcaagatttgtgagtcat

SEQ ID NO: 6302 - DNA, 25 bp, Homo sapien
aagaaatgcatactgattgcctgtt

SEQ ID NO: 6303 - DNA, 25 bp, Homo sapien
aagaaatgccacaggtaagctaaga

SEQ ID NO: 6304 - DNA, 25 bp, Homo sapien
aagaaatgccacgggtaagctaaga

SEQ ID NO: 6305 - DNA, 25 bp, Homo sapien
aagaaatgcttactgattgcctgtt

SEQ ID NO: 6306 - DNA, 25 bp, Homo sapien
aagaaatggagatttgtgaattgcc

SEQ ID NO: 6307 - DNA, 25 bp, Homo sapien
aagaaatggtaaagtgggatgccaa

SEQ ID NO: 6308 - DNA, 25 bp, Homo sapien
aagaaatggtaacgtgggatgccaa

SEQ ID NO: 6309 - DNA, 25 bp, Homo sapien
aagaaattatgaagctatttcaggc

SEQ ID NO: 6310 - DNA, 25 bp, Homo sapien
aagaaattctggccagcatcaggaa

SEQ ID NO: 6311 - DNA, 25 bp, Homo sapien
aagaaattctgggcagcatcaggaa

SEQ ID NO: 6312 - DNA, 25 bp, Homo sapien
aagaaattgaaaataaacactctca

SEQ ID NO: 6313 - DNA, 25 bp, Homo sapien
aagaaattggaaataaacactctca

SEQ ID NO: 6314 - DNA, 25 bp, Homo sapien
aagaaattgtgaatgcatagaaatt

SEQ ID NO: 6315 - DNA, 25 bp, Homo sapien
aagaaattgtgaatgcgtagaaatt

SEQ ID NO: 6316 - DNA, 25 bp, Homo sapien
aagaaatttcccagaacaaaagaca

SEQ ID NO: 6317 - DNA, 25 bp, Homo sapien
aagaaatttcccataacaaaagaca

SEQ ID NO: 6318 - DNA, 25 bp, Homo sapien
aagaaattttgaagctatttcaggc

SEQ ID NO: 6319 - DNA, 25 bp, Homo sapien
aagaacaaccacagatgcaaggtaa

SEQ ID NO: 6320 - DNA, 25 bp, Homo sapien
aagaacaacgaagtagttgagattt

SEQ ID NO: 6321 - DNA, 25 bp, Homo sapien
aagaacaactacagatgcaaggtaa

SEQ ID NO: 6322 - DNA, 25 bp, Homo sapien
aagaacaactctaccaactaattcc

SEQ ID NO: 6323 - DNA, 25 bp, Homo sapien
aagaacaatgaagtagttgagattt

SEQ ID NO: 6324 - DNA, 25 bp, Homo sapien
aagaacaatgacgactataacaggc

SEQ ID NO: 6325 - DNA, 25 bp, Homo sapien
aagaacaatgatgactataacaggc

SEQ ID NO: 6326 - DNA, 25 bp, Homo sapien
aagaacaattctaccaactaattcc

SEQ ID NO: 6327 - DNA, 25 bp, Homo sapien
aagaacacacagctacagggacaaa

SEQ ID NO: 6328 - DNA, 25 bp, Homo sapien
aagaacacatcgacaacaggggagc

SEQ ID NO: 6329 - DNA, 25 bp, Homo sapien
aagaacacatcgacgacaggggagc

SEQ ID NO: 6330 - DNA, 25 bp, Homo sapien
aagaacaccatttaatctttaaaac

SEQ ID NO: 6331 - DNA, 25 bp, Homo sapien
aagaacaccatttgatctttaaaac

SEQ ID NO: 6332 - DNA, 25 bp, Homo sapien
aagaacacgcagctacagggacaaa

SEQ ID NO: 6333 - DNA, 25 bp, Homo sapien
aagaacagaatacggcactagattt

SEQ ID NO: 6334 - DNA, 25 bp, Homo sapien
aagaacagaatatggcactagattt

SEQ ID NO: 6335 - DNA, 25 bp, Homo sapien
aagaacaggaataattcttcagacc

SEQ ID NO: 6336 - DNA, 25 bp, Homo sapien
aagaacaggaattattcttcagacc

SEQ ID NO: 6337 - DNA, 25 bp, Homo sapien
aagaacataaattgctattcctctt

SEQ ID NO: 6338 - DNA, 25 bp, Homo sapien
aagaacataaattgttattcctctt

SEQ ID NO: 6339 - DNA, 25 bp, Homo sapien
aagaacataatataaagcagtatga

SEQ ID NO: 6340 - DNA, 25 bp, Homo sapien
aagaacatattataaagcagtatga

SEQ ID NO: 6341 - DNA, 25 bp, Homo sapien
aagaacatgcggttccacagcagtc

SEQ ID NO: 6342 - DNA, 25 bp, Homo sapien
aagaacatgtggttccacagcagtc

SEQ ID NO: 6343 - DNA, 25 bp, Homo sapien
aagaaccaatacggtaatggcatgt

SEQ ID NO: 6344 - DNA, 25 bp, Homo sapien
aagaaccaatatggtaatggcatgt

SEQ ID NO: 6345 - DNA, 25 bp, Homo sapien
aagaaccagtgaaaacataaacaga

SEQ ID NO: 6346 - DNA, 25 bp, Homo sapien
aagaaccagtgagaacataaacaga

SEQ ID NO: 6347 - DNA, 25 bp, Homo sapien
aagaaccatatcatcaatgtcatgt

SEQ ID NO: 6348 - DNA, 25 bp, Homo sapien
aagaaccatatcgtcaatgtcatgt

SEQ ID NO: 6349 - DNA, 25 bp, Homo sapien
aagaactacgtggagacaaaagtgc

SEQ ID NO: 6350 - DNA, 25 bp, Homo sapien
aagaactacgtggtgacaaaagtgc

SEQ ID NO: 6351 - DNA, 25 bp, Homo sapien
aagaactactgtattttctgcgtat

SEQ ID NO: 6352 - DNA, 25 bp, Homo sapien
aagaactattgtattttctgcgtat

SEQ ID NO: 6353 - DNA, 25 bp, Homo sapien
aagaactcacagtttcaaagtgttt

SEQ ID NO: 6354 - DNA, 25 bp, Homo sapien
aagaactcacagtttcgaagtgttt

SEQ ID NO: 6355 - DNA, 25 bp, Homo sapien
aagaactgaaaaaaagtcctgaaat

SEQ ID NO: 6356 - DNA, 25 bp, Homo sapien
aagaactgaaaaaatgtcctgaaat

SEQ ID NO: 6357 - DNA, 25 bp, Homo sapien
aagaactgtggaaaaattatttcat

SEQ ID NO: 6358 - DNA, 25 bp, Homo sapien
aagaactgtgggaaaattatttcat

SEQ ID NO: 6359 - DNA, 25 bp, Homo sapien
aagaacttaccaacttaactgataa

SEQ ID NO: 6360 - DNA, 25 bp, Homo sapien
aagaacttatcaacttaactgataa

SEQ ID NO: 6361 - DNA, 25 bp, Homo sapien
aagaacttgtagtcaactggagaag

SEQ ID NO: 6362 - DNA, 25 bp, Homo sapien
aagaacttgtagtcaattggagaag

SEQ ID NO: 6363 - DNA, 25 bp, Homo sapien
aagaagaaaataaaagttggcatta

SEQ ID NO: 6364 - DNA, 25 bp, Homo sapien
aagaagaaaatacaagttggcatta

SEQ ID NO: 6365 - DNA, 25 bp, Homo sapien
aagaagaaaatatacgctatcacag

SEQ ID NO: 6366 - DNA, 25 bp, Homo sapien
aagaagaaaatatatgctatcacag

SEQ ID NO: 6367 - DNA, 25 bp, Homo sapien
aagaagaaaatggagtccttgctgg

SEQ ID NO: 6368 - DNA, 25 bp, Homo sapien
aagaagaaaattgagtccttgctgg

SEQ ID NO: 6369 - DNA, 25 bp, Homo sapien
aagaagaaacatgtttgaggccaca

SEQ ID NO: 6370 - DNA, 25 bp, Homo sapien
aagaagaaactgcagagtccctgcc

SEQ ID NO: 6371 - DNA, 25 bp, Homo sapien
aagaagaaaggttctcaatccagtc

SEQ ID NO: 6372 - DNA, 25 bp, Homo sapien
aagaagaaaggttctcgatccagtc

SEQ ID NO: 6373 - DNA, 25 bp, Homo sapien
aagaagaaatatgtttgaggccaca

SEQ ID NO: 6374 - DNA, 25 bp, Homo sapien
aagaagaaattgcagagtccctgcc

SEQ ID NO: 6375 - DNA, 25 bp, Homo sapien
aagaagaacaagtcggaggactgat

SEQ ID NO: 6376 - DNA, 25 bp, Homo sapien
aagaagaagaagtcggaggactgat

SEQ ID NO: 6377 - DNA, 25 bp, Homo sapien
aagaagaagcacaataccatatgtt

SEQ ID NO: 6378 - DNA, 25 bp, Homo sapien
aagaagaagcacaatatcatatgtt

SEQ ID NO: 6379 - DNA, 25 bp, Homo sapien
aagaagagcagcctacacttagtga

SEQ ID NO: 6380 - DNA, 25 bp, Homo sapien
aagaagagcggcctacacttagtga

SEQ ID NO: 6381 - DNA, 25 bp, Homo sapien
aagaagattaaactgatcggccaat

SEQ ID NO: 6382 - DNA, 25 bp, Homo sapien
aagaagattaagctgatcggccaat

SEQ ID NO: 6383 - DNA, 25 bp, Homo sapien
aagaagattacacatggtgtattga

SEQ ID NO: 6384 - DNA, 25 bp, Homo sapien
aagaagattacacgtggtgtattga

SEQ ID NO: 6385 - DNA, 25 bp, Homo sapien
aagaagcaacatggtagacatcatg

SEQ ID NO: 6386 - DNA, 25 bp, Homo sapien
aagaagcaccatggtagacatcatg

SEQ ID NO: 6387 - DNA, 25 bp, Homo sapien
aagaagcagaaaactcaaaaacaaa

SEQ ID NO: 6388 - DNA, 25 bp, Homo sapien
aagaagcagaaaactcgaaaacaaa

SEQ ID NO: 6389 - DNA, 25 bp, Homo sapien
aagaagcagtaaattactttttccc

SEQ ID NO: 6390 - DNA, 25 bp, Homo sapien
aagaagcattaaattactttttccc

SEQ ID NO: 6391 - DNA, 25 bp, Homo sapien
aagaagccaagaaatgttactcaaa

SEQ ID NO: 6392 - DNA, 25 bp, Homo sapien
aagaagccataataactgaaggcct

SEQ ID NO: 6393 - DNA, 25 bp, Homo sapien
aagaagccatagtaactgaaggcct

SEQ ID NO: 6394 - DNA, 25 bp, Homo sapien
aagaagcccagcgccagggtaggaa

SEQ ID NO: 6395 - DNA, 25 bp, Homo sapien
aagaagcccagtgccagggtaggaa

SEQ ID NO: 6396 - DNA, 25 bp, Homo sapien
aagaagccgagaaatgttactcaaa

SEQ ID NO: 6397 - DNA, 25 bp, Homo sapien
aagaagctagaaaagccaaggaagg

SEQ ID NO: 6398 - DNA, 25 bp, Homo sapien
aagaagctagaagagccaaggaagg

SEQ ID NO: 6399 - DNA, 25 bp, Homo sapien
aagaagctcagacaatctgtgctca

SEQ ID NO: 6400 - DNA, 25 bp, Homo sapien
aagaagctctgacaatctgtgctca

SEQ ID NO: 6401 - DNA, 25 bp, Homo sapien
aagaagcttcatacccattagcggt

SEQ ID NO: 6402 - DNA, 25 bp, Homo sapien
aagaagcttcatacccgttagcggt

SEQ ID NO: 6403 - DNA, 25 bp, Homo sapien
aagaagcttcatctatttctccagc

SEQ ID NO: 6404 - DNA, 25 bp, Homo sapien
aagaagcttcatttatttctccagc

SEQ ID NO: 6405 - DNA, 25 bp, Homo sapien
aagaaggaagcaatgtgagttgaaa

SEQ ID NO: 6406 - DNA, 25 bp, Homo sapien
aagaaggaagcaatttgagttgaaa

SEQ ID NO: 6407 - DNA, 25 bp, Homo sapien
aagaaggacagtacttgtgctgaag

SEQ ID NO: 6408 - DNA, 25 bp, Homo sapien
aagaaggacagtatttgtgctgaag

SEQ ID NO: 6409 - DNA, 25 bp, Homo sapien
aagaaggacctaagagctccctaat

SEQ ID NO: 6410 - DNA, 25 bp, Homo sapien
aagaaggacctatgagctccctaat

SEQ ID NO: 6411 - DNA, 25 bp, Homo sapien
aagaaggagataccgtatataaaga

SEQ ID NO: 6412 - DNA, 25 bp, Homo sapien
aagaaggagcacaagagggtcagag

SEQ ID NO: 6413 - DNA, 25 bp, Homo sapien
aagaaggaggacaagagggtcagag

SEQ ID NO: 6414 - DNA, 25 bp, Homo sapien
aagaaggaggtaccgtatataaaga

SEQ ID NO: 6415 - DNA, 25 bp, Homo sapien
aagaaggcaaaacagatgagagcaa

SEQ ID NO: 6416 - DNA, 25 bp, Homo sapien
aagaaggcaaaagagatgagagcaa

SEQ ID NO: 6417 - DNA, 25 bp, Homo sapien
aagaaggcacaatttaatcaggatt

SEQ ID NO: 6418 - DNA, 25 bp, Homo sapien
aagaaggcataatttaatcaggatt

SEQ ID NO: 6419 - DNA, 25 bp, Homo sapien
aagaaggcatccttgaagtccagaa

SEQ ID NO: 6420 - DNA, 25 bp, Homo sapien
aagaaggcatgaagacatttatgtg

SEQ ID NO: 6421 - DNA, 25 bp, Homo sapien
aagaaggcatgaaggcatttatgtg

SEQ ID NO: 6422 - DNA, 25 bp, Homo sapien
aagaaggcgtccttgaagtccagaa

SEQ ID NO: 6423 - DNA, 25 bp, Homo sapien
aagaaggtattccgctgtttactga

SEQ ID NO: 6424 - DNA, 25 bp, Homo sapien
aagaaggtattctgctgtttactga

SEQ ID NO: 6425 - DNA, 25 bp, Homo sapien
aagaagtatcaaggtatatatgaag

SEQ ID NO: 6426 - DNA, 25 bp, Homo sapien
aagaagtatcagggtatatatgaag

SEQ ID NO: 6427 - DNA, 25 bp, Homo sapien
aagaagtctcccatcaaagaaaatc

SEQ ID NO: 6428 - DNA, 25 bp, Homo sapien
aagaagtctcccgtcaaagaaaatc

SEQ ID NO: 6429 - DNA, 25 bp, Homo sapien
aagaagtgaaacaggataaaatgag

SEQ ID NO: 6430 - DNA, 25 bp, Homo sapien
aagaagtgaaacgggataaaatgag

SEQ ID NO: 6431 - DNA, 25 bp, Homo sapien
aagaagtgaattaaacagagaagac

SEQ ID NO: 6432 - DNA, 25 bp, Homo sapien
aagaagtgaattaaacggagaagac

SEQ ID NO: 6433 - DNA, 25 bp, Homo sapien
aagaagttagaacaactgtacaata

SEQ ID NO: 6434 - DNA, 25 bp, Homo sapien
aagaagttagaataactgtacaata

SEQ ID NO: 6435 - DNA, 25 bp, Homo sapien
aagaataaaaatacggtcatagtcc

SEQ ID NO: 6436 - DNA, 25 bp, Homo sapien
aagaataaaaatgcggtcatagtcc

SEQ ID NO: 6437 - DNA, 25 bp, Homo sapien
aagaataaaagacccacaatccaat

SEQ ID NO: 6438 - DNA, 25 bp, Homo sapien
aagaataaaagacctacaatccaat

SEQ ID NO: 6439 - DNA, 25 bp, Homo sapien
aagaataaaatcagaggactgacgt

SEQ ID NO: 6440 - DNA, 25 bp, Homo sapien
aagaataaccccataaacaagcaat

SEQ ID NO: 6441 - DNA, 25 bp, Homo sapien
aagaataagatcagaggactgacgt

SEQ ID NO: 6442 - DNA, 25 bp, Homo sapien
aagaataagctaaatacgctgagac

SEQ ID NO: 6443 - DNA, 25 bp, Homo sapien
aagaataagctaaatatgctgagac

SEQ ID NO: 6444 - DNA, 25 bp, Homo sapien
aagaataatacataccacatgcttg

SEQ ID NO: 6445 - DNA, 25 bp, Homo sapien
aagaataatacgtaccacatgcttg

SEQ ID NO: 6446 - DNA, 25 bp, Homo sapien
aagaataatcccataaacaagcaat

SEQ ID NO: 6447 - DNA, 25 bp, Homo sapien
aagaatacccaaagaaaccatgaaa

SEQ ID NO: 6448 - DNA, 25 bp, Homo sapien
aagaatacccagagaaaccatgaaa

SEQ ID NO: 6449 - DNA, 25 bp, Homo sapien
aagaataccttttgatagaagacac

SEQ ID NO: 6450 - DNA, 25 bp, Homo sapien
aagaatacctttttatagaagacac

SEQ ID NO: 6451 - DNA, 25 bp, Homo sapien
aagaatagacccattgcttcaaatc

SEQ ID NO: 6452 - DNA, 25 bp, Homo sapien
aagaatagacccgttgcttcaaatc

SEQ ID NO: 6453 - DNA, 25 bp, Homo sapien
aagaatatgccttcccagacactat

SEQ ID NO: 6454 - DNA, 25 bp, Homo sapien
aagaatattccttcccagacactat

SEQ ID NO: 6455 - DNA, 25 bp, Homo sapien
aagaatcctcacatggctgtaaaaa

SEQ ID NO: 6456 - DNA, 25 bp, Homo sapien
aagaatcctcacctggctgtaaaaa

SEQ ID NO: 6457 - DNA, 25 bp, Homo sapien
aagaatctggctttaaatatctgcc

SEQ ID NO: 6458 - DNA, 25 bp, Homo sapien
aagaatctggctttgaatatctgcc

SEQ ID NO: 6459 - DNA, 25 bp, Homo sapien
aagaatgaaagaacgactgcaactg

SEQ ID NO: 6460 - DNA, 25 bp, Homo sapien
aagaatgacgagagaaacgcaatgg

SEQ ID NO: 6461 - DNA, 25 bp, Homo sapien
aagaatgacgccttctatatttgta

SEQ ID NO: 6462 - DNA, 25 bp, Homo sapien
aagaatgagagaacgactgcaactg

SEQ ID NO: 6463 - DNA, 25 bp, Homo sapien
aagaatgatattgttccataacctg

SEQ ID NO: 6464 - DNA, 25 bp, Homo sapien
aagaatgatattgttctataacctg

SEQ ID NO: 6465 - DNA, 25 bp, Homo sapien
aagaatgatgagagaaacgcaatgg

SEQ ID NO: 6466 - DNA, 25 bp, Homo sapien
aagaatgatgccttctatatttgta

SEQ ID NO: 6467 - DNA, 25 bp, Homo sapien
aagaatggagtgtcggcatgaaata

SEQ ID NO: 6468 - DNA, 25 bp, Homo sapien
aagaatggagtgttggcatgaaata

SEQ ID NO: 6469 - DNA, 25 bp, Homo sapien
aagaatggatatataactttgactc

SEQ ID NO: 6470 - DNA, 25 bp, Homo sapien
aagaatggatatgtaactttgactc

SEQ ID NO: 6471 - DNA, 25 bp, Homo sapien
aagaatgtataaattgatgtgtttt

SEQ ID NO: 6472 - DNA, 25 bp, Homo sapien
aagaatgtataagttgatgtgtttt

SEQ ID NO: 6473 - DNA, 25 bp, Homo sapien
aagaatgtcaaaaacggtatctgac

SEQ ID NO: 6474 - DNA, 25 bp, Homo sapien
aagaatgtcaaacacggtatctgac

SEQ ID NO: 6475 - DNA, 25 bp, Homo sapien
aagaattacacaaacaaactgatct

SEQ ID NO: 6476 - DNA, 25 bp, Homo sapien
aagaattacgcaaacaaactgatct

SEQ ID NO: 6477 - DNA, 25 bp, Homo sapien
aagaattactggactgtgcattcct

SEQ ID NO: 6478 - DNA, 25 bp, Homo sapien
aagaattactgggctgtgcattcct

SEQ ID NO: 6479 - DNA, 25 bp, Homo sapien
aagaattagccattgatacaagaag

SEQ ID NO: 6480 - DNA, 25 bp, Homo sapien
aagaattaggtaatgtggccatact

SEQ ID NO: 6481 - DNA, 25 bp, Homo sapien
aagaattagtcattgatacaagaag

SEQ ID NO: 6482 - DNA, 25 bp, Homo sapien
aagaattagttaatgtggccatact

SEQ ID NO: 6483 - DNA, 25 bp, Homo sapien
aagaattcagtgcagatattcgctg

SEQ ID NO: 6484 - DNA, 25 bp, Homo sapien
aagaattcagtgtagatattcgctg

SEQ ID NO: 6485 - DNA, 25 bp, Homo sapien
aagaattccaaataatcatggagct

SEQ ID NO: 6486 - DNA, 25 bp, Homo sapien
aagaattccgaataatcatggagct

SEQ ID NO: 6487 - DNA, 25 bp, Homo sapien
aagaattcttcactgtcaaattatt

SEQ ID NO: 6488 - DNA, 25 bp, Homo sapien
aagaattcttcgctgtcaaattatt

SEQ ID NO: 6489 - DNA, 25 bp, Homo sapien
aagaattgacgaaggaaaattacaa

SEQ ID NO: 6490 - DNA, 25 bp, Homo sapien
aagaattgatgaaggaaaattacaa

SEQ ID NO: 6491 - DNA, 25 bp, Homo sapien
aagaattgatggataaatttttctc

SEQ ID NO: 6492 - DNA, 25 bp, Homo sapien
aagaattgatggataactttttctc

SEQ ID NO: 6493 - DNA, 25 bp, Homo sapien
aagaattgtctcaggccgcatataa

SEQ ID NO: 6494 - DNA, 25 bp, Homo sapien
aagaattgtctcaggctgcatataa

SEQ ID NO: 6495 - DNA, 25 bp, Homo sapien
aagaattgtgttgccactgagtttc

SEQ ID NO: 6496 - DNA, 25 bp, Homo sapien
aagaattgtgttgccattgagtttc

SEQ ID NO: 6497 - DNA, 25 bp, Homo sapien
aagaatttccgtccttgttgtctca

SEQ ID NO: 6498 - DNA, 25 bp, Homo sapien
aagaatttctgtccttgttgtctca

SEQ ID NO: 6499 - DNA, 25 bp, Homo sapien
aagaatttttgacagattttaatga

SEQ ID NO: 6500 - DNA, 25 bp, Homo sapien
aagaatttttgacggattttaatga

SEQ ID NO: 6501 - DNA, 25 bp, Homo sapien
aagacaaaaaagaccacatgtgaag

SEQ ID NO: 6502 - DNA, 25 bp, Homo sapien
aagacaaaaaagatcacatgtgaag

SEQ ID NO: 6503 - DNA, 25 bp, Homo sapien
aagacaaaaccaacaacaaattagg

SEQ ID NO: 6504 - DNA, 25 bp, Homo sapien
aagacaaaagcaacaacaaattagg

SEQ ID NO: 6505 - DNA, 25 bp, Homo sapien
aagacaaatctaaccagaagaggag

SEQ ID NO: 6506 - DNA, 25 bp, Homo sapien
aagacaaatctaactagaagaggag

SEQ ID NO: 6507 - DNA, 25 bp, Homo sapien
aagacaaattaaacctctgacttcc

SEQ ID NO: 6508 - DNA, 25 bp, Homo sapien
aagacaaattaaatctctgacttcc

SEQ ID NO: 6509 - DNA, 25 bp, Homo sapien
aagacaacacacatagcaatttaag

SEQ ID NO: 6510 - DNA, 25 bp, Homo sapien
aagacaacacacgtagcaatttaag

SEQ ID NO: 6511 - DNA, 25 bp, Homo sapien
aagacaaccaatccactgaataaga

SEQ ID NO: 6512 - DNA, 25 bp, Homo sapien
aagacaaccaatccgctgaataaga

SEQ ID NO: 6513 - DNA, 25 bp, Homo sapien
aagacaagagaagcctgtaaatccg

SEQ ID NO: 6514 - DNA, 25 bp, Homo sapien
aagacaagagaaggctgtaaatccg

SEQ ID NO: 6515 - DNA, 25 bp, Homo sapien
aagacaaggtcaaaagttgattata

SEQ ID NO: 6516 - DNA, 25 bp, Homo sapien
aagacaaggtcaaatgttgattata

SEQ ID NO: 6517 - DNA, 25 bp, Homo sapien
aagacaatctgacactttcttatta

SEQ ID NO: 6518 - DNA, 25 bp, Homo sapien
aagacaattgaccaactgtgcgtgg

SEQ ID NO: 6519 - DNA, 25 bp, Homo sapien
aagacaattgaccgactgtgcgtgg

SEQ ID NO: 6520 - DNA, 25 bp, Homo sapien
aagacaatttgacactttcttatta

SEQ ID NO: 6521 - DNA, 25 bp, Homo sapien
aagacacaagggaataatatgtgct

SEQ ID NO: 6522 - DNA, 25 bp, Homo sapien
aagacacaagggagtaatatgtgct

SEQ ID NO: 6523 - DNA, 25 bp, Homo sapien
aagacacagacggggcaaggccact

SEQ ID NO: 6524 - DNA, 25 bp, Homo sapien
aagacacagacggggctaggccact

SEQ ID NO: 6525 - DNA, 25 bp, Homo sapien
aagacacagggaatatccccttctc

SEQ ID NO: 6526 - DNA, 25 bp, Homo sapien
aagacacagggactatccccttctc

SEQ ID NO: 6527 - DNA, 25 bp, Homo sapien
aagacacggaggtatcagaaataca

SEQ ID NO: 6528 - DNA, 25 bp, Homo sapien
aagacacggcggtatcagaaataca

SEQ ID NO: 6529 - DNA, 25 bp, Homo sapien
aagacacttcatacagagagtttgg

SEQ ID NO: 6530 - DNA, 25 bp, Homo sapien
aagacacttcatacggagagtttgg

SEQ ID NO: 6531 - DNA, 25 bp, Homo sapien
aagacacttttcgtaaggaatgaga

SEQ ID NO: 6532 - DNA, 25 bp, Homo sapien
aagacacttttcttaaggaatgaga

SEQ ID NO: 6533 - DNA, 25 bp, Homo sapien
aagacagagggaggtttacaaatgc

SEQ ID NO: 6534 - DNA, 25 bp, Homo sapien
aagacagagggatgtttacaaatgc

SEQ ID NO: 6535 - DNA, 25 bp, Homo sapien
aagacaggaaaatacagtttgggat

SEQ ID NO: 6536 - DNA, 25 bp, Homo sapien
aagacaggaatgctgctatatatcc

SEQ ID NO: 6537 - DNA, 25 bp, Homo sapien
aagacaggatgacaaagaaaagggc

SEQ ID NO: 6538 - DNA, 25 bp, Homo sapien
aagacaggatgacagagaaaagggc

SEQ ID NO: 6539 - DNA, 25 bp, Homo sapien
aagacagggaaatacagtttgggat

SEQ ID NO: 6540 - DNA, 25 bp, Homo sapien
aagacagggatgctgctatatatcc

SEQ ID NO: 6541 - DNA, 25 bp, Homo sapien
aagacagtaaaagaagagtaacaaa

SEQ ID NO: 6542 - DNA, 25 bp, Homo sapien
aagacagtaaaagaagtgtaacaaa

SEQ ID NO: 6543 - DNA, 25 bp, Homo sapien
aagacagtaacacagcaggatccta

SEQ ID NO: 6544 - DNA, 25 bp, Homo sapien
aagacagtgcccatagacggccata

SEQ ID NO: 6545 - DNA, 25 bp, Homo sapien
aagacagtgcccatggacggccata

SEQ ID NO: 6546 - DNA, 25 bp, Homo sapien
aagacagttacacagcaggatccta

SEQ ID NO: 6547 - DNA, 25 bp, Homo sapien
aagacatatagcacaagtgatacat

SEQ ID NO: 6548 - DNA, 25 bp, Homo sapien
aagacatatagcacgagtgatacat

SEQ ID NO: 6549 - DNA, 25 bp, Homo sapien
aagacatctcagtatgtatatgcaa

SEQ ID NO: 6550 - DNA, 25 bp, Homo sapien
aagacatctgagtatgtatatgcaa

SEQ ID NO: 6551 - DNA, 25 bp, Homo sapien
aagacatctgcatgattttccttaa

SEQ ID NO: 6552 - DNA, 25 bp, Homo sapien
aagacatctgcatgtttttccttaa

SEQ ID NO: 6553 - DNA, 25 bp, Homo sapien
aagacattccatgaacaaggattgg

SEQ ID NO: 6554 - DNA, 25 bp, Homo sapien
aagacattctaaaaggcagtttatt

SEQ ID NO: 6555 - DNA, 25 bp, Homo sapien
aagacattctaaagggcagtttatt

SEQ ID NO: 6556 - DNA, 25 bp, Homo sapien
aagacattgggtctgcatattgaac

SEQ ID NO: 6557 - DNA, 25 bp, Homo sapien
aagacattgggtttgcatattgaac

SEQ ID NO: 6558 - DNA, 25 bp, Homo sapien
aagacatttcatgaacaaggattgg

SEQ ID NO: 6559 - DNA, 25 bp, Homo sapien
aagaccaaaaaatcttacgaactgc

SEQ ID NO: 6560 - DNA, 25 bp, Homo sapien
aagaccaaaaagtcttacgaactgc

SEQ ID NO: 6561 - DNA, 25 bp, Homo sapien
aagaccaacattccttgttaagtga

SEQ ID NO: 6562 - DNA, 25 bp, Homo sapien
aagaccaacattctttgttaagtga

SEQ ID NO: 6563 - DNA, 25 bp, Homo sapien
aagaccacaaactccctgtcacata

SEQ ID NO: 6564 - DNA, 25 bp, Homo sapien
aagaccacaacaggaacatagccaa

SEQ ID NO: 6565 - DNA, 25 bp, Homo sapien
aagaccacaacgggaacatagccaa

SEQ ID NO: 6566 - DNA, 25 bp, Homo sapien
aagaccacagactccctgtcacata

SEQ ID NO: 6567 - DNA, 25 bp, Homo sapien
aagaccagatgtgagcacagagatt

SEQ ID NO: 6568 - DNA, 25 bp, Homo sapien
aagaccagatgtgggcacagagatt

SEQ ID NO: 6569 - DNA, 25 bp, Homo sapien
aagaccatcatcatctctcaaccca

SEQ ID NO: 6570 - DNA, 25 bp, Homo sapien
aagaccatcgtcatctctcaaccca

SEQ ID NO: 6571 - DNA, 25 bp, Homo sapien
aagacccatcgcatcatcattcaag

SEQ ID NO: 6572 - DNA, 25 bp, Homo sapien
aagacccatggcatcatcattcaag

SEQ ID NO: 6573 - DNA, 25 bp, Homo sapien
aagacctatcgcaagccctcagttg

SEQ ID NO: 6574 - DNA, 25 bp, Homo sapien
aagacctattgcaagccctcagttg

SEQ ID NO: 6575 - DNA, 25 bp, Homo sapien
aagaccttgccatgttaagtgatgt

SEQ ID NO: 6576 - DNA, 25 bp, Homo sapien
aagaccttgccgtgttaagtgatgt

SEQ ID NO: 6577 - DNA, 25 bp, Homo sapien
aagacgccaggcacagtgctaaaca

SEQ ID NO: 6578 - DNA, 25 bp, Homo sapien
aagacgccaggcaccgtgctaaaca

SEQ ID NO: 6579 - DNA, 25 bp, Homo sapien
aagacggaatcagcaggtatttttg

SEQ ID NO: 6580 - DNA, 25 bp, Homo sapien
aagacggactcagcaggtatttttg

SEQ ID NO: 6581 - DNA, 25 bp, Homo sapien
aagacggctacgtaacggaaaccca

SEQ ID NO: 6582 - DNA, 25 bp, Homo sapien
aagacggctacgtgacggaaaccca

SEQ ID NO: 6583 - DNA, 25 bp, Homo sapien
aagactaaataagtagtgtctgaat

SEQ ID NO: 6584 - DNA, 25 bp, Homo sapien
aagactaagtaagtagtgtctgaat

SEQ ID NO: 6585 - DNA, 25 bp, Homo sapien
aagactcaaagttccggtggctctg

SEQ ID NO: 6586 - DNA, 25 bp, Homo sapien
aagactcaaagttctggtggctctg

SEQ ID NO: 6587 - DNA, 25 bp, Homo sapien
aagactccaagcctaactctctgct

SEQ ID NO: 6588 - DNA, 25 bp, Homo sapien
aagactccaagcctgactctctgct

SEQ ID NO: 6589 - DNA, 25 bp, Homo sapien
aagactctctcctccacgttacttt

SEQ ID NO: 6590 - DNA, 25 bp, Homo sapien
aagactctctcctccatgttacttt

SEQ ID NO: 6591 - DNA, 25 bp, Homo sapien
aagactctcttctcttttatagatg

SEQ ID NO: 6592 - DNA, 25 bp, Homo sapien
aagactctcttctgttttatagatg

SEQ ID NO: 6593 - DNA, 25 bp, Homo sapien
aagactctctttaaaaaatgaaaat

SEQ ID NO: 6594 - DNA, 25 bp, Homo sapien
aagactctctttgaaaaatgaaaat

SEQ ID NO: 6595 - DNA, 25 bp, Homo sapien
aagactgataaatgagaaaacatgt

SEQ ID NO: 6596 - DNA, 25 bp, Homo sapien
aagactgataaatgggaaaacatgt

SEQ ID NO: 6597 - DNA, 25 bp, Homo sapien
aagactgcaagaaatacctaagtct

SEQ ID NO: 6598 - DNA, 25 bp, Homo sapien
aagactgcgagaaatacctaagtct

SEQ ID NO: 6599 - DNA, 25 bp, Homo sapien
aagactgctaactgatttgaacatg

SEQ ID NO: 6600 - DNA, 25 bp, Homo sapien
aagactgctaactggtttgaacatg

SEQ ID NO: 6601 - DNA, 25 bp, Homo sapien
aagactggcaccaaagttccaccag

SEQ ID NO: 6602 - DNA, 25 bp, Homo sapien
aagactggcaccagagttccaccag

SEQ ID NO: 6603 - DNA, 25 bp, Homo sapien
aagactgggggcgcaaagagcttcg

SEQ ID NO: 6604 - DNA, 25 bp, Homo sapien
aagactgggggtgcaaagagcttcg

SEQ ID NO: 6605 - DNA, 25 bp, Homo sapien
aagactgtattgacatgaataaatt

SEQ ID NO: 6606 - DNA, 25 bp, Homo sapien
aagactgtattgtcatgaataaatt

SEQ ID NO: 6607 - DNA, 25 bp, Homo sapien
aagactgtgttgtgcactagataga

SEQ ID NO: 6608 - DNA, 25 bp, Homo sapien
aagactgtgttgtgcattagataga

SEQ ID NO: 6609 - DNA, 25 bp, Homo sapien
aagacttacgcctgggatacctttt

SEQ ID NO: 6610 - DNA, 25 bp, Homo sapien
aagacttacgccttggatacctttt

SEQ ID NO: 6611 - DNA, 25 bp, Homo sapien
aagacttcaccctaaccttttattc

SEQ ID NO: 6612 - DNA, 25 bp, Homo sapien
aagacttcaccctaacgttttattc

SEQ ID NO: 6613 - DNA, 25 bp, Homo sapien
aagacttcagaaagaaacaaaccca

SEQ ID NO: 6614 - DNA, 25 bp, Homo sapien
aagacttcggaaagaaacaaaccca

SEQ ID NO: 6615 - DNA, 25 bp, Homo sapien
aagacttgctcaacttagacatgca

SEQ ID NO: 6616 - DNA, 25 bp, Homo sapien
aagacttgctcaccttagacatgca

SEQ ID NO: 6617 - DNA, 25 bp, Homo sapien
aagactttccatctcaattgtacag

SEQ ID NO: 6618 - DNA, 25 bp, Homo sapien
aagactttccatctgaattgtacag

SEQ ID NO: 6619 - DNA, 25 bp, Homo sapien
aagagaaaaagatgagtaagcattt

SEQ ID NO: 6620 - DNA, 25 bp, Homo sapien
aagagaaaaatgattgtgctataag

SEQ ID NO: 6621 - DNA, 25 bp, Homo sapien
aagagaaacatgattgtgctataag

SEQ ID NO: 6622 - DNA, 25 bp, Homo sapien
aagagaaagagatgagtaagcattt

SEQ ID NO: 6623 - DNA, 25 bp, Homo sapien
aagagaaatgcaaggagagtcggaa

SEQ ID NO: 6624 - DNA, 25 bp, Homo sapien
aagagaaatgccaggagagtcggaa

SEQ ID NO: 6625 - DNA, 25 bp, Homo sapien
aagagaacaagacccaatactacag

SEQ ID NO: 6626 - DNA, 25 bp, Homo sapien
aagagaacaaggcccaatactacag

SEQ ID NO: 6627 - DNA, 25 bp, Homo sapien
aagagaacactggaaaagaggccca

SEQ ID NO: 6628 - DNA, 25 bp, Homo sapien
aagagaacattggaaaagaggccca

SEQ ID NO: 6629 - DNA, 25 bp, Homo sapien
aagagaaccagatttctgctttctc

SEQ ID NO: 6630 - DNA, 25 bp, Homo sapien
aagagaaccaggtttctgctttctc

SEQ ID NO: 6631 - DNA, 25 bp, Homo sapien
aagagaacgctaaacatgggatcaa

SEQ ID NO: 6632 - DNA, 25 bp, Homo sapien
aagagaacgctaagcatgggatcaa

SEQ ID NO: 6633 - DNA, 25 bp, Homo sapien
aagagaacttaacggttttccagac

SEQ ID NO: 6634 - DNA, 25 bp, Homo sapien
aagagaacttaatggttttccagac

SEQ ID NO: 6635 - DNA, 25 bp, Homo sapien
aagagaagaaagtaccaggacttaa

SEQ ID NO: 6636 - DNA, 25 bp, Homo sapien
aagagaagaaatgtgggttcctggt

SEQ ID NO: 6637 - DNA, 25 bp, Homo sapien
aagagaagaaattaccaggacttaa

SEQ ID NO: 6638 - DNA, 25 bp, Homo sapien
aagagaagaaatttgggttcctggt

SEQ ID NO: 6639 - DNA, 25 bp, Homo sapien
aagagaagacctaagatgaacaaat

SEQ ID NO: 6640 - DNA, 25 bp, Homo sapien
aagagaagagcatcaagagacgggt

SEQ ID NO: 6641 - DNA, 25 bp, Homo sapien
aagagaagagctaagatgaacaaat

SEQ ID NO: 6642 - DNA, 25 bp, Homo sapien
aagagaagagggtcggtttctcata

SEQ ID NO: 6643 - DNA, 25 bp, Homo sapien
aagagaagagggttggtttctcata

SEQ ID NO: 6644 - DNA, 25 bp, Homo sapien
aagagaagatcatcaagagacgggt

SEQ ID NO: 6645 - DNA, 25 bp, Homo sapien
aagagaagctaacagaatatgttta

SEQ ID NO: 6646 - DNA, 25 bp, Homo sapien
aagagaagctaacagagtatgttta

SEQ ID NO: 6647 - DNA, 25 bp, Homo sapien
aagagaagtatgcaagaattcagaa

SEQ ID NO: 6648 - DNA, 25 bp, Homo sapien
aagagaagtttgcaagaattcagaa

SEQ ID NO: 6649 - DNA, 25 bp, Homo sapien
aagagaataggcctgagtcttgctg

SEQ ID NO: 6650 - DNA, 25 bp, Homo sapien
aagagaataggtctgagtcttgctg

SEQ ID NO: 6651 - DNA, 25 bp, Homo sapien
aagagaatgtcctactcagcttacc

SEQ ID NO: 6652 - DNA, 25 bp, Homo sapien
aagagaatgtggtcacaatcaatag

SEQ ID NO: 6653 - DNA, 25 bp, Homo sapien
aagagaatgtggtcgcaatcaatag

SEQ ID NO: 6654 - DNA, 25 bp, Homo sapien
aagagaatttcctactcagcttacc

SEQ ID NO: 6655 - DNA, 25 bp, Homo sapien
aagagacaagctgagaaaagaatct

SEQ ID NO: 6656 - DNA, 25 bp, Homo sapien
aagagacaatctgagaaaagaatct

SEQ ID NO: 6657 - DNA, 25 bp, Homo sapien
aagagacgtcaacatggaaggtaca

SEQ ID NO: 6658 - DNA, 25 bp, Homo sapien
aagagacgtcaatatggaaggtaca

SEQ ID NO: 6659 - DNA, 25 bp, Homo sapien
aagagactgtgaaagaacagctaga

SEQ ID NO: 6660 - DNA, 25 bp, Homo sapien
aagagactgtgaaggaacagctaga

SEQ ID NO: 6661 - DNA, 25 bp, Homo sapien
aagagagaaagcaatgtgacaacct

SEQ ID NO: 6662 - DNA, 25 bp, Homo sapien
aagagagaaagcagtgtgacaacct

SEQ ID NO: 6663 - DNA, 25 bp, Homo sapien
aagagagaactccggacactctaca

SEQ ID NO: 6664 - DNA, 25 bp, Homo sapien
aagagagaactctggacactctaca

SEQ ID NO: 6665 - DNA, 25 bp, Homo sapien
aagagagaccaaaactcactgaaca

SEQ ID NO: 6666 - DNA, 25 bp, Homo sapien
aagagagaccaacactcactgaaca

SEQ ID NO: 6667 - DNA, 25 bp, Homo sapien
aagagagaggttcgtctgagaaaac

SEQ ID NO: 6668 - DNA, 25 bp, Homo sapien
aagagagaggtttgtctgagaaaac

SEQ ID NO: 6669 - DNA, 25 bp, Homo sapien
aagagagcagcattagccagacctt

SEQ ID NO: 6670 - DNA, 25 bp, Homo sapien
aagagagcagcgttagccagacctt

SEQ ID NO: 6671 - DNA, 25 bp, Homo sapien
aagagagccagaaaccagtatgcag

SEQ ID NO: 6672 - DNA, 25 bp, Homo sapien
aagagagcccgaaaccagtatgcag

SEQ ID NO: 6673 - DNA, 25 bp, Homo sapien
aagagagccctgaaaaatctcatct

SEQ ID NO: 6674 - DNA, 25 bp, Homo sapien
aagagagccgttttctacctacttt

SEQ ID NO: 6675 - DNA, 25 bp, Homo sapien
aagagagccttgaaaaatctcatct

SEQ ID NO: 6676 - DNA, 25 bp, Homo sapien
aagagagctgttttctacctacttt

SEQ ID NO: 6677 - DNA, 25 bp, Homo sapien
aagagaggaaaacggacctctatgg

SEQ ID NO: 6678 - DNA, 25 bp, Homo sapien
aagagaggaaaacggatctctatgg

SEQ ID NO: 6679 - DNA, 25 bp, Homo sapien
aagagaggaaggccgatgggaaggg

SEQ ID NO: 6680 - DNA, 25 bp, Homo sapien
aagagaggaaggtcgatgggaaggg

SEQ ID NO: 6681 - DNA, 25 bp, Homo sapien
aagagaggacatcgctactattatt

SEQ ID NO: 6682 - DNA, 25 bp, Homo sapien
aagagaggacattgctactattatt

SEQ ID NO: 6683 - DNA, 25 bp, Homo sapien
aagagaggcaggaagacttaccttg

SEQ ID NO: 6684 - DNA, 25 bp, Homo sapien
aagagaggcagggagacttaccttg

SEQ ID NO: 6685 - DNA, 25 bp, Homo sapien
aagagaggcctacgaaaaggttcca

SEQ ID NO: 6686 - DNA, 25 bp, Homo sapien
aagagaggcctatgaaaaggttcca

SEQ ID NO: 6687 - DNA, 25 bp, Homo sapien
aagagaggctcacatcaagtggaag

SEQ ID NO: 6688 - DNA, 25 bp, Homo sapien
aagagaggctcacgtcaagtggaag

SEQ ID NO: 6689 - DNA, 25 bp, Homo sapien
aagagataaaaagataataaaaagt

SEQ ID NO: 6690 - DNA, 25 bp, Homo sapien
aagagataaacaccaaataaatgca

SEQ ID NO: 6691 - DNA, 25 bp, Homo sapien
aagagataaacagcaaataaatgca

SEQ ID NO: 6692 - DNA, 25 bp, Homo sapien
aagagatagaaagataataaaaagt

SEQ ID NO: 6693 - DNA, 25 bp, Homo sapien
aagagatctgtggaagagaactgag

SEQ ID NO: 6694 - DNA, 25 bp, Homo sapien
aagagatctgtggaagggaactgag

SEQ ID NO: 6695 - DNA, 25 bp, Homo sapien
aagagatgaagtcatgaaagtaacc

SEQ ID NO: 6696 - DNA, 25 bp, Homo sapien
aagagatgaagtcatggaagtaacc

SEQ ID NO: 6697 - DNA, 25 bp, Homo sapien
aagagatgccggatgttcctatcaa

SEQ ID NO: 6698 - DNA, 25 bp, Homo sapien
aagagatgctggatgttcctatcaa

SEQ ID NO: 6699 - DNA, 25 bp, Homo sapien
aagagatggaaggaaactttttgca

SEQ ID NO: 6700 - DNA, 25 bp, Homo sapien
aagagatggaaggaaattttttgca

SEQ ID NO: 6701 - DNA, 25 bp, Homo sapien
aagagatggcctgtttccagatctt

SEQ ID NO: 6702 - DNA, 25 bp, Homo sapien
aagagatggcctgttttcagatctt

SEQ ID NO: 6703 - DNA, 25 bp, Homo sapien
aagagatgtcacatgttgcattgag

SEQ ID NO: 6704 - DNA, 25 bp, Homo sapien
aagagatgttacatgttgcattgag

SEQ ID NO: 6705 - DNA, 25 bp, Homo sapien
aagagattgacagtctaagcattcg

SEQ ID NO: 6706 - DNA, 25 bp, Homo sapien
aagagattggcagtctaagcattcg

SEQ ID NO: 6707 - DNA, 25 bp, Homo sapien
aagagatttcagtaggtgcattgga

SEQ ID NO: 6708 - DNA, 25 bp, Homo sapien
aagagatttcattaggtgcattgga

SEQ ID NO: 6709 - DNA, 25 bp, Homo sapien
aagagattttgaaggagcaagactg

SEQ ID NO: 6710 - DNA, 25 bp, Homo sapien
aagagattttgagggagcaagactg

SEQ ID NO: 6711 - DNA, 25 bp, Homo sapien
aagagcaacacacgattcttgcggc

SEQ ID NO: 6712 - DNA, 25 bp, Homo sapien
aagagcaacacaggattcttgcggc

SEQ ID NO: 6713 - DNA, 25 bp, Homo sapien
aagagcaaccaggaagctgtgagct

SEQ ID NO: 6714 - DNA, 25 bp, Homo sapien
aagagcaaccagggagctgtgagct

SEQ ID NO: 6715 - DNA, 25 bp, Homo sapien
aagagcaactagttatgggaaaaga

SEQ ID NO: 6716 - DNA, 25 bp, Homo sapien
aagagcaagataccttttagtctat

SEQ ID NO: 6717 - DNA, 25 bp, Homo sapien
aagagcaagatatcttttagtctat

SEQ ID NO: 6718 - DNA, 25 bp, Homo sapien
aagagcaattagttatgggaaaaga

SEQ ID NO: 6719 - DNA, 25 bp, Homo sapien
aagagcacaagggactatttcttca

SEQ ID NO: 6720 - DNA, 25 bp, Homo sapien
aagagcacaagggactgtttcttca

SEQ ID NO: 6721 - DNA, 25 bp, Homo sapien
aagagcataagatcatttttcagta

SEQ ID NO: 6722 - DNA, 25 bp, Homo sapien
aagagcataagatcgtttttcagta

SEQ ID NO: 6723 - DNA, 25 bp, Homo sapien
aagagcatggaatcaagaaaagggt

SEQ ID NO: 6724 - DNA, 25 bp, Homo sapien
aagagcatggactcaagaaaagggt

SEQ ID NO: 6725 - DNA, 25 bp, Homo sapien
aagagcatggttccagaaactccac

SEQ ID NO: 6726 - DNA, 25 bp, Homo sapien
aagagcatggttccaggaactccac

SEQ ID NO: 6727 - DNA, 25 bp, Homo sapien
aagagccacatgttcagtgagacta

SEQ ID NO: 6728 - DNA, 25 bp, Homo sapien
aagagccagatgttcagtgagacta

SEQ ID NO: 6729 - DNA, 25 bp, Homo sapien
aagagccagctttcccaactcaatc

SEQ ID NO: 6730 - DNA, 25 bp, Homo sapien
aagagccagctttcccgactcaatc

SEQ ID NO: 6731 - DNA, 25 bp, Homo sapien
aagagcccacagctttcaaatttat

SEQ ID NO: 6732 - DNA, 25 bp, Homo sapien
aagagcccacaggtttcaaatttat

SEQ ID NO: 6733 - DNA, 25 bp, Homo sapien
aagagcccagaggatagcgacggct

SEQ ID NO: 6734 - DNA, 25 bp, Homo sapien
aagagcccagagtatagcgacggct

SEQ ID NO: 6735 - DNA, 25 bp, Homo sapien
aagagccctgacgtacatacttgtg

SEQ ID NO: 6736 - DNA, 25 bp, Homo sapien
aagagccctgacgtgcatacttgtg

SEQ ID NO: 6737 - DNA, 25 bp, Homo sapien
aagagccgggcagtggcggactgta

SEQ ID NO: 6738 - DNA, 25 bp, Homo sapien
aagagccgggcagtggtggactgta

SEQ ID NO: 6739 - DNA, 25 bp, Homo sapien
aagagcctgaaagaatattttatgg

SEQ ID NO: 6740 - DNA, 25 bp, Homo sapien
aagagcctgaatgaatattttatgg

SEQ ID NO: 6741 - DNA, 25 bp, Homo sapien
aagagcctgtgaacaagataaggaa

SEQ ID NO: 6742 - DNA, 25 bp, Homo sapien
aagagcctgtgaacgagataaggaa

SEQ ID NO: 6743 - DNA, 25 bp, Homo sapien
aagagccttgaaagtactatttcac

SEQ ID NO: 6744 - DNA, 25 bp, Homo sapien
aagagccttgaatgtactatttcac

SEQ ID NO: 6745 - DNA, 25 bp, Homo sapien
aagagcggtagtggcatgtccctag

SEQ ID NO: 6746 - DNA, 25 bp, Homo sapien
aagagcggtcgtggcatgtccctag

SEQ ID NO: 6747 - DNA, 25 bp, Homo sapien
aagagctaaaagtcggtcacacaag

SEQ ID NO: 6748 - DNA, 25 bp, Homo sapien
aagagctaaaagtgggtcacacaag

SEQ ID NO: 6749 - DNA, 25 bp, Homo sapien
aagagctcattcctcgggatttaat

SEQ ID NO: 6750 - DNA, 25 bp, Homo sapien
aagagctcattccttgggatttaat

SEQ ID NO: 6751 - DNA, 25 bp, Homo sapien
aagagctctcaacatacctctgtag

SEQ ID NO: 6752 - DNA, 25 bp, Homo sapien
aagagctctcaacatatctctgtag

SEQ ID NO: 6753 - DNA, 25 bp, Homo sapien
aagagctgagcccgcaagtttgcct

SEQ ID NO: 6754 - DNA, 25 bp, Homo sapien
aagagctgagccggcaagtttgcct

SEQ ID NO: 6755 - DNA, 25 bp, Homo sapien
aagagctgcaagagacaaggaatat

SEQ ID NO: 6756 - DNA, 25 bp, Homo sapien
aagagctgcaagagaccaggaatat

SEQ ID NO: 6757 - DNA, 25 bp, Homo sapien
aagagcttaacatgctgtatggtgc

SEQ ID NO: 6758 - DNA, 25 bp, Homo sapien
aagagcttaacatggtgtatggtgc

SEQ ID NO: 6759 - DNA, 25 bp, Homo sapien
aagaggaaacgatgctgaagactga

SEQ ID NO: 6760 - DNA, 25 bp, Homo sapien
aagaggaaatgatgctgaagactga

SEQ ID NO: 6761 - DNA, 25 bp, Homo sapien
aagaggaacgcataaataggtccca

SEQ ID NO: 6762 - DNA, 25 bp, Homo sapien
aagaggaagcacagagcatgtccag

SEQ ID NO: 6763 - DNA, 25 bp, Homo sapien
aagaggaagcacagagtatgtccag

SEQ ID NO: 6764 - DNA, 25 bp, Homo sapien
aagaggaaggatcaactgtgaatgg

SEQ ID NO: 6765 - DNA, 25 bp, Homo sapien
aagaggaaggatcgactgtgaatgg

SEQ ID NO: 6766 - DNA, 25 bp, Homo sapien
aagaggaatgcataaataggtccca

SEQ ID NO: 6767 - DNA, 25 bp, Homo sapien
aagaggacaatgccacagagaagca

SEQ ID NO: 6768 - DNA, 25 bp, Homo sapien
aagaggacagtgccacagagaagca

SEQ ID NO: 6769 - DNA, 25 bp, Homo sapien
aagaggagattctgacacagacaca

SEQ ID NO: 6770 - DNA, 25 bp, Homo sapien
aagaggagtttctgacacagacaca

SEQ ID NO: 6771 - DNA, 25 bp, Homo sapien
aagaggattttattaaacgtattca

SEQ ID NO: 6772 - DNA, 25 bp, Homo sapien
aagaggattttgttaaacgtattca

SEQ ID NO: 6773 - DNA, 25 bp, Homo sapien
aagaggcaaattgcagaatctaatc

SEQ ID NO: 6774 - DNA, 25 bp, Homo sapien
aagaggcaagagacaacctgaagga

SEQ ID NO: 6775 - DNA, 25 bp, Homo sapien
aagaggcaagagataacctgaagga

SEQ ID NO: 6776 - DNA, 25 bp, Homo sapien
aagaggcaagttgcagaatctaatc

SEQ ID NO: 6777 - DNA, 25 bp, Homo sapien
aagaggcaatctgcatagcatcaga

SEQ ID NO: 6778 - DNA, 25 bp, Homo sapien
aagaggcaatctgcatggcatcaga

SEQ ID NO: 6779 - DNA, 25 bp, Homo sapien
aagaggcctgtacattcgtttaatt

SEQ ID NO: 6780 - DNA, 25 bp, Homo sapien
aagaggcctgtacgttcgtttaatt

SEQ ID NO: 6781 - DNA, 25 bp, Homo sapien
aagaggctgagccacagaggaatgt

SEQ ID NO: 6782 - DNA, 25 bp, Homo sapien
aagaggctgagtcacagaggaatgt

SEQ ID NO: 6783 - DNA, 25 bp, Homo sapien
aagagggaaggacatgataggatcc

SEQ ID NO: 6784 - DNA, 25 bp, Homo sapien
aagagggaaggccatgataggatcc

SEQ ID NO: 6785 - DNA, 25 bp, Homo sapien
aagagggagaggacaaaggtgtaaa

SEQ ID NO: 6786 - DNA, 25 bp, Homo sapien
aagagggagaggacaagggtgtaaa

SEQ ID NO: 6787 - DNA, 25 bp, Homo sapien
aagagggatatacactgtagctaaa

SEQ ID NO: 6788 - DNA, 25 bp, Homo sapien
aagagggatatacattgtagctaaa

SEQ ID NO: 6789 - DNA, 25 bp, Homo sapien
aagagggcacgcgagtcccactcct

SEQ ID NO: 6790 - DNA, 25 bp, Homo sapien
aagagggcacgggctccgcagacag

SEQ ID NO: 6791 - DNA, 25 bp, Homo sapien
aagagggcatgcgagtcccactcct

SEQ ID NO: 6792 - DNA, 25 bp, Homo sapien
aagagggcatgggctccgcagacag

SEQ ID NO: 6793 - DNA, 25 bp, Homo sapien
aagagggcatttcaataaaggaagg

SEQ ID NO: 6794 - DNA, 25 bp, Homo sapien
aagagggcatttcaatgaaggaagg

SEQ ID NO: 6795 - DNA, 25 bp, Homo sapien
aagagggtcggtttctcatatttga

SEQ ID NO: 6796 - DNA, 25 bp, Homo sapien
aagagggttggtttctcatatttga

SEQ ID NO: 6797 - DNA, 25 bp, Homo sapien
aagaggtacaaaaaaacagtcttga

SEQ ID NO: 6798 - DNA, 25 bp, Homo sapien
aagaggtacgtcaaagatagaatca

SEQ ID NO: 6799 - DNA, 25 bp, Homo sapien
aagaggtagaaaaaaacagtcttga

SEQ ID NO: 6800 - DNA, 25 bp, Homo sapien
aagaggtagaggttggaaggattgg

SEQ ID NO: 6801 - DNA, 25 bp, Homo sapien
aagaggtagagtttggaaggattgg

SEQ ID NO: 6802 - DNA, 25 bp, Homo sapien
aagaggtatctaaaatctcccactg

SEQ ID NO: 6803 - DNA, 25 bp, Homo sapien
aagaggtatgtaaaatctcccactg

SEQ ID NO: 6804 - DNA, 25 bp, Homo sapien
aagaggtatgtcaaagatagaatca

SEQ ID NO: 6805 - DNA, 25 bp, Homo sapien
aagaggtcactttactttcctaaac

SEQ ID NO: 6806 - DNA, 25 bp, Homo sapien
aagaggtcgctttactttcctaaac

SEQ ID NO: 6807 - DNA, 25 bp, Homo sapien
aagaggtggctttgcttacaggttg

SEQ ID NO: 6808 - DNA, 25 bp, Homo sapien
aagaggtggttttgcttacaggttg

SEQ ID NO: 6809 - DNA, 25 bp, Homo sapien
aagagtaaaggggaatttgtcttgc

SEQ ID NO: 6810 - DNA, 25 bp, Homo sapien
aagagtaaagggtaatttgtcttgc

SEQ ID NO: 6811 - DNA, 25 bp, Homo sapien
aagagtaacgataactgttcttatc

SEQ ID NO: 6812 - DNA, 25 bp, Homo sapien
aagagtaatgagacctctgtattat

SEQ ID NO: 6813 - DNA, 25 bp, Homo sapien
aagagtaatgagacctttgtattat

SEQ ID NO: 6814 - DNA, 25 bp, Homo sapien
aagagtaatgataactgttcttatc

SEQ ID NO: 6815 - DNA, 25 bp, Homo sapien
aagagtacaaagttctccatgaacc

SEQ ID NO: 6816 - DNA, 25 bp, Homo sapien
aagagtaccaagttctccatgaacc

SEQ ID NO: 6817 - DNA, 25 bp, Homo sapien
aagagtagcaaggcaatttagttta

SEQ ID NO: 6818 - DNA, 25 bp, Homo sapien
aagagtagcatgcgattctaataat

SEQ ID NO: 6819 - DNA, 25 bp, Homo sapien
aagagtagcatgtgattctaataat

SEQ ID NO: 6820 - DNA, 25 bp, Homo sapien
aagagtagcgaggcaatttagttta

SEQ ID NO: 6821 - DNA, 25 bp, Homo sapien
aagagtataaagttccttcttctcc

SEQ ID NO: 6822 - DNA, 25 bp, Homo sapien
aagagtataaagtttcttcttctcc

SEQ ID NO: 6823 - DNA, 25 bp, Homo sapien
aagagtcaagttgcttctggaagat

SEQ ID NO: 6824 - DNA, 25 bp, Homo sapien
aagagtcactttacaatggagaaac

SEQ ID NO: 6825 - DNA, 25 bp, Homo sapien
aagagtcactttgcaatggagaaac

SEQ ID NO: 6826 - DNA, 25 bp, Homo sapien
aagagtcatgttgcttctggaagat

SEQ ID NO: 6827 - DNA, 25 bp, Homo sapien
aagagtccatcgaatgctaagcagg

SEQ ID NO: 6828 - DNA, 25 bp, Homo sapien
aagagtccatctaatgctaagcagg

SEQ ID NO: 6829 - DNA, 25 bp, Homo sapien
aagagtccgagtctatagtctcata

SEQ ID NO: 6830 - DNA, 25 bp, Homo sapien
aagagtccgagtgtatagtctcata

SEQ ID NO: 6831 - DNA, 25 bp, Homo sapien
aagagtcgacatgtctattcaacat

SEQ ID NO: 6832 - DNA, 25 bp, Homo sapien
aagagtcgatatgtctattcaacat

SEQ ID NO: 6833 - DNA, 25 bp, Homo sapien
aagagtctcacactttctttcaggg

SEQ ID NO: 6834 - DNA, 25 bp, Homo sapien
aagagtctcacattttctttcaggg

SEQ ID NO: 6835 - DNA, 25 bp, Homo sapien
aagagtgaactagaaataaaccaaa

SEQ ID NO: 6836 - DNA, 25 bp, Homo sapien
aagagtgaagaagaagagaagatgc

SEQ ID NO: 6837 - DNA, 25 bp, Homo sapien
aagagtgaagaagaggagaagatgc

SEQ ID NO: 6838 - DNA, 25 bp, Homo sapien
aagagtgaattagaaataaaccaaa

SEQ ID NO: 6839 - DNA, 25 bp, Homo sapien
aagagtgaattattacaggaaaaaa

SEQ ID NO: 6840 - DNA, 25 bp, Homo sapien
aagagtgaattattacgggaaaaaa

SEQ ID NO: 6841 - DNA, 25 bp, Homo sapien
aagagtgggaagccttgattatagg

SEQ ID NO: 6842 - DNA, 25 bp, Homo sapien
aagagtgggaaggcttgattatagg

SEQ ID NO: 6843 - DNA, 25 bp, Homo sapien
aagagtgtcattgcaacagtaaatt

SEQ ID NO: 6844 - DNA, 25 bp, Homo sapien
aagagtgtcattgcaatagtaaatt

SEQ ID NO: 6845 - DNA, 25 bp, Homo sapien
aagagtgttccttctcaaatcatct

SEQ ID NO: 6846 - DNA, 25 bp, Homo sapien
aagagtgttctcaacatatttaaaa

SEQ ID NO: 6847 - DNA, 25 bp, Homo sapien
aagagtgttctctacatatttaaaa

SEQ ID NO: 6848 - DNA, 25 bp, Homo sapien
aagagtgtttcttctcaaatcatct

SEQ ID NO: 6849 - DNA, 25 bp, Homo sapien
aagagttaagtgtctctgacccagg

SEQ ID NO: 6850 - DNA, 25 bp, Homo sapien
aagagttaataaattgcattccctt

SEQ ID NO: 6851 - DNA, 25 bp, Homo sapien
aagagttaatacattgcattccctt

SEQ ID NO: 6852 - DNA, 25 bp, Homo sapien
aagagttatgtgtctctgacccagg

SEQ ID NO: 6853 - DNA, 25 bp, Homo sapien
aagagttcacaggtaaatgaaagga

SEQ ID NO: 6854 - DNA, 25 bp, Homo sapien
aagagttcacaggtgaatgaaagga

SEQ ID NO: 6855 - DNA, 25 bp, Homo sapien
aagagttcagaatatgctccttatc

SEQ ID NO: 6856 - DNA, 25 bp, Homo sapien
aagagttcagaatatgttccttatc

SEQ ID NO: 6857 - DNA, 25 bp, Homo sapien
aagagttcattgtaagtaaattttt

SEQ ID NO: 6858 - DNA, 25 bp, Homo sapien
aagagttcattgtaggtaaattttt

SEQ ID NO: 6859 - DNA, 25 bp, Homo sapien
aagagttgactcatcattggaggac

SEQ ID NO: 6860 - DNA, 25 bp, Homo sapien
aagagttgagtcatcattggaggac

SEQ ID NO: 6861 - DNA, 25 bp, Homo sapien
aagagttgtacggcttggattgtag

SEQ ID NO: 6862 - DNA, 25 bp, Homo sapien
aagagttgtgcggcttggattgtag

SEQ ID NO: 6863 - DNA, 25 bp, Homo sapien
aagataaaagtcgggtcgaaaaaga

SEQ ID NO: 6864 - DNA, 25 bp, Homo sapien
aagataaaagttgggtcgaaaaaga

SEQ ID NO: 6865 - DNA, 25 bp, Homo sapien
aagataaaatagcacaaaacgctga

SEQ ID NO: 6866 - DNA, 25 bp, Homo sapien
aagataaaatagcagaaaacgctga

SEQ ID NO: 6867 - DNA, 25 bp, Homo sapien
aagataaacagctgaagaatctggg

SEQ ID NO: 6868 - DNA, 25 bp, Homo sapien
aagataaacagttgaagaatctggg

SEQ ID NO: 6869 - DNA, 25 bp, Homo sapien
aagataaagccaagacaatattagg

SEQ ID NO: 6870 - DNA, 25 bp, Homo sapien
aagataaagccaaggcaatattagg

SEQ ID NO: 6871 - DNA, 25 bp, Homo sapien
aagataaccgctatgacacactgac

SEQ ID NO: 6872 - DNA, 25 bp, Homo sapien
aagataactagcagtgttcctggaa

SEQ ID NO: 6873 - DNA, 25 bp, Homo sapien
aagataactgctatgacacactgac

SEQ ID NO: 6874 - DNA, 25 bp, Homo sapien
aagataactggcagtgttcctggaa

SEQ ID NO: 6875 - DNA, 25 bp, Homo sapien
aagataagacagtcaaattgggagc

SEQ ID NO: 6876 - DNA, 25 bp, Homo sapien
aagataagacagtcaagttgggagc

SEQ ID NO: 6877 - DNA, 25 bp, Homo sapien
aagataatgggtaaggatgagaaag

SEQ ID NO: 6878 - DNA, 25 bp, Homo sapien
aagataatgggtaaggctgagaaag

SEQ ID NO: 6879 - DNA, 25 bp, Homo sapien
aagataatgtgctaaaggcagatcc

SEQ ID NO: 6880 - DNA, 25 bp, Homo sapien
aagataatgtggtaaaggcagatcc

SEQ ID NO: 6881 - DNA, 25 bp, Homo sapien
aagatacatttgaattttataccac

SEQ ID NO: 6882 - DNA, 25 bp, Homo sapien
aagatacatttggattttataccac

SEQ ID NO: 6883 - DNA, 25 bp, Homo sapien
aagataccaagataatttgcaagct

SEQ ID NO: 6884 - DNA, 25 bp, Homo sapien
aagataccaagatattttgcaagct

SEQ ID NO: 6885 - DNA, 25 bp, Homo sapien
aagataccacgctgcaaagtctctt

SEQ ID NO: 6886 - DNA, 25 bp, Homo sapien
aagataccatgctgcaaagtctctt

SEQ ID NO: 6887 - DNA, 25 bp, Homo sapien
aagatacccactgaaatttgagacc

SEQ ID NO: 6888 - DNA, 25 bp, Homo sapien
aagatacccactggaatttgagacc

SEQ ID NO: 6889 - DNA, 25 bp, Homo sapien
aagatactctcaccataggtaactt

SEQ ID NO: 6890 - DNA, 25 bp, Homo sapien
aagatactctcactataggtaactt

SEQ ID NO: 6891 - DNA, 25 bp, Homo sapien
aagatacttcattcgaccattttaa

SEQ ID NO: 6892 - DNA, 25 bp, Homo sapien
aagatacttcatttgaccattttaa

SEQ ID NO: 6893 - DNA, 25 bp, Homo sapien
aagatagagcagagcgcaaggaatg

SEQ ID NO: 6894 - DNA, 25 bp, Homo sapien
aagatagagcagagtgcaaggaatg

SEQ ID NO: 6895 - DNA, 25 bp, Homo sapien
aagatagcctacaggacccaaaagg

SEQ ID NO: 6896 - DNA, 25 bp, Homo sapien
aagatagcctacgggacccaaaagg

SEQ ID NO: 6897 - DNA, 25 bp, Homo sapien
aagatagctctacttgaccttcatc

SEQ ID NO: 6898 - DNA, 25 bp, Homo sapien
aagatagctctgcttgaccttcatc

SEQ ID NO: 6899 - DNA, 25 bp, Homo sapien
aagatagctggcaggctaaaattgc

SEQ ID NO: 6900 - DNA, 25 bp, Homo sapien
aagatagctggcatgctaaaattgc

SEQ ID NO: 6901 - DNA, 25 bp, Homo sapien
aagatagggttgtagtccaattatg

SEQ ID NO: 6902 - DNA, 25 bp, Homo sapien
aagatagggttgttgtccaattatg

SEQ ID NO: 6903 - DNA, 25 bp, Homo sapien
aagatagtaacttggtcagctagat

SEQ ID NO: 6904 - DNA, 25 bp, Homo sapien
aagatagtgaagcagaatggtaaac

SEQ ID NO: 6905 - DNA, 25 bp, Homo sapien
aagatagtgaagcagagtggtaaac

SEQ ID NO: 6906 - DNA, 25 bp, Homo sapien
aagatagttacttggtcagctagat

SEQ ID NO: 6907 - DNA, 25 bp, Homo sapien
aagatatacaacagaatgcattgat

SEQ ID NO: 6908 - DNA, 25 bp, Homo sapien
aagatatagaacagaatgcattgat

SEQ ID NO: 6909 - DNA, 25 bp, Homo sapien
aagatatagactggctaaatggatt

SEQ ID NO: 6910 - DNA, 25 bp, Homo sapien
aagatatagactggctgaatggatt

SEQ ID NO: 6911 - DNA, 25 bp, Homo sapien
aagatatcacacgatcaagtgctgt

SEQ ID NO: 6912 - DNA, 25 bp, Homo sapien
aagatatcacatgatcaagtgctgt

SEQ ID NO: 6913 - DNA, 25 bp, Homo sapien
aagatatgactcgtaactttccaat

SEQ ID NO: 6914 - DNA, 25 bp, Homo sapien
aagatatgacttgtaactttccaat

SEQ ID NO: 6915 - DNA, 25 bp, Homo sapien
aagatattaggctgccatatgatcc

SEQ ID NO: 6916 - DNA, 25 bp, Homo sapien
aagatattaggcttccatatgatcc

SEQ ID NO: 6917 - DNA, 25 bp, Homo sapien
aagatattcaaagagccacgaagag

SEQ ID NO: 6918 - DNA, 25 bp, Homo sapien
aagatattcaaagagctacgaagag

SEQ ID NO: 6919 - DNA, 25 bp, Homo sapien
aagatattctgtgacagtagcccaa

SEQ ID NO: 6920 - DNA, 25 bp, Homo sapien
aagatattctgtgatagtagcccaa

SEQ ID NO: 6921 - DNA, 25 bp, Homo sapien
aagatattgggtgcttattccctgg

SEQ ID NO: 6922 - DNA, 25 bp, Homo sapien
aagatattgggtgtttattccctgg

SEQ ID NO: 6923 - DNA, 25 bp, Homo sapien
aagatcaatgaagaaagtttccaag

SEQ ID NO: 6924 - DNA, 25 bp, Homo sapien
aagatcaatgaaggaagtttccaag

SEQ ID NO: 6925 - DNA, 25 bp, Homo sapien
aagatcactgaagatttgagaaaca

SEQ ID NO: 6926 - DNA, 25 bp, Homo sapien
aagatcactgaaggtttgagaaaca

SEQ ID NO: 6927 - DNA, 25 bp, Homo sapien
aagatcagtaacgtaggataaacct

SEQ ID NO: 6928 - DNA, 25 bp, Homo sapien
aagatcagtaatgtaggataaacct

SEQ ID NO: 6929 - DNA, 25 bp, Homo sapien
aagatccacggccgctttagtgaaa

SEQ ID NO: 6930 - DNA, 25 bp, Homo sapien
aagatccatggccgctttagtgaaa

SEQ ID NO: 6931 - DNA, 25 bp, Homo sapien
aagatcctcagggactatacaaaag

SEQ ID NO: 6932 - DNA, 25 bp, Homo sapien
aagatcctcagggtctatacaaaag

SEQ ID NO: 6933 - DNA, 25 bp, Homo sapien
aagatcgctaaatgtcttagattgt

SEQ ID NO: 6934 - DNA, 25 bp, Homo sapien
aagatcgcttaatgtcttagattgt

SEQ ID NO: 6935 - DNA, 25 bp, Homo sapien
aagatctatcaagcaaaactgaaca

SEQ ID NO: 6936 - DNA, 25 bp, Homo sapien
aagatctatcatgcaaaactgaaca

SEQ ID NO: 6937 - DNA, 25 bp, Homo sapien
aagatctctagcaatctttccctct

SEQ ID NO: 6938 - DNA, 25 bp, Homo sapien
aagatctctagcagtctttccctct

SEQ ID NO: 6939 - DNA, 25 bp, Homo sapien
aagatctctttatgctctcacatgc

SEQ ID NO: 6940 - DNA, 25 bp, Homo sapien
aagatctctttatgctgtcacatgc

SEQ ID NO: 6941 - DNA, 25 bp, Homo sapien
aagatctgaatttgagctctagttg

SEQ ID NO: 6942 - DNA, 25 bp, Homo sapien
aagatctgaatttgcgctctagttg

SEQ ID NO: 6943 - DNA, 25 bp, Homo sapien
aagatctgatgaaacccagcgtgtt

SEQ ID NO: 6944 - DNA, 25 bp, Homo sapien
aagatctgatgaagcccagcgtgtt

SEQ ID NO: 6945 - DNA, 25 bp, Homo sapien
aagatctgtgaccaaaccaggccat

SEQ ID NO: 6946 - DNA, 25 bp, Homo sapien
aagatctgtgactaaaccaggccat

SEQ ID NO: 6947 - DNA, 25 bp, Homo sapien
aagatcttttacttgtggttaggct

SEQ ID NO: 6948 - DNA, 25 bp, Homo sapien
aagatcttttatttgtggttaggct

SEQ ID NO: 6949 - DNA, 25 bp, Homo sapien
aagatgaaacttccaccctacagat

SEQ ID NO: 6950 - DNA, 25 bp, Homo sapien
aagatgaaactttcaccctacagat

SEQ ID NO: 6951 - DNA, 25 bp, Homo sapien
aagatgaaatccataaaggtcagag

SEQ ID NO: 6952 - DNA, 25 bp, Homo sapien
aagatgaaatccatgaaggtcagag

SEQ ID NO: 6953 - DNA, 25 bp, Homo sapien
aagatgaagattcaggcattacctg

SEQ ID NO: 6954 - DNA, 25 bp, Homo sapien
aagatgaaggttcaggcattacctg

SEQ ID NO: 6955 - DNA, 25 bp, Homo sapien
aagatgaatatatacaaatctatga

SEQ ID NO: 6956 - DNA, 25 bp, Homo sapien
aagatgaatgtatacaaatctatga

SEQ ID NO: 6957 - DNA, 25 bp, Homo sapien
aagatgacaataagtaacaatgaat

SEQ ID NO: 6958 - DNA, 25 bp, Homo sapien
aagatgacagtaagtaacaatgaat

SEQ ID NO: 6959 - DNA, 25 bp, Homo sapien
aagatgactgaatcatagggtagtt

SEQ ID NO: 6960 - DNA, 25 bp, Homo sapien
aagatgactgaatcatggggtagtt

SEQ ID NO: 6961 - DNA, 25 bp, Homo sapien
aagatgagagctacaggcatccttt

SEQ ID NO: 6962 - DNA, 25 bp, Homo sapien
aagatgagagctagaggcatccttt

SEQ ID NO: 6963 - DNA, 25 bp, Homo sapien
aagatgagccaggtttctttctgtc

SEQ ID NO: 6964 - DNA, 25 bp, Homo sapien
aagatgaggatacaaagcagagcat

SEQ ID NO: 6965 - DNA, 25 bp, Homo sapien
aagatgaggatacgaagcagagcat

SEQ ID NO: 6966 - DNA, 25 bp, Homo sapien
aagatgaggcaggtttctttctgtc

SEQ ID NO: 6967 - DNA, 25 bp, Homo sapien
aagatgagtaaaacaaactgtagct

SEQ ID NO: 6968 - DNA, 25 bp, Homo sapien
aagatgagtaaatcaaactgtagct

SEQ ID NO: 6969 - DNA, 25 bp, Homo sapien
aagatgagtagttcagcttgtgaca

SEQ ID NO: 6970 - DNA, 25 bp, Homo sapien
aagatgagtagttcagtttgtgaca

SEQ ID NO: 6971 - DNA, 25 bp, Homo sapien
aagatgagtcactctgaccattgaa

SEQ ID NO: 6972 - DNA, 25 bp, Homo sapien
aagatgagtcactgtgaccattgaa

SEQ ID NO: 6973 - DNA, 25 bp, Homo sapien
aagatgatagttaagatttgatgta

SEQ ID NO: 6974 - DNA, 25 bp, Homo sapien
aagatgatatttaagatttgatgta

SEQ ID NO: 6975 - DNA, 25 bp, Homo sapien
aagatgatgtttatatttccatgta

SEQ ID NO: 6976 - DNA, 25 bp, Homo sapien
aagatgatgtttgtatttccatgta

SEQ ID NO: 6977 - DNA, 25 bp, Homo sapien
aagatgattttcatggctttttatc

SEQ ID NO: 6978 - DNA, 25 bp, Homo sapien
aagatgattttcatggttttttatc

SEQ ID NO: 6979 - DNA, 25 bp, Homo sapien
aagatgcagatgccgttaaaactaa

SEQ ID NO: 6980 - DNA, 25 bp, Homo sapien
aagatgcagatgctgttaaaactaa

SEQ ID NO: 6981 - DNA, 25 bp, Homo sapien
aagatgcctatgtacgtggtatagc

SEQ ID NO: 6982 - DNA, 25 bp, Homo sapien
aagatgcctatgtgcgtggtatagc

SEQ ID NO: 6983 - DNA, 25 bp, Homo sapien
aagatgctgccctctttcttatcac

SEQ ID NO: 6984 - DNA, 25 bp, Homo sapien
aagatgctgccttctttcttatcac

SEQ ID NO: 6985 - DNA, 25 bp, Homo sapien
aagatggaatgaatatggtttctgc

SEQ ID NO: 6986 - DNA, 25 bp, Homo sapien
aagatggaatggatatggtttctgc

SEQ ID NO: 6987 - DNA, 25 bp, Homo sapien
aagatggcatagctgatagatggta

SEQ ID NO: 6988 - DNA, 25 bp, Homo sapien
aagatggcgtagctgatagatggta

SEQ ID NO: 6989 - DNA, 25 bp, Homo sapien
aagatgggctgctcgaaccttgtat

SEQ ID NO: 6990 - DNA, 25 bp, Homo sapien
aagatgggctgcttgaaccttgtat

SEQ ID NO: 6991 - DNA, 25 bp, Homo sapien
aagatggttaatgcaacacagactg

SEQ ID NO: 6992 - DNA, 25 bp, Homo sapien
aagatggttaatgcaatacagactg

SEQ ID NO: 6993 - DNA, 25 bp, Homo sapien
aagatgtactttaaaccactgaaat

SEQ ID NO: 6994 - DNA, 25 bp, Homo sapien
aagatgtactttaaactactgaaat

SEQ ID NO: 6995 - DNA, 25 bp, Homo sapien
aagatgtgcttcgttattaatttca

SEQ ID NO: 6996 - DNA, 25 bp, Homo sapien
aagatgtgcttctttattaatttca

SEQ ID NO: 6997 - DNA, 25 bp, Homo sapien
aagatgtttcctgttgatagtactt

SEQ ID NO: 6998 - DNA, 25 bp, Homo sapien
aagatgttttctgttgatagtactt

SEQ ID NO: 6999 - DNA, 25 bp, Homo sapien
aagattaaactgatcggccaataaa

SEQ ID NO: 7000 - DNA, 25 bp, Homo sapien
aagattaaagactaggagtggccat

SEQ ID NO: 7001 - DNA, 25 bp, Homo sapien
aagattaaagaggtgaggatggctg

SEQ ID NO: 7002 - DNA, 25 bp, Homo sapien
aagattaaagagttgaggatggctg

SEQ ID NO: 7003 - DNA, 25 bp, Homo sapien
aagattaaagattaggagtggccat

SEQ ID NO: 7004 - DNA, 25 bp, Homo sapien
aagattaagctgatcggccaataaa

SEQ ID NO: 7005 - DNA, 25 bp, Homo sapien
aagattaattacaactcctggccca

SEQ ID NO: 7006 - DNA, 25 bp, Homo sapien
aagattaattacgactcctggccca

SEQ ID NO: 7007 - DNA, 25 bp, Homo sapien
aagattacatttccatacaagaagt

SEQ ID NO: 7008 - DNA, 25 bp, Homo sapien
aagattacatttccgtacaagaagt

SEQ ID NO: 7009 - DNA, 25 bp, Homo sapien
aagattacgacacaacaacttgaga

SEQ ID NO: 7010 - DNA, 25 bp, Homo sapien
aagattacgacacagcaacttgaga

SEQ ID NO: 7011 - DNA, 25 bp, Homo sapien
aagattagctgtagccacacattcc

SEQ ID NO: 7012 - DNA, 25 bp, Homo sapien
aagattagctgtagccgcacattcc

SEQ ID NO: 7013 - DNA, 25 bp, Homo sapien
aagattcaacttcctctgtttaaat

SEQ ID NO: 7014 - DNA, 25 bp, Homo sapien
aagattcagcagccctggaaagtta

SEQ ID NO: 7015 - DNA, 25 bp, Homo sapien
aagattcagcagtcctggaaagtta

SEQ ID NO: 7016 - DNA, 25 bp, Homo sapien
aagattcataaaaaaaaaaaaggaa

SEQ ID NO: 7017 - DNA, 25 bp, Homo sapien
aagattcataaaagaaaaaaaggaa

SEQ ID NO: 7018 - DNA, 25 bp, Homo sapien
aagattcatcttcctctgtttaaat

SEQ ID NO: 7019 - DNA, 25 bp, Homo sapien
aagattccacttacattttatatct

SEQ ID NO: 7020 - DNA, 25 bp, Homo sapien
aagattccacttgcattttatatct

SEQ ID NO: 7021 - DNA, 25 bp, Homo sapien
aagattccatggtcttggttcattt

SEQ ID NO: 7022 - DNA, 25 bp, Homo sapien
aagattccatggtctttgttcattt

SEQ ID NO: 7023 - DNA, 25 bp, Homo sapien
aagattctcaaaaatgaagtttcct

SEQ ID NO: 7024 - DNA, 25 bp, Homo sapien
aagattctcgaaaatgaagtttcct

SEQ ID NO: 7025 - DNA, 25 bp, Homo sapien
aagattctcgatgggacatatgaag

SEQ ID NO: 7026 - DNA, 25 bp, Homo sapien
aagattctcgatgggatatatgaag

SEQ ID NO: 7027 - DNA, 25 bp, Homo sapien
aagattgaaatacgaagacatggaa

SEQ ID NO: 7028 - DNA, 25 bp, Homo sapien
aagattgaaatatgaagacatggaa

SEQ ID NO: 7029 - DNA, 25 bp, Homo sapien
aagattgagaaaggagatggatgtg

SEQ ID NO: 7030 - DNA, 25 bp, Homo sapien
aagattgaggaaggagatggatgtg

SEQ ID NO: 7031 - DNA, 25 bp, Homo sapien
aagattgatgcattttgtgtatgat

SEQ ID NO: 7032 - DNA, 25 bp, Homo sapien
aagattgatgcattttttgtatgat

SEQ ID NO: 7033 - DNA, 25 bp, Homo sapien
aagattgcacctctacactatagcc

SEQ ID NO: 7034 - DNA, 25 bp, Homo sapien
aagattgcacctctgcactatagcc

SEQ ID NO: 7035 - DNA, 25 bp, Homo sapien
aagattgcatttgaacgatatactt

SEQ ID NO: 7036 - DNA, 25 bp, Homo sapien
aagattgcatttgaactatatactt

SEQ ID NO: 7037 - DNA, 25 bp, Homo sapien
aagattgtatctaaacttcaaagta

SEQ ID NO: 7038 - DNA, 25 bp, Homo sapien
aagattgtatctaaccttcaaagta

SEQ ID NO: 7039 - DNA, 25 bp, Homo sapien
aagatttaaactacaccatgatgct

SEQ ID NO: 7040 - DNA, 25 bp, Homo sapien
aagatttaaactataccatgatgct

SEQ ID NO: 7041 - DNA, 25 bp, Homo sapien
aagatttaatatgctgttactgtaa

SEQ ID NO: 7042 - DNA, 25 bp, Homo sapien
aagatttaatatgttgttactgtaa

SEQ ID NO: 7043 - DNA, 25 bp, Homo sapien
aagatttagttataatgaaaggaag

SEQ ID NO: 7044 - DNA, 25 bp, Homo sapien
aagatttagttctaatgaaaggaag

SEQ ID NO: 7045 - DNA, 25 bp, Homo sapien
aagatttcagaatgggccaagctta

SEQ ID NO: 7046 - DNA, 25 bp, Homo sapien
aagatttcagaatgggtcaagctta

SEQ ID NO: 7047 - DNA, 25 bp, Homo sapien
aagatttcccaattttactggactt

SEQ ID NO: 7048 - DNA, 25 bp, Homo sapien
aagatttctcaattttactggactt

SEQ ID NO: 7049 - DNA, 25 bp, Homo sapien
aagatttgaaagcttagaccttatg

SEQ ID NO: 7050 - DNA, 25 bp, Homo sapien
aagatttgaaagcttataccttatg

SEQ ID NO: 7051 - DNA, 25 bp, Homo sapien
aagatttgaaagtccagattactct

SEQ ID NO: 7052 - DNA, 25 bp, Homo sapien
aagatttgaagtagatgagcaaggt

SEQ ID NO: 7053 - DNA, 25 bp, Homo sapien
aagatttgaagtaggtgagcaaggt

SEQ ID NO: 7054 - DNA, 25 bp, Homo sapien
aagatttggaagtccagattactct

SEQ ID NO: 7055 - DNA, 25 bp, Homo sapien
aagattttcagccttctggaagtat

SEQ ID NO: 7056 - DNA, 25 bp, Homo sapien
aagattttccgacatgataattagc

SEQ ID NO: 7057 - DNA, 25 bp, Homo sapien
aagattttcggacatgataattagc

SEQ ID NO: 7058 - DNA, 25 bp, Homo sapien
aagattttgagccttctggaagtat

SEQ ID NO: 7059 - DNA, 25 bp, Homo sapien
aagattttgatgaccaggtagtata

SEQ ID NO: 7060 - DNA, 25 bp, Homo sapien
aagattttgcttctcatctcaaacc

SEQ ID NO: 7061 - DNA, 25 bp, Homo sapien
aagattttggtgaccaggtagtata

SEQ ID NO: 7062 - DNA, 25 bp, Homo sapien
aagatttttagacgataaagtgcta

SEQ ID NO: 7063 - DNA, 25 bp, Homo sapien
aagatttttagacggtaaagtgcta

SEQ ID NO: 7064 - DNA, 25 bp, Homo sapien
aagatttttcttctcatctcaaacc

SEQ ID NO: 7065 - DNA, 25 bp, Homo sapien
aagcaaaaacaactgtccctaagtg

SEQ ID NO: 7066 - DNA, 25 bp, Homo sapien
aagcaaaaagagtactgttatcacc

SEQ ID NO: 7067 - DNA, 25 bp, Homo sapien
aagcaaaaagagtgctgttatcacc

SEQ ID NO: 7068 - DNA, 25 bp, Homo sapien
aagcaaaacaaaataaaacctccaa

SEQ ID NO: 7069 - DNA, 25 bp, Homo sapien
aagcaaaacaaaataatacctccaa

SEQ ID NO: 7070 - DNA, 25 bp, Homo sapien
aagcaaaagcaactgtccctaagtg

SEQ ID NO: 7071 - DNA, 25 bp, Homo sapien
aagcaaaatgatctttatgtgactc

SEQ ID NO: 7072 - DNA, 25 bp, Homo sapien
aagcaaaatgatctttgtgtgactc

SEQ ID NO: 7073 - DNA, 25 bp, Homo sapien
aagcaaacttgttcatcgcctatca

SEQ ID NO: 7074 - DNA, 25 bp, Homo sapien
aagcaaacttgttcattgcctatca

SEQ ID NO: 7075 - DNA, 25 bp, Homo sapien
aagcaaagaaaatactcagttaatt

SEQ ID NO: 7076 - DNA, 25 bp, Homo sapien
aagcaaagaaaatattcagttaatt

SEQ ID NO: 7077 - DNA, 25 bp, Homo sapien
aagcaaagaacaacgaagtagttga

SEQ ID NO: 7078 - DNA, 25 bp, Homo sapien
aagcaaagaacaatgaagtagttga

SEQ ID NO: 7079 - DNA, 25 bp, Homo sapien
aagcaaaggctagaataaaaacctc

SEQ ID NO: 7080 - DNA, 25 bp, Homo sapien
aagcaaaggctagaatgaaaacctc

SEQ ID NO: 7081 - DNA, 25 bp, Homo sapien
aagcaaataactacaatacacggac

SEQ ID NO: 7082 - DNA, 25 bp, Homo sapien
aagcaaataactaccatacacggac

SEQ ID NO: 7083 - DNA, 25 bp, Homo sapien
aagcaaataccttcaaggttgagtc

SEQ ID NO: 7084 - DNA, 25 bp, Homo sapien
aagcaaatcccttcaaggttgagtc

SEQ ID NO: 7085 - DNA, 25 bp, Homo sapien
aagcaaatcgtggtcctggaacttg

SEQ ID NO: 7086 - DNA, 25 bp, Homo sapien
aagcaaatgaacatctttaccttta

SEQ ID NO: 7087 - DNA, 25 bp, Homo sapien
aagcaaatgaatatctttaccttta

SEQ ID NO: 7088 - DNA, 25 bp, Homo sapien
aagcaaatggccatctggaccagac

SEQ ID NO: 7089 - DNA, 25 bp, Homo sapien
aagcaaatggccgtctggaccagac

SEQ ID NO: 7090 - DNA, 25 bp, Homo sapien
aagcaaattgtggtcctggaacttg

SEQ ID NO: 7091 - DNA, 25 bp, Homo sapien
aagcaaatttgaagagctaggcaaa

SEQ ID NO: 7092 - DNA, 25 bp, Homo sapien
aagcaaatttgaagagttaggcaaa

SEQ ID NO: 7093 - DNA, 25 bp, Homo sapien
aagcaacaacctgcctggtttgctt

SEQ ID NO: 7094 - DNA, 25 bp, Homo sapien
aagcaacaatatcaaagaatgcttt

SEQ ID NO: 7095 - DNA, 25 bp, Homo sapien
aagcaacagcctgcctggtttgctt

SEQ ID NO: 7096 - DNA, 25 bp, Homo sapien
aagcaacagtatcaaagaatgcttt

SEQ ID NO: 7097 - DNA, 25 bp, Homo sapien
aagcaaccaaaaaagcttctcaaat

SEQ ID NO: 7098 - DNA, 25 bp, Homo sapien
aagcaaccacaaaagcttctcaaat

SEQ ID NO: 7099 - DNA, 25 bp, Homo sapien
aagcaaccctcaacggacggctgca

SEQ ID NO: 7100 - DNA, 25 bp, Homo sapien
aagcaaccctcaatggacggctgca

SEQ ID NO: 7101 - DNA, 25 bp, Homo sapien
aagcaacgtatcaaaagctatggga

SEQ ID NO: 7102 - DNA, 25 bp, Homo sapien
aagcaacgtatcgaaagctatggga

SEQ ID NO: 7103 - DNA, 25 bp, Homo sapien
aagcaactgttttcaacgaggtttg

SEQ ID NO: 7104 - DNA, 25 bp, Homo sapien
aagcaactgttttcaatgaggtttg

SEQ ID NO: 7105 - DNA, 25 bp, Homo sapien
aagcaagacaggaaaatacagtttg

SEQ ID NO: 7106 - DNA, 25 bp, Homo sapien
aagcaagacagggaaatacagtttg

SEQ ID NO: 7107 - DNA, 25 bp, Homo sapien
aagcaagatgatttcgggaatgatt

SEQ ID NO: 7108 - DNA, 25 bp, Homo sapien
aagcaagatgattttgggaatgatt

SEQ ID NO: 7109 - DNA, 25 bp, Homo sapien
aagcaagcacattatatccagagat

SEQ ID NO: 7110 - DNA, 25 bp, Homo sapien
aagcaagcacattgtatccagagat

SEQ ID NO: 7111 - DNA, 25 bp, Homo sapien
aagcaagcacccgttttcacttctt

SEQ ID NO: 7112 - DNA, 25 bp, Homo sapien
aagcaagccaagacagttatctaag

SEQ ID NO: 7113 - DNA, 25 bp, Homo sapien
aagcaagccaagagagttatctaag

SEQ ID NO: 7114 - DNA, 25 bp, Homo sapien
aagcaagcccatctctaagtagaaa

SEQ ID NO: 7115 - DNA, 25 bp, Homo sapien
aagcaagcccatctctgagtagaaa

SEQ ID NO: 7116 - DNA, 25 bp, Homo sapien
aagcaagcgcccgttttcacttctt

SEQ ID NO: 7117 - DNA, 25 bp, Homo sapien
aagcaagctctcgtattccaggcat

SEQ ID NO: 7118 - DNA, 25 bp, Homo sapien
aagcaagctcttgtattccaggcat

SEQ ID NO: 7119 - DNA, 25 bp, Homo sapien
aagcaagctgtaaaccctctgagaa

SEQ ID NO: 7120 - DNA, 25 bp, Homo sapien
aagcaagctgtaagccctctgagaa

SEQ ID NO: 7121 - DNA, 25 bp, Homo sapien
aagcaagtggacggtctccaacttc

SEQ ID NO: 7122 - DNA, 25 bp, Homo sapien
aagcaagtggatggtctccaacttc

SEQ ID NO: 7123 - DNA, 25 bp, Homo sapien
aagcaataaaaacatacccctaaag

SEQ ID NO: 7124 - DNA, 25 bp, Homo sapien
aagcaatacaaaaaggatagttcat

SEQ ID NO: 7125 - DNA, 25 bp, Homo sapien
aagcaatacgaaaaggatagttcat

SEQ ID NO: 7126 - DNA, 25 bp, Homo sapien
aagcaatagaaacatacccctaaag

SEQ ID NO: 7127 - DNA, 25 bp, Homo sapien
aagcaatagctactgaggactgttt

SEQ ID NO: 7128 - DNA, 25 bp, Homo sapien
aagcaatagctactgatgactgttt

SEQ ID NO: 7129 - DNA, 25 bp, Homo sapien
aagcaatccattaaacttctcctgg

SEQ ID NO: 7130 - DNA, 25 bp, Homo sapien
aagcaatccattaatcttctcctgg

SEQ ID NO: 7131 - DNA, 25 bp, Homo sapien
aagcaatggcgtcagtcatttagta

SEQ ID NO: 7132 - DNA, 25 bp, Homo sapien
aagcaatggtgtcagtcatttagta

SEQ ID NO: 7133 - DNA, 25 bp, Homo sapien
aagcaattgattcgaaaacctgtgt

SEQ ID NO: 7134 - DNA, 25 bp, Homo sapien
aagcaattgatttgaaaacctgtgt

SEQ ID NO: 7135 - DNA, 25 bp, Homo sapien
aagcacaaaagacatggaaaaacga

SEQ ID NO: 7136 - DNA, 25 bp, Homo sapien
aagcacaaaagagatggaaaaacga

SEQ ID NO: 7137 - DNA, 25 bp, Homo sapien
aagcacaaagaaaactattcttggc

SEQ ID NO: 7138 - DNA, 25 bp, Homo sapien
aagcacaaagaaaagtattcttggc

SEQ ID NO: 7139 - DNA, 25 bp, Homo sapien
aagcacaacacaggattagcacata

SEQ ID NO: 7140 - DNA, 25 bp, Homo sapien
aagcacaacacagtattagcacata

SEQ ID NO: 7141 - DNA, 25 bp, Homo sapien
aagcacaacagatgagcagaaatta

SEQ ID NO: 7142 - DNA, 25 bp, Homo sapien
aagcacaagcacaagtcactgttgt

SEQ ID NO: 7143 - DNA, 25 bp, Homo sapien
aagcacaagcacaattcactgttgt

SEQ ID NO: 7144 - DNA, 25 bp, Homo sapien
aagcacaatagatgagcagaaatta

SEQ ID NO: 7145 - DNA, 25 bp, Homo sapien
aagcacacatagctgtttcactgct

SEQ ID NO: 7146 - DNA, 25 bp, Homo sapien
aagcacacatagttgtttcactgct

SEQ ID NO: 7147 - DNA, 25 bp, Homo sapien
aagcacagatagtcctctgaattgt

SEQ ID NO: 7148 - DNA, 25 bp, Homo sapien
aagcacagccagttgctctaaagtg

SEQ ID NO: 7149 - DNA, 25 bp, Homo sapien
aagcacagctagtcctctgaattgt

SEQ ID NO: 7150 - DNA, 25 bp, Homo sapien
aagcacagtcagttgctctaaagtg

SEQ ID NO: 7151 - DNA, 25 bp, Homo sapien
aagcacagtgcagaaatggttatat

SEQ ID NO: 7152 - DNA, 25 bp, Homo sapien
aagcacagtgcatttgagtaactga

SEQ ID NO: 7153 - DNA, 25 bp, Homo sapien
aagcacagtgccgaaatggttatat

SEQ ID NO: 7154 - DNA, 25 bp, Homo sapien
aagcacagtgcctttgagtaactga

SEQ ID NO: 7155 - DNA, 25 bp, Homo sapien
aagcacattatatccagagatgatt

SEQ ID NO: 7156 - DNA, 25 bp, Homo sapien
aagcacattcaaattaaagagaaaa

SEQ ID NO: 7157 - DNA, 25 bp, Homo sapien
aagcacattcaagttaaagagaaaa

SEQ ID NO: 7158 - DNA, 25 bp, Homo sapien
aagcacattgtatccagagatgatt

SEQ ID NO: 7159 - DNA, 25 bp, Homo sapien
aagcacatttcacggaccgtgcatc

SEQ ID NO: 7160 - DNA, 25 bp, Homo sapien
aagcacatttcatggaccgtgcatc

SEQ ID NO: 7161 - DNA, 25 bp, Homo sapien
aagcaccctataccaaagctctctc

SEQ ID NO: 7162 - DNA, 25 bp, Homo sapien
aagcaccctattccaaagctctctc

SEQ ID NO: 7163 - DNA, 25 bp, Homo sapien
aagcacctatttgaatcttttgcct

SEQ ID NO: 7164 - DNA, 25 bp, Homo sapien
aagcacctgtttgaatcttttgcct

SEQ ID NO: 7165 - DNA, 25 bp, Homo sapien
aagcacgtcgtaaccccgtctggac

SEQ ID NO: 7166 - DNA, 25 bp, Homo sapien
aagcacgtcgtaaccctgtctggac

SEQ ID NO: 7167 - DNA, 25 bp, Homo sapien
aagcactaacctttctgattccctt

SEQ ID NO: 7168 - DNA, 25 bp, Homo sapien
aagcactaacctttcttattccctt

SEQ ID NO: 7169 - DNA, 25 bp, Homo sapien
aagcactaatactgtaaaacttagg

SEQ ID NO: 7170 - DNA, 25 bp, Homo sapien
aagcactactactgtaaaacttagg

SEQ ID NO: 7171 - DNA, 25 bp, Homo sapien
aagcactgcaaatcgcatcagactg

SEQ ID NO: 7172 - DNA, 25 bp, Homo sapien
aagcactgcaaatggcatcagactg

SEQ ID NO: 7173 - DNA, 25 bp, Homo sapien
aagcacttagcatcacactctgcat

SEQ ID NO: 7174 - DNA, 25 bp, Homo sapien
aagcacttagcatcacgctctgcat

SEQ ID NO: 7175 - DNA, 25 bp, Homo sapien
aagcacttcaaacttcataaacttg

SEQ ID NO: 7176 - DNA, 25 bp, Homo sapien
aagcacttccccttggtgtcaaaca

SEQ ID NO: 7177 - DNA, 25 bp, Homo sapien
aagcacttgggaacagctgggccag

SEQ ID NO: 7178 - DNA, 25 bp, Homo sapien
aagcacttgtaaagaaacacaaggg

SEQ ID NO: 7179 - DNA, 25 bp, Homo sapien
aagcacttgtaaggaaacacaaggg

SEQ ID NO: 7180 - DNA, 25 bp, Homo sapien
aagcacttgtgaacagctgggccag

SEQ ID NO: 7181 - DNA, 25 bp, Homo sapien
aagcactttaaacttcataaacttg

SEQ ID NO: 7182 - DNA, 25 bp, Homo sapien
aagcactttcccttggtgtcaaaca

SEQ ID NO: 7183 - DNA, 25 bp, Homo sapien
aagcagaaaacagatatcagccttg

SEQ ID NO: 7184 - DNA, 25 bp, Homo sapien
aagcagaaaacaggtatcagccttg

SEQ ID NO: 7185 - DNA, 25 bp, Homo sapien
aagcagaaaactcaaaaacaaacaa

SEQ ID NO: 7186 - DNA, 25 bp, Homo sapien
aagcagaaaactcgaaaacaaacaa

SEQ ID NO: 7187 - DNA, 25 bp, Homo sapien
aagcagaaaagaggatctactggtg

SEQ ID NO: 7188 - DNA, 25 bp, Homo sapien
aagcagaaatcaattatgcctgtgt

SEQ ID NO: 7189 - DNA, 25 bp, Homo sapien
aagcagaaatcagttatgcctgtgt

SEQ ID NO: 7190 - DNA, 25 bp, Homo sapien
aagcagaaatgaggatctactggtg

SEQ ID NO: 7191 - DNA, 25 bp, Homo sapien
aagcagaccataatatgatacctat

SEQ ID NO: 7192 - DNA, 25 bp, Homo sapien
aagcagaccatgatatgatacctat

SEQ ID NO: 7193 - DNA, 25 bp, Homo sapien
aagcagagaatagaatagtggttat

SEQ ID NO: 7194 - DNA, 25 bp, Homo sapien
aagcagagaatagaatggtggttat

SEQ ID NO: 7195 - DNA, 25 bp, Homo sapien
aagcagagcatggtatccccagaga

SEQ ID NO: 7196 - DNA, 25 bp, Homo sapien
aagcagaggatggtatccccagaga

SEQ ID NO: 7197 - DNA, 25 bp, Homo sapien
aagcagagtatgcgataagagatag

SEQ ID NO: 7198 - DNA, 25 bp, Homo sapien
aagcagagtatgtgataagagatag

SEQ ID NO: 7199 - DNA, 25 bp, Homo sapien
aagcagataaagattgaatcacaac

SEQ ID NO: 7200 - DNA, 25 bp, Homo sapien
aagcagatacagattgaatcacaac

SEQ ID NO: 7201 - DNA, 25 bp, Homo sapien
aagcagattatcatcatcagaatga

SEQ ID NO: 7202 - DNA, 25 bp, Homo sapien
aagcagattgtcatcatcagaatga

SEQ ID NO: 7203 - DNA, 25 bp, Homo sapien
aagcagattttaaaatttatgtgga

SEQ ID NO: 7204 - DNA, 25 bp, Homo sapien
aagcagattttactcaggaactatt

SEQ ID NO: 7205 - DNA, 25 bp, Homo sapien
aagcagattttattcaggaactatt

SEQ ID NO: 7206 - DNA, 25 bp, Homo sapien
aagcagatttttaaatttatgtgga

SEQ ID NO: 7207 - DNA, 25 bp, Homo sapien
aagcagcagcactgcaaacatagta

SEQ ID NO: 7208 - DNA, 25 bp, Homo sapien
aagcagcagcattgcaaacatagta

SEQ ID NO: 7209 - DNA, 25 bp, Homo sapien
aagcagccactggacaggactaagc

SEQ ID NO: 7210 - DNA, 25 bp, Homo sapien
aagcagccactgggcaggactaagc

SEQ ID NO: 7211 - DNA, 25 bp, Homo sapien
aagcagctactatctggtttttgtc

SEQ ID NO: 7212 - DNA, 25 bp, Homo sapien
aagcagctactatctgttttttgtc

SEQ ID NO: 7213 - DNA, 25 bp, Homo sapien
aagcagctcaaggaacaagatcatg

SEQ ID NO: 7214 - DNA, 25 bp, Homo sapien
aagcagctcaaggaaccagatcatg

SEQ ID NO: 7215 - DNA, 25 bp, Homo sapien
aagcaggcaagaatatgtgggtggt

SEQ ID NO: 7216 - DNA, 25 bp, Homo sapien
aagcaggcgagaatatgtgggtggt

SEQ ID NO: 7217 - DNA, 25 bp, Homo sapien
aagcaggtaattctgaagcaagtaa

SEQ ID NO: 7218 - DNA, 25 bp, Homo sapien
aagcaggtaattttgaagcaagtaa

SEQ ID NO: 7219 - DNA, 25 bp, Homo sapien
aagcagtaaagatggaatcaggaac

SEQ ID NO: 7220 - DNA, 25 bp, Homo sapien
aagcagtacagatggaatcaggaac

SEQ ID NO: 7221 - DNA, 25 bp, Homo sapien
aagcagtcaaaagtccattgataat

SEQ ID NO: 7222 - DNA, 25 bp, Homo sapien
aagcagtcaaatgtccattgataat

SEQ ID NO: 7223 - DNA, 25 bp, Homo sapien
aagcagtccttcctttctgagaagt

SEQ ID NO: 7224 - DNA, 25 bp, Homo sapien
aagcagtctttcctttctgagaagt

SEQ ID NO: 7225 - DNA, 25 bp, Homo sapien
aagcagtgtttcataaacttatttg

SEQ ID NO: 7226 - DNA, 25 bp, Homo sapien
aagcagtgtttcatgaacttatttg

SEQ ID NO: 7227 - DNA, 25 bp, Homo sapien
aagcagttatgtttctcggaagcag

SEQ ID NO: 7228 - DNA, 25 bp, Homo sapien
aagcagttatgtttcttggaagcag

SEQ ID NO: 7229 - DNA, 25 bp, Homo sapien
aagcagttcaaataaaaagtgatgt

SEQ ID NO: 7230 - DNA, 25 bp, Homo sapien
aagcagttcaaatacaaagtgatgt

SEQ ID NO: 7231 - DNA, 25 bp, Homo sapien
aagcagttcaatcccaatagtttct

SEQ ID NO: 7232 - DNA, 25 bp, Homo sapien
aagcagttcaatcccagtagtttct

SEQ ID NO: 7233 - DNA, 25 bp, Homo sapien
aagcagtttgaccataatgtgccct

SEQ ID NO: 7234 - DNA, 25 bp, Homo sapien
aagcagtttgaccgtaatgtgccct

SEQ ID NO: 7235 - DNA, 25 bp, Homo sapien
aagcataaaatccaaatctcgagtt

SEQ ID NO: 7236 - DNA, 25 bp, Homo sapien
aagcataaaatccgaatctcgagtt

SEQ ID NO: 7237 - DNA, 25 bp, Homo sapien
aagcataaagaaaaagtagcacatt

SEQ ID NO: 7238 - DNA, 25 bp, Homo sapien
aagcataaagaacaagtagcacatt

SEQ ID NO: 7239 - DNA, 25 bp, Homo sapien
aagcataacaggtcggatgacatgg

SEQ ID NO: 7240 - DNA, 25 bp, Homo sapien
aagcataacaggttggatgacatgg

SEQ ID NO: 7241 - DNA, 25 bp, Homo sapien
aagcataacgataaatgaaggtaca

SEQ ID NO: 7242 - DNA, 25 bp, Homo sapien
aagcataacgcaaatcgatgcagac

SEQ ID NO: 7243 - DNA, 25 bp, Homo sapien
aagcataagaacaccaacctccaag

SEQ ID NO: 7244 - DNA, 25 bp, Homo sapien
aagcataagaacacgaacctccaag

SEQ ID NO: 7245 - DNA, 25 bp, Homo sapien
aagcataatagacggagtgtgtggt

SEQ ID NO: 7246 - DNA, 25 bp, Homo sapien
aagcataatagatggagtgtgtggt

SEQ ID NO: 7247 - DNA, 25 bp, Homo sapien
aagcataatgataaatgaaggtaca

SEQ ID NO: 7248 - DNA, 25 bp, Homo sapien
aagcataatgcaaatcgatgcagac

SEQ ID NO: 7249 - DNA, 25 bp, Homo sapien
aagcatacacgcccattggatttca

SEQ ID NO: 7250 - DNA, 25 bp, Homo sapien
aagcatacatgcccattggatttca

SEQ ID NO: 7251 - DNA, 25 bp, Homo sapien
aagcatagaatgagtgattaaaacc

SEQ ID NO: 7252 - DNA, 25 bp, Homo sapien
aagcatagaatgagtggttaaaacc

SEQ ID NO: 7253 - DNA, 25 bp, Homo sapien
aagcatagaccaaaaatgtggagaa

SEQ ID NO: 7254 - DNA, 25 bp, Homo sapien
aagcataggccaaaaatgtggagaa

SEQ ID NO: 7255 - DNA, 25 bp, Homo sapien
aagcatatggcatctcctcagcttg

SEQ ID NO: 7256 - DNA, 25 bp, Homo sapien
aagcatatggcatttcctcagcttg

SEQ ID NO: 7257 - DNA, 25 bp, Homo sapien
aagcatatttccgaagttttgccaa

SEQ ID NO: 7258 - DNA, 25 bp, Homo sapien
aagcatatttctgaagttttgccaa

SEQ ID NO: 7259 - DNA, 25 bp, Homo sapien
aagcatcaaagtattaataagaaca

SEQ ID NO: 7260 - DNA, 25 bp, Homo sapien
aagcatcaaagtgttaataagaaca

SEQ ID NO: 7261 - DNA, 25 bp, Homo sapien
aagcatcaacctttaggtactccat

SEQ ID NO: 7262 - DNA, 25 bp, Homo sapien
aagcatcagcctttaggtactccat

SEQ ID NO: 7263 - DNA, 25 bp, Homo sapien
aagcatcccttacgttcttttagca

SEQ ID NO: 7264 - DNA, 25 bp, Homo sapien
aagcatcccttatgttcttttagca

SEQ ID NO: 7265 - DNA, 25 bp, Homo sapien
aagcatccgacttcttaaaggtaga

SEQ ID NO: 7266 - DNA, 25 bp, Homo sapien
aagcatccggcttcttaaaggtaga

SEQ ID NO: 7267 - DNA, 25 bp, Homo sapien
aagcatcctgcaacgcacagtcccc

SEQ ID NO: 7268 - DNA, 25 bp, Homo sapien
aagcatcctgcaatgcacagtcccc

SEQ ID NO: 7269 - DNA, 25 bp, Homo sapien
aagcatctcaaataaaatatttcaa

SEQ ID NO: 7270 - DNA, 25 bp, Homo sapien
aagcatctcaaataaagtatttcaa

SEQ ID NO: 7271 - DNA, 25 bp, Homo sapien
aagcatctgacaattggcctaacag

SEQ ID NO: 7272 - DNA, 25 bp, Homo sapien
aagcatctgacagttggcctaacag

SEQ ID NO: 7273 - DNA, 25 bp, Homo sapien
aagcatgactgtgacacctggaaaa

SEQ ID NO: 7274 - DNA, 25 bp, Homo sapien
aagcatgattgtgacacctggaaaa

SEQ ID NO: 7275 - DNA, 25 bp, Homo sapien
aagcatgcctaggaacactagcacc

SEQ ID NO: 7276 - DNA, 25 bp, Homo sapien
aagcatgcctagggacactagcacc

SEQ ID NO: 7277 - DNA, 25 bp, Homo sapien
aagcatgctactactaatcaattag

SEQ ID NO: 7278 - DNA, 25 bp, Homo sapien
aagcatgctactgctaatcaattag

SEQ ID NO: 7279 - DNA, 25 bp, Homo sapien
aagcatgctgaacatggaaaccaca

SEQ ID NO: 7280 - DNA, 25 bp, Homo sapien
aagcatgctgaacttggaaaccaca

SEQ ID NO: 7281 - DNA, 25 bp, Homo sapien
aagcatggtctcactaagaaccagg

SEQ ID NO: 7282 - DNA, 25 bp, Homo sapien
aagcatggtctcattaagaaccagg

SEQ ID NO: 7283 - DNA, 25 bp, Homo sapien
aagcatgtggcctgtactttctaaa

SEQ ID NO: 7284 - DNA, 25 bp, Homo sapien
aagcatgtggcgtgtactttctaaa

SEQ ID NO: 7285 - DNA, 25 bp, Homo sapien
aagcatgttttgacctgattttctt

SEQ ID NO: 7286 - DNA, 25 bp, Homo sapien
aagcatgtttttacctgattttctt

SEQ ID NO: 7287 - DNA, 25 bp, Homo sapien
aagcattagaacacatctgatctga

SEQ ID NO: 7288 - DNA, 25 bp, Homo sapien
aagcattagaactcatctgatctga

SEQ ID NO: 7289 - DNA, 25 bp, Homo sapien
aagcattcaatatcattgttcatca

SEQ ID NO: 7290 - DNA, 25 bp, Homo sapien
aagcattcaatatcgttgttcatca

SEQ ID NO: 7291 - DNA, 25 bp, Homo sapien
aagcattgatttctcgcactgagtc

SEQ ID NO: 7292 - DNA, 25 bp, Homo sapien
aagcattgatttctggcactgagtc

SEQ ID NO: 7293 - DNA, 25 bp, Homo sapien
aagcattgccagtgctaagagtgaa

SEQ ID NO: 7294 - DNA, 25 bp, Homo sapien
aagcattgtcagtgctaagagtgaa

SEQ ID NO: 7295 - DNA, 25 bp, Homo sapien
aagcattgtgccgcaacagctgtta

SEQ ID NO: 7296 - DNA, 25 bp, Homo sapien
aagcattgtgctgcaacagctgtta

SEQ ID NO: 7297 - DNA, 25 bp, Homo sapien
aagcatttaaataaagtgcagatag

SEQ ID NO: 7298 - DNA, 25 bp, Homo sapien
aagcatttaaatgaagtgcagatag

SEQ ID NO: 7299 - DNA, 25 bp, Homo sapien
aagcatttgaatagaaggaatcaat

SEQ ID NO: 7300 - DNA, 25 bp, Homo sapien
aagcatttgaatagaatgaatcaat

SEQ ID NO: 7301 - DNA, 25 bp, Homo sapien
aagcatttgcccgtacagcattgtg

SEQ ID NO: 7302 - DNA, 25 bp, Homo sapien
aagcatttgcctgtacagcattgtg

SEQ ID NO: 7303 - DNA, 25 bp, Homo sapien
aagcatttggaaatgactggggaca

SEQ ID NO: 7304 - DNA, 25 bp, Homo sapien
aagcatttggaattgactggggaca

SEQ ID NO: 7305 - DNA, 25 bp, Homo sapien
aagcattttaatccctatcaagaga

SEQ ID NO: 7306 - DNA, 25 bp, Homo sapien
aagcattttaattcctatcaagaga

SEQ ID NO: 7307 - DNA, 25 bp, Homo sapien
aagcattttgacagagctaatcaca

SEQ ID NO: 7308 - DNA, 25 bp, Homo sapien
aagcattttgacagagttaatcaca

SEQ ID NO: 7309 - DNA, 25 bp, Homo sapien
aagcattttgcaatcatctggaata

SEQ ID NO: 7310 - DNA, 25 bp, Homo sapien
aagcattttgcaattatctggaata

SEQ ID NO: 7311 - DNA, 25 bp, Homo sapien
aagcatttttgcagtttatcaatcg

SEQ ID NO: 7312 - DNA, 25 bp, Homo sapien
aagcatttttgccgtttatcaatcg

SEQ ID NO: 7313 - DNA, 25 bp, Homo sapien
aagccaaagccatcatgcctagcag

SEQ ID NO: 7314 - DNA, 25 bp, Homo sapien
aagccaaagccatcgtgcctagcag

SEQ ID NO: 7315 - DNA, 25 bp, Homo sapien
aagccaaatattactcctacataca

SEQ ID NO: 7316 - DNA, 25 bp, Homo sapien
aagccaaatattgctcctacataca

SEQ ID NO: 7317 - DNA, 25 bp, Homo sapien
aagccaaattttgaacataaagctc

SEQ ID NO: 7318 - DNA, 25 bp, Homo sapien
aagccaaattttgcacataaagctc

SEQ ID NO: 7319 - DNA, 25 bp, Homo sapien
aagccaagagggctaacaggaaaac

SEQ ID NO: 7320 - DNA, 25 bp, Homo sapien
aagccaagataacaactctatcatt

SEQ ID NO: 7321 - DNA, 25 bp, Homo sapien
aagccaagataacacctctatcatt

SEQ ID NO: 7322 - DNA, 25 bp, Homo sapien
aagccaagtgggctaacaggaaaac

SEQ ID NO: 7323 - DNA, 25 bp, Homo sapien
aagccaataaaagcccgaaaggtat

SEQ ID NO: 7324 - DNA, 25 bp, Homo sapien
aagccaatgaaagcccgaaaggtat

SEQ ID NO: 7325 - DNA, 25 bp, Homo sapien
aagccaatttccaatgattaaaaga

SEQ ID NO: 7326 - DNA, 25 bp, Homo sapien
aagccaatttccgatgattaaaaga

SEQ ID NO: 7327 - DNA, 25 bp, Homo sapien
aagccaccaagttcatgttaatcta

SEQ ID NO: 7328 - DNA, 25 bp, Homo sapien
aagccaccaagttcgtgttaatcta

SEQ ID NO: 7329 - DNA, 25 bp, Homo sapien
aagccaccgagttggtggtgatttg

SEQ ID NO: 7330 - DNA, 25 bp, Homo sapien
aagccaccgagtttgtggtgatttg

SEQ ID NO: 7331 - DNA, 25 bp, Homo sapien
aagccacctcacttcctggcatggc

SEQ ID NO: 7332 - DNA, 25 bp, Homo sapien
aagccacctcatttcctggcatggc

SEQ ID NO: 7333 - DNA, 25 bp, Homo sapien
aagccagaatgactctgaactttct

SEQ ID NO: 7334 - DNA, 25 bp, Homo sapien
aagccagaatgtctctgaactttct

SEQ ID NO: 7335 - DNA, 25 bp, Homo sapien
aagccagagatgacgcttcacattc

SEQ ID NO: 7336 - DNA, 25 bp, Homo sapien
aagccagagatgactcttcacattc

SEQ ID NO: 7337 - DNA, 25 bp, Homo sapien
aagccagaggaccaggaaagttgtg

SEQ ID NO: 7338 - DNA, 25 bp, Homo sapien
aagccagaggaccagggaagttgtg

SEQ ID NO: 7339 - DNA, 25 bp, Homo sapien
aagccaggcataagcagctatgtgc

SEQ ID NO: 7340 - DNA, 25 bp, Homo sapien
aagccaggcgtaagcagctatgtgc

SEQ ID NO: 7341 - DNA, 25 bp, Homo sapien
aagccaggtccttaacttcccggag

SEQ ID NO: 7342 - DNA, 25 bp, Homo sapien
aagccaggtcctttacttcccggag

SEQ ID NO: 7343 - DNA, 25 bp, Homo sapien
aagccataataactgaaggccttgt

SEQ ID NO: 7344 - DNA, 25 bp, Homo sapien
aagccatagtaactgaaggccttgt

SEQ ID NO: 7345 - DNA, 25 bp, Homo sapien
aagccatattcaaattcagccattt

SEQ ID NO: 7346 - DNA, 25 bp, Homo sapien
aagccatattccaattcagccattt

SEQ ID NO: 7347 - DNA, 25 bp, Homo sapien
aagccatcatgcctagcagaggagc

SEQ ID NO: 7348 - DNA, 25 bp, Homo sapien
aagccatcgtgcctagcagaggagc

SEQ ID NO: 7349 - DNA, 25 bp, Homo sapien
aagccatgaataaaaccgttctcag

SEQ ID NO: 7350 - DNA, 25 bp, Homo sapien
aagccatgaataaaactgttctcag

SEQ ID NO: 7351 - DNA, 25 bp, Homo sapien
aagccatgctgaacgtggggcatct

SEQ ID NO: 7352 - DNA, 25 bp, Homo sapien
aagccatgctggacgtggggcatct

SEQ ID NO: 7353 - DNA, 25 bp, Homo sapien
aagccatgctggagtggtgctcaca

SEQ ID NO: 7354 - DNA, 25 bp, Homo sapien
aagccatgctggcgtggtgctcaca

SEQ ID NO: 7355 - DNA, 25 bp, Homo sapien
aagccattcgtcagacagtgtcaat

SEQ ID NO: 7356 - DNA, 25 bp, Homo sapien
aagccattcgtcggacagtgtcaat

SEQ ID NO: 7357 - DNA, 25 bp, Homo sapien
aagccattcttgagctaagtaagaa

SEQ ID NO: 7358 - DNA, 25 bp, Homo sapien
aagccattcttgaggtaagtaagaa

SEQ ID NO: 7359 - DNA, 25 bp, Homo sapien
aagccattgccctgaaaagaaggac

SEQ ID NO: 7360 - DNA, 25 bp, Homo sapien
aagccattgccctgaagagaaggac

SEQ ID NO: 7361 - DNA, 25 bp, Homo sapien
aagccatttaaccatgtcccagaac

SEQ ID NO: 7362 - DNA, 25 bp, Homo sapien
aagccatttaacgatgtcccagaac

SEQ ID NO: 7363 - DNA, 25 bp, Homo sapien
aagcccaaaccaaaaaatcaaatgc

SEQ ID NO: 7364 - DNA, 25 bp, Homo sapien
aagcccaaagctctatgatgaccct

SEQ ID NO: 7365 - DNA, 25 bp, Homo sapien
aagcccaaagctgtatgatgaccct

SEQ ID NO: 7366 - DNA, 25 bp, Homo sapien
aagcccaacccaaaaaatcaaatgc

SEQ ID NO: 7367 - DNA, 25 bp, Homo sapien
aagcccaatttaactatggaaggga

SEQ ID NO: 7368 - DNA, 25 bp, Homo sapien
aagcccaatttagctatggaaggga

SEQ ID NO: 7369 - DNA, 25 bp, Homo sapien
aagcccacaggacacgtcacctttt

SEQ ID NO: 7370 - DNA, 25 bp, Homo sapien
aagcccacaggacatgtcacctttt

SEQ ID NO: 7371 - DNA, 25 bp, Homo sapien
aagcccagggaaatagtaattgcag

SEQ ID NO: 7372 - DNA, 25 bp, Homo sapien
aagcccagggaactagtaattgcag

SEQ ID NO: 7373 - DNA, 25 bp, Homo sapien
aagcccatctctaagtagaaaaatc

SEQ ID NO: 7374 - DNA, 25 bp, Homo sapien
aagcccatctctgagtagaaaaatc

SEQ ID NO: 7375 - DNA, 25 bp, Homo sapien
aagcccgtctatggacacaaaactg

SEQ ID NO: 7376 - DNA, 25 bp, Homo sapien
aagcccgtctatggactcaaaactg

SEQ ID NO: 7377 - DNA, 25 bp, Homo sapien
aagccgacttgactgtggtggataa

SEQ ID NO: 7378 - DNA, 25 bp, Homo sapien
aagccgacttgactgttgtggataa

SEQ ID NO: 7379 - DNA, 25 bp, Homo sapien
aagccgctttgccgtgctgattgct

SEQ ID NO: 7380 - DNA, 25 bp, Homo sapien
aagccgctttgctgtgctgattgct

SEQ ID NO: 7381 - DNA, 25 bp, Homo sapien
aagcctacatgtgctgttatggcct

SEQ ID NO: 7382 - DNA, 25 bp, Homo sapien
aagcctacgtgtgctgttatggcct

SEQ ID NO: 7383 - DNA, 25 bp, Homo sapien
aagcctagacttcagacttactaag

SEQ ID NO: 7384 - DNA, 25 bp, Homo sapien
aagcctagacttcagatttactaag

SEQ ID NO: 7385 - DNA, 25 bp, Homo sapien
aagcctagtctcaacacatgaggaa

SEQ ID NO: 7386 - DNA, 25 bp, Homo sapien
aagcctagtcttaacacatgaggaa

SEQ ID NO: 7387 - DNA, 25 bp, Homo sapien
aagcctagttactcttggcccacca

SEQ ID NO: 7388 - DNA, 25 bp, Homo sapien
aagcctagttacttttggcccacca

SEQ ID NO: 7389 - DNA, 25 bp, Homo sapien
aagcctatcttttgagagcatggtt

SEQ ID NO: 7390 - DNA, 25 bp, Homo sapien
aagcctatcttttgcgagcatggtt

SEQ ID NO: 7391 - DNA, 25 bp, Homo sapien
aagcctcaagacatttgcctttcac

SEQ ID NO: 7392 - DNA, 25 bp, Homo sapien
aagcctcactcgcatatcttacgta

SEQ ID NO: 7393 - DNA, 25 bp, Homo sapien
aagcctcactcgcgtatcttacgta

SEQ ID NO: 7394 - DNA, 25 bp, Homo sapien
aagcctcaggaagtttacaagcatg

SEQ ID NO: 7395 - DNA, 25 bp, Homo sapien
aagcctcaggaattttacaagcatg

SEQ ID NO: 7396 - DNA, 25 bp, Homo sapien
aagcctcaggacatttgcctttcac

SEQ ID NO: 7397 - DNA, 25 bp, Homo sapien
aagcctctctgttcaaccagaacag

SEQ ID NO: 7398 - DNA, 25 bp, Homo sapien
aagcctctctgttccaccagaacag

SEQ ID NO: 7399 - DNA, 25 bp, Homo sapien
aagcctgcttgatactctaccccac

SEQ ID NO: 7400 - DNA, 25 bp, Homo sapien
aagcctgcttggtactctaccccac

SEQ ID NO: 7401 - DNA, 25 bp, Homo sapien
aagcctggtgacatgtttaaacccc

SEQ ID NO: 7402 - DNA, 25 bp, Homo sapien
aagcctggtgacatttttaaacccc

SEQ ID NO: 7403 - DNA, 25 bp, Homo sapien
aagcctgtgctttccttaaacaagt

SEQ ID NO: 7404 - DNA, 25 bp, Homo sapien
aagcctgtgttttccttaaacaagt

SEQ ID NO: 7405 - DNA, 25 bp, Homo sapien
aagccttatcaaagaagaataaaaa

SEQ ID NO: 7406 - DNA, 25 bp, Homo sapien
aagccttatcaaggaagaataaaaa

SEQ ID NO: 7407 - DNA, 25 bp, Homo sapien
aagccttcactcacactcttctgtc

SEQ ID NO: 7408 - DNA, 25 bp, Homo sapien
aagccttcactcacgctcttctgtc

SEQ ID NO: 7409 - DNA, 25 bp, Homo sapien
aagccttgacgggagagccaattcg

SEQ ID NO: 7410 - DNA, 25 bp, Homo sapien
aagccttgatgggagagccaattcg

SEQ ID NO: 7411 - DNA, 25 bp, Homo sapien
aagcgaactcaaaggaagaggcttc

SEQ ID NO: 7412 - DNA, 25 bp, Homo sapien
aagcgaactcaagggaagaggcttc

SEQ ID NO: 7413 - DNA, 25 bp, Homo sapien
aagcgaagtgaaaagaatgcattaa

SEQ ID NO: 7414 - DNA, 25 bp, Homo sapien
aagcgaagtgaaaataatgcattaa

SEQ ID NO: 7415 - DNA, 25 bp, Homo sapien
aagcgacatcaggtgttttagtaca

SEQ ID NO: 7416 - DNA, 25 bp, Homo sapien
aagcgacattaggtgttttagtaca

SEQ ID NO: 7417 - DNA, 25 bp, Homo sapien
aagcgacttcgaaattattatatac

SEQ ID NO: 7418 - DNA, 25 bp, Homo sapien
aagcgactttgaaattattatatac

SEQ ID NO: 7419 - DNA, 25 bp, Homo sapien
aagcgatcttccctgtgtcataagt

SEQ ID NO: 7420 - DNA, 25 bp, Homo sapien
aagcgatcttccctgtttcataagt

SEQ ID NO: 7421 - DNA, 25 bp, Homo sapien
aagcgcacatttgatctaattgtgt

SEQ ID NO: 7422 - DNA, 25 bp, Homo sapien
aagcgcacgtttgatctaattgtgt

SEQ ID NO: 7423 - DNA, 25 bp, Homo sapien
aagcgtatgaaacaagattcacaaa

SEQ ID NO: 7424 - DNA, 25 bp, Homo sapien
aagcgtatgaaagaagattcacaaa

SEQ ID NO: 7425 - DNA, 25 bp, Homo sapien
aagcgtgatcaaacataaaatgcac

SEQ ID NO: 7426 - DNA, 25 bp, Homo sapien
aagcgtgatcaaacatcaaatgcac

SEQ ID NO: 7427 - DNA, 25 bp, Homo sapien
aagcgtgtattaatggcactaattt

SEQ ID NO: 7428 - DNA, 25 bp, Homo sapien
aagcgtgtattaatggtactaattt

SEQ ID NO: 7429 - DNA, 25 bp, Homo sapien
aagcgttttgattaagtgctggatt

SEQ ID NO: 7430 - DNA, 25 bp, Homo sapien
aagcgttttgatttagtgctggatt

SEQ ID NO: 7431 - DNA, 25 bp, Homo sapien
aagctaaataaacgcctatgtactg

SEQ ID NO: 7432 - DNA, 25 bp, Homo sapien
aagctaaataaatgcctatgtactg

SEQ ID NO: 7433 - DNA, 25 bp, Homo sapien
aagctaacagaatatgtttaccact

SEQ ID NO: 7434 - DNA, 25 bp, Homo sapien
aagctaacagagtatgtttaccact

SEQ ID NO: 7435 - DNA, 25 bp, Homo sapien
aagctaagaccatgtgcgccctgtg

SEQ ID NO: 7436 - DNA, 25 bp, Homo sapien
aagctaagtccatgtgcgccctgtg

SEQ ID NO: 7437 - DNA, 25 bp, Homo sapien
aagctacctataaagttcaatatcc

SEQ ID NO: 7438 - DNA, 25 bp, Homo sapien
aagctacctctaaagttcaatatcc

SEQ ID NO: 7439 - DNA, 25 bp, Homo sapien
aagctactgaaaaactgatttctaa

SEQ ID NO: 7440 - DNA, 25 bp, Homo sapien
aagctactgaaacactgatttctaa

SEQ ID NO: 7441 - DNA, 25 bp, Homo sapien
aagctagaaaagccaaggaaggatt

SEQ ID NO: 7442 - DNA, 25 bp, Homo sapien
aagctagaacaatgagcaacaaaat

SEQ ID NO: 7443 - DNA, 25 bp, Homo sapien
aagctagaacactgagcaacaaaat

SEQ ID NO: 7444 - DNA, 25 bp, Homo sapien
aagctagaagagccaaggaaggatt

SEQ ID NO: 7445 - DNA, 25 bp, Homo sapien
aagctagaaggacgatactgaacgg

SEQ ID NO: 7446 - DNA, 25 bp, Homo sapien
aagctagaaggatgatactgaacgg

SEQ ID NO: 7447 - DNA, 25 bp, Homo sapien
aagctaggaagcaagccctccccag

SEQ ID NO: 7448 - DNA, 25 bp, Homo sapien
aagctaggaagcgagccctccccag

SEQ ID NO: 7449 - DNA, 25 bp, Homo sapien
aagctagttctctccagtacaggga

SEQ ID NO: 7450 - DNA, 25 bp, Homo sapien
aagctagttctttccagtacaggga

SEQ ID NO: 7451 - DNA, 25 bp, Homo sapien
aagctataaaccaaagaagcatcta

SEQ ID NO: 7452 - DNA, 25 bp, Homo sapien
aagctataaaccaacgaagcatcta

SEQ ID NO: 7453 - DNA, 25 bp, Homo sapien
aagctataaagaagtgtatagagta

SEQ ID NO: 7454 - DNA, 25 bp, Homo sapien
aagctatatagaagtgtatagagta

SEQ ID NO: 7455 - DNA, 25 bp, Homo sapien
aagctatgaattagaaacagagtag

SEQ ID NO: 7456 - DNA, 25 bp, Homo sapien
aagctatgaattagaaccagagtag

SEQ ID NO: 7457 - DNA, 25 bp, Homo sapien
aagctattaggactatgcactagag

SEQ ID NO: 7458 - DNA, 25 bp, Homo sapien
aagctattcatctgaaaacttgaac

SEQ ID NO: 7459 - DNA, 25 bp, Homo sapien
aagctattcatttgaaaacttgaac

SEQ ID NO: 7460 - DNA, 25 bp, Homo sapien
aagctattgggactatgcactagag

SEQ ID NO: 7461 - DNA, 25 bp, Homo sapien
aagctcaacataagtacaagtcaat

SEQ ID NO: 7462 - DNA, 25 bp, Homo sapien
aagctcaacataagtataagtcaat

SEQ ID NO: 7463 - DNA, 25 bp, Homo sapien
aagctcaagcgctcttcaatcagct

SEQ ID NO: 7464 - DNA, 25 bp, Homo sapien
aagctcaaggacgggacaaagttca

SEQ ID NO: 7465 - DNA, 25 bp, Homo sapien
aagctcaaggatgggacaaagttca

SEQ ID NO: 7466 - DNA, 25 bp, Homo sapien
aagctcaagggctcttcaatcagct

SEQ ID NO: 7467 - DNA, 25 bp, Homo sapien
aagctcaagtaccggagttcccaat

SEQ ID NO: 7468 - DNA, 25 bp, Homo sapien
aagctcaagtactggagttcccaat

SEQ ID NO: 7469 - DNA, 25 bp, Homo sapien
aagctcaccgttgagagacctactg

SEQ ID NO: 7470 - DNA, 25 bp, Homo sapien
aagctcactgtacaatcaggacgca

SEQ ID NO: 7471 - DNA, 25 bp, Homo sapien
aagctcactgtataatcaggacgca

SEQ ID NO: 7472 - DNA, 25 bp, Homo sapien
aagctcactgttgagagacctactg

SEQ ID NO: 7473 - DNA, 25 bp, Homo sapien
aagctcagaatggttaagtaacttg

SEQ ID NO: 7474 - DNA, 25 bp, Homo sapien
aagctcagaatggttaggtaacttg

SEQ ID NO: 7475 - DNA, 25 bp, Homo sapien
aagctcagagacgttaagcaatttg

SEQ ID NO: 7476 - DNA, 25 bp, Homo sapien
aagctcagagatgttaagcaatttg

SEQ ID NO: 7477 - DNA, 25 bp, Homo sapien
aagctcagtgccagctctgtgacag

SEQ ID NO: 7478 - DNA, 25 bp, Homo sapien
aagctcagtgccagctttgtgacag

SEQ ID NO: 7479 - DNA, 25 bp, Homo sapien
aagctcattcaaactgttggctgaa

SEQ ID NO: 7480 - DNA, 25 bp, Homo sapien
aagctcattcaaattgttggctgaa

SEQ ID NO: 7481 - DNA, 25 bp, Homo sapien
aagctccgccatcctgagttcctgt

SEQ ID NO: 7482 - DNA, 25 bp, Homo sapien
aagctccgccatcttgagttcctgt

SEQ ID NO: 7483 - DNA, 25 bp, Homo sapien
aagctctagtaatcaagacagtgtg

SEQ ID NO: 7484 - DNA, 25 bp, Homo sapien
aagctctagtaattaagacagtgtg

SEQ ID NO: 7485 - DNA, 25 bp, Homo sapien
aagctctatagaaagtaaaatgtag

SEQ ID NO: 7486 - DNA, 25 bp, Homo sapien
aagctctatagagagtaaaatgtag

SEQ ID NO: 7487 - DNA, 25 bp, Homo sapien
aagctctggtctcaaagccccaaat

SEQ ID NO: 7488 - DNA, 25 bp, Homo sapien
aagctctgttctcaaagccccaaat

SEQ ID NO: 7489 - DNA, 25 bp, Homo sapien
aagctcttcaggaccaagcctgaac

SEQ ID NO: 7490 - DNA, 25 bp, Homo sapien
aagctcttcgggaccaagcctgaac

SEQ ID NO: 7491 - DNA, 25 bp, Homo sapien
aagctcttgaattcgtttcctaggg

SEQ ID NO: 7492 - DNA, 25 bp, Homo sapien
aagctcttgcattcgtttcctaggg

SEQ ID NO: 7493 - DNA, 25 bp, Homo sapien
aagctgaaactaccatctagccctt

SEQ ID NO: 7494 - DNA, 25 bp, Homo sapien
aagctgaaactactatctagccctt

SEQ ID NO: 7495 - DNA, 25 bp, Homo sapien
aagctgaaagcctgtttgaaccgtg

SEQ ID NO: 7496 - DNA, 25 bp, Homo sapien
aagctgaacaaattgagaacatgtt

SEQ ID NO: 7497 - DNA, 25 bp, Homo sapien
aagctgaacgaattgagaacatgtt

SEQ ID NO: 7498 - DNA, 25 bp, Homo sapien
aagctgaaggtttaggaaagaacca

SEQ ID NO: 7499 - DNA, 25 bp, Homo sapien
aagctgaaggtttagggaagaacca

SEQ ID NO: 7500 - DNA, 25 bp, Homo sapien
aagctgaatgcctgtttgaaccgtg

SEQ ID NO: 7501 - DNA, 25 bp, Homo sapien
aagctgacaagaaaaaagcatttca

SEQ ID NO: 7502 - DNA, 25 bp, Homo sapien
aagctgacaaggaaaaagcatttca

SEQ ID NO: 7503 - DNA, 25 bp, Homo sapien
aagctgacaatgaaatgaaatctac

SEQ ID NO: 7504 - DNA, 25 bp, Homo sapien
aagctgacactgaaatgaaatctac

SEQ ID NO: 7505 - DNA, 25 bp, Homo sapien
aagctgaccatcaaggatctgcctg

SEQ ID NO: 7506 - DNA, 25 bp, Homo sapien
aagctgaccatgaaggatctgcctg

SEQ ID NO: 7507 - DNA, 25 bp, Homo sapien
aagctgaccctgacgcaaagattca

SEQ ID NO: 7508 - DNA, 25 bp, Homo sapien
aagctgaccctgatgcaaagattca

SEQ ID NO: 7509 - DNA, 25 bp, Homo sapien
aagctgagagtgaatgaataaacag

SEQ ID NO: 7510 - DNA, 25 bp, Homo sapien
aagctgagagttaatgaataaacag

SEQ ID NO: 7511 - DNA, 25 bp, Homo sapien
aagctgaggatgagagctgactgct

SEQ ID NO: 7512 - DNA, 25 bp, Homo sapien
aagctgaggatgagagttgactgct

SEQ ID NO: 7513 - DNA, 25 bp, Homo sapien
aagctgaggcactgaaaacctaaat

SEQ ID NO: 7514 - DNA, 25 bp, Homo sapien
aagctgaggcactgaatacctaaat

SEQ ID NO: 7515 - DNA, 25 bp, Homo sapien
aagctgagggttaggagaagctgag

SEQ ID NO: 7516 - DNA, 25 bp, Homo sapien
aagctgaggttcacaaagtttgagg

SEQ ID NO: 7517 - DNA, 25 bp, Homo sapien
aagctgaggttcagaaagtttgagg

SEQ ID NO: 7518 - DNA, 25 bp, Homo sapien
aagctgagtgttaggagaagctgag

SEQ ID NO: 7519 - DNA, 25 bp, Homo sapien
aagctgatgataaaagaagtttcat

SEQ ID NO: 7520 - DNA, 25 bp, Homo sapien
aagctgatggtaaaagaagtttcat

SEQ ID NO: 7521 - DNA, 25 bp, Homo sapien
aagctgatgtggaaagaaccactgg

SEQ ID NO: 7522 - DNA, 25 bp, Homo sapien
aagctgatgtggatagaaccactgg

SEQ ID NO: 7523 - DNA, 25 bp, Homo sapien
aagctgcaaaaaacaaggattttcc

SEQ ID NO: 7524 - DNA, 25 bp, Homo sapien
aagctgcaaaaagcaaggattttcc

SEQ ID NO: 7525 - DNA, 25 bp, Homo sapien
aagctgcaaaggcaaattgaaattc

SEQ ID NO: 7526 - DNA, 25 bp, Homo sapien
aagctgcaagacataatcctcttta

SEQ ID NO: 7527 - DNA, 25 bp, Homo sapien
aagctgcaagatataatcctcttta

SEQ ID NO: 7528 - DNA, 25 bp, Homo sapien
aagctgcaatggcaaattgaaattc

SEQ ID NO: 7529 - DNA, 25 bp, Homo sapien
aagctgctagtactacagagatgtg

SEQ ID NO: 7530 - DNA, 25 bp, Homo sapien
aagctgctgccttatgaacaagtaa

SEQ ID NO: 7531 - DNA, 25 bp, Homo sapien
aagctgctgccttatggacaagtaa

SEQ ID NO: 7532 - DNA, 25 bp, Homo sapien
aagctgctggtactacagagatgtg

SEQ ID NO: 7533 - DNA, 25 bp, Homo sapien
aagctggaaagtttgtgtcaattta

SEQ ID NO: 7534 - DNA, 25 bp, Homo sapien
aagctggaaagtttttgtcaattta

SEQ ID NO: 7535 - DNA, 25 bp, Homo sapien
aagctggacaggagcgaagagtctc

SEQ ID NO: 7536 - DNA, 25 bp, Homo sapien
aagctggactggagcgaagagtctc

SEQ ID NO: 7537 - DNA, 25 bp, Homo sapien
aagctggccatgcatcaataacata

SEQ ID NO: 7538 - DNA, 25 bp, Homo sapien
aagctggccatgcgtcaataacata

SEQ ID NO: 7539 - DNA, 25 bp, Homo sapien
aagctggccatttgggtgtgagtat

SEQ ID NO: 7540 - DNA, 25 bp, Homo sapien
aagctggctaagctggtgagtgaca

SEQ ID NO: 7541 - DNA, 25 bp, Homo sapien
aagctggctaatctggtgagtgaca

SEQ ID NO: 7542 - DNA, 25 bp, Homo sapien
aagctggctatttgggtgtgagtat

SEQ ID NO: 7543 - DNA, 25 bp, Homo sapien
aagctgggagtgccgcgaatcagtg

SEQ ID NO: 7544 - DNA, 25 bp, Homo sapien
aagctgggagtgctgcgaatcagtg

SEQ ID NO: 7545 - DNA, 25 bp, Homo sapien
aagctgtaacacagtagacattcag

SEQ ID NO: 7546 - DNA, 25 bp, Homo sapien
aagctgtaacatagtagacattcag

SEQ ID NO: 7547 - DNA, 25 bp, Homo sapien
aagctgtataactcaaatctttgat

SEQ ID NO: 7548 - DNA, 25 bp, Homo sapien
aagctgtataactcaagtctttgat

SEQ ID NO: 7549 - DNA, 25 bp, Homo sapien
aagctgtccacatcaaagacgccat

SEQ ID NO: 7550 - DNA, 25 bp, Homo sapien
aagctgtccacatcaaggacgccat

SEQ ID NO: 7551 - DNA, 25 bp, Homo sapien
aagctgtgagcgtctcactttcctt

SEQ ID NO: 7552 - DNA, 25 bp, Homo sapien
aagctgtgagcgtctcgctttcctt

SEQ ID NO: 7553 - DNA, 25 bp, Homo sapien
aagctgtgcctttcagattgcaaaa

SEQ ID NO: 7554 - DNA, 25 bp, Homo sapien
aagctgtgcctttctgattgcaaaa

SEQ ID NO: 7555 - DNA, 25 bp, Homo sapien
aagctgtgtaatcgattgtgaagaa

SEQ ID NO: 7556 - DNA, 25 bp, Homo sapien
aagctgtgtaatctattgtgaagaa

SEQ ID NO: 7557 - DNA, 25 bp, Homo sapien
aagctgttcttagcctcttaatttt

SEQ ID NO: 7558 - DNA, 25 bp, Homo sapien
aagctgtttgtaggcatcgtacgaa

SEQ ID NO: 7559 - DNA, 25 bp, Homo sapien
aagctgtttgtcggcatcgtacgaa

SEQ ID NO: 7560 - DNA, 25 bp, Homo sapien
aagctgtttttagcctcttaatttt

SEQ ID NO: 7561 - DNA, 25 bp, Homo sapien
aagctgttttttatttccctcctat

SEQ ID NO: 7562 - DNA, 25 bp, Homo sapien
aagctgttttttattttcctcctat

SEQ ID NO: 7563 - DNA, 25 bp, Homo sapien
aagcttaatagccaatgtgacagta

SEQ ID NO: 7564 - DNA, 25 bp, Homo sapien
aagcttaatagccagtgtgacagta

SEQ ID NO: 7565 - DNA, 25 bp, Homo sapien
aagcttagatttccgcttcaggatg

SEQ ID NO: 7566 - DNA, 25 bp, Homo sapien
aagcttagatttctgcttcaggatg

SEQ ID NO: 7567 - DNA, 25 bp, Homo sapien
aagcttatatttcagtagtcaggta

SEQ ID NO: 7568 - DNA, 25 bp, Homo sapien
aagcttatatttcattagtcaggta

SEQ ID NO: 7569 - DNA, 25 bp, Homo sapien
aagcttattaaactccatgacacag

SEQ ID NO: 7570 - DNA, 25 bp, Homo sapien
aagcttattaaattccatgacacag

SEQ ID NO: 7571 - DNA, 25 bp, Homo sapien
aagcttcaaatgacaatagtttacc

SEQ ID NO: 7572 - DNA, 25 bp, Homo sapien
aagcttcaaatgacgatagtttacc

SEQ ID NO: 7573 - DNA, 25 bp, Homo sapien
aagcttcatacccattagcggtcac

SEQ ID NO: 7574 - DNA, 25 bp, Homo sapien
aagcttcatacccgttagcggtcac

SEQ ID NO: 7575 - DNA, 25 bp, Homo sapien
aagcttccctcagaacattgcacac

SEQ ID NO: 7576 - DNA, 25 bp, Homo sapien
aagcttccctcataacattgcacac

SEQ ID NO: 7577 - DNA, 25 bp, Homo sapien
aagcttgaaatgatgctgacaaggg

SEQ ID NO: 7578 - DNA, 25 bp, Homo sapien
aagcttgaaatggtgctgacaaggg

SEQ ID NO: 7579 - DNA, 25 bp, Homo sapien
aagcttggcagacctgtatgcattc

SEQ ID NO: 7580 - DNA, 25 bp, Homo sapien
aagcttggcaggcctgtatgcattc

SEQ ID NO: 7581 - DNA, 25 bp, Homo sapien
aagctttcttactacaatgtaaatg

SEQ ID NO: 7582 - DNA, 25 bp, Homo sapien
aagctttcttactacagtgtaaatg

SEQ ID NO: 7583 - DNA, 25 bp, Homo sapien
aagcttttgctatgaggcaataaca

SEQ ID NO: 7584 - DNA, 25 bp, Homo sapien
aagcttttgctattaggcaataaca

SEQ ID NO: 7585 - DNA, 25 bp, Homo sapien
aaggaaaacctccaaacatcagcaa

SEQ ID NO: 7586 - DNA, 25 bp, Homo sapien
aaggaaaacctccgaacatcagcaa

SEQ ID NO: 7587 - DNA, 25 bp, Homo sapien
aaggaaaatgtattcaaagtgatgg

SEQ ID NO: 7588 - DNA, 25 bp, Homo sapien
aaggaaaatgtattcacagtgatgg

SEQ ID NO: 7589 - DNA, 25 bp, Homo sapien
aaggaaaattccgcactggtgctgc

SEQ ID NO: 7590 - DNA, 25 bp, Homo sapien
aaggaaaattctgcactggtgctgc

SEQ ID NO: 7591 - DNA, 25 bp, Homo sapien
aaggaaacaagaagcagtaaattac

SEQ ID NO: 7592 - DNA, 25 bp, Homo sapien
aaggaaacaagaagcattaaattac

SEQ ID NO: 7593 - DNA, 25 bp, Homo sapien
aaggaaacatgtaccgtacctcacc

SEQ ID NO: 7594 - DNA, 25 bp, Homo sapien
aaggaaacatgtactgtacctcacc

SEQ ID NO: 7595 - DNA, 25 bp, Homo sapien
aaggaaaccaatcgtgtgatttcaa

SEQ ID NO: 7596 - DNA, 25 bp, Homo sapien
aaggaaaccaattgtgtgatttcaa

SEQ ID NO: 7597 - DNA, 25 bp, Homo sapien
aaggaaactagcaggagatgatgaa

SEQ ID NO: 7598 - DNA, 25 bp, Homo sapien
aaggaaactcaattcgtgctcagca

SEQ ID NO: 7599 - DNA, 25 bp, Homo sapien
aaggaaactcaatttgtgctcagca

SEQ ID NO: 7600 - DNA, 25 bp, Homo sapien
aaggaaactggcaggagatgatgaa

SEQ ID NO: 7601 - DNA, 25 bp, Homo sapien
aaggaaagaaactggcatgttataa

SEQ ID NO: 7602 - DNA, 25 bp, Homo sapien
aaggaaagacaatcccaacatgtac

SEQ ID NO: 7603 - DNA, 25 bp, Homo sapien
aaggaaagagaatcccaacatgtac

SEQ ID NO: 7604 - DNA, 25 bp, Homo sapien
aaggaaagagactggcatgttataa

SEQ ID NO: 7605 - DNA, 25 bp, Homo sapien
aaggaaagagtgcaatcagaggata

SEQ ID NO: 7606 - DNA, 25 bp, Homo sapien
aaggaaaggagacagggagactttg

SEQ ID NO: 7607 - DNA, 25 bp, Homo sapien
aaggaaaggcgacagggagactttg

SEQ ID NO: 7608 - DNA, 25 bp, Homo sapien
aaggaaagggtgcaatcagaggata

SEQ ID NO: 7609 - DNA, 25 bp, Homo sapien
aaggaaataccaccgcttcttatgc

SEQ ID NO: 7610 - DNA, 25 bp, Homo sapien
aaggaaataccactgcttcttatgc

SEQ ID NO: 7611 - DNA, 25 bp, Homo sapien
aaggaaatacctcaatccttatgct

SEQ ID NO: 7612 - DNA, 25 bp, Homo sapien
aaggaaatacctcaattcttatgct

SEQ ID NO: 7613 - DNA, 25 bp, Homo sapien
aaggaaatccagacacagacatgtg

SEQ ID NO: 7614 - DNA, 25 bp, Homo sapien
aaggaaatccagatacagacatgtg

SEQ ID NO: 7615 - DNA, 25 bp, Homo sapien
aaggaaatgtccataacatgaatta

SEQ ID NO: 7616 - DNA, 25 bp, Homo sapien
aaggaaatgtccataatatgaatta

SEQ ID NO: 7617 - DNA, 25 bp, Homo sapien
aaggaaattagaatccctgtcctag

SEQ ID NO: 7618 - DNA, 25 bp, Homo sapien
aaggaaattagagtccctgtcctag

SEQ ID NO: 7619 - DNA, 25 bp, Homo sapien
aaggaacctctgcgaatgaagcact

SEQ ID NO: 7620 - DNA, 25 bp, Homo sapien
aaggaacctctgtgaatgaagcact

SEQ ID NO: 7621 - DNA, 25 bp, Homo sapien
aaggaacttacccacggatatacac

SEQ ID NO: 7622 - DNA, 25 bp, Homo sapien
aaggaacttacccatggatatacac

SEQ ID NO: 7623 - DNA, 25 bp, Homo sapien
aaggaagaaccatatcatcaatgtc

SEQ ID NO: 7624 - DNA, 25 bp, Homo sapien
aaggaagaaccatatcgtcaatgtc

SEQ ID NO: 7625 - DNA, 25 bp, Homo sapien
aaggaagaagttagaacaactgtac

SEQ ID NO: 7626 - DNA, 25 bp, Homo sapien
aaggaagaagttagaataactgtac

SEQ ID NO: 7627 - DNA, 25 bp, Homo sapien
aaggaagacaaatggatgtaaggag

SEQ ID NO: 7628 - DNA, 25 bp, Homo sapien
aaggaagacgagacacataaacctg

SEQ ID NO: 7629 - DNA, 25 bp, Homo sapien
aaggaagagaaatggatgtaaggag

SEQ ID NO: 7630 - DNA, 25 bp, Homo sapien
aaggaagataatcttttttaagctt

SEQ ID NO: 7631 - DNA, 25 bp, Homo sapien
aaggaagatgagacacataaacctg

SEQ ID NO: 7632 - DNA, 25 bp, Homo sapien
aaggaagattatcttttttaagctt

SEQ ID NO: 7633 - DNA, 25 bp, Homo sapien
aaggaagcaatgtgagttgaaaaaa

SEQ ID NO: 7634 - DNA, 25 bp, Homo sapien
aaggaagcaatttgagttgaaaaaa

SEQ ID NO: 7635 - DNA, 25 bp, Homo sapien
aaggaagctgcaaaaaggctgtgtt

SEQ ID NO: 7636 - DNA, 25 bp, Homo sapien
aaggaagctgcagaaaggctgtgtt

SEQ ID NO: 7637 - DNA, 25 bp, Homo sapien
aaggaaggaaagaaactggcatgtt

SEQ ID NO: 7638 - DNA, 25 bp, Homo sapien
aaggaaggaaagagactggcatgtt

SEQ ID NO: 7639 - DNA, 25 bp, Homo sapien
aaggaaggcatgagagacagcgaag

SEQ ID NO: 7640 - DNA, 25 bp, Homo sapien
aaggaaggcgtgagagacagcgaag

SEQ ID NO: 7641 - DNA, 25 bp, Homo sapien
aaggaaggtcacagtgattgtcaca

SEQ ID NO: 7642 - DNA, 25 bp, Homo sapien
aaggaaggtcagagtgattgtcaca

SEQ ID NO: 7643 - DNA, 25 bp, Homo sapien
aaggaaggtcctgcgagctgcggct

SEQ ID NO: 7644 - DNA, 25 bp, Homo sapien
aaggaaggtcctgtgagctgcggct

SEQ ID NO: 7645 - DNA, 25 bp, Homo sapien
aaggaagtaaggatgatcagagccc

SEQ ID NO: 7646 - DNA, 25 bp, Homo sapien
aaggaagtaagggtgatcagagccc

SEQ ID NO: 7647 - DNA, 25 bp, Homo sapien
aaggaagtgtaattcgcctgcctag

SEQ ID NO: 7648 - DNA, 25 bp, Homo sapien
aaggaagtgtaatttgcctgcctag

SEQ ID NO: 7649 - DNA, 25 bp, Homo sapien
aaggaataaatacctatcaaagtga

SEQ ID NO: 7650 - DNA, 25 bp, Homo sapien
aaggaataactacttgttcattttg

SEQ ID NO: 7651 - DNA, 25 bp, Homo sapien
aaggaataagtacctatcaaagtga

SEQ ID NO: 7652 - DNA, 25 bp, Homo sapien
aaggaataattacttgttcattttg

SEQ ID NO: 7653 - DNA, 25 bp, Homo sapien
aaggaatcaaacaaatccaattgca

SEQ ID NO: 7654 - DNA, 25 bp, Homo sapien
aaggaatcaaactaatccaattgca

SEQ ID NO: 7655 - DNA, 25 bp, Homo sapien
aaggaatcacagctccttgcatccc

SEQ ID NO: 7656 - DNA, 25 bp, Homo sapien
aaggaatcacagcttcttgcatccc

SEQ ID NO: 7657 - DNA, 25 bp, Homo sapien
aaggaatctattattatcttcatgt

SEQ ID NO: 7658 - DNA, 25 bp, Homo sapien
aaggaatctatttttatcttcatgt

SEQ ID NO: 7659 - DNA, 25 bp, Homo sapien
aaggaatgaatagatagaggacaaa

SEQ ID NO: 7660 - DNA, 25 bp, Homo sapien
aaggaatgaataggtagaggacaaa

SEQ ID NO: 7661 - DNA, 25 bp, Homo sapien
aaggaatgaatctgtgagttggtta

SEQ ID NO: 7662 - DNA, 25 bp, Homo sapien
aaggaatgaatctgtgggttggtta

SEQ ID NO: 7663 - DNA, 25 bp, Homo sapien
aaggaatgacctacatagcattaaa

SEQ ID NO: 7664 - DNA, 25 bp, Homo sapien
aaggaatgacctatatagcattaaa

SEQ ID NO: 7665 - DNA, 25 bp, Homo sapien
aaggaatgcatatacactatcaaat

SEQ ID NO: 7666 - DNA, 25 bp, Homo sapien
aaggaatgcatgtacactatcaaat

SEQ ID NO: 7667 - DNA, 25 bp, Homo sapien
aaggaatgccactcatacatgggga

SEQ ID NO: 7668 - DNA, 25 bp, Homo sapien
aaggaatgtcactcatacatgggga

SEQ ID NO: 7669 - DNA, 25 bp, Homo sapien
aaggaattaatgcaggcactgagaa

SEQ ID NO: 7670 - DNA, 25 bp, Homo sapien
aaggaattactgcaggcactgagaa

SEQ ID NO: 7671 - DNA, 25 bp, Homo sapien
aaggaattataaaaacagtcatatg

SEQ ID NO: 7672 - DNA, 25 bp, Homo sapien
aaggaattataagaacagtcatatg

SEQ ID NO: 7673 - DNA, 25 bp, Homo sapien
aaggaattcaagctgtacattgtct

SEQ ID NO: 7674 - DNA, 25 bp, Homo sapien
aaggaattcgagctgtacattgtct

SEQ ID NO: 7675 - DNA, 25 bp, Homo sapien
aaggaattgaaagaaataatgtgat

SEQ ID NO: 7676 - DNA, 25 bp, Homo sapien
aaggaattgcaagaaataatgtgat

SEQ ID NO: 7677 - DNA, 25 bp, Homo sapien
aaggaatttcactgtgttcagagtc

SEQ ID NO: 7678 - DNA, 25 bp, Homo sapien
aaggaatttcattgtgttcagagtc

SEQ ID NO: 7679 - DNA, 25 bp, Homo sapien
aaggaattttatcatttttctgatc

SEQ ID NO: 7680 - DNA, 25 bp, Homo sapien
aaggaattttatcgtttttctgatc

SEQ ID NO: 7681 - DNA, 25 bp, Homo sapien
aaggacaaataatacaagagaaaaa

SEQ ID NO: 7682 - DNA, 25 bp, Homo sapien
aaggacaaataatataagagaaaaa

SEQ ID NO: 7683 - DNA, 25 bp, Homo sapien
aaggacaacaagtagtgtgaaacaa

SEQ ID NO: 7684 - DNA, 25 bp, Homo sapien
aaggacaagaagtagtgtgaaacaa

SEQ ID NO: 7685 - DNA, 25 bp, Homo sapien
aaggacaagaatcgtcaagattgag

SEQ ID NO: 7686 - DNA, 25 bp, Homo sapien
aaggacaagaattgtcaagattgag

SEQ ID NO: 7687 - DNA, 25 bp, Homo sapien
aaggacaatattagacatctgcttt

SEQ ID NO: 7688 - DNA, 25 bp, Homo sapien
aaggacaatattggacatctgcttt

SEQ ID NO: 7689 - DNA, 25 bp, Homo sapien
aaggacacatataggctgaaagtaa

SEQ ID NO: 7690 - DNA, 25 bp, Homo sapien
aaggacacgtataggctgaaagtaa

SEQ ID NO: 7691 - DNA, 25 bp, Homo sapien
aaggacagaagcccaagatcaagct

SEQ ID NO: 7692 - DNA, 25 bp, Homo sapien
aaggacagaagcctaagatcaagct

SEQ ID NO: 7693 - DNA, 25 bp, Homo sapien
aaggacagcaaaaatgagggataag

SEQ ID NO: 7694 - DNA, 25 bp, Homo sapien
aaggacagcgaaaatgagggataag

SEQ ID NO: 7695 - DNA, 25 bp, Homo sapien
aaggacagctagtgaagtaggaaga

SEQ ID NO: 7696 - DNA, 25 bp, Homo sapien
aaggacagctagttaagtaggaaga

SEQ ID NO: 7697 - DNA, 25 bp, Homo sapien
aaggacagttctaacggcttccatt

SEQ ID NO: 7698 - DNA, 25 bp, Homo sapien
aaggacagttctaatggcttccatt

SEQ ID NO: 7699 - DNA, 25 bp, Homo sapien
aaggacataaggatagctgtcagtg

SEQ ID NO: 7700 - DNA, 25 bp, Homo sapien
aaggacataaggatagttgtcagtg

SEQ ID NO: 7701 - DNA, 25 bp, Homo sapien
aaggacatttcaggcaaagaaagta

SEQ ID NO: 7702 - DNA, 25 bp, Homo sapien
aaggacatttcaggcagagaaagta

SEQ ID NO: 7703 - DNA, 25 bp, Homo sapien
aaggaccaatcagtgtgcactttct

SEQ ID NO: 7704 - DNA, 25 bp, Homo sapien
aaggaccacagagtaaacattttca

SEQ ID NO: 7705 - DNA, 25 bp, Homo sapien
aaggaccacggagtaaacattttca

SEQ ID NO: 7706 - DNA, 25 bp, Homo sapien
aaggaccagtcagtgtgcactttct

SEQ ID NO: 7707 - DNA, 25 bp, Homo sapien
aaggacccagcagtccaagaacttg

SEQ ID NO: 7708 - DNA, 25 bp, Homo sapien
aaggacccagcagtccgagaacttg

SEQ ID NO: 7709 - DNA, 25 bp, Homo sapien
aaggaccctaacgaatacacctccc

SEQ ID NO: 7710 - DNA, 25 bp, Homo sapien
aaggaccctaactaatacacctccc

SEQ ID NO: 7711 - DNA, 25 bp, Homo sapien
aaggaccggcgttgctttctgacta

SEQ ID NO: 7712 - DNA, 25 bp, Homo sapien
aaggaccggtgttgctttctgacta

SEQ ID NO: 7713 - DNA, 25 bp, Homo sapien
aaggacctaagagctccctaatcaa

SEQ ID NO: 7714 - DNA, 25 bp, Homo sapien
aaggacctatgagctccctaatcaa

SEQ ID NO: 7715 - DNA, 25 bp, Homo sapien
aaggactgctttagctacttctcat

SEQ ID NO: 7716 - DNA, 25 bp, Homo sapien
aaggactgctttcgctacttctcat

SEQ ID NO: 7717 - DNA, 25 bp, Homo sapien
aaggacttatgattgccctcattac

SEQ ID NO: 7718 - DNA, 25 bp, Homo sapien
aaggacttatgattgctctcattac

SEQ ID NO: 7719 - DNA, 25 bp, Homo sapien
aaggagaacaaaagacaggaataaa

SEQ ID NO: 7720 - DNA, 25 bp, Homo sapien
aaggagaacaagagacaggaataaa

SEQ ID NO: 7721 - DNA, 25 bp, Homo sapien
aaggagaagttctggctctgagatc

SEQ ID NO: 7722 - DNA, 25 bp, Homo sapien
aaggagaagttttggctctgagatc

SEQ ID NO: 7723 - DNA, 25 bp, Homo sapien
aaggagacaggaaacaatacagtcc

SEQ ID NO: 7724 - DNA, 25 bp, Homo sapien
aaggagacaggagacaatacagtcc

SEQ ID NO: 7725 - DNA, 25 bp, Homo sapien
aaggagacagttaacaaatccacta

SEQ ID NO: 7726 - DNA, 25 bp, Homo sapien
aaggagacagttgacaaatccacta

SEQ ID NO: 7727 - DNA, 25 bp, Homo sapien
aaggagagaacttccgactgaaagc

SEQ ID NO: 7728 - DNA, 25 bp, Homo sapien
aaggagagaacttctgactgaaagc

SEQ ID NO: 7729 - DNA, 25 bp, Homo sapien
aaggagaggtgcgatcatagcccag

SEQ ID NO: 7730 - DNA, 25 bp, Homo sapien
aaggagaggtgtgatcatagcccag

SEQ ID NO: 7731 - DNA, 25 bp, Homo sapien
aaggagatagacaaggagatgaagt

SEQ ID NO: 7732 - DNA, 25 bp, Homo sapien
aaggagatagacgaggagatgaagt

SEQ ID NO: 7733 - DNA, 25 bp, Homo sapien
aaggagcacaactgttgaatcacat

SEQ ID NO: 7734 - DNA, 25 bp, Homo sapien
aaggagcagtaggcctagcaaggag

SEQ ID NO: 7735 - DNA, 25 bp, Homo sapien
aaggagcagtaggcctggcaaggag

SEQ ID NO: 7736 - DNA, 25 bp, Homo sapien
aaggagcataactgttgaatcacat

SEQ ID NO: 7737 - DNA, 25 bp, Homo sapien
aaggagctgaaaagtcacaatcttt

SEQ ID NO: 7738 - DNA, 25 bp, Homo sapien
aaggagctgaagagtcacaatcttt

SEQ ID NO: 7739 - DNA, 25 bp, Homo sapien
aaggaggactccacggtgcaggcag

SEQ ID NO: 7740 - DNA, 25 bp, Homo sapien
aaggaggactccatggtgcaggcag

SEQ ID NO: 7741 - DNA, 25 bp, Homo sapien
aaggagggtggcacatgctcatcac

SEQ ID NO: 7742 - DNA, 25 bp, Homo sapien
aaggagggtggcgcatgctcatcac

SEQ ID NO: 7743 - DNA, 25 bp, Homo sapien
aaggagtaaacggtcctttcacagg

SEQ ID NO: 7744 - DNA, 25 bp, Homo sapien
aaggagtaagcggtcctttcacagg

SEQ ID NO: 7745 - DNA, 25 bp, Homo sapien
aaggagtggccagaccatagaggca

SEQ ID NO: 7746 - DNA, 25 bp, Homo sapien
aaggagtggccaggccatagaggca

SEQ ID NO: 7747 - DNA, 25 bp, Homo sapien
aaggagtgtgctagctagattgtat

SEQ ID NO: 7748 - DNA, 25 bp, Homo sapien
aaggagtgtgcttgctagattgtat

SEQ ID NO: 7749 - DNA, 25 bp, Homo sapien
aaggagtgttgaacctgcattccag

SEQ ID NO: 7750 - DNA, 25 bp, Homo sapien
aaggagtgttgagcctgcattccag

SEQ ID NO: 7751 - DNA, 25 bp, Homo sapien
aaggataaaagacgcatttgtgata

SEQ ID NO: 7752 - DNA, 25 bp, Homo sapien
aaggataaaagatgcatttgtgata

SEQ ID NO: 7753 - DNA, 25 bp, Homo sapien
aaggataagaaaacaaaaagtactt

SEQ ID NO: 7754 - DNA, 25 bp, Homo sapien
aaggataaggaaacaaaaagtactt

SEQ ID NO: 7755 - DNA, 25 bp, Homo sapien
aaggataccatataacttggcactc

SEQ ID NO: 7756 - DNA, 25 bp, Homo sapien
aaggataccatatgacttggcactc

SEQ ID NO: 7757 - DNA, 25 bp, Homo sapien
aaggatagaaaatggaatcctggca

SEQ ID NO: 7758 - DNA, 25 bp, Homo sapien
aaggatagagaatggaatcctggca

SEQ ID NO: 7759 - DNA, 25 bp, Homo sapien
aaggataggaagagaaaactgcaca

SEQ ID NO: 7760 - DNA, 25 bp, Homo sapien
aaggataggaagggaaaactgcaca

SEQ ID NO: 7761 - DNA, 25 bp, Homo sapien
aaggatcataagattgagagattac

SEQ ID NO: 7762 - DNA, 25 bp, Homo sapien
aaggatcataagattgggagattac

SEQ ID NO: 7763 - DNA, 25 bp, Homo sapien
aaggatcctcaacattgtactgtaa

SEQ ID NO: 7764 - DNA, 25 bp, Homo sapien
aaggatcctcaatattgtactgtaa

SEQ ID NO: 7765 - DNA, 25 bp, Homo sapien
aaggatcttggccatattctgagcc

SEQ ID NO: 7766 - DNA, 25 bp, Homo sapien
aaggatcttggccgtattctgagcc

SEQ ID NO: 7767 - DNA, 25 bp, Homo sapien
aaggatgaatacatttttcgggctt

SEQ ID NO: 7768 - DNA, 25 bp, Homo sapien
aaggatgagtcatcgcaaaccacca

SEQ ID NO: 7769 - DNA, 25 bp, Homo sapien
aaggatgagtcatcgccaaccacca

SEQ ID NO: 7770 - DNA, 25 bp, Homo sapien
aaggatgatcaagttccaccaagta

SEQ ID NO: 7771 - DNA, 25 bp, Homo sapien
aaggatgatcaatttccaccaagta

SEQ ID NO: 7772 - DNA, 25 bp, Homo sapien
aaggatgattacatttttcgggctt

SEQ ID NO: 7773 - DNA, 25 bp, Homo sapien
aaggatggccaggtgtgttcctcta

SEQ ID NO: 7774 - DNA, 25 bp, Homo sapien
aaggatggcttaaagtatgcaaatc

SEQ ID NO: 7775 - DNA, 25 bp, Homo sapien
aaggatggcttaacgtatgcaaatc

SEQ ID NO: 7776 - DNA, 25 bp, Homo sapien
aaggatggtcaggtgtgttcctcta

SEQ ID NO: 7777 - DNA, 25 bp, Homo sapien
aaggatgtcataatgtcatgtggat

SEQ ID NO: 7778 - DNA, 25 bp, Homo sapien
aaggatgtcatgatgtcatgtggat

SEQ ID NO: 7779 - DNA, 25 bp, Homo sapien
aaggatgtgcctgtcaatgtttttt

SEQ ID NO: 7780 - DNA, 25 bp, Homo sapien
aaggatgtgcctgtcattgtttttt

SEQ ID NO: 7781 - DNA, 25 bp, Homo sapien
aaggatgttttcattttcagttttt

SEQ ID NO: 7782 - DNA, 25 bp, Homo sapien
aaggatgttttcgttttcagttttt

SEQ ID NO: 7783 - DNA, 25 bp, Homo sapien
aaggattaatgctgccatcatgaat

SEQ ID NO: 7784 - DNA, 25 bp, Homo sapien
aaggattaatgttgccatcatgaat

SEQ ID NO: 7785 - DNA, 25 bp, Homo sapien
aaggattcagttaagtttgttcatc

SEQ ID NO: 7786 - DNA, 25 bp, Homo sapien
aaggattcagttacgtttgttcatc

SEQ ID NO: 7787 - DNA, 25 bp, Homo sapien
aaggattcatcatcattaggtgtca

SEQ ID NO: 7788 - DNA, 25 bp, Homo sapien
aaggattcatcatcgttaggtgtca

SEQ ID NO: 7789 - DNA, 25 bp, Homo sapien
aaggattccatgagaaaaaatatca

SEQ ID NO: 7790 - DNA, 25 bp, Homo sapien
aaggattctatgagaaaaaatatca

SEQ ID NO: 7791 - DNA, 25 bp, Homo sapien
aaggattgcggcttcctccttcctg

SEQ ID NO: 7792 - DNA, 25 bp, Homo sapien
aaggattgcggcttgctccttcctg

SEQ ID NO: 7793 - DNA, 25 bp, Homo sapien
aaggatttactcacccacaaaagtg

SEQ ID NO: 7794 - DNA, 25 bp, Homo sapien
aaggatttactcagccacaaaagtg

SEQ ID NO: 7795 - DNA, 25 bp, Homo sapien
aaggatttgccataatataaggaaa

SEQ ID NO: 7796 - DNA, 25 bp, Homo sapien
aaggatttgccataatctaaggaaa

SEQ ID NO: 7797 - DNA, 25 bp, Homo sapien
aaggatttgggagatacttcagagg

SEQ ID NO: 7798 - DNA, 25 bp, Homo sapien
aaggatttgggagatatttcagagg

SEQ ID NO: 7799 - DNA, 25 bp, Homo sapien
aaggattttgagtaagagatttttc

SEQ ID NO: 7800 - DNA, 25 bp, Homo sapien
aaggattttgagtaagggatttttc

SEQ ID NO: 7801 - DNA, 25 bp, Homo sapien
aaggatttttactctagtctctagt

SEQ ID NO: 7802 - DNA, 25 bp, Homo sapien
aaggatttttactttagtctctagt

SEQ ID NO: 7803 - DNA, 25 bp, Homo sapien
aaggcaaaagactagagagtgacat

SEQ ID NO: 7804 - DNA, 25 bp, Homo sapien
aaggcaaaagattagagagtgacat

SEQ ID NO: 7805 - DNA, 25 bp, Homo sapien
aaggcaactcaatgaaaccaaagtc

SEQ ID NO: 7806 - DNA, 25 bp, Homo sapien
aaggcaactcaatgaagccaaagtc

SEQ ID NO: 7807 - DNA, 25 bp, Homo sapien
aaggcaagaactgatatgatttcct

SEQ ID NO: 7808 - DNA, 25 bp, Homo sapien
aaggcaagacctcaactgcttcatt

SEQ ID NO: 7809 - DNA, 25 bp, Homo sapien
aaggcaagaccttaactgcttcatt

SEQ ID NO: 7810 - DNA, 25 bp, Homo sapien
aaggcaagatctgatatgatttcct

SEQ ID NO: 7811 - DNA, 25 bp, Homo sapien
aaggcaagcagacatatattattag

SEQ ID NO: 7812 - DNA, 25 bp, Homo sapien
aaggcaagcagtcatatattattag

SEQ ID NO: 7813 - DNA, 25 bp, Homo sapien
aaggcaatatgacacgaacaaagga

SEQ ID NO: 7814 - DNA, 25 bp, Homo sapien
aaggcaatatgacatgaacaaagga

SEQ ID NO: 7815 - DNA, 25 bp, Homo sapien
aaggcaatcattatgaagcttcagc

SEQ ID NO: 7816 - DNA, 25 bp, Homo sapien
aaggcaatcattgtgaagcttcagc

SEQ ID NO: 7817 - DNA, 25 bp, Homo sapien
aaggcaatgacaatcttcctggcct

SEQ ID NO: 7818 - DNA, 25 bp, Homo sapien
aaggcaatgacaatgttcctggcct

SEQ ID NO: 7819 - DNA, 25 bp, Homo sapien
aaggcacagaggcacgctgatcagg

SEQ ID NO: 7820 - DNA, 25 bp, Homo sapien
aaggcacagaggcatgctgatcagg

SEQ ID NO: 7821 - DNA, 25 bp, Homo sapien
aaggcacatagtatcctcagctttc

SEQ ID NO: 7822 - DNA, 25 bp, Homo sapien
aaggcacatggtatcctcagctttc

SEQ ID NO: 7823 - DNA, 25 bp, Homo sapien
aaggcacattcagcctggcctatct

SEQ ID NO: 7824 - DNA, 25 bp, Homo sapien
aaggcacattcagccttgcctatct

SEQ ID NO: 7825 - DNA, 25 bp, Homo sapien
aaggcactaatagcctcaacagttt

SEQ ID NO: 7826 - DNA, 25 bp, Homo sapien
aaggcactagtagcctcaacagttt

SEQ ID NO: 7827 - DNA, 25 bp, Homo sapien
aaggcactggagagtccgcagtgac

SEQ ID NO: 7828 - DNA, 25 bp, Homo sapien
aaggcactggagagtctgcagtgac

SEQ ID NO: 7829 - DNA, 25 bp, Homo sapien
aaggcacttcgtagcacaatgatat

SEQ ID NO: 7830 - DNA, 25 bp, Homo sapien
aaggcactttgtagcacaatgatat

SEQ ID NO: 7831 - DNA, 25 bp, Homo sapien
aaggcagaaaaaacaaagctggaaa

SEQ ID NO: 7832 - DNA, 25 bp, Homo sapien
aaggcagaaaaagcaaagctggaaa

SEQ ID NO: 7833 - DNA, 25 bp, Homo sapien
aaggcagacctgccagaagcacagg

SEQ ID NO: 7834 - DNA, 25 bp, Homo sapien
aaggcagactaactggagaacaggt

SEQ ID NO: 7835 - DNA, 25 bp, Homo sapien
aaggcagactcatgattattccaaa

SEQ ID NO: 7836 - DNA, 25 bp, Homo sapien
aaggcagactcgtgattattccaaa

SEQ ID NO: 7837 - DNA, 25 bp, Homo sapien
aaggcagacttgccagaagcacagg

SEQ ID NO: 7838 - DNA, 25 bp, Homo sapien
aaggcagagggcatcagattgtgag

SEQ ID NO: 7839 - DNA, 25 bp, Homo sapien
aaggcagagggcgtcagattgtgag

SEQ ID NO: 7840 - DNA, 25 bp, Homo sapien
aaggcagattaactggagaacaggt

SEQ ID NO: 7841 - DNA, 25 bp, Homo sapien
aaggcagcagcacaaacagatgggt

SEQ ID NO: 7842 - DNA, 25 bp, Homo sapien
aaggcagcagcacaaatagatgggt

SEQ ID NO: 7843 - DNA, 25 bp, Homo sapien
aaggcagctgtggcctgataaaggc

SEQ ID NO: 7844 - DNA, 25 bp, Homo sapien
aaggcagctgtggtctgataaaggc

SEQ ID NO: 7845 - DNA, 25 bp, Homo sapien
aaggcaggtgcctctgctttgccgt

SEQ ID NO: 7846 - DNA, 25 bp, Homo sapien
aaggcaggtgcttctgctttgccgt

SEQ ID NO: 7847 - DNA, 25 bp, Homo sapien
aaggcagtgtcacagcacaaagaaa

SEQ ID NO: 7848 - DNA, 25 bp, Homo sapien
aaggcagtgtcacggcacaaagaaa

SEQ ID NO: 7849 - DNA, 25 bp, Homo sapien
aaggcataaactatctaaatgctct

SEQ ID NO: 7850 - DNA, 25 bp, Homo sapien
aaggcataaagtgatccgggtgatg

SEQ ID NO: 7851 - DNA, 25 bp, Homo sapien
aaggcataaagtgatctgggtgatg

SEQ ID NO: 7852 - DNA, 25 bp, Homo sapien
aaggcatacagacagctgaagaaca

SEQ ID NO: 7853 - DNA, 25 bp, Homo sapien
aaggcatacaggcagctgaagaaca

SEQ ID NO: 7854 - DNA, 25 bp, Homo sapien
aaggcatagactatctaaatgctct

SEQ ID NO: 7855 - DNA, 25 bp, Homo sapien
aaggcatcagtgctattgtagagtt

SEQ ID NO: 7856 - DNA, 25 bp, Homo sapien
aaggcatcagtgctgttgtagagtt

SEQ ID NO: 7857 - DNA, 25 bp, Homo sapien
aaggcatcataacttattaacagtg

SEQ ID NO: 7858 - DNA, 25 bp, Homo sapien
aaggcatcataagttattaacagtg

SEQ ID NO: 7859 - DNA, 25 bp, Homo sapien
aaggcatgaagacatttatgtggtc

SEQ ID NO: 7860 - DNA, 25 bp, Homo sapien
aaggcatgaaggcatttatgtggtc

SEQ ID NO: 7861 - DNA, 25 bp, Homo sapien
aaggcatgatatatctgtctactcc

SEQ ID NO: 7862 - DNA, 25 bp, Homo sapien
aaggcatgatatatttgtctactcc

SEQ ID NO: 7863 - DNA, 25 bp, Homo sapien
aaggcatgtgaatatgtccctgaat

SEQ ID NO: 7864 - DNA, 25 bp, Homo sapien
aaggcatgtgaatgtgtccctgaat

SEQ ID NO: 7865 - DNA, 25 bp, Homo sapien
aaggcattctcaggtagcagcatgg

SEQ ID NO: 7866 - DNA, 25 bp, Homo sapien
aaggcattctcgggtagcagcatgg

SEQ ID NO: 7867 - DNA, 25 bp, Homo sapien
aaggcattcttaaatcacaaacaat

SEQ ID NO: 7868 - DNA, 25 bp, Homo sapien
aaggcattcttacatcacaaacaat

SEQ ID NO: 7869 - DNA, 25 bp, Homo sapien
aaggcattgttctacctttcagtgc

SEQ ID NO: 7870 - DNA, 25 bp, Homo sapien
aaggcattgttttacctttcagtgc

SEQ ID NO: 7871 - DNA, 25 bp, Homo sapien
aaggccacctggcaggaatccctct

SEQ ID NO: 7872 - DNA, 25 bp, Homo sapien
aaggccacctgtcaggaatccctct

SEQ ID NO: 7873 - DNA, 25 bp, Homo sapien
aaggccagacaagccagcataattt

SEQ ID NO: 7874 - DNA, 25 bp, Homo sapien
aaggccagactgaagaggtcacaga

SEQ ID NO: 7875 - DNA, 25 bp, Homo sapien
aaggccagacttaagaggtcacaga

SEQ ID NO: 7876 - DNA, 25 bp, Homo sapien
aaggccagagaagccagcataattt

SEQ ID NO: 7877 - DNA, 25 bp, Homo sapien
aaggccatgaataacctcttgcctg

SEQ ID NO: 7878 - DNA, 25 bp, Homo sapien
aaggccatgaatagcctcttgcctg

SEQ ID NO: 7879 - DNA, 25 bp, Homo sapien
aaggccatgctgcaccctcttcagc

SEQ ID NO: 7880 - DNA, 25 bp, Homo sapien
aaggccattctgcaccctcttcagc

SEQ ID NO: 7881 - DNA, 25 bp, Homo sapien
aaggccattgaaccagacagaaaga

SEQ ID NO: 7882 - DNA, 25 bp, Homo sapien
aaggccattgacccagacagaaaga

SEQ ID NO: 7883 - DNA, 25 bp, Homo sapien
aaggccatttgacataacaaaaact

SEQ ID NO: 7884 - DNA, 25 bp, Homo sapien
aaggccatttggcataacaaaaact

SEQ ID NO: 7885 - DNA, 25 bp, Homo sapien
aaggcccattggcaagggaagaatg

SEQ ID NO: 7886 - DNA, 25 bp, Homo sapien
aaggcccattggtaagggaagaatg

SEQ ID NO: 7887 - DNA, 25 bp, Homo sapien
aaggcctacacccttcatcacatct

SEQ ID NO: 7888 - DNA, 25 bp, Homo sapien
aaggcctacacccttcgtcacatct

SEQ ID NO: 7889 - DNA, 25 bp, Homo sapien
aaggcctgccagtagagcaaaacaa

SEQ ID NO: 7890 - DNA, 25 bp, Homo sapien
aaggcctggtcaagaactagaggac

SEQ ID NO: 7891 - DNA, 25 bp, Homo sapien
aaggcctggtcaaggactagaggac

SEQ ID NO: 7892 - DNA, 25 bp, Homo sapien
aaggcctgtcagtagagcaaaacaa

SEQ ID NO: 7893 - DNA, 25 bp, Homo sapien
aaggcgaaataccacctggtccctg

SEQ ID NO: 7894 - DNA, 25 bp, Homo sapien
aaggcgaaataccgcctggtccctg

SEQ ID NO: 7895 - DNA, 25 bp, Homo sapien
aaggcgaacgcaaacataataagtt

SEQ ID NO: 7896 - DNA, 25 bp, Homo sapien
aaggcgaacgcaagcataataagtt

SEQ ID NO: 7897 - DNA, 25 bp, Homo sapien
aaggcgtaaagaggtgagaaagtga

SEQ ID NO: 7898 - DNA, 25 bp, Homo sapien
aaggcgtaaggaggtgagaaagtga

SEQ ID NO: 7899 - DNA, 25 bp, Homo sapien
aaggcgttttattcacatcagttgt

SEQ ID NO: 7900 - DNA, 25 bp, Homo sapien
aaggcgttttattcgcatcagttgt

SEQ ID NO: 7901 - DNA, 25 bp, Homo sapien
aaggctaatacctataataacattt

SEQ ID NO: 7902 - DNA, 25 bp, Homo sapien
aaggctaatacgtataataacattt

SEQ ID NO: 7903 - DNA, 25 bp, Homo sapien
aaggctacaccaactacataagcag

SEQ ID NO: 7904 - DNA, 25 bp, Homo sapien
aaggctacaccacctacataagcag

SEQ ID NO: 7905 - DNA, 25 bp, Homo sapien
aaggctaccacaacgattaagtaat

SEQ ID NO: 7906 - DNA, 25 bp, Homo sapien
aaggctaccacaaggattaagtaat

SEQ ID NO: 7907 - DNA, 25 bp, Homo sapien
aaggctactggaataatatttttgg

SEQ ID NO: 7908 - DNA, 25 bp, Homo sapien
aaggctactggagtaatatttttgg

SEQ ID NO: 7909 - DNA, 25 bp, Homo sapien
aaggctagaataaaaacctccatga

SEQ ID NO: 7910 - DNA, 25 bp, Homo sapien
aaggctagaatgaaaacctccatga

SEQ ID NO: 7911 - DNA, 25 bp, Homo sapien
aaggctatgacataattcttggttg

SEQ ID NO: 7912 - DNA, 25 bp, Homo sapien
aaggctatgacgtaattcttggttg

SEQ ID NO: 7913 - DNA, 25 bp, Homo sapien
aaggctcaatgcggaaattcatggt

SEQ ID NO: 7914 - DNA, 25 bp, Homo sapien
aaggctcaatgctgaaattcatggt

SEQ ID NO: 7915 - DNA, 25 bp, Homo sapien
aaggctcaattctgcttttccctca

SEQ ID NO: 7916 - DNA, 25 bp, Homo sapien
aaggctcaattgtgcttttccctca

SEQ ID NO: 7917 - DNA, 25 bp, Homo sapien
aaggctctcgacttacctgagaagg

SEQ ID NO: 7918 - DNA, 25 bp, Homo sapien
aaggctctgcaactagatctgtggg

SEQ ID NO: 7919 - DNA, 25 bp, Homo sapien
aaggctctgcagctagatctgtggg

SEQ ID NO: 7920 - DNA, 25 bp, Homo sapien
aaggctctggcagctgtggtgtttc

SEQ ID NO: 7921 - DNA, 25 bp, Homo sapien
aaggctctggcatctgtggtgtttc

SEQ ID NO: 7922 - DNA, 25 bp, Homo sapien
aaggctctgttacaactctcctggg

SEQ ID NO: 7923 - DNA, 25 bp, Homo sapien
aaggctctgttacgactctcctggg

SEQ ID NO: 7924 - DNA, 25 bp, Homo sapien
aaggctcttgacttacctgagaagg

SEQ ID NO: 7925 - DNA, 25 bp, Homo sapien
aaggctgaaagtaagagtggcctca

SEQ ID NO: 7926 - DNA, 25 bp, Homo sapien
aaggctgaaagtaggagtggcctca

SEQ ID NO: 7927 - DNA, 25 bp, Homo sapien
aaggctgagacccgctgtgtttcca

SEQ ID NO: 7928 - DNA, 25 bp, Homo sapien
aaggctgagacctgctgtgtttcca

SEQ ID NO: 7929 - DNA, 25 bp, Homo sapien
aaggctgctgtaatatcacacactg

SEQ ID NO: 7930 - DNA, 25 bp, Homo sapien
aaggctgctgtaatgtcacacactg

SEQ ID NO: 7931 - DNA, 25 bp, Homo sapien
aaggctgttcctaaatggactggat

SEQ ID NO: 7932 - DNA, 25 bp, Homo sapien
aaggctgtttctaaatggactggat

SEQ ID NO: 7933 - DNA, 25 bp, Homo sapien
aaggcttacctgactctttgaaggc

SEQ ID NO: 7934 - DNA, 25 bp, Homo sapien
aaggcttacctggctctttgaaggc

SEQ ID NO: 7935 - DNA, 25 bp, Homo sapien
aaggcttcaccggttttggtcacaa

SEQ ID NO: 7936 - DNA, 25 bp, Homo sapien
aaggcttcatcggttttggtcacaa

SEQ ID NO: 7937 - DNA, 25 bp, Homo sapien
aaggcttctgagtaccttagccttt

SEQ ID NO: 7938 - DNA, 25 bp, Homo sapien
aaggcttctgagtgccttagccttt

SEQ ID NO: 7939 - DNA, 25 bp, Homo sapien
aaggcttgaccctgggaagcagcag

SEQ ID NO: 7940 - DNA, 25 bp, Homo sapien
aaggcttgagtcaaataaccctgat

SEQ ID NO: 7941 - DNA, 25 bp, Homo sapien
aaggcttgagtcaaatcaccctgat

SEQ ID NO: 7942 - DNA, 25 bp, Homo sapien
aaggcttgatcctgggaagcagcag

SEQ ID NO: 7943 - DNA, 25 bp, Homo sapien
aaggcttgcttgcagcttcccaggt

SEQ ID NO: 7944 - DNA, 25 bp, Homo sapien
aaggcttgcttgtagcttcccaggt

SEQ ID NO: 7945 - DNA, 25 bp, Homo sapien
aaggcttgtagacaggataactcat

SEQ ID NO: 7946 - DNA, 25 bp, Homo sapien
aaggcttgtagataggataactcat

SEQ ID NO: 7947 - DNA, 25 bp, Homo sapien
aaggctttagcaatgaacttttaag

SEQ ID NO: 7948 - DNA, 25 bp, Homo sapien
aaggctttagcagtgaacttttaag

SEQ ID NO: 7949 - DNA, 25 bp, Homo sapien
aaggctttaggtctttcgtaccaaa

SEQ ID NO: 7950 - DNA, 25 bp, Homo sapien
aaggctttaggtctttggtaccaaa

SEQ ID NO: 7951 - DNA, 25 bp, Homo sapien
aaggcttttagtatccatgaaggtc

SEQ ID NO: 7952 - DNA, 25 bp, Homo sapien
aaggctttttgtatccatgaaggtc

SEQ ID NO: 7953 - DNA, 25 bp, Homo sapien
aagggaaaaattaaagcataactca

SEQ ID NO: 7954 - DNA, 25 bp, Homo sapien
aagggaaaatatgaagcagccacct

SEQ ID NO: 7955 - DNA, 25 bp, Homo sapien
aagggaaaatatgaggcagccacct

SEQ ID NO: 7956 - DNA, 25 bp, Homo sapien
aagggaaaatttaaagcataactca

SEQ ID NO: 7957 - DNA, 25 bp, Homo sapien
aagggaaatattaacaggtcttgca

SEQ ID NO: 7958 - DNA, 25 bp, Homo sapien
aagggaaatattaataggtcttgca

SEQ ID NO: 7959 - DNA, 25 bp, Homo sapien
aagggaaccatcctgaattacctag

SEQ ID NO: 7960 - DNA, 25 bp, Homo sapien
aagggaaccgtcctgaattacctag

SEQ ID NO: 7961 - DNA, 25 bp, Homo sapien
aagggaactgacgagtcttgggtgc

SEQ ID NO: 7962 - DNA, 25 bp, Homo sapien
aagggaactgatgagtcttgggtgc

SEQ ID NO: 7963 - DNA, 25 bp, Homo sapien
aagggaagaatttagactcataggg

SEQ ID NO: 7964 - DNA, 25 bp, Homo sapien
aagggaagaatttatactcataggg

SEQ ID NO: 7965 - DNA, 25 bp, Homo sapien
aagggaagccaacttccgatgatta

SEQ ID NO: 7966 - DNA, 25 bp, Homo sapien
aagggaagccaatttccgatgatta

SEQ ID NO: 7967 - DNA, 25 bp, Homo sapien
aagggaaggtgctactgacatgtgc

SEQ ID NO: 7968 - DNA, 25 bp, Homo sapien
aagggaaggtggtactgacatgtgc

SEQ ID NO: 7969 - DNA, 25 bp, Homo sapien
aagggaagtcattatccactcctct

SEQ ID NO: 7970 - DNA, 25 bp, Homo sapien
aagggaagttattatccactcctct

SEQ ID NO: 7971 - DNA, 25 bp, Homo sapien
aagggaatctgagcatctcagaata

SEQ ID NO: 7972 - DNA, 25 bp, Homo sapien
aagggaatctgagcatgtcagaata

SEQ ID NO: 7973 - DNA, 25 bp, Homo sapien
aagggaatgaaccagtgttttccat

SEQ ID NO: 7974 - DNA, 25 bp, Homo sapien
aagggaatgaaccggtgttttccat

SEQ ID NO: 7975 - DNA, 25 bp, Homo sapien
aagggaatggagatccaggtttctg

SEQ ID NO: 7976 - DNA, 25 bp, Homo sapien
aagggaatggaggtccaggtttctg

SEQ ID NO: 7977 - DNA, 25 bp, Homo sapien
aagggacatcctaaaacagcttatg

SEQ ID NO: 7978 - DNA, 25 bp, Homo sapien
aagggacatcctaaaagagcttatg

SEQ ID NO: 7979 - DNA, 25 bp, Homo sapien
aagggacatcgaaatctcgacatcc

SEQ ID NO: 7980 - DNA, 25 bp, Homo sapien
aagggacatcggaatctcgacatcc

SEQ ID NO: 7981 - DNA, 25 bp, Homo sapien
aagggacccgcagcttcaattctgg

SEQ ID NO: 7982 - DNA, 25 bp, Homo sapien
aagggacccgcagtcatgttcattg

SEQ ID NO: 7983 - DNA, 25 bp, Homo sapien
aagggacctgcagcttcaattctgg

SEQ ID NO: 7984 - DNA, 25 bp, Homo sapien
aagggacctgcagtcatgttcattg

SEQ ID NO: 7985 - DNA, 25 bp, Homo sapien
aagggactgtagaccactgcataca

SEQ ID NO: 7986 - DNA, 25 bp, Homo sapien
aagggactgtagagcactgcataca

SEQ ID NO: 7987 - DNA, 25 bp, Homo sapien
aagggagagataggcttcaatgcaa

SEQ ID NO: 7988 - DNA, 25 bp, Homo sapien
aagggagagatgggcttcaatgcaa

SEQ ID NO: 7989 - DNA, 25 bp, Homo sapien
aagggagatcaacatgaaatgaaca

SEQ ID NO: 7990 - DNA, 25 bp, Homo sapien
aagggagatcaatatgaaatgaaca

SEQ ID NO: 7991 - DNA, 25 bp, Homo sapien
aagggagcaaagatgggttcctttg

SEQ ID NO: 7992 - DNA, 25 bp, Homo sapien
aagggagcaacatggcaccccagaa

SEQ ID NO: 7993 - DNA, 25 bp, Homo sapien
aagggagcagcatggcaccccagaa

SEQ ID NO: 7994 - DNA, 25 bp, Homo sapien
aagggagcgaagatgggttcctttg

SEQ ID NO: 7995 - DNA, 25 bp, Homo sapien
aagggaggatcaatcgcttgagcct

SEQ ID NO: 7996 - DNA, 25 bp, Homo sapien
aagggaggatcgatcgcttgagcct

SEQ ID NO: 7997 - DNA, 25 bp, Homo sapien
aagggaggttgacgaaatattatgc

SEQ ID NO: 7998 - DNA, 25 bp, Homo sapien
aagggaggttgatgaaatattatgc

SEQ ID NO: 7999 - DNA, 25 bp, Homo sapien
aagggatattaaccaagacccagca

SEQ ID NO: 8000 - DNA, 25 bp, Homo sapien
aagggatattaatcaagacccagca

SEQ ID NO: 8001 - DNA, 25 bp, Homo sapien
aagggatttttgaactgcatatttt

SEQ ID NO: 8002 - DNA, 25 bp, Homo sapien
aagggatttttgaattgcatatttt

SEQ ID NO: 8003 - DNA, 25 bp, Homo sapien
aagggcacactggtttctggaaagg

SEQ ID NO: 8004 - DNA, 25 bp, Homo sapien
aagggcacattggtttctggaaagg

SEQ ID NO: 8005 - DNA, 25 bp, Homo sapien
aagggcagtttttcacagcaccttg

SEQ ID NO: 8006 - DNA, 25 bp, Homo sapien
aagggcagtttttcacggcaccttg

SEQ ID NO: 8007 - DNA, 25 bp, Homo sapien
aagggcataacaggaacattaatca

SEQ ID NO: 8008 - DNA, 25 bp, Homo sapien
aagggcataacgggaacattaatca

SEQ ID NO: 8009 - DNA, 25 bp, Homo sapien
aagggcatacgttgcggcaaggatg

SEQ ID NO: 8010 - DNA, 25 bp, Homo sapien
aagggcatacgttgtggcaaggatg

SEQ ID NO: 8011 - DNA, 25 bp, Homo sapien
aagggccacatgccttcaatttggg

SEQ ID NO: 8012 - DNA, 25 bp, Homo sapien
aagggccacatgtcttcaatttggg

SEQ ID NO: 8013 - DNA, 25 bp, Homo sapien
aagggccactccaaactcttgaaac

SEQ ID NO: 8014 - DNA, 25 bp, Homo sapien
aagggccactctaaactcttgaaac

SEQ ID NO: 8015 - DNA, 25 bp, Homo sapien
aagggccagaaacacatggaaagct

SEQ ID NO: 8016 - DNA, 25 bp, Homo sapien
aagggccagaaactcatggaaagct

SEQ ID NO: 8017 - DNA, 25 bp, Homo sapien
aagggctaaagtttacatcataaag

SEQ ID NO: 8018 - DNA, 25 bp, Homo sapien
aagggctaaagtttacgtcataaag

SEQ ID NO: 8019 - DNA, 25 bp, Homo sapien
aagggctaacagtcaaaccatggta

SEQ ID NO: 8020 - DNA, 25 bp, Homo sapien
aagggctaagagtcaaaccatggta

SEQ ID NO: 8021 - DNA, 25 bp, Homo sapien
aagggctgtgctgcagcggtgtgtg

SEQ ID NO: 8022 - DNA, 25 bp, Homo sapien
aagggctgtgctgcagtggtgtgtg

SEQ ID NO: 8023 - DNA, 25 bp, Homo sapien
aagggcttcttcctcaaatatgtta

SEQ ID NO: 8024 - DNA, 25 bp, Homo sapien
aagggcttcttcttcaaatatgtta

SEQ ID NO: 8025 - DNA, 25 bp, Homo sapien
aaggggaagaaatagcattattgga

SEQ ID NO: 8026 - DNA, 25 bp, Homo sapien
aaggggaagaagtagcattattgga

SEQ ID NO: 8027 - DNA, 25 bp, Homo sapien
aaggggatgcagataaaagttgctg

SEQ ID NO: 8028 - DNA, 25 bp, Homo sapien
aaggggatgcaggtaaaagttgctg

SEQ ID NO: 8029 - DNA, 25 bp, Homo sapien
aaggggatgccatgtacaccactgg

SEQ ID NO: 8030 - DNA, 25 bp, Homo sapien
aaggggatgccatgtataccactgg

SEQ ID NO: 8031 - DNA, 25 bp, Homo sapien
aaggggcttagatttactacaaatt

SEQ ID NO: 8032 - DNA, 25 bp, Homo sapien
aaggggcttagatttattacaaatt

SEQ ID NO: 8033 - DNA, 25 bp, Homo sapien
aagggggaacagccatgtcttctga

SEQ ID NO: 8034 - DNA, 25 bp, Homo sapien
aagggggaacagccgtgtcttctga

SEQ ID NO: 8035 - DNA, 25 bp, Homo sapien
aagggggtcagaaacatttggatgg

SEQ ID NO: 8036 - DNA, 25 bp, Homo sapien
aagggggtcagaaatatttggatgg

SEQ ID NO: 8037 - DNA, 25 bp, Homo sapien
aagggtaaaaaataaacaagtcaga

SEQ ID NO: 8038 - DNA, 25 bp, Homo sapien
aagggtaagaaataaacaagtcaga

SEQ ID NO: 8039 - DNA, 25 bp, Homo sapien
aagggtaagatcggaaaccaactca

SEQ ID NO: 8040 - DNA, 25 bp, Homo sapien
aagggtaagatctgaaaccaactca

SEQ ID NO: 8041 - DNA, 25 bp, Homo sapien
aagggtatgcttaaattattgctat

SEQ ID NO: 8042 - DNA, 25 bp, Homo sapien
aagggtatgcttcaattattgctat

SEQ ID NO: 8043 - DNA, 25 bp, Homo sapien
aagggtcataaaaaagattcaagta

SEQ ID NO: 8044 - DNA, 25 bp, Homo sapien
aagggtcataaacaagattcaagta

SEQ ID NO: 8045 - DNA, 25 bp, Homo sapien
aagggtcatctacatggatactgaa

SEQ ID NO: 8046 - DNA, 25 bp, Homo sapien
aagggtcatctacgtggatactgaa

SEQ ID NO: 8047 - DNA, 25 bp, Homo sapien
aagggtctataaaagtagaaaagag

SEQ ID NO: 8048 - DNA, 25 bp, Homo sapien
aagggtctgtaaaagtagaaaagag

SEQ ID NO: 8049 - DNA, 25 bp, Homo sapien
aagggtgattggtacaactttctat

SEQ ID NO: 8050 - DNA, 25 bp, Homo sapien
aagggtgattggtagaactttctat

SEQ ID NO: 8051 - DNA, 25 bp, Homo sapien
aagggtgcatttatctgctgagtga

SEQ ID NO: 8052 - DNA, 25 bp, Homo sapien
aagggtgcatttgtctgctgagtga

SEQ ID NO: 8053 - DNA, 25 bp, Homo sapien
aagggtgtcggcagggagaatcccc

SEQ ID NO: 8054 - DNA, 25 bp, Homo sapien
aagggtgttggcagggagaatcccc

SEQ ID NO: 8055 - DNA, 25 bp, Homo sapien
aagggttaaagcagatagagattaa

SEQ ID NO: 8056 - DNA, 25 bp, Homo sapien
aagggttagagcagatagagattaa

SEQ ID NO: 8057 - DNA, 25 bp, Homo sapien
aagggttgacacagaaatacagacc

SEQ ID NO: 8058 - DNA, 25 bp, Homo sapien
aagggttgacacagaattacagacc

SEQ ID NO: 8059 - DNA, 25 bp, Homo sapien
aagggtttcagattaaacattttgt

SEQ ID NO: 8060 - DNA, 25 bp, Homo sapien
aagggtttcaggttaaacattttgt

SEQ ID NO: 8061 - DNA, 25 bp, Homo sapien
aagggtttctgttcaggatttagct

SEQ ID NO: 8062 - DNA, 25 bp, Homo sapien
aagggtttctgttcgggatttagct

SEQ ID NO: 8063 - DNA, 25 bp, Homo sapien
aagggtttgagaagaaatatgtcgg

SEQ ID NO: 8064 - DNA, 25 bp, Homo sapien
aagggtttgagaaggaatatgtcgg

SEQ ID NO: 8065 - DNA, 25 bp, Homo sapien
aaggtaaaacatagcatggaagaca

SEQ ID NO: 8066 - DNA, 25 bp, Homo sapien
aaggtaaaacatagtatggaagaca

SEQ ID NO: 8067 - DNA, 25 bp, Homo sapien
aaggtaaaatgaggacagaaactgt

SEQ ID NO: 8068 - DNA, 25 bp, Homo sapien
aaggtaaaatgagggcagaaactgt

SEQ ID NO: 8069 - DNA, 25 bp, Homo sapien
aaggtaaggcccaaagtattgattg

SEQ ID NO: 8070 - DNA, 25 bp, Homo sapien
aaggtaaggcccgaagtattgattg

SEQ ID NO: 8071 - DNA, 25 bp, Homo sapien
aaggtacaaactcacgtgcattaaa

SEQ ID NO: 8072 - DNA, 25 bp, Homo sapien
aaggtacagactcacgtgcattaaa

SEQ ID NO: 8073 - DNA, 25 bp, Homo sapien
aaggtacctaattatcacataaatc

SEQ ID NO: 8074 - DNA, 25 bp, Homo sapien
aaggtacctaattatctcataaatc

SEQ ID NO: 8075 - DNA, 25 bp, Homo sapien
aaggtacggatgagtaaagcacatg

SEQ ID NO: 8076 - DNA, 25 bp, Homo sapien
aaggtacggatgtgtaaagcacatg

SEQ ID NO: 8077 - DNA, 25 bp, Homo sapien
aaggtagagattcagttgctgggtg

SEQ ID NO: 8078 - DNA, 25 bp, Homo sapien
aaggtagaggttcagttgctgggtg

SEQ ID NO: 8079 - DNA, 25 bp, Homo sapien
aaggtagctttgccaactaagaccc

SEQ ID NO: 8080 - DNA, 25 bp, Homo sapien
aaggtagctttgccgactaagaccc

SEQ ID NO: 8081 - DNA, 25 bp, Homo sapien
aaggtaggaaatagcacggtgagta

SEQ ID NO: 8082 - DNA, 25 bp, Homo sapien
aaggtaggaaatagcatggtgagta

SEQ ID NO: 8083 - DNA, 25 bp, Homo sapien
aaggtagtgtttgccttcgttacat

SEQ ID NO: 8084 - DNA, 25 bp, Homo sapien
aaggtagtgtttgctttcgttacat

SEQ ID NO: 8085 - DNA, 25 bp, Homo sapien
aaggtataaactccacatgttgttt

SEQ ID NO: 8086 - DNA, 25 bp, Homo sapien
aaggtataaactccacgtgttgttt

SEQ ID NO: 8087 - DNA, 25 bp, Homo sapien
aaggtatgtattataagacctacag

SEQ ID NO: 8088 - DNA, 25 bp, Homo sapien
aaggtatgtattgtaagacctacag

SEQ ID NO: 8089 - DNA, 25 bp, Homo sapien
aaggtcaaacttttccatagcagct

SEQ ID NO: 8090 - DNA, 25 bp, Homo sapien
aaggtcaaacttttccgtagcagct

SEQ ID NO: 8091 - DNA, 25 bp, Homo sapien
aaggtcacaggataaaaggtcaata

SEQ ID NO: 8092 - DNA, 25 bp, Homo sapien
aaggtcacaggatacaaggtcaata

SEQ ID NO: 8093 - DNA, 25 bp, Homo sapien
aaggtcacctgcatttctttgtgag

SEQ ID NO: 8094 - DNA, 25 bp, Homo sapien
aaggtcacctgcatttttttgtgag

SEQ ID NO: 8095 - DNA, 25 bp, Homo sapien
aaggtcactagaaggatgctcacca

SEQ ID NO: 8096 - DNA, 25 bp, Homo sapien
aaggtcactagaagtatgctcacca

SEQ ID NO: 8097 - DNA, 25 bp, Homo sapien
aaggtcagccgaagaagtagaagaa

SEQ ID NO: 8098 - DNA, 25 bp, Homo sapien
aaggtcagctgaagaagtagaagaa

SEQ ID NO: 8099 - DNA, 25 bp, Homo sapien
aaggtcagggaacggggtcacaatg

SEQ ID NO: 8100 - DNA, 25 bp, Homo sapien
aaggtcagggaatggggtcacaatg

SEQ ID NO: 8101 - DNA, 25 bp, Homo sapien
aaggtcatttaactaccaggactaa

SEQ ID NO: 8102 - DNA, 25 bp, Homo sapien
aaggtcatttaacttccaggactaa

SEQ ID NO: 8103 - DNA, 25 bp, Homo sapien
aaggtccaggtcccattttctctac

SEQ ID NO: 8104 - DNA, 25 bp, Homo sapien
aaggtccaggtccccttttctctac

SEQ ID NO: 8105 - DNA, 25 bp, Homo sapien
aaggtcctgcgagctgcggctgttt

SEQ ID NO: 8106 - DNA, 25 bp, Homo sapien
aaggtcctgtgagctgcggctgttt

SEQ ID NO: 8107 - DNA, 25 bp, Homo sapien
aaggtctcatccgtattttcatcta

SEQ ID NO: 8108 - DNA, 25 bp, Homo sapien
aaggtctcgtccgtattttcatcta

SEQ ID NO: 8109 - DNA, 25 bp, Homo sapien
aaggtctgcccattccagaacattc

SEQ ID NO: 8110 - DNA, 25 bp, Homo sapien
aaggtctgcccattcccgaacattc

SEQ ID NO: 8111 - DNA, 25 bp, Homo sapien
aaggtcttgcctctaaagcccgcta

SEQ ID NO: 8112 - DNA, 25 bp, Homo sapien
aaggtcttgtctctaaagcccgcta

SEQ ID NO: 8113 - DNA, 25 bp, Homo sapien
aaggtcttttctctgcaccatccag

SEQ ID NO: 8114 - DNA, 25 bp, Homo sapien
aaggtcttttctctgcgccatccag

SEQ ID NO: 8115 - DNA, 25 bp, Homo sapien
aaggtgaaacagaaacagatcatcc

SEQ ID NO: 8116 - DNA, 25 bp, Homo sapien
aaggtgaaatagaaacagatcatcc

SEQ ID NO: 8117 - DNA, 25 bp, Homo sapien
aaggtgaacctcgcatattcttact

SEQ ID NO: 8118 - DNA, 25 bp, Homo sapien
aaggtgaaccttgcatattcttact

SEQ ID NO: 8119 - DNA, 25 bp, Homo sapien
aaggtgaagactacagtttacacac

SEQ ID NO: 8120 - DNA, 25 bp, Homo sapien
aaggtgaagactacggtttacacac

SEQ ID NO: 8121 - DNA, 25 bp, Homo sapien
aaggtgaggccaagagaatttcctg

SEQ ID NO: 8122 - DNA, 25 bp, Homo sapien
aaggtgaggccaagaggatttcctg

SEQ ID NO: 8123 - DNA, 25 bp, Homo sapien
aaggtgagtagacacagagaaaatc

SEQ ID NO: 8124 - DNA, 25 bp, Homo sapien
aaggtgagtagacgcagagaaaatc

SEQ ID NO: 8125 - DNA, 25 bp, Homo sapien
aaggtgattgacaaataaacttaat

SEQ ID NO: 8126 - DNA, 25 bp, Homo sapien
aaggtgattgacaagtaaacttaat

SEQ ID NO: 8127 - DNA, 25 bp, Homo sapien
aaggtgattgggacgagcttttcaa

SEQ ID NO: 8128 - DNA, 25 bp, Homo sapien
aaggtgattgggatgagcttttcaa

SEQ ID NO: 8129 - DNA, 25 bp, Homo sapien
aaggtgcaactgaagatcatcgtgg

SEQ ID NO: 8130 - DNA, 25 bp, Homo sapien
aaggtgcaattgaagatcatcgtgg

SEQ ID NO: 8131 - DNA, 25 bp, Homo sapien
aaggtgcataacggactcccttctc

SEQ ID NO: 8132 - DNA, 25 bp, Homo sapien
aaggtgcataatggactcccttctc

SEQ ID NO: 8133 - DNA, 25 bp, Homo sapien
aaggtgctacgagaacatgtatgaa

SEQ ID NO: 8134 - DNA, 25 bp, Homo sapien
aaggtgctatgagaacatgtatgaa

SEQ ID NO: 8135 - DNA, 25 bp, Homo sapien
aaggtgctcgtgaagattaaatgca

SEQ ID NO: 8136 - DNA, 25 bp, Homo sapien
aaggtgctcgtgaggattaaatgca

SEQ ID NO: 8137 - DNA, 25 bp, Homo sapien
aaggtgcttaatccgtttgggctac

SEQ ID NO: 8138 - DNA, 25 bp, Homo sapien
aaggtgcttaatctgtttgggctac

SEQ ID NO: 8139 - DNA, 25 bp, Homo sapien
aaggtgcttccgaaaggattcttac

SEQ ID NO: 8140 - DNA, 25 bp, Homo sapien
aaggtgcttccgcaaggattcttac

SEQ ID NO: 8141 - DNA, 25 bp, Homo sapien
aaggtggagtacagcctgggtatcc

SEQ ID NO: 8142 - DNA, 25 bp, Homo sapien
aaggtggagtacggcctgggtatcc

SEQ ID NO: 8143 - DNA, 25 bp, Homo sapien
aaggtggctatgtagacccggttcg

SEQ ID NO: 8144 - DNA, 25 bp, Homo sapien
aaggtggctatgtagagccggttcg

SEQ ID NO: 8145 - DNA, 25 bp, Homo sapien
aaggtggtacaatataacaagaacc

SEQ ID NO: 8146 - DNA, 25 bp, Homo sapien
aaggtggtacaatgtaacaagaacc

SEQ ID NO: 8147 - DNA, 25 bp, Homo sapien
aaggtggtgcgtgcagtacattttt

SEQ ID NO: 8148 - DNA, 25 bp, Homo sapien
aaggtggtgcgtggagtacattttt

SEQ ID NO: 8149 - DNA, 25 bp, Homo sapien
aaggtggttgtccgagtgcccaaag

SEQ ID NO: 8150 - DNA, 25 bp, Homo sapien
aaggtggttgtctgagtgcccaaag

SEQ ID NO: 8151 - DNA, 25 bp, Homo sapien
aaggtgtacaaaacaatagaaaagt

SEQ ID NO: 8152 - DNA, 25 bp, Homo sapien
aaggtgtacaaaagaatagaaaagt

SEQ ID NO: 8153 - DNA, 25 bp, Homo sapien
aaggtgtgaactttgaaaatttgac

SEQ ID NO: 8154 - DNA, 25 bp, Homo sapien
aaggtgtgatctttgaaaatttgac

SEQ ID NO: 8155 - DNA, 25 bp, Homo sapien
aaggtgttcatctgaattatcccct

SEQ ID NO: 8156 - DNA, 25 bp, Homo sapien
aaggtgttcatctggattatcccct

SEQ ID NO: 8157 - DNA, 25 bp, Homo sapien
aaggtgtttttgcatagcttgtccc

SEQ ID NO: 8158 - DNA, 25 bp, Homo sapien
aaggtgtttttgcgtagcttgtccc

SEQ ID NO: 8159 - DNA, 25 bp, Homo sapien
aaggttaagtagcattcccagagtg

SEQ ID NO: 8160 - DNA, 25 bp, Homo sapien
aaggttaagtagcatttccagagtg

SEQ ID NO: 8161 - DNA, 25 bp, Homo sapien
aaggttacagataccaggtaccagg

SEQ ID NO: 8162 - DNA, 25 bp, Homo sapien
aaggttacagatatcaggtaccagg

SEQ ID NO: 8163 - DNA, 25 bp, Homo sapien
aaggttacgcatctagcaagtggca

SEQ ID NO: 8164 - DNA, 25 bp, Homo sapien
aaggttactcatctagcaagtggca

SEQ ID NO: 8165 - DNA, 25 bp, Homo sapien
aaggttatatgacgatttgcagact

SEQ ID NO: 8166 - DNA, 25 bp, Homo sapien
aaggttatatgatgatttgcagact

SEQ ID NO: 8167 - DNA, 25 bp, Homo sapien
aaggttatttgaagaccaatctggc

SEQ ID NO: 8168 - DNA, 25 bp, Homo sapien
aaggttatttgaaggccaatctggc

SEQ ID NO: 8169 - DNA, 25 bp, Homo sapien
aaggttcctgcaattctaacatttg

SEQ ID NO: 8170 - DNA, 25 bp, Homo sapien
aaggttcctgcagttctaacatttg

SEQ ID NO: 8171 - DNA, 25 bp, Homo sapien
aaggttctcagtcacacctggcaga

SEQ ID NO: 8172 - DNA, 25 bp, Homo sapien
aaggttctcagtcccacctggcaga

SEQ ID NO: 8173 - DNA, 25 bp, Homo sapien
aaggttctctgcagaacaaggcaga

SEQ ID NO: 8174 - DNA, 25 bp, Homo sapien
aaggttctctgtagaacaaggcaga

SEQ ID NO: 8175 - DNA, 25 bp, Homo sapien
aaggttgaatccctacatgataaga

SEQ ID NO: 8176 - DNA, 25 bp, Homo sapien
aaggttgaatccctacgtgataaga

SEQ ID NO: 8177 - DNA, 25 bp, Homo sapien
aaggttgactcttccacattctatg

SEQ ID NO: 8178 - DNA, 25 bp, Homo sapien
aaggttgactcttctacattctatg

SEQ ID NO: 8179 - DNA, 25 bp, Homo sapien
aaggttgagtaccgatactgggggt

SEQ ID NO: 8180 - DNA, 25 bp, Homo sapien
aaggttgagtacggatactgggggt

SEQ ID NO: 8181 - DNA, 25 bp, Homo sapien
aaggttgcttgacaacatgctttcc

SEQ ID NO: 8182 - DNA, 25 bp, Homo sapien
aaggttgcttgacaacgtgctttcc

SEQ ID NO: 8183 - DNA, 25 bp, Homo sapien
aaggttggatttctttctccatggt

SEQ ID NO: 8184 - DNA, 25 bp, Homo sapien
aaggttggatttctttttccatggt

SEQ ID NO: 8185 - DNA, 25 bp, Homo sapien
aaggttgggcacatggcatcagcat

SEQ ID NO: 8186 - DNA, 25 bp, Homo sapien
aaggttgggcacgtggcatcagcat

SEQ ID NO: 8187 - DNA, 25 bp, Homo sapien
aaggttggggcatgcatcctctgaa

SEQ ID NO: 8188 - DNA, 25 bp, Homo sapien
aaggttggggcttgcatcctctgaa

SEQ ID NO: 8189 - DNA, 25 bp, Homo sapien
aaggttgtctcatcactgctaatgt

SEQ ID NO: 8190 - DNA, 25 bp, Homo sapien
aaggttgtctcatgactgctaatgt

SEQ ID NO: 8191 - DNA, 25 bp, Homo sapien
aaggttgtgcgtttaatctttagca

SEQ ID NO: 8192 - DNA, 25 bp, Homo sapien
aaggttgtgtgtttaatctttagca

SEQ ID NO: 8193 - DNA, 25 bp, Homo sapien
aaggttgttagattctaaatttact

SEQ ID NO: 8194 - DNA, 25 bp, Homo sapien
aaggttgttagattgtaaatttact

SEQ ID NO: 8195 - DNA, 25 bp, Homo sapien
aaggtttacggccctgaggatgccg

SEQ ID NO: 8196 - DNA, 25 bp, Homo sapien
aaggtttatggccctgaggatgccg

SEQ ID NO: 8197 - DNA, 25 bp, Homo sapien
aaggtttccagagatcacatgtgga

SEQ ID NO: 8198 - DNA, 25 bp, Homo sapien
aaggtttccagcgatcacatgtgga

SEQ ID NO: 8199 - DNA, 25 bp, Homo sapien
aaggtttccgactcagatcctggct

SEQ ID NO: 8200 - DNA, 25 bp, Homo sapien
aaggtttctgactcagatcctggct

SEQ ID NO: 8201 - DNA, 25 bp, Homo sapien
aaggtttgggtcattctgtcaggta

SEQ ID NO: 8202 - DNA, 25 bp, Homo sapien
aaggtttgggtcgttctgtcaggta

SEQ ID NO: 8203 - DNA, 25 bp, Homo sapien
aaggttttatcatattgtacatgtg

SEQ ID NO: 8204 - DNA, 25 bp, Homo sapien
aaggttttgtcatattgtacatgtg

SEQ ID NO: 8205 - DNA, 25 bp, Homo sapien
aagtaaaaaataatctgggcatcca

SEQ ID NO: 8206 - DNA, 25 bp, Homo sapien
aagtaaaaagagacaggtaaatcga

SEQ ID NO: 8207 - DNA, 25 bp, Homo sapien
aagtaaaaagagacgggtaaatcga

SEQ ID NO: 8208 - DNA, 25 bp, Homo sapien
aagtaaaatataatctgggcatcca

SEQ ID NO: 8209 - DNA, 25 bp, Homo sapien
aagtaaacacatgagtataaggcat

SEQ ID NO: 8210 - DNA, 25 bp, Homo sapien
aagtaaacagatgagtataaggcat

SEQ ID NO: 8211 - DNA, 25 bp, Homo sapien
aagtaaactctggccccagaacaac

SEQ ID NO: 8212 - DNA, 25 bp, Homo sapien
aagtaaactctgggcccagaacaac

SEQ ID NO: 8213 - DNA, 25 bp, Homo sapien
aagtaaagagaacagtatattatgg

SEQ ID NO: 8214 - DNA, 25 bp, Homo sapien
aagtaaagagaacagtgtattatgg

SEQ ID NO: 8215 - DNA, 25 bp, Homo sapien
aagtaaagtacacttagaagagggt

SEQ ID NO: 8216 - DNA, 25 bp, Homo sapien
aagtaaagtgcacttagaagagggt

SEQ ID NO: 8217 - DNA, 25 bp, Homo sapien
aagtaaataaaatggaacactgttg

SEQ ID NO: 8218 - DNA, 25 bp, Homo sapien
aagtaaataaagtggaacactgttg

SEQ ID NO: 8219 - DNA, 25 bp, Homo sapien
aagtaaatgtcatcttgagtgttaa

SEQ ID NO: 8220 - DNA, 25 bp, Homo sapien
aagtaaatgtcattttgagtgttaa

SEQ ID NO: 8221 - DNA, 25 bp, Homo sapien
aagtaaattcacctgttcttagaag

SEQ ID NO: 8222 - DNA, 25 bp, Homo sapien
aagtaaattcacttgttcttagaag

SEQ ID NO: 8223 - DNA, 25 bp, Homo sapien
aagtaacacaaagatcaatggatgt

SEQ ID NO: 8224 - DNA, 25 bp, Homo sapien
aagtaacacaaagttcaatggatgt

SEQ ID NO: 8225 - DNA, 25 bp, Homo sapien
aagtaaccaccagaaaaataaattg

SEQ ID NO: 8226 - DNA, 25 bp, Homo sapien
aagtaaccaccagacaaataaattg

SEQ ID NO: 8227 - DNA, 25 bp, Homo sapien
aagtaaccctaaagaaaatccacca

SEQ ID NO: 8228 - DNA, 25 bp, Homo sapien
aagtaaccttaaagaaaatccacca

SEQ ID NO: 8229 - DNA, 25 bp, Homo sapien
aagtaactacaaatataatgcttat

SEQ ID NO: 8230 - DNA, 25 bp, Homo sapien
aagtaactacaagtataatgcttat

SEQ ID NO: 8231 - DNA, 25 bp, Homo sapien
aagtaagaaaaatgctctagtctca

SEQ ID NO: 8232 - DNA, 25 bp, Homo sapien
aagtaagaaaaatgctgtagtctca

SEQ ID NO: 8233 - DNA, 25 bp, Homo sapien
aagtaagaaaatgacagagttgata

SEQ ID NO: 8234 - DNA, 25 bp, Homo sapien
aagtaagaagatgacagagttgata

SEQ ID NO: 8235 - DNA, 25 bp, Homo sapien
aagtaagaatgaatatagtccatcg

SEQ ID NO: 8236 - DNA, 25 bp, Homo sapien
aagtaagaatgcatatagtccatcg

SEQ ID NO: 8237 - DNA, 25 bp, Homo sapien
aagtaagcataacgcaaatcgatgc

SEQ ID NO: 8238 - DNA, 25 bp, Homo sapien
aagtaagcataatgcaaatcgatgc

SEQ ID NO: 8239 - DNA, 25 bp, Homo sapien
aagtaagcccttgttaacatgtgtg

SEQ ID NO: 8240 - DNA, 25 bp, Homo sapien
aagtaagctcttgttaacatgtgtg

SEQ ID NO: 8241 - DNA, 25 bp, Homo sapien
aagtaagcttggacagctgagttct

SEQ ID NO: 8242 - DNA, 25 bp, Homo sapien
aagtaagcttggccagctgagttct

SEQ ID NO: 8243 - DNA, 25 bp, Homo sapien
aagtaaggatgatcagagccctaga

SEQ ID NO: 8244 - DNA, 25 bp, Homo sapien
aagtaagggtgatcagagccctaga

SEQ ID NO: 8245 - DNA, 25 bp, Homo sapien
aagtaagtaaaaaataatctgggca

SEQ ID NO: 8246 - DNA, 25 bp, Homo sapien
aagtaagtaaaatataatctgggca

SEQ ID NO: 8247 - DNA, 25 bp, Homo sapien
aagtaagtgaacacaataatagcca

SEQ ID NO: 8248 - DNA, 25 bp, Homo sapien
aagtaagtgaacagaataatagcca

SEQ ID NO: 8249 - DNA, 25 bp, Homo sapien
aagtaataaaaccaagacttgaacc

SEQ ID NO: 8250 - DNA, 25 bp, Homo sapien
aagtaataaaaccgagacttgaacc

SEQ ID NO: 8251 - DNA, 25 bp, Homo sapien
aagtaataagagtcacaaccactat

SEQ ID NO: 8252 - DNA, 25 bp, Homo sapien
aagtaataagagtgacaaccactat

SEQ ID NO: 8253 - DNA, 25 bp, Homo sapien
aagtaatattgcccttgctccaaaa

SEQ ID NO: 8254 - DNA, 25 bp, Homo sapien
aagtaatattgcctttgctccaaaa

SEQ ID NO: 8255 - DNA, 25 bp, Homo sapien
aagtaatgactgcgctttggccccc

SEQ ID NO: 8256 - DNA, 25 bp, Homo sapien
aagtaatgactgtgctttggccccc

SEQ ID NO: 8257 - DNA, 25 bp, Homo sapien
aagtaatgtccattttacctattcc

SEQ ID NO: 8258 - DNA, 25 bp, Homo sapien
aagtaatgttcattttacctattcc

SEQ ID NO: 8259 - DNA, 25 bp, Homo sapien
aagtaattgttcttatcgcacctta

SEQ ID NO: 8260 - DNA, 25 bp, Homo sapien
aagtaattgttcttattgcacctta

SEQ ID NO: 8261 - DNA, 25 bp, Homo sapien
aagtaatttacccaacatcacatag

SEQ ID NO: 8262 - DNA, 25 bp, Homo sapien
aagtaatttacccatcatcacatag

SEQ ID NO: 8263 - DNA, 25 bp, Homo sapien
aagtacaaatgtcttcctgtaaaca

SEQ ID NO: 8264 - DNA, 25 bp, Homo sapien
aagtacaataatgtcggagtctaaa

SEQ ID NO: 8265 - DNA, 25 bp, Homo sapien
aagtacaattatgtcggagtctaaa

SEQ ID NO: 8266 - DNA, 25 bp, Homo sapien
aagtacaattgtcttcctgtaaaca

SEQ ID NO: 8267 - DNA, 25 bp, Homo sapien
aagtacacactggaaaattacagca

SEQ ID NO: 8268 - DNA, 25 bp, Homo sapien
aagtacaccctggaaaattacagca

SEQ ID NO: 8269 - DNA, 25 bp, Homo sapien
aagtacagacctaccaagtgcttaa

SEQ ID NO: 8270 - DNA, 25 bp, Homo sapien
aagtacagatctaccaagtgcttaa

SEQ ID NO: 8271 - DNA, 25 bp, Homo sapien
aagtacaggcaactaaagaatgatt

SEQ ID NO: 8272 - DNA, 25 bp, Homo sapien
aagtacaggcagctaaagaatgatt

SEQ ID NO: 8273 - DNA, 25 bp, Homo sapien
aagtacagtccacaaacatgagtgt

SEQ ID NO: 8274 - DNA, 25 bp, Homo sapien
aagtacagtccacaaatatgagtgt

SEQ ID NO: 8275 - DNA, 25 bp, Homo sapien
aagtaccactttaacccaccagact

SEQ ID NO: 8276 - DNA, 25 bp, Homo sapien
aagtaccattttaacccaccagact

SEQ ID NO: 8277 - DNA, 25 bp, Homo sapien
aagtaccttctcaataacacatgcc

SEQ ID NO: 8278 - DNA, 25 bp, Homo sapien
aagtaccttgtcaataacacatgcc

SEQ ID NO: 8279 - DNA, 25 bp, Homo sapien
aagtactattccggtattctagcta

SEQ ID NO: 8280 - DNA, 25 bp, Homo sapien
aagtactattcctgtattctagcta

SEQ ID NO: 8281 - DNA, 25 bp, Homo sapien
aagtacttgaaaccaggacctggaa

SEQ ID NO: 8282 - DNA, 25 bp, Homo sapien
aagtacttgaagccaggacctggaa

SEQ ID NO: 8283 - DNA, 25 bp, Homo sapien
aagtactttttagcagttaagtcca

SEQ ID NO: 8284 - DNA, 25 bp, Homo sapien
aagtactttttcgcagttaagtcca

SEQ ID NO: 8285 - DNA, 25 bp, Homo sapien
aagtagaggacagctgaaccaaggc

SEQ ID NO: 8286 - DNA, 25 bp, Homo sapien
aagtagagggcagctgaaccaaggc

SEQ ID NO: 8287 - DNA, 25 bp, Homo sapien
aagtagagtgctttctatgtacctg

SEQ ID NO: 8288 - DNA, 25 bp, Homo sapien
aagtagagtgctttctgtgtacctg

SEQ ID NO: 8289 - DNA, 25 bp, Homo sapien
aagtagataataagactgttgcctc

SEQ ID NO: 8290 - DNA, 25 bp, Homo sapien
aagtagataatcagactgttgcctc

SEQ ID NO: 8291 - DNA, 25 bp, Homo sapien
aagtagatactcacatattgaatag

SEQ ID NO: 8292 - DNA, 25 bp, Homo sapien
aagtagatactcatatattgaatag

SEQ ID NO: 8293 - DNA, 25 bp, Homo sapien
aagtagatgcagaaatgagagagga

SEQ ID NO: 8294 - DNA, 25 bp, Homo sapien
aagtagatgcagaagtgagagagga

SEQ ID NO: 8295 - DNA, 25 bp, Homo sapien
aagtagatttgtagaaaggttgttg

SEQ ID NO: 8296 - DNA, 25 bp, Homo sapien
aagtagatttgtagaagggttgttg

SEQ ID NO: 8297 - DNA, 25 bp, Homo sapien
aagtagcagaacatactccttataa

SEQ ID NO: 8298 - DNA, 25 bp, Homo sapien
aagtagcagaacatgctccttataa

SEQ ID NO: 8299 - DNA, 25 bp, Homo sapien
aagtagcagcaaacctaatgctctc

SEQ ID NO: 8300 - DNA, 25 bp, Homo sapien
aagtagcagcagacctaatgctctc

SEQ ID NO: 8301 - DNA, 25 bp, Homo sapien
aagtagccagggacatttgtctttc

SEQ ID NO: 8302 - DNA, 25 bp, Homo sapien
aagtagccagggatatttgtctttc

SEQ ID NO: 8303 - DNA, 25 bp, Homo sapien
aagtagcctatttcctctaaataac

SEQ ID NO: 8304 - DNA, 25 bp, Homo sapien
aagtagcctgtttcctctaaataac

SEQ ID NO: 8305 - DNA, 25 bp, Homo sapien
aagtagcttaactgtacgccaggag

SEQ ID NO: 8306 - DNA, 25 bp, Homo sapien
aagtagcttaactgtatgccaggag

SEQ ID NO: 8307 - DNA, 25 bp, Homo sapien
aagtaggcagacacattaggtggaa

SEQ ID NO: 8308 - DNA, 25 bp, Homo sapien
aagtaggcagacatattaggtggaa

SEQ ID NO: 8309 - DNA, 25 bp, Homo sapien
aagtaggcctgctactagttccaat

SEQ ID NO: 8310 - DNA, 25 bp, Homo sapien
aagtaggcctgctattagttccaat

SEQ ID NO: 8311 - DNA, 25 bp, Homo sapien
aagtagtcagaccggaaatgtacta

SEQ ID NO: 8312 - DNA, 25 bp, Homo sapien
aagtagtcagactggaaatgtacta

SEQ ID NO: 8313 - DNA, 25 bp, Homo sapien
aagtagtcgataattggacctgatt

SEQ ID NO: 8314 - DNA, 25 bp, Homo sapien
aagtagtcggtaattggacctgatt

SEQ ID NO: 8315 - DNA, 25 bp, Homo sapien
aagtagtctctacaaacacagggta

SEQ ID NO: 8316 - DNA, 25 bp, Homo sapien
aagtagtctctataaacacagggta

SEQ ID NO: 8317 - DNA, 25 bp, Homo sapien
aagtagttgggtaaagaaactgcca

SEQ ID NO: 8318 - DNA, 25 bp, Homo sapien
aagtagttgggtaaggaaactgcca

SEQ ID NO: 8319 - DNA, 25 bp, Homo sapien
aagtagtttgcactgtgcctggcac

SEQ ID NO: 8320 - DNA, 25 bp, Homo sapien
aagtagtttgcattgtgcctggcac

SEQ ID NO: 8321 - DNA, 25 bp, Homo sapien
aagtatacaacaaagctcatcattc

SEQ ID NO: 8322 - DNA, 25 bp, Homo sapien
aagtatacaacacagctcatcattc

SEQ ID NO: 8323 - DNA, 25 bp, Homo sapien
aagtatacacatattttgaaacaag

SEQ ID NO: 8324 - DNA, 25 bp, Homo sapien
aagtatacgcatattttgaaacaag

SEQ ID NO: 8325 - DNA, 25 bp, Homo sapien
aagtatagatgtaaagatgtatgtg

SEQ ID NO: 8326 - DNA, 25 bp, Homo sapien
aagtatagatgtaaaggtgtatgtg

SEQ ID NO: 8327 - DNA, 25 bp, Homo sapien
aagtatagggccattgaaaaacaca

SEQ ID NO: 8328 - DNA, 25 bp, Homo sapien
aagtatagggccgttgaaaaacaca

SEQ ID NO: 8329 - DNA, 25 bp, Homo sapien
aagtatagtaacagggctcatttgg

SEQ ID NO: 8330 - DNA, 25 bp, Homo sapien
aagtatagtaacagggttcatttgg

SEQ ID NO: 8331 - DNA, 25 bp, Homo sapien
aagtatagtcgtcctttaaatgttt

SEQ ID NO: 8332 - DNA, 25 bp, Homo sapien
aagtatagttgacataaccttggca

SEQ ID NO: 8333 - DNA, 25 bp, Homo sapien
aagtatagttgacgtaaccttggca

SEQ ID NO: 8334 - DNA, 25 bp, Homo sapien
aagtatagttgtcctttaaatgttt

SEQ ID NO: 8335 - DNA, 25 bp, Homo sapien
aagtatagtttctaagcctttaaga

SEQ ID NO: 8336 - DNA, 25 bp, Homo sapien
aagtatagtttttaagcctttaaga

SEQ ID NO: 8337 - DNA, 25 bp, Homo sapien
aagtatatcaagcagaaggaaccta

SEQ ID NO: 8338 - DNA, 25 bp, Homo sapien
aagtatatcgagcagaaggaaccta

SEQ ID NO: 8339 - DNA, 25 bp, Homo sapien
aagtatatgacaaccgcgacagcaa

SEQ ID NO: 8340 - DNA, 25 bp, Homo sapien
aagtatatgacaactgcgacagcaa

SEQ ID NO: 8341 - DNA, 25 bp, Homo sapien
aagtatatggtagcaccaggttttg

SEQ ID NO: 8342 - DNA, 25 bp, Homo sapien
aagtatatggtagtaccaggttttg

SEQ ID NO: 8343 - DNA, 25 bp, Homo sapien
aagtatatttagctcatttccaaat

SEQ ID NO: 8344 - DNA, 25 bp, Homo sapien
aagtatatttagttcatttccaaat

SEQ ID NO: 8345 - DNA, 25 bp, Homo sapien
aagtatcaacacggataagcaaaga

SEQ ID NO: 8346 - DNA, 25 bp, Homo sapien
aagtatcaacacgggtaagcaaaga

SEQ ID NO: 8347 - DNA, 25 bp, Homo sapien
aagtatcaaggtatatatgaagaga

SEQ ID NO: 8348 - DNA, 25 bp, Homo sapien
aagtatcagggtatatatgaagaga

SEQ ID NO: 8349 - DNA, 25 bp, Homo sapien
aagtatctccacgaggttggtcatt

SEQ ID NO: 8350 - DNA, 25 bp, Homo sapien
aagtatctccatgaggttggtcatt

SEQ ID NO: 8351 - DNA, 25 bp, Homo sapien
aagtatgatattaatagtgggctgg

SEQ ID NO: 8352 - DNA, 25 bp, Homo sapien
aagtatgatattgatagtgggctgg

SEQ ID NO: 8353 - DNA, 25 bp, Homo sapien
aagtatgattacagagtgaagacat

SEQ ID NO: 8354 - DNA, 25 bp, Homo sapien
aagtatgattacggagtgaagacat

SEQ ID NO: 8355 - DNA, 25 bp, Homo sapien
aagtatgcaaagtattaatcctgcg

SEQ ID NO: 8356 - DNA, 25 bp, Homo sapien
aagtatgcaaagtattgatcctgcg

SEQ ID NO: 8357 - DNA, 25 bp, Homo sapien
aagtatggacactaaccaactctac

SEQ ID NO: 8358 - DNA, 25 bp, Homo sapien
aagtatggacactacccaactctac

SEQ ID NO: 8359 - DNA, 25 bp, Homo sapien
aagtatggagcatggaaaaatgggc

SEQ ID NO: 8360 - DNA, 25 bp, Homo sapien
aagtatggagcctggaaaaatgggc

SEQ ID NO: 8361 - DNA, 25 bp, Homo sapien
aagtatgggaacaatagacactgga

SEQ ID NO: 8362 - DNA, 25 bp, Homo sapien
aagtatggggacaatagacactgga

SEQ ID NO: 8363 - DNA, 25 bp, Homo sapien
aagtatggtaccaagaagaaatatc

SEQ ID NO: 8364 - DNA, 25 bp, Homo sapien
aagtatggtacccagaagaaatatc

SEQ ID NO: 8365 - DNA, 25 bp, Homo sapien
aagtatgtgcagattcaagcaattc

SEQ ID NO: 8366 - DNA, 25 bp, Homo sapien
aagtatgtgtagattcaagcaattc

SEQ ID NO: 8367 - DNA, 25 bp, Homo sapien
aagtatgttgttctagcaccatgca

SEQ ID NO: 8368 - DNA, 25 bp, Homo sapien
aagtatgttgttctggcaccatgca

SEQ ID NO: 8369 - DNA, 25 bp, Homo sapien
aagtattagtctccaaagattagaa

SEQ ID NO: 8370 - DNA, 25 bp, Homo sapien
aagtattagtctccgaagattagaa

SEQ ID NO: 8371 - DNA, 25 bp, Homo sapien
aagtattgaggcttctcaggcaatg

SEQ ID NO: 8372 - DNA, 25 bp, Homo sapien
aagtattgaggtttctcaggcaatg

SEQ ID NO: 8373 - DNA, 25 bp, Homo sapien
aagtattggagttatagcatgagag

SEQ ID NO: 8374 - DNA, 25 bp, Homo sapien
aagtattggagttctagcatgagag

SEQ ID NO: 8375 - DNA, 25 bp, Homo sapien
aagtattgtattagtttcctcttgc

SEQ ID NO: 8376 - DNA, 25 bp, Homo sapien
aagtattgtattcgtttcctcttgc

SEQ ID NO: 8377 - DNA, 25 bp, Homo sapien
aagtatttaatagcaattacgtgtt

SEQ ID NO: 8378 - DNA, 25 bp, Homo sapien
aagtatttagtagcaattacgtgtt

SEQ ID NO: 8379 - DNA, 25 bp, Homo sapien
aagtatttcatgacgtcttgaggca

SEQ ID NO: 8380 - DNA, 25 bp, Homo sapien
aagtatttcatgatgtcttgaggca

SEQ ID NO: 8381 - DNA, 25 bp, Homo sapien
aagtcaaaaatttaccatcctggct

SEQ ID NO: 8382 - DNA, 25 bp, Homo sapien
aagtcaaaagtttaccatcctggct

SEQ ID NO: 8383 - DNA, 25 bp, Homo sapien
aagtcaacatgaaaaaaaataatgc

SEQ ID NO: 8384 - DNA, 25 bp, Homo sapien
aagtcaacatgagaaaaaataatgc

SEQ ID NO: 8385 - DNA, 25 bp, Homo sapien
aagtcaacatgctccgaatttatga

SEQ ID NO: 8386 - DNA, 25 bp, Homo sapien
aagtcaacatgctctgaatttatga

SEQ ID NO: 8387 - DNA, 25 bp, Homo sapien
aagtcaacattatttattcactaaa

SEQ ID NO: 8388 - DNA, 25 bp, Homo sapien
aagtcaacattgtttattcactaaa

SEQ ID NO: 8389 - DNA, 25 bp, Homo sapien
aagtcaagtatataatgacaaaaac

SEQ ID NO: 8390 - DNA, 25 bp, Homo sapien
aagtcaagtatgtaatgacaaaaac

SEQ ID NO: 8391 - DNA, 25 bp, Homo sapien
aagtcaatgaccatgagagaatgcc

SEQ ID NO: 8392 - DNA, 25 bp, Homo sapien
aagtcaatgactatgagagaatgcc

SEQ ID NO: 8393 - DNA, 25 bp, Homo sapien
aagtcacaagatgcccagttcaatt

SEQ ID NO: 8394 - DNA, 25 bp, Homo sapien
aagtcacacgttgtggacagcaaag

SEQ ID NO: 8395 - DNA, 25 bp, Homo sapien
aagtcacacgttgtgggcagcaaag

SEQ ID NO: 8396 - DNA, 25 bp, Homo sapien
aagtcacagaatgtcatttctattg

SEQ ID NO: 8397 - DNA, 25 bp, Homo sapien
aagtcacaggaaggcatactacagt

SEQ ID NO: 8398 - DNA, 25 bp, Homo sapien
aagtcacaggagggcatactacagt

SEQ ID NO: 8399 - DNA, 25 bp, Homo sapien
aagtcacaggatgcccagttcaatt

SEQ ID NO: 8400 - DNA, 25 bp, Homo sapien
aagtcacataatgtcatttctattg

SEQ ID NO: 8401 - DNA, 25 bp, Homo sapien
aagtcacatgaactaaaaagcatta

SEQ ID NO: 8402 - DNA, 25 bp, Homo sapien
aagtcacatgaactgaaaagcatta

SEQ ID NO: 8403 - DNA, 25 bp, Homo sapien
aagtcaccagttaccagagctgcaa

SEQ ID NO: 8404 - DNA, 25 bp, Homo sapien
aagtcaccagttgccagagctgcaa

SEQ ID NO: 8405 - DNA, 25 bp, Homo sapien
aagtcacgtggtcaaacccagagaa

SEQ ID NO: 8406 - DNA, 25 bp, Homo sapien
aagtcacgtggtcaaatccagagaa

SEQ ID NO: 8407 - DNA, 25 bp, Homo sapien
aagtcactgaaacgtgggtcagatg

SEQ ID NO: 8408 - DNA, 25 bp, Homo sapien
aagtcactgaaatgtgggtcagatg

SEQ ID NO: 8409 - DNA, 25 bp, Homo sapien
aagtcacttatctgagtcagccctt

SEQ ID NO: 8410 - DNA, 25 bp, Homo sapien
aagtcacttctctgagtcagccctt

SEQ ID NO: 8411 - DNA, 25 bp, Homo sapien
aagtcagaccctatcactcctctac

SEQ ID NO: 8412 - DNA, 25 bp, Homo sapien
aagtcagaccctatcagtcctctac

SEQ ID NO: 8413 - DNA, 25 bp, Homo sapien
aagtcagaggttcatccaaggcgct

SEQ ID NO: 8414 - DNA, 25 bp, Homo sapien
aagtcagaggttcgtccaaggcgct

SEQ ID NO: 8415 - DNA, 25 bp, Homo sapien
aagtcagagtttgccgcccaaaaaa

SEQ ID NO: 8416 - DNA, 25 bp, Homo sapien
aagtcagagtttgctgcccaaaaaa

SEQ ID NO: 8417 - DNA, 25 bp, Homo sapien
aagtcagtgatgttttatatactgt

SEQ ID NO: 8418 - DNA, 25 bp, Homo sapien
aagtcagtgatgttttctatactgt

SEQ ID NO: 8419 - DNA, 25 bp, Homo sapien
aagtcataccttgattttcaatact

SEQ ID NO: 8420 - DNA, 25 bp, Homo sapien
aagtcatacgtgtagagaagagtcc

SEQ ID NO: 8421 - DNA, 25 bp, Homo sapien
aagtcatactttgattttcaatact

SEQ ID NO: 8422 - DNA, 25 bp, Homo sapien
aagtcatatgtgtagagaagagtcc

SEQ ID NO: 8423 - DNA, 25 bp, Homo sapien
aagtcatccggtcctttgtcactaa

SEQ ID NO: 8424 - DNA, 25 bp, Homo sapien
aagtcatcgggtcctttgtcactaa

SEQ ID NO: 8425 - DNA, 25 bp, Homo sapien
aagtcatgaaagtaaccagtggaac

SEQ ID NO: 8426 - DNA, 25 bp, Homo sapien
aagtcatggaagtaaccagtggaac

SEQ ID NO: 8427 - DNA, 25 bp, Homo sapien
aagtcatggctagcagcatttccct

SEQ ID NO: 8428 - DNA, 25 bp, Homo sapien
aagtcatggctagcggcatttccct

SEQ ID NO: 8429 - DNA, 25 bp, Homo sapien
aagtcattgctagagaggctttagg

SEQ ID NO: 8430 - DNA, 25 bp, Homo sapien
aagtcattgctggagaggctttagg

SEQ ID NO: 8431 - DNA, 25 bp, Homo sapien
aagtcatttcaaattttcactatca

SEQ ID NO: 8432 - DNA, 25 bp, Homo sapien
aagtcatttccacttaaaaaaatga

SEQ ID NO: 8433 - DNA, 25 bp, Homo sapien
aagtcatttccagttaaaaaaatga

SEQ ID NO: 8434 - DNA, 25 bp, Homo sapien
aagtcattttaaattttcactatca

SEQ ID NO: 8435 - DNA, 25 bp, Homo sapien
aagtccaaagtggtggccattacct

SEQ ID NO: 8436 - DNA, 25 bp, Homo sapien
aagtccaaagtgttggccattacct

SEQ ID NO: 8437 - DNA, 25 bp, Homo sapien
aagtccacacgctcaggtttgccta

SEQ ID NO: 8438 - DNA, 25 bp, Homo sapien
aagtccacatgcaagttgagacctg

SEQ ID NO: 8439 - DNA, 25 bp, Homo sapien
aagtccacatgctcaggtttgccta

SEQ ID NO: 8440 - DNA, 25 bp, Homo sapien
aagtccacatgtaagttgagacctg

SEQ ID NO: 8441 - DNA, 25 bp, Homo sapien
aagtccagtttatccaagtccaaga

SEQ ID NO: 8442 - DNA, 25 bp, Homo sapien
aagtccagtttatccaggtccaaga

SEQ ID NO: 8443 - DNA, 25 bp, Homo sapien
aagtccatcttttcgaggccattca

SEQ ID NO: 8444 - DNA, 25 bp, Homo sapien
aagtccatctttttgaggccattca

SEQ ID NO: 8445 - DNA, 25 bp, Homo sapien
aagtcccagacatctgagcagcagt

SEQ ID NO: 8446 - DNA, 25 bp, Homo sapien
aagtcccagacatctgggcagcagt

SEQ ID NO: 8447 - DNA, 25 bp, Homo sapien
aagtcccttctgccatacatgtgaa

SEQ ID NO: 8448 - DNA, 25 bp, Homo sapien
aagtcccttctgtcatacatgtgaa

SEQ ID NO: 8449 - DNA, 25 bp, Homo sapien
aagtccgtacttgccattttctctt

SEQ ID NO: 8450 - DNA, 25 bp, Homo sapien
aagtccgtacttggcattttctctt

SEQ ID NO: 8451 - DNA, 25 bp, Homo sapien
aagtcctagtcaaagtagttgggat

SEQ ID NO: 8452 - DNA, 25 bp, Homo sapien
aagtcctagtcaaagtggttgggat

SEQ ID NO: 8453 - DNA, 25 bp, Homo sapien
aagtcctatataacatcttccaata

SEQ ID NO: 8454 - DNA, 25 bp, Homo sapien
aagtcctatataacgtcttccaata

SEQ ID NO: 8455 - DNA, 25 bp, Homo sapien
aagtcctatctgctttaatctttac

SEQ ID NO: 8456 - DNA, 25 bp, Homo sapien
aagtcctatcttctttaatctttac

SEQ ID NO: 8457 - DNA, 25 bp, Homo sapien
aagtcgaactgttacctttccagaa

SEQ ID NO: 8458 - DNA, 25 bp, Homo sapien
aagtcgaactgtttcctttccagaa

SEQ ID NO: 8459 - DNA, 25 bp, Homo sapien
aagtcgcttaattcaggaggcagag

SEQ ID NO: 8460 - DNA, 25 bp, Homo sapien
aagtcgcttaattcgggaggcagag

SEQ ID NO: 8461 - DNA, 25 bp, Homo sapien
aagtctaaaaaaaccctgaaatctg

SEQ ID NO: 8462 - DNA, 25 bp, Homo sapien
aagtctaaaaaacccctgaaatctg

SEQ ID NO: 8463 - DNA, 25 bp, Homo sapien
aagtctacaggcctttaagcctctg

SEQ ID NO: 8464 - DNA, 25 bp, Homo sapien
aagtctacaggcgtttaagcctctg

SEQ ID NO: 8465 - DNA, 25 bp, Homo sapien
aagtctactcgtggtccctgaaata

SEQ ID NO: 8466 - DNA, 25 bp, Homo sapien
aagtctactcgttgtccctgaaata

SEQ ID NO: 8467 - DNA, 25 bp, Homo sapien
aagtctagggtatacacagtagcat

SEQ ID NO: 8468 - DNA, 25 bp, Homo sapien
aagtctagggtatatacagtagcat

SEQ ID NO: 8469 - DNA, 25 bp, Homo sapien
aagtctaggtgttcaaaccaactcc

SEQ ID NO: 8470 - DNA, 25 bp, Homo sapien
aagtctaggtgttcgaaccaactcc

SEQ ID NO: 8471 - DNA, 25 bp, Homo sapien
aagtctatgagacggactaacaccc

SEQ ID NO: 8472 - DNA, 25 bp, Homo sapien
aagtctatgagatggactaacaccc

SEQ ID NO: 8473 - DNA, 25 bp, Homo sapien
aagtctcaaaattaatgttccagtc

SEQ ID NO: 8474 - DNA, 25 bp, Homo sapien
aagtctcaaaatttatgttccagtc

SEQ ID NO: 8475 - DNA, 25 bp, Homo sapien
aagtctcaaatccatttccttgacc

SEQ ID NO: 8476 - DNA, 25 bp, Homo sapien
aagtctcaaatccttttccttgacc

SEQ ID NO: 8477 - DNA, 25 bp, Homo sapien
aagtctcactttcgctgttcttcct

SEQ ID NO: 8478 - DNA, 25 bp, Homo sapien
aagtctcacttttgctgttcttcct

SEQ ID NO: 8479 - DNA, 25 bp, Homo sapien
aagtctccatgagatcacttaggaa

SEQ ID NO: 8480 - DNA, 25 bp, Homo sapien
aagtctccatgagatcgcttaggaa

SEQ ID NO: 8481 - DNA, 25 bp, Homo sapien
aagtctctccctatgtgtcagcctc

SEQ ID NO: 8482 - DNA, 25 bp, Homo sapien
aagtctctccctgtgtgtcagcctc

SEQ ID NO: 8483 - DNA, 25 bp, Homo sapien
aagtctctgaacataccgtacttgt

SEQ ID NO: 8484 - DNA, 25 bp, Homo sapien
aagtctctgaacatactgtacttgt

SEQ ID NO: 8485 - DNA, 25 bp, Homo sapien
aagtctcttttaccacatgaaatga

SEQ ID NO: 8486 - DNA, 25 bp, Homo sapien
aagtctcttttaccgcatgaaatga

SEQ ID NO: 8487 - DNA, 25 bp, Homo sapien
aagtctgaaatcaaggtgtaaagag

SEQ ID NO: 8488 - DNA, 25 bp, Homo sapien
aagtctgaaatcaatgtgtaaagag

SEQ ID NO: 8489 - DNA, 25 bp, Homo sapien
aagtctgactcaaaagcgcactgtc

SEQ ID NO: 8490 - DNA, 25 bp, Homo sapien
aagtctgactcaaaggcgcactgtc

SEQ ID NO: 8491 - DNA, 25 bp, Homo sapien
aagtctgcataaatgtgggatgcct

SEQ ID NO: 8492 - DNA, 25 bp, Homo sapien
aagtctgcataactgtgggatgcct

SEQ ID NO: 8493 - DNA, 25 bp, Homo sapien
aagtctgcatacatatagcctcctc

SEQ ID NO: 8494 - DNA, 25 bp, Homo sapien
aagtctgcgtacatatagcctcctc

SEQ ID NO: 8495 - DNA, 25 bp, Homo sapien
aagtctgcttgaaaacccatcaaag

SEQ ID NO: 8496 - DNA, 25 bp, Homo sapien
aagtctgcttggaaacccatcaaag

SEQ ID NO: 8497 - DNA, 25 bp, Homo sapien
aagtctggtcaaactccttcctttt

SEQ ID NO: 8498 - DNA, 25 bp, Homo sapien
aagtctggtcaaactctttcctttt

SEQ ID NO: 8499 - DNA, 25 bp, Homo sapien
aagtctgtatacgagtttaagtcca

SEQ ID NO: 8500 - DNA, 25 bp, Homo sapien
aagtctgtatatgagtttaagtcca

SEQ ID NO: 8501 - DNA, 25 bp, Homo sapien
aagtcttagaagcgttgttttttct

SEQ ID NO: 8502 - DNA, 25 bp, Homo sapien
aagtcttagaagggttgttttttct

SEQ ID NO: 8503 - DNA, 25 bp, Homo sapien
aagtcttcccatggcttctcttatc

SEQ ID NO: 8504 - DNA, 25 bp, Homo sapien
aagtcttcctatggcttctcttatc

SEQ ID NO: 8505 - DNA, 25 bp, Homo sapien
aagtcttgcagtattgcttaaccct

SEQ ID NO: 8506 - DNA, 25 bp, Homo sapien
aagtcttgcagtattgtttaaccct

SEQ ID NO: 8507 - DNA, 25 bp, Homo sapien
aagtcttgctaagtgtattttctga

SEQ ID NO: 8508 - DNA, 25 bp, Homo sapien
aagtcttgctaattgtattttctga

SEQ ID NO: 8509 - DNA, 25 bp, Homo sapien
aagtctttaccaactcagtcaatgt

SEQ ID NO: 8510 - DNA, 25 bp, Homo sapien
aagtctttaccaattcagtcaatgt

SEQ ID NO: 8511 - DNA, 25 bp, Homo sapien
aagtctttaccagtgaagtgggtgt

SEQ ID NO: 8512 - DNA, 25 bp, Homo sapien
aagtctttaccagtgaggtgggtgt

SEQ ID NO: 8513 - DNA, 25 bp, Homo sapien
aagtcttttagcccatcttaaaatt

SEQ ID NO: 8514 - DNA, 25 bp, Homo sapien
aagtcttttagtccatcttaaaatt

SEQ ID NO: 8515 - DNA, 25 bp, Homo sapien
aagtgaaaagaatgcattaaggttt

SEQ ID NO: 8516 - DNA, 25 bp, Homo sapien
aagtgaaaataatgcattaaggttt

SEQ ID NO: 8517 - DNA, 25 bp, Homo sapien
aagtgaaacaggataaaatgagtag

SEQ ID NO: 8518 - DNA, 25 bp, Homo sapien
aagtgaaacgggataaaatgagtag

SEQ ID NO: 8519 - DNA, 25 bp, Homo sapien
aagtgaaactcagataaattaaatt

SEQ ID NO: 8520 - DNA, 25 bp, Homo sapien
aagtgaaactcggataaattaaatt

SEQ ID NO: 8521 - DNA, 25 bp, Homo sapien
aagtgaaagacagaaacagatattc

SEQ ID NO: 8522 - DNA, 25 bp, Homo sapien
aagtgaaagacggaaacagatattc

SEQ ID NO: 8523 - DNA, 25 bp, Homo sapien
aagtgaacacaataatagccaaata

SEQ ID NO: 8524 - DNA, 25 bp, Homo sapien
aagtgaacacccttttttgccaagg

SEQ ID NO: 8525 - DNA, 25 bp, Homo sapien
aagtgaacactcagctcaaagtcca

SEQ ID NO: 8526 - DNA, 25 bp, Homo sapien
aagtgaacactcggctcaaagtcca

SEQ ID NO: 8527 - DNA, 25 bp, Homo sapien
aagtgaacagaataatagccaaata

SEQ ID NO: 8528 - DNA, 25 bp, Homo sapien
aagtgaacagccttttttgccaagg

SEQ ID NO: 8529 - DNA, 25 bp, Homo sapien
aagtgaaccctcaaacacaaaacac

SEQ ID NO: 8530 - DNA, 25 bp, Homo sapien
aagtgaaccctcaagcacaaaacac

SEQ ID NO: 8531 - DNA, 25 bp, Homo sapien
aagtgaactgaaagctcagtccaag

SEQ ID NO: 8532 - DNA, 25 bp, Homo sapien
aagtgaactgaatgctcagtccaag

SEQ ID NO: 8533 - DNA, 25 bp, Homo sapien
aagtgaacttagttcggagctacct

SEQ ID NO: 8534 - DNA, 25 bp, Homo sapien
aagtgaacttagtttggagctacct

SEQ ID NO: 8535 - DNA, 25 bp, Homo sapien
aagtgaagcgatactgaccataaaa

SEQ ID NO: 8536 - DNA, 25 bp, Homo sapien
aagtgaagctatactgaccataaaa

SEQ ID NO: 8537 - DNA, 25 bp, Homo sapien
aagtgaagtatatcaagcagaagga

SEQ ID NO: 8538 - DNA, 25 bp, Homo sapien
aagtgaagtatatcgagcagaagga

SEQ ID NO: 8539 - DNA, 25 bp, Homo sapien
aagtgaagttgctgtcaggtaactt

SEQ ID NO: 8540 - DNA, 25 bp, Homo sapien
aagtgaagttggtgtcaggtaactt

SEQ ID NO: 8541 - DNA, 25 bp, Homo sapien
aagtgaattaaacagagaagactag

SEQ ID NO: 8542 - DNA, 25 bp, Homo sapien
aagtgaattaaacggagaagactag

SEQ ID NO: 8543 - DNA, 25 bp, Homo sapien
aagtgacagaagggatgtatatgta

SEQ ID NO: 8544 - DNA, 25 bp, Homo sapien
aagtgacagaagggttgtatatgta

SEQ ID NO: 8545 - DNA, 25 bp, Homo sapien
aagtgaccaatttgcacagtaaggt

SEQ ID NO: 8546 - DNA, 25 bp, Homo sapien
aagtgaccgatttgcacagtaaggt

SEQ ID NO: 8547 - DNA, 25 bp, Homo sapien
aagtgacctacactggagtcctgaa

SEQ ID NO: 8548 - DNA, 25 bp, Homo sapien
aagtgacctacattggagtcctgaa

SEQ ID NO: 8549 - DNA, 25 bp, Homo sapien
aagtgacggtagaaaaattataatg

SEQ ID NO: 8550 - DNA, 25 bp, Homo sapien
aagtgacggtaggaaaattataatg

SEQ ID NO: 8551 - DNA, 25 bp, Homo sapien
aagtgacttagaaaccagtttagag

SEQ ID NO: 8552 - DNA, 25 bp, Homo sapien
aagtgacttagaaaccggtttagag

SEQ ID NO: 8553 - DNA, 25 bp, Homo sapien
aagtgactttcaaactagggtgagg

SEQ ID NO: 8554 - DNA, 25 bp, Homo sapien
aagtgactttcatactagggtgagg

SEQ ID NO: 8555 - DNA, 25 bp, Homo sapien
aagtgagaagcatgagaaaagctag

SEQ ID NO: 8556 - DNA, 25 bp, Homo sapien
aagtgagaagcatgggaaaagctag

SEQ ID NO: 8557 - DNA, 25 bp, Homo sapien
aagtgagaagttctgcctgtggagg

SEQ ID NO: 8558 - DNA, 25 bp, Homo sapien
aagtgagaagttttgcctgtggagg

SEQ ID NO: 8559 - DNA, 25 bp, Homo sapien
aagtgagatgacgtaaatagtttat

SEQ ID NO: 8560 - DNA, 25 bp, Homo sapien
aagtgagatgatgtaaatagtttat

SEQ ID NO: 8561 - DNA, 25 bp, Homo sapien
aagtgagctcttaggatgtctgatt

SEQ ID NO: 8562 - DNA, 25 bp, Homo sapien
aagtgagcttttaggatgtctgatt

SEQ ID NO: 8563 - DNA, 25 bp, Homo sapien
aagtgaggcttagagaactaaagta

SEQ ID NO: 8564 - DNA, 25 bp, Homo sapien
aagtgaggcttagagagctaaagta

SEQ ID NO: 8565 - DNA, 25 bp, Homo sapien
aagtgagtaaactctatctagctca

SEQ ID NO: 8566 - DNA, 25 bp, Homo sapien
aagtgagtaaattctatctagctca

SEQ ID NO: 8567 - DNA, 25 bp, Homo sapien
aagtgatacctttttctgtccttgt

SEQ ID NO: 8568 - DNA, 25 bp, Homo sapien
aagtgatacgtttttctgtccttgt

SEQ ID NO: 8569 - DNA, 25 bp, Homo sapien
aagtgatatgacctcggtgtttatt

SEQ ID NO: 8570 - DNA, 25 bp, Homo sapien
aagtgatatgacttcggtgtttatt

SEQ ID NO: 8571 - DNA, 25 bp, Homo sapien
aagtgatcatcaatttaaatcagcc

SEQ ID NO: 8572 - DNA, 25 bp, Homo sapien
aagtgatcatcattttaaatcagcc

SEQ ID NO: 8573 - DNA, 25 bp, Homo sapien
aagtgatcattttgcaactcctaac

SEQ ID NO: 8574 - DNA, 25 bp, Homo sapien
aagtgatcattttgcagctcctaac

SEQ ID NO: 8575 - DNA, 25 bp, Homo sapien
aagtgatccgggtgatggagggcag

SEQ ID NO: 8576 - DNA, 25 bp, Homo sapien
aagtgatctgggtgatggagggcag

SEQ ID NO: 8577 - DNA, 25 bp, Homo sapien
aagtgatgaggacctagatttgacc

SEQ ID NO: 8578 - DNA, 25 bp, Homo sapien
aagtgatgaggacttagatttgacc

SEQ ID NO: 8579 - DNA, 25 bp, Homo sapien
aagtgatgcaccggtctcggcctcc

SEQ ID NO: 8580 - DNA, 25 bp, Homo sapien
aagtgatgcgataacagctcctttt

SEQ ID NO: 8581 - DNA, 25 bp, Homo sapien
aagtgatgtaccggtctcggcctcc

SEQ ID NO: 8582 - DNA, 25 bp, Homo sapien
aagtgatgtgataacagctcctttt

SEQ ID NO: 8583 - DNA, 25 bp, Homo sapien
aagtgattaagaaacacttctgcca

SEQ ID NO: 8584 - DNA, 25 bp, Homo sapien
aagtgattaagaaacatttctgcca

SEQ ID NO: 8585 - DNA, 25 bp, Homo sapien
aagtgattctccttcacttttgctg

SEQ ID NO: 8586 - DNA, 25 bp, Homo sapien
aagtgattctctttcacttttgctg

SEQ ID NO: 8587 - DNA, 25 bp, Homo sapien
aagtgatttctttcggtgacaaagt

SEQ ID NO: 8588 - DNA, 25 bp, Homo sapien
aagtgatttcttttggtgacaaagt

SEQ ID NO: 8589 - DNA, 25 bp, Homo sapien
aagtgcatacgccgaagaggcattg

SEQ ID NO: 8590 - DNA, 25 bp, Homo sapien
aagtgcatacgctgaagaggcattg

SEQ ID NO: 8591 - DNA, 25 bp, Homo sapien
aagtgcatagaaacagaatagattt

SEQ ID NO: 8592 - DNA, 25 bp, Homo sapien
aagtgcatagaaatagaatagattt

SEQ ID NO: 8593 - DNA, 25 bp, Homo sapien
aagtgccaggacatggagaaacaat

SEQ ID NO: 8594 - DNA, 25 bp, Homo sapien
aagtgccaggacctggagaaacaat

SEQ ID NO: 8595 - DNA, 25 bp, Homo sapien
aagtgcccattaaactgtagtgggc

SEQ ID NO: 8596 - DNA, 25 bp, Homo sapien
aagtgcccattgaactgtagtgggc

SEQ ID NO: 8597 - DNA, 25 bp, Homo sapien
aagtgccctcaacttgaggcagtca

SEQ ID NO: 8598 - DNA, 25 bp, Homo sapien
aagtgccctcaatttgaggcagtca

SEQ ID NO: 8599 - DNA, 25 bp, Homo sapien
aagtgcctggtgaagctacagtgga

SEQ ID NO: 8600 - DNA, 25 bp, Homo sapien
aagtgcctggtggagctacagtgga

SEQ ID NO: 8601 - DNA, 25 bp, Homo sapien
aagtgccttaaagttggactagagt

SEQ ID NO: 8602 - DNA, 25 bp, Homo sapien
aagtgccttacacgttcacgcagtc

SEQ ID NO: 8603 - DNA, 25 bp, Homo sapien
aagtgccttacatgttcacgcagtc

SEQ ID NO: 8604 - DNA, 25 bp, Homo sapien
aagtgccttgaagttggactagagt

SEQ ID NO: 8605 - DNA, 25 bp, Homo sapien
aagtgcgtttaatgtagaggtgact

SEQ ID NO: 8606 - DNA, 25 bp, Homo sapien
aagtgcgtttaatttagaggtgact

SEQ ID NO: 8607 - DNA, 25 bp, Homo sapien
aagtgctaagaatataaatatccag

SEQ ID NO: 8608 - DNA, 25 bp, Homo sapien
aagtgctaattcattataaggttat

SEQ ID NO: 8609 - DNA, 25 bp, Homo sapien
aagtgctaattcgttataaggttat

SEQ ID NO: 8610 - DNA, 25 bp, Homo sapien
aagtgctaggaatataaatatccag

SEQ ID NO: 8611 - DNA, 25 bp, Homo sapien
aagtgctcaaagatatttcctgtaa

SEQ ID NO: 8612 - DNA, 25 bp, Homo sapien
aagtgctcagagatatttcctgtaa

SEQ ID NO: 8613 - DNA, 25 bp, Homo sapien
aagtgctcagtaactgcgtgtgact

SEQ ID NO: 8614 - DNA, 25 bp, Homo sapien
aagtgctcagtaactgtgtgtgact

SEQ ID NO: 8615 - DNA, 25 bp, Homo sapien
aagtgctctaggacataaccaataa

SEQ ID NO: 8616 - DNA, 25 bp, Homo sapien
aagtgctctagggcataaccaataa

SEQ ID NO: 8617 - DNA, 25 bp, Homo sapien
aagtggaaaaggataggctgagatt

SEQ ID NO: 8618 - DNA, 25 bp, Homo sapien
aagtggaataggataggctgagatt

SEQ ID NO: 8619 - DNA, 25 bp, Homo sapien
aagtggaattacattacgcaaatga

SEQ ID NO: 8620 - DNA, 25 bp, Homo sapien
aagtggaattacattaggcaaatga

SEQ ID NO: 8621 - DNA, 25 bp, Homo sapien
aagtggacagcctcattctcaagac

SEQ ID NO: 8622 - DNA, 25 bp, Homo sapien
aagtggacagcctccttctcaagac

SEQ ID NO: 8623 - DNA, 25 bp, Homo sapien
aagtggaccttgatgtgactcctgg

SEQ ID NO: 8624 - DNA, 25 bp, Homo sapien
aagtggaccttggtgtgactcctgg

SEQ ID NO: 8625 - DNA, 25 bp, Homo sapien
aagtggactttttaccttaatgtat

SEQ ID NO: 8626 - DNA, 25 bp, Homo sapien
aagtggactttttagcttaatgtat

SEQ ID NO: 8627 - DNA, 25 bp, Homo sapien
aagtggagaaattgaagatccctga

SEQ ID NO: 8628 - DNA, 25 bp, Homo sapien
aagtggagaaatttaagatccctga

SEQ ID NO: 8629 - DNA, 25 bp, Homo sapien
aagtggagattaaaatagtacctac

SEQ ID NO: 8630 - DNA, 25 bp, Homo sapien
aagtggagattaaaatcgtacctac

SEQ ID NO: 8631 - DNA, 25 bp, Homo sapien
aagtggaggaattgaagatccctga

SEQ ID NO: 8632 - DNA, 25 bp, Homo sapien
aagtggagtagacagcaggaaccaa

SEQ ID NO: 8633 - DNA, 25 bp, Homo sapien
aagtggagtagatagcaggaaccaa

SEQ ID NO: 8634 - DNA, 25 bp, Homo sapien
aagtggagtgttctttctgagtgga

SEQ ID NO: 8635 - DNA, 25 bp, Homo sapien
aagtggagttttctttctgagtgga

SEQ ID NO: 8636 - DNA, 25 bp, Homo sapien
aagtggatattttgtcatcattgag

SEQ ID NO: 8637 - DNA, 25 bp, Homo sapien
aagtggatattttgtcgtcattgag

SEQ ID NO: 8638 - DNA, 25 bp, Homo sapien
aagtggatggacagaaggatgctgc

SEQ ID NO: 8639 - DNA, 25 bp, Homo sapien
aagtggatggatagaaggatgctgc

SEQ ID NO: 8640 - DNA, 25 bp, Homo sapien
aagtggcctcaccctggacgctggg

SEQ ID NO: 8641 - DNA, 25 bp, Homo sapien
aagtggcctcatcctggacgctggg

SEQ ID NO: 8642 - DNA, 25 bp, Homo sapien
aagtggcgacggtatgactcaggct

SEQ ID NO: 8643 - DNA, 25 bp, Homo sapien
aagtggcgatggtatgactcaggct

SEQ ID NO: 8644 - DNA, 25 bp, Homo sapien
aagtggctcttcccatggacagtcc

SEQ ID NO: 8645 - DNA, 25 bp, Homo sapien
aagtggctcttcgcatggacagtcc

SEQ ID NO: 8646 - DNA, 25 bp, Homo sapien
aagtgggaagcacgtgagccaatgt

SEQ ID NO: 8647 - DNA, 25 bp, Homo sapien
aagtgggaagcatgtgagccaatgt

SEQ ID NO: 8648 - DNA, 25 bp, Homo sapien
aagtgggaataacaatgcccatcat

SEQ ID NO: 8649 - DNA, 25 bp, Homo sapien
aagtgggaatagcaatgcccatcat

SEQ ID NO: 8650 - DNA, 25 bp, Homo sapien
aagtgggcattatggtctttataac

SEQ ID NO: 8651 - DNA, 25 bp, Homo sapien
aagtgggcgttatggtctttataac

SEQ ID NO: 8652 - DNA, 25 bp, Homo sapien
aagtggtaaaatcttgatttctttg

SEQ ID NO: 8653 - DNA, 25 bp, Homo sapien
aagtggtaagatcttgatttctttg

SEQ ID NO: 8654 - DNA, 25 bp, Homo sapien
aagtggtcctccatgatctccacat

SEQ ID NO: 8655 - DNA, 25 bp, Homo sapien
aagtggtcctccgtgatctccacat

SEQ ID NO: 8656 - DNA, 25 bp, Homo sapien
aagtggttgcacatggttctttttt

SEQ ID NO: 8657 - DNA, 25 bp, Homo sapien
aagtggttggttcaaggtcacacca

SEQ ID NO: 8658 - DNA, 25 bp, Homo sapien
aagtggttggttccaggtcacacca

SEQ ID NO: 8659 - DNA, 25 bp, Homo sapien
aagtggttgtacatggttctttttt

SEQ ID NO: 8660 - DNA, 25 bp, Homo sapien
aagtgtaaacacgagtcccaggccc

SEQ ID NO: 8661 - DNA, 25 bp, Homo sapien
aagtgtaaagacgagtcccaggccc

SEQ ID NO: 8662 - DNA, 25 bp, Homo sapien
aagtgtaagccaacgattttatacc

SEQ ID NO: 8663 - DNA, 25 bp, Homo sapien
aagtgtaagccaatgattttatacc

SEQ ID NO: 8664 - DNA, 25 bp, Homo sapien
aagtgtacactgcagcattgttgac

SEQ ID NO: 8665 - DNA, 25 bp, Homo sapien
aagtgtacactgtagcattgttgac

SEQ ID NO: 8666 - DNA, 25 bp, Homo sapien
aagtgtaccaatagctctatataat

SEQ ID NO: 8667 - DNA, 25 bp, Homo sapien
aagtgtaccaatagctgtatataat

SEQ ID NO: 8668 - DNA, 25 bp, Homo sapien
aagtgtaccagctagaagtaactac

SEQ ID NO: 8669 - DNA, 25 bp, Homo sapien
aagtgtaccagctggaagtaactac

SEQ ID NO: 8670 - DNA, 25 bp, Homo sapien
aagtgtcagctgtagacctctctga

SEQ ID NO: 8671 - DNA, 25 bp, Homo sapien
aagtgtcagctgtagatctctctga

SEQ ID NO: 8672 - DNA, 25 bp, Homo sapien
aagtgtccaacatgcattctctcat

SEQ ID NO: 8673 - DNA, 25 bp, Homo sapien
aagtgtccaacgtgcattctctcat

SEQ ID NO: 8674 - DNA, 25 bp, Homo sapien
aagtgtcctacatttccaacaagat

SEQ ID NO: 8675 - DNA, 25 bp, Homo sapien
aagtgtcctacatttcgaacaagat

SEQ ID NO: 8676 - DNA, 25 bp, Homo sapien
aagtgtctacctaagataggctttt

SEQ ID NO: 8677 - DNA, 25 bp, Homo sapien
aagtgtctactatgtaacagataat

SEQ ID NO: 8678 - DNA, 25 bp, Homo sapien
aagtgtctactatgtatcagataat

SEQ ID NO: 8679 - DNA, 25 bp, Homo sapien
aagtgtctatcaagtgcatgagcga

SEQ ID NO: 8680 - DNA, 25 bp, Homo sapien
aagtgtctctcaagtgcatgagcga

SEQ ID NO: 8681 - DNA, 25 bp, Homo sapien
aagtgtctgaacacagcctacacag

SEQ ID NO: 8682 - DNA, 25 bp, Homo sapien
aagtgtctgaacatagcctacacag

SEQ ID NO: 8683 - DNA, 25 bp, Homo sapien
aagtgtctgcctaagataggctttt

SEQ ID NO: 8684 - DNA, 25 bp, Homo sapien
aagtgtgaatgacaatagcacagag

SEQ ID NO: 8685 - DNA, 25 bp, Homo sapien
aagtgtgaatgagaatagcacagag

SEQ ID NO: 8686 - DNA, 25 bp, Homo sapien
aagtgtgaattccgatttgaggatt

SEQ ID NO: 8687 - DNA, 25 bp, Homo sapien
aagtgtgaattctgatttgaggatt

SEQ ID NO: 8688 - DNA, 25 bp, Homo sapien
aagtgtgacctaaaccggtgatggt

SEQ ID NO: 8689 - DNA, 25 bp, Homo sapien
aagtgtgagactcaaagttagacaa

SEQ ID NO: 8690 - DNA, 25 bp, Homo sapien
aagtgtgagcctcaaagttagacaa

SEQ ID NO: 8691 - DNA, 25 bp, Homo sapien
aagtgtgagctaaaccggtgatggt

SEQ ID NO: 8692 - DNA, 25 bp, Homo sapien
aagtgtggttcaactatgtgagatg

SEQ ID NO: 8693 - DNA, 25 bp, Homo sapien
aagtgtggttcacctatgtgagatg

SEQ ID NO: 8694 - DNA, 25 bp, Homo sapien
aagtgtgtcatacgctgccaagttt

SEQ ID NO: 8695 - DNA, 25 bp, Homo sapien
aagtgtgtcataggctgccaagttt

SEQ ID NO: 8696 - DNA, 25 bp, Homo sapien
aagtgtgtgcctccatattttagca

SEQ ID NO: 8697 - DNA, 25 bp, Homo sapien
aagtgtgtgcctccgtattttagca

SEQ ID NO: 8698 - DNA, 25 bp, Homo sapien
aagtgtgtttataccatcttttcct

SEQ ID NO: 8699 - DNA, 25 bp, Homo sapien
aagtgtgtttatacgatcttttcct

SEQ ID NO: 8700 - DNA, 25 bp, Homo sapien
aagtgttaaaatatacctacaaatg

SEQ ID NO: 8701 - DNA, 25 bp, Homo sapien
aagtgttaaaatgtacctacaaatg

SEQ ID NO: 8702 - DNA, 25 bp, Homo sapien
aagtgttatacccttacgcaattta

SEQ ID NO: 8703 - DNA, 25 bp, Homo sapien
aagtgttatacccttaggcaattta

SEQ ID NO: 8704 - DNA, 25 bp, Homo sapien
aagtgttcctcaatcttggtgctat

SEQ ID NO: 8705 - DNA, 25 bp, Homo sapien
aagtgttcctcagtcttggtgctat

SEQ ID NO: 8706 - DNA, 25 bp, Homo sapien
aagtgttctcccatagaaataaaat

SEQ ID NO: 8707 - DNA, 25 bp, Homo sapien
aagtgttctcccgtagaaataaaat

SEQ ID NO: 8708 - DNA, 25 bp, Homo sapien
aagtgttggattcagacacgcatgc

SEQ ID NO: 8709 - DNA, 25 bp, Homo sapien
aagtgttggatttagacacgcatgc

SEQ ID NO: 8710 - DNA, 25 bp, Homo sapien
aagtgtttcatctagtgtggaaatt

SEQ ID NO: 8711 - DNA, 25 bp, Homo sapien
aagtgtttcatttagtgtggaaatt

SEQ ID NO: 8712 - DNA, 25 bp, Homo sapien
aagtgttttacacatcctgaggttg

SEQ ID NO: 8713 - DNA, 25 bp, Homo sapien
aagtgttttacatatcctgaggttg

SEQ ID NO: 8714 - DNA, 25 bp, Homo sapien
aagttaaaagttgcgatgatacaaa

SEQ ID NO: 8715 - DNA, 25 bp, Homo sapien
aagttaaaagttgtgatgatacaaa

SEQ ID NO: 8716 - DNA, 25 bp, Homo sapien
aagttaaaataaggcaagtgttcaa

SEQ ID NO: 8717 - DNA, 25 bp, Homo sapien
aagttaaaataaggtaagtgttcaa

SEQ ID NO: 8718 - DNA, 25 bp, Homo sapien
aagttaaattatctgtttatatcat

SEQ ID NO: 8719 - DNA, 25 bp, Homo sapien
aagttaaattatttgtttatatcat

SEQ ID NO: 8720 - DNA, 25 bp, Homo sapien
aagttaacaggctaatgcttacttg

SEQ ID NO: 8721 - DNA, 25 bp, Homo sapien
aagttaacaggctaattcttacttg

SEQ ID NO: 8722 - DNA, 25 bp, Homo sapien
aagttaatgcaaaagaatatcgagg

SEQ ID NO: 8723 - DNA, 25 bp, Homo sapien
aagttaatgcaaaagagtatcgagg

SEQ ID NO: 8724 - DNA, 25 bp, Homo sapien
aagttaccaatgttccactggttga

SEQ ID NO: 8725 - DNA, 25 bp, Homo sapien
aagttaccaatgtttcactggttga

SEQ ID NO: 8726 - DNA, 25 bp, Homo sapien
aagttactaagaagaggcaaatgtg

SEQ ID NO: 8727 - DNA, 25 bp, Homo sapien
aagttactcagaagaggcaaatgtg

SEQ ID NO: 8728 - DNA, 25 bp, Homo sapien
aagttagaaactatgacctagagca

SEQ ID NO: 8729 - DNA, 25 bp, Homo sapien
aagttagaatctatgacctagagca

SEQ ID NO: 8730 - DNA, 25 bp, Homo sapien
aagttaggcaatgagtccactaaat

SEQ ID NO: 8731 - DNA, 25 bp, Homo sapien
aagttaggcgatgagtccactaaat

SEQ ID NO: 8732 - DNA, 25 bp, Homo sapien
aagttatctatggccaactcatgca

SEQ ID NO: 8733 - DNA, 25 bp, Homo sapien
aagttatctatggccagctcatgca

SEQ ID NO: 8734 - DNA, 25 bp, Homo sapien
aagttattctcgtgttctccatttc

SEQ ID NO: 8735 - DNA, 25 bp, Homo sapien
aagttattctcgttttctccatttc

SEQ ID NO: 8736 - DNA, 25 bp, Homo sapien
aagttattgcacatgagataaagat

SEQ ID NO: 8737 - DNA, 25 bp, Homo sapien
aagttattgcacgtgagataaagat

SEQ ID NO: 8738 - DNA, 25 bp, Homo sapien
aagttatttgacaaaatttctcatg

SEQ ID NO: 8739 - DNA, 25 bp, Homo sapien
aagttatttgacataatttctcatg

SEQ ID NO: 8740 - DNA, 25 bp, Homo sapien
aagttcaacaatttttaaatcaggg

SEQ ID NO: 8741 - DNA, 25 bp, Homo sapien
aagttcaacaattttttaatcaggg

SEQ ID NO: 8742 - DNA, 25 bp, Homo sapien
aagttcaaggttaatttgatatgtg

SEQ ID NO: 8743 - DNA, 25 bp, Homo sapien
aagttcaaggttattttgatatgtg

SEQ ID NO: 8744 - DNA, 25 bp, Homo sapien
aagttcaattttttaaagacatgtt

SEQ ID NO: 8745 - DNA, 25 bp, Homo sapien
aagttcaattttttaaggacatgtt

SEQ ID NO: 8746 - DNA, 25 bp, Homo sapien
aagttcaggaaaatttagtcgttac

SEQ ID NO: 8747 - DNA, 25 bp, Homo sapien
aagttcaggaaagtttagtcgttac

SEQ ID NO: 8748 - DNA, 25 bp, Homo sapien
aagttcatcaaaatagccagggaaa

SEQ ID NO: 8749 - DNA, 25 bp, Homo sapien
aagttcatcaaagtagccagggaaa

SEQ ID NO: 8750 - DNA, 25 bp, Homo sapien
aagttcatgtgttaaaagaagcaat

SEQ ID NO: 8751 - DNA, 25 bp, Homo sapien
aagttcatgtgttagaagaagcaat

SEQ ID NO: 8752 - DNA, 25 bp, Homo sapien
aagttccacgtacactactatggtg

SEQ ID NO: 8753 - DNA, 25 bp, Homo sapien
aagttccagctcagagcacccaact

SEQ ID NO: 8754 - DNA, 25 bp, Homo sapien
aagttccagctcagagtacccaact

SEQ ID NO: 8755 - DNA, 25 bp, Homo sapien
aagttccaggccgcctgtttttact

SEQ ID NO: 8756 - DNA, 25 bp, Homo sapien
aagttccaggcctcctgtttttact

SEQ ID NO: 8757 - DNA, 25 bp, Homo sapien
aagttccatgtacactactatggtg

SEQ ID NO: 8758 - DNA, 25 bp, Homo sapien
aagttcctccaattcagaaagggat

SEQ ID NO: 8759 - DNA, 25 bp, Homo sapien
aagttcctccagttcagaaagggat

SEQ ID NO: 8760 - DNA, 25 bp, Homo sapien
aagttcctgctgagacccttgcaat

SEQ ID NO: 8761 - DNA, 25 bp, Homo sapien
aagttcctgctgcgacccttgcaat

SEQ ID NO: 8762 - DNA, 25 bp, Homo sapien
aagttctctttgcgtggcatttctc

SEQ ID NO: 8763 - DNA, 25 bp, Homo sapien
aagttctctttgtgtggcatttctc

SEQ ID NO: 8764 - DNA, 25 bp, Homo sapien
aagttctgatgaggacatcaagctg

SEQ ID NO: 8765 - DNA, 25 bp, Homo sapien
aagttctgatgagggcatcaagctg

SEQ ID NO: 8766 - DNA, 25 bp, Homo sapien
aagttctgattacattgtagagttt

SEQ ID NO: 8767 - DNA, 25 bp, Homo sapien
aagttctgattatattgtagagttt

SEQ ID NO: 8768 - DNA, 25 bp, Homo sapien
aagttctgccatcctgaggctaatt

SEQ ID NO: 8769 - DNA, 25 bp, Homo sapien
aagttctgccatcttgaggctaatt

SEQ ID NO: 8770 - DNA, 25 bp, Homo sapien
aagttcttaatgtactccaatgaaa

SEQ ID NO: 8771 - DNA, 25 bp, Homo sapien
aagttcttaatgtgctccaatgaaa

SEQ ID NO: 8772 - DNA, 25 bp, Homo sapien
aagttcttcatcatgcaccaggtag

SEQ ID NO: 8773 - DNA, 25 bp, Homo sapien
aagttcttcatcatgcgccaggtag

SEQ ID NO: 8774 - DNA, 25 bp, Homo sapien
aagttcttccaagccaccaccgaag

SEQ ID NO: 8775 - DNA, 25 bp, Homo sapien
aagttcttccaggccaccaccgaag

SEQ ID NO: 8776 - DNA, 25 bp, Homo sapien
aagttcttttccctgcctgacatac

SEQ ID NO: 8777 - DNA, 25 bp, Homo sapien
aagttcttttcccttcctgacatac

SEQ ID NO: 8778 - DNA, 25 bp, Homo sapien
aagttgaaaatatgatcaatccaag

SEQ ID NO: 8779 - DNA, 25 bp, Homo sapien
aagttgaaaatatggtcaatccaag

SEQ ID NO: 8780 - DNA, 25 bp, Homo sapien
aagttgaaattactccttactccat

SEQ ID NO: 8781 - DNA, 25 bp, Homo sapien
aagttgaaattagtccttactccat

SEQ ID NO: 8782 - DNA, 25 bp, Homo sapien
aagttgaaattgaataaccactgta

SEQ ID NO: 8783 - DNA, 25 bp, Homo sapien
aagttgaacaaataacccaagttta

SEQ ID NO: 8784 - DNA, 25 bp, Homo sapien
aagttgaacaaattacccaagttta

SEQ ID NO: 8785 - DNA, 25 bp, Homo sapien
aagttgaaccacttttgcatcactg

SEQ ID NO: 8786 - DNA, 25 bp, Homo sapien
aagttgaaccatttttgcatcactg

SEQ ID NO: 8787 - DNA, 25 bp, Homo sapien
aagttgaacctgtcaaattgagttc

SEQ ID NO: 8788 - DNA, 25 bp, Homo sapien
aagttgaacctgttaaattgagttc

SEQ ID NO: 8789 - DNA, 25 bp, Homo sapien
aagttgaagttgaataaccactgta

SEQ ID NO: 8790 - DNA, 25 bp, Homo sapien
aagttgaatctcagctctgccacat

SEQ ID NO: 8791 - DNA, 25 bp, Homo sapien
aagttgaatctcagctttgccacat

SEQ ID NO: 8792 - DNA, 25 bp, Homo sapien
aagttgacaaggataaacctatcat

SEQ ID NO: 8793 - DNA, 25 bp, Homo sapien
aagttgacaaggctaaacctatcat

SEQ ID NO: 8794 - DNA, 25 bp, Homo sapien
aagttgacacccgatcactcaatat

SEQ ID NO: 8795 - DNA, 25 bp, Homo sapien
aagttgacaccggatcactcaatat

SEQ ID NO: 8796 - DNA, 25 bp, Homo sapien
aagttgactttaagatcgcataatg

SEQ ID NO: 8797 - DNA, 25 bp, Homo sapien
aagttgactttaagattgcataatg

SEQ ID NO: 8798 - DNA, 25 bp, Homo sapien
aagttgagacaatggcttaacatgg

SEQ ID NO: 8799 - DNA, 25 bp, Homo sapien
aagttgaggcaatggcttaacatgg

SEQ ID NO: 8800 - DNA, 25 bp, Homo sapien
aagttgagtacaaaaggatttatct

SEQ ID NO: 8801 - DNA, 25 bp, Homo sapien
aagttgagtccaaaaggatttatct

SEQ ID NO: 8802 - DNA, 25 bp, Homo sapien
aagttgatataggtttaagttatgt

SEQ ID NO: 8803 - DNA, 25 bp, Homo sapien
aagttgatgtaggtttaagttatgt

SEQ ID NO: 8804 - DNA, 25 bp, Homo sapien
aagttgatgtcacctaatgtaaaaa

SEQ ID NO: 8805 - DNA, 25 bp, Homo sapien
aagttgatgtcacctagtgtaaaaa

SEQ ID NO: 8806 - DNA, 25 bp, Homo sapien
aagttgattccagatgttcagcttt

SEQ ID NO: 8807 - DNA, 25 bp, Homo sapien
aagttgatttcagatgttcagcttt

SEQ ID NO: 8808 - DNA, 25 bp, Homo sapien
aagttgcacactagctacagcagag

SEQ ID NO: 8809 - DNA, 25 bp, Homo sapien
aagttgcacactaggtacagcagag

SEQ ID NO: 8810 - DNA, 25 bp, Homo sapien
aagttgcacttgaattttgaaatac

SEQ ID NO: 8811 - DNA, 25 bp, Homo sapien
aagttgcatttgaattttgaaatac

SEQ ID NO: 8812 - DNA, 25 bp, Homo sapien
aagttgccatatccatttctgtgat

SEQ ID NO: 8813 - DNA, 25 bp, Homo sapien
aagttgccatatctatttctgtgat

SEQ ID NO: 8814 - DNA, 25 bp, Homo sapien
aagttgcctgaggagacaaaaagaa

SEQ ID NO: 8815 - DNA, 25 bp, Homo sapien
aagttgcctgaggagataaaaagaa

SEQ ID NO: 8816 - DNA, 25 bp, Homo sapien
aagttgctatattatttttcttctg

SEQ ID NO: 8817 - DNA, 25 bp, Homo sapien
aagttgctatattctttttcttctg

SEQ ID NO: 8818 - DNA, 25 bp, Homo sapien
aagttggagaataacgaaagagaag

SEQ ID NO: 8819 - DNA, 25 bp, Homo sapien
aagttggagaataatgaaagagaag

SEQ ID NO: 8820 - DNA, 25 bp, Homo sapien
aagttggcgttgatggaactctgtt

SEQ ID NO: 8821 - DNA, 25 bp, Homo sapien
aagttggcttcacctttgggctggc

SEQ ID NO: 8822 - DNA, 25 bp, Homo sapien
aagttggcttcacgtttgggctggc

SEQ ID NO: 8823 - DNA, 25 bp, Homo sapien
aagttggctttgatggaactctgtt

SEQ ID NO: 8824 - DNA, 25 bp, Homo sapien
aagttgggatatgtagcctgtggga

SEQ ID NO: 8825 - DNA, 25 bp, Homo sapien
aagttgggatatgtagtctgtggga

SEQ ID NO: 8826 - DNA, 25 bp, Homo sapien
aagttggtgcttggtagagttgctg

SEQ ID NO: 8827 - DNA, 25 bp, Homo sapien
aagttggtgtttggtagagttgctg

SEQ ID NO: 8828 - DNA, 25 bp, Homo sapien
aagttgtatgaaattatatgaaatt

SEQ ID NO: 8829 - DNA, 25 bp, Homo sapien
aagttgtatgagattatatgaaatt

SEQ ID NO: 8830 - DNA, 25 bp, Homo sapien
aagttgtcaaaaattaacagtaatg

SEQ ID NO: 8831 - DNA, 25 bp, Homo sapien
aagttgtcagaaattaacagtaatg

SEQ ID NO: 8832 - DNA, 25 bp, Homo sapien
aagttgtgaggattggaatagaata

SEQ ID NO: 8833 - DNA, 25 bp, Homo sapien
aagttgtgaggattggcatagaata

SEQ ID NO: 8834 - DNA, 25 bp, Homo sapien
aagttgttctctaacattccaagga

SEQ ID NO: 8835 - DNA, 25 bp, Homo sapien
aagttgttgtctaacattccaagga

SEQ ID NO: 8836 - DNA, 25 bp, Homo sapien
aagttgtttagttttcatatatttg

SEQ ID NO: 8837 - DNA, 25 bp, Homo sapien
aagttgtttctgtctttttgtaatc

SEQ ID NO: 8838 - DNA, 25 bp, Homo sapien
aagttgtttctgtttttttgtaatc

SEQ ID NO: 8839 - DNA, 25 bp, Homo sapien
aagttgtttggttttcatatatttg

SEQ ID NO: 8840 - DNA, 25 bp, Homo sapien
aagtttaagctgaatatgttggaaa

SEQ ID NO: 8841 - DNA, 25 bp, Homo sapien
aagtttaagctggatatgttggaaa

SEQ ID NO: 8842 - DNA, 25 bp, Homo sapien
aagtttaagtgaatgacgctaaagg

SEQ ID NO: 8843 - DNA, 25 bp, Homo sapien
aagtttaagtgaatgatgctaaagg

SEQ ID NO: 8844 - DNA, 25 bp, Homo sapien
aagtttacatcataaagtgtcaatg

SEQ ID NO: 8845 - DNA, 25 bp, Homo sapien
aagtttacatttcatattggaccag

SEQ ID NO: 8846 - DNA, 25 bp, Homo sapien
aagtttacgtcataaagtgtcaatg

SEQ ID NO: 8847 - DNA, 25 bp, Homo sapien
aagtttacttttcatattggaccag

SEQ ID NO: 8848 - DNA, 25 bp, Homo sapien
aagtttaggatctctacagaaagtg

SEQ ID NO: 8849 - DNA, 25 bp, Homo sapien
aagtttaggatctctatagaaagtg

SEQ ID NO: 8850 - DNA, 25 bp, Homo sapien
aagtttattcttctctggttgatga

SEQ ID NO: 8851 - DNA, 25 bp, Homo sapien
aagtttattcttctttggttgatga

SEQ ID NO: 8852 - DNA, 25 bp, Homo sapien
aagtttatttgtaatcaagagtggc

SEQ ID NO: 8853 - DNA, 25 bp, Homo sapien
aagtttatttgtagtcaagagtggc

SEQ ID NO: 8854 - DNA, 25 bp, Homo sapien
aagtttcaaaacagggccactccag

SEQ ID NO: 8855 - DNA, 25 bp, Homo sapien
aagtttcaaaacggggccactccag

SEQ ID NO: 8856 - DNA, 25 bp, Homo sapien
aagtttcagtttcaattcagtttct

SEQ ID NO: 8857 - DNA, 25 bp, Homo sapien
aagtttcagtttcagttcagtttct

SEQ ID NO: 8858 - DNA, 25 bp, Homo sapien
aagtttcatgtgaaatcttttggag

SEQ ID NO: 8859 - DNA, 25 bp, Homo sapien
aagtttcatgtgaattcttttggag

SEQ ID NO: 8860 - DNA, 25 bp, Homo sapien
aagtttccaagtggtgctgatactt

SEQ ID NO: 8861 - DNA, 25 bp, Homo sapien
aagtttcccagtggtgctgatactt

SEQ ID NO: 8862 - DNA, 25 bp, Homo sapien
aagtttcctgtaacgccagccagga

SEQ ID NO: 8863 - DNA, 25 bp, Homo sapien
aagtttcctgtaatgccagccagga

SEQ ID NO: 8864 - DNA, 25 bp, Homo sapien
aagtttctcattcctctggctctgt

SEQ ID NO: 8865 - DNA, 25 bp, Homo sapien
aagtttctcatttctctggctctgt

SEQ ID NO: 8866 - DNA, 25 bp, Homo sapien
aagtttctcctaaaaacacagaaga

SEQ ID NO: 8867 - DNA, 25 bp, Homo sapien
aagtttctcttaaaaacacagaaga

SEQ ID NO: 8868 - DNA, 25 bp, Homo sapien
aagtttgaaaaatgtcttaacagcc

SEQ ID NO: 8869 - DNA, 25 bp, Homo sapien
aagtttgaacccagtgacaatcatg

SEQ ID NO: 8870 - DNA, 25 bp, Homo sapien
aagtttgaagccagtgacaatcatg

SEQ ID NO: 8871 - DNA, 25 bp, Homo sapien
aagtttgagaaatgtcttaacagcc

SEQ ID NO: 8872 - DNA, 25 bp, Homo sapien
aagtttgcagaaaaagttctgaagt

SEQ ID NO: 8873 - DNA, 25 bp, Homo sapien
aagtttgcagaaagagttctgaagt

SEQ ID NO: 8874 - DNA, 25 bp, Homo sapien
aagtttgccgtttaggctctagcac

SEQ ID NO: 8875 - DNA, 25 bp, Homo sapien
aagtttgctgtttaggctctagcac

SEQ ID NO: 8876 - DNA, 25 bp, Homo sapien
aagtttgcttacctctcctttacat

SEQ ID NO: 8877 - DNA, 25 bp, Homo sapien
aagtttgcttacctctgctttacat

SEQ ID NO: 8878 - DNA, 25 bp, Homo sapien
aagtttggcagtctcgttctctata

SEQ ID NO: 8879 - DNA, 25 bp, Homo sapien
aagtttggcagtcttgttctctata

SEQ ID NO: 8880 - DNA, 25 bp, Homo sapien
aagttttaaataaggaacacaatga

SEQ ID NO: 8881 - DNA, 25 bp, Homo sapien
aagttttaaatacggaacacaatga

SEQ ID NO: 8882 - DNA, 25 bp, Homo sapien
aagttttacgagatgacaaaattag

SEQ ID NO: 8883 - DNA, 25 bp, Homo sapien
aagttttatctcggtgaactacctg

SEQ ID NO: 8884 - DNA, 25 bp, Homo sapien
aagttttatcttggtgaactacctg

SEQ ID NO: 8885 - DNA, 25 bp, Homo sapien
aagttttatgagatgacaaaattag

SEQ ID NO: 8886 - DNA, 25 bp, Homo sapien
aagttttattggaacacactatgta

SEQ ID NO: 8887 - DNA, 25 bp, Homo sapien
aagttttattggaagacactatgta

SEQ ID NO: 8888 - DNA, 25 bp, Homo sapien
aagttttcacaaataacataaacaa

SEQ ID NO: 8889 - DNA, 25 bp, Homo sapien
aagttttcacaaataagataaacaa

SEQ ID NO: 8890 - DNA, 25 bp, Homo sapien
aagttttcagaaagcagtacctttt

SEQ ID NO: 8891 - DNA, 25 bp, Homo sapien
aagttttcagaaagcattacctttt

SEQ ID NO: 8892 - DNA, 25 bp, Homo sapien
aagttttcagcttattggcacatct

SEQ ID NO: 8893 - DNA, 25 bp, Homo sapien
aagttttccgcttattggcacatct

SEQ ID NO: 8894 - DNA, 25 bp, Homo sapien
aagttttccgtaatgtgaatttctg

SEQ ID NO: 8895 - DNA, 25 bp, Homo sapien
aagttttccttaatgtgaatttctg

SEQ ID NO: 8896 - DNA, 25 bp, Homo sapien
aagttttgcctgagctataggagga

SEQ ID NO: 8897 - DNA, 25 bp, Homo sapien
aagttttgcttgagctataggagga

SEQ ID NO: 8898 - DNA, 25 bp, Homo sapien
aagttttgtcttttacatttttcac

SEQ ID NO: 8899 - DNA, 25 bp, Homo sapien
aagttttgtcttttacgtttttcac

SEQ ID NO: 8900 - DNA, 25 bp, Homo sapien
aagttttttaaaatgatcaggaagt

SEQ ID NO: 8901 - DNA, 25 bp, Homo sapien
aagtttttttaaatgatcaggaagt

SEQ ID NO: 8902 - DNA, 25 bp, Homo sapien
aataaaaaacagatgaacaatgtaa

SEQ ID NO: 8903 - DNA, 25 bp, Homo sapien
aataaaaaacaggtgaacaatgtaa

SEQ ID NO: 8904 - DNA, 25 bp, Homo sapien
aataaaaaagcgaaacagccttatt

SEQ ID NO: 8905 - DNA, 25 bp, Homo sapien
aataaaaaagctaaacagccttatt

SEQ ID NO: 8906 - DNA, 25 bp, Homo sapien
aataaaaagatctaaaaattgcacc

SEQ ID NO: 8907 - DNA, 25 bp, Homo sapien
aataaaaagatctaaacattgcacc

SEQ ID NO: 8908 - DNA, 25 bp, Homo sapien
aataaaaatgtcaagagtatgttgt

SEQ ID NO: 8909 - DNA, 25 bp, Homo sapien
aataaaaatgtcgagagtatgttgt

SEQ ID NO: 8910 - DNA, 25 bp, Homo sapien
aataaaaatgttcacgaattaagtg

SEQ ID NO: 8911 - DNA, 25 bp, Homo sapien
aataaaaatgttcgcgaattaagtg

SEQ ID NO: 8912 - DNA, 25 bp, Homo sapien
aataaaacaaaaagatgcatagatg

SEQ ID NO: 8913 - DNA, 25 bp, Homo sapien
aataaaacaaagagatgcatagatg

SEQ ID NO: 8914 - DNA, 25 bp, Homo sapien
aataaaacaattgcactttgcctca

SEQ ID NO: 8915 - DNA, 25 bp, Homo sapien
aataaaacaccaagtggagaaattg

SEQ ID NO: 8916 - DNA, 25 bp, Homo sapien
aataaaacagaagatatggaggtga

SEQ ID NO: 8917 - DNA, 25 bp, Homo sapien
aataaaacagaaggtatggaggtga

SEQ ID NO: 8918 - DNA, 25 bp, Homo sapien
aataaaaccaagacttgaacccagc

SEQ ID NO: 8919 - DNA, 25 bp, Homo sapien
aataaaaccacaacaaacagcttta

SEQ ID NO: 8920 - DNA, 25 bp, Homo sapien
aataaaaccacagcaaacagcttta

SEQ ID NO: 8921 - DNA, 25 bp, Homo sapien
aataaaaccgagacttgaacccagc

SEQ ID NO: 8922 - DNA, 25 bp, Homo sapien
aataaaaccgatacaagcaattatt

SEQ ID NO: 8923 - DNA, 25 bp, Homo sapien
aataaaacgattgcactttgcctca

SEQ ID NO: 8924 - DNA, 25 bp, Homo sapien
aataaaacgccaagtggagaaattg

SEQ ID NO: 8925 - DNA, 25 bp, Homo sapien
aataaaactgatacaagcaattatt

SEQ ID NO: 8926 - DNA, 25 bp, Homo sapien
aataaaagacccacaatccaattaa

SEQ ID NO: 8927 - DNA, 25 bp, Homo sapien
aataaaagacctacaatccaattaa

SEQ ID NO: 8928 - DNA, 25 bp, Homo sapien
aataaaagcttataactcataatat

SEQ ID NO: 8929 - DNA, 25 bp, Homo sapien
aataaaagtggctgctgattggagt

SEQ ID NO: 8930 - DNA, 25 bp, Homo sapien
aataaaagtggttgctgattggagt

SEQ ID NO: 8931 - DNA, 25 bp, Homo sapien
aataaaagttgccaaccaacaccac

SEQ ID NO: 8932 - DNA, 25 bp, Homo sapien
aataaaagttgccatccaacaccac

SEQ ID NO: 8933 - DNA, 25 bp, Homo sapien
aataaaagtttataactcataatat

SEQ ID NO: 8934 - DNA, 25 bp, Homo sapien
aataaaatatgcgcttgtgtgctga

SEQ ID NO: 8935 - DNA, 25 bp, Homo sapien
aataaaatatgtgcttgtgtgctga

SEQ ID NO: 8936 - DNA, 25 bp, Homo sapien
aataaaatgtagtagaaacatagtc

SEQ ID NO: 8937 - DNA, 25 bp, Homo sapien
aataaaatgtagtggaaacatagtc

SEQ ID NO: 8938 - DNA, 25 bp, Homo sapien
aataaacaaatacaagacataggaa

SEQ ID NO: 8939 - DNA, 25 bp, Homo sapien
aataaacaactacaagacataggaa

SEQ ID NO: 8940 - DNA, 25 bp, Homo sapien
aataaacaatagacctctttgggga

SEQ ID NO: 8941 - DNA, 25 bp, Homo sapien
aataaacaatagacctttttgggga

SEQ ID NO: 8942 - DNA, 25 bp, Homo sapien
aataaacacgactactgatttgata

SEQ ID NO: 8943 - DNA, 25 bp, Homo sapien
aataaacacgattactgatttgata

SEQ ID NO: 8944 - DNA, 25 bp, Homo sapien
aataaacagcggtcagtttttgtta

SEQ ID NO: 8945 - DNA, 25 bp, Homo sapien
aataaacaggcaagacagggagatt

SEQ ID NO: 8946 - DNA, 25 bp, Homo sapien
aataaacaggcaaggcagggagatt

SEQ ID NO: 8947 - DNA, 25 bp, Homo sapien
aataaacagtggtcagtttttgtta

SEQ ID NO: 8948 - DNA, 25 bp, Homo sapien
aataaacataagcagcagtcaggca

SEQ ID NO: 8949 - DNA, 25 bp, Homo sapien
aataaacatcagcagcagtcaggca

SEQ ID NO: 8950 - DNA, 25 bp, Homo sapien
aataaaccaacatttgtatttccaa

SEQ ID NO: 8951 - DNA, 25 bp, Homo sapien
aataaaccagcatttgtatttccaa

SEQ ID NO: 8952 - DNA, 25 bp, Homo sapien
aataaacctgaagaatattatgtga

SEQ ID NO: 8953 - DNA, 25 bp, Homo sapien
aataaacctgaagagtattatgtga

SEQ ID NO: 8954 - DNA, 25 bp, Homo sapien
aataaacgtagccggtaagcctgag

SEQ ID NO: 8955 - DNA, 25 bp, Homo sapien
aataaacgtagctggtaagcctgag

SEQ ID NO: 8956 - DNA, 25 bp, Homo sapien
aataaactaccaaggaccaatactg

SEQ ID NO: 8957 - DNA, 25 bp, Homo sapien
aataaactaccagggaccaatactg

SEQ ID NO: 8958 - DNA, 25 bp, Homo sapien
aataaactcacatatacggaaatgt

SEQ ID NO: 8959 - DNA, 25 bp, Homo sapien
aataaactcacgtatacggaaatgt

SEQ ID NO: 8960 - DNA, 25 bp, Homo sapien
aataaactcagaaaagaatcaaaga

SEQ ID NO: 8961 - DNA, 25 bp, Homo sapien
aataaactcagaagagaatcaaaga

SEQ ID NO: 8962 - DNA, 25 bp, Homo sapien
aataaacttgtactaacgttatgac

SEQ ID NO: 8963 - DNA, 25 bp, Homo sapien
aataaacttgtactaatgttatgac

SEQ ID NO: 8964 - DNA, 25 bp, Homo sapien
aataaagaaacaacgtaaaacaaga

SEQ ID NO: 8965 - DNA, 25 bp, Homo sapien
aataaagaaccaacgtaaaacaaga

SEQ ID NO: 8966 - DNA, 25 bp, Homo sapien
aataaagacgaaaggatgagtttgc

SEQ ID NO: 8967 - DNA, 25 bp, Homo sapien
aataaagactaaataagtagtgtct

SEQ ID NO: 8968 - DNA, 25 bp, Homo sapien
aataaagactaagtaagtagtgtct

SEQ ID NO: 8969 - DNA, 25 bp, Homo sapien
aataaagagccgctatgttctaaat

SEQ ID NO: 8970 - DNA, 25 bp, Homo sapien
aataaagagctgatttctgaaacat

SEQ ID NO: 8971 - DNA, 25 bp, Homo sapien
aataaagagctgctttctgaaacat

SEQ ID NO: 8972 - DNA, 25 bp, Homo sapien
aataaagaggaatagctacagtggc

SEQ ID NO: 8973 - DNA, 25 bp, Homo sapien
aataaagaggagtagctacagtggc

SEQ ID NO: 8974 - DNA, 25 bp, Homo sapien
aataaagagtcgctatgttctaaat

SEQ ID NO: 8975 - DNA, 25 bp, Homo sapien
aataaagatgaaaggatgagtttgc

SEQ ID NO: 8976 - DNA, 25 bp, Homo sapien
aataaagatggtgctaccttcaatg

SEQ ID NO: 8977 - DNA, 25 bp, Homo sapien
aataaagattgtgctaccttcaatg

SEQ ID NO: 8978 - DNA, 25 bp, Homo sapien
aataaagcgatcctggtgtgtttac

SEQ ID NO: 8979 - DNA, 25 bp, Homo sapien
aataaagctaaaatatgtctcattc

SEQ ID NO: 8980 - DNA, 25 bp, Homo sapien
aataaagctaaaatgtgtctcattc

SEQ ID NO: 8981 - DNA, 25 bp, Homo sapien
aataaagctatcctggtgtgtttac

SEQ ID NO: 8982 - DNA, 25 bp, Homo sapien
aataaaggatccaaaaaccagacag

SEQ ID NO: 8983 - DNA, 25 bp, Homo sapien
aataaaggctttagcaatgaacttt

SEQ ID NO: 8984 - DNA, 25 bp, Homo sapien
aataaaggctttagcagtgaacttt

SEQ ID NO: 8985 - DNA, 25 bp, Homo sapien
aataaagggtccaaaaaccagacag

SEQ ID NO: 8986 - DNA, 25 bp, Homo sapien
aataaaggtactgagcataagcatg

SEQ ID NO: 8987 - DNA, 25 bp, Homo sapien
aataaaggttctgagcataagcatg

SEQ ID NO: 8988 - DNA, 25 bp, Homo sapien
aataaagtcacaagatgcccagttc

SEQ ID NO: 8989 - DNA, 25 bp, Homo sapien
aataaagtcacaggatgcccagttc

SEQ ID NO: 8990 - DNA, 25 bp, Homo sapien
aataaagtcagcttgtgaggtaaaa

SEQ ID NO: 8991 - DNA, 25 bp, Homo sapien
aataaagtcagtttgtgaggtaaaa

SEQ ID NO: 8992 - DNA, 25 bp, Homo sapien
aataaataaaacgactgttgaaaga

SEQ ID NO: 8993 - DNA, 25 bp, Homo sapien
aataaataaaatgactgttgaaaga

SEQ ID NO: 8994 - DNA, 25 bp, Homo sapien
aataaataattgctttactttatac

SEQ ID NO: 8995 - DNA, 25 bp, Homo sapien
aataaataattgctttgctttatac

SEQ ID NO: 8996 - DNA, 25 bp, Homo sapien
aataaatcaccaatgaatacaaaga

SEQ ID NO: 8997 - DNA, 25 bp, Homo sapien
aataaatcaccagtgaatacaaaga

SEQ ID NO: 8998 - DNA, 25 bp, Homo sapien
aataaatctaaccagtgagagtcag

SEQ ID NO: 8999 - DNA, 25 bp, Homo sapien
aataaatctaatcagtgagagtcag

SEQ ID NO: 9000 - DNA, 25 bp, Homo sapien
aataaatcttgacgaaaactttcta

SEQ ID NO: 9001 - DNA, 25 bp, Homo sapien
aataaatcttgatgaaaactttcta

SEQ ID NO: 9002 - DNA, 25 bp, Homo sapien
aataaatgaccagcaataaagtcca

SEQ ID NO: 9003 - DNA, 25 bp, Homo sapien
aataaatgaccggcaataaagtcca

SEQ ID NO: 9004 - DNA, 25 bp, Homo sapien
aataaatgcaattccagctgaaatg

SEQ ID NO: 9005 - DNA, 25 bp, Homo sapien
aataaatgcaattctagctgaaatg

SEQ ID NO: 9006 - DNA, 25 bp, Homo sapien
aataaatgcctactgagaaataaaa

SEQ ID NO: 9007 - DNA, 25 bp, Homo sapien
aataaatgcggacagactaggtatt

SEQ ID NO: 9008 - DNA, 25 bp, Homo sapien
aataaatggctaagtcaaaaaagta

SEQ ID NO: 9009 - DNA, 25 bp, Homo sapien
aataaatggctacgtcaaaaaagta

SEQ ID NO: 9010 - DNA, 25 bp, Homo sapien
aataaatgtctactgagaaataaaa

SEQ ID NO: 9011 - DNA, 25 bp, Homo sapien
aataaatgtctgcgattaggttatt

SEQ ID NO: 9012 - DNA, 25 bp, Homo sapien
aataaatgtctgtgattaggttatt

SEQ ID NO: 9013 - DNA, 25 bp, Homo sapien
aataaatgtggacagactaggtatt

SEQ ID NO: 9014 - DNA, 25 bp, Homo sapien
aataaattcaaaactgtgcaaaatc

SEQ ID NO: 9015 - DNA, 25 bp, Homo sapien
aataaattcaaaagtgtgcaaaatc

SEQ ID NO: 9016 - DNA, 25 bp, Homo sapien
aataaattctacggcacatcagtct

SEQ ID NO: 9017 - DNA, 25 bp, Homo sapien
aataaattctatggcacatcagtct

SEQ ID NO: 9018 - DNA, 25 bp, Homo sapien
aataaatttggcggacataggcaaa

SEQ ID NO: 9019 - DNA, 25 bp, Homo sapien
aataaatttggtggacataggcaaa

SEQ ID NO: 9020 - DNA, 25 bp, Homo sapien
aataacaaaaactgaatgtgtctgt

SEQ ID NO: 9021 - DNA, 25 bp, Homo sapien
aataacaaaaattgtaaaatgcaag

SEQ ID NO: 9022 - DNA, 25 bp, Homo sapien
aataacaaaaattgtagaatgcaag

SEQ ID NO: 9023 - DNA, 25 bp, Homo sapien
aataacaacaactgaatgtgtctgt

SEQ ID NO: 9024 - DNA, 25 bp, Homo sapien
aataacaagagttaagtgtctctga

SEQ ID NO: 9025 - DNA, 25 bp, Homo sapien
aataacaagagttatgtgtctctga

SEQ ID NO: 9026 - DNA, 25 bp, Homo sapien
aataacacaactgtagggtctgaag

SEQ ID NO: 9027 - DNA, 25 bp, Homo sapien
aataacacaactgtggggtctgaag

SEQ ID NO: 9028 - DNA, 25 bp, Homo sapien
aataacacctcctctttgtaatgct

SEQ ID NO: 9029 - DNA, 25 bp, Homo sapien
aataacacctcctttttgtaatgct

SEQ ID NO: 9030 - DNA, 25 bp, Homo sapien
aataacactactgctattcactttt

SEQ ID NO: 9031 - DNA, 25 bp, Homo sapien
aataacactacttctattcactttt

SEQ ID NO: 9032 - DNA, 25 bp, Homo sapien
aataacactcttgtgcagtaagcgt

SEQ ID NO: 9033 - DNA, 25 bp, Homo sapien
aataacactcttgttcagtaagcgt

SEQ ID NO: 9034 - DNA, 25 bp, Homo sapien
aataacagaaaagctcttgtgaggg

SEQ ID NO: 9035 - DNA, 25 bp, Homo sapien
aataacagaaaatctcttgtgaggg

SEQ ID NO: 9036 - DNA, 25 bp, Homo sapien
aataacagcaacggcggctgctact

SEQ ID NO: 9037 - DNA, 25 bp, Homo sapien
aataacagcaactgcggctgctact

SEQ ID NO: 9038 - DNA, 25 bp, Homo sapien
aataacagcggttaaagggcaggtg

SEQ ID NO: 9039 - DNA, 25 bp, Homo sapien
aataacagtggttaaagggcaggtg

SEQ ID NO: 9040 - DNA, 25 bp, Homo sapien
aataacatccaacagtgtgaaaata

SEQ ID NO: 9041 - DNA, 25 bp, Homo sapien
aataacatccaactgtgtgaaaata

SEQ ID NO: 9042 - DNA, 25 bp, Homo sapien
aataacatcgcaggaaactactttg

SEQ ID NO: 9043 - DNA, 25 bp, Homo sapien
aataacatcgcgggaaactactttg

SEQ ID NO: 9044 - DNA, 25 bp, Homo sapien
aataacatcggtatgacacaggagc

SEQ ID NO: 9045 - DNA, 25 bp, Homo sapien
aataacatgacaccagttttcagat

SEQ ID NO: 9046 - DNA, 25 bp, Homo sapien
aataacatgacactagttttcagat

SEQ ID NO: 9047 - DNA, 25 bp, Homo sapien
aataacattccaccatagttcagac

SEQ ID NO: 9048 - DNA, 25 bp, Homo sapien
aataacattccaccgtagttcagac

SEQ ID NO: 9049 - DNA, 25 bp, Homo sapien
aataacattggtatgacacaggagc

SEQ ID NO: 9050 - DNA, 25 bp, Homo sapien
aataaccacaaacagaagtcccaga

SEQ ID NO: 9051 - DNA, 25 bp, Homo sapien
aataaccacaaagagaagtcccaga

SEQ ID NO: 9052 - DNA, 25 bp, Homo sapien
aataaccataacatctacgaacagg

SEQ ID NO: 9053 - DNA, 25 bp, Homo sapien
aataaccataacgtctacgaacagg

SEQ ID NO: 9054 - DNA, 25 bp, Homo sapien
aataacgcaactacaaaccaaggaa

SEQ ID NO: 9055 - DNA, 25 bp, Homo sapien
aataacgcatctacaaaccaaggaa

SEQ ID NO: 9056 - DNA, 25 bp, Homo sapien
aataactaacacaccggaacgcaaa

SEQ ID NO: 9057 - DNA, 25 bp, Homo sapien
aataactaacataccggaacgcaaa

SEQ ID NO: 9058 - DNA, 25 bp, Homo sapien
aataactccagagcgtagcatcaaa

SEQ ID NO: 9059 - DNA, 25 bp, Homo sapien
aataactccagagtgtagcatcaaa

SEQ ID NO: 9060 - DNA, 25 bp, Homo sapien
aataactgggatcgtgcatcacgtc

SEQ ID NO: 9061 - DNA, 25 bp, Homo sapien
aataactgggattgtgcatcacgtc

SEQ ID NO: 9062 - DNA, 25 bp, Homo sapien
aataacttacaaaaattgagaaagg

SEQ ID NO: 9063 - DNA, 25 bp, Homo sapien
aataacttacagaaattgagaaagg

SEQ ID NO: 9064 - DNA, 25 bp, Homo sapien
aataacttaggaccaaagctggaac

SEQ ID NO: 9065 - DNA, 25 bp, Homo sapien
aataacttagggccaaagctggaac

SEQ ID NO: 9066 - DNA, 25 bp, Homo sapien
aataacttggcacctatttatatat

SEQ ID NO: 9067 - DNA, 25 bp, Homo sapien
aataacttggcacgtatttatatat

SEQ ID NO: 9068 - DNA, 25 bp, Homo sapien
aataagaacctcaaaaatatatctg

SEQ ID NO: 9069 - DNA, 25 bp, Homo sapien
aataagaacctcagaaatatatctg

SEQ ID NO: 9070 - DNA, 25 bp, Homo sapien
aataagacactcaccgtaaagatca

SEQ ID NO: 9071 - DNA, 25 bp, Homo sapien
aataagacactcatcgtaaagatca

SEQ ID NO: 9072 - DNA, 25 bp, Homo sapien
aataagactctctctacgtaatttt

SEQ ID NO: 9073 - DNA, 25 bp, Homo sapien
aataagactctctttacgtaatttt

SEQ ID NO: 9074 - DNA, 25 bp, Homo sapien
aataagagaattttctcgggtgata

SEQ ID NO: 9075 - DNA, 25 bp, Homo sapien
aataagagaattttcttgggtgata

SEQ ID NO: 9076 - DNA, 25 bp, Homo sapien
aataagaggtacagtctctgtcctc

SEQ ID NO: 9077 - DNA, 25 bp, Homo sapien
aataagagttacagtctctgtcctc

SEQ ID NO: 9078 - DNA, 25 bp, Homo sapien
aataagatcggagaagaacaaaatg

SEQ ID NO: 9079 - DNA, 25 bp, Homo sapien
aataagattggagaagaacaaaatg

SEQ ID NO: 9080 - DNA, 25 bp, Homo sapien
aataagatttgaaagtccagattac

SEQ ID NO: 9081 - DNA, 25 bp, Homo sapien
aataagatttggaagtccagattac

SEQ ID NO: 9082 - DNA, 25 bp, Homo sapien
aataagcaacggaaccagaattcaa

SEQ ID NO: 9083 - DNA, 25 bp, Homo sapien
aataagcaagcacattatatccaga

SEQ ID NO: 9084 - DNA, 25 bp, Homo sapien
aataagcaagcacattgtatccaga

SEQ ID NO: 9085 - DNA, 25 bp, Homo sapien
aataagcaatggaaccagaattcaa

SEQ ID NO: 9086 - DNA, 25 bp, Homo sapien
aataagctaaatacgctgagactca

SEQ ID NO: 9087 - DNA, 25 bp, Homo sapien
aataagctaaatatgctgagactca

SEQ ID NO: 9088 - DNA, 25 bp, Homo sapien
aataagcttttcatcaatataatat

SEQ ID NO: 9089 - DNA, 25 bp, Homo sapien
aataagcttttcatcagtataatat

SEQ ID NO: 9090 - DNA, 25 bp, Homo sapien
aataaggaatccagtaacttgaagg

SEQ ID NO: 9091 - DNA, 25 bp, Homo sapien
aataaggaatccggtaacttgaagg

SEQ ID NO: 9092 - DNA, 25 bp, Homo sapien
aataaggcagcacaagcttgggtgc

SEQ ID NO: 9093 - DNA, 25 bp, Homo sapien
aataaggcagcagaagcttgggtgc

SEQ ID NO: 9094 - DNA, 25 bp, Homo sapien
aataaggcatgtgaatatgtccctg

SEQ ID NO: 9095 - DNA, 25 bp, Homo sapien
aataaggcatgtgaatgtgtccctg

SEQ ID NO: 9096 - DNA, 25 bp, Homo sapien
aataaggcattgttctacctttcag

SEQ ID NO: 9097 - DNA, 25 bp, Homo sapien
aataaggcattgttttacctttcag

SEQ ID NO: 9098 - DNA, 25 bp, Homo sapien
aataagggacaaatattgcatgcct

SEQ ID NO: 9099 - DNA, 25 bp, Homo sapien
aataagggagaaatattgcatgcct

SEQ ID NO: 9100 - DNA, 25 bp, Homo sapien
aataaggtgaaacagaaacagatca

SEQ ID NO: 9101 - DNA, 25 bp, Homo sapien
aataaggtgaaatagaaacagatca

SEQ ID NO: 9102 - DNA, 25 bp, Homo sapien
aataagtaagcccttgttaacatgt

SEQ ID NO: 9103 - DNA, 25 bp, Homo sapien
aataagtaagctcttgttaacatgt

SEQ ID NO: 9104 - DNA, 25 bp, Homo sapien
aataagtcacagccatgagcacaac

SEQ ID NO: 9105 - DNA, 25 bp, Homo sapien
aataagtcatagccatgagcacaac

SEQ ID NO: 9106 - DNA, 25 bp, Homo sapien
aataagtgatacctttttctgtcct

SEQ ID NO: 9107 - DNA, 25 bp, Homo sapien
aataagtgatacgtttttctgtcct

SEQ ID NO: 9108 - DNA, 25 bp, Homo sapien
aataagtgatttctttcggtgacaa

SEQ ID NO: 9109 - DNA, 25 bp, Homo sapien
aataagtgatttcttttggtgacaa

SEQ ID NO: 9110 - DNA, 25 bp, Homo sapien
aataagtgcacacaagacattcaaa

SEQ ID NO: 9111 - DNA, 25 bp, Homo sapien
aataagtgcacacgagacattcaaa

SEQ ID NO: 9112 - DNA, 25 bp, Homo sapien
aataagtggatgtcctcatttatcc

SEQ ID NO: 9113 - DNA, 25 bp, Homo sapien
aataagtgggtgtcctcatttatcc

SEQ ID NO: 9114 - DNA, 25 bp, Homo sapien
aataagttttttaaaatgatcagga

SEQ ID NO: 9115 - DNA, 25 bp, Homo sapien
aataagtttttttaaatgatcagga

SEQ ID NO: 9116 - DNA, 25 bp, Homo sapien
aataataaaccaacatttgtatttc

SEQ ID NO: 9117 - DNA, 25 bp, Homo sapien
aataataaaccagcatttgtatttc

SEQ ID NO: 9118 - DNA, 25 bp, Homo sapien
aataataaagttcaaaagccagtaa

SEQ ID NO: 9119 - DNA, 25 bp, Homo sapien
aataataagcagtaaagatggaatc

SEQ ID NO: 9120 - DNA, 25 bp, Homo sapien
aataataagcagtacagatggaatc

SEQ ID NO: 9121 - DNA, 25 bp, Homo sapien
aataataaggttcaaaagccagtaa

SEQ ID NO: 9122 - DNA, 25 bp, Homo sapien
aataataccgtgttagatgcaaatg

SEQ ID NO: 9123 - DNA, 25 bp, Homo sapien
aataataccgttttagatgcaaatg

SEQ ID NO: 9124 - DNA, 25 bp, Homo sapien
aataatacctacacccaaagattgt

SEQ ID NO: 9125 - DNA, 25 bp, Homo sapien
aataatacctatacccaaagattgt

SEQ ID NO: 9126 - DNA, 25 bp, Homo sapien
aataatacgacttgattagttcttt

SEQ ID NO: 9127 - DNA, 25 bp, Homo sapien
aataatacggcttgattagttcttt

SEQ ID NO: 9128 - DNA, 25 bp, Homo sapien
aataatatagatggacgaaggggac

SEQ ID NO: 9129 - DNA, 25 bp, Homo sapien
aataatatagattgacgaaggggac

SEQ ID NO: 9130 - DNA, 25 bp, Homo sapien
aataatattctgcctattgctctcc

SEQ ID NO: 9131 - DNA, 25 bp, Homo sapien
aataatattctgcgtattgctctcc

SEQ ID NO: 9132 - DNA, 25 bp, Homo sapien
aataatcttccaagacagttacaga

SEQ ID NO: 9133 - DNA, 25 bp, Homo sapien
aataatcttccaagaccgttacaga

SEQ ID NO: 9134 - DNA, 25 bp, Homo sapien
aataatgaacggcagacttaaaaat

SEQ ID NO: 9135 - DNA, 25 bp, Homo sapien
aataatgaatggcagacttaaaaat

SEQ ID NO: 9136 - DNA, 25 bp, Homo sapien
aataatgaggttctgctatgtaagt

SEQ ID NO: 9137 - DNA, 25 bp, Homo sapien
aataatgaggttttgctatgtaagt

SEQ ID NO: 9138 - DNA, 25 bp, Homo sapien
aataatgcacactccataatctcaa

SEQ ID NO: 9139 - DNA, 25 bp, Homo sapien
aataatgcacattccataatctcaa

SEQ ID NO: 9140 - DNA, 25 bp, Homo sapien
aataatgcatgacaaatggcctgta

SEQ ID NO: 9141 - DNA, 25 bp, Homo sapien
aataatgcatgataaatggcctgta

SEQ ID NO: 9142 - DNA, 25 bp, Homo sapien
aataatggctcgcgtccacggttct

SEQ ID NO: 9143 - DNA, 25 bp, Homo sapien
aataatggctcgtgtccacggttct

SEQ ID NO: 9144 - DNA, 25 bp, Homo sapien
aataatgtatcaccctgaattgcta

SEQ ID NO: 9145 - DNA, 25 bp, Homo sapien
aataatgtatcactctgaattgcta

SEQ ID NO: 9146 - DNA, 25 bp, Homo sapien
aataatgtcctggaatttgttagat

SEQ ID NO: 9147 - DNA, 25 bp, Homo sapien
aataatgtcttggaatttgttagat

SEQ ID NO: 9148 - DNA, 25 bp, Homo sapien
aataattatcacaaaaatgccttga

SEQ ID NO: 9149 - DNA, 25 bp, Homo sapien
aataattatgacaaaaatgccttga

SEQ ID NO: 9150 - DNA, 25 bp, Homo sapien
aataattcaaagcacggatttcaag

SEQ ID NO: 9151 - DNA, 25 bp, Homo sapien
aataattcaaagcatggatttcaag

SEQ ID NO: 9152 - DNA, 25 bp, Homo sapien
aataattcagtaaatcatgctataa

SEQ ID NO: 9153 - DNA, 25 bp, Homo sapien
aataattcagttaatcatgctataa

SEQ ID NO: 9154 - DNA, 25 bp, Homo sapien
aataattcctaaaatacgcaaatat

SEQ ID NO: 9155 - DNA, 25 bp, Homo sapien
aataattctatcattttgtcaaagc

SEQ ID NO: 9156 - DNA, 25 bp, Homo sapien
aataattctatccttttgtcaaagc

SEQ ID NO: 9157 - DNA, 25 bp, Homo sapien
aataattctggatgatcccacaatc

SEQ ID NO: 9158 - DNA, 25 bp, Homo sapien
aataattctggatgctcccacaatc

SEQ ID NO: 9159 - DNA, 25 bp, Homo sapien
aataattcttaaaatacgcaaatat

SEQ ID NO: 9160 - DNA, 25 bp, Homo sapien
aataattgctttactttatacaaac

SEQ ID NO: 9161 - DNA, 25 bp, Homo sapien
aataattgctttgctttatacaaac

SEQ ID NO: 9162 - DNA, 25 bp, Homo sapien
aataatttaaatcatatagcatgcc

SEQ ID NO: 9163 - DNA, 25 bp, Homo sapien
aataatttaaatcgtatagcatgcc

SEQ ID NO: 9164 - DNA, 25 bp, Homo sapien
aataatttagataactgaccaaagg

SEQ ID NO: 9165 - DNA, 25 bp, Homo sapien
aataatttagatatctgaccaaagg

SEQ ID NO: 9166 - DNA, 25 bp, Homo sapien
aatacaaaaacaatgacccatggaa

SEQ ID NO: 9167 - DNA, 25 bp, Homo sapien
aatacaaaaacattgacccatggaa

SEQ ID NO: 9168 - DNA, 25 bp, Homo sapien
aatacaaacttattgagcaatgtgt

SEQ ID NO: 9169 - DNA, 25 bp, Homo sapien
aatacaaatctagcttccgaaagct

SEQ ID NO: 9170 - DNA, 25 bp, Homo sapien
aatacaaatctagtttccgaaagct

SEQ ID NO: 9171 - DNA, 25 bp, Homo sapien
aatacaaatttattgagcaatgtgt

SEQ ID NO: 9172 - DNA, 25 bp, Homo sapien
aatacaacaagcaatctatcctaca

SEQ ID NO: 9173 - DNA, 25 bp, Homo sapien
aatacaacaagcagtctatcctaca

SEQ ID NO: 9174 - DNA, 25 bp, Homo sapien
aatacaacgggaaggataacagtca

SEQ ID NO: 9175 - DNA, 25 bp, Homo sapien
aatacaacgggaatgataacagtca

SEQ ID NO: 9176 - DNA, 25 bp, Homo sapien
aatacaagctgtaacacagtagaca

SEQ ID NO: 9177 - DNA, 25 bp, Homo sapien
aatacaagctgtaacatagtagaca

SEQ ID NO: 9178 - DNA, 25 bp, Homo sapien
aatacaaggacttgaaagtgattca

SEQ ID NO: 9179 - DNA, 25 bp, Homo sapien
aatacaaggtcttgaaagtgattca

SEQ ID NO: 9180 - DNA, 25 bp, Homo sapien
aatacaataaaatgcttgcacttga

SEQ ID NO: 9181 - DNA, 25 bp, Homo sapien
aatacaataatgcgctcaggagtgc

SEQ ID NO: 9182 - DNA, 25 bp, Homo sapien
aatacaataatgtgctcaggagtgc

SEQ ID NO: 9183 - DNA, 25 bp, Homo sapien
aatacaatagaatgcttgcacttga

SEQ ID NO: 9184 - DNA, 25 bp, Homo sapien
aatacacaaaaagggataaagaata

SEQ ID NO: 9185 - DNA, 25 bp, Homo sapien
aatacacaaaatgggataaagaata

SEQ ID NO: 9186 - DNA, 25 bp, Homo sapien
aatacacaccttaaaacctgctgat

SEQ ID NO: 9187 - DNA, 25 bp, Homo sapien
aatacacaccttaacacctgctgat

SEQ ID NO: 9188 - DNA, 25 bp, Homo sapien
aatacacagatgctctcctatttaa

SEQ ID NO: 9189 - DNA, 25 bp, Homo sapien
aatacacagatgttctcctatttaa

SEQ ID NO: 9190 - DNA, 25 bp, Homo sapien
aatacaccagaaagtcccagcaata

SEQ ID NO: 9191 - DNA, 25 bp, Homo sapien
aatacaccggaaagtcccagcaata

SEQ ID NO: 9192 - DNA, 25 bp, Homo sapien
aatacactacaattgagcacatttg

SEQ ID NO: 9193 - DNA, 25 bp, Homo sapien
aatacactacagttgagcacatttg

SEQ ID NO: 9194 - DNA, 25 bp, Homo sapien
aatacactgcaacgatttaaggtat

SEQ ID NO: 9195 - DNA, 25 bp, Homo sapien
aatacactgcaatgatttaaggtat

SEQ ID NO: 9196 - DNA, 25 bp, Homo sapien
aatacactggattaaaacaaattgt

SEQ ID NO: 9197 - DNA, 25 bp, Homo sapien
aatacactggattacaacaaattgt

SEQ ID NO: 9198 - DNA, 25 bp, Homo sapien
aatacactgtggcaacttcagaaat

SEQ ID NO: 9199 - DNA, 25 bp, Homo sapien
aatacactgtggcagcttcagaaat

SEQ ID NO: 9200 - DNA, 25 bp, Homo sapien
aatacacttgaccgggccaggtcct

SEQ ID NO: 9201 - DNA, 25 bp, Homo sapien
aatacacttgactgggccaggtcct

SEQ ID NO: 9202 - DNA, 25 bp, Homo sapien
aatacagaacaatctcaactcattg

SEQ ID NO: 9203 - DNA, 25 bp, Homo sapien
aatacagaagtttgatttttaaaat

SEQ ID NO: 9204 - DNA, 25 bp, Homo sapien
aatacagaagtttgttttttaaaat

SEQ ID NO: 9205 - DNA, 25 bp, Homo sapien
aatacagaggatcacattctagttt

SEQ ID NO: 9206 - DNA, 25 bp, Homo sapien
aatacagaggatcagattctagttt

SEQ ID NO: 9207 - DNA, 25 bp, Homo sapien
aatacagatcaatctcaactcattg

SEQ ID NO: 9208 - DNA, 25 bp, Homo sapien
aatacagcaaagtggttcccaggct

SEQ ID NO: 9209 - DNA, 25 bp, Homo sapien
aatacagcagagtggttcccaggct

SEQ ID NO: 9210 - DNA, 25 bp, Homo sapien
aatacaggaaaatcacctgatgaag

SEQ ID NO: 9211 - DNA, 25 bp, Homo sapien
aatacaggaaaatcacttgatgaag

SEQ ID NO: 9212 - DNA, 25 bp, Homo sapien
aatacaggactgaaggacaaacaga

SEQ ID NO: 9213 - DNA, 25 bp, Homo sapien
aatacagggctgaaggacaaacaga

SEQ ID NO: 9214 - DNA, 25 bp, Homo sapien
aatacaggtcttaaattcctggtct

SEQ ID NO: 9215 - DNA, 25 bp, Homo sapien
aatacaggtcttgaattcctggtct

SEQ ID NO: 9216 - DNA, 25 bp, Homo sapien
aatacatacaccctaataagtgtta

SEQ ID NO: 9217 - DNA, 25 bp, Homo sapien
aatacatacagactttttgtgtggt

SEQ ID NO: 9218 - DNA, 25 bp, Homo sapien
aatacatacagattttttgtgtggt

SEQ ID NO: 9219 - DNA, 25 bp, Homo sapien
aatacatacgaaatttttggaaagc

SEQ ID NO: 9220 - DNA, 25 bp, Homo sapien
aatacatataccctaataagtgtta

SEQ ID NO: 9221 - DNA, 25 bp, Homo sapien
aatacatatgaaatttttggaaagc

SEQ ID NO: 9222 - DNA, 25 bp, Homo sapien
aatacatcaattcatcttcttttaa

SEQ ID NO: 9223 - DNA, 25 bp, Homo sapien
aatacatcagtttacatgagagact

SEQ ID NO: 9224 - DNA, 25 bp, Homo sapien
aatacatcattttacatgagagact

SEQ ID NO: 9225 - DNA, 25 bp, Homo sapien
aatacatctacaccaaaaaagaaaa

SEQ ID NO: 9226 - DNA, 25 bp, Homo sapien
aatacatctacgccaaaaaagaaaa

SEQ ID NO: 9227 - DNA, 25 bp, Homo sapien
aatacatctattcatcttcttttaa

SEQ ID NO: 9228 - DNA, 25 bp, Homo sapien
aatacatgcgaagtttccttaagac

SEQ ID NO: 9229 - DNA, 25 bp, Homo sapien
aatacatgcgaagttttcttaagac

SEQ ID NO: 9230 - DNA, 25 bp, Homo sapien
aatacatggtatagcgccaacattc

SEQ ID NO: 9231 - DNA, 25 bp, Homo sapien
aatacatggtatagtgccaacattc

SEQ ID NO: 9232 - DNA, 25 bp, Homo sapien
aatacatgtgatcataagaagcaac

SEQ ID NO: 9233 - DNA, 25 bp, Homo sapien
aatacatgtgatcgtaagaagcaac

SEQ ID NO: 9234 - DNA, 25 bp, Homo sapien
aatacattaaaagaccattcatatg

SEQ ID NO: 9235 - DNA, 25 bp, Homo sapien
aatacattaaaagatcattcatatg

SEQ ID NO: 9236 - DNA, 25 bp, Homo sapien
aatacattcaatgcactgtattgga

SEQ ID NO: 9237 - DNA, 25 bp, Homo sapien
aatacattcaatgcgctgtattgga

SEQ ID NO: 9238 - DNA, 25 bp, Homo sapien
aatacatttcctgttgtggaagcag

SEQ ID NO: 9239 - DNA, 25 bp, Homo sapien
aatacatttccttttgtggaagcag

SEQ ID NO: 9240 - DNA, 25 bp, Homo sapien
aataccaaaatcttcacttatttat

SEQ ID NO: 9241 - DNA, 25 bp, Homo sapien
aataccaaaatcttcagttatttat

SEQ ID NO: 9242 - DNA, 25 bp, Homo sapien
aataccaaacaaaagacgacacaac

SEQ ID NO: 9243 - DNA, 25 bp, Homo sapien
aataccaaacaaaagatgacacaac

SEQ ID NO: 9244 - DNA, 25 bp, Homo sapien
aataccaacaggagcaagaagttta

SEQ ID NO: 9245 - DNA, 25 bp, Homo sapien
aataccaacaggggcaagaagttta

SEQ ID NO: 9246 - DNA, 25 bp, Homo sapien
aataccaacattaaaatgcagccaa

SEQ ID NO: 9247 - DNA, 25 bp, Homo sapien
aataccaacattaagatgcagccaa

SEQ ID NO: 9248 - DNA, 25 bp, Homo sapien
aataccaacgatggggagtggctgt

SEQ ID NO: 9249 - DNA, 25 bp, Homo sapien
aataccaactccatcatatcttcag

SEQ ID NO: 9250 - DNA, 25 bp, Homo sapien
aataccaactccgtcatatcttcag

SEQ ID NO: 9251 - DNA, 25 bp, Homo sapien
aataccaagaaacacaattgctgga

SEQ ID NO: 9252 - DNA, 25 bp, Homo sapien
aataccaaggaacacaattgctgga

SEQ ID NO: 9253 - DNA, 25 bp, Homo sapien
aataccaatgatggggagtggctgt

SEQ ID NO: 9254 - DNA, 25 bp, Homo sapien
aataccacaaatttatagtttggtt

SEQ ID NO: 9255 - DNA, 25 bp, Homo sapien
aataccacaaatttgtagtttggtt

SEQ ID NO: 9256 - DNA, 25 bp, Homo sapien
aataccaccgcttcttatgcataca

SEQ ID NO: 9257 - DNA, 25 bp, Homo sapien
aataccactgcttcttatgcataca

SEQ ID NO: 9258 - DNA, 25 bp, Homo sapien
aataccacttcaatgcatactgtag

SEQ ID NO: 9259 - DNA, 25 bp, Homo sapien
aataccacttcgatgcatactgtag

SEQ ID NO: 9260 - DNA, 25 bp, Homo sapien
aataccagacacacagtttcttgac

SEQ ID NO: 9261 - DNA, 25 bp, Homo sapien
aataccagacacgcagtttcttgac

SEQ ID NO: 9262 - DNA, 25 bp, Homo sapien
aataccagcaaacaacaatttcttc

SEQ ID NO: 9263 - DNA, 25 bp, Homo sapien
aataccagcaaacaaccatttcttc

SEQ ID NO: 9264 - DNA, 25 bp, Homo sapien
aataccatacaatcagtagatttta

SEQ ID NO: 9265 - DNA, 25 bp, Homo sapien
aataccatacaatcggtagatttta

SEQ ID NO: 9266 - DNA, 25 bp, Homo sapien
aataccatacacatacagaaaagtg

SEQ ID NO: 9267 - DNA, 25 bp, Homo sapien
aataccatacacatacggaaaagtg

SEQ ID NO: 9268 - DNA, 25 bp, Homo sapien
aataccatcaaaatctcggccagct

SEQ ID NO: 9269 - DNA, 25 bp, Homo sapien
aataccatcaaaatcttggccagct

SEQ ID NO: 9270 - DNA, 25 bp, Homo sapien
aatacccaaagaaaccatgaaatct

SEQ ID NO: 9271 - DNA, 25 bp, Homo sapien
aatacccaaattgttcaaaccacca

SEQ ID NO: 9272 - DNA, 25 bp, Homo sapien
aatacccaacagtgacaacatccag

SEQ ID NO: 9273 - DNA, 25 bp, Homo sapien
aatacccagacaaaaacaaacataa

SEQ ID NO: 9274 - DNA, 25 bp, Homo sapien
aatacccagacacaaacaaacataa

SEQ ID NO: 9275 - DNA, 25 bp, Homo sapien
aatacccagagaaaccatgaaatct

SEQ ID NO: 9276 - DNA, 25 bp, Homo sapien
aatacccagattgttcaaaccacca

SEQ ID NO: 9277 - DNA, 25 bp, Homo sapien
aatacccagcagtgacaacatccag

SEQ ID NO: 9278 - DNA, 25 bp, Homo sapien
aataccgagcgtaaaaaatgaatat

SEQ ID NO: 9279 - DNA, 25 bp, Homo sapien
aataccgagtgtaaaaaatgaatat

SEQ ID NO: 9280 - DNA, 25 bp, Homo sapien
aataccgctgaaccaactcattcaa

SEQ ID NO: 9281 - DNA, 25 bp, Homo sapien
aataccgctgaatcaactcattcaa

SEQ ID NO: 9282 - DNA, 25 bp, Homo sapien
aataccgtgttagatgcaaatggca

SEQ ID NO: 9283 - DNA, 25 bp, Homo sapien
aataccgtttcattgcctccgattt

SEQ ID NO: 9284 - DNA, 25 bp, Homo sapien
aataccgtttcatttcctccgattt

SEQ ID NO: 9285 - DNA, 25 bp, Homo sapien
aataccgttttagatgcaaatggca

SEQ ID NO: 9286 - DNA, 25 bp, Homo sapien
aatacctaagcatctcaaaaaaaaa

SEQ ID NO: 9287 - DNA, 25 bp, Homo sapien
aatacctacacccaaagattgtgga

SEQ ID NO: 9288 - DNA, 25 bp, Homo sapien
aatacctaggcatctcaaaaaaaaa

SEQ ID NO: 9289 - DNA, 25 bp, Homo sapien
aatacctatacccaaagattgtgga

SEQ ID NO: 9290 - DNA, 25 bp, Homo sapien
aatacctcaatccttatgcttcagg

SEQ ID NO: 9291 - DNA, 25 bp, Homo sapien
aatacctcaattcttatgcttcagg

SEQ ID NO: 9292 - DNA, 25 bp, Homo sapien
aatacctgatgacctaatcttttta

SEQ ID NO: 9293 - DNA, 25 bp, Homo sapien
aatacctgatgacgtaatcttttta

SEQ ID NO: 9294 - DNA, 25 bp, Homo sapien
aatacctgattagccacaataacac

SEQ ID NO: 9295 - DNA, 25 bp, Homo sapien
aatacctgattagccagaataacac

SEQ ID NO: 9296 - DNA, 25 bp, Homo sapien
aatacctgctatttgctgtttgtct

SEQ ID NO: 9297 - DNA, 25 bp, Homo sapien
aatacctgctattttctgtttgtct

SEQ ID NO: 9298 - DNA, 25 bp, Homo sapien
aataccttatatcattctccagtcc

SEQ ID NO: 9299 - DNA, 25 bp, Homo sapien
aataccttatctaaatgccaatctc

SEQ ID NO: 9300 - DNA, 25 bp, Homo sapien
aataccttgtatcattctccagtcc

SEQ ID NO: 9301 - DNA, 25 bp, Homo sapien
aataccttttctaaatgccaatctc

SEQ ID NO: 9302 - DNA, 25 bp, Homo sapien
aataccttttgaaacgtaaacaaaa

SEQ ID NO: 9303 - DNA, 25 bp, Homo sapien
aataccttttgaaatgtaaacaaaa

SEQ ID NO: 9304 - DNA, 25 bp, Homo sapien
aatacgatgaaaaccaaggattcaa

SEQ ID NO: 9305 - DNA, 25 bp, Homo sapien
aatacgatgaaaagcaaggattcaa

SEQ ID NO: 9306 - DNA, 25 bp, Homo sapien
aatacgcttttcaaactttttgtgt

SEQ ID NO: 9307 - DNA, 25 bp, Homo sapien
aatacgcttttcatactttttgtgt

SEQ ID NO: 9308 - DNA, 25 bp, Homo sapien
aatacggacatgttctgaaattcta

SEQ ID NO: 9309 - DNA, 25 bp, Homo sapien
aatacggatatgttctgaaattcta

SEQ ID NO: 9310 - DNA, 25 bp, Homo sapien
aatacggtatccaccagccatatgg

SEQ ID NO: 9311 - DNA, 25 bp, Homo sapien
aatacggtgtccaccagccatatgg

SEQ ID NO: 9312 - DNA, 25 bp, Homo sapien
aatacgtatgaacgatacagtttac

SEQ ID NO: 9313 - DNA, 25 bp, Homo sapien
aatacgtatgaatgatacagtttac

SEQ ID NO: 9314 - DNA, 25 bp, Homo sapien
aatacgtgcacaacgggacatagac

SEQ ID NO: 9315 - DNA, 25 bp, Homo sapien
aatacgtgcacaatgggacatagac

SEQ ID NO: 9316 - DNA, 25 bp, Homo sapien
aatacgtgtcaggattcatctggaa

SEQ ID NO: 9317 - DNA, 25 bp, Homo sapien
aatacgtgtgaggattcatctggaa

SEQ ID NO: 9318 - DNA, 25 bp, Homo sapien
aatacgttttatgcaccgaacttac

SEQ ID NO: 9319 - DNA, 25 bp, Homo sapien
aatacgttttatgcacggaacttac

SEQ ID NO: 9320 - DNA, 25 bp, Homo sapien
aatactaaacgttgatgagaatgtg

SEQ ID NO: 9321 - DNA, 25 bp, Homo sapien
aatactaaacgttggtgagaatgtg

SEQ ID NO: 9322 - DNA, 25 bp, Homo sapien
aatactactactctgaatttgagaa

SEQ ID NO: 9323 - DNA, 25 bp, Homo sapien
aatactactactttgaatttgagaa

SEQ ID NO: 9324 - DNA, 25 bp, Homo sapien
aatactagccacatagaataagttt

SEQ ID NO: 9325 - DNA, 25 bp, Homo sapien
aatactagccacgtagaataagttt

SEQ ID NO: 9326 - DNA, 25 bp, Homo sapien
aatactagtagacattcataaccaa

SEQ ID NO: 9327 - DNA, 25 bp, Homo sapien
aatactagtagtcattcataaccaa

SEQ ID NO: 9328 - DNA, 25 bp, Homo sapien
aatactattccaaaaacaatgcccg

SEQ ID NO: 9329 - DNA, 25 bp, Homo sapien
aatactattccaaagacaatgcccg

SEQ ID NO: 9330 - DNA, 25 bp, Homo sapien
aatactatttacattaacaccaaac

SEQ ID NO: 9331 - DNA, 25 bp, Homo sapien
aatactatttacgttaacaccaaac

SEQ ID NO: 9332 - DNA, 25 bp, Homo sapien
aatactcatttctcttcatccagga

SEQ ID NO: 9333 - DNA, 25 bp, Homo sapien
aatactcatttctctttatccagga

SEQ ID NO: 9334 - DNA, 25 bp, Homo sapien
aatactccaaagcccgcttatgaga

SEQ ID NO: 9335 - DNA, 25 bp, Homo sapien
aatactccaaaggccgcttatgaga

SEQ ID NO: 9336 - DNA, 25 bp, Homo sapien
aatactcccagaatgttctgtataa

SEQ ID NO: 9337 - DNA, 25 bp, Homo sapien
aatactcccagactgttctgtataa

SEQ ID NO: 9338 - DNA, 25 bp, Homo sapien
aatactctacggactgaaacacaat

SEQ ID NO: 9339 - DNA, 25 bp, Homo sapien
aatactctactggattgctttacat

SEQ ID NO: 9340 - DNA, 25 bp, Homo sapien
aatactctactggtttgctttacat

SEQ ID NO: 9341 - DNA, 25 bp, Homo sapien
aatactctatggactgaaacacaat

SEQ ID NO: 9342 - DNA, 25 bp, Homo sapien
aatactctccatccatagccattcc

SEQ ID NO: 9343 - DNA, 25 bp, Homo sapien
aatactctctatccatagccattcc

SEQ ID NO: 9344 - DNA, 25 bp, Homo sapien
aatactctggctgtaactcactgaa

SEQ ID NO: 9345 - DNA, 25 bp, Homo sapien
aatactctggctgtgactcactgaa

SEQ ID NO: 9346 - DNA, 25 bp, Homo sapien
aatactgacccagttgttaactcct

SEQ ID NO: 9347 - DNA, 25 bp, Homo sapien
aatactgacgcagttgttaactcct

SEQ ID NO: 9348 - DNA, 25 bp, Homo sapien
aatactgcaattactgatatggata

SEQ ID NO: 9349 - DNA, 25 bp, Homo sapien
aatactgcagttactgatatggata

SEQ ID NO: 9350 - DNA, 25 bp, Homo sapien
aatactggaaagttcctaaaacaca

SEQ ID NO: 9351 - DNA, 25 bp, Homo sapien
aatactgggaagttcctaaaacaca

SEQ ID NO: 9352 - DNA, 25 bp, Homo sapien
aatacttccaatatcatattcattg

SEQ ID NO: 9353 - DNA, 25 bp, Homo sapien
aatacttccagatccttatggagca

SEQ ID NO: 9354 - DNA, 25 bp, Homo sapien
aatacttccaggtccttatggagca

SEQ ID NO: 9355 - DNA, 25 bp, Homo sapien
aatacttccgatatcatattcattg

SEQ ID NO: 9356 - DNA, 25 bp, Homo sapien
aatacttgaagacctgttatgtgct

SEQ ID NO: 9357 - DNA, 25 bp, Homo sapien
aatacttgaggacctgttatgtgct

SEQ ID NO: 9358 - DNA, 25 bp, Homo sapien
aatacttgggttactcccagtgtct

SEQ ID NO: 9359 - DNA, 25 bp, Homo sapien
aatacttggtttactcccagtgtct

SEQ ID NO: 9360 - DNA, 25 bp, Homo sapien
aatactttaaatacactctaggcaa

SEQ ID NO: 9361 - DNA, 25 bp, Homo sapien
aatactttaaatactctctaggcaa

SEQ ID NO: 9362 - DNA, 25 bp, Homo sapien
aatactttatcactacacaatgccc

SEQ ID NO: 9363 - DNA, 25 bp, Homo sapien
aatactttatcattacacaatgccc

SEQ ID NO: 9364 - DNA, 25 bp, Homo sapien
aatactttcaggcccaacaatactg

SEQ ID NO: 9365 - DNA, 25 bp, Homo sapien
aatactttcaggtccaacaatactg

SEQ ID NO: 9366 - DNA, 25 bp, Homo sapien
aatactttccaacatcgattttgat

SEQ ID NO: 9367 - DNA, 25 bp, Homo sapien
aatactttccaacgtcgattttgat

SEQ ID NO: 9368 - DNA, 25 bp, Homo sapien
aatactttttcagctctgaagtttc

SEQ ID NO: 9369 - DNA, 25 bp, Homo sapien
aatactttttcagttctgaagtttc

SEQ ID NO: 9370 - DNA, 25 bp, Homo sapien
aatactttttcctccaaatgactcc

SEQ ID NO: 9371 - DNA, 25 bp, Homo sapien
aatactttttcctccacatgactcc

SEQ ID NO: 9372 - DNA, 25 bp, Homo sapien
aatagaaacacctacatagcctata

SEQ ID NO: 9373 - DNA, 25 bp, Homo sapien
aatagaaagaagaaattgaagatgt

SEQ ID NO: 9374 - DNA, 25 bp, Homo sapien
aatagaaagaagagattgaagatgt

SEQ ID NO: 9375 - DNA, 25 bp, Homo sapien
aatagaaagacctacatagcctata

SEQ ID NO: 9376 - DNA, 25 bp, Homo sapien
aatagaaagcgtaggttgattgatt

SEQ ID NO: 9377 - DNA, 25 bp, Homo sapien
aatagaaagggtaggttgattgatt

SEQ ID NO: 9378 - DNA, 25 bp, Homo sapien
aatagaaaggtccagcagacagttg

SEQ ID NO: 9379 - DNA, 25 bp, Homo sapien
aatagaaaggtccagcggacagttg

SEQ ID NO: 9380 - DNA, 25 bp, Homo sapien
aatagaaatgaatagagagtgcgtt

SEQ ID NO: 9381 - DNA, 25 bp, Homo sapien
aatagaaatgaatagatagtgcgtt

SEQ ID NO: 9382 - DNA, 25 bp, Homo sapien
aatagaactgcattaaattatttca

SEQ ID NO: 9383 - DNA, 25 bp, Homo sapien
aatagaactgcgttaaattatttca

SEQ ID NO: 9384 - DNA, 25 bp, Homo sapien
aatagaagacatccataggagatct

SEQ ID NO: 9385 - DNA, 25 bp, Homo sapien
aatagaagcgtaagggagacatcac

SEQ ID NO: 9386 - DNA, 25 bp, Homo sapien
aatagaaggaaaagtcagggaaatg

SEQ ID NO: 9387 - DNA, 25 bp, Homo sapien
aatagaaggaaatgtcagggaaatg

SEQ ID NO: 9388 - DNA, 25 bp, Homo sapien
aatagaaggacaattctactcagtg

SEQ ID NO: 9389 - DNA, 25 bp, Homo sapien
aatagaaggacagttctactcagtg

SEQ ID NO: 9390 - DNA, 25 bp, Homo sapien
aatagaaggcatccataggagatct

SEQ ID NO: 9391 - DNA, 25 bp, Homo sapien
aatagaagtgtaagggagacatcac

SEQ ID NO: 9392 - DNA, 25 bp, Homo sapien
aatagaattagcgaaacagaaaagt

SEQ ID NO: 9393 - DNA, 25 bp, Homo sapien
aatagaattagctaaacagaaaagt

SEQ ID NO: 9394 - DNA, 25 bp, Homo sapien
aatagaattcaggaactcagttgaa

SEQ ID NO: 9395 - DNA, 25 bp, Homo sapien
aatagaattcaggtactcagttgaa

SEQ ID NO: 9396 - DNA, 25 bp, Homo sapien
aatagacatcaaccatttgagcacg

SEQ ID NO: 9397 - DNA, 25 bp, Homo sapien
aatagacatcaagcatttgagcacg

SEQ ID NO: 9398 - DNA, 25 bp, Homo sapien
aatagactcaatgaagattcagagg

SEQ ID NO: 9399 - DNA, 25 bp, Homo sapien
aatagactcaatgaaggttcagagg

SEQ ID NO: 9400 - DNA, 25 bp, Homo sapien
aatagactcacacggcaaaaggaaa

SEQ ID NO: 9401 - DNA, 25 bp, Homo sapien
aatagactcacatggcaaaaggaaa

SEQ ID NO: 9402 - DNA, 25 bp, Homo sapien
aatagacttattgcgaagaatgtac

SEQ ID NO: 9403 - DNA, 25 bp, Homo sapien
aatagacttattgtgaagaatgtac

SEQ ID NO: 9404 - DNA, 25 bp, Homo sapien
aatagagaatatccaaattgaagtc

SEQ ID NO: 9405 - DNA, 25 bp, Homo sapien
aatagagaatatccgaattgaagtc

SEQ ID NO: 9406 - DNA, 25 bp, Homo sapien
aatagagagaataacagttttcatt

SEQ ID NO: 9407 - DNA, 25 bp, Homo sapien
aatagagagaataacatttttcatt

SEQ ID NO: 9408 - DNA, 25 bp, Homo sapien
aatagagagtgatctgaacaactaa

SEQ ID NO: 9409 - DNA, 25 bp, Homo sapien
aatagagagtggtctgaacaactaa

SEQ ID NO: 9410 - DNA, 25 bp, Homo sapien
aatagagataagacagaggaaatat

SEQ ID NO: 9411 - DNA, 25 bp, Homo sapien
aatagagataagactgaggaaatat

SEQ ID NO: 9412 - DNA, 25 bp, Homo sapien
aatagagcctacataaattagagtt

SEQ ID NO: 9413 - DNA, 25 bp, Homo sapien
aatagagcctacctaaattagagtt

SEQ ID NO: 9414 - DNA, 25 bp, Homo sapien
aatagagctacgagtctctgtattc

SEQ ID NO: 9415 - DNA, 25 bp, Homo sapien
aatagagctacgcgtctctgtattc

SEQ ID NO: 9416 - DNA, 25 bp, Homo sapien
aatagagctgatcaaagaagtggaa

SEQ ID NO: 9417 - DNA, 25 bp, Homo sapien
aatagagctgatgaaagaagtggaa

SEQ ID NO: 9418 - DNA, 25 bp, Homo sapien
aatagaggctgatccctgtctgtac

SEQ ID NO: 9419 - DNA, 25 bp, Homo sapien
aatagaggctgatctctgtctgtac

SEQ ID NO: 9420 - DNA, 25 bp, Homo sapien
aatagagtctcccatgcatgcaggc

SEQ ID NO: 9421 - DNA, 25 bp, Homo sapien
aatagagtctcccgtgcatgcaggc

SEQ ID NO: 9422 - DNA, 25 bp, Homo sapien
aatagagttcaaaaaaatcaagata

SEQ ID NO: 9423 - DNA, 25 bp, Homo sapien
aatagagttcaaagaaatcaagata

SEQ ID NO: 9424 - DNA, 25 bp, Homo sapien
aatagagttgacaggataattagct

SEQ ID NO: 9425 - DNA, 25 bp, Homo sapien
aatagagttgataggataattagct

SEQ ID NO: 9426 - DNA, 25 bp, Homo sapien
aatagataactagataaacaaagtc

SEQ ID NO: 9427 - DNA, 25 bp, Homo sapien
aatagataactggataaacaaagtc

SEQ ID NO: 9428 - DNA, 25 bp, Homo sapien
aatagataagttcagaatagtcaca

SEQ ID NO: 9429 - DNA, 25 bp, Homo sapien
aatagataagttccgaatagtcaca

SEQ ID NO: 9430 - DNA, 25 bp, Homo sapien
aatagatctaacactggactgcttt

SEQ ID NO: 9431 - DNA, 25 bp, Homo sapien
aatagatctaacattggactgcttt

SEQ ID NO: 9432 - DNA, 25 bp, Homo sapien
aatagattcagcattaaaatacagg

SEQ ID NO: 9433 - DNA, 25 bp, Homo sapien
aatagattccgcattaaaatacagg

SEQ ID NO: 9434 - DNA, 25 bp, Homo sapien
aatagcaaaaatgtccaggtatagg

SEQ ID NO: 9435 - DNA, 25 bp, Homo sapien
aatagcaaaaatgtccgggtatagg

SEQ ID NO: 9436 - DNA, 25 bp, Homo sapien
aatagcaataaaacctacttctttg

SEQ ID NO: 9437 - DNA, 25 bp, Homo sapien
aatagcaattaaacctacttctttg

SEQ ID NO: 9438 - DNA, 25 bp, Homo sapien
aatagcacaaacatcaaatcagagt

SEQ ID NO: 9439 - DNA, 25 bp, Homo sapien
aatagcacgaacatcaaatcagagt

SEQ ID NO: 9440 - DNA, 25 bp, Homo sapien
aatagcagaaacagagactcctggt

SEQ ID NO: 9441 - DNA, 25 bp, Homo sapien
aatagcagaaacggagactcctggt

SEQ ID NO: 9442 - DNA, 25 bp, Homo sapien
aatagcagagaaaatgaagaaattt

SEQ ID NO: 9443 - DNA, 25 bp, Homo sapien
aatagcagagataatgaagaaattt

SEQ ID NO: 9444 - DNA, 25 bp, Homo sapien
aatagcagataagacacaattaaag

SEQ ID NO: 9445 - DNA, 25 bp, Homo sapien
aatagcagataatacacaattaaag

SEQ ID NO: 9446 - DNA, 25 bp, Homo sapien
aatagcagcttaccaagaccaaaag

SEQ ID NO: 9447 - DNA, 25 bp, Homo sapien
aatagcagcttaccgagaccaaaag

SEQ ID NO: 9448 - DNA, 25 bp, Homo sapien
aatagcaggatatagggttcagtct

SEQ ID NO: 9449 - DNA, 25 bp, Homo sapien
aatagcaggatatatggttcagtct

SEQ ID NO: 9450 - DNA, 25 bp, Homo sapien
aatagccacgttttcagaaaagaat

SEQ ID NO: 9451 - DNA, 25 bp, Homo sapien
aatagccatattgcttcactctcat

SEQ ID NO: 9452 - DNA, 25 bp, Homo sapien
aatagccatattgtttcactctcat

SEQ ID NO: 9453 - DNA, 25 bp, Homo sapien
aatagccatggcatattgtagtcct

SEQ ID NO: 9454 - DNA, 25 bp, Homo sapien
aatagccatggcgtattgtagtcct

SEQ ID NO: 9455 - DNA, 25 bp, Homo sapien
aatagccatgttttcagaaaagaat

SEQ ID NO: 9456 - DNA, 25 bp, Homo sapien
aatagcctcatggtctgcttgtcct

SEQ ID NO: 9457 - DNA, 25 bp, Homo sapien
aatagcctcatggtttgcttgtcct

SEQ ID NO: 9458 - DNA, 25 bp, Homo sapien
aatagctaacctacttgaaccagct

SEQ ID NO: 9459 - DNA, 25 bp, Homo sapien
aatagctaacctactttaaccagct

SEQ ID NO: 9460 - DNA, 25 bp, Homo sapien
aatagctaatttttactcactttaa

SEQ ID NO: 9461 - DNA, 25 bp, Homo sapien
aatagctactgaggactgtttcttt

SEQ ID NO: 9462 - DNA, 25 bp, Homo sapien
aatagctactgatgactgtttcttt

SEQ ID NO: 9463 - DNA, 25 bp, Homo sapien
aatagctagatgctaattatttgga

SEQ ID NO: 9464 - DNA, 25 bp, Homo sapien
aatagctagatgttaattatttgga

SEQ ID NO: 9465 - DNA, 25 bp, Homo sapien
aatagctattttttactcactttaa

SEQ ID NO: 9466 - DNA, 25 bp, Homo sapien
aatagctcaagaaatgctgttataa

SEQ ID NO: 9467 - DNA, 25 bp, Homo sapien
aatagctcaagaagtgctgttataa

SEQ ID NO: 9468 - DNA, 25 bp, Homo sapien
aatagctcatgaatttgttcacttt

SEQ ID NO: 9469 - DNA, 25 bp, Homo sapien
aatagctcccagtaaaatttaaggg

SEQ ID NO: 9470 - DNA, 25 bp, Homo sapien
aatagctcccagtacaatttaaggg

SEQ ID NO: 9471 - DNA, 25 bp, Homo sapien
aatagctcgtgaatttgttcacttt

SEQ ID NO: 9472 - DNA, 25 bp, Homo sapien
aatagctctagcctcagtacccgcc

SEQ ID NO: 9473 - DNA, 25 bp, Homo sapien
aatagctctagcttcagtacccgcc

SEQ ID NO: 9474 - DNA, 25 bp, Homo sapien
aatagctgcaaggagtactgaaagc

SEQ ID NO: 9475 - DNA, 25 bp, Homo sapien
aatagctgcaatgagtactgaaagc

SEQ ID NO: 9476 - DNA, 25 bp, Homo sapien
aatagcttatgatgatgcctagaga

SEQ ID NO: 9477 - DNA, 25 bp, Homo sapien
aatagcttatgatggtgcctagaga

SEQ ID NO: 9478 - DNA, 25 bp, Homo sapien
aatagcttcaacataaaagtccaga

SEQ ID NO: 9479 - DNA, 25 bp, Homo sapien
aatagcttcaacgtaaaagtccaga

SEQ ID NO: 9480 - DNA, 25 bp, Homo sapien
aataggaactggaattcttagactg

SEQ ID NO: 9481 - DNA, 25 bp, Homo sapien
aataggaactggaatttttagactg

SEQ ID NO: 9482 - DNA, 25 bp, Homo sapien
aataggacactcagctaatgacttt

SEQ ID NO: 9483 - DNA, 25 bp, Homo sapien
aataggacagaactatcattcaata

SEQ ID NO: 9484 - DNA, 25 bp, Homo sapien
aataggacagaagtatcattcaata

SEQ ID NO: 9485 - DNA, 25 bp, Homo sapien
aataggacgctcagctaatgacttt

SEQ ID NO: 9486 - DNA, 25 bp, Homo sapien
aataggagccgaaattccataggca

SEQ ID NO: 9487 - DNA, 25 bp, Homo sapien
aataggagctgaaattccataggca

SEQ ID NO: 9488 - DNA, 25 bp, Homo sapien
aataggatttacatctacatatgca

SEQ ID NO: 9489 - DNA, 25 bp, Homo sapien
aataggatttacgtctacatatgca

SEQ ID NO: 9490 - DNA, 25 bp, Homo sapien
aataggatttgaatgtaagcattaa

SEQ ID NO: 9491 - DNA, 25 bp, Homo sapien
aataggatttgagtgtaagcattaa

SEQ ID NO: 9492 - DNA, 25 bp, Homo sapien
aataggcaaaaatttgttaagtgtg

SEQ ID NO: 9493 - DNA, 25 bp, Homo sapien
aataggcaacgcagattcaattcat

SEQ ID NO: 9494 - DNA, 25 bp, Homo sapien
aataggcaatgcagattcaattcat

SEQ ID NO: 9495 - DNA, 25 bp, Homo sapien
aataggcataaatttgttaagtgtg

SEQ ID NO: 9496 - DNA, 25 bp, Homo sapien
aataggctatcagttgcccaatagc

SEQ ID NO: 9497 - DNA, 25 bp, Homo sapien
aataggctatccgttgcccaatagc

SEQ ID NO: 9498 - DNA, 25 bp, Homo sapien
aataggctctgatatagctctcacc

SEQ ID NO: 9499 - DNA, 25 bp, Homo sapien
aataggctctgatgtagctctcacc

SEQ ID NO: 9500 - DNA, 25 bp, Homo sapien
aataggctgcaccgtactttgagat

SEQ ID NO: 9501 - DNA, 25 bp, Homo sapien
aataggctgcactgtactttgagat

SEQ ID NO: 9502 - DNA, 25 bp, Homo sapien
aatagggacactctccagagagggc

SEQ ID NO: 9503 - DNA, 25 bp, Homo sapien
aatagggatactctccagagagggc

SEQ ID NO: 9504 - DNA, 25 bp, Homo sapien
aataggggtgccagtgaacaagtcc

SEQ ID NO: 9505 - DNA, 25 bp, Homo sapien
aataggggtgccggtgaacaagtcc

SEQ ID NO: 9506 - DNA, 25 bp, Homo sapien
aataggtcagtttatggcatactgg

SEQ ID NO: 9507 - DNA, 25 bp, Homo sapien
aataggtcagtttatgtcatactgg

SEQ ID NO: 9508 - DNA, 25 bp, Homo sapien
aataggtctgtatgtaaccacctgt

SEQ ID NO: 9509 - DNA, 25 bp, Homo sapien
aataggtctgtgtgtaaccacctgt

SEQ ID NO: 9510 - DNA, 25 bp, Homo sapien
aatagtaaagtcggagttctttggc

SEQ ID NO: 9511 - DNA, 25 bp, Homo sapien
aatagtaaagttggagttctttggc

SEQ ID NO: 9512 - DNA, 25 bp, Homo sapien
aatagtactccatcatagagttatt

SEQ ID NO: 9513 - DNA, 25 bp, Homo sapien
aatagtacttcatcatagagttatt

SEQ ID NO: 9514 - DNA, 25 bp, Homo sapien
aatagtagcggcctacaaatctgtg

SEQ ID NO: 9515 - DNA, 25 bp, Homo sapien
aatagtagtggcctacaaatctgtg

SEQ ID NO: 9516 - DNA, 25 bp, Homo sapien
aatagtatgtgtctcagaatgtaat

SEQ ID NO: 9517 - DNA, 25 bp, Homo sapien
aatagtatgtgtcttagaatgtaat

SEQ ID NO: 9518 - DNA, 25 bp, Homo sapien
aatagtcaaaaatcgtgtgttctaa

SEQ ID NO: 9519 - DNA, 25 bp, Homo sapien
aatagtcaaaaattgtgtgttctaa

SEQ ID NO: 9520 - DNA, 25 bp, Homo sapien
aatagtcaaggaagaatcagcattc

SEQ ID NO: 9521 - DNA, 25 bp, Homo sapien
aatagtcaaggaggaatcagcattc

SEQ ID NO: 9522 - DNA, 25 bp, Homo sapien
aatagtcctgcaaagccagagtatt

SEQ ID NO: 9523 - DNA, 25 bp, Homo sapien
aatagtccttcaaagccagagtatt

SEQ ID NO: 9524 - DNA, 25 bp, Homo sapien
aatagtgaaaaatgaaaatcatgtt

SEQ ID NO: 9525 - DNA, 25 bp, Homo sapien
aatagtgagaaatgaaaatcatgtt

SEQ ID NO: 9526 - DNA, 25 bp, Homo sapien
aatagttacagccattggagcaaat

SEQ ID NO: 9527 - DNA, 25 bp, Homo sapien
aatagttacagccatttgagcaaat

SEQ ID NO: 9528 - DNA, 25 bp, Homo sapien
aatagttcaagtgcagtaaataatg

SEQ ID NO: 9529 - DNA, 25 bp, Homo sapien
aatagttcaagtgtagtaaataatg

SEQ ID NO: 9530 - DNA, 25 bp, Homo sapien
aatagttgtaacaaaactcatacaa

SEQ ID NO: 9531 - DNA, 25 bp, Homo sapien
aatagttgtaacaaaattcatacaa

SEQ ID NO: 9532 - DNA, 25 bp, Homo sapien
aatagttgtggacaagttttattca

SEQ ID NO: 9533 - DNA, 25 bp, Homo sapien
aatagttgtggagaagttttattca

SEQ ID NO: 9534 - DNA, 25 bp, Homo sapien
aatataaaacgtgatatgtaagtgt

SEQ ID NO: 9535 - DNA, 25 bp, Homo sapien
aatataaaaggaaaaggcttaaatg

SEQ ID NO: 9536 - DNA, 25 bp, Homo sapien
aatataaaaggaaaagtcttaaatg

SEQ ID NO: 9537 - DNA, 25 bp, Homo sapien
aatataaaatagaacgatgaatgct

SEQ ID NO: 9538 - DNA, 25 bp, Homo sapien
aatataaaatagaatgatgaatgct

SEQ ID NO: 9539 - DNA, 25 bp, Homo sapien
aatataaaatgtgatatgtaagtgt

SEQ ID NO: 9540 - DNA, 25 bp, Homo sapien
aatataaacagctaatggggttagt

SEQ ID NO: 9541 - DNA, 25 bp, Homo sapien
aatataaacggctaatggggttagt

SEQ ID NO: 9542 - DNA, 25 bp, Homo sapien
aatataacaaaacaaatgtaggatt

SEQ ID NO: 9543 - DNA, 25 bp, Homo sapien
aatataacaaaataaatgtaggatt

SEQ ID NO: 9544 - DNA, 25 bp, Homo sapien
aatataacatcaattgactttccac

SEQ ID NO: 9545 - DNA, 25 bp, Homo sapien
aatataacatcagttgactttccac

SEQ ID NO: 9546 - DNA, 25 bp, Homo sapien
aatataactagccatcctgtatttt

SEQ ID NO: 9547 - DNA, 25 bp, Homo sapien
aatataactagccatcttgtatttt

SEQ ID NO: 9548 - DNA, 25 bp, Homo sapien
aatataataaagaacgaacatctgc

SEQ ID NO: 9549 - DNA, 25 bp, Homo sapien
aatataataaagaatgaacatctgc

SEQ ID NO: 9550 - DNA, 25 bp, Homo sapien
aatatacatcgcttggagtttgtta

SEQ ID NO: 9551 - DNA, 25 bp, Homo sapien
aatatacatggcttggagtttgtta

SEQ ID NO: 9552 - DNA, 25 bp, Homo sapien
aatatacattcctaccatctgtgta

SEQ ID NO: 9553 - DNA, 25 bp, Homo sapien
aatatacattcctagcatctgtgta

SEQ ID NO: 9554 - DNA, 25 bp, Homo sapien
aatatactcacaggctccagggtta

SEQ ID NO: 9555 - DNA, 25 bp, Homo sapien
aatatactcacgggctccagggtta

SEQ ID NO: 9556 - DNA, 25 bp, Homo sapien
aatatacttggcgcatgctattctt

SEQ ID NO: 9557 - DNA, 25 bp, Homo sapien
aatatacttggtgcatgctattctt

SEQ ID NO: 9558 - DNA, 25 bp, Homo sapien
aatatagatagatggacatcgagat

SEQ ID NO: 9559 - DNA, 25 bp, Homo sapien
aatatagatagatggatatcgagat

SEQ ID NO: 9560 - DNA, 25 bp, Homo sapien
aatatagatggacgaaggggacaaa

SEQ ID NO: 9561 - DNA, 25 bp, Homo sapien
aatatagattccaaatttctcctct

SEQ ID NO: 9562 - DNA, 25 bp, Homo sapien
aatatagattctaaatttctcctct

SEQ ID NO: 9563 - DNA, 25 bp, Homo sapien
aatatagattgacgaaggggacaaa

SEQ ID NO: 9564 - DNA, 25 bp, Homo sapien
aatatagtaacaagttctgggaatt

SEQ ID NO: 9565 - DNA, 25 bp, Homo sapien
aatatagtaacaggttctgggaatt

SEQ ID NO: 9566 - DNA, 25 bp, Homo sapien
aatatataatacaaaaaacgctatg

SEQ ID NO: 9567 - DNA, 25 bp, Homo sapien
aatatataatacgaaaaacgctatg

SEQ ID NO: 9568 - DNA, 25 bp, Homo sapien
aatatatactcttaccagtcaataa

SEQ ID NO: 9569 - DNA, 25 bp, Homo sapien
aatatatactcttaccggtcaataa

SEQ ID NO: 9570 - DNA, 25 bp, Homo sapien
aatatatagtgaaaaaaactgggtt

SEQ ID NO: 9571 - DNA, 25 bp, Homo sapien
aatatatagtgtaaaaaactgggtt

SEQ ID NO: 9572 - DNA, 25 bp, Homo sapien
aatatatatttctcttaacgacctg

SEQ ID NO: 9573 - DNA, 25 bp, Homo sapien
aatatatatttttcttaacgacctg

SEQ ID NO: 9574 - DNA, 25 bp, Homo sapien
aatatatgactgctgactttgccta

SEQ ID NO: 9575 - DNA, 25 bp, Homo sapien
aatatatgagtgctgactttgccta

SEQ ID NO: 9576 - DNA, 25 bp, Homo sapien
aatatatgatacaatgatggcacat

SEQ ID NO: 9577 - DNA, 25 bp, Homo sapien
aatatatgatataatgatggcacat

SEQ ID NO: 9578 - DNA, 25 bp, Homo sapien
aatatatgttgaggtgttaagtttt

SEQ ID NO: 9579 - DNA, 25 bp, Homo sapien
aatatatgttggggtgttaagtttt

SEQ ID NO: 9580 - DNA, 25 bp, Homo sapien
aatatattccaatgcaatcctagca

SEQ ID NO: 9581 - DNA, 25 bp, Homo sapien
aatatattccagtgcaatcctagca

SEQ ID NO: 9582 - DNA, 25 bp, Homo sapien
aatatcaaatccactgacaatgtta

SEQ ID NO: 9583 - DNA, 25 bp, Homo sapien
aatatcaaatccactgccaatgtta

SEQ ID NO: 9584 - DNA, 25 bp, Homo sapien
aatatcaagaataaccccataaaca

SEQ ID NO: 9585 - DNA, 25 bp, Homo sapien
aatatcaagaataatcccataaaca

SEQ ID NO: 9586 - DNA, 25 bp, Homo sapien
aatatcacaggcagaagaattccga

SEQ ID NO: 9587 - DNA, 25 bp, Homo sapien
aatatcacatgcagaagaattccga

SEQ ID NO: 9588 - DNA, 25 bp, Homo sapien
aatatcaccaaaggatttaaatgta

SEQ ID NO: 9589 - DNA, 25 bp, Homo sapien
aatatcaccaaaggttttaaatgta

SEQ ID NO: 9590 - DNA, 25 bp, Homo sapien
aatatcaccacctaagaaaggcatg

SEQ ID NO: 9591 - DNA, 25 bp, Homo sapien
aatatcaccacctacgaaaggcatg

SEQ ID NO: 9592 - DNA, 25 bp, Homo sapien
aatatcagcccattaagcatcattt

SEQ ID NO: 9593 - DNA, 25 bp, Homo sapien
aatatcagctcattaagcatcattt

SEQ ID NO: 9594 - DNA, 25 bp, Homo sapien
aatatcaggttaccgtcaacattaa

SEQ ID NO: 9595 - DNA, 25 bp, Homo sapien
aatatcaggttagcgtcaacattaa

SEQ ID NO: 9596 - DNA, 25 bp, Homo sapien
aatatcatccaaattgctttggctc

SEQ ID NO: 9597 - DNA, 25 bp, Homo sapien
aatatcatccaaattgttttggctc

SEQ ID NO: 9598 - DNA, 25 bp, Homo sapien
aatatcatcctcattattatcatta

SEQ ID NO: 9599 - DNA, 25 bp, Homo sapien
aatatcatcctcgttattatcatta

SEQ ID NO: 9600 - DNA, 25 bp, Homo sapien
aatatcatcgtccaggagggttcca

SEQ ID NO: 9601 - DNA, 25 bp, Homo sapien
aatatcatcttccaggagggttcca

SEQ ID NO: 9602 - DNA, 25 bp, Homo sapien
aatatccagggttacttctagccct

SEQ ID NO: 9603 - DNA, 25 bp, Homo sapien
aatatccagggttccttctagccct

SEQ ID NO: 9604 - DNA, 25 bp, Homo sapien
aatatcccatgcgtacttgcctaat

SEQ ID NO: 9605 - DNA, 25 bp, Homo sapien
aatatcccatgtgtacttgcctaat

SEQ ID NO: 9606 - DNA, 25 bp, Homo sapien
aatatccctacatggaactcttgga

SEQ ID NO: 9607 - DNA, 25 bp, Homo sapien
aatatccctgcatggaactcttgga

SEQ ID NO: 9608 - DNA, 25 bp, Homo sapien
aatatcccttcaccatcattgttcc

SEQ ID NO: 9609 - DNA, 25 bp, Homo sapien
aatatcccttcgccatcattgttcc

SEQ ID NO: 9610 - DNA, 25 bp, Homo sapien
aatatcccttggaagacagtggtag

SEQ ID NO: 9611 - DNA, 25 bp, Homo sapien
aatatcccttggaagagagtggtag

SEQ ID NO: 9612 - DNA, 25 bp, Homo sapien
aatatcctaaattttgcctacctcc

SEQ ID NO: 9613 - DNA, 25 bp, Homo sapien
aatatcctaaattttgtctacctcc

SEQ ID NO: 9614 - DNA, 25 bp, Homo sapien
aatatcctctttcagaactagcgct

SEQ ID NO: 9615 - DNA, 25 bp, Homo sapien
aatatcctgataagttcacagtact

SEQ ID NO: 9616 - DNA, 25 bp, Homo sapien
aatatcctgttaagttcacagtact

SEQ ID NO: 9617 - DNA, 25 bp, Homo sapien
aatatcctgtttcagaactagcgct

SEQ ID NO: 9618 - DNA, 25 bp, Homo sapien
aatatccttgaaaagacggtccata

SEQ ID NO: 9619 - DNA, 25 bp, Homo sapien
aatatccttgaaaagatggtccata

SEQ ID NO: 9620 - DNA, 25 bp, Homo sapien
aatatccttttagagtaaagcaggt

SEQ ID NO: 9621 - DNA, 25 bp, Homo sapien
aatatccttttagagtgaagcaggt

SEQ ID NO: 9622 - DNA, 25 bp, Homo sapien
aatatcgccggctgtttacatacat

SEQ ID NO: 9623 - DNA, 25 bp, Homo sapien
aatatcgctattattcaatgtggca

SEQ ID NO: 9624 - DNA, 25 bp, Homo sapien
aatatcgctattgttcaatgtggca

SEQ ID NO: 9625 - DNA, 25 bp, Homo sapien
aatatcgctggctgtttacatacat

SEQ ID NO: 9626 - DNA, 25 bp, Homo sapien
aatatcgttatccatgactgctttt

SEQ ID NO: 9627 - DNA, 25 bp, Homo sapien
aatatcgttatctatgactgctttt

SEQ ID NO: 9628 - DNA, 25 bp, Homo sapien
aatatctaggtacggagacagcctt

SEQ ID NO: 9629 - DNA, 25 bp, Homo sapien
aatatctaggtatggagacagcctt

SEQ ID NO: 9630 - DNA, 25 bp, Homo sapien
aatatctcacagcatgattttatta

SEQ ID NO: 9631 - DNA, 25 bp, Homo sapien
aatatctcacagtatgattttatta

SEQ ID NO: 9632 - DNA, 25 bp, Homo sapien
aatatctcatgcgtagtatgtaaat

SEQ ID NO: 9633 - DNA, 25 bp, Homo sapien
aatatctcatgtgtagtatgtaaat

SEQ ID NO: 9634 - DNA, 25 bp, Homo sapien
aatatctgcgcatgcaatagaggtt

SEQ ID NO: 9635 - DNA, 25 bp, Homo sapien
aatatctgtgcatgcaatagaggtt

SEQ ID NO: 9636 - DNA, 25 bp, Homo sapien
aatatcttaaccattcacagagaaa

SEQ ID NO: 9637 - DNA, 25 bp, Homo sapien
aatatcttaaccattcgcagagaaa

SEQ ID NO: 9638 - DNA, 25 bp, Homo sapien
aatatcttcacttaatcatctctga

SEQ ID NO: 9639 - DNA, 25 bp, Homo sapien
aatatcttcccttaatcatctctga

SEQ ID NO: 9640 - DNA, 25 bp, Homo sapien
aatatcttgagaaaacagggctaaa

SEQ ID NO: 9641 - DNA, 25 bp, Homo sapien
aatatcttgagaagacagggctaaa

SEQ ID NO: 9642 - DNA, 25 bp, Homo sapien
aatatctttcatccggtaaccactc

SEQ ID NO: 9643 - DNA, 25 bp, Homo sapien
aatatctttcatctggtaaccactc

SEQ ID NO: 9644 - DNA, 25 bp, Homo sapien
aatatgaaatgctctttcagaggca

SEQ ID NO: 9645 - DNA, 25 bp, Homo sapien
aatatgaaatggtctttcagaggca

SEQ ID NO: 9646 - DNA, 25 bp, Homo sapien
aatatgaagctagaacccaatggga

SEQ ID NO: 9647 - DNA, 25 bp, Homo sapien
aatatgaagctagaactcaatggga

SEQ ID NO: 9648 - DNA, 25 bp, Homo sapien
aatatgaatttattgcaacactgtg

SEQ ID NO: 9649 - DNA, 25 bp, Homo sapien
aatatgaatttattgccacactgtg

SEQ ID NO: 9650 - DNA, 25 bp, Homo sapien
aatatgacagacggtaagaaaataa

SEQ ID NO: 9651 - DNA, 25 bp, Homo sapien
aatatgacagagggtaagaaaataa

SEQ ID NO: 9652 - DNA, 25 bp, Homo sapien
aatatgacggtccactctttacttg

SEQ ID NO: 9653 - DNA, 25 bp, Homo sapien
aatatgacggtccactgtttacttg

SEQ ID NO: 9654 - DNA, 25 bp, Homo sapien
aatatgagaaaatactacaatggaa

SEQ ID NO: 9655 - DNA, 25 bp, Homo sapien
aatatgagaaaatagtacaatggaa

SEQ ID NO: 9656 - DNA, 25 bp, Homo sapien
aatatgagcatcaaaaaagatggac

SEQ ID NO: 9657 - DNA, 25 bp, Homo sapien
aatatgagcatcagaaaagatggac

SEQ ID NO: 9658 - DNA, 25 bp, Homo sapien
aatatgatccctgtaaagcatagac

SEQ ID NO: 9659 - DNA, 25 bp, Homo sapien
aatatgatcgctgtaaagcatagac

SEQ ID NO: 9660 - DNA, 25 bp, Homo sapien
aatatgatctaacgggacttaattt

SEQ ID NO: 9661 - DNA, 25 bp, Homo sapien
aatatgatctaatgggacttaattt

SEQ ID NO: 9662 - DNA, 25 bp, Homo sapien
aatatgattgtcacctcctgaatta

SEQ ID NO: 9663 - DNA, 25 bp, Homo sapien
aatatgattgtcgcctcctgaatta

SEQ ID NO: 9664 - DNA, 25 bp, Homo sapien
aatatgcaactctctaatggctaat

SEQ ID NO: 9665 - DNA, 25 bp, Homo sapien
aatatgcaactctttaatggctaat

SEQ ID NO: 9666 - DNA, 25 bp, Homo sapien
aatatgcaccttctctgtcccatct

SEQ ID NO: 9667 - DNA, 25 bp, Homo sapien
aatatgcaccttctctttcccatct

SEQ ID NO: 9668 - DNA, 25 bp, Homo sapien
aatatgcactttccttaataaaaat

SEQ ID NO: 9669 - DNA, 25 bp, Homo sapien
aatatgcactttcgttaataaaaat

SEQ ID NO: 9670 - DNA, 25 bp, Homo sapien
aatatgcagagtttcacaacataaa

SEQ ID NO: 9671 - DNA, 25 bp, Homo sapien
aatatgcagagttttacaacataaa

SEQ ID NO: 9672 - DNA, 25 bp, Homo sapien
aatatgctatcgtgaacatctggtc

SEQ ID NO: 9673 - DNA, 25 bp, Homo sapien
aatatgctgtcgtgaacatctggtc

SEQ ID NO: 9674 - DNA, 25 bp, Homo sapien
aatatggagtacacattctgctgct

SEQ ID NO: 9675 - DNA, 25 bp, Homo sapien
aatatggagtatacattctgctgct

SEQ ID NO: 9676 - DNA, 25 bp, Homo sapien
aatatggattcttgcaaaagatagt

SEQ ID NO: 9677 - DNA, 25 bp, Homo sapien
aatatggattcttgcacaagatagt

SEQ ID NO: 9678 - DNA, 25 bp, Homo sapien
aatatggattttgataaggattgtg

SEQ ID NO: 9679 - DNA, 25 bp, Homo sapien
aatatggattttgttaaggattgtg

SEQ ID NO: 9680 - DNA, 25 bp, Homo sapien
aatatggcccataaccaggaaatgt

SEQ ID NO: 9681 - DNA, 25 bp, Homo sapien
aatatggcctaagaaaatgcagtta

SEQ ID NO: 9682 - DNA, 25 bp, Homo sapien
aatatggcctaaggaaatgcagtta

SEQ ID NO: 9683 - DNA, 25 bp, Homo sapien
aatatggcctataaccaggaaatgt

SEQ ID NO: 9684 - DNA, 25 bp, Homo sapien
aatatggttaacgataatggtctcc

SEQ ID NO: 9685 - DNA, 25 bp, Homo sapien
aatatggttaatgataatggtctcc

SEQ ID NO: 9686 - DNA, 25 bp, Homo sapien
aatatggttgatcctaaattgacca

SEQ ID NO: 9687 - DNA, 25 bp, Homo sapien
aatatggttgattctaaattgacca

SEQ ID NO: 9688 - DNA, 25 bp, Homo sapien
aatatgtacaactaggaagtatgag

SEQ ID NO: 9689 - DNA, 25 bp, Homo sapien
aatatgtacaactgggaagtatgag

SEQ ID NO: 9690 - DNA, 25 bp, Homo sapien
aatatgtcaggcactaatgctcagt

SEQ ID NO: 9691 - DNA, 25 bp, Homo sapien
aatatgtcaggcagtaatgctcagt

SEQ ID NO: 9692 - DNA, 25 bp, Homo sapien
aatatgtctatgacgatttgcttgg

SEQ ID NO: 9693 - DNA, 25 bp, Homo sapien
aatatgtctatgatgatttgcttgg

SEQ ID NO: 9694 - DNA, 25 bp, Homo sapien
aatatgtgacggatcatcttcttac

SEQ ID NO: 9695 - DNA, 25 bp, Homo sapien
aatatgtgatggatcatcttcttac

SEQ ID NO: 9696 - DNA, 25 bp, Homo sapien
aatatgtgtagagctattatcctca

SEQ ID NO: 9697 - DNA, 25 bp, Homo sapien
aatatgtgtagatctattatcctca

SEQ ID NO: 9698 - DNA, 25 bp, Homo sapien
aatatgttccggaccccaagaaaat

SEQ ID NO: 9699 - DNA, 25 bp, Homo sapien
aatatgttctggaccccaagaaaat

SEQ ID NO: 9700 - DNA, 25 bp, Homo sapien
aatatgttgggccacgtgacaaaca

SEQ ID NO: 9701 - DNA, 25 bp, Homo sapien
aatatgttgggctacgtgacaaaca

SEQ ID NO: 9702 - DNA, 25 bp, Homo sapien
aatatgttttatcatcctgtttctg

SEQ ID NO: 9703 - DNA, 25 bp, Homo sapien
aatatgttttattatcctgtttctg

SEQ ID NO: 9704 - DNA, 25 bp, Homo sapien
aatattaagagtattgactccttca

SEQ ID NO: 9705 - DNA, 25 bp, Homo sapien
aatattaagagtattgtctccttca

SEQ ID NO: 9706 - DNA, 25 bp, Homo sapien
aatattaatcacaactagtttcaga

SEQ ID NO: 9707 - DNA, 25 bp, Homo sapien
aatattaatcacgactagtttcaga

SEQ ID NO: 9708 - DNA, 25 bp, Homo sapien
aatattacataacatgaggtcaaag

SEQ ID NO: 9709 - DNA, 25 bp, Homo sapien
aatattacgtaacatgaggtcaaag

SEQ ID NO: 9710 - DNA, 25 bp, Homo sapien
aatattcatcagaaatacttgtcta

SEQ ID NO: 9711 - DNA, 25 bp, Homo sapien
aatattcatcaggaatacttgtcta

SEQ ID NO: 9712 - DNA, 25 bp, Homo sapien
aatattctatccgaaagaccttgga

SEQ ID NO: 9713 - DNA, 25 bp, Homo sapien
aatattctatctgaaagaccttgga

SEQ ID NO: 9714 - DNA, 25 bp, Homo sapien
aatattctcaacacggcaatgattt

SEQ ID NO: 9715 - DNA, 25 bp, Homo sapien
aatattctcaacatggcaatgattt

SEQ ID NO: 9716 - DNA, 25 bp, Homo sapien
aatattgaataacacatgacaactg

SEQ ID NO: 9717 - DNA, 25 bp, Homo sapien
aatattgactaacacatgacaactg

SEQ ID NO: 9718 - DNA, 25 bp, Homo sapien
aatattgagaactgaacctgctctt

SEQ ID NO: 9719 - DNA, 25 bp, Homo sapien
aatattgagaactgaatctgctctt

SEQ ID NO: 9720 - DNA, 25 bp, Homo sapien
aatattgcaaactgattttgggcaa

SEQ ID NO: 9721 - DNA, 25 bp, Homo sapien
aatattgcaaactggttttgggcaa

SEQ ID NO: 9722 - DNA, 25 bp, Homo sapien
aatattgggagaatataaagccaat

SEQ ID NO: 9723 - DNA, 25 bp, Homo sapien
aatattgggagaatatgaagccaat

SEQ ID NO: 9724 - DNA, 25 bp, Homo sapien
aatattgtcaaaacggccatactac

SEQ ID NO: 9725 - DNA, 25 bp, Homo sapien
aatattgtcaaaagggccatactac

SEQ ID NO: 9726 - DNA, 25 bp, Homo sapien
aatattgtggaaacaaacagaatgc

SEQ ID NO: 9727 - DNA, 25 bp, Homo sapien
aatattgtggaagcaaacagaatgc

SEQ ID NO: 9728 - DNA, 25 bp, Homo sapien
aatattgttcaggcaaagaagaagg

SEQ ID NO: 9729 - DNA, 25 bp, Homo sapien
aatattgttcaggcaaggaagaagg

SEQ ID NO: 9730 - DNA, 25 bp, Homo sapien
aatatttaaagagttcttgtaggga

SEQ ID NO: 9731 - DNA, 25 bp, Homo sapien
aatatttaaagggttcttgtaggga

SEQ ID NO: 9732 - DNA, 25 bp, Homo sapien
aatatttacatattagtgctcttct

SEQ ID NO: 9733 - DNA, 25 bp, Homo sapien
aatatttacatgttagtgctcttct

SEQ ID NO: 9734 - DNA, 25 bp, Homo sapien
aatatttatcacgtcttggtgtttc

SEQ ID NO: 9735 - DNA, 25 bp, Homo sapien
aatatttatcatgtcttggtgtttc

SEQ ID NO: 9736 - DNA, 25 bp, Homo sapien
aatatttcaagaccatggtttgaag

SEQ ID NO: 9737 - DNA, 25 bp, Homo sapien
aatatttcacgtaaaccatagactg

SEQ ID NO: 9738 - DNA, 25 bp, Homo sapien
aatatttcatgtaaaccatagactg

SEQ ID NO: 9739 - DNA, 25 bp, Homo sapien
aatatttccaacgtgactctaccat

SEQ ID NO: 9740 - DNA, 25 bp, Homo sapien
aatatttccaatgtgactctaccat

SEQ ID NO: 9741 - DNA, 25 bp, Homo sapien
aatatttccagaccatggtttgaag

SEQ ID NO: 9742 - DNA, 25 bp, Homo sapien
aatatttgaactaacataaagaata

SEQ ID NO: 9743 - DNA, 25 bp, Homo sapien
aatatttgaactgacataaagaata

SEQ ID NO: 9744 - DNA, 25 bp, Homo sapien
aatatttgacatggaaagtctaggt

SEQ ID NO: 9745 - DNA, 25 bp, Homo sapien
aatatttgacatgggaagtctaggt

SEQ ID NO: 9746 - DNA, 25 bp, Homo sapien
aatatttggaaattaaatgtctgag

SEQ ID NO: 9747 - DNA, 25 bp, Homo sapien
aatatttggaaattaagtgtctgag

SEQ ID NO: 9748 - DNA, 25 bp, Homo sapien
aatattttcaaataactccatggtg

SEQ ID NO: 9749 - DNA, 25 bp, Homo sapien
aatattttcaaatgatgtggtattg

SEQ ID NO: 9750 - DNA, 25 bp, Homo sapien
aatattttcaagtaactccatggtg

SEQ ID NO: 9751 - DNA, 25 bp, Homo sapien
aatattttcaagtgatgtggtattg

SEQ ID NO: 9752 - DNA, 25 bp, Homo sapien
aatattttgtgagctacgactctgg

SEQ ID NO: 9753 - DNA, 25 bp, Homo sapien
aatattttgtgagctatgactctgg

SEQ ID NO: 9754 - DNA, 25 bp, Homo sapien
aatcaaaaatcaattggacttagtg

SEQ ID NO: 9755 - DNA, 25 bp, Homo sapien
aatcaaaaatcacttggacttagtg

SEQ ID NO: 9756 - DNA, 25 bp, Homo sapien
aatcaaaacgagtagaaatgaaact

SEQ ID NO: 9757 - DNA, 25 bp, Homo sapien
aatcaaaacgagtggaaatgaaact

SEQ ID NO: 9758 - DNA, 25 bp, Homo sapien
aatcaaaccttcttcctttataaat

SEQ ID NO: 9759 - DNA, 25 bp, Homo sapien
aatcaaacctttttcctttataaat

SEQ ID NO: 9760 - DNA, 25 bp, Homo sapien
aatcaaaggattcttgtcttcatta

SEQ ID NO: 9761 - DNA, 25 bp, Homo sapien
aatcaaaggattgttgtcttcatta

SEQ ID NO: 9762 - DNA, 25 bp, Homo sapien
aatcaaagggcaagcttcaggatgt

SEQ ID NO: 9763 - DNA, 25 bp, Homo sapien
aatcaaagggcacgcttcaggatgt

SEQ ID NO: 9764 - DNA, 25 bp, Homo sapien
aatcaaagtggaatccacaagccag

SEQ ID NO: 9765 - DNA, 25 bp, Homo sapien
aatcaaagtggagtccacaagccag

SEQ ID NO: 9766 - DNA, 25 bp, Homo sapien
aatcaaagttatgtcctccaatcta

SEQ ID NO: 9767 - DNA, 25 bp, Homo sapien
aatcaaagttatgttctccaatcta

SEQ ID NO: 9768 - DNA, 25 bp, Homo sapien
aatcaaatccattgaaggccaataa

SEQ ID NO: 9769 - DNA, 25 bp, Homo sapien
aatcaaatccatttaaggccaataa

SEQ ID NO: 9770 - DNA, 25 bp, Homo sapien
aatcaaatcctgtcgttgtaggtaa

SEQ ID NO: 9771 - DNA, 25 bp, Homo sapien
aatcaaatcctgttgttgtaggtaa

SEQ ID NO: 9772 - DNA, 25 bp, Homo sapien
aatcaaatgtcagtaaacaataaag

SEQ ID NO: 9773 - DNA, 25 bp, Homo sapien
aatcaaatttcagtaaacaataaag

SEQ ID NO: 9774 - DNA, 25 bp, Homo sapien
aatcaaatttctatagccaagtagt

SEQ ID NO: 9775 - DNA, 25 bp, Homo sapien
aatcaaatttctataggcaagtagt

SEQ ID NO: 9776 - DNA, 25 bp, Homo sapien
aatcaagaagacgctaaaaggatag

SEQ ID NO: 9777 - DNA, 25 bp, Homo sapien
aatcaagaagatgctaaaaggatag

SEQ ID NO: 9778 - DNA, 25 bp, Homo sapien
aatcaagacgagagccactcctcca

SEQ ID NO: 9779 - DNA, 25 bp, Homo sapien
aatcaagatgagagccactcctcca

SEQ ID NO: 9780 - DNA, 25 bp, Homo sapien
aatcaagctataaagaagtgtatag

SEQ ID NO: 9781 - DNA, 25 bp, Homo sapien
aatcaagctatatagaagtgtatag

SEQ ID NO: 9782 - DNA, 25 bp, Homo sapien
aatcaagtgaattctagccacttat

SEQ ID NO: 9783 - DNA, 25 bp, Homo sapien
aatcaagtgaattttagccacttat

SEQ ID NO: 9784 - DNA, 25 bp, Homo sapien
aatcaagtgctaattcattataagg

SEQ ID NO: 9785 - DNA, 25 bp, Homo sapien
aatcaagtgctaattcgttataagg

SEQ ID NO: 9786 - DNA, 25 bp, Homo sapien
aatcaatgactaacgaaaaaactac

SEQ ID NO: 9787 - DNA, 25 bp, Homo sapien
aatcaatgactaatgaaaaaactac

SEQ ID NO: 9788 - DNA, 25 bp, Homo sapien
aatcaatgatcctagcctaatgtgc

SEQ ID NO: 9789 - DNA, 25 bp, Homo sapien
aatcaatgatcctagcttaatgtgc

SEQ ID NO: 9790 - DNA, 25 bp, Homo sapien
aatcaattaaccattaatgtaacag

SEQ ID NO: 9791 - DNA, 25 bp, Homo sapien
aatcaattactgacttaacaatcag

SEQ ID NO: 9792 - DNA, 25 bp, Homo sapien
aatcaattattgacttaacaatcag

SEQ ID NO: 9793 - DNA, 25 bp, Homo sapien
aatcaatttaccattaatgtaacag

SEQ ID NO: 9794 - DNA, 25 bp, Homo sapien
aatcacaagttttgcaatttcctgt

SEQ ID NO: 9795 - DNA, 25 bp, Homo sapien
aatcacaagttttgcattttcctgt

SEQ ID NO: 9796 - DNA, 25 bp, Homo sapien
aatcacaatacaacattccctttgg

SEQ ID NO: 9797 - DNA, 25 bp, Homo sapien
aatcacaatacgacattccctttgg

SEQ ID NO: 9798 - DNA, 25 bp, Homo sapien
aatcacacaatctatctcaaataac

SEQ ID NO: 9799 - DNA, 25 bp, Homo sapien
aatcacacaatctgtctcaaataac

SEQ ID NO: 9800 - DNA, 25 bp, Homo sapien
aatcacaccatattgtttctgatgt

SEQ ID NO: 9801 - DNA, 25 bp, Homo sapien
aatcacaccgtattgtttctgatgt

SEQ ID NO: 9802 - DNA, 25 bp, Homo sapien
aatcacacgtttctcccgtgctcac

SEQ ID NO: 9803 - DNA, 25 bp, Homo sapien
aatcacacgtttctcctgtgctcac

SEQ ID NO: 9804 - DNA, 25 bp, Homo sapien
aatcacaggagtctatcacagtttt

SEQ ID NO: 9805 - DNA, 25 bp, Homo sapien
aatcacaggagtttatcacagtttt

SEQ ID NO: 9806 - DNA, 25 bp, Homo sapien
aatcacagggtccctataagagaag

SEQ ID NO: 9807 - DNA, 25 bp, Homo sapien
aatcacagggttcctataagagaag

SEQ ID NO: 9808 - DNA, 25 bp, Homo sapien
aatcacataagctcctcctctattg

SEQ ID NO: 9809 - DNA, 25 bp, Homo sapien
aatcacatatgctcctcctctattg

SEQ ID NO: 9810 - DNA, 25 bp, Homo sapien
aatcacatctgatacagaagctgca

SEQ ID NO: 9811 - DNA, 25 bp, Homo sapien
aatcacatctggtacagaagctgca

SEQ ID NO: 9812 - DNA, 25 bp, Homo sapien
aatcaccagcagaacgaagaaaaaa

SEQ ID NO: 9813 - DNA, 25 bp, Homo sapien
aatcaccagcagaatgaagaaaaaa

SEQ ID NO: 9814 - DNA, 25 bp, Homo sapien
aatcaccagctagtttcacctatac

SEQ ID NO: 9815 - DNA, 25 bp, Homo sapien
aatcaccagctagttttacctatac

SEQ ID NO: 9816 - DNA, 25 bp, Homo sapien
aatcaccaggggaatttctgaaacc

SEQ ID NO: 9817 - DNA, 25 bp, Homo sapien
aatcaccaggggagtttctgaaacc

SEQ ID NO: 9818 - DNA, 25 bp, Homo sapien
aatcacccgtcaaatctttactagc

SEQ ID NO: 9819 - DNA, 25 bp, Homo sapien
aatcacccgtcgaatctttactagc

SEQ ID NO: 9820 - DNA, 25 bp, Homo sapien
aatcacctattcaaaaggcgaatcc

SEQ ID NO: 9821 - DNA, 25 bp, Homo sapien
aatcacctattcgaaaggcgaatcc

SEQ ID NO: 9822 - DNA, 25 bp, Homo sapien
aatcacctctgaattacttgtaata

SEQ ID NO: 9823 - DNA, 25 bp, Homo sapien
aatcacctctgagttacttgtaata

SEQ ID NO: 9824 - DNA, 25 bp, Homo sapien
aatcactaatatggtcaactcttat

SEQ ID NO: 9825 - DNA, 25 bp, Homo sapien
aatcactaatatgttcaactcttat

SEQ ID NO: 9826 - DNA, 25 bp, Homo sapien
aatcactattggaaagggcctccga

SEQ ID NO: 9827 - DNA, 25 bp, Homo sapien
aatcactattggcaagggcctccga

SEQ ID NO: 9828 - DNA, 25 bp, Homo sapien
aatcactcactctgctatttatttt

SEQ ID NO: 9829 - DNA, 25 bp, Homo sapien
aatcactctctctgctatttatttt

SEQ ID NO: 9830 - DNA, 25 bp, Homo sapien
aatcactgcagttttctccatcttt

SEQ ID NO: 9831 - DNA, 25 bp, Homo sapien
aatcactgccgttttctccatcttt

SEQ ID NO: 9832 - DNA, 25 bp, Homo sapien
aatcagaaatgagcaggcttggtgg

SEQ ID NO: 9833 - DNA, 25 bp, Homo sapien
aatcagaaatgtgcaggcttggtgg

SEQ ID NO: 9834 - DNA, 25 bp, Homo sapien
aatcagaacatctcttcttgttctc

SEQ ID NO: 9835 - DNA, 25 bp, Homo sapien
aatcagaacatctctttttgttctc

SEQ ID NO: 9836 - DNA, 25 bp, Homo sapien
aatcagaagaaaaagataacagcca

SEQ ID NO: 9837 - DNA, 25 bp, Homo sapien
aatcagaagaagaagataacagcca

SEQ ID NO: 9838 - DNA, 25 bp, Homo sapien
aatcagaagtattaatagcagaaga

SEQ ID NO: 9839 - DNA, 25 bp, Homo sapien
aatcagaagtattaatggcagaaga

SEQ ID NO: 9840 - DNA, 25 bp, Homo sapien
aatcagagtagagcaagtagcagtt

SEQ ID NO: 9841 - DNA, 25 bp, Homo sapien
aatcagagtagagtaagtagcagtt

SEQ ID NO: 9842 - DNA, 25 bp, Homo sapien
aatcagatcaaaacctgaaatgatc

SEQ ID NO: 9843 - DNA, 25 bp, Homo sapien
aatcagatcaaagcctgaaatgatc

SEQ ID NO: 9844 - DNA, 25 bp, Homo sapien
aatcagatcatgtatgtgttactca

SEQ ID NO: 9845 - DNA, 25 bp, Homo sapien
aatcagatggtttttgcttttaatt

SEQ ID NO: 9846 - DNA, 25 bp, Homo sapien
aatcagatgttttttgcttttaatt

SEQ ID NO: 9847 - DNA, 25 bp, Homo sapien
aatcagattatgtatgtgttactca

SEQ ID NO: 9848 - DNA, 25 bp, Homo sapien
aatcagcaaagatcaatcaaggcag

SEQ ID NO: 9849 - DNA, 25 bp, Homo sapien
aatcagcacctactgtcaatgtagg

SEQ ID NO: 9850 - DNA, 25 bp, Homo sapien
aatcagcacctgctgtcaatgtagg

SEQ ID NO: 9851 - DNA, 25 bp, Homo sapien
aatcagcactggcatctcattttgg

SEQ ID NO: 9852 - DNA, 25 bp, Homo sapien
aatcagcactggcttctcattttgg

SEQ ID NO: 9853 - DNA, 25 bp, Homo sapien
aatcagcagagatcaatcaaggcag

SEQ ID NO: 9854 - DNA, 25 bp, Homo sapien
aatcagccacaagctttcatatcac

SEQ ID NO: 9855 - DNA, 25 bp, Homo sapien
aatcagcccggaacttctgatgaat

SEQ ID NO: 9856 - DNA, 25 bp, Homo sapien
aatcagcccggagcttctgatgaat

SEQ ID NO: 9857 - DNA, 25 bp, Homo sapien
aatcagccgcaagctttcatatcac

SEQ ID NO: 9858 - DNA, 25 bp, Homo sapien
aatcagcctctctctttttatttct

SEQ ID NO: 9859 - DNA, 25 bp, Homo sapien
aatcagcctgccaaggttccaataa

SEQ ID NO: 9860 - DNA, 25 bp, Homo sapien
aatcagcctgccaatgttccaataa

SEQ ID NO: 9861 - DNA, 25 bp, Homo sapien
aatcagcctttctctttttatttct

SEQ ID NO: 9862 - DNA, 25 bp, Homo sapien
aatcagctgatagcacaggataatg

SEQ ID NO: 9863 - DNA, 25 bp, Homo sapien
aatcagcttatagcacaggataatg

SEQ ID NO: 9864 - DNA, 25 bp, Homo sapien
aatcaggaactttaggaatatactg

SEQ ID NO: 9865 - DNA, 25 bp, Homo sapien
aatcaggaactttagggatatactg

SEQ ID NO: 9866 - DNA, 25 bp, Homo sapien
aatcaggatattggtggaactagga

SEQ ID NO: 9867 - DNA, 25 bp, Homo sapien
aatcaggatatttgtggaactagga

SEQ ID NO: 9868 - DNA, 25 bp, Homo sapien
aatcagggaaaattatagatgtcca

SEQ ID NO: 9869 - DNA, 25 bp, Homo sapien
aatcagggaaaattatggatgtcca

SEQ ID NO: 9870 - DNA, 25 bp, Homo sapien
aatcagtatacaatgggaaatcatg

SEQ ID NO: 9871 - DNA, 25 bp, Homo sapien
aatcagtatacagtgggaaatcatg

SEQ ID NO: 9872 - DNA, 25 bp, Homo sapien
aatcagtccttgtacacggtatagc

SEQ ID NO: 9873 - DNA, 25 bp, Homo sapien
aatcagtccttgtacatggtatagc

SEQ ID NO: 9874 - DNA, 25 bp, Homo sapien
aatcagtcgtacttagttggctgga

SEQ ID NO: 9875 - DNA, 25 bp, Homo sapien
aatcagtcttacttagttggctgga

SEQ ID NO: 9876 - DNA, 25 bp, Homo sapien
aatcagtgaaaactaccgaaaacac

SEQ ID NO: 9877 - DNA, 25 bp, Homo sapien
aatcagtgaaaactacggaaaacac

SEQ ID NO: 9878 - DNA, 25 bp, Homo sapien
aatcagtgccacagttgcaccaatc

SEQ ID NO: 9879 - DNA, 25 bp, Homo sapien
aatcagtgctacagttgcaccaatc

SEQ ID NO: 9880 - DNA, 25 bp, Homo sapien
aatcagtgctcaatggaatcccgtg

SEQ ID NO: 9881 - DNA, 25 bp, Homo sapien
aatcagtgctcagtggaatcccgtg

SEQ ID NO: 9882 - DNA, 25 bp, Homo sapien
aatcagtgtctaatctgatgttaaa

SEQ ID NO: 9883 - DNA, 25 bp, Homo sapien
aatcagtgtctagtctgatgttaaa

SEQ ID NO: 9884 - DNA, 25 bp, Homo sapien
aatcagtgttgaactcagtatgttt

SEQ ID NO: 9885 - DNA, 25 bp, Homo sapien
aatcagtgttgaactcggtatgttt

SEQ ID NO: 9886 - DNA, 25 bp, Homo sapien
aatcagttcagatctaatatttaga

SEQ ID NO: 9887 - DNA, 25 bp, Homo sapien
aatcagttcctgaaaatttgtgtgc

SEQ ID NO: 9888 - DNA, 25 bp, Homo sapien
aatcagtttagatctaatatttaga

SEQ ID NO: 9889 - DNA, 25 bp, Homo sapien
aatcagtttctgaaaatttgtgtgc

SEQ ID NO: 9890 - DNA, 25 bp, Homo sapien
aatcagttttaaccttgctagccta

SEQ ID NO: 9891 - DNA, 25 bp, Homo sapien
aatcagttttaacgttgctagccta

SEQ ID NO: 9892 - DNA, 25 bp, Homo sapien
aatcataacaagacattgcatttga

SEQ ID NO: 9893 - DNA, 25 bp, Homo sapien
aatcataacaagccattgcatttga

SEQ ID NO: 9894 - DNA, 25 bp, Homo sapien
aatcataagggtctataaaagtaga

SEQ ID NO: 9895 - DNA, 25 bp, Homo sapien
aatcataagggtctgtaaaagtaga

SEQ ID NO: 9896 - DNA, 25 bp, Homo sapien
aatcataggttcttccatttctgtt

SEQ ID NO: 9897 - DNA, 25 bp, Homo sapien
aatcataggttcttccgtttctgtt

SEQ ID NO: 9898 - DNA, 25 bp, Homo sapien
aatcatatttacagatacatcgaaa

SEQ ID NO: 9899 - DNA, 25 bp, Homo sapien
aatcatatttacggatacatcgaaa

SEQ ID NO: 9900 - DNA, 25 bp, Homo sapien
aatcatcaattaaatgaatcgctaa

SEQ ID NO: 9901 - DNA, 25 bp, Homo sapien
aatcatcaattgaatgaatcgctaa

SEQ ID NO: 9902 - DNA, 25 bp, Homo sapien
aatcatccaaccataattgtctaaa

SEQ ID NO: 9903 - DNA, 25 bp, Homo sapien
aatcatccaaccgtaattgtctaaa

SEQ ID NO: 9904 - DNA, 25 bp, Homo sapien
aatcatccaagcctgtgcaaattcc

SEQ ID NO: 9905 - DNA, 25 bp, Homo sapien
aatcatcccagcctgtgcaaattcc

SEQ ID NO: 9906 - DNA, 25 bp, Homo sapien
aatcatctgaatccatgcagaaaaa

SEQ ID NO: 9907 - DNA, 25 bp, Homo sapien
aatcatctgaatctatgcagaaaaa

SEQ ID NO: 9908 - DNA, 25 bp, Homo sapien
aatcatctgttcatatatctgcttc

SEQ ID NO: 9909 - DNA, 25 bp, Homo sapien
aatcatctgttcatatgtctgcttc

SEQ ID NO: 9910 - DNA, 25 bp, Homo sapien
aatcatgaaaatatgagattaagaa

SEQ ID NO: 9911 - DNA, 25 bp, Homo sapien
aatcatgagaatatgagattaagaa

SEQ ID NO: 9912 - DNA, 25 bp, Homo sapien
aatcatgcatctttgcatcaacttt

SEQ ID NO: 9913 - DNA, 25 bp, Homo sapien
aatcatgcgtctttgcatcaacttt

SEQ ID NO: 9914 - DNA, 25 bp, Homo sapien
aatcatggaatgctcagggatcaga

SEQ ID NO: 9915 - DNA, 25 bp, Homo sapien
aatcatggaatggtcagggatcaga

SEQ ID NO: 9916 - DNA, 25 bp, Homo sapien
aatcatggcagatgaaataaaaaga

SEQ ID NO: 9917 - DNA, 25 bp, Homo sapien
aatcatggcggatgaaataaaaaga

SEQ ID NO: 9918 - DNA, 25 bp, Homo sapien
aatcatgggtttctctagtgtgccg

SEQ ID NO: 9919 - DNA, 25 bp, Homo sapien
aatcatggttttctctagtgtgccg

SEQ ID NO: 9920 - DNA, 25 bp, Homo sapien
aatcatgtccagtaagagacaagga

SEQ ID NO: 9921 - DNA, 25 bp, Homo sapien
aatcatgtccagtaggagacaagga

SEQ ID NO: 9922 - DNA, 25 bp, Homo sapien
aatcatgtgatgacgagaggagaag

SEQ ID NO: 9923 - DNA, 25 bp, Homo sapien
aatcatgtgatgatgagaggagaag

SEQ ID NO: 9924 - DNA, 25 bp, Homo sapien
aatcattacagttgtggggaatgtt

SEQ ID NO: 9925 - DNA, 25 bp, Homo sapien
aatcattacggttgtggggaatgtt

SEQ ID NO: 9926 - DNA, 25 bp, Homo sapien
aatcattatcaaagctgtatgaagt

SEQ ID NO: 9927 - DNA, 25 bp, Homo sapien
aatcattatcaaagctttatgaagt

SEQ ID NO: 9928 - DNA, 25 bp, Homo sapien
aatcattgacaggcattttggcaac

SEQ ID NO: 9929 - DNA, 25 bp, Homo sapien
aatcattgacaggtattttggcaac

SEQ ID NO: 9930 - DNA, 25 bp, Homo sapien
aatcattgacattacatatgcccag

SEQ ID NO: 9931 - DNA, 25 bp, Homo sapien
aatcattgacattgcatatgcccag

SEQ ID NO: 9932 - DNA, 25 bp, Homo sapien
aatcattgccaggatttgattttat

SEQ ID NO: 9933 - DNA, 25 bp, Homo sapien
aatcattgtcaggatttgattttat

SEQ ID NO: 9934 - DNA, 25 bp, Homo sapien
aatcattttatccagtgttaaggct

SEQ ID NO: 9935 - DNA, 25 bp, Homo sapien
aatcattttatccggtgttaaggct

SEQ ID NO: 9936 - DNA, 25 bp, Homo sapien
aatcattttctcaccatattgctca

SEQ ID NO: 9937 - DNA, 25 bp, Homo sapien
aatcattttctcactatattgctca

SEQ ID NO: 9938 - DNA, 25 bp, Homo sapien
aatccaaacagaaaagggagactct

SEQ ID NO: 9939 - DNA, 25 bp, Homo sapien
aatccaaagagaaaagggagactct

SEQ ID NO: 9940 - DNA, 25 bp, Homo sapien
aatccaaataatccctgaataacat

SEQ ID NO: 9941 - DNA, 25 bp, Homo sapien
aatccaaataatccttgaataacat

SEQ ID NO: 9942 - DNA, 25 bp, Homo sapien
aatccaaattatacctttgtgaata

SEQ ID NO: 9943 - DNA, 25 bp, Homo sapien
aatccaaattatatctttgtgaata

SEQ ID NO: 9944 - DNA, 25 bp, Homo sapien
aatccaagatataattgcacaaaca

SEQ ID NO: 9945 - DNA, 25 bp, Homo sapien
aatccaagatataatttcacaaaca

SEQ ID NO: 9946 - DNA, 25 bp, Homo sapien
aatccaagcatctgaaaattgtact

SEQ ID NO: 9947 - DNA, 25 bp, Homo sapien
aatccaagcgtctgaaaattgtact

SEQ ID NO: 9948 - DNA, 25 bp, Homo sapien
aatccaagttttacgagatgacaaa

SEQ ID NO: 9949 - DNA, 25 bp, Homo sapien
aatccaagttttatgagatgacaaa

SEQ ID NO: 9950 - DNA, 25 bp, Homo sapien
aatccaattataatccatttctcat

SEQ ID NO: 9951 - DNA, 25 bp, Homo sapien
aatccaattatagtccatttctcat

SEQ ID NO: 9952 - DNA, 25 bp, Homo sapien
aatccacacaaaaggtcaaggaaat

SEQ ID NO: 9953 - DNA, 25 bp, Homo sapien
aatccacacaaagcaaagcattttc

SEQ ID NO: 9954 - DNA, 25 bp, Homo sapien
aatccacacaaggcaaagcattttc

SEQ ID NO: 9955 - DNA, 25 bp, Homo sapien
aatccacacctagaagaggaaaagc

SEQ ID NO: 9956 - DNA, 25 bp, Homo sapien
aatccacacctagcagaggaaaagc

SEQ ID NO: 9957 - DNA, 25 bp, Homo sapien
aatccacataaaaggtcaaggaaat

SEQ ID NO: 9958 - DNA, 25 bp, Homo sapien
aatccactgacaatgttatattcct

SEQ ID NO: 9959 - DNA, 25 bp, Homo sapien
aatccactgccaatgttatattcct

SEQ ID NO: 9960 - DNA, 25 bp, Homo sapien
aatccactgtttttatactggagtt

SEQ ID NO: 9961 - DNA, 25 bp, Homo sapien
aatccactgtttttgtactggagtt

SEQ ID NO: 9962 - DNA, 25 bp, Homo sapien
aatccacttgcaacaaaaactgtat

SEQ ID NO: 9963 - DNA, 25 bp, Homo sapien
aatccacttgcgacaaaaactgtat

SEQ ID NO: 9964 - DNA, 25 bp, Homo sapien
aatccagataaaactgtttttttcc

SEQ ID NO: 9965 - DNA, 25 bp, Homo sapien
aatccagataaaattgtttttttcc

SEQ ID NO: 9966 - DNA, 25 bp, Homo sapien
aatccagccaatgtcatttcccaaa

SEQ ID NO: 9967 - DNA, 25 bp, Homo sapien
aatccagcccatgtcatttcccaaa

SEQ ID NO: 9968 - DNA, 25 bp, Homo sapien
aatccaggtcctggctcctggaaag

SEQ ID NO: 9969 - DNA, 25 bp, Homo sapien
aatccaggttctggctcctggaaag

SEQ ID NO: 9970 - DNA, 25 bp, Homo sapien
aatccagtatctgcctttggtggta

SEQ ID NO: 9971 - DNA, 25 bp, Homo sapien
aatccagtgtctgcctttggtggta

SEQ ID NO: 9972 - DNA, 25 bp, Homo sapien
aatccataagacaatgtcaccatag

SEQ ID NO: 9973 - DNA, 25 bp, Homo sapien
aatccataagacagtgtcaccatag

SEQ ID NO: 9974 - DNA, 25 bp, Homo sapien
aatccataagtcatttaggagcaaa

SEQ ID NO: 9975 - DNA, 25 bp, Homo sapien
aatccataagtcgtttaggagcaaa

SEQ ID NO: 9976 - DNA, 25 bp, Homo sapien
aatccataggcccagtctaatcatg

SEQ ID NO: 9977 - DNA, 25 bp, Homo sapien
aatccatagtcccagtctaatcatg

SEQ ID NO: 9978 - DNA, 25 bp, Homo sapien
aatccatattgtttggcatcaatat

SEQ ID NO: 9979 - DNA, 25 bp, Homo sapien
aatccatattgttttgcatcaatat

SEQ ID NO: 9980 - DNA, 25 bp, Homo sapien
aatccatcggcctcctgtcagtgat

SEQ ID NO: 9981 - DNA, 25 bp, Homo sapien
aatccatctgcctcctgtcagtgat

SEQ ID NO: 9982 - DNA, 25 bp, Homo sapien
aatccatgacaacacctgggattga

SEQ ID NO: 9983 - DNA, 25 bp, Homo sapien
aatccatgacgcttgtaagtggagc

SEQ ID NO: 9984 - DNA, 25 bp, Homo sapien
aatccatgacgcttgtgagtggagc

SEQ ID NO: 9985 - DNA, 25 bp, Homo sapien
aatccatggcaacacctgggattga

SEQ ID NO: 9986 - DNA, 25 bp, Homo sapien
aatccattgaaggccaataataaat

SEQ ID NO: 9987 - DNA, 25 bp, Homo sapien
aatccatttaaggccaataataaat

SEQ ID NO: 9988 - DNA, 25 bp, Homo sapien
aatcccaacttcgttccactacagg

SEQ ID NO: 9989 - DNA, 25 bp, Homo sapien
aatcccaactttgttccactacagg

SEQ ID NO: 9990 - DNA, 25 bp, Homo sapien
aatcccaatatccttaatttcaaca

SEQ ID NO: 9991 - DNA, 25 bp, Homo sapien
aatcccaatatcgttaatttcaaca

SEQ ID NO: 9992 - DNA, 25 bp, Homo sapien
aatcccactaggttctgatgaatct

SEQ ID NO: 9993 - DNA, 25 bp, Homo sapien
aatcccacttggttctgatgaatct

SEQ ID NO: 9994 - DNA, 25 bp, Homo sapien
aatcccagacgtttaaccctcaaaa

SEQ ID NO: 9995 - DNA, 25 bp, Homo sapien
aatcccagatgtttaaccctcaaaa

SEQ ID NO: 9996 - DNA, 25 bp, Homo sapien
aatcccagcacattacaggctccat

SEQ ID NO: 9997 - DNA, 25 bp, Homo sapien
aatcccagcacattacgggctccat

SEQ ID NO: 9998 - DNA, 25 bp, Homo sapien
aatcccagtgcctaaccgggtgcct

SEQ ID NO: 9999 - DNA, 25 bp, Homo sapien
aatcccagtgcctaactgggtgcct

SEQ ID NO: 10000 - DNA, 25 bp, Homo sapien
aatccctacatgataagaaactgca

SEQ ID NO: 10001 - DNA, 25 bp, Homo sapien
aatccctacgtgataagaaactgca

SEQ ID NO: 10002 - DNA, 25 bp, Homo sapien
aatccggctgtggaagtgtgagatg

SEQ ID NO: 10003 - DNA, 25 bp, Homo sapien
aatccggctgtgggagtgtgagatg

SEQ ID NO: 10004 - DNA, 25 bp, Homo sapien
aatccgtcttgactcagcttcattt

SEQ ID NO: 10005 - DNA, 25 bp, Homo sapien
aatccgtcttgactgagcttcattt

SEQ ID NO: 10006 - DNA, 25 bp, Homo sapien
aatcctaaaatttaataaggcaaat

SEQ ID NO: 10007 - DNA, 25 bp, Homo sapien
aatcctaaaatttagtaaggcaaat

SEQ ID NO: 10008 - DNA, 25 bp, Homo sapien
aatcctacatttattttgttatatt

SEQ ID NO: 10009 - DNA, 25 bp, Homo sapien
aatcctacatttgttttgttatatt

SEQ ID NO: 10010 - DNA, 25 bp, Homo sapien
aatcctagaaataaaggaagcagtg

SEQ ID NO: 10011 - DNA, 25 bp, Homo sapien
aatcctagatataaaggaagcagtg

SEQ ID NO: 10012 - DNA, 25 bp, Homo sapien
aatcctcatgccactgaagcaatag

SEQ ID NO: 10013 - DNA, 25 bp, Homo sapien
aatcctcatgctactgaagcaatag

SEQ ID NO: 10014 - DNA, 25 bp, Homo sapien
aatcctccaaaaatgaacacagatt

SEQ ID NO: 10015 - DNA, 25 bp, Homo sapien
aatcctccagaaatgaacacagatt

SEQ ID NO: 10016 - DNA, 25 bp, Homo sapien
aatcctctattcttgtataccgaga

SEQ ID NO: 10017 - DNA, 25 bp, Homo sapien
aatcctctattcttgtgtaccgaga

SEQ ID NO: 10018 - DNA, 25 bp, Homo sapien
aatcctctcttaaccatcatgagat

SEQ ID NO: 10019 - DNA, 25 bp, Homo sapien
aatcctctcttagccatcatgagat

SEQ ID NO: 10020 - DNA, 25 bp, Homo sapien
aatcctgactgcaaacatactaatg

SEQ ID NO: 10021 - DNA, 25 bp, Homo sapien
aatcctgactgcaaacctactaatg

SEQ ID NO: 10022 - DNA, 25 bp, Homo sapien
aatcctgagttgactaagagcacat

SEQ ID NO: 10023 - DNA, 25 bp, Homo sapien
aatcctgatttgactaagagcacat

SEQ ID NO: 10024 - DNA, 25 bp, Homo sapien
aatcctgcgccatttaattgagtga

SEQ ID NO: 10025 - DNA, 25 bp, Homo sapien
aatcctgcgccttttaattgagtga

SEQ ID NO: 10026 - DNA, 25 bp, Homo sapien
aatcctggctttgctactttctaag

SEQ ID NO: 10027 - DNA, 25 bp, Homo sapien
aatcctgggtttgctactttctaag

SEQ ID NO: 10028 - DNA, 25 bp, Homo sapien
aatcctgtcgttgtaggtaaaattt

SEQ ID NO: 10029 - DNA, 25 bp, Homo sapien
aatcctgtgttaccataaaggacaa

SEQ ID NO: 10030 - DNA, 25 bp, Homo sapien
aatcctgtgttaccgtaaaggacaa

SEQ ID NO: 10031 - DNA, 25 bp, Homo sapien
aatcctgttgttgtaggtaaaattt

SEQ ID NO: 10032 - DNA, 25 bp, Homo sapien
aatccttgaaagatcccactagggc

SEQ ID NO: 10033 - DNA, 25 bp, Homo sapien
aatccttgctgctggacccaaaaat

SEQ ID NO: 10034 - DNA, 25 bp, Homo sapien
aatccttggaagatcccactagggc

SEQ ID NO: 10035 - DNA, 25 bp, Homo sapien
aatccttgttgctggacccaaaaat

SEQ ID NO: 10036 - DNA, 25 bp, Homo sapien
aatcctttagaacatgatgaaagcc

SEQ ID NO: 10037 - DNA, 25 bp, Homo sapien
aatcctttagaatatgatgaaagcc

SEQ ID NO: 10038 - DNA, 25 bp, Homo sapien
aatcctttttatccagttgttctca

SEQ ID NO: 10039 - DNA, 25 bp, Homo sapien
aatcctttttatccggttgttctca

SEQ ID NO: 10040 - DNA, 25 bp, Homo sapien
aatcgagcagaaagcacagagagtt

SEQ ID NO: 10041 - DNA, 25 bp, Homo sapien
aatcgagcggaaagcacagagagtt

SEQ ID NO: 10042 - DNA, 25 bp, Homo sapien
aatcgggcgggcagaaatacttgtc

SEQ ID NO: 10043 - DNA, 25 bp, Homo sapien
aatcgggcgggcaggaatacttgtc

SEQ ID NO: 10044 - DNA, 25 bp, Homo sapien
aatcgtcctcaatgaaaaaccttcc

SEQ ID NO: 10045 - DNA, 25 bp, Homo sapien
aatcgtcctcagtgaaaaaccttcc

SEQ ID NO: 10046 - DNA, 25 bp, Homo sapien
aatcgtgtgtttgtacatgtatctt

SEQ ID NO: 10047 - DNA, 25 bp, Homo sapien
aatcgtgtgtttgtacgtgtatctt

SEQ ID NO: 10048 - DNA, 25 bp, Homo sapien
aatctaaaatagtcatgttcttaga

SEQ ID NO: 10049 - DNA, 25 bp, Homo sapien
aatctaaactagtcatgttcttaga

SEQ ID NO: 10050 - DNA, 25 bp, Homo sapien
aatctaacacgataggcttgtataa

SEQ ID NO: 10051 - DNA, 25 bp, Homo sapien
aatctaacatgataggcttgtataa

SEQ ID NO: 10052 - DNA, 25 bp, Homo sapien
aatctaaccagaagaggagacccgg

SEQ ID NO: 10053 - DNA, 25 bp, Homo sapien
aatctaaccattgaccatattggac

SEQ ID NO: 10054 - DNA, 25 bp, Homo sapien
aatctaaccattgaccgtattggac

SEQ ID NO: 10055 - DNA, 25 bp, Homo sapien
aatctaactagaagaggagacccgg

SEQ ID NO: 10056 - DNA, 25 bp, Homo sapien
aatctaactggcttcgtattgcact

SEQ ID NO: 10057 - DNA, 25 bp, Homo sapien
aatctaactggctttgtattgcact

SEQ ID NO: 10058 - DNA, 25 bp, Homo sapien
aatctaagacttcagaaagaaacaa

SEQ ID NO: 10059 - DNA, 25 bp, Homo sapien
aatctaagacttcggaaagaaacaa

SEQ ID NO: 10060 - DNA, 25 bp, Homo sapien
aatctaagctaatgctatctcgctc

SEQ ID NO: 10061 - DNA, 25 bp, Homo sapien
aatctaagctagtgctatctcgctc

SEQ ID NO: 10062 - DNA, 25 bp, Homo sapien
aatctaatccaatgcaagacactaa

SEQ ID NO: 10063 - DNA, 25 bp, Homo sapien
aatctaatccagtgcaagacactaa

SEQ ID NO: 10064 - DNA, 25 bp, Homo sapien
aatctaatgattcagcatagttcac

SEQ ID NO: 10065 - DNA, 25 bp, Homo sapien
aatctaatgattcagcgtagttcac

SEQ ID NO: 10066 - DNA, 25 bp, Homo sapien
aatctaccaaacagaatttgaagtc

SEQ ID NO: 10067 - DNA, 25 bp, Homo sapien
aatctaccaaacagtatttgaagtc

SEQ ID NO: 10068 - DNA, 25 bp, Homo sapien
aatctacctaaacattcattgccaa

SEQ ID NO: 10069 - DNA, 25 bp, Homo sapien
aatctacctaaacgttcattgccaa

SEQ ID NO: 10070 - DNA, 25 bp, Homo sapien
aatctactattgaggtttactactc

SEQ ID NO: 10071 - DNA, 25 bp, Homo sapien
aatctactgttgaggtttactactc

SEQ ID NO: 10072 - DNA, 25 bp, Homo sapien
aatctagcagccgaactgtgctttt

SEQ ID NO: 10073 - DNA, 25 bp, Homo sapien
aatctagcagcctaactgtgctttt

SEQ ID NO: 10074 - DNA, 25 bp, Homo sapien
aatctaggaaaaaaagaacacaata

SEQ ID NO: 10075 - DNA, 25 bp, Homo sapien
aatctaggaaaaaaggaacacaata

SEQ ID NO: 10076 - DNA, 25 bp, Homo sapien
aatctagggtgctatatgcttagga

SEQ ID NO: 10077 - DNA, 25 bp, Homo sapien
aatctagggtggtatatgcttagga

SEQ ID NO: 10078 - DNA, 25 bp, Homo sapien
aatctagtcttcactgtccttcttg

SEQ ID NO: 10079 - DNA, 25 bp, Homo sapien
aatctagtcttcattgtccttcttg

SEQ ID NO: 10080 - DNA, 25 bp, Homo sapien
aatctataatgaacggttaatactt

SEQ ID NO: 10081 - DNA, 25 bp, Homo sapien
aatctataatgaatggttaatactt

SEQ ID NO: 10082 - DNA, 25 bp, Homo sapien
aatctatcttgagaatggaatttgc

SEQ ID NO: 10083 - DNA, 25 bp, Homo sapien
aatctatcttgagagtggaatttgc

SEQ ID NO: 10084 - DNA, 25 bp, Homo sapien
aatctatgaataagaaagacccaag

SEQ ID NO: 10085 - DNA, 25 bp, Homo sapien
aatctatgaatgagaaagacccaag

SEQ ID NO: 10086 - DNA, 25 bp, Homo sapien
aatctatgcttttgagtcccaatgt

SEQ ID NO: 10087 - DNA, 25 bp, Homo sapien
aatctatgctttttagtcccaatgt

SEQ ID NO: 10088 - DNA, 25 bp, Homo sapien
aatctatggttccgtgatgctgact

SEQ ID NO: 10089 - DNA, 25 bp, Homo sapien
aatctatggttctgtgatgctgact

SEQ ID NO: 10090 - DNA, 25 bp, Homo sapien
aatctattattatcttcatgttgta

SEQ ID NO: 10091 - DNA, 25 bp, Homo sapien
aatctatttactccagaagcagttt

SEQ ID NO: 10092 - DNA, 25 bp, Homo sapien
aatctatttacttcagaagcagttt

SEQ ID NO: 10093 - DNA, 25 bp, Homo sapien
aatctatttctgccttttattttaa

SEQ ID NO: 10094 - DNA, 25 bp, Homo sapien
aatctatttctggcttttattttaa

SEQ ID NO: 10095 - DNA, 25 bp, Homo sapien
aatctatttttatcttcatgttgta

SEQ ID NO: 10096 - DNA, 25 bp, Homo sapien
aatctcaactaatactctgcttttg

SEQ ID NO: 10097 - DNA, 25 bp, Homo sapien
aatctcaactaatactgtgcttttg

SEQ ID NO: 10098 - DNA, 25 bp, Homo sapien
aatctcaaggagaataaattgatac

SEQ ID NO: 10099 - DNA, 25 bp, Homo sapien
aatctcaaggagtataaattgatac

SEQ ID NO: 10100 - DNA, 25 bp, Homo sapien
aatctcacagagagagcacggactg

SEQ ID NO: 10101 - DNA, 25 bp, Homo sapien
aatctcacagagagagtacggactg

SEQ ID NO: 10102 - DNA, 25 bp, Homo sapien
aatctcactaaaattcaagaatatt

SEQ ID NO: 10103 - DNA, 25 bp, Homo sapien
aatctcactaaaattcgagaatatt

SEQ ID NO: 10104 - DNA, 25 bp, Homo sapien
aatctcaggacatccgctagcaaat

SEQ ID NO: 10105 - DNA, 25 bp, Homo sapien
aatctcaggacatctgctagcaaat

SEQ ID NO: 10106 - DNA, 25 bp, Homo sapien
aatctccaaaaactttcccaatgta

SEQ ID NO: 10107 - DNA, 25 bp, Homo sapien
aatctccaaaaactttgccaatgta

SEQ ID NO: 10108 - DNA, 25 bp, Homo sapien
aatctccaaacaatgatacatttag

SEQ ID NO: 10109 - DNA, 25 bp, Homo sapien
aatctccaaacactgatacatttag

SEQ ID NO: 10110 - DNA, 25 bp, Homo sapien
aatctccaaagctattaggactatg

SEQ ID NO: 10111 - DNA, 25 bp, Homo sapien
aatctccaaagctattgggactatg

SEQ ID NO: 10112 - DNA, 25 bp, Homo sapien
aatctccatgttgaatattcccagt

SEQ ID NO: 10113 - DNA, 25 bp, Homo sapien
aatctccatgttggatattcccagt

SEQ ID NO: 10114 - DNA, 25 bp, Homo sapien
aatctcctcactatggaaacattgg

SEQ ID NO: 10115 - DNA, 25 bp, Homo sapien
aatctcctcactgtggaaacattgg

SEQ ID NO: 10116 - DNA, 25 bp, Homo sapien
aatctcctcttccttttcttataag

SEQ ID NO: 10117 - DNA, 25 bp, Homo sapien
aatctcctcttctttttcttataag

SEQ ID NO: 10118 - DNA, 25 bp, Homo sapien
aatctctgcaacaaaatgccaggtg

SEQ ID NO: 10119 - DNA, 25 bp, Homo sapien
aatctctgcaacagaatgccaggtg

SEQ ID NO: 10120 - DNA, 25 bp, Homo sapien
aatctgaacttacgactacatgggt

SEQ ID NO: 10121 - DNA, 25 bp, Homo sapien
aatctgaacttatgactacatgggt

SEQ ID NO: 10122 - DNA, 25 bp, Homo sapien
aatctgaagcaacgacagcaaagac

SEQ ID NO: 10123 - DNA, 25 bp, Homo sapien
aatctgaagcaatgacagcaaagac

SEQ ID NO: 10124 - DNA, 25 bp, Homo sapien
aatctgaatccagattctgaaactt

SEQ ID NO: 10125 - DNA, 25 bp, Homo sapien
aatctgaatccatattctgaaactt

SEQ ID NO: 10126 - DNA, 25 bp, Homo sapien
aatctgaatgacagttgccctaaaa

SEQ ID NO: 10127 - DNA, 25 bp, Homo sapien
aatctgaatgagagttgccctaaaa

SEQ ID NO: 10128 - DNA, 25 bp, Homo sapien
aatctgaatttaatccatatgagca

SEQ ID NO: 10129 - DNA, 25 bp, Homo sapien
aatctgaatttattccatatgagca

SEQ ID NO: 10130 - DNA, 25 bp, Homo sapien
aatctgactactaatgcagctaaat

SEQ ID NO: 10131 - DNA, 25 bp, Homo sapien
aatctgactactgatgcagctaaat

SEQ ID NO: 10132 - DNA, 25 bp, Homo sapien
aatctgagagcattgttaggagagt

SEQ ID NO: 10133 - DNA, 25 bp, Homo sapien
aatctgagagcgttgttaggagagt

SEQ ID NO: 10134 - DNA, 25 bp, Homo sapien
aatctgagagtcacaaacccacctg

SEQ ID NO: 10135 - DNA, 25 bp, Homo sapien
aatctgagagtcaccaacccacctg

SEQ ID NO: 10136 - DNA, 25 bp, Homo sapien
aatctgagccttgcatatttaaaga

SEQ ID NO: 10137 - DNA, 25 bp, Homo sapien
aatctgaggaaccttcataatgctt

SEQ ID NO: 10138 - DNA, 25 bp, Homo sapien
aatctgaggaaccttcctaatgctt

SEQ ID NO: 10139 - DNA, 25 bp, Homo sapien
aatctgagtcttgcatatttaaaga

SEQ ID NO: 10140 - DNA, 25 bp, Homo sapien
aatctgatattgatcaccttattac

SEQ ID NO: 10141 - DNA, 25 bp, Homo sapien
aatctgatattgattaccttattac

SEQ ID NO: 10142 - DNA, 25 bp, Homo sapien
aatctgatatttcagttgcaggcta

SEQ ID NO: 10143 - DNA, 25 bp, Homo sapien
aatctgatatttcggttgcaggcta

SEQ ID NO: 10144 - DNA, 25 bp, Homo sapien
aatctgcatagcatcagaacagaaa

SEQ ID NO: 10145 - DNA, 25 bp, Homo sapien
aatctgcatggcatcagaacagaaa

SEQ ID NO: 10146 - DNA, 25 bp, Homo sapien
aatctgccattgtaaagagattcag

SEQ ID NO: 10147 - DNA, 25 bp, Homo sapien
aatctgcccagttgctcagccagaa

SEQ ID NO: 10148 - DNA, 25 bp, Homo sapien
aatctgcccagttgttcagccagaa

SEQ ID NO: 10149 - DNA, 25 bp, Homo sapien
aatctgccgttgtaaagagattcag

SEQ ID NO: 10150 - DNA, 25 bp, Homo sapien
aatctgctataaagcaaagcctccc

SEQ ID NO: 10151 - DNA, 25 bp, Homo sapien
aatctgctccacacaatttctcagt

SEQ ID NO: 10152 - DNA, 25 bp, Homo sapien
aatctgctccacgcaatttctcagt

SEQ ID NO: 10153 - DNA, 25 bp, Homo sapien
aatctgctcctcgaagtagggacct

SEQ ID NO: 10154 - DNA, 25 bp, Homo sapien
aatctgctccttgaagtagggacct

SEQ ID NO: 10155 - DNA, 25 bp, Homo sapien
aatctgctgtaaagcaaagcctccc

SEQ ID NO: 10156 - DNA, 25 bp, Homo sapien
aatctggcatttcgcccattattcc

SEQ ID NO: 10157 - DNA, 25 bp, Homo sapien
aatctggcatttctcccattattcc

SEQ ID NO: 10158 - DNA, 25 bp, Homo sapien
aatctggctcaaaaaccactgcacc

SEQ ID NO: 10159 - DNA, 25 bp, Homo sapien
aatctggctcaaaagccactgcacc

SEQ ID NO: 10160 - DNA, 25 bp, Homo sapien
aatctggctttaaatatctgcctta

SEQ ID NO: 10161 - DNA, 25 bp, Homo sapien
aatctggctttgaatatctgcctta

SEQ ID NO: 10162 - DNA, 25 bp, Homo sapien
aatctgtacctgcattatactggag

SEQ ID NO: 10163 - DNA, 25 bp, Homo sapien
aatctgtacttgcattatactggag

SEQ ID NO: 10164 - DNA, 25 bp, Homo sapien
aatctgtatttgcttgaatggtgaa

SEQ ID NO: 10165 - DNA, 25 bp, Homo sapien
aatctgtatttgtttgaatggtgaa

SEQ ID NO: 10166 - DNA, 25 bp, Homo sapien
aatctgtcactactggccagaacaa

SEQ ID NO: 10167 - DNA, 25 bp, Homo sapien
aatctgtcactattggccagaacaa

SEQ ID NO: 10168 - DNA, 25 bp, Homo sapien
aatctgtgagttggttacgtctgga

SEQ ID NO: 10169 - DNA, 25 bp, Homo sapien
aatctgtgcaacaggatatgtcctt

SEQ ID NO: 10170 - DNA, 25 bp, Homo sapien
aatctgtgcaataggatatgtcctt

SEQ ID NO: 10171 - DNA, 25 bp, Homo sapien
aatctgtgcagaagaaagtaactat

SEQ ID NO: 10172 - DNA, 25 bp, Homo sapien
aatctgtgcaggagaaagtaactat

SEQ ID NO: 10173 - DNA, 25 bp, Homo sapien
aatctgtgcttctcataactactgg

SEQ ID NO: 10174 - DNA, 25 bp, Homo sapien
aatctgtgcttctcctaactactgg

SEQ ID NO: 10175 - DNA, 25 bp, Homo sapien
aatctgtggatcaatttgaacatac

SEQ ID NO: 10176 - DNA, 25 bp, Homo sapien
aatctgtggatccatttgaacatac

SEQ ID NO: 10177 - DNA, 25 bp, Homo sapien
aatctgtgggttggttacgtctgga

SEQ ID NO: 10178 - DNA, 25 bp, Homo sapien
aatctgttctcagtttgggagagaa

SEQ ID NO: 10179 - DNA, 25 bp, Homo sapien
aatctgttctcagttttggagagaa

SEQ ID NO: 10180 - DNA, 25 bp, Homo sapien
aatctgttgggactgcaataaaaca

SEQ ID NO: 10181 - DNA, 25 bp, Homo sapien
aatctgttgggactgccataaaaca

SEQ ID NO: 10182 - DNA, 25 bp, Homo sapien
aatcttacgcgtactcagtttgaga

SEQ ID NO: 10183 - DNA, 25 bp, Homo sapien
aatcttacgtgtactcagtttgaga

SEQ ID NO: 10184 - DNA, 25 bp, Homo sapien
aatcttatgagaccactattactct

SEQ ID NO: 10185 - DNA, 25 bp, Homo sapien
aatcttatgaggccactattactct

SEQ ID NO: 10186 - DNA, 25 bp, Homo sapien
aatcttcagtccttatccacatttt

SEQ ID NO: 10187 - DNA, 25 bp, Homo sapien
aatcttcagtccttgtccacatttt

SEQ ID NO: 10188 - DNA, 25 bp, Homo sapien
aatcttcagttggctgggataaaaa

SEQ ID NO: 10189 - DNA, 25 bp, Homo sapien
aatcttcagttggttgggataaaaa

SEQ ID NO: 10190 - DNA, 25 bp, Homo sapien
aatcttccaagacagttacagatta

SEQ ID NO: 10191 - DNA, 25 bp, Homo sapien
aatcttccaagaccgttacagatta

SEQ ID NO: 10192 - DNA, 25 bp, Homo sapien
aatcttcctactgtttgatttgtcc

SEQ ID NO: 10193 - DNA, 25 bp, Homo sapien
aatcttcctactgttttatttgtcc

SEQ ID NO: 10194 - DNA, 25 bp, Homo sapien
aatcttctcgctgaggttagttaaa

SEQ ID NO: 10195 - DNA, 25 bp, Homo sapien
aatcttctgtagtactgccttgatt

SEQ ID NO: 10196 - DNA, 25 bp, Homo sapien
aatcttctgtagtagtgccttgatt

SEQ ID NO: 10197 - DNA, 25 bp, Homo sapien
aatcttcttgctgaggttagttaaa

SEQ ID NO: 10198 - DNA, 25 bp, Homo sapien
aatcttgaagtatgagtaagagttt

SEQ ID NO: 10199 - DNA, 25 bp, Homo sapien
aatcttgaagtttgagtaagagttt

SEQ ID NO: 10200 - DNA, 25 bp, Homo sapien
aatcttgacatactggattggaatt

SEQ ID NO: 10201 - DNA, 25 bp, Homo sapien
aatcttgacatattggattggaatt

SEQ ID NO: 10202 - DNA, 25 bp, Homo sapien
aatcttgacgaaaactttctaatga

SEQ ID NO: 10203 - DNA, 25 bp, Homo sapien
aatcttgaggcctaattactttcaa

SEQ ID NO: 10204 - DNA, 25 bp, Homo sapien
aatcttgaggcctgattactttcaa

SEQ ID NO: 10205 - DNA, 25 bp, Homo sapien
aatcttgatgaaaactttctaatga

SEQ ID NO: 10206 - DNA, 25 bp, Homo sapien
aatcttgccctgtcttccaggctgg

SEQ ID NO: 10207 - DNA, 25 bp, Homo sapien
aatcttgctctgtcttccaggctgg

SEQ ID NO: 10208 - DNA, 25 bp, Homo sapien
aatcttgctcttaaacctaaatcta

SEQ ID NO: 10209 - DNA, 25 bp, Homo sapien
aatcttgctcttaagcctaaatcta

SEQ ID NO: 10210 - DNA, 25 bp, Homo sapien
aatcttggagtgctatgtcttgttc

SEQ ID NO: 10211 - DNA, 25 bp, Homo sapien
aatcttggagtgttatgtcttgttc

SEQ ID NO: 10212 - DNA, 25 bp, Homo sapien
aatcttggtattgttcatcaatttt

SEQ ID NO: 10213 - DNA, 25 bp, Homo sapien
aatcttggtatttttcatcaatttt

SEQ ID NO: 10214 - DNA, 25 bp, Homo sapien
aatctttccaacaaaaaggtgacct

SEQ ID NO: 10215 - DNA, 25 bp, Homo sapien
aatctttctaacaaaaaggtgacct

SEQ ID NO: 10216 - DNA, 25 bp, Homo sapien
aatctttctcctcaaggagttcatg

SEQ ID NO: 10217 - DNA, 25 bp, Homo sapien
aatctttctcctcatggagttcatg

SEQ ID NO: 10218 - DNA, 25 bp, Homo sapien
aatctttgcactcagggttgaaatt

SEQ ID NO: 10219 - DNA, 25 bp, Homo sapien
aatctttgcatcaaattaacataat

SEQ ID NO: 10220 - DNA, 25 bp, Homo sapien
aatctttgcatcagattaacataat

SEQ ID NO: 10221 - DNA, 25 bp, Homo sapien
aatctttgcgctcagggttgaaatt

SEQ ID NO: 10222 - DNA, 25 bp, Homo sapien
aatcttttagtcaaatgtatcaaac

SEQ ID NO: 10223 - DNA, 25 bp, Homo sapien
aatcttttagtcaagtgtatcaaac

SEQ ID NO: 10224 - DNA, 25 bp, Homo sapien
aatgaaaacaattctggtactggtg

SEQ ID NO: 10225 - DNA, 25 bp, Homo sapien
aatgaaaagtcaagtgctgaatggg

SEQ ID NO: 10226 - DNA, 25 bp, Homo sapien
aatgaaaagtcaggtgctgaatggg

SEQ ID NO: 10227 - DNA, 25 bp, Homo sapien
aatgaaaagttaagcgattattttt

SEQ ID NO: 10228 - DNA, 25 bp, Homo sapien
aatgaaaagttaagtgattattttt

SEQ ID NO: 10229 - DNA, 25 bp, Homo sapien
aatgaaaataattctggtactggtg

SEQ ID NO: 10230 - DNA, 25 bp, Homo sapien
aatgaaaatctcagtaagaaaaaag

SEQ ID NO: 10231 - DNA, 25 bp, Homo sapien
aatgaaaatctcggtaagaaaaaag

SEQ ID NO: 10232 - DNA, 25 bp, Homo sapien
aatgaaaatgaatcaagccctttat

SEQ ID NO: 10233 - DNA, 25 bp, Homo sapien
aatgaaaatgaatcgagccctttat

SEQ ID NO: 10234 - DNA, 25 bp, Homo sapien
aatgaaaccaaaaggaattacagcc

SEQ ID NO: 10235 - DNA, 25 bp, Homo sapien
aatgaaaccgaaaggaattacagcc

SEQ ID NO: 10236 - DNA, 25 bp, Homo sapien
aatgaaatatctatgcaaatcagcc

SEQ ID NO: 10237 - DNA, 25 bp, Homo sapien
aatgaaatcacataaaccttagcac

SEQ ID NO: 10238 - DNA, 25 bp, Homo sapien
aatgaaatcacatcaaccttagcac

SEQ ID NO: 10239 - DNA, 25 bp, Homo sapien
aatgaaatgtctatgcaaatcagcc

SEQ ID NO: 10240 - DNA, 25 bp, Homo sapien
aatgaacaaatgaaaaatatgtttc

SEQ ID NO: 10241 - DNA, 25 bp, Homo sapien
aatgaacaaatggaaaatatgtttc

SEQ ID NO: 10242 - DNA, 25 bp, Homo sapien
aatgaacaggtaaaaaaaaatgcga

SEQ ID NO: 10243 - DNA, 25 bp, Homo sapien
aatgaacaggttaaaaaaaatgcga

SEQ ID NO: 10244 - DNA, 25 bp, Homo sapien
aatgaacatttattatctctgggct

SEQ ID NO: 10245 - DNA, 25 bp, Homo sapien
aatgaacatttattctctctgggct

SEQ ID NO: 10246 - DNA, 25 bp, Homo sapien
aatgaactacggtgatggccaaatt

SEQ ID NO: 10247 - DNA, 25 bp, Homo sapien
aatgaactagggtgatggccaaatt

SEQ ID NO: 10248 - DNA, 25 bp, Homo sapien
aatgaactccatcgatgtctcctga

SEQ ID NO: 10249 - DNA, 25 bp, Homo sapien
aatgaactccatggatgtctcctga

SEQ ID NO: 10250 - DNA, 25 bp, Homo sapien
aatgaagaaacatttaagattagag

SEQ ID NO: 10251 - DNA, 25 bp, Homo sapien
aatgaagaacagaatacggcactag

SEQ ID NO: 10252 - DNA, 25 bp, Homo sapien
aatgaagaacagaatatggcactag

SEQ ID NO: 10253 - DNA, 25 bp, Homo sapien
aatgaagactgccacatcagttgac

SEQ ID NO: 10254 - DNA, 25 bp, Homo sapien
aatgaagagacatttaagattagag

SEQ ID NO: 10255 - DNA, 25 bp, Homo sapien
aatgaagattgccacatcagttgac

SEQ ID NO: 10256 - DNA, 25 bp, Homo sapien
aatgaagggatgaaagaatgaatga

SEQ ID NO: 10257 - DNA, 25 bp, Homo sapien
aatgaagggatgaaggaatgaatga

SEQ ID NO: 10258 - DNA, 25 bp, Homo sapien
aatgaagtaccactttaacccacca

SEQ ID NO: 10259 - DNA, 25 bp, Homo sapien
aatgaagtaccattttaacccacca

SEQ ID NO: 10260 - DNA, 25 bp, Homo sapien
aatgaagtgtgaatgacaatagcac

SEQ ID NO: 10261 - DNA, 25 bp, Homo sapien
aatgaagtgtgaatgagaatagcac

SEQ ID NO: 10262 - DNA, 25 bp, Homo sapien
aatgaataaagacgaaaggatgagt

SEQ ID NO: 10263 - DNA, 25 bp, Homo sapien
aatgaataaagatgaaaggatgagt

SEQ ID NO: 10264 - DNA, 25 bp, Homo sapien
aatgaatacgacagcgacaacttac

SEQ ID NO: 10265 - DNA, 25 bp, Homo sapien
aatgaatacgacggcgacaacttac

SEQ ID NO: 10266 - DNA, 25 bp, Homo sapien
aatgaatactgaccatgtgctccga

SEQ ID NO: 10267 - DNA, 25 bp, Homo sapien
aatgaatagatagaggacaaagatt

SEQ ID NO: 10268 - DNA, 25 bp, Homo sapien
aatgaataggtagaggacaaagatt

SEQ ID NO: 10269 - DNA, 25 bp, Homo sapien
aatgaatattgaccatgtgctccga

SEQ ID NO: 10270 - DNA, 25 bp, Homo sapien
aatgaatcaagccctttattctcac

SEQ ID NO: 10271 - DNA, 25 bp, Homo sapien
aatgaatcagttgaattcagagaca

SEQ ID NO: 10272 - DNA, 25 bp, Homo sapien
aatgaatccaaaacaagactcaagc

SEQ ID NO: 10273 - DNA, 25 bp, Homo sapien
aatgaatccaaaactagactcaagc

SEQ ID NO: 10274 - DNA, 25 bp, Homo sapien
aatgaatcgagccctttattctcac

SEQ ID NO: 10275 - DNA, 25 bp, Homo sapien
aatgaatcggttgaattcagagaca

SEQ ID NO: 10276 - DNA, 25 bp, Homo sapien
aatgaatctgtgagttggttacgtc

SEQ ID NO: 10277 - DNA, 25 bp, Homo sapien
aatgaatctgtgggttggttacgtc

SEQ ID NO: 10278 - DNA, 25 bp, Homo sapien
aatgaatcttttccctttttgcttt

SEQ ID NO: 10279 - DNA, 25 bp, Homo sapien
aatgaatcttttctctttttgcttt

SEQ ID NO: 10280 - DNA, 25 bp, Homo sapien
aatgaatgaactccatcgatgtctc

SEQ ID NO: 10281 - DNA, 25 bp, Homo sapien
aatgaatgaactccatggatgtctc

SEQ ID NO: 10282 - DNA, 25 bp, Homo sapien
aatgaatgaatactgaccatgtgct

SEQ ID NO: 10283 - DNA, 25 bp, Homo sapien
aatgaatgaatattgaccatgtgct

SEQ ID NO: 10284 - DNA, 25 bp, Homo sapien
aatgaatgacaaaataaggaatagc

SEQ ID NO: 10285 - DNA, 25 bp, Homo sapien
aatgaatgagaaaataaggaatagc

SEQ ID NO: 10286 - DNA, 25 bp, Homo sapien
aatgaatggatggaaaatccactca

SEQ ID NO: 10287 - DNA, 25 bp, Homo sapien
aatgaatggatggcaaatccactca

SEQ ID NO: 10288 - DNA, 25 bp, Homo sapien
aatgaattccctttcttcttgtttg

SEQ ID NO: 10289 - DNA, 25 bp, Homo sapien
aatgaattctctttcttcttgtttg

SEQ ID NO: 10290 - DNA, 25 bp, Homo sapien
aatgaattttcccgagggcaggaga

SEQ ID NO: 10291 - DNA, 25 bp, Homo sapien
aatgaattttcctgagggcaggaga

SEQ ID NO: 10292 - DNA, 25 bp, Homo sapien
aatgacaaacgtccttataaatgag

SEQ ID NO: 10293 - DNA, 25 bp, Homo sapien
aatgacaaatgtccttataaatgag

SEQ ID NO: 10294 - DNA, 25 bp, Homo sapien
aatgacaacagggactgcagaaagt

SEQ ID NO: 10295 - DNA, 25 bp, Homo sapien
aatgacaacaggggctgcagaaagt

SEQ ID NO: 10296 - DNA, 25 bp, Homo sapien
aatgacaagatatactcatttgcct

SEQ ID NO: 10297 - DNA, 25 bp, Homo sapien
aatgacaagatattctcatttgcct

SEQ ID NO: 10298 - DNA, 25 bp, Homo sapien
aatgacaagggagcaaagatgggtt

SEQ ID NO: 10299 - DNA, 25 bp, Homo sapien
aatgacaagggagcgaagatgggtt

SEQ ID NO: 10300 - DNA, 25 bp, Homo sapien
aatgacaatcaccgtggtgggtttg

SEQ ID NO: 10301 - DNA, 25 bp, Homo sapien
aatgacaatcactgtggtgggtttg

SEQ ID NO: 10302 - DNA, 25 bp, Homo sapien
aatgacacaaagatgttatctggct

SEQ ID NO: 10303 - DNA, 25 bp, Homo sapien
aatgacacaaatatgttatctggct

SEQ ID NO: 10304 - DNA, 25 bp, Homo sapien
aatgacagacataatcaacagttag

SEQ ID NO: 10305 - DNA, 25 bp, Homo sapien
aatgacagacatcatcaacagttag

SEQ ID NO: 10306 - DNA, 25 bp, Homo sapien
aatgacatcttgtgttcatgatatt

SEQ ID NO: 10307 - DNA, 25 bp, Homo sapien
aatgacatcttgtgtttatgatatt

SEQ ID NO: 10308 - DNA, 25 bp, Homo sapien
aatgacatgcgtgacatattcccct

SEQ ID NO: 10309 - DNA, 25 bp, Homo sapien
aatgacatgtgtgacatattcccct

SEQ ID NO: 10310 - DNA, 25 bp, Homo sapien
aatgacattttctctcagtgttctt

SEQ ID NO: 10311 - DNA, 25 bp, Homo sapien
aatgacattttctgtcagtgttctt

SEQ ID NO: 10312 - DNA, 25 bp, Homo sapien
aatgaccaggtacgctgtcaatgag

SEQ ID NO: 10313 - DNA, 25 bp, Homo sapien
aatgaccaggtatgctgtcaatgag

SEQ ID NO: 10314 - DNA, 25 bp, Homo sapien
aatgaccagttcttcctaagtcttt

SEQ ID NO: 10315 - DNA, 25 bp, Homo sapien
aatgaccagttctttctaagtcttt

SEQ ID NO: 10316 - DNA, 25 bp, Homo sapien
aatgaccatggctctttgatatctt

SEQ ID NO: 10317 - DNA, 25 bp, Homo sapien
aatgaccatggttctttgatatctt

SEQ ID NO: 10318 - DNA, 25 bp, Homo sapien
aatgaccatttctggaaattcatag

SEQ ID NO: 10319 - DNA, 25 bp, Homo sapien
aatgaccatttctgtaaattcatag

SEQ ID NO: 10320 - DNA, 25 bp, Homo sapien
aatgaccggggaccaaccaccaaca

SEQ ID NO: 10321 - DNA, 25 bp, Homo sapien
aatgaccggtgaccaaccaccaaca

SEQ ID NO: 10322 - DNA, 25 bp, Homo sapien
aatgacctacatagcattaaaacag

SEQ ID NO: 10323 - DNA, 25 bp, Homo sapien
aatgacctatatagcattaaaacag

SEQ ID NO: 10324 - DNA, 25 bp, Homo sapien
aatgactaaaacaattgcatttaaa

SEQ ID NO: 10325 - DNA, 25 bp, Homo sapien
aatgactaaaacacttgcatttaaa

SEQ ID NO: 10326 - DNA, 25 bp, Homo sapien
aatgactaacgaaaaaactaccaaa

SEQ ID NO: 10327 - DNA, 25 bp, Homo sapien
aatgactaatgaaaaaactaccaaa

SEQ ID NO: 10328 - DNA, 25 bp, Homo sapien
aatgactagatggagtgtgttttat

SEQ ID NO: 10329 - DNA, 25 bp, Homo sapien
aatgactagatggagtttgttttat

SEQ ID NO: 10330 - DNA, 25 bp, Homo sapien
aatgactcaaaatcatcttcagaca

SEQ ID NO: 10331 - DNA, 25 bp, Homo sapien
aatgactcaaaatcattttcagaca

SEQ ID NO: 10332 - DNA, 25 bp, Homo sapien
aatgactcatacagtgagaaagtga

SEQ ID NO: 10333 - DNA, 25 bp, Homo sapien
aatgactcatatagtgagaaagtga

SEQ ID NO: 10334 - DNA, 25 bp, Homo sapien
aatgactgagaaataattgatacat

SEQ ID NO: 10335 - DNA, 25 bp, Homo sapien
aatgactgagaactaattgatacat

SEQ ID NO: 10336 - DNA, 25 bp, Homo sapien
aatgacttatttggagcagtgattg

SEQ ID NO: 10337 - DNA, 25 bp, Homo sapien
aatgacttatttggagtagtgattg

SEQ ID NO: 10338 - DNA, 25 bp, Homo sapien
aatgacttcctcgaagccagtgttt

SEQ ID NO: 10339 - DNA, 25 bp, Homo sapien
aatgacttccttgaagccagtgttt

SEQ ID NO: 10340 - DNA, 25 bp, Homo sapien
aatgacttgagtagtcaaagggcat

SEQ ID NO: 10341 - DNA, 25 bp, Homo sapien
aatgacttgcgtagtcaaagggcat

SEQ ID NO: 10342 - DNA, 25 bp, Homo sapien
aatgagaaacaacgaagcaagccta

SEQ ID NO: 10343 - DNA, 25 bp, Homo sapien
aatgagaaacaatgaagcaagccta

SEQ ID NO: 10344 - DNA, 25 bp, Homo sapien
aatgagaaagaatttttttgcccct

SEQ ID NO: 10345 - DNA, 25 bp, Homo sapien
aatgagaaataatttttttgcccct

SEQ ID NO: 10346 - DNA, 25 bp, Homo sapien
aatgagaacttccaaattaaccaaa

SEQ ID NO: 10347 - DNA, 25 bp, Homo sapien
aatgagaagaaaagagaaagaactg

SEQ ID NO: 10348 - DNA, 25 bp, Homo sapien
aatgagaagaaaggagaaagaactg

SEQ ID NO: 10349 - DNA, 25 bp, Homo sapien
aatgagaagacggaatcagcaggta

SEQ ID NO: 10350 - DNA, 25 bp, Homo sapien
aatgagaagacggactcagcaggta

SEQ ID NO: 10351 - DNA, 25 bp, Homo sapien
aatgagaagcaaaaccacgtcttac

SEQ ID NO: 10352 - DNA, 25 bp, Homo sapien
aatgagaagcaaaatcacgtcttac

SEQ ID NO: 10353 - DNA, 25 bp, Homo sapien
aatgagaagggtaagagacttagga

SEQ ID NO: 10354 - DNA, 25 bp, Homo sapien
aatgagaagggtaggagacttagga

SEQ ID NO: 10355 - DNA, 25 bp, Homo sapien
aatgagaattacatcatctgcttct

SEQ ID NO: 10356 - DNA, 25 bp, Homo sapien
aatgagaattacttcatctgcttct

SEQ ID NO: 10357 - DNA, 25 bp, Homo sapien
aatgagaatttccaaattaaccaaa

SEQ ID NO: 10358 - DNA, 25 bp, Homo sapien
aatgagacaagagagtaggatctgg

SEQ ID NO: 10359 - DNA, 25 bp, Homo sapien
aatgagacaggagagtaggatctgg

SEQ ID NO: 10360 - DNA, 25 bp, Homo sapien
aatgagactacaaacaatccagcct

SEQ ID NO: 10361 - DNA, 25 bp, Homo sapien
aatgagactacacacaatccagcct

SEQ ID NO: 10362 - DNA, 25 bp, Homo sapien
aatgagagatgctggttttaagtct

SEQ ID NO: 10363 - DNA, 25 bp, Homo sapien
aatgagagatgttggttttaagtct

SEQ ID NO: 10364 - DNA, 25 bp, Homo sapien
aatgagataaacaatgtctcttact

SEQ ID NO: 10365 - DNA, 25 bp, Homo sapien
aatgagataaacgatgtctcttact

SEQ ID NO: 10366 - DNA, 25 bp, Homo sapien
aatgagatgttcactggaggatttg

SEQ ID NO: 10367 - DNA, 25 bp, Homo sapien
aatgagatgttcattggaggatttg

SEQ ID NO: 10368 - DNA, 25 bp, Homo sapien
aatgagattaagaactggaataaga

SEQ ID NO: 10369 - DNA, 25 bp, Homo sapien
aatgagattaagaattggaataaga

SEQ ID NO: 10370 - DNA, 25 bp, Homo sapien
aatgagattgattataaacctatgt

SEQ ID NO: 10371 - DNA, 25 bp, Homo sapien
aatgagattgattgtaaacctatgt

SEQ ID NO: 10372 - DNA, 25 bp, Homo sapien
aatgagcaaattgtggtatattcat

SEQ ID NO: 10373 - DNA, 25 bp, Homo sapien
aatgagcaaattttggtatattcat

SEQ ID NO: 10374 - DNA, 25 bp, Homo sapien
aatgagcaacagacatttctgcaac

SEQ ID NO: 10375 - DNA, 25 bp, Homo sapien
aatgagcaacagacttttctgcaac

SEQ ID NO: 10376 - DNA, 25 bp, Homo sapien
aatgagcagaaataggagacctggg

SEQ ID NO: 10377 - DNA, 25 bp, Homo sapien
aatgagcagaagtaggagacctggg

SEQ ID NO: 10378 - DNA, 25 bp, Homo sapien
aatgagcattttcttttgccaaaaa

SEQ ID NO: 10379 - DNA, 25 bp, Homo sapien
aatgagcattttgttttgccaaaaa

SEQ ID NO: 10380 - DNA, 25 bp, Homo sapien
aatgagcccagctgaacactctata

SEQ ID NO: 10381 - DNA, 25 bp, Homo sapien
aatgagcccagttgaacactctata

SEQ ID NO: 10382 - DNA, 25 bp, Homo sapien
aatgagcctataacctctgttgttt

SEQ ID NO: 10383 - DNA, 25 bp, Homo sapien
aatgagcctataagctctgttgttt

SEQ ID NO: 10384 - DNA, 25 bp, Homo sapien
aatgagctatacttctacaccacat

SEQ ID NO: 10385 - DNA, 25 bp, Homo sapien
aatgagctatacttctgcaccacat

SEQ ID NO: 10386 - DNA, 25 bp, Homo sapien
aatgaggacatgtcaaaatcacaat

SEQ ID NO: 10387 - DNA, 25 bp, Homo sapien
aatgaggacatgtcgaaatcacaat

SEQ ID NO: 10388 - DNA, 25 bp, Homo sapien
aatgaggcttcaagaagtctgtttc

SEQ ID NO: 10389 - DNA, 25 bp, Homo sapien
aatgaggcttcaggaagtctgtttc

SEQ ID NO: 10390 - DNA, 25 bp, Homo sapien
aatgagggaaccgaggtatagaaag

SEQ ID NO: 10391 - DNA, 25 bp, Homo sapien
aatgagggaactgaggtatagaaag

SEQ ID NO: 10392 - DNA, 25 bp, Homo sapien
aatgaggtcaccaagtgatggattc

SEQ ID NO: 10393 - DNA, 25 bp, Homo sapien
aatgaggtcgccaagtgatggattc

SEQ ID NO: 10394 - DNA, 25 bp, Homo sapien
aatgaggttccaatgcatgctacca

SEQ ID NO: 10395 - DNA, 25 bp, Homo sapien
aatgaggttccgatgcatgctacca

SEQ ID NO: 10396 - DNA, 25 bp, Homo sapien
aatgagtatgccctaaaattgtgtg

SEQ ID NO: 10397 - DNA, 25 bp, Homo sapien
aatgagtatgccttaaaattgtgtg

SEQ ID NO: 10398 - DNA, 25 bp, Homo sapien
aatgagtctaagctgaatctagtta

SEQ ID NO: 10399 - DNA, 25 bp, Homo sapien
aatgagtctaaggtgaatctagtta

SEQ ID NO: 10400 - DNA, 25 bp, Homo sapien
aatgagtgacatgcctttgatagta

SEQ ID NO: 10401 - DNA, 25 bp, Homo sapien
aatgagtgattaaaaccaggaaacc

SEQ ID NO: 10402 - DNA, 25 bp, Homo sapien
aatgagtggcatgcctttgatagta

SEQ ID NO: 10403 - DNA, 25 bp, Homo sapien
aatgagtggttaaaaccaggaaacc

SEQ ID NO: 10404 - DNA, 25 bp, Homo sapien
aatgagttcaaggaaggccaagaga

SEQ ID NO: 10405 - DNA, 25 bp, Homo sapien
aatgagttcaagtaaggccaagaga

SEQ ID NO: 10406 - DNA, 25 bp, Homo sapien
aatgagttcatgcatcaactatagt

SEQ ID NO: 10407 - DNA, 25 bp, Homo sapien
aatgagttcgtgcatcaactatagt

SEQ ID NO: 10408 - DNA, 25 bp, Homo sapien
aatgagttgggaagaagttctctcc

SEQ ID NO: 10409 - DNA, 25 bp, Homo sapien
aatgagttgggtagaagttctctcc

SEQ ID NO: 10410 - DNA, 25 bp, Homo sapien
aatgataacagagtaccctggaaaa

SEQ ID NO: 10411 - DNA, 25 bp, Homo sapien
aatgataactcccatttttggagcc

SEQ ID NO: 10412 - DNA, 25 bp, Homo sapien
aatgataactcccttttttggagcc

SEQ ID NO: 10413 - DNA, 25 bp, Homo sapien
aatgataagagagtaccctggaaaa

SEQ ID NO: 10414 - DNA, 25 bp, Homo sapien
aatgataccctacatacaaaatact

SEQ ID NO: 10415 - DNA, 25 bp, Homo sapien
aatgatactctacatacaaaatact

SEQ ID NO: 10416 - DNA, 25 bp, Homo sapien
aatgatagaaaaggaaagagtaact

SEQ ID NO: 10417 - DNA, 25 bp, Homo sapien
aatgatagaaaagtaaagagtaact

SEQ ID NO: 10418 - DNA, 25 bp, Homo sapien
aatgatagaacatcatccttccatt

SEQ ID NO: 10419 - DNA, 25 bp, Homo sapien
aatgatagaacgtcatccttccatt

SEQ ID NO: 10420 - DNA, 25 bp, Homo sapien
aatgatagcaattcacgctagagtc

SEQ ID NO: 10421 - DNA, 25 bp, Homo sapien
aatgatagcgattcacgctagagtc

SEQ ID NO: 10422 - DNA, 25 bp, Homo sapien
aatgatataatgctgaattactggc

SEQ ID NO: 10423 - DNA, 25 bp, Homo sapien
aatgatataatgttgaattactggc

SEQ ID NO: 10424 - DNA, 25 bp, Homo sapien
aatgatcccaaattcacacaggtag

SEQ ID NO: 10425 - DNA, 25 bp, Homo sapien
aatgatcccaagttcacacaggtag

SEQ ID NO: 10426 - DNA, 25 bp, Homo sapien
aatgatcctagcctaatgtgctatt

SEQ ID NO: 10427 - DNA, 25 bp, Homo sapien
aatgatcctagcttaatgtgctatt

SEQ ID NO: 10428 - DNA, 25 bp, Homo sapien
aatgatctgcgagcgtctaactgtg

SEQ ID NO: 10429 - DNA, 25 bp, Homo sapien
aatgatctgcgagtgtctaactgtg

SEQ ID NO: 10430 - DNA, 25 bp, Homo sapien
aatgatgaaaataagcaagttacca

SEQ ID NO: 10431 - DNA, 25 bp, Homo sapien
aatgatgaaaataagcgagttacca

SEQ ID NO: 10432 - DNA, 25 bp, Homo sapien
aatgatgaaggatagaaaatggaat

SEQ ID NO: 10433 - DNA, 25 bp, Homo sapien
aatgatgaaggatagagaatggaat

SEQ ID NO: 10434 - DNA, 25 bp, Homo sapien
aatgatgacagaattaagttgttgg

SEQ ID NO: 10435 - DNA, 25 bp, Homo sapien
aatgatgatagaattaagttgttgg

SEQ ID NO: 10436 - DNA, 25 bp, Homo sapien
aatgatgctatacgctttatatatt

SEQ ID NO: 10437 - DNA, 25 bp, Homo sapien
aatgatgctatatgctttatatatt

SEQ ID NO: 10438 - DNA, 25 bp, Homo sapien
aatgatgggtagagtctaaaagagg

SEQ ID NO: 10439 - DNA, 25 bp, Homo sapien
aatgatgggtgtccaaaaagtgtta

SEQ ID NO: 10440 - DNA, 25 bp, Homo sapien
aatgatgggtgttcaaaaagtgtta

SEQ ID NO: 10441 - DNA, 25 bp, Homo sapien
aatgatggttagagtctaaaagagg

SEQ ID NO: 10442 - DNA, 25 bp, Homo sapien
aatgatgtatcagaccattcatgtt

SEQ ID NO: 10443 - DNA, 25 bp, Homo sapien
aatgatgtatctgaccattcatgtt

SEQ ID NO: 10444 - DNA, 25 bp, Homo sapien
aatgatgtatggccgtgcaatgtgt

SEQ ID NO: 10445 - DNA, 25 bp, Homo sapien
aatgatgtatggctgtgcaatgtgt

SEQ ID NO: 10446 - DNA, 25 bp, Homo sapien
aatgatgtgaccataagccaagggt

SEQ ID NO: 10447 - DNA, 25 bp, Homo sapien
aatgatgtggccataagccaagggt

SEQ ID NO: 10448 - DNA, 25 bp, Homo sapien
aatgattaaaaagactaaaaataac

SEQ ID NO: 10449 - DNA, 25 bp, Homo sapien
aatgattagaaagactaaaaataac

SEQ ID NO: 10450 - DNA, 25 bp, Homo sapien
aatgattagcagagtctattgaaat

SEQ ID NO: 10451 - DNA, 25 bp, Homo sapien
aatgattatcagagtctattgaaat

SEQ ID NO: 10452 - DNA, 25 bp, Homo sapien
aatgattcaaagacggttagaggat

SEQ ID NO: 10453 - DNA, 25 bp, Homo sapien
aatgattcaaagatggttagaggat

SEQ ID NO: 10454 - DNA, 25 bp, Homo sapien
aatgattcaagagggagaggacaaa

SEQ ID NO: 10455 - DNA, 25 bp, Homo sapien
aatgattcagcatagttcactactt

SEQ ID NO: 10456 - DNA, 25 bp, Homo sapien
aatgattcagcgtagttcactactt

SEQ ID NO: 10457 - DNA, 25 bp, Homo sapien
aatgattcaggagggagaggacaaa

SEQ ID NO: 10458 - DNA, 25 bp, Homo sapien
aatgattccggaaagttaacttgta

SEQ ID NO: 10459 - DNA, 25 bp, Homo sapien
aatgattccgggaagttaacttgta

SEQ ID NO: 10460 - DNA, 25 bp, Homo sapien
aatgattcttaaataacatcatgca

SEQ ID NO: 10461 - DNA, 25 bp, Homo sapien
aatgattcttaagtaacatcatgca

SEQ ID NO: 10462 - DNA, 25 bp, Homo sapien
aatgattgaatcggctaaatatctc

SEQ ID NO: 10463 - DNA, 25 bp, Homo sapien
aatgattgaattggctaaatatctc

SEQ ID NO: 10464 - DNA, 25 bp, Homo sapien
aatgattgagtaaaagtgatttttc

SEQ ID NO: 10465 - DNA, 25 bp, Homo sapien
aatgattgcgtaaaagtgatttttc

SEQ ID NO: 10466 - DNA, 25 bp, Homo sapien
aatgattggatataggttgaggggt

SEQ ID NO: 10467 - DNA, 25 bp, Homo sapien
aatgattggatgtaggttgaggggt

SEQ ID NO: 10468 - DNA, 25 bp, Homo sapien
aatgattgtcaagtggtcataatac

SEQ ID NO: 10469 - DNA, 25 bp, Homo sapien
aatgattgtcaagttgtcataatac

SEQ ID NO: 10470 - DNA, 25 bp, Homo sapien
aatgattgttacagccaatgaacac

SEQ ID NO: 10471 - DNA, 25 bp, Homo sapien
aatgattgttatagccaatgaacac

SEQ ID NO: 10472 - DNA, 25 bp, Homo sapien
aatgattgttccgagggttttgtaa

SEQ ID NO: 10473 - DNA, 25 bp, Homo sapien
aatgattgttctgagggttttgtaa

SEQ ID NO: 10474 - DNA, 25 bp, Homo sapien
aatgatttctaagtaaacaacaaaa

SEQ ID NO: 10475 - DNA, 25 bp, Homo sapien
aatgatttctaggtaaacaacaaaa

SEQ ID NO: 10476 - DNA, 25 bp, Homo sapien
aatgatttgagagacaatcttggaa

SEQ ID NO: 10477 - DNA, 25 bp, Homo sapien
aatgatttgagagagaatcttggaa

SEQ ID NO: 10478 - DNA, 25 bp, Homo sapien
aatgatttgagtctaaaaacaaggc

SEQ ID NO: 10479 - DNA, 25 bp, Homo sapien
aatgatttgagtctaagaacaaggc

SEQ ID NO: 10480 - DNA, 25 bp, Homo sapien
aatgatttgtgccactaagaaacaa

SEQ ID NO: 10481 - DNA, 25 bp, Homo sapien
aatgatttgtgtcactaagaaacaa

SEQ ID NO: 10482 - DNA, 25 bp, Homo sapien
aatgcaaaagaatatcgagggtact

SEQ ID NO: 10483 - DNA, 25 bp, Homo sapien
aatgcaaaagagtatcgagggtact

SEQ ID NO: 10484 - DNA, 25 bp, Homo sapien
aatgcaaaaggtacaaaaaccaatg

SEQ ID NO: 10485 - DNA, 25 bp, Homo sapien
aatgcaaaaggtacgaaaaccaatg

SEQ ID NO: 10486 - DNA, 25 bp, Homo sapien
aatgcaaaagtcccacatgtcctca

SEQ ID NO: 10487 - DNA, 25 bp, Homo sapien
aatgcaaaagtcccgcatgtcctca

SEQ ID NO: 10488 - DNA, 25 bp, Homo sapien
aatgcaaactgatatagccactctg

SEQ ID NO: 10489 - DNA, 25 bp, Homo sapien
aatgcaaactggtatagccactctg

SEQ ID NO: 10490 - DNA, 25 bp, Homo sapien
aatgcaaatgagccttttttccttc

SEQ ID NO: 10491 - DNA, 25 bp, Homo sapien
aatgcaaatgagtcttttttccttc

SEQ ID NO: 10492 - DNA, 25 bp, Homo sapien
aatgcaacaaacattcacatagaat

SEQ ID NO: 10493 - DNA, 25 bp, Homo sapien
aatgcaacaaacgttcacatagaat

SEQ ID NO: 10494 - DNA, 25 bp, Homo sapien
aatgcaacactgagttttcctcaaa

SEQ ID NO: 10495 - DNA, 25 bp, Homo sapien
aatgcaacactgtgttttcctcaaa

SEQ ID NO: 10496 - DNA, 25 bp, Homo sapien
aatgcaacagaattcagtccagatg

SEQ ID NO: 10497 - DNA, 25 bp, Homo sapien
aatgcaacataattcagtccagatg

SEQ ID NO: 10498 - DNA, 25 bp, Homo sapien
aatgcaagatttatgagtcatgaaa

SEQ ID NO: 10499 - DNA, 25 bp, Homo sapien
aatgcaagatttgtgagtcatgaaa

SEQ ID NO: 10500 - DNA, 25 bp, Homo sapien
aatgcaagttttcagcttattggca

SEQ ID NO: 10501 - DNA, 25 bp, Homo sapien
aatgcaagttttccgcttattggca

SEQ ID NO: 10502 - DNA, 25 bp, Homo sapien
aatgcaatacatttggaactggaga

SEQ ID NO: 10503 - DNA, 25 bp, Homo sapien
aatgcaatccatttggaactggaga

SEQ ID NO: 10504 - DNA, 25 bp, Homo sapien
aatgcacacatgtcaaggtgttcaa

SEQ ID NO: 10505 - DNA, 25 bp, Homo sapien
aatgcacactccataatctcaaaca

SEQ ID NO: 10506 - DNA, 25 bp, Homo sapien
aatgcacagaaacagggcagcacaa

SEQ ID NO: 10507 - DNA, 25 bp, Homo sapien
aatgcacagaaacggggcagcacaa

SEQ ID NO: 10508 - DNA, 25 bp, Homo sapien
aatgcacagatgtcaaggtgttcaa

SEQ ID NO: 10509 - DNA, 25 bp, Homo sapien
aatgcacattccataatctcaaaca

SEQ ID NO: 10510 - DNA, 25 bp, Homo sapien
aatgcaccaagtggtcttcctaaaa

SEQ ID NO: 10511 - DNA, 25 bp, Homo sapien
aatgcaccgagtggtcttcctaaaa

SEQ ID NO: 10512 - DNA, 25 bp, Homo sapien
aatgcacgggttgaccctacagaaa

SEQ ID NO: 10513 - DNA, 25 bp, Homo sapien
aatgcacgggttgaccttacagaaa

SEQ ID NO: 10514 - DNA, 25 bp, Homo sapien
aatgcacttgagtgaacgggtgaaa

SEQ ID NO: 10515 - DNA, 25 bp, Homo sapien
aatgcacttgagtgaatgggtgaaa

SEQ ID NO: 10516 - DNA, 25 bp, Homo sapien
aatgcagcaatctcaggctttattt

SEQ ID NO: 10517 - DNA, 25 bp, Homo sapien
aatgcagccagagagaatagccaga

SEQ ID NO: 10518 - DNA, 25 bp, Homo sapien
aatgcagcccgagagaatagccaga

SEQ ID NO: 10519 - DNA, 25 bp, Homo sapien
aatgcagcgatctcaggctttattt

SEQ ID NO: 10520 - DNA, 25 bp, Homo sapien
aatgcaggaaacgctgaggctttga

SEQ ID NO: 10521 - DNA, 25 bp, Homo sapien
aatgcaggaaatgctgaggctttga

SEQ ID NO: 10522 - DNA, 25 bp, Homo sapien
aatgcagtaggtagtctctttctcc

SEQ ID NO: 10523 - DNA, 25 bp, Homo sapien
aatgcagtaggtggtctctttctcc

SEQ ID NO: 10524 - DNA, 25 bp, Homo sapien
aatgcagtatatccaaagtttaatt

SEQ ID NO: 10525 - DNA, 25 bp, Homo sapien
aatgcagtatatccgaagtttaatt

SEQ ID NO: 10526 - DNA, 25 bp, Homo sapien
aatgcagttttaagatgcagaatta

SEQ ID NO: 10527 - DNA, 25 bp, Homo sapien
aatgcagttttaggatgcagaatta

SEQ ID NO: 10528 - DNA, 25 bp, Homo sapien
aatgcatatacatgcgggagaaact

SEQ ID NO: 10529 - DNA, 25 bp, Homo sapien
aatgcatatacatgtgggagaaact

SEQ ID NO: 10530 - DNA, 25 bp, Homo sapien
aatgcatgaatgtaaggtatgaatc

SEQ ID NO: 10531 - DNA, 25 bp, Homo sapien
aatgcatgacccaaagtgttcttgt

SEQ ID NO: 10532 - DNA, 25 bp, Homo sapien
aatgcatgataagctgggttcttaa

SEQ ID NO: 10533 - DNA, 25 bp, Homo sapien
aatgcatgataatctgggttcttaa

SEQ ID NO: 10534 - DNA, 25 bp, Homo sapien
aatgcatgattgtaaggtatgaatc

SEQ ID NO: 10535 - DNA, 25 bp, Homo sapien
aatgcatgtcccaaagtgttcttgt

SEQ ID NO: 10536 - DNA, 25 bp, Homo sapien
aatgcatgtgaaacactactgaatg

SEQ ID NO: 10537 - DNA, 25 bp, Homo sapien
aatgcatgtgaagcactactgaatg

SEQ ID NO: 10538 - DNA, 25 bp, Homo sapien
aatgcatttaagcagatgtcaaggg

SEQ ID NO: 10539 - DNA, 25 bp, Homo sapien
aatgcatttaaggagatgtcaaggg

SEQ ID NO: 10540 - DNA, 25 bp, Homo sapien
aatgcatttccttcgtgtccaagct

SEQ ID NO: 10541 - DNA, 25 bp, Homo sapien
aatgcatttcctttgtgtccaagct

SEQ ID NO: 10542 - DNA, 25 bp, Homo sapien
aatgcatttcggccatgaggttaaa

SEQ ID NO: 10543 - DNA, 25 bp, Homo sapien
aatgcattttggccatgaggttaaa

SEQ ID NO: 10544 - DNA, 25 bp, Homo sapien
aatgccaaaaatatgctctcaaagg

SEQ ID NO: 10545 - DNA, 25 bp, Homo sapien
aatgccaaacatatgctctcaaagg

SEQ ID NO: 10546 - DNA, 25 bp, Homo sapien
aatgccaacggctacagacaaaaat

SEQ ID NO: 10547 - DNA, 25 bp, Homo sapien
aatgccaatggctacagacaaaaat

SEQ ID NO: 10548 - DNA, 25 bp, Homo sapien
aatgccaattttatgtaagagctga

SEQ ID NO: 10549 - DNA, 25 bp, Homo sapien
aatgccaattttatgttagagctga

SEQ ID NO: 10550 - DNA, 25 bp, Homo sapien
aatgccacaacatgactggaatgct

SEQ ID NO: 10551 - DNA, 25 bp, Homo sapien
aatgccacaacatggctggaatgct

SEQ ID NO: 10552 - DNA, 25 bp, Homo sapien
aatgccacaggtaagctaagagcaa

SEQ ID NO: 10553 - DNA, 25 bp, Homo sapien
aatgccacgggtaagctaagagcaa

SEQ ID NO: 10554 - DNA, 25 bp, Homo sapien
aatgccagatgatgaatccatgacg

SEQ ID NO: 10555 - DNA, 25 bp, Homo sapien
aatgccaggtgatgaatccatgacg

SEQ ID NO: 10556 - DNA, 25 bp, Homo sapien
aatgccaggttcatattcaaaataa

SEQ ID NO: 10557 - DNA, 25 bp, Homo sapien
aatgccaggttgatattcaaaataa

SEQ ID NO: 10558 - DNA, 25 bp, Homo sapien
aatgccatcccattctcttctgacc

SEQ ID NO: 10559 - DNA, 25 bp, Homo sapien
aatgccatcccattgtcttctgacc

SEQ ID NO: 10560 - DNA, 25 bp, Homo sapien
aatgcccattcctggttcatgagag

SEQ ID NO: 10561 - DNA, 25 bp, Homo sapien
aatgcccattcttggttcatgagag

SEQ ID NO: 10562 - DNA, 25 bp, Homo sapien
aatgcccttctgcatatagccatct

SEQ ID NO: 10563 - DNA, 25 bp, Homo sapien
aatgcccttttgcatatagccatct

SEQ ID NO: 10564 - DNA, 25 bp, Homo sapien
aatgccgaatttacgaacagctgtg

SEQ ID NO: 10565 - DNA, 25 bp, Homo sapien
aatgccgaatttatgaacagctgtg

SEQ ID NO: 10566 - DNA, 25 bp, Homo sapien
aatgcctaacgcagagtaaacattc

SEQ ID NO: 10567 - DNA, 25 bp, Homo sapien
aatgcctaatgcagagtaaacattc

SEQ ID NO: 10568 - DNA, 25 bp, Homo sapien
aatgcctaggagtgaacaggttggg

SEQ ID NO: 10569 - DNA, 25 bp, Homo sapien
aatgcctatgagtgaacaggttggg

SEQ ID NO: 10570 - DNA, 25 bp, Homo sapien
aatgcctattagatagttgtggagc

SEQ ID NO: 10571 - DNA, 25 bp, Homo sapien
aatgcctattatatagttgtggagc

SEQ ID NO: 10572 - DNA, 25 bp, Homo sapien
aatgcctcagctgcaataaaaaagt

SEQ ID NO: 10573 - DNA, 25 bp, Homo sapien
aatgcctcagctgcgataaaaaagt

SEQ ID NO: 10574 - DNA, 25 bp, Homo sapien
aatgcctcctaaggatttagctgtg

SEQ ID NO: 10575 - DNA, 25 bp, Homo sapien
aatgcctcctaatgatttagctgtg

SEQ ID NO: 10576 - DNA, 25 bp, Homo sapien
aatgcctgacgaaggagttcctcta

SEQ ID NO: 10577 - DNA, 25 bp, Homo sapien
aatgcctgatgaaggagttcctcta

SEQ ID NO: 10578 - DNA, 25 bp, Homo sapien
aatgcctgtaaattcacggctatgg

SEQ ID NO: 10579 - DNA, 25 bp, Homo sapien
aatgcctgtaaattcatggctatgg

SEQ ID NO: 10580 - DNA, 25 bp, Homo sapien
aatgccttcctttgtacttcagtgc

SEQ ID NO: 10581 - DNA, 25 bp, Homo sapien
aatgccttcttcggttgacaagttc

SEQ ID NO: 10582 - DNA, 25 bp, Homo sapien
aatgccttctttggttgacaagttc

SEQ ID NO: 10583 - DNA, 25 bp, Homo sapien
aatgccttcttttgtacttcagtgc

SEQ ID NO: 10584 - DNA, 25 bp, Homo sapien
aatgccttgccaatattgaaataaa

SEQ ID NO: 10585 - DNA, 25 bp, Homo sapien
aatgccttgccagtattgaaataaa

SEQ ID NO: 10586 - DNA, 25 bp, Homo sapien
aatgccttttgagtaaacaaaatta

SEQ ID NO: 10587 - DNA, 25 bp, Homo sapien
aatgccttttgattaaacaaaatta

SEQ ID NO: 10588 - DNA, 25 bp, Homo sapien
aatgcgctttctaatgtctgagtga

SEQ ID NO: 10589 - DNA, 25 bp, Homo sapien
aatgcgctttctactgtctgagtga

SEQ ID NO: 10590 - DNA, 25 bp, Homo sapien
aatgcggaaaacgctgccaagacaa

SEQ ID NO: 10591 - DNA, 25 bp, Homo sapien
aatgcggaaaatgctgccaagacaa

SEQ ID NO: 10592 - DNA, 25 bp, Homo sapien
aatgctaaaatgatgtgtaaaatat

SEQ ID NO: 10593 - DNA, 25 bp, Homo sapien
aatgctaaagtgatgtgtaaaatat

SEQ ID NO: 10594 - DNA, 25 bp, Homo sapien
aatgctaacttctatgcttattggt

SEQ ID NO: 10595 - DNA, 25 bp, Homo sapien
aatgctaacttctatgtttattggt

SEQ ID NO: 10596 - DNA, 25 bp, Homo sapien
aatgctacaaaacttaatccaacaa

SEQ ID NO: 10597 - DNA, 25 bp, Homo sapien
aatgctacaggcatctagtgagtag

SEQ ID NO: 10598 - DNA, 25 bp, Homo sapien
aatgctacaggccggcgagctgggg

SEQ ID NO: 10599 - DNA, 25 bp, Homo sapien
aatgctacaggctggcgagctgggg

SEQ ID NO: 10600 - DNA, 25 bp, Homo sapien
aatgctacagggatctagtgagtag

SEQ ID NO: 10601 - DNA, 25 bp, Homo sapien
aatgctacgaaacttaatccaacaa

SEQ ID NO: 10602 - DNA, 25 bp, Homo sapien
aatgctagaggatccagctgggcca

SEQ ID NO: 10603 - DNA, 25 bp, Homo sapien
aatgctagaggctccagctgggcca

SEQ ID NO: 10604 - DNA, 25 bp, Homo sapien
aatgctagtggcgttcagtggttta

SEQ ID NO: 10605 - DNA, 25 bp, Homo sapien
aatgctagtggctttcagtggttta

SEQ ID NO: 10606 - DNA, 25 bp, Homo sapien
aatgctcacagaagatctgagaaga

SEQ ID NO: 10607 - DNA, 25 bp, Homo sapien
aatgctcacagaatatctgagaaga

SEQ ID NO: 10608 - DNA, 25 bp, Homo sapien
aatgctccaacgtggtcttctcatg

SEQ ID NO: 10609 - DNA, 25 bp, Homo sapien
aatgctccaacttggtcttctcatg

SEQ ID NO: 10610 - DNA, 25 bp, Homo sapien
aatgctctaatctgaaagaaaaagt

SEQ ID NO: 10611 - DNA, 25 bp, Homo sapien
aatgctctaatttgaaagaaaaagt

SEQ ID NO: 10612 - DNA, 25 bp, Homo sapien
aatgctgaaaaatataaaaagtgtt

SEQ ID NO: 10613 - DNA, 25 bp, Homo sapien
aatgctgaaaaatctaaaaagtgtt

SEQ ID NO: 10614 - DNA, 25 bp, Homo sapien
aatgctgcaagtcaataatatcgtt

SEQ ID NO: 10615 - DNA, 25 bp, Homo sapien
aatgctgcatagctcttttactcag

SEQ ID NO: 10616 - DNA, 25 bp, Homo sapien
aatgctgcatagcttttttactcag

SEQ ID NO: 10617 - DNA, 25 bp, Homo sapien
aatgctgccatcaagaatttaaaag

SEQ ID NO: 10618 - DNA, 25 bp, Homo sapien
aatgctgccatcatgaatttaaaag

SEQ ID NO: 10619 - DNA, 25 bp, Homo sapien
aatgctgcgagtcaataatatcgtt

SEQ ID NO: 10620 - DNA, 25 bp, Homo sapien
aatgctggagacatggtgaaatagg

SEQ ID NO: 10621 - DNA, 25 bp, Homo sapien
aatgctggagacgtggtgaaatagg

SEQ ID NO: 10622 - DNA, 25 bp, Homo sapien
aatgctggcttagcctcttatttag

SEQ ID NO: 10623 - DNA, 25 bp, Homo sapien
aatgctggcttagcttcttatttag

SEQ ID NO: 10624 - DNA, 25 bp, Homo sapien
aatgctgtaaataggagtcattaat

SEQ ID NO: 10625 - DNA, 25 bp, Homo sapien
aatgctgtaaatcggagtcattaat

SEQ ID NO: 10626 - DNA, 25 bp, Homo sapien
aatgctgtggtaagagaggaagaga

SEQ ID NO: 10627 - DNA, 25 bp, Homo sapien
aatgctgtggtacgagaggaagaga

SEQ ID NO: 10628 - DNA, 25 bp, Homo sapien
aatgcttattgtaaattctaaagag

SEQ ID NO: 10629 - DNA, 25 bp, Homo sapien
aatgcttattgttaattctaaagag

SEQ ID NO: 10630 - DNA, 25 bp, Homo sapien
aatgcttcaaatacgttgtcatctc

SEQ ID NO: 10631 - DNA, 25 bp, Homo sapien
aatgcttcaaatatgttgtcatctc

SEQ ID NO: 10632 - DNA, 25 bp, Homo sapien
aatgcttccaatatctctagtacat

SEQ ID NO: 10633 - DNA, 25 bp, Homo sapien
aatgcttccaatatttctagtacat

SEQ ID NO: 10634 - DNA, 25 bp, Homo sapien
aatgcttcctatctctcacacagcc

SEQ ID NO: 10635 - DNA, 25 bp, Homo sapien
aatgcttcctatgtctcacacagcc

SEQ ID NO: 10636 - DNA, 25 bp, Homo sapien
aatgcttcctggaggctggtattgt

SEQ ID NO: 10637 - DNA, 25 bp, Homo sapien
aatgcttcctggagtctggtattgt

SEQ ID NO: 10638 - DNA, 25 bp, Homo sapien
aatgcttgctcatatggaaagtctg

SEQ ID NO: 10639 - DNA, 25 bp, Homo sapien
aatgcttggaaaggaagtttaagtt

SEQ ID NO: 10640 - DNA, 25 bp, Homo sapien
aatgcttggaaatgaagtttaagtt

SEQ ID NO: 10641 - DNA, 25 bp, Homo sapien
aatgcttgttcatatggaaagtctg

SEQ ID NO: 10642 - DNA, 25 bp, Homo sapien
aatgcttttaacgacaccaaagtca

SEQ ID NO: 10643 - DNA, 25 bp, Homo sapien
aatgcttttaatgacaccaaagtca

SEQ ID NO: 10644 - DNA, 25 bp, Homo sapien
aatggaaaaaaagacactttgaaat

SEQ ID NO: 10645 - DNA, 25 bp, Homo sapien
aatggaaacaaagacactttgaaat

SEQ ID NO: 10646 - DNA, 25 bp, Homo sapien
aatggaaagatatatatgcatcttt

SEQ ID NO: 10647 - DNA, 25 bp, Homo sapien
aatggaaagatatgtatgcatcttt

SEQ ID NO: 10648 - DNA, 25 bp, Homo sapien
aatggaacaaaattaagaaggccta

SEQ ID NO: 10649 - DNA, 25 bp, Homo sapien
aatggaacagaattaagaaggccta

SEQ ID NO: 10650 - DNA, 25 bp, Homo sapien
aatggaaggcggacagcggccatct

SEQ ID NO: 10651 - DNA, 25 bp, Homo sapien
aatggaaggtggacagcggccatct

SEQ ID NO: 10652 - DNA, 25 bp, Homo sapien
aatggaatgaattttacaaccagac

SEQ ID NO: 10653 - DNA, 25 bp, Homo sapien
aatggaatgaattttagaaccagac

SEQ ID NO: 10654 - DNA, 25 bp, Homo sapien
aatggaccaaggaaaacaaacgttt

SEQ ID NO: 10655 - DNA, 25 bp, Homo sapien
aatggaccacgcagtgttggagcat

SEQ ID NO: 10656 - DNA, 25 bp, Homo sapien
aatggaccagggaaaacaaacgttt

SEQ ID NO: 10657 - DNA, 25 bp, Homo sapien
aatggaccatgcagtgttggagcat

SEQ ID NO: 10658 - DNA, 25 bp, Homo sapien
aatggagaaagaaaccatgaaccaa

SEQ ID NO: 10659 - DNA, 25 bp, Homo sapien
aatggagaaaggaaccatgaaccaa

SEQ ID NO: 10660 - DNA, 25 bp, Homo sapien
aatggagcatgaagctgcacaggca

SEQ ID NO: 10661 - DNA, 25 bp, Homo sapien
aatggagcatgaagttgcacaggca

SEQ ID NO: 10662 - DNA, 25 bp, Homo sapien
aatggagctgtcctctgacctacca

SEQ ID NO: 10663 - DNA, 25 bp, Homo sapien
aatggagctgtcttctgacctacca

SEQ ID NO: 10664 - DNA, 25 bp, Homo sapien
aatggaggcacaatggtgagaaaga

SEQ ID NO: 10665 - DNA, 25 bp, Homo sapien
aatggaggcacgatggtgagaaaga

SEQ ID NO: 10666 - DNA, 25 bp, Homo sapien
aatggagtaaagaggagtgagaatt

SEQ ID NO: 10667 - DNA, 25 bp, Homo sapien
aatggagtgaagaggagtgagaatt

SEQ ID NO: 10668 - DNA, 25 bp, Homo sapien
aatggagtgaccatgagtgaatgat

SEQ ID NO: 10669 - DNA, 25 bp, Homo sapien
aatggagtgaccgtgagtgaatgat

SEQ ID NO: 10670 - DNA, 25 bp, Homo sapien
aatggataaaataaggcagatgatc

SEQ ID NO: 10671 - DNA, 25 bp, Homo sapien
aatggataagaattgaacaaccaaa

SEQ ID NO: 10672 - DNA, 25 bp, Homo sapien
aatggataagaattgaccaaccaaa

SEQ ID NO: 10673 - DNA, 25 bp, Homo sapien
aatggatacaataaggcagatgatc

SEQ ID NO: 10674 - DNA, 25 bp, Homo sapien
aatggatatataactttgactcatc

SEQ ID NO: 10675 - DNA, 25 bp, Homo sapien
aatggatatgtaactttgactcatc

SEQ ID NO: 10676 - DNA, 25 bp, Homo sapien
aatggatctgattatacgttctgta

SEQ ID NO: 10677 - DNA, 25 bp, Homo sapien
aatggatctgattatatgttctgta

SEQ ID NO: 10678 - DNA, 25 bp, Homo sapien
aatggatgctgaacagatttttaaa

SEQ ID NO: 10679 - DNA, 25 bp, Homo sapien
aatggatgctgagcagatttttaaa

SEQ ID NO: 10680 - DNA, 25 bp, Homo sapien
aatggatggaaaatccactcatgtc

SEQ ID NO: 10681 - DNA, 25 bp, Homo sapien
aatggatggcaaatccactcatgtc

SEQ ID NO: 10682 - DNA, 25 bp, Homo sapien
aatggatgtcaactttttctgctga

SEQ ID NO: 10683 - DNA, 25 bp, Homo sapien
aatggatgtcgagtttatcccatgt

SEQ ID NO: 10684 - DNA, 25 bp, Homo sapien
aatggatgttaactttttctgctga

SEQ ID NO: 10685 - DNA, 25 bp, Homo sapien
aatggatgttgagtttatcccatgt

SEQ ID NO: 10686 - DNA, 25 bp, Homo sapien
aatggattgatatgattattgggcc

SEQ ID NO: 10687 - DNA, 25 bp, Homo sapien
aatggattgatgtgattattgggcc

SEQ ID NO: 10688 - DNA, 25 bp, Homo sapien
aatggcaaatataaacagctaatgg

SEQ ID NO: 10689 - DNA, 25 bp, Homo sapien
aatggcaaatataaacggctaatgg

SEQ ID NO: 10690 - DNA, 25 bp, Homo sapien
aatggcatgcccacttagtaatgaa

SEQ ID NO: 10691 - DNA, 25 bp, Homo sapien
aatggcatgccctcttagtaatgaa

SEQ ID NO: 10692 - DNA, 25 bp, Homo sapien
aatggcattccaggctagctctgtt

SEQ ID NO: 10693 - DNA, 25 bp, Homo sapien
aatggcattccaggttagctctgtt

SEQ ID NO: 10694 - DNA, 25 bp, Homo sapien
aatggcgagctatcatactgcattg

SEQ ID NO: 10695 - DNA, 25 bp, Homo sapien
aatggcgagctatcatgctgcattg

SEQ ID NO: 10696 - DNA, 25 bp, Homo sapien
aatggcgtaacatcaccaggccaca

SEQ ID NO: 10697 - DNA, 25 bp, Homo sapien
aatggcgtcctcagagagtagaaag

SEQ ID NO: 10698 - DNA, 25 bp, Homo sapien
aatggcgtcctcggagagtagaaag

SEQ ID NO: 10699 - DNA, 25 bp, Homo sapien
aatggcgtgacatcaccaggccaca

SEQ ID NO: 10700 - DNA, 25 bp, Homo sapien
aatggctacaaaacattttaaagcc

SEQ ID NO: 10701 - DNA, 25 bp, Homo sapien
aatggctacaaccagaacgattaac

SEQ ID NO: 10702 - DNA, 25 bp, Homo sapien
aatggctacaatcagaacgattaac

SEQ ID NO: 10703 - DNA, 25 bp, Homo sapien
aatggctacgaaacattttaaagcc

SEQ ID NO: 10704 - DNA, 25 bp, Homo sapien
aatggctcatggggaaaaacaatct

SEQ ID NO: 10705 - DNA, 25 bp, Homo sapien
aatggctcgtggggaaaaacaatct

SEQ ID NO: 10706 - DNA, 25 bp, Homo sapien
aatggctgttaaaaaaattcacatt

SEQ ID NO: 10707 - DNA, 25 bp, Homo sapien
aatggctgttaaaaaatttcacatt

SEQ ID NO: 10708 - DNA, 25 bp, Homo sapien
aatggcttagttgatccctttgaat

SEQ ID NO: 10709 - DNA, 25 bp, Homo sapien
aatggcttatttgatccctttgaat

SEQ ID NO: 10710 - DNA, 25 bp, Homo sapien
aatggcttcttttcgtaaagaggaa

SEQ ID NO: 10711 - DNA, 25 bp, Homo sapien
aatggcttctttttgtaaagaggaa

SEQ ID NO: 10712 - DNA, 25 bp, Homo sapien
aatggctttgatagtttgatagaaa

SEQ ID NO: 10713 - DNA, 25 bp, Homo sapien
aatggctttgatggtttgatagaaa

SEQ ID NO: 10714 - DNA, 25 bp, Homo sapien
aatggctttggtctagcgtcctata

SEQ ID NO: 10715 - DNA, 25 bp, Homo sapien
aatggctttggtctagtgtcctata

SEQ ID NO: 10716 - DNA, 25 bp, Homo sapien
aatgggaacaagcgagacagagcct

SEQ ID NO: 10717 - DNA, 25 bp, Homo sapien
aatgggaacaagtgagacagagcct

SEQ ID NO: 10718 - DNA, 25 bp, Homo sapien
aatgggaatagaagtcacaacatat

SEQ ID NO: 10719 - DNA, 25 bp, Homo sapien
aatgggaatagaagtcgcaacatat

SEQ ID NO: 10720 - DNA, 25 bp, Homo sapien
aatgggaccacataattgaagttgg

SEQ ID NO: 10721 - DNA, 25 bp, Homo sapien
aatgggactacataattgaagttgg

SEQ ID NO: 10722 - DNA, 25 bp, Homo sapien
aatgggactcagcaattagtgaaac

SEQ ID NO: 10723 - DNA, 25 bp, Homo sapien
aatgggactcagtaattagtgaaac

SEQ ID NO: 10724 - DNA, 25 bp, Homo sapien
aatgggagtagtgatcaggacattt

SEQ ID NO: 10725 - DNA, 25 bp, Homo sapien
aatgggagtggtgatcaggacattt

SEQ ID NO: 10726 - DNA, 25 bp, Homo sapien
aatgggctaatacagtaaatgcagt

SEQ ID NO: 10727 - DNA, 25 bp, Homo sapien
aatgggctaatatagtaaatgcagt

SEQ ID NO: 10728 - DNA, 25 bp, Homo sapien
aatggggatgacaatgcttcctgtc

SEQ ID NO: 10729 - DNA, 25 bp, Homo sapien
aatggggatgacagtgcttcctgtc

SEQ ID NO: 10730 - DNA, 25 bp, Homo sapien
aatgggtttccatgcaccaataaaa

SEQ ID NO: 10731 - DNA, 25 bp, Homo sapien
aatgggtttccatgtaccaataaaa

SEQ ID NO: 10732 - DNA, 25 bp, Homo sapien
aatggtaaagctccttggtctctgg

SEQ ID NO: 10733 - DNA, 25 bp, Homo sapien
aatggtaaagctctttggtctctgg

SEQ ID NO: 10734 - DNA, 25 bp, Homo sapien
aatggtaaagtgggatgccaagtta

SEQ ID NO: 10735 - DNA, 25 bp, Homo sapien
aatggtaacgtgggatgccaagtta

SEQ ID NO: 10736 - DNA, 25 bp, Homo sapien
aatggtaactacatcgtctgaaagg

SEQ ID NO: 10737 - DNA, 25 bp, Homo sapien
aatggtaactacattgtctgaaagg

SEQ ID NO: 10738 - DNA, 25 bp, Homo sapien
aatggtagatgggaacatccaatga

SEQ ID NO: 10739 - DNA, 25 bp, Homo sapien
aatggtagctgtagtttattgagta

SEQ ID NO: 10740 - DNA, 25 bp, Homo sapien
aatggtagctgtggtttattgagta

SEQ ID NO: 10741 - DNA, 25 bp, Homo sapien
aatggtaggtgggaacatccaatga

SEQ ID NO: 10742 - DNA, 25 bp, Homo sapien
aatggtatgggtcctagcactgagg

SEQ ID NO: 10743 - DNA, 25 bp, Homo sapien
aatggtatgggtcttagcactgagg

SEQ ID NO: 10744 - DNA, 25 bp, Homo sapien
aatggtcaacacatcataaatgatt

SEQ ID NO: 10745 - DNA, 25 bp, Homo sapien
aatggtcaacacctcataaatgatt

SEQ ID NO: 10746 - DNA, 25 bp, Homo sapien
aatggtcaagggaaatgatcactct

SEQ ID NO: 10747 - DNA, 25 bp, Homo sapien
aatggtcaagggaactgatcactct

SEQ ID NO: 10748 - DNA, 25 bp, Homo sapien
aatggtcagaatcaatatcatgtat

SEQ ID NO: 10749 - DNA, 25 bp, Homo sapien
aatggtcagaatgaatatcatgtat

SEQ ID NO: 10750 - DNA, 25 bp, Homo sapien
aatggtccaagcaagagtttcctac

SEQ ID NO: 10751 - DNA, 25 bp, Homo sapien
aatggtccaggcaagagtttcctac

SEQ ID NO: 10752 - DNA, 25 bp, Homo sapien
aatggtccatggcctggtggttgct

SEQ ID NO: 10753 - DNA, 25 bp, Homo sapien
aatggtccgtggcctggtggttgct

SEQ ID NO: 10754 - DNA, 25 bp, Homo sapien
aatggtctcactaactgatatgtca

SEQ ID NO: 10755 - DNA, 25 bp, Homo sapien
aatggtctcactaattgatatgtca

SEQ ID NO: 10756 - DNA, 25 bp, Homo sapien
aatggtctttttttccacaagaaca

SEQ ID NO: 10757 - DNA, 25 bp, Homo sapien
aatggtcttttttttcacaagaaca

SEQ ID NO: 10758 - DNA, 25 bp, Homo sapien
aatggtgccagcaaaagagaaggca

SEQ ID NO: 10759 - DNA, 25 bp, Homo sapien
aatggtgccagcgaaagagaaggca

SEQ ID NO: 10760 - DNA, 25 bp, Homo sapien
aatggtggtgtgcgtccaagatggt

SEQ ID NO: 10761 - DNA, 25 bp, Homo sapien
aatggtggtgtgtgtccaagatggt

SEQ ID NO: 10762 - DNA, 25 bp, Homo sapien
aatggtgtcacctgctctcaagtat

SEQ ID NO: 10763 - DNA, 25 bp, Homo sapien
aatggtgtcacttgctctcaagtat

SEQ ID NO: 10764 - DNA, 25 bp, Homo sapien
aatggtgttggacttacataagaga

SEQ ID NO: 10765 - DNA, 25 bp, Homo sapien
aatggtgttggatttacataagaga

SEQ ID NO: 10766 - DNA, 25 bp, Homo sapien
aatggttaagtaacttgccaaaggt

SEQ ID NO: 10767 - DNA, 25 bp, Homo sapien
aatggttagaaagggaataaactgg

SEQ ID NO: 10768 - DNA, 25 bp, Homo sapien
aatggttagaaatggaataaactgg

SEQ ID NO: 10769 - DNA, 25 bp, Homo sapien
aatggttaggtaacttgccaaaggt

SEQ ID NO: 10770 - DNA, 25 bp, Homo sapien
aatggttgttttacaccactgagtt

SEQ ID NO: 10771 - DNA, 25 bp, Homo sapien
aatggttgttttataccactgagtt

SEQ ID NO: 10772 - DNA, 25 bp, Homo sapien
aatggtttcatagatacatgtcaaa

SEQ ID NO: 10773 - DNA, 25 bp, Homo sapien
aatggtttcatagatatatgtcaaa

SEQ ID NO: 10774 - DNA, 25 bp, Homo sapien
aatggtttccaggcttacagaggag

SEQ ID NO: 10775 - DNA, 25 bp, Homo sapien
aatggtttccaggtttacagaggag

SEQ ID NO: 10776 - DNA, 25 bp, Homo sapien
aatggttttgactagccatgactga

SEQ ID NO: 10777 - DNA, 25 bp, Homo sapien
aatggttttgactggccatgactga

SEQ ID NO: 10778 - DNA, 25 bp, Homo sapien
aatgtaaactggtacatctattcca

SEQ ID NO: 10779 - DNA, 25 bp, Homo sapien
aatgtaaactggtgcatctattcca

SEQ ID NO: 10780 - DNA, 25 bp, Homo sapien
aatgtaaagcaggcagaataagcct

SEQ ID NO: 10781 - DNA, 25 bp, Homo sapien
aatgtaaaggaggcagaataagcct

SEQ ID NO: 10782 - DNA, 25 bp, Homo sapien
aatgtaaattgcatctcgacaaaac

SEQ ID NO: 10783 - DNA, 25 bp, Homo sapien
aatgtaaattgtatctcgacaaaac

SEQ ID NO: 10784 - DNA, 25 bp, Homo sapien
aatgtaacaatgttggactctttct

SEQ ID NO: 10785 - DNA, 25 bp, Homo sapien
aatgtaacagcaagctctgctttcc

SEQ ID NO: 10786 - DNA, 25 bp, Homo sapien
aatgtaacagcgagctctgctttcc

SEQ ID NO: 10787 - DNA, 25 bp, Homo sapien
aatgtaaccatgttggactctttct

SEQ ID NO: 10788 - DNA, 25 bp, Homo sapien
aatgtaagaagaatctgctgggaaa

SEQ ID NO: 10789 - DNA, 25 bp, Homo sapien
aatgtaagaggaatctgctgggaaa

SEQ ID NO: 10790 - DNA, 25 bp, Homo sapien
aatgtaagctctacaaaggcaggtg

SEQ ID NO: 10791 - DNA, 25 bp, Homo sapien
aatgtaagctctataaaggcaggtg

SEQ ID NO: 10792 - DNA, 25 bp, Homo sapien
aatgtaagctggatgtactatttta

SEQ ID NO: 10793 - DNA, 25 bp, Homo sapien
aatgtaagttggatgtactatttta

SEQ ID NO: 10794 - DNA, 25 bp, Homo sapien
aatgtaattcttccggtgaatttaa

SEQ ID NO: 10795 - DNA, 25 bp, Homo sapien
aatgtaattcttctggtgaatttaa

SEQ ID NO: 10796 - DNA, 25 bp, Homo sapien
aatgtacaagatattcagttcctca

SEQ ID NO: 10797 - DNA, 25 bp, Homo sapien
aatgtacaagatattcggttcctca

SEQ ID NO: 10798 - DNA, 25 bp, Homo sapien
aatgtacagaacgacgcagttgaag

SEQ ID NO: 10799 - DNA, 25 bp, Homo sapien
aatgtacagaacgatgcagttgaag

SEQ ID NO: 10800 - DNA, 25 bp, Homo sapien
aatgtacagttgagtagtgttaagt

SEQ ID NO: 10801 - DNA, 25 bp, Homo sapien
aatgtacagtttaatgggttatgtt

SEQ ID NO: 10802 - DNA, 25 bp, Homo sapien
aatgtacagtttagtagtgttaagt

SEQ ID NO: 10803 - DNA, 25 bp, Homo sapien
aatgtacagtttagtgggttatgtt

SEQ ID NO: 10804 - DNA, 25 bp, Homo sapien
aatgtaccttggaggagttttcgtc

SEQ ID NO: 10805 - DNA, 25 bp, Homo sapien
aatgtaccttggtggagttttcgtc

SEQ ID NO: 10806 - DNA, 25 bp, Homo sapien
aatgtactacattgattgtcaactt

SEQ ID NO: 10807 - DNA, 25 bp, Homo sapien
aatgtactccattgattgtcaactt

SEQ ID NO: 10808 - DNA, 25 bp, Homo sapien
aatgtagaaaaatatacggttggaa

SEQ ID NO: 10809 - DNA, 25 bp, Homo sapien
aatgtagaaaaatatatggttggaa

SEQ ID NO: 10810 - DNA, 25 bp, Homo sapien
aatgtagagccagtaaaacattaca

SEQ ID NO: 10811 - DNA, 25 bp, Homo sapien
aatgtagagccagtgaaacattaca

SEQ ID NO: 10812 - DNA, 25 bp, Homo sapien
aatgtagctccatctttaatgatca

SEQ ID NO: 10813 - DNA, 25 bp, Homo sapien
aatgtagctccttctttaatgatca

SEQ ID NO: 10814 - DNA, 25 bp, Homo sapien
aatgtagctgctgactttaaattga

SEQ ID NO: 10815 - DNA, 25 bp, Homo sapien
aatgtagctgctgattttaaattga

SEQ ID NO: 10816 - DNA, 25 bp, Homo sapien
aatgtaggccttttaattccatatg

SEQ ID NO: 10817 - DNA, 25 bp, Homo sapien
aatgtagggcttttaattccatatg

SEQ ID NO: 10818 - DNA, 25 bp, Homo sapien
aatgtagtagaaacatagtcacact

SEQ ID NO: 10819 - DNA, 25 bp, Homo sapien
aatgtagtggaaacatagtcacact

SEQ ID NO: 10820 - DNA, 25 bp, Homo sapien
aatgtataaaccatttgggcactgg

SEQ ID NO: 10821 - DNA, 25 bp, Homo sapien
aatgtatagaccatttgggcactgg

SEQ ID NO: 10822 - DNA, 25 bp, Homo sapien
aatgtatcctaaaataagccaacac

SEQ ID NO: 10823 - DNA, 25 bp, Homo sapien
aatgtatcctaagataagccaacac

SEQ ID NO: 10824 - DNA, 25 bp, Homo sapien
aatgtatgcaactcttgtccttcag

SEQ ID NO: 10825 - DNA, 25 bp, Homo sapien
aatgtatgctactcttgtccttcag

SEQ ID NO: 10826 - DNA, 25 bp, Homo sapien
aatgtatgtgtaataattcatgtat

SEQ ID NO: 10827 - DNA, 25 bp, Homo sapien
aatgtatgtgtagtaattcatgtat

SEQ ID NO: 10828 - DNA, 25 bp, Homo sapien
aatgtcaaaaacggtatctgacact

SEQ ID NO: 10829 - DNA, 25 bp, Homo sapien
aatgtcaaacacggtatctgacact

SEQ ID NO: 10830 - DNA, 25 bp, Homo sapien
aatgtcaaataacaatgatgataga

SEQ ID NO: 10831 - DNA, 25 bp, Homo sapien
aatgtcaacaatattatctctggga

SEQ ID NO: 10832 - DNA, 25 bp, Homo sapien
aatgtcaacttacaaacctctcata

SEQ ID NO: 10833 - DNA, 25 bp, Homo sapien
aatgtcaacttataaacctctcata

SEQ ID NO: 10834 - DNA, 25 bp, Homo sapien
aatgtcaagaatattatctctggga

SEQ ID NO: 10835 - DNA, 25 bp, Homo sapien
aatgtcaagtaacaatgatgataga

SEQ ID NO: 10836 - DNA, 25 bp, Homo sapien
aatgtcaagttggtaactgatatat

SEQ ID NO: 10837 - DNA, 25 bp, Homo sapien
aatgtcaagttggtaattgatatat

SEQ ID NO: 10838 - DNA, 25 bp, Homo sapien
aatgtcaatttccatttttctacta

SEQ ID NO: 10839 - DNA, 25 bp, Homo sapien
aatgtcaatttccgtttttctacta

SEQ ID NO: 10840 - DNA, 25 bp, Homo sapien
aatgtcacacaacttgttgttctta

SEQ ID NO: 10841 - DNA, 25 bp, Homo sapien
aatgtcacacaatttgttgttctta

SEQ ID NO: 10842 - DNA, 25 bp, Homo sapien
aatgtcaggcccattatttattggc

SEQ ID NO: 10843 - DNA, 25 bp, Homo sapien
aatgtcaggtccattatttattggc

SEQ ID NO: 10844 - DNA, 25 bp, Homo sapien
aatgtcagtaccagtttatgacaaa

SEQ ID NO: 10845 - DNA, 25 bp, Homo sapien
aatgtcagtacctgtttatgacaaa

SEQ ID NO: 10846 - DNA, 25 bp, Homo sapien
aatgtcagtgtgggaacatgcactt

SEQ ID NO: 10847 - DNA, 25 bp, Homo sapien
aatgtcagtgtggtaacatgcactt

SEQ ID NO: 10848 - DNA, 25 bp, Homo sapien
aatgtcagttactatcattaacatt

SEQ ID NO: 10849 - DNA, 25 bp, Homo sapien
aatgtcagttattatcattaacatt

SEQ ID NO: 10850 - DNA, 25 bp, Homo sapien
aatgtcatcccacatttctccgtgg

SEQ ID NO: 10851 - DNA, 25 bp, Homo sapien
aatgtcatcccactgtcatcttgac

SEQ ID NO: 10852 - DNA, 25 bp, Homo sapien
aatgtcatcccagtgtcatcttgac

SEQ ID NO: 10853 - DNA, 25 bp, Homo sapien
aatgtcatctcacatttctccgtgg

SEQ ID NO: 10854 - DNA, 25 bp, Homo sapien
aatgtcatcttgagtgttaatggat

SEQ ID NO: 10855 - DNA, 25 bp, Homo sapien
aatgtcattttgagtgttaatggat

SEQ ID NO: 10856 - DNA, 25 bp, Homo sapien
aatgtccaaggattgccatttattc

SEQ ID NO: 10857 - DNA, 25 bp, Homo sapien
aatgtccaagggttgccatttattc

SEQ ID NO: 10858 - DNA, 25 bp, Homo sapien
aatgtccaagtaatcaacatgagac

SEQ ID NO: 10859 - DNA, 25 bp, Homo sapien
aatgtccacgtaatcaacatgagac

SEQ ID NO: 10860 - DNA, 25 bp, Homo sapien
aatgtccggccgacgtttctggggt

SEQ ID NO: 10861 - DNA, 25 bp, Homo sapien
aatgtccggccgatgtttctggggt

SEQ ID NO: 10862 - DNA, 25 bp, Homo sapien
aatgtcctcatgagatcaaagtata

SEQ ID NO: 10863 - DNA, 25 bp, Homo sapien
aatgtcctcatgagttcaaagtata

SEQ ID NO: 10864 - DNA, 25 bp, Homo sapien
aatgtccttcatagtgaaaagatcc

SEQ ID NO: 10865 - DNA, 25 bp, Homo sapien
aatgtcctttatagtgaaaagatcc

SEQ ID NO: 10866 - DNA, 25 bp, Homo sapien
aatgtctacagatgccagaactgtg

SEQ ID NO: 10867 - DNA, 25 bp, Homo sapien
aatgtctacggatgccagaactgtg

SEQ ID NO: 10868 - DNA, 25 bp, Homo sapien
aatgtctcacggcgaatcaaatgtc

SEQ ID NO: 10869 - DNA, 25 bp, Homo sapien
aatgtctcacggctaatcaaatgtc

SEQ ID NO: 10870 - DNA, 25 bp, Homo sapien
aatgtctctctctgttccttctatt

SEQ ID NO: 10871 - DNA, 25 bp, Homo sapien
aatgtctctctgtgttccttctatt

SEQ ID NO: 10872 - DNA, 25 bp, Homo sapien
aatgtctgcgattaggttattcatt

SEQ ID NO: 10873 - DNA, 25 bp, Homo sapien
aatgtctgtatcaaccaagacattt

SEQ ID NO: 10874 - DNA, 25 bp, Homo sapien
aatgtctgtatccaccaagacattt

SEQ ID NO: 10875 - DNA, 25 bp, Homo sapien
aatgtctgtgattaggttattcatt

SEQ ID NO: 10876 - DNA, 25 bp, Homo sapien
aatgtcttaccacttgttcgataaa

SEQ ID NO: 10877 - DNA, 25 bp, Homo sapien
aatgtcttcatcagtttatttcttc

SEQ ID NO: 10878 - DNA, 25 bp, Homo sapien
aatgtcttcatcggtttatttcttc

SEQ ID NO: 10879 - DNA, 25 bp, Homo sapien
aatgtcttccaattgcagcaattcg

SEQ ID NO: 10880 - DNA, 25 bp, Homo sapien
aatgtcttccaattgctgcaattcg

SEQ ID NO: 10881 - DNA, 25 bp, Homo sapien
aatgtcttcccacttgttcgataaa

SEQ ID NO: 10882 - DNA, 25 bp, Homo sapien
aatgtcttcttgctttgggaaatat

SEQ ID NO: 10883 - DNA, 25 bp, Homo sapien
aatgtcttcttgttttgggaaatat

SEQ ID NO: 10884 - DNA, 25 bp, Homo sapien
aatgtgaaaaggtgggaagacttgc

SEQ ID NO: 10885 - DNA, 25 bp, Homo sapien
aatgtgaaaagttgggaagacttgc

SEQ ID NO: 10886 - DNA, 25 bp, Homo sapien
aatgtgaaaatggtacttacaaatt

SEQ ID NO: 10887 - DNA, 25 bp, Homo sapien
aatgtgaacagaccagtcaaatcct

SEQ ID NO: 10888 - DNA, 25 bp, Homo sapien
aatgtgaacagagaagtgaccacag

SEQ ID NO: 10889 - DNA, 25 bp, Homo sapien
aatgtgaacagataagtgaccacag

SEQ ID NO: 10890 - DNA, 25 bp, Homo sapien
aatgtgaacatcatcaaacagattt

SEQ ID NO: 10891 - DNA, 25 bp, Homo sapien
aatgtgaacatcattaaacagattt

SEQ ID NO: 10892 - DNA, 25 bp, Homo sapien
aatgtgaacatggtacttacaaatt

SEQ ID NO: 10893 - DNA, 25 bp, Homo sapien
aatgtgaaggacagcatcacaggtt

SEQ ID NO: 10894 - DNA, 25 bp, Homo sapien
aatgtgaaggacagtatcacaggtt

SEQ ID NO: 10895 - DNA, 25 bp, Homo sapien
aatgtgaatagaccagtcaaatcct

SEQ ID NO: 10896 - DNA, 25 bp, Homo sapien
aatgtgagcaaaggatcgagtggaa

SEQ ID NO: 10897 - DNA, 25 bp, Homo sapien
aatgtgagcaaaggatggagtggaa

SEQ ID NO: 10898 - DNA, 25 bp, Homo sapien
aatgtgaggaaaggatgcatttggt

SEQ ID NO: 10899 - DNA, 25 bp, Homo sapien
aatgtgaggaagggatgcatttggt

SEQ ID NO: 10900 - DNA, 25 bp, Homo sapien
aatgtgatagatatcacaatactca

SEQ ID NO: 10901 - DNA, 25 bp, Homo sapien
aatgtgatagatatcagaatactca

SEQ ID NO: 10902 - DNA, 25 bp, Homo sapien
aatgtgatgtttgatatggacgtga

SEQ ID NO: 10903 - DNA, 25 bp, Homo sapien
aatgtgatgtttggtatggacgtga

SEQ ID NO: 10904 - DNA, 25 bp, Homo sapien
aatgtgattcaaatataatctcctg

SEQ ID NO: 10905 - DNA, 25 bp, Homo sapien
aatgtgattcagatataatctcctg

SEQ ID NO: 10906 - DNA, 25 bp, Homo sapien
aatgtgcaaagaagtaactgcgagg

SEQ ID NO: 10907 - DNA, 25 bp, Homo sapien
aatgtgcaaaggagtaactgcgagg

SEQ ID NO: 10908 - DNA, 25 bp, Homo sapien
aatgtgcagtaaaaatatggtatta

SEQ ID NO: 10909 - DNA, 25 bp, Homo sapien
aatgtgcattaaaaatatggtatta

SEQ ID NO: 10910 - DNA, 25 bp, Homo sapien
aatgtgcatttcctttatgaccagt

SEQ ID NO: 10911 - DNA, 25 bp, Homo sapien
aatgtgcatttcttttatgaccagt

SEQ ID NO: 10912 - DNA, 25 bp, Homo sapien
aatgtgccctaactcaggcagatag

SEQ ID NO: 10913 - DNA, 25 bp, Homo sapien
aatgtgccctagctcaggcagatag

SEQ ID NO: 10914 - DNA, 25 bp, Homo sapien
aatgtgctacagattcttcattttt

SEQ ID NO: 10915 - DNA, 25 bp, Homo sapien
aatgtgctaccttccaaggctgcca

SEQ ID NO: 10916 - DNA, 25 bp, Homo sapien
aatgtgctacctttcaaggctgcca

SEQ ID NO: 10917 - DNA, 25 bp, Homo sapien
aatgtgctatgagagcaccaaatta

SEQ ID NO: 10918 - DNA, 25 bp, Homo sapien
aatgtgctatgagagcgccaaatta

SEQ ID NO: 10919 - DNA, 25 bp, Homo sapien
aatgtgctcaagcatttaaagaaaa

SEQ ID NO: 10920 - DNA, 25 bp, Homo sapien
aatgtgctcaaggatttaaagaaaa

SEQ ID NO: 10921 - DNA, 25 bp, Homo sapien
aatgtgctccagattcttcattttt

SEQ ID NO: 10922 - DNA, 25 bp, Homo sapien
aatgtgctgttatcagatgtgcagt

SEQ ID NO: 10923 - DNA, 25 bp, Homo sapien
aatgtgctgttttcagatgtgcagt

SEQ ID NO: 10924 - DNA, 25 bp, Homo sapien
aatgtgcttgcagagaggaaagata

SEQ ID NO: 10925 - DNA, 25 bp, Homo sapien
aatgtgcttgcatagaggaaagata

SEQ ID NO: 10926 - DNA, 25 bp, Homo sapien
aatgtggaactgtgtcctgctatgc

SEQ ID NO: 10927 - DNA, 25 bp, Homo sapien
aatgtggaactgtgtcttgctatgc

SEQ ID NO: 10928 - DNA, 25 bp, Homo sapien
aatgtggccgtctccaatcacaaat

SEQ ID NO: 10929 - DNA, 25 bp, Homo sapien
aatgtggctagagttactggaaaac

SEQ ID NO: 10930 - DNA, 25 bp, Homo sapien
aatgtggctagtgttactggaaaac

SEQ ID NO: 10931 - DNA, 25 bp, Homo sapien
aatgtggctgtctccaatcacaaat

SEQ ID NO: 10932 - DNA, 25 bp, Homo sapien
aatgtgggaagagtctcacttgtta

SEQ ID NO: 10933 - DNA, 25 bp, Homo sapien
aatgtgggaagattctcacttgtta

SEQ ID NO: 10934 - DNA, 25 bp, Homo sapien
aatgtggtcacaatcaataggaaac

SEQ ID NO: 10935 - DNA, 25 bp, Homo sapien
aatgtggtcgcaatcaataggaaac

SEQ ID NO: 10936 - DNA, 25 bp, Homo sapien
aatgtggttgaccaacatcatcaga

SEQ ID NO: 10937 - DNA, 25 bp, Homo sapien
aatgtggttgactaacatcatcaga

SEQ ID NO: 10938 - DNA, 25 bp, Homo sapien
aatgtggtttccagtttagcagtgg

SEQ ID NO: 10939 - DNA, 25 bp, Homo sapien
aatgtggtttctagtttagcagtgg

SEQ ID NO: 10940 - DNA, 25 bp, Homo sapien
aatgtgtaagcagattatcatcatc

SEQ ID NO: 10941 - DNA, 25 bp, Homo sapien
aatgtgtaagcagattgtcatcatc

SEQ ID NO: 10942 - DNA, 25 bp, Homo sapien
aatgtgtaatccagcatcctaggct

SEQ ID NO: 10943 - DNA, 25 bp, Homo sapien
aatgtgtagtccagcatcctaggct

SEQ ID NO: 10944 - DNA, 25 bp, Homo sapien
aatgtgtcaatattagttcaccaac

SEQ ID NO: 10945 - DNA, 25 bp, Homo sapien
aatgtgtcaatatttgttcaccaac

SEQ ID NO: 10946 - DNA, 25 bp, Homo sapien
aatgtgtcagcagagccagctcatc

SEQ ID NO: 10947 - DNA, 25 bp, Homo sapien
aatgtgtcagcagggccagctcatc

SEQ ID NO: 10948 - DNA, 25 bp, Homo sapien
aatgtgtcagtctctctgaacttca

SEQ ID NO: 10949 - DNA, 25 bp, Homo sapien
aatgtgtcagtttctctgaacttca

SEQ ID NO: 10950 - DNA, 25 bp, Homo sapien
aatgtgtccaaggacttgggttcag

SEQ ID NO: 10951 - DNA, 25 bp, Homo sapien
aatgtgtccaaggtcttgggttcag

SEQ ID NO: 10952 - DNA, 25 bp, Homo sapien
aatgtgtggcttcaaacgtaaatgt

SEQ ID NO: 10953 - DNA, 25 bp, Homo sapien
aatgtgtggcttcaaatgtaaatgt

SEQ ID NO: 10954 - DNA, 25 bp, Homo sapien
aatgtgtggtacaacgtgaagtcag

SEQ ID NO: 10955 - DNA, 25 bp, Homo sapien
aatgtgtggtacaatgtgaagtcag

SEQ ID NO: 10956 - DNA, 25 bp, Homo sapien
aatgtgttggtgatcatacaaagct

SEQ ID NO: 10957 - DNA, 25 bp, Homo sapien
aatgtgttggtgattatacaaagct

SEQ ID NO: 10958 - DNA, 25 bp, Homo sapien
aatgtgttgtcattacaggactgta

SEQ ID NO: 10959 - DNA, 25 bp, Homo sapien
aatgtgttgtcgttacaggactgta

SEQ ID NO: 10960 - DNA, 25 bp, Homo sapien
aatgtgtttcatgcgtcttcctcct

SEQ ID NO: 10961 - DNA, 25 bp, Homo sapien
aatgtgtttcatgcgttttcctcct

SEQ ID NO: 10962 - DNA, 25 bp, Homo sapien
aatgtgtttggcttcaataattcca

SEQ ID NO: 10963 - DNA, 25 bp, Homo sapien
aatgtgtttggctttaataattcca

SEQ ID NO: 10964 - DNA, 25 bp, Homo sapien
aatgttaaaaggtaagtgcttggtg

SEQ ID NO: 10965 - DNA, 25 bp, Homo sapien
aatgttaaagggtaagtgcttggtg

SEQ ID NO: 10966 - DNA, 25 bp, Homo sapien
aatgttacataaaaggaatcacatg

SEQ ID NO: 10967 - DNA, 25 bp, Homo sapien
aatgttacgtaaaaggaatcacatg

SEQ ID NO: 10968 - DNA, 25 bp, Homo sapien
aatgttagcatacgctttttaaact

SEQ ID NO: 10969 - DNA, 25 bp, Homo sapien
aatgttagcatatgctttttaaact

SEQ ID NO: 10970 - DNA, 25 bp, Homo sapien
aatgttatatccaatgcgtatgtgc

SEQ ID NO: 10971 - DNA, 25 bp, Homo sapien
aatgttatatccaatgtgtatgtgc

SEQ ID NO: 10972 - DNA, 25 bp, Homo sapien
aatgttcaaagcgcttgcaacctgc

SEQ ID NO: 10973 - DNA, 25 bp, Homo sapien
aatgttcaacgcgcttgcaacctgc

SEQ ID NO: 10974 - DNA, 25 bp, Homo sapien
aatgttcaatcactaacaaaggaat

SEQ ID NO: 10975 - DNA, 25 bp, Homo sapien
aatgttcactggatgaattttgggt

SEQ ID NO: 10976 - DNA, 25 bp, Homo sapien
aatgttcactggttgaattttgggt

SEQ ID NO: 10977 - DNA, 25 bp, Homo sapien
aatgttcagtcactaacaaaggaat

SEQ ID NO: 10978 - DNA, 25 bp, Homo sapien
aatgttcataccaaaaaaataaaaa

SEQ ID NO: 10979 - DNA, 25 bp, Homo sapien
aatgttcataccacaaaaataaaaa

SEQ ID NO: 10980 - DNA, 25 bp, Homo sapien
aatgttcctgcttcatgccactagc

SEQ ID NO: 10981 - DNA, 25 bp, Homo sapien
aatgttcctgcttcgtgccactagc

SEQ ID NO: 10982 - DNA, 25 bp, Homo sapien
aatgttcgctgtctgcactgtctga

SEQ ID NO: 10983 - DNA, 25 bp, Homo sapien
aatgttcgttgtctgcactgtctga

SEQ ID NO: 10984 - DNA, 25 bp, Homo sapien
aatgttctaaaatggattaccagga

SEQ ID NO: 10985 - DNA, 25 bp, Homo sapien
aatgttctaaaattgattaccagga

SEQ ID NO: 10986 - DNA, 25 bp, Homo sapien
aatgttctaaattcgtcgtgcgatg

SEQ ID NO: 10987 - DNA, 25 bp, Homo sapien
aatgttctaaatttgtcgtgcgatg

SEQ ID NO: 10988 - DNA, 25 bp, Homo sapien
aatgttctaacagcgaattttgagt

SEQ ID NO: 10989 - DNA, 25 bp, Homo sapien
aatgttctaacagtgaattttgagt

SEQ ID NO: 10990 - DNA, 25 bp, Homo sapien
aatgttctccttccatggttcttca

SEQ ID NO: 10991 - DNA, 25 bp, Homo sapien
aatgttctccttctatggttcttca

SEQ ID NO: 10992 - DNA, 25 bp, Homo sapien
aatgttctgctttcctcttgacctg

SEQ ID NO: 10993 - DNA, 25 bp, Homo sapien
aatgttctgcttttctcttgacctg

SEQ ID NO: 10994 - DNA, 25 bp, Homo sapien
aatgttcttcaggcataataggtgc

SEQ ID NO: 10995 - DNA, 25 bp, Homo sapien
aatgttcttcaggcctaataggtgc

SEQ ID NO: 10996 - DNA, 25 bp, Homo sapien
aatgttgaaggacatcagtcaatct

SEQ ID NO: 10997 - DNA, 25 bp, Homo sapien
aatgttgaaggacgtcagtcaatct

SEQ ID NO: 10998 - DNA, 25 bp, Homo sapien
aatgttgcctacacaactgtatggg

SEQ ID NO: 10999 - DNA, 25 bp, Homo sapien
aatgttgcctacagaactgtatggg

SEQ ID NO: 11000 - DNA, 25 bp, Homo sapien
aatgttgctaggcacctgtatctct

SEQ ID NO: 11001 - DNA, 25 bp, Homo sapien
aatgttgctaggcatctgtatctct

SEQ ID NO: 11002 - DNA, 25 bp, Homo sapien
aatgttgttggttctatttatgtta

SEQ ID NO: 11003 - DNA, 25 bp, Homo sapien
aatgttgtttgttctatttatgtta

SEQ ID NO: 11004 - DNA, 25 bp, Homo sapien
aatgtttacaacacattttcagata

SEQ ID NO: 11005 - DNA, 25 bp, Homo sapien
aatgtttacgacacattttcagata

SEQ ID NO: 11006 - DNA, 25 bp, Homo sapien
aatgtttatcagcaatattggccta

SEQ ID NO: 11007 - DNA, 25 bp, Homo sapien
aatgtttatcaggaatattggccta

SEQ ID NO: 11008 - DNA, 25 bp, Homo sapien
aatgtttattaggccagaggatcaa

SEQ ID NO: 11009 - DNA, 25 bp, Homo sapien
aatgtttattaggtcagaggatcaa

SEQ ID NO: 11010 - DNA, 25 bp, Homo sapien
aatgtttattcacaatgtgagactc

SEQ ID NO: 11011 - DNA, 25 bp, Homo sapien
aatgtttattcacaatttgagactc

SEQ ID NO: 11012 - DNA, 25 bp, Homo sapien
aatgtttcaatcgctaaaaccaagt

SEQ ID NO: 11013 - DNA, 25 bp, Homo sapien
aatgtttcaattgctaaaaccaagt

SEQ ID NO: 11014 - DNA, 25 bp, Homo sapien
aatgtttcagtgagtacacagtcaa

SEQ ID NO: 11015 - DNA, 25 bp, Homo sapien
aatgtttcagtgcgtacacagtcaa

SEQ ID NO: 11016 - DNA, 25 bp, Homo sapien
aatgtttccctcgagcccttggata

SEQ ID NO: 11017 - DNA, 25 bp, Homo sapien
aatgtttccctcgggcccttggata

SEQ ID NO: 11018 - DNA, 25 bp, Homo sapien
aatgtttgcccaactttaagaattc

SEQ ID NO: 11019 - DNA, 25 bp, Homo sapien
aatgtttgcccgactttaagaattc

SEQ ID NO: 11020 - DNA, 25 bp, Homo sapien
aatgtttggtgtatctctccgttgt

SEQ ID NO: 11021 - DNA, 25 bp, Homo sapien
aatgtttggtgtatttctccgttgt

SEQ ID NO: 11022 - DNA, 25 bp, Homo sapien
aatgtttggttattttctcatggca

SEQ ID NO: 11023 - DNA, 25 bp, Homo sapien
aatgtttggttattttttcatggca

SEQ ID NO: 11024 - DNA, 25 bp, Homo sapien
aatgttttagcatataccatcaggc

SEQ ID NO: 11025 - DNA, 25 bp, Homo sapien
aatgttttagcatatatcatcaggc

SEQ ID NO: 11026 - DNA, 25 bp, Homo sapien
aatgttttgggataaatatggcata

SEQ ID NO: 11027 - DNA, 25 bp, Homo sapien
aatgttttgtgataaatatggcata

SEQ ID NO: 11028 - DNA, 25 bp, Homo sapien
aattaaaaaatatctccgaaacttc

SEQ ID NO: 11029 - DNA, 25 bp, Homo sapien
aattaaaaaatatctctgaaacttc

SEQ ID NO: 11030 - DNA, 25 bp, Homo sapien
aattaaaacctcggtggtgaagatt

SEQ ID NO: 11031 - DNA, 25 bp, Homo sapien
aattaaaaccttggtggtgaagatt

SEQ ID NO: 11032 - DNA, 25 bp, Homo sapien
aattaaaaggagaatcaaacatttt

SEQ ID NO: 11033 - DNA, 25 bp, Homo sapien
aattaaaaggataatcaaacatttt

SEQ ID NO: 11034 - DNA, 25 bp, Homo sapien
aattaaaagtatccttgcagttttc

SEQ ID NO: 11035 - DNA, 25 bp, Homo sapien
aattaaaagtatctttgcagttttc

SEQ ID NO: 11036 - DNA, 25 bp, Homo sapien
aattaaaatgtgtcatagagctgaa

SEQ ID NO: 11037 - DNA, 25 bp, Homo sapien
aattaaaatgtgtcgtagagctgaa

SEQ ID NO: 11038 - DNA, 25 bp, Homo sapien
aattaaacttcactgctttcaaagt

SEQ ID NO: 11039 - DNA, 25 bp, Homo sapien
aattaaacttcagtgctttcaaagt

SEQ ID NO: 11040 - DNA, 25 bp, Homo sapien
aattaaagacaacacggtaccagaa

SEQ ID NO: 11041 - DNA, 25 bp, Homo sapien
aattaaagataacacggtaccagaa

SEQ ID NO: 11042 - DNA, 25 bp, Homo sapien
aattaaagtcatgagagtggacaat

SEQ ID NO: 11043 - DNA, 25 bp, Homo sapien
aattaaagtgatgagagtggacaat

SEQ ID NO: 11044 - DNA, 25 bp, Homo sapien
aattaaatagcacacgtatgaagtg

SEQ ID NO: 11045 - DNA, 25 bp, Homo sapien
aattaaatagcacatgtatgaagtg

SEQ ID NO: 11046 - DNA, 25 bp, Homo sapien
aattaaattgttgtgagaccaccaa

SEQ ID NO: 11047 - DNA, 25 bp, Homo sapien
aattaaattgttttgagaccaccaa

SEQ ID NO: 11048 - DNA, 25 bp, Homo sapien
aattaacataccaacaagtcaaatt

SEQ ID NO: 11049 - DNA, 25 bp, Homo sapien
aattaacatgccaacaagtcaaatt

SEQ ID NO: 11050 - DNA, 25 bp, Homo sapien
aattaaccaaccctggatattagta

SEQ ID NO: 11051 - DNA, 25 bp, Homo sapien
aattaaccaaccgtggatattagta

SEQ ID NO: 11052 - DNA, 25 bp, Homo sapien
aattaaccagatactgagccttcag

SEQ ID NO: 11053 - DNA, 25 bp, Homo sapien
aattaaccagatattgagccttcag

SEQ ID NO: 11054 - DNA, 25 bp, Homo sapien
aattaagaaacagcagtatcatgaa

SEQ ID NO: 11055 - DNA, 25 bp, Homo sapien
aattaagaaacaggagtatcatgaa

SEQ ID NO: 11056 - DNA, 25 bp, Homo sapien
aattaagatcgctaaatgtcttaga

SEQ ID NO: 11057 - DNA, 25 bp, Homo sapien
aattaagatcgcttaatgtcttaga

SEQ ID NO: 11058 - DNA, 25 bp, Homo sapien
aattaagatgatagttaagatttga

SEQ ID NO: 11059 - DNA, 25 bp, Homo sapien
aattaagatgatatttaagatttga

SEQ ID NO: 11060 - DNA, 25 bp, Homo sapien
aattaagattcagaaatgtacagat

SEQ ID NO: 11061 - DNA, 25 bp, Homo sapien
aattaagattcagagatgtacagat

SEQ ID NO: 11062 - DNA, 25 bp, Homo sapien
aattaaggccgactctcatgatctc

SEQ ID NO: 11063 - DNA, 25 bp, Homo sapien
aattaaggccgcctctcatgatctc

SEQ ID NO: 11064 - DNA, 25 bp, Homo sapien
aattaataaacccctggtacataat

SEQ ID NO: 11065 - DNA, 25 bp, Homo sapien
aattaataaacccttggtacataat

SEQ ID NO: 11066 - DNA, 25 bp, Homo sapien
aattaatactccaaagcccgcttat

SEQ ID NO: 11067 - DNA, 25 bp, Homo sapien
aattaatactccaaaggccgcttat

SEQ ID NO: 11068 - DNA, 25 bp, Homo sapien
aattaatactggaaagttcctaaaa

SEQ ID NO: 11069 - DNA, 25 bp, Homo sapien
aattaatactgggaagttcctaaaa

SEQ ID NO: 11070 - DNA, 25 bp, Homo sapien
aattaatcactcccgccactgtcca

SEQ ID NO: 11071 - DNA, 25 bp, Homo sapien
aattaatcattcccgccactgtcca

SEQ ID NO: 11072 - DNA, 25 bp, Homo sapien
aattaatgtaaactaccaaatcaac

SEQ ID NO: 11073 - DNA, 25 bp, Homo sapien
aattaatgtaatctaccaaatcaac

SEQ ID NO: 11074 - DNA, 25 bp, Homo sapien
aattaattaagccttgagacagacc

SEQ ID NO: 11075 - DNA, 25 bp, Homo sapien
aattaattaggccttgagacagacc

SEQ ID NO: 11076 - DNA, 25 bp, Homo sapien
aattaattcagaggcgctgacacat

SEQ ID NO: 11077 - DNA, 25 bp, Homo sapien
aattaattcagaggtgctgacacat

SEQ ID NO: 11078 - DNA, 25 bp, Homo sapien
aattaattgcctaactgggtatgat

SEQ ID NO: 11079 - DNA, 25 bp, Homo sapien
aattaattgcctaattgggtatgat

SEQ ID NO: 11080 - DNA, 25 bp, Homo sapien
aattaatttcagtcacatcccaatt

SEQ ID NO: 11081 - DNA, 25 bp, Homo sapien
aattaatttcagtcacgtcccaatt

SEQ ID NO: 11082 - DNA, 25 bp, Homo sapien
aattacacaatcatcagataaaaat

SEQ ID NO: 11083 - DNA, 25 bp, Homo sapien
aattacacaatcgtcagataaaaat

SEQ ID NO: 11084 - DNA, 25 bp, Homo sapien
aattacaccaactccatctgtttag

SEQ ID NO: 11085 - DNA, 25 bp, Homo sapien
aattacaccagtcattcaaaaatac

SEQ ID NO: 11086 - DNA, 25 bp, Homo sapien
aattacaccagtcgttcaaaaatac

SEQ ID NO: 11087 - DNA, 25 bp, Homo sapien
aattacaccgactccatctgtttag

SEQ ID NO: 11088 - DNA, 25 bp, Homo sapien
aattacactttaatgccctcaaata

SEQ ID NO: 11089 - DNA, 25 bp, Homo sapien
aattacacttttatgccctcaaata

SEQ ID NO: 11090 - DNA, 25 bp, Homo sapien
aattacagcaacattgccttccagt

SEQ ID NO: 11091 - DNA, 25 bp, Homo sapien
aattacagcaacattgtcttccagt

SEQ ID NO: 11092 - DNA, 25 bp, Homo sapien
aattacagccgtgtaagacattttc

SEQ ID NO: 11093 - DNA, 25 bp, Homo sapien
aattacagccgtttaagacattttc

SEQ ID NO: 11094 - DNA, 25 bp, Homo sapien
aattacaggcttatttttagagaca

SEQ ID NO: 11095 - DNA, 25 bp, Homo sapien
aattacaggcttgtttttagagaca

SEQ ID NO: 11096 - DNA, 25 bp, Homo sapien
aattacattggactacttctatcat

SEQ ID NO: 11097 - DNA, 25 bp, Homo sapien
aattacattggactgcttctatcat

SEQ ID NO: 11098 - DNA, 25 bp, Homo sapien
aattacatttttcaaagtgcacaca

SEQ ID NO: 11099 - DNA, 25 bp, Homo sapien
aattacatttttgaaagtgcacaca

SEQ ID NO: 11100 - DNA, 25 bp, Homo sapien
aattaccaaacttcaccatgatagc

SEQ ID NO: 11101 - DNA, 25 bp, Homo sapien
aattaccaaacttcactatgatagc

SEQ ID NO: 11102 - DNA, 25 bp, Homo sapien
aattaccaccaaagaatgtgtgtga

SEQ ID NO: 11103 - DNA, 25 bp, Homo sapien
aattaccatcaaagaatgtgtgtga

SEQ ID NO: 11104 - DNA, 25 bp, Homo sapien
aattaccattaccgtaactgctgtc

SEQ ID NO: 11105 - DNA, 25 bp, Homo sapien
aattaccattactgtaactgctgtc

SEQ ID NO: 11106 - DNA, 25 bp, Homo sapien
aattacccgtatttaaacagcaatc

SEQ ID NO: 11107 - DNA, 25 bp, Homo sapien
aattacccgtatttaaccagcaatc

SEQ ID NO: 11108 - DNA, 25 bp, Homo sapien
aattacctatgtcttttctgcattt

SEQ ID NO: 11109 - DNA, 25 bp, Homo sapien
aattacctatgtgttttctgcattt

SEQ ID NO: 11110 - DNA, 25 bp, Homo sapien
aattacggacgcaaacaaggcctga

SEQ ID NO: 11111 - DNA, 25 bp, Homo sapien
aattacggatgcaaacaaggcctga

SEQ ID NO: 11112 - DNA, 25 bp, Homo sapien
aattactaatgcaaagtggccagtc

SEQ ID NO: 11113 - DNA, 25 bp, Homo sapien
aattactaatggaaagtggccagtc

SEQ ID NO: 11114 - DNA, 25 bp, Homo sapien
aattactacaatctataacgtctga

SEQ ID NO: 11115 - DNA, 25 bp, Homo sapien
aattactataatctataacgtctga

SEQ ID NO: 11116 - DNA, 25 bp, Homo sapien
aattactatataatagaactgcagc

SEQ ID NO: 11117 - DNA, 25 bp, Homo sapien
aattactatatattagaactgcagc

SEQ ID NO: 11118 - DNA, 25 bp, Homo sapien
aattactatgtaaggttactcaagg

SEQ ID NO: 11119 - DNA, 25 bp, Homo sapien
aattactatgtaatgttactcaagg

SEQ ID NO: 11120 - DNA, 25 bp, Homo sapien
aattactcggtgatttgttcaatat

SEQ ID NO: 11121 - DNA, 25 bp, Homo sapien
aattactcggtgattttttcaatat

SEQ ID NO: 11122 - DNA, 25 bp, Homo sapien
aattactggactgtgcattcctctc

SEQ ID NO: 11123 - DNA, 25 bp, Homo sapien
aattactgggctgtgcattcctctc

SEQ ID NO: 11124 - DNA, 25 bp, Homo sapien
aattactttgtgacttccatatgct

SEQ ID NO: 11125 - DNA, 25 bp, Homo sapien
aattactttgtgtcttccatatgct

SEQ ID NO: 11126 - DNA, 25 bp, Homo sapien
aattagaaaaccagtagtaggcaaa

SEQ ID NO: 11127 - DNA, 25 bp, Homo sapien
aattagaaaaccggtagtaggcaaa

SEQ ID NO: 11128 - DNA, 25 bp, Homo sapien
aattagaaaactgtacactttccac

SEQ ID NO: 11129 - DNA, 25 bp, Homo sapien
aattagaaaactgtacgctttccac

SEQ ID NO: 11130 - DNA, 25 bp, Homo sapien
aattagaaacagagtagtcttttat

SEQ ID NO: 11131 - DNA, 25 bp, Homo sapien
aattagaaagtataagtgaagagat

SEQ ID NO: 11132 - DNA, 25 bp, Homo sapien
aattagaaagtgtaagtgaagagat

SEQ ID NO: 11133 - DNA, 25 bp, Homo sapien
aattagaaccacattgtttgcttat

SEQ ID NO: 11134 - DNA, 25 bp, Homo sapien
aattagaaccagagtagtcttttat

SEQ ID NO: 11135 - DNA, 25 bp, Homo sapien
aattagaactacattgtttgcttat

SEQ ID NO: 11136 - DNA, 25 bp, Homo sapien
aattagaagtttacatttcatattg

SEQ ID NO: 11137 - DNA, 25 bp, Homo sapien
aattagaagtttacttttcatattg

SEQ ID NO: 11138 - DNA, 25 bp, Homo sapien
aattagacatttgtcagcacacagc

SEQ ID NO: 11139 - DNA, 25 bp, Homo sapien
aattagacttttgtcagcacacagc

SEQ ID NO: 11140 - DNA, 25 bp, Homo sapien
aattagagaatgaatgcctaggtcc

SEQ ID NO: 11141 - DNA, 25 bp, Homo sapien
aattagaggatgaatgcctaggtcc

SEQ ID NO: 11142 - DNA, 25 bp, Homo sapien
aattagagtaagcgtacatctaaag

SEQ ID NO: 11143 - DNA, 25 bp, Homo sapien
aattagagtaagtgtacatctaaag

SEQ ID NO: 11144 - DNA, 25 bp, Homo sapien
aattagatagtcgttatggcctcac

SEQ ID NO: 11145 - DNA, 25 bp, Homo sapien
aattagatagtggttatggcctcac

SEQ ID NO: 11146 - DNA, 25 bp, Homo sapien
aattagatcttacggatttatgaga

SEQ ID NO: 11147 - DNA, 25 bp, Homo sapien
aattagatcttatggatttatgaga

SEQ ID NO: 11148 - DNA, 25 bp, Homo sapien
aattagcaggtggcagaccccagtt

SEQ ID NO: 11149 - DNA, 25 bp, Homo sapien
aattagcagttggcagaccccagtt

SEQ ID NO: 11150 - DNA, 25 bp, Homo sapien
aattagcataactgacagaaatgca

SEQ ID NO: 11151 - DNA, 25 bp, Homo sapien
aattagcataactggcagaaatgca

SEQ ID NO: 11152 - DNA, 25 bp, Homo sapien
aattagctttcttacctgaaaatct

SEQ ID NO: 11153 - DNA, 25 bp, Homo sapien
aattagctttcttatctgaaaatct

SEQ ID NO: 11154 - DNA, 25 bp, Homo sapien
aattaggagaacagtgtctaagaat

SEQ ID NO: 11155 - DNA, 25 bp, Homo sapien
aattaggaggacagtgtctaagaat

SEQ ID NO: 11156 - DNA, 25 bp, Homo sapien
aattaggtcaggtcctcaaacttgg

SEQ ID NO: 11157 - DNA, 25 bp, Homo sapien
aattaggtcaggtccttaaacttgg

SEQ ID NO: 11158 - DNA, 25 bp, Homo sapien
aattagtaaaaaaaatagtgtgtca

SEQ ID NO: 11159 - DNA, 25 bp, Homo sapien
aattagtaaaacaaatagtgtgtca

SEQ ID NO: 11160 - DNA, 25 bp, Homo sapien
aattagtatcatccgaatgtcccag

SEQ ID NO: 11161 - DNA, 25 bp, Homo sapien
aattagtatcatctgaatgtcccag

SEQ ID NO: 11162 - DNA, 25 bp, Homo sapien
aattagtcataccttcccataattg

SEQ ID NO: 11163 - DNA, 25 bp, Homo sapien
aattagtcatactttcccataattg

SEQ ID NO: 11164 - DNA, 25 bp, Homo sapien
aattagtggagactttaatagaaaa

SEQ ID NO: 11165 - DNA, 25 bp, Homo sapien
aattagtggagattttaatagaaaa

SEQ ID NO: 11166 - DNA, 25 bp, Homo sapien
aattagttgaaactctcttgaatat

SEQ ID NO: 11167 - DNA, 25 bp, Homo sapien
aattagttgaacctctcttgaatat

SEQ ID NO: 11168 - DNA, 25 bp, Homo sapien
aattataacagacatgtgctcagaa

SEQ ID NO: 11169 - DNA, 25 bp, Homo sapien
aattataagacagttagtcatcaag

SEQ ID NO: 11170 - DNA, 25 bp, Homo sapien
aattataagacagttattcatcaag

SEQ ID NO: 11171 - DNA, 25 bp, Homo sapien
aattataagagaaactataaaagca

SEQ ID NO: 11172 - DNA, 25 bp, Homo sapien
aattataagagaaactctaaaagca

SEQ ID NO: 11173 - DNA, 25 bp, Homo sapien
aattataatagacatgtgctcagaa

SEQ ID NO: 11174 - DNA, 25 bp, Homo sapien
aattatagaagcagcttattgaaat

SEQ ID NO: 11175 - DNA, 25 bp, Homo sapien
aattatagaagcaggttattgaaat

SEQ ID NO: 11176 - DNA, 25 bp, Homo sapien
aattataggcctgatttctccttac

SEQ ID NO: 11177 - DNA, 25 bp, Homo sapien
aattatagtcctgatttctccttac

SEQ ID NO: 11178 - DNA, 25 bp, Homo sapien
aattatagtctgtatgctttctatt

SEQ ID NO: 11179 - DNA, 25 bp, Homo sapien
aattatagtggaccatcaacttatg

SEQ ID NO: 11180 - DNA, 25 bp, Homo sapien
aattatagtggaccgtcaacttatg

SEQ ID NO: 11181 - DNA, 25 bp, Homo sapien
aattatagtttgtatgctttctatt

SEQ ID NO: 11182 - DNA, 25 bp, Homo sapien
aattatatactcaacgttcaacaag

SEQ ID NO: 11183 - DNA, 25 bp, Homo sapien
aattatatactcaatgttcaacaag

SEQ ID NO: 11184 - DNA, 25 bp, Homo sapien
aattatattggatatcgtgaattgt

SEQ ID NO: 11185 - DNA, 25 bp, Homo sapien
aattatattggatatcttgaattgt

SEQ ID NO: 11186 - DNA, 25 bp, Homo sapien
aattatcacacacttagcagatgaa

SEQ ID NO: 11187 - DNA, 25 bp, Homo sapien
aattatcacacatttagcagatgaa

SEQ ID NO: 11188 - DNA, 25 bp, Homo sapien
aattatctaactaagggctatttgt

SEQ ID NO: 11189 - DNA, 25 bp, Homo sapien
aattatctaactaaggtctatttgt

SEQ ID NO: 11190 - DNA, 25 bp, Homo sapien
aattatctcaaccaaggagattgga

SEQ ID NO: 11191 - DNA, 25 bp, Homo sapien
aattatctcgaccaaggagattgga

SEQ ID NO: 11192 - DNA, 25 bp, Homo sapien
aattatctcttttcgcatctctgcc

SEQ ID NO: 11193 - DNA, 25 bp, Homo sapien
aattatctctttttgcatctctgcc

SEQ ID NO: 11194 - DNA, 25 bp, Homo sapien
aattatctgcacgatggaaacgtct

SEQ ID NO: 11195 - DNA, 25 bp, Homo sapien
aattatctgcatgatggaaacgtct

SEQ ID NO: 11196 - DNA, 25 bp, Homo sapien
aattatcttccaacaaatagattag

SEQ ID NO: 11197 - DNA, 25 bp, Homo sapien
aattatcttccaacaagtagattag

SEQ ID NO: 11198 - DNA, 25 bp, Homo sapien
aattatgaaatctgtggagcttgac

SEQ ID NO: 11199 - DNA, 25 bp, Homo sapien
aattatgaaatttgtggagcttgac

SEQ ID NO: 11200 - DNA, 25 bp, Homo sapien
aattatgatttcggttagtaatgta

SEQ ID NO: 11201 - DNA, 25 bp, Homo sapien
aattatgattttggttagtaatgta

SEQ ID NO: 11202 - DNA, 25 bp, Homo sapien
aattatgccactccataaatttgtt

SEQ ID NO: 11203 - DNA, 25 bp, Homo sapien
aattatgccactctataaatttgtt

SEQ ID NO: 11204 - DNA, 25 bp, Homo sapien
aattatgccggggaatgcctttaaa

SEQ ID NO: 11205 - DNA, 25 bp, Homo sapien
aattatgctcaactcgagtgccttt

SEQ ID NO: 11206 - DNA, 25 bp, Homo sapien
aattatgctcaacttgagtgccttt

SEQ ID NO: 11207 - DNA, 25 bp, Homo sapien
aattatgctcatattacaggtgagg

SEQ ID NO: 11208 - DNA, 25 bp, Homo sapien
aattatgctgaccaagatgaacact

SEQ ID NO: 11209 - DNA, 25 bp, Homo sapien
aattatgctgaccaaggtgaacact

SEQ ID NO: 11210 - DNA, 25 bp, Homo sapien
aattatgctgatattacaggtgagg

SEQ ID NO: 11211 - DNA, 25 bp, Homo sapien
aattatgctggggaatgcctttaaa

SEQ ID NO: 11212 - DNA, 25 bp, Homo sapien
aattatgcttactatgctcatgcag

SEQ ID NO: 11213 - DNA, 25 bp, Homo sapien
aattatgcttactatgttcatgcag

SEQ ID NO: 11214 - DNA, 25 bp, Homo sapien
aattatgtacgcacgagataaaacc

SEQ ID NO: 11215 - DNA, 25 bp, Homo sapien
aattatgtacgcatgagataaaacc

SEQ ID NO: 11216 - DNA, 25 bp, Homo sapien
aattattaatccattcaactgttgg

SEQ ID NO: 11217 - DNA, 25 bp, Homo sapien
aattattaatccgttcaactgttgg

SEQ ID NO: 11218 - DNA, 25 bp, Homo sapien
aattattagactgcggcaaagccag

SEQ ID NO: 11219 - DNA, 25 bp, Homo sapien
aattattagactgtggcaaagccag

SEQ ID NO: 11220 - DNA, 25 bp, Homo sapien
aattattagatccgtagcttcttaa

SEQ ID NO: 11221 - DNA, 25 bp, Homo sapien
aattattagatccttagcttcttaa

SEQ ID NO: 11222 - DNA, 25 bp, Homo sapien
aattattccactccatgacctcccg

SEQ ID NO: 11223 - DNA, 25 bp, Homo sapien
aattattccgctccatgacctcccg

SEQ ID NO: 11224 - DNA, 25 bp, Homo sapien
aattattgcaactatcttttaacaa

SEQ ID NO: 11225 - DNA, 25 bp, Homo sapien
aattattgcaattatcttttaacaa

SEQ ID NO: 11226 - DNA, 25 bp, Homo sapien
aattatttataggaatccaaaacat

SEQ ID NO: 11227 - DNA, 25 bp, Homo sapien
aattatttgaacctgtcttttttta

SEQ ID NO: 11228 - DNA, 25 bp, Homo sapien
aattatttgaacttgtcttttttta

SEQ ID NO: 11229 - DNA, 25 bp, Homo sapien
aattatttgtaggaatccaaaacat

SEQ ID NO: 11230 - DNA, 25 bp, Homo sapien
aattcaaaaatcagtcgggtgcagt

SEQ ID NO: 11231 - DNA, 25 bp, Homo sapien
aattcaaaaattagtcgggtgcagt

SEQ ID NO: 11232 - DNA, 25 bp, Homo sapien
aattcaaaactgtgcaaaatctatg

SEQ ID NO: 11233 - DNA, 25 bp, Homo sapien
aattcaaaaggatacgcactggctt

SEQ ID NO: 11234 - DNA, 25 bp, Homo sapien
aattcaaaaggatatgcactggctt

SEQ ID NO: 11235 - DNA, 25 bp, Homo sapien
aattcaaaagtgtgcaaaatctatg

SEQ ID NO: 11236 - DNA, 25 bp, Homo sapien
aattcaaagcacggatttcaagcaa

SEQ ID NO: 11237 - DNA, 25 bp, Homo sapien
aattcaaagcatggatttcaagcaa

SEQ ID NO: 11238 - DNA, 25 bp, Homo sapien
aattcaaccacaatgaaggaattat

SEQ ID NO: 11239 - DNA, 25 bp, Homo sapien
aattcaaccacagtgaaggaattat

SEQ ID NO: 11240 - DNA, 25 bp, Homo sapien
aattcaaggagctgaaaagtcacaa

SEQ ID NO: 11241 - DNA, 25 bp, Homo sapien
aattcaaggagctgaagagtcacaa

SEQ ID NO: 11242 - DNA, 25 bp, Homo sapien
aattcaagtttccatttgtattctg

SEQ ID NO: 11243 - DNA, 25 bp, Homo sapien
aattcaagtttccgtttgtattctg

SEQ ID NO: 11244 - DNA, 25 bp, Homo sapien
aattcaatcagatatccttagaacc

SEQ ID NO: 11245 - DNA, 25 bp, Homo sapien
aattcaatcaggtatccttagaacc

SEQ ID NO: 11246 - DNA, 25 bp, Homo sapien
aattcaattgtttaaagagcaaaaa

SEQ ID NO: 11247 - DNA, 25 bp, Homo sapien
aattcaattgtttcaagagcaaaaa

SEQ ID NO: 11248 - DNA, 25 bp, Homo sapien
aattcacaaagggtacaatacatcg

SEQ ID NO: 11249 - DNA, 25 bp, Homo sapien
aattcacaaggggtacaatacatcg

SEQ ID NO: 11250 - DNA, 25 bp, Homo sapien
aattcacaatgtcatagaatgctaa

SEQ ID NO: 11251 - DNA, 25 bp, Homo sapien
aattcacaatgtcgtagaatgctaa

SEQ ID NO: 11252 - DNA, 25 bp, Homo sapien
aattcacacgcttactgaacttcaa

SEQ ID NO: 11253 - DNA, 25 bp, Homo sapien
aattcacacggcaaaacctagaaaa

SEQ ID NO: 11254 - DNA, 25 bp, Homo sapien
aattcacatgcaaggatggctcttg

SEQ ID NO: 11255 - DNA, 25 bp, Homo sapien
aattcacatgcagggatggctcttg

SEQ ID NO: 11256 - DNA, 25 bp, Homo sapien
aattcacatgcttactgaacttcaa

SEQ ID NO: 11257 - DNA, 25 bp, Homo sapien
aattcacatggcaaaacctagaaaa

SEQ ID NO: 11258 - DNA, 25 bp, Homo sapien
aattcaccaggtgttattctttcac

SEQ ID NO: 11259 - DNA, 25 bp, Homo sapien
aattcaccatatagttgaaggatgg

SEQ ID NO: 11260 - DNA, 25 bp, Homo sapien
aattcaccgggtgttattctttcac

SEQ ID NO: 11261 - DNA, 25 bp, Homo sapien
aattcaccgtatagttgaaggatgg

SEQ ID NO: 11262 - DNA, 25 bp, Homo sapien
aattcacctgctggataattgtaac

SEQ ID NO: 11263 - DNA, 25 bp, Homo sapien
aattcacctgctggctaattgtaac

SEQ ID NO: 11264 - DNA, 25 bp, Homo sapien
aattcactaatcgagttgggctatt

SEQ ID NO: 11265 - DNA, 25 bp, Homo sapien
aattcactaattgagttgggctatt

SEQ ID NO: 11266 - DNA, 25 bp, Homo sapien
aattcactatgatcttctattctgt

SEQ ID NO: 11267 - DNA, 25 bp, Homo sapien
aattcactgtgatcttctattctgt

SEQ ID NO: 11268 - DNA, 25 bp, Homo sapien
aattcagaattacggtgttgttaga

SEQ ID NO: 11269 - DNA, 25 bp, Homo sapien
aattcagaattacggttttgttaga

SEQ ID NO: 11270 - DNA, 25 bp, Homo sapien
aattcagacccaaaatttttgctct

SEQ ID NO: 11271 - DNA, 25 bp, Homo sapien
aattcagacccagaatttttgctct

SEQ ID NO: 11272 - DNA, 25 bp, Homo sapien
aattcagaggataaattaatctctt

SEQ ID NO: 11273 - DNA, 25 bp, Homo sapien
aattcagaggatgaattaatctctt

SEQ ID NO: 11274 - DNA, 25 bp, Homo sapien
aattcagcttttcattgaagctact

SEQ ID NO: 11275 - DNA, 25 bp, Homo sapien
aattcagcttttcgttgaagctact

SEQ ID NO: 11276 - DNA, 25 bp, Homo sapien
aattcagggaaagtccacagtgcaa

SEQ ID NO: 11277 - DNA, 25 bp, Homo sapien
aattcagggaaagtccgcagtgcaa

SEQ ID NO: 11278 - DNA, 25 bp, Homo sapien
aattcagtcagagcggaaaaaacag

SEQ ID NO: 11279 - DNA, 25 bp, Homo sapien
aattcagtcatgtatttccacagat

SEQ ID NO: 11280 - DNA, 25 bp, Homo sapien
aattcagtcatgtctttccacagat

SEQ ID NO: 11281 - DNA, 25 bp, Homo sapien
aattcagtcggagcggaaaaaacag

SEQ ID NO: 11282 - DNA, 25 bp, Homo sapien
aattcagtgcagatattcgctgcaa

SEQ ID NO: 11283 - DNA, 25 bp, Homo sapien
aattcagtgtagatattcgctgcaa

SEQ ID NO: 11284 - DNA, 25 bp, Homo sapien
aattcagttagaacagagtgctgag

SEQ ID NO: 11285 - DNA, 25 bp, Homo sapien
aattcagttagaccagagtgctgag

SEQ ID NO: 11286 - DNA, 25 bp, Homo sapien
aattcagtttgcaaaaccttcaatc

SEQ ID NO: 11287 - DNA, 25 bp, Homo sapien
aattcagtttgcaaaagcttcaatc

SEQ ID NO: 11288 - DNA, 25 bp, Homo sapien
aattcataacacacaaatgtaaggg

SEQ ID NO: 11289 - DNA, 25 bp, Homo sapien
aattcataacacgcaaatgtaaggg

SEQ ID NO: 11290 - DNA, 25 bp, Homo sapien
aattcatacctagagagctcagtaa

SEQ ID NO: 11291 - DNA, 25 bp, Homo sapien
aattcatacctagcgagctcagtaa

SEQ ID NO: 11292 - DNA, 25 bp, Homo sapien
aattcatatcagaacatacagatct

SEQ ID NO: 11293 - DNA, 25 bp, Homo sapien
aattcatatcagcacatacagatct

SEQ ID NO: 11294 - DNA, 25 bp, Homo sapien
aattcatcatcggaaaatatccagg

SEQ ID NO: 11295 - DNA, 25 bp, Homo sapien
aattcatcatcggacaatatccagg

SEQ ID NO: 11296 - DNA, 25 bp, Homo sapien
aattcatcattaccaaattccaggc

SEQ ID NO: 11297 - DNA, 25 bp, Homo sapien
aattcatcattgccaaattccaggc

SEQ ID NO: 11298 - DNA, 25 bp, Homo sapien
aattcatccaccaagtagtggcatc

SEQ ID NO: 11299 - DNA, 25 bp, Homo sapien
aattcatccaccaggtagtggcatc

SEQ ID NO: 11300 - DNA, 25 bp, Homo sapien
aattcatcgccatatccaggctcct

SEQ ID NO: 11301 - DNA, 25 bp, Homo sapien
aattcatcgccatgtccaggctcct

SEQ ID NO: 11302 - DNA, 25 bp, Homo sapien
aattcatgccaagttgaagaagcag

SEQ ID NO: 11303 - DNA, 25 bp, Homo sapien
aattcatgccaagttgcagaagcag

SEQ ID NO: 11304 - DNA, 25 bp, Homo sapien
aattcatgctgttaaaatggctgag

SEQ ID NO: 11305 - DNA, 25 bp, Homo sapien
aattcatgctgttaaagtggctgag

SEQ ID NO: 11306 - DNA, 25 bp, Homo sapien
aattcatgcttcgttgaatccacag

SEQ ID NO: 11307 - DNA, 25 bp, Homo sapien
aattcatgcttggttgaatccacag

SEQ ID NO: 11308 - DNA, 25 bp, Homo sapien
aattccaacggctcagagcaaaaca

SEQ ID NO: 11309 - DNA, 25 bp, Homo sapien
aattccaagggctcagagcaaaaca

SEQ ID NO: 11310 - DNA, 25 bp, Homo sapien
aattccacattaattcttagatctg

SEQ ID NO: 11311 - DNA, 25 bp, Homo sapien
aattccacgttaattcttagatctg

SEQ ID NO: 11312 - DNA, 25 bp, Homo sapien
aattccactttgtcacatgccagat

SEQ ID NO: 11313 - DNA, 25 bp, Homo sapien
aattccactttgtcacttgccagat

SEQ ID NO: 11314 - DNA, 25 bp, Homo sapien
aattccagaatggttccctaagata

SEQ ID NO: 11315 - DNA, 25 bp, Homo sapien
aattccagaattgttccctaagata

SEQ ID NO: 11316 - DNA, 25 bp, Homo sapien
aattccagatttttggaattctgta

SEQ ID NO: 11317 - DNA, 25 bp, Homo sapien
aattccagattttttgaattctgta

SEQ ID NO: 11318 - DNA, 25 bp, Homo sapien
aattccatgattttgacaagtgcac

SEQ ID NO: 11319 - DNA, 25 bp, Homo sapien
aattccatggttttgacaagtgcac

SEQ ID NO: 11320 - DNA, 25 bp, Homo sapien
aattccatttctgtatatgttcatg

SEQ ID NO: 11321 - DNA, 25 bp, Homo sapien
aattccatttctttatatgttcatg

SEQ ID NO: 11322 - DNA, 25 bp, Homo sapien
aattcccacatgaactctatgcaat

SEQ ID NO: 11323 - DNA, 25 bp, Homo sapien
aattcccacgggtaaacacttatgt

SEQ ID NO: 11324 - DNA, 25 bp, Homo sapien
aattcccacgtgaactctatgcaat

SEQ ID NO: 11325 - DNA, 25 bp, Homo sapien
aattcccatgggtaaacacttatgt

SEQ ID NO: 11326 - DNA, 25 bp, Homo sapien
aattcccgaattccgctgtctggtc

SEQ ID NO: 11327 - DNA, 25 bp, Homo sapien
aattcccgaattctgctgtctggtc

SEQ ID NO: 11328 - DNA, 25 bp, Homo sapien
aattccgcttggccaatttaaagag

SEQ ID NO: 11329 - DNA, 25 bp, Homo sapien
aattccgcttggctaatttaaagag

SEQ ID NO: 11330 - DNA, 25 bp, Homo sapien
aattcctaaatcatgatcccagtgc

SEQ ID NO: 11331 - DNA, 25 bp, Homo sapien
aattcctaaattatgatcccagtgc

SEQ ID NO: 11332 - DNA, 25 bp, Homo sapien
aattcctatcttgactttatgtttt

SEQ ID NO: 11333 - DNA, 25 bp, Homo sapien
aattcctatcttgattttatgtttt

SEQ ID NO: 11334 - DNA, 25 bp, Homo sapien
aattcctgcataacaagtaccaatg

SEQ ID NO: 11335 - DNA, 25 bp, Homo sapien
aattcctgcgtaacaagtaccaatg

SEQ ID NO: 11336 - DNA, 25 bp, Homo sapien
aattcctgcttttcatgcatcttgg

SEQ ID NO: 11337 - DNA, 25 bp, Homo sapien
aattcctgcttttcgtgcatcttgg

SEQ ID NO: 11338 - DNA, 25 bp, Homo sapien
aattcctggaactcaaagaaatggt

SEQ ID NO: 11339 - DNA, 25 bp, Homo sapien
aattcctggaactgaaagaaatggt

SEQ ID NO: 11340 - DNA, 25 bp, Homo sapien
aattcgaacttacctcatatttgtg

SEQ ID NO: 11341 - DNA, 25 bp, Homo sapien
aattcgaacttacctcttatttgtg

SEQ ID NO: 11342 - DNA, 25 bp, Homo sapien
aattcgaccatttaatatacaactc

SEQ ID NO: 11343 - DNA, 25 bp, Homo sapien
aattcgaccatttaatgtacaactc

SEQ ID NO: 11344 - DNA, 25 bp, Homo sapien
aattcgccatagcatggtctatgtt

SEQ ID NO: 11345 - DNA, 25 bp, Homo sapien
aattcgccgtagcatggtctatgtt

SEQ ID NO: 11346 - DNA, 25 bp, Homo sapien
aattcgtgaacaatgtggaacagtc

SEQ ID NO: 11347 - DNA, 25 bp, Homo sapien
aattcgtgcacaatgtggaacagtc

SEQ ID NO: 11348 - DNA, 25 bp, Homo sapien
aattcgttgactcgtactgtgctaa

SEQ ID NO: 11349 - DNA, 25 bp, Homo sapien
aattcgttgtctcgtactgtgctaa

SEQ ID NO: 11350 - DNA, 25 bp, Homo sapien
aattctaaaaaaagttcaagtaacc

SEQ ID NO: 11351 - DNA, 25 bp, Homo sapien
aattctaaaaaacgttcaagtaacc

SEQ ID NO: 11352 - DNA, 25 bp, Homo sapien
aattctaaaatataagagtgcagtt

SEQ ID NO: 11353 - DNA, 25 bp, Homo sapien
aattctaaaatattagagtgcagtt

SEQ ID NO: 11354 - DNA, 25 bp, Homo sapien
aattctaaaggactaacttttctta

SEQ ID NO: 11355 - DNA, 25 bp, Homo sapien
aattctaactcactacaagtactac

SEQ ID NO: 11356 - DNA, 25 bp, Homo sapien
aattctaactcactgcaagtactac

SEQ ID NO: 11357 - DNA, 25 bp, Homo sapien
aattctaagatacagggttcaaagg

SEQ ID NO: 11358 - DNA, 25 bp, Homo sapien
aattctaagatatagggttcaaagg

SEQ ID NO: 11359 - DNA, 25 bp, Homo sapien
aattctaagggactaacttttctta

SEQ ID NO: 11360 - DNA, 25 bp, Homo sapien
aattctactctatcgactatattga

SEQ ID NO: 11361 - DNA, 25 bp, Homo sapien
aattctactctattgactatattga

SEQ ID NO: 11362 - DNA, 25 bp, Homo sapien
aattctactgactttttcctaccct

SEQ ID NO: 11363 - DNA, 25 bp, Homo sapien
aattctactgattttttcctaccct

SEQ ID NO: 11364 - DNA, 25 bp, Homo sapien
aattctagcgcagagacttccagtt

SEQ ID NO: 11365 - DNA, 25 bp, Homo sapien
aattctagctcagagacttccagtt

SEQ ID NO: 11366 - DNA, 25 bp, Homo sapien
aattctagtcagaccgattatctgc

SEQ ID NO: 11367 - DNA, 25 bp, Homo sapien
aattctagtcagactgattatctgc

SEQ ID NO: 11368 - DNA, 25 bp, Homo sapien
aattctatacccacttctttacctc

SEQ ID NO: 11369 - DNA, 25 bp, Homo sapien
aattctatacccagttctttacctc

SEQ ID NO: 11370 - DNA, 25 bp, Homo sapien
aattctatcagacattcaaaagaga

SEQ ID NO: 11371 - DNA, 25 bp, Homo sapien
aattctatcagacgttcaaaagaga

SEQ ID NO: 11372 - DNA, 25 bp, Homo sapien
aattctatgatgaacaatgaagaga

SEQ ID NO: 11373 - DNA, 25 bp, Homo sapien
aattctatgatgaccaatgaagaga

SEQ ID NO: 11374 - DNA, 25 bp, Homo sapien
aattctatgttgccatactcccata

SEQ ID NO: 11375 - DNA, 25 bp, Homo sapien
aattctatgttgtcatactcccata

SEQ ID NO: 11376 - DNA, 25 bp, Homo sapien
aattctcaactccataaaagtagta

SEQ ID NO: 11377 - DNA, 25 bp, Homo sapien
aattctcaactccgtaaaagtagta

SEQ ID NO: 11378 - DNA, 25 bp, Homo sapien
aattctcaagtatttcaaatccata

SEQ ID NO: 11379 - DNA, 25 bp, Homo sapien
aattctcaattatttcaaatccata

SEQ ID NO: 11380 - DNA, 25 bp, Homo sapien
aattctcagagaccaaagagcaaga

SEQ ID NO: 11381 - DNA, 25 bp, Homo sapien
aattctcagagatcaaagagcaaga

SEQ ID NO: 11382 - DNA, 25 bp, Homo sapien
aattctgacaggccttgtgttgtgt

SEQ ID NO: 11383 - DNA, 25 bp, Homo sapien
aattctgacaggtcttgtgttgtgt

SEQ ID NO: 11384 - DNA, 25 bp, Homo sapien
aattctgagccatacgctttaacag

SEQ ID NO: 11385 - DNA, 25 bp, Homo sapien
aattctgagccatatgctttaacag

SEQ ID NO: 11386 - DNA, 25 bp, Homo sapien
aattctgatatgacttagtgtatgc

SEQ ID NO: 11387 - DNA, 25 bp, Homo sapien
aattctgatttgacttagtgtatgc

SEQ ID NO: 11388 - DNA, 25 bp, Homo sapien
aattctgctatccaacgaatcactg

SEQ ID NO: 11389 - DNA, 25 bp, Homo sapien
aattctgctgctaaaacagttatta

SEQ ID NO: 11390 - DNA, 25 bp, Homo sapien
aattctgcttcaatgaaagtgagcg

SEQ ID NO: 11391 - DNA, 25 bp, Homo sapien
aattctgcttccatgaaagtgagcg

SEQ ID NO: 11392 - DNA, 25 bp, Homo sapien
aattctgcttccattgccacatctt

SEQ ID NO: 11393 - DNA, 25 bp, Homo sapien
aattctgcttccgttgccacatctt

SEQ ID NO: 11394 - DNA, 25 bp, Homo sapien
aattctgcttctaaaacagttatta

SEQ ID NO: 11395 - DNA, 25 bp, Homo sapien
aattctgctttccaacgaatcactg

SEQ ID NO: 11396 - DNA, 25 bp, Homo sapien
aattctggaattatttttgctcaat

SEQ ID NO: 11397 - DNA, 25 bp, Homo sapien
aattctggcattatttttgctcaat

SEQ ID NO: 11398 - DNA, 25 bp, Homo sapien
aattctggccagcatcaggaaccaa

SEQ ID NO: 11399 - DNA, 25 bp, Homo sapien
aattctgggcagcatcaggaaccaa

SEQ ID NO: 11400 - DNA, 25 bp, Homo sapien
aattctggtacaagcctaattggaa

SEQ ID NO: 11401 - DNA, 25 bp, Homo sapien
aattctggtacaagtctaattggaa

SEQ ID NO: 11402 - DNA, 25 bp, Homo sapien
aattctgttcccagagaaatgaaaa

SEQ ID NO: 11403 - DNA, 25 bp, Homo sapien
aattctgttcctagagaaatgaaaa

SEQ ID NO: 11404 - DNA, 25 bp, Homo sapien
aattctgttgtacttacatggagtc

SEQ ID NO: 11405 - DNA, 25 bp, Homo sapien
aattctgttgttcttacatggagtc

SEQ ID NO: 11406 - DNA, 25 bp, Homo sapien
aattcttaaaggccctagtattttt

SEQ ID NO: 11407 - DNA, 25 bp, Homo sapien
aattcttaaaggtcctagtattttt

SEQ ID NO: 11408 - DNA, 25 bp, Homo sapien
aattcttaccaaactagagagagaa

SEQ ID NO: 11409 - DNA, 25 bp, Homo sapien
aattcttaccacactagagagagaa

SEQ ID NO: 11410 - DNA, 25 bp, Homo sapien
aattcttacgtggcagtcactaagc

SEQ ID NO: 11411 - DNA, 25 bp, Homo sapien
aattcttactttgtcttagcccaca

SEQ ID NO: 11412 - DNA, 25 bp, Homo sapien
aattcttactttgttttagcccaca

SEQ ID NO: 11413 - DNA, 25 bp, Homo sapien
aattcttagccagtattatttcaaa

SEQ ID NO: 11414 - DNA, 25 bp, Homo sapien
aattcttagccattattatttcaaa

SEQ ID NO: 11415 - DNA, 25 bp, Homo sapien
aattcttatgtggcagtcactaagc

SEQ ID NO: 11416 - DNA, 25 bp, Homo sapien
aattcttcaactaaggtgtttatga

SEQ ID NO: 11417 - DNA, 25 bp, Homo sapien
aattcttcagctaaggtgtttatga

SEQ ID NO: 11418 - DNA, 25 bp, Homo sapien
aattcttcataaacctgacctggac

SEQ ID NO: 11419 - DNA, 25 bp, Homo sapien
aattcttcataaacgtgacctggac

SEQ ID NO: 11420 - DNA, 25 bp, Homo sapien
aattcttccaagctatttgcaactg

SEQ ID NO: 11421 - DNA, 25 bp, Homo sapien
aattcttccaagctctttgcaactg

SEQ ID NO: 11422 - DNA, 25 bp, Homo sapien
aattcttccggtgaatttaactgaa

SEQ ID NO: 11423 - DNA, 25 bp, Homo sapien
aattcttcctcactatcttcacaga

SEQ ID NO: 11424 - DNA, 25 bp, Homo sapien
aattcttcctcgctatcttcacaga

SEQ ID NO: 11425 - DNA, 25 bp, Homo sapien
aattcttctggtgaatttaactgaa

SEQ ID NO: 11426 - DNA, 25 bp, Homo sapien
aattcttgatactagcagtagagga

SEQ ID NO: 11427 - DNA, 25 bp, Homo sapien
aattcttgatactagcggtagagga

SEQ ID NO: 11428 - DNA, 25 bp, Homo sapien
aattcttgtcctcatacacttttga

SEQ ID NO: 11429 - DNA, 25 bp, Homo sapien
aattcttgtcctcgtacacttttga

SEQ ID NO: 11430 - DNA, 25 bp, Homo sapien
aattcttgttgatgacagtctccag

SEQ ID NO: 11431 - DNA, 25 bp, Homo sapien
aattcttgttgatgacggtctccag

SEQ ID NO: 11432 - DNA, 25 bp, Homo sapien
aattctttactctaatccattattt

SEQ ID NO: 11433 - DNA, 25 bp, Homo sapien
aattctttcatgggctaagctccac

SEQ ID NO: 11434 - DNA, 25 bp, Homo sapien
aattctttcgggtaaatactcagaa

SEQ ID NO: 11435 - DNA, 25 bp, Homo sapien
aattctttcgtgggctaagctccac

SEQ ID NO: 11436 - DNA, 25 bp, Homo sapien
aattctttctgttcctcaagactag

SEQ ID NO: 11437 - DNA, 25 bp, Homo sapien
aattctttcttaaactacaaaagca

SEQ ID NO: 11438 - DNA, 25 bp, Homo sapien
aattctttcttgaactacaaaagca

SEQ ID NO: 11439 - DNA, 25 bp, Homo sapien
aattctttgctctaatccattattt

SEQ ID NO: 11440 - DNA, 25 bp, Homo sapien
aattcttttgggtaaatactcagaa

SEQ ID NO: 11441 - DNA, 25 bp, Homo sapien
aattcttttgtgcacgaggcatttt

SEQ ID NO: 11442 - DNA, 25 bp, Homo sapien
aattcttttgtgcatgaggcatttt

SEQ ID NO: 11443 - DNA, 25 bp, Homo sapien
aattctttttgttcctcaagactag

SEQ ID NO: 11444 - DNA, 25 bp, Homo sapien
aattgaaagccttaacaatagatta

SEQ ID NO: 11445 - DNA, 25 bp, Homo sapien
aattgaaagccttaaccatagatta

SEQ ID NO: 11446 - DNA, 25 bp, Homo sapien
aattgaaatcagaaaaaaacagaag

SEQ ID NO: 11447 - DNA, 25 bp, Homo sapien
aattgaaatcagaagaaaacagaag

SEQ ID NO: 11448 - DNA, 25 bp, Homo sapien
aattgaaattcgcttccggtgccag

SEQ ID NO: 11449 - DNA, 25 bp, Homo sapien
aattgaaattcggttccggtgccag

SEQ ID NO: 11450 - DNA, 25 bp, Homo sapien
aattgaacaaactctcttgattagc

SEQ ID NO: 11451 - DNA, 25 bp, Homo sapien
aattgaacaaattctcttgattagc

SEQ ID NO: 11452 - DNA, 25 bp, Homo sapien
aattgaacttacgcaaagcttcatc

SEQ ID NO: 11453 - DNA, 25 bp, Homo sapien
aattgaacttatgcaaagcttcatc

SEQ ID NO: 11454 - DNA, 25 bp, Homo sapien
aattgaatatggtcaattggcatca

SEQ ID NO: 11455 - DNA, 25 bp, Homo sapien
aattgaatatgttcaattggcatca

SEQ ID NO: 11456 - DNA, 25 bp, Homo sapien
aattgaatgatatattttcacatcc

SEQ ID NO: 11457 - DNA, 25 bp, Homo sapien
aattgaatgatgtattttcacatcc

SEQ ID NO: 11458 - DNA, 25 bp, Homo sapien
aattgaatgttcaatcactaacaaa

SEQ ID NO: 11459 - DNA, 25 bp, Homo sapien
aattgaatgttcagtcactaacaaa

SEQ ID NO: 11460 - DNA, 25 bp, Homo sapien
aattgaccaactgtgcgtggaatca

SEQ ID NO: 11461 - DNA, 25 bp, Homo sapien
aattgaccacatacttaaccataaa

SEQ ID NO: 11462 - DNA, 25 bp, Homo sapien
aattgaccacatgcttaaccataaa

SEQ ID NO: 11463 - DNA, 25 bp, Homo sapien
aattgaccatcacataatgtataca

SEQ ID NO: 11464 - DNA, 25 bp, Homo sapien
aattgaccattaccattaccattac

SEQ ID NO: 11465 - DNA, 25 bp, Homo sapien
aattgaccattaccgttaccattac

SEQ ID NO: 11466 - DNA, 25 bp, Homo sapien
aattgaccgactgtgcgtggaatca

SEQ ID NO: 11467 - DNA, 25 bp, Homo sapien
aattgaccgtcacataatgtataca

SEQ ID NO: 11468 - DNA, 25 bp, Homo sapien
aattgactaatagcacaaacatcaa

SEQ ID NO: 11469 - DNA, 25 bp, Homo sapien
aattgactaatagcacgaacatcaa

SEQ ID NO: 11470 - DNA, 25 bp, Homo sapien
aattgactatggtaggagaatttat

SEQ ID NO: 11471 - DNA, 25 bp, Homo sapien
aattgactcattatgcctcgaattt

SEQ ID NO: 11472 - DNA, 25 bp, Homo sapien
aattgactcattatgcttcgaattt

SEQ ID NO: 11473 - DNA, 25 bp, Homo sapien
aattgactctggtaggagaatttat

SEQ ID NO: 11474 - DNA, 25 bp, Homo sapien
aattgagaggccctctgaatactct

SEQ ID NO: 11475 - DNA, 25 bp, Homo sapien
aattgagaggctctctgaatactct

SEQ ID NO: 11476 - DNA, 25 bp, Homo sapien
aattgaggactcacgtagtaaggtg

SEQ ID NO: 11477 - DNA, 25 bp, Homo sapien
aattgaggactcatgtagtaaggtg

SEQ ID NO: 11478 - DNA, 25 bp, Homo sapien
aattgaggactgcgtatcaacaaat

SEQ ID NO: 11479 - DNA, 25 bp, Homo sapien
aattgaggactgtgtatcaacaaat

SEQ ID NO: 11480 - DNA, 25 bp, Homo sapien
aattgaggatgcctaatgggtaaca

SEQ ID NO: 11481 - DNA, 25 bp, Homo sapien
aattgaggatggctaatgggtaaca

SEQ ID NO: 11482 - DNA, 25 bp, Homo sapien
aattgagtctgaattaatttctgcc

SEQ ID NO: 11483 - DNA, 25 bp, Homo sapien
aattgagttccagggcagtaagtta

SEQ ID NO: 11484 - DNA, 25 bp, Homo sapien
aattgagtttcagggcagtaagtta

SEQ ID NO: 11485 - DNA, 25 bp, Homo sapien
aattgagtttgaattaatttctgcc

SEQ ID NO: 11486 - DNA, 25 bp, Homo sapien
aattgatatgcagatgaattatcca

SEQ ID NO: 11487 - DNA, 25 bp, Homo sapien
aattgatatgcggatgaattatcca

SEQ ID NO: 11488 - DNA, 25 bp, Homo sapien
aattgatggataaatttttctcaga

SEQ ID NO: 11489 - DNA, 25 bp, Homo sapien
aattgatggataactttttctcaga

SEQ ID NO: 11490 - DNA, 25 bp, Homo sapien
aattgattaagattttgcttctcat

SEQ ID NO: 11491 - DNA, 25 bp, Homo sapien
aattgattaagatttttcttctcat

SEQ ID NO: 11492 - DNA, 25 bp, Homo sapien
aattgcacaaaatatcaaaatacag

SEQ ID NO: 11493 - DNA, 25 bp, Homo sapien
aattgcacgaaatatcaaaatacag

SEQ ID NO: 11494 - DNA, 25 bp, Homo sapien
aattgccactttcatggactagtgc

SEQ ID NO: 11495 - DNA, 25 bp, Homo sapien
aattgccacttttatggactagtgc

SEQ ID NO: 11496 - DNA, 25 bp, Homo sapien
aattgcctaatatcataaaaacagt

SEQ ID NO: 11497 - DNA, 25 bp, Homo sapien
aattgcctgatatcataaaaacagt

SEQ ID NO: 11498 - DNA, 25 bp, Homo sapien
aattgctaaatctcttgcacaggta

SEQ ID NO: 11499 - DNA, 25 bp, Homo sapien
aattgctaaatctgttgcacaggta

SEQ ID NO: 11500 - DNA, 25 bp, Homo sapien
aattgctaatgaaagatatgttgac

SEQ ID NO: 11501 - DNA, 25 bp, Homo sapien
aattgctaatgaaggatatgttgac

SEQ ID NO: 11502 - DNA, 25 bp, Homo sapien
aattgctacaaactaatgactaatg

SEQ ID NO: 11503 - DNA, 25 bp, Homo sapien
aattgctacaaactgatgactaatg

SEQ ID NO: 11504 - DNA, 25 bp, Homo sapien
aattgctataacgaatctaaagtat

SEQ ID NO: 11505 - DNA, 25 bp, Homo sapien
aattgctataatgaatctaaagtat

SEQ ID NO: 11506 - DNA, 25 bp, Homo sapien
aattgctatatatggttatgtaggt

SEQ ID NO: 11507 - DNA, 25 bp, Homo sapien
aattgctatgtatggttatgtaggt

SEQ ID NO: 11508 - DNA, 25 bp, Homo sapien
aattgctgagaaaacaagtaagtta

SEQ ID NO: 11509 - DNA, 25 bp, Homo sapien
aattgctgagaaaataagtaagtta

SEQ ID NO: 11510 - DNA, 25 bp, Homo sapien
aattgctgcaggtagagactacatt

SEQ ID NO: 11511 - DNA, 25 bp, Homo sapien
aattgctgcaggtggagactacatt

SEQ ID NO: 11512 - DNA, 25 bp, Homo sapien
aattgctgtcattgaaccgccagtg

SEQ ID NO: 11513 - DNA, 25 bp, Homo sapien
aattgctgtcattggaccgccagtg

SEQ ID NO: 11514 - DNA, 25 bp, Homo sapien
aattgcttatgctcgaattgatttg

SEQ ID NO: 11515 - DNA, 25 bp, Homo sapien
aattgcttatgcttgaattgatttg

SEQ ID NO: 11516 - DNA, 25 bp, Homo sapien
aattgcttgcggaacgcgttataaa

SEQ ID NO: 11517 - DNA, 25 bp, Homo sapien
aattgcttgcggaacgtgttataaa

SEQ ID NO: 11518 - DNA, 25 bp, Homo sapien
aattgctttgcagcagtcttcataa

SEQ ID NO: 11519 - DNA, 25 bp, Homo sapien
aattgctttgcagcggtcttcataa

SEQ ID NO: 11520 - DNA, 25 bp, Homo sapien
aattggaaacaggaaggagcacctg

SEQ ID NO: 11521 - DNA, 25 bp, Homo sapien
aattggaaagaggaaggagcacctg

SEQ ID NO: 11522 - DNA, 25 bp, Homo sapien
aattggaaatggaatagaatagaag

SEQ ID NO: 11523 - DNA, 25 bp, Homo sapien
aattggaaatgggatagaatagaag

SEQ ID NO: 11524 - DNA, 25 bp, Homo sapien
aattggaacacaatctaactgttgc

SEQ ID NO: 11525 - DNA, 25 bp, Homo sapien
aattggaacacgatctaactgttgc

SEQ ID NO: 11526 - DNA, 25 bp, Homo sapien
aattggagcctcttaaattgaagga

SEQ ID NO: 11527 - DNA, 25 bp, Homo sapien
aattggagcttcttaaattgaagga

SEQ ID NO: 11528 - DNA, 25 bp, Homo sapien
aattggataactaatacttgtacac

SEQ ID NO: 11529 - DNA, 25 bp, Homo sapien
aattggataactaatatttgtacac

SEQ ID NO: 11530 - DNA, 25 bp, Homo sapien
aattggatactctgtgggtggtttg

SEQ ID NO: 11531 - DNA, 25 bp, Homo sapien
aattggatactttgtgggtggtttg

SEQ ID NO: 11532 - DNA, 25 bp, Homo sapien
aattggatagataagacaggatgta

SEQ ID NO: 11533 - DNA, 25 bp, Homo sapien
aattggatgacagcatactaagaca

SEQ ID NO: 11534 - DNA, 25 bp, Homo sapien
aattggatgacagcgtactaagaca

SEQ ID NO: 11535 - DNA, 25 bp, Homo sapien
aattggatggataagacaggatgta

SEQ ID NO: 11536 - DNA, 25 bp, Homo sapien
aattggcacttatgaaagtggagct

SEQ ID NO: 11537 - DNA, 25 bp, Homo sapien
aattggcacttgtgaaagtggagct

SEQ ID NO: 11538 - DNA, 25 bp, Homo sapien
aattggcataccttttattttgttt

SEQ ID NO: 11539 - DNA, 25 bp, Homo sapien
aattggcatactttttattttgttt

SEQ ID NO: 11540 - DNA, 25 bp, Homo sapien
aattggccttggttgaattggatca

SEQ ID NO: 11541 - DNA, 25 bp, Homo sapien
aattggccttggttgacttggatca

SEQ ID NO: 11542 - DNA, 25 bp, Homo sapien
aattgggaaagacatattcagcatc

SEQ ID NO: 11543 - DNA, 25 bp, Homo sapien
aattgggaaagatatattcagcatc

SEQ ID NO: 11544 - DNA, 25 bp, Homo sapien
aattgggaatgcagacaactagcat

SEQ ID NO: 11545 - DNA, 25 bp, Homo sapien
aattgggaatgtagacaactagcat

SEQ ID NO: 11546 - DNA, 25 bp, Homo sapien
aattgggatcatcaaaggagagaaa

SEQ ID NO: 11547 - DNA, 25 bp, Homo sapien
aattgggatcattaaaggagagaaa

SEQ ID NO: 11548 - DNA, 25 bp, Homo sapien
aattgggcaaaataataatccttga

SEQ ID NO: 11549 - DNA, 25 bp, Homo sapien
aattgggccaaataataatccttga

SEQ ID NO: 11550 - DNA, 25 bp, Homo sapien
aattgggccagaagaaagttctaga

SEQ ID NO: 11551 - DNA, 25 bp, Homo sapien
aattgggccagaaggaagttctaga

SEQ ID NO: 11552 - DNA, 25 bp, Homo sapien
aattgggccagactcttcctatgtg

SEQ ID NO: 11553 - DNA, 25 bp, Homo sapien
aattgggccagacttttcctatgtg

SEQ ID NO: 11554 - DNA, 25 bp, Homo sapien
aattgggtaaacagttcttaggagt

SEQ ID NO: 11555 - DNA, 25 bp, Homo sapien
aattgggtatacagttcttaggagt

SEQ ID NO: 11556 - DNA, 25 bp, Homo sapien
aattgggtcgctgaaaacaatagac

SEQ ID NO: 11557 - DNA, 25 bp, Homo sapien
aattgggtggctgaaaacaatagac

SEQ ID NO: 11558 - DNA, 25 bp, Homo sapien
aattgggtgtagacagtaaatacac

SEQ ID NO: 11559 - DNA, 25 bp, Homo sapien
aattgggtgtagatagtaaatacac

SEQ ID NO: 11560 - DNA, 25 bp, Homo sapien
aattggtgacaggccaaatacgaaa

SEQ ID NO: 11561 - DNA, 25 bp, Homo sapien
aattggtgagaggccaaatacgaaa

SEQ ID NO: 11562 - DNA, 25 bp, Homo sapien
aattggtgattcctatcatccctct

SEQ ID NO: 11563 - DNA, 25 bp, Homo sapien
aattggtggttcctatcatccctct

SEQ ID NO: 11564 - DNA, 25 bp, Homo sapien
aattggttcaatcatccgtctacta

SEQ ID NO: 11565 - DNA, 25 bp, Homo sapien
aattggttcaatcgtccgtctacta

SEQ ID NO: 11566 - DNA, 25 bp, Homo sapien
aattgtaaatataggattaaagtgc

SEQ ID NO: 11567 - DNA, 25 bp, Homo sapien
aattgtaaatatgggattaaagtgc

SEQ ID NO: 11568 - DNA, 25 bp, Homo sapien
aattgtaagtacaagtgtcagccat

SEQ ID NO: 11569 - DNA, 25 bp, Homo sapien
aattgtaagtacgagtgtcagccat

SEQ ID NO: 11570 - DNA, 25 bp, Homo sapien
aattgtaatttgcacacgtggaggg

SEQ ID NO: 11571 - DNA, 25 bp, Homo sapien
aattgtaatttgcacatgtggaggg

SEQ ID NO: 11572 - DNA, 25 bp, Homo sapien
aattgtacaataattcccagtgttg

SEQ ID NO: 11573 - DNA, 25 bp, Homo sapien
aattgtacagtaattcccagtgttg

SEQ ID NO: 11574 - DNA, 25 bp, Homo sapien
aattgtagcgccttctaaaaaaact

SEQ ID NO: 11575 - DNA, 25 bp, Homo sapien
aattgtagtgccttctaaaaaaact

SEQ ID NO: 11576 - DNA, 25 bp, Homo sapien
aattgtagttttgactgaatttctt

SEQ ID NO: 11577 - DNA, 25 bp, Homo sapien
aattgtagttttgattgaatttctt

SEQ ID NO: 11578 - DNA, 25 bp, Homo sapien
aattgtattcattggttttcattgt

SEQ ID NO: 11579 - DNA, 25 bp, Homo sapien
aattgtattcatttgttttcattgt

SEQ ID NO: 11580 - DNA, 25 bp, Homo sapien
aattgtcataattaatagaaacaca

SEQ ID NO: 11581 - DNA, 25 bp, Homo sapien
aattgtcatcattaatagaaacaca

SEQ ID NO: 11582 - DNA, 25 bp, Homo sapien
aattgtcgatggtggaaataacagc

SEQ ID NO: 11583 - DNA, 25 bp, Homo sapien
aattgtcggtggtggaaataacagc

SEQ ID NO: 11584 - DNA, 25 bp, Homo sapien
aattgtctccctcaaagcaaggcca

SEQ ID NO: 11585 - DNA, 25 bp, Homo sapien
aattgtctccctcagagcaaggcca

SEQ ID NO: 11586 - DNA, 25 bp, Homo sapien
aattgtgaatgcatagaaattaatc

SEQ ID NO: 11587 - DNA, 25 bp, Homo sapien
aattgtgaatgcgtagaaattaatc

SEQ ID NO: 11588 - DNA, 25 bp, Homo sapien
aattgtgcaccaaagtatcatccta

SEQ ID NO: 11589 - DNA, 25 bp, Homo sapien
aattgtgcaccaaagtgtcatccta

SEQ ID NO: 11590 - DNA, 25 bp, Homo sapien
aattgtgctcaaacatattcataaa

SEQ ID NO: 11591 - DNA, 25 bp, Homo sapien
aattgtgctcaaacatgttcataaa

SEQ ID NO: 11592 - DNA, 25 bp, Homo sapien
aattgtgtctatcctggagtttccc

SEQ ID NO: 11593 - DNA, 25 bp, Homo sapien
aattgtgtctattctggagtttccc

SEQ ID NO: 11594 - DNA, 25 bp, Homo sapien
aattgtgtggaatggaatagaggtc

SEQ ID NO: 11595 - DNA, 25 bp, Homo sapien
aattgtgtgtaatggaatagaggtc

SEQ ID NO: 11596 - DNA, 25 bp, Homo sapien
aattgtgttgccactgagtttctat

SEQ ID NO: 11597 - DNA, 25 bp, Homo sapien
aattgtgttgccattgagtttctat

SEQ ID NO: 11598 - DNA, 25 bp, Homo sapien
aattgttaaattgcagctttcaagg

SEQ ID NO: 11599 - DNA, 25 bp, Homo sapien
aattgttaagttgcagctttcaagg

SEQ ID NO: 11600 - DNA, 25 bp, Homo sapien
aattgttcaactatacagagagttc

SEQ ID NO: 11601 - DNA, 25 bp, Homo sapien
aattgttcagctatacagagagttc

SEQ ID NO: 11602 - DNA, 25 bp, Homo sapien
aattgttcattcacttgctcaacaa

SEQ ID NO: 11603 - DNA, 25 bp, Homo sapien
aattgttcattcagttgctcaacaa

SEQ ID NO: 11604 - DNA, 25 bp, Homo sapien
aattgttcttagacaaggtgtgaag

SEQ ID NO: 11605 - DNA, 25 bp, Homo sapien
aattgttcttagacaatgtgtgaag

SEQ ID NO: 11606 - DNA, 25 bp, Homo sapien
aattgttcttatcgcaccttattga

SEQ ID NO: 11607 - DNA, 25 bp, Homo sapien
aattgttcttattgcaccttattga

SEQ ID NO: 11608 - DNA, 25 bp, Homo sapien
aattgtttaaagagcaaaaatttat

SEQ ID NO: 11609 - DNA, 25 bp, Homo sapien
aattgtttaagacatactagagctt

SEQ ID NO: 11610 - DNA, 25 bp, Homo sapien
aattgtttaagacgtactagagctt

SEQ ID NO: 11611 - DNA, 25 bp, Homo sapien
aattgtttcaagagcaaaaatttat

SEQ ID NO: 11612 - DNA, 25 bp, Homo sapien
aattgtttccctatactctaagaat

SEQ ID NO: 11613 - DNA, 25 bp, Homo sapien
aattgtttccctgtactctaagaat

SEQ ID NO: 11614 - DNA, 25 bp, Homo sapien
aattgtttgccaagcgagacagatt

SEQ ID NO: 11615 - DNA, 25 bp, Homo sapien
aattgtttgccaagtgagacagatt

SEQ ID NO: 11616 - DNA, 25 bp, Homo sapien
aattgttttcctatcttgggagaag

SEQ ID NO: 11617 - DNA, 25 bp, Homo sapien
aattgttttcctctcttgggagaag

SEQ ID NO: 11618 - DNA, 25 bp, Homo sapien
aatttaaatgaggatctgattccaa

SEQ ID NO: 11619 - DNA, 25 bp, Homo sapien
aatttaaatgagtatctgattccaa

SEQ ID NO: 11620 - DNA, 25 bp, Homo sapien
aatttaaattccaaaaagcagcatc

SEQ ID NO: 11621 - DNA, 25 bp, Homo sapien
aatttaaattcccaaaagcagcatc

SEQ ID NO: 11622 - DNA, 25 bp, Homo sapien
aatttaagcaaatgaacatctttac

SEQ ID NO: 11623 - DNA, 25 bp, Homo sapien
aatttaagcaaatgaatatctttac

SEQ ID NO: 11624 - DNA, 25 bp, Homo sapien
aatttaagccactcttttctgtccc

SEQ ID NO: 11625 - DNA, 25 bp, Homo sapien
aatttaaggacacatataggctgaa

SEQ ID NO: 11626 - DNA, 25 bp, Homo sapien
aatttaaggacacgtataggctgaa

SEQ ID NO: 11627 - DNA, 25 bp, Homo sapien
aatttaagtcactcttttctgtccc

SEQ ID NO: 11628 - DNA, 25 bp, Homo sapien
aatttaatactcagatttcatatac

SEQ ID NO: 11629 - DNA, 25 bp, Homo sapien
aatttaatactcggatttcatatac

SEQ ID NO: 11630 - DNA, 25 bp, Homo sapien
aatttaatgagtgatttctgataga

SEQ ID NO: 11631 - DNA, 25 bp, Homo sapien
aatttaatgcgtgatttctgataga

SEQ ID NO: 11632 - DNA, 25 bp, Homo sapien
aatttaattttcacatcacagtaat

SEQ ID NO: 11633 - DNA, 25 bp, Homo sapien
aatttaattttcacgtcacagtaat

SEQ ID NO: 11634 - DNA, 25 bp, Homo sapien
aatttacaagcacgtttcaaaaacc

SEQ ID NO: 11635 - DNA, 25 bp, Homo sapien
aatttacaagcatgtttcaaaaacc

SEQ ID NO: 11636 - DNA, 25 bp, Homo sapien
aatttacactggagcctaagtaaca

SEQ ID NO: 11637 - DNA, 25 bp, Homo sapien
aatttacattggagcctaagtaaca

SEQ ID NO: 11638 - DNA, 25 bp, Homo sapien
aatttaccaacttctaggccatgaa

SEQ ID NO: 11639 - DNA, 25 bp, Homo sapien
aatttaccctgcatcattttgcata

SEQ ID NO: 11640 - DNA, 25 bp, Homo sapien
aatttaccctgcgtcattttgcata

SEQ ID NO: 11641 - DNA, 25 bp, Homo sapien
aatttaccgacttctaggccatgaa

SEQ ID NO: 11642 - DNA, 25 bp, Homo sapien
aatttactagatccatctaattcta

SEQ ID NO: 11643 - DNA, 25 bp, Homo sapien
aatttactagattcatctaattcta

SEQ ID NO: 11644 - DNA, 25 bp, Homo sapien
aatttactgaaaacggaactgaaag

SEQ ID NO: 11645 - DNA, 25 bp, Homo sapien
aatttactgaaaactgaactgaaag

SEQ ID NO: 11646 - DNA, 25 bp, Homo sapien
aatttagatctcagtaaaaagaaat

SEQ ID NO: 11647 - DNA, 25 bp, Homo sapien
aatttagatctctgtaaaaagaaat

SEQ ID NO: 11648 - DNA, 25 bp, Homo sapien
aatttagcttccacctttttttgag

SEQ ID NO: 11649 - DNA, 25 bp, Homo sapien
aatttagcttccatctttttttgag

SEQ ID NO: 11650 - DNA, 25 bp, Homo sapien
aatttaggatgtcttcatttaattc

SEQ ID NO: 11651 - DNA, 25 bp, Homo sapien
aatttaggatgtcttcgtttaattc

SEQ ID NO: 11652 - DNA, 25 bp, Homo sapien
aatttagtagtgacgccattaggtc

SEQ ID NO: 11653 - DNA, 25 bp, Homo sapien
aatttagtagtgatgccattaggtc

SEQ ID NO: 11654 - DNA, 25 bp, Homo sapien
aatttagtgggtcaaaacaatacaa

SEQ ID NO: 11655 - DNA, 25 bp, Homo sapien
aatttagtgggttaaaacaatacaa

SEQ ID NO: 11656 - DNA, 25 bp, Homo sapien
aatttagttagggacgaattcagat

SEQ ID NO: 11657 - DNA, 25 bp, Homo sapien
aatttagttagggatgaattcagat

SEQ ID NO: 11658 - DNA, 25 bp, Homo sapien
aatttatagtcactaagcatctact

SEQ ID NO: 11659 - DNA, 25 bp, Homo sapien
aatttatagtcagtaagcatctact

SEQ ID NO: 11660 - DNA, 25 bp, Homo sapien
aatttatataaatgagaacacactg

SEQ ID NO: 11661 - DNA, 25 bp, Homo sapien
aatttatataaatgcgaacacactg

SEQ ID NO: 11662 - DNA, 25 bp, Homo sapien
aatttatcgttttcagaacatctct

SEQ ID NO: 11663 - DNA, 25 bp, Homo sapien
aatttatcgttttcggaacatctct

SEQ ID NO: 11664 - DNA, 25 bp, Homo sapien
aatttattaccacaaacctccagtg

SEQ ID NO: 11665 - DNA, 25 bp, Homo sapien
aatttattaccgcaaacctccagtg

SEQ ID NO: 11666 - DNA, 25 bp, Homo sapien
aatttattctgcttaatgggtcgct

SEQ ID NO: 11667 - DNA, 25 bp, Homo sapien
aatttattctgtttaatgggtcgct

SEQ ID NO: 11668 - DNA, 25 bp, Homo sapien
aatttcaaactgtagcattaatagg

SEQ ID NO: 11669 - DNA, 25 bp, Homo sapien
aatttcaaattgtagcattaatagg

SEQ ID NO: 11670 - DNA, 25 bp, Homo sapien
aatttcaacatttaggactctatga

SEQ ID NO: 11671 - DNA, 25 bp, Homo sapien
aatttcaagatttaggactctatga

SEQ ID NO: 11672 - DNA, 25 bp, Homo sapien
aatttcaatctaagttagccatttg

SEQ ID NO: 11673 - DNA, 25 bp, Homo sapien
aatttcaatgtaagttagccatttg

SEQ ID NO: 11674 - DNA, 25 bp, Homo sapien
aatttcacacgtatgatctcatttc

SEQ ID NO: 11675 - DNA, 25 bp, Homo sapien
aatttcacatgtatgatctcatttc

SEQ ID NO: 11676 - DNA, 25 bp, Homo sapien
aatttcactgcttagaacttaatag

SEQ ID NO: 11677 - DNA, 25 bp, Homo sapien
aatttcacttcttagaacttaatag

SEQ ID NO: 11678 - DNA, 25 bp, Homo sapien
aatttcagtcacatcccaattaatt

SEQ ID NO: 11679 - DNA, 25 bp, Homo sapien
aatttcagtcacgtcccaattaatt

SEQ ID NO: 11680 - DNA, 25 bp, Homo sapien
aatttcatctaaagctgacattttt

SEQ ID NO: 11681 - DNA, 25 bp, Homo sapien
aatttcatctaatgctgacattttt

SEQ ID NO: 11682 - DNA, 25 bp, Homo sapien
aatttcatgctaagccagccaggtt

SEQ ID NO: 11683 - DNA, 25 bp, Homo sapien
aatttcatgttaagccagccaggtt

SEQ ID NO: 11684 - DNA, 25 bp, Homo sapien
aatttccatacatgtcaaacaaatg

SEQ ID NO: 11685 - DNA, 25 bp, Homo sapien
aatttccatacgtgtcaaacaaatg

SEQ ID NO: 11686 - DNA, 25 bp, Homo sapien
aatttccatgttcctataaaaatgg

SEQ ID NO: 11687 - DNA, 25 bp, Homo sapien
aatttccatgttgctataaaaatgg

SEQ ID NO: 11688 - DNA, 25 bp, Homo sapien
aatttcccacgtgtagcattcaagg

SEQ ID NO: 11689 - DNA, 25 bp, Homo sapien
aatttcccatgtgtagcattcaagg

SEQ ID NO: 11690 - DNA, 25 bp, Homo sapien
aatttccctaacattaagcattttt

SEQ ID NO: 11691 - DNA, 25 bp, Homo sapien
aatttccctaacgttaagcattttt

SEQ ID NO: 11692 - DNA, 25 bp, Homo sapien
aatttcctggagccacctctgggcc

SEQ ID NO: 11693 - DNA, 25 bp, Homo sapien
aatttcctggaggcacctctgggcc

SEQ ID NO: 11694 - DNA, 25 bp, Homo sapien
aatttcctgggcgatagaagcatct

SEQ ID NO: 11695 - DNA, 25 bp, Homo sapien
aatttcctgggtgatagaagcatct

SEQ ID NO: 11696 - DNA, 25 bp, Homo sapien
aatttccttatttctctcagccttc

SEQ ID NO: 11697 - DNA, 25 bp, Homo sapien
aatttccttatttgtctcagccttc

SEQ ID NO: 11698 - DNA, 25 bp, Homo sapien
aatttcgccgattcattaaaataat

SEQ ID NO: 11699 - DNA, 25 bp, Homo sapien
aatttcgccgattcgttaaaataat

SEQ ID NO: 11700 - DNA, 25 bp, Homo sapien
aatttctacctaagggtaatcttct

SEQ ID NO: 11701 - DNA, 25 bp, Homo sapien
aatttctacctaagtgtaatcttct

SEQ ID NO: 11702 - DNA, 25 bp, Homo sapien
aatttctacctactcctgttacaat

SEQ ID NO: 11703 - DNA, 25 bp, Homo sapien
aatttctacctcctcctgttacaat

SEQ ID NO: 11704 - DNA, 25 bp, Homo sapien
aatttctaggagagtagggagaaaa

SEQ ID NO: 11705 - DNA, 25 bp, Homo sapien
aatttctaggagtgtagggagaaaa

SEQ ID NO: 11706 - DNA, 25 bp, Homo sapien
aatttctatgcctgagattgagaag

SEQ ID NO: 11707 - DNA, 25 bp, Homo sapien
aatttctatgcctgagtttgagaag

SEQ ID NO: 11708 - DNA, 25 bp, Homo sapien
aatttctcccacatgattaagctgt

SEQ ID NO: 11709 - DNA, 25 bp, Homo sapien
aatttctcccacgtgattaagctgt

SEQ ID NO: 11710 - DNA, 25 bp, Homo sapien
aatttctcttcccgggtgcgattcc

SEQ ID NO: 11711 - DNA, 25 bp, Homo sapien
aatttctcttcctgggtgcgattcc

SEQ ID NO: 11712 - DNA, 25 bp, Homo sapien
aatttctgcttgtttttctcttgtt

SEQ ID NO: 11713 - DNA, 25 bp, Homo sapien
aatttctgtttgtttttctcttgtt

SEQ ID NO: 11714 - DNA, 25 bp, Homo sapien
aatttcttaatgcaataggagggca

SEQ ID NO: 11715 - DNA, 25 bp, Homo sapien
aatttcttaatgcgataggagggca

SEQ ID NO: 11716 - DNA, 25 bp, Homo sapien
aatttcttacgtagagattagtgct

SEQ ID NO: 11717 - DNA, 25 bp, Homo sapien
aatttcttacgtagggattagtgct

SEQ ID NO: 11718 - DNA, 25 bp, Homo sapien
aatttcttattgactactagctaga

SEQ ID NO: 11719 - DNA, 25 bp, Homo sapien
aatttcttattgactagtagctaga

SEQ ID NO: 11720 - DNA, 25 bp, Homo sapien
aatttcttcaatttcccttggcagt

SEQ ID NO: 11721 - DNA, 25 bp, Homo sapien
aatttcttcaatttcctttggcagt

SEQ ID NO: 11722 - DNA, 25 bp, Homo sapien
aatttcttccactacaagacactag

SEQ ID NO: 11723 - DNA, 25 bp, Homo sapien
aatttcttccactgcaagacactag

SEQ ID NO: 11724 - DNA, 25 bp, Homo sapien
aatttctttacttaatctcagaact

SEQ ID NO: 11725 - DNA, 25 bp, Homo sapien
aatttcttttccctgatgacatatg

SEQ ID NO: 11726 - DNA, 25 bp, Homo sapien
aatttcttttccgtgatgacatatg

SEQ ID NO: 11727 - DNA, 25 bp, Homo sapien
aatttcttttcttaatctcagaact

SEQ ID NO: 11728 - DNA, 25 bp, Homo sapien
aatttgaaagacgctaagaagccac

SEQ ID NO: 11729 - DNA, 25 bp, Homo sapien
aatttgaaagatgctaagaagccac

SEQ ID NO: 11730 - DNA, 25 bp, Homo sapien
aatttgaacaaaactcttaaacagc

SEQ ID NO: 11731 - DNA, 25 bp, Homo sapien
aatttgaacaaacctcttaaacagc

SEQ ID NO: 11732 - DNA, 25 bp, Homo sapien
aatttgaaccacacacagtctaagt

SEQ ID NO: 11733 - DNA, 25 bp, Homo sapien
aatttgaaccacgcacagtctaagt

SEQ ID NO: 11734 - DNA, 25 bp, Homo sapien
aatttgaagagctaggcaaattatt

SEQ ID NO: 11735 - DNA, 25 bp, Homo sapien
aatttgaagagttaggcaaattatt

SEQ ID NO: 11736 - DNA, 25 bp, Homo sapien
aatttgacagaggacttggacagtg

SEQ ID NO: 11737 - DNA, 25 bp, Homo sapien
aatttgacagaggtcttggacagtg

SEQ ID NO: 11738 - DNA, 25 bp, Homo sapien
aatttgatgaggtggtagagttgga

SEQ ID NO: 11739 - DNA, 25 bp, Homo sapien
aatttgatgaggttgtagagttgga

SEQ ID NO: 11740 - DNA, 25 bp, Homo sapien
aatttgatggaagagaattgtcccc

SEQ ID NO: 11741 - DNA, 25 bp, Homo sapien
aatttgatggaagtgaattgtcccc

SEQ ID NO: 11742 - DNA, 25 bp, Homo sapien
aatttgatgggtagagagcaaaaaa

SEQ ID NO: 11743 - DNA, 25 bp, Homo sapien
aatttgatgggtatagagcaaaaaa

SEQ ID NO: 11744 - DNA, 25 bp, Homo sapien
aatttgattggccacggtaaggttc

SEQ ID NO: 11745 - DNA, 25 bp, Homo sapien
aatttgattggctacggtaaggttc

SEQ ID NO: 11746 - DNA, 25 bp, Homo sapien
aatttgcaacacttacacattttac

SEQ ID NO: 11747 - DNA, 25 bp, Homo sapien
aatttgcaatacttacacattttac

SEQ ID NO: 11748 - DNA, 25 bp, Homo sapien
aatttgcaatcaatcaccaagttct

SEQ ID NO: 11749 - DNA, 25 bp, Homo sapien
aatttgcaatcagtcaccaagttct

SEQ ID NO: 11750 - DNA, 25 bp, Homo sapien
aatttgcacactatattaccggaaa

SEQ ID NO: 11751 - DNA, 25 bp, Homo sapien
aatttgcacactgtattaccggaaa

SEQ ID NO: 11752 - DNA, 25 bp, Homo sapien
aatttgctacttacgatgtgaaagc

SEQ ID NO: 11753 - DNA, 25 bp, Homo sapien
aatttgctacttatgatgtgaaagc

SEQ ID NO: 11754 - DNA, 25 bp, Homo sapien
aatttgctaggtcaccattgagtag

SEQ ID NO: 11755 - DNA, 25 bp, Homo sapien
aatttgctaggtcatcattgagtag

SEQ ID NO: 11756 - DNA, 25 bp, Homo sapien
aatttgctgatactttcttccgcct

SEQ ID NO: 11757 - DNA, 25 bp, Homo sapien
aatttgctgatattttcttccgcct

SEQ ID NO: 11758 - DNA, 25 bp, Homo sapien
aatttgcttcgcgtttggagagttt

SEQ ID NO: 11759 - DNA, 25 bp, Homo sapien
aatttgctttcctgtaccagacacc

SEQ ID NO: 11760 - DNA, 25 bp, Homo sapien
aatttgctttcctttaccagacacc

SEQ ID NO: 11761 - DNA, 25 bp, Homo sapien
aatttgctttgcgtttggagagttt

SEQ ID NO: 11762 - DNA, 25 bp, Homo sapien
aatttggaccatattcatcttcatc

SEQ ID NO: 11763 - DNA, 25 bp, Homo sapien
aatttggaccatattcttcttcatc

SEQ ID NO: 11764 - DNA, 25 bp, Homo sapien
aatttggagaggtataaaatgaggt

SEQ ID NO: 11765 - DNA, 25 bp, Homo sapien
aatttggagagttataaaatgaggt

SEQ ID NO: 11766 - DNA, 25 bp, Homo sapien
aatttggcaattcctaataaagcaa

SEQ ID NO: 11767 - DNA, 25 bp, Homo sapien
aatttggcaattcctattaaagcaa

SEQ ID NO: 11768 - DNA, 25 bp, Homo sapien
aatttggccatcactcgggaaaatc

SEQ ID NO: 11769 - DNA, 25 bp, Homo sapien
aatttggccatcattcgggaaaatc

SEQ ID NO: 11770 - DNA, 25 bp, Homo sapien
aatttggctgaacacaaaacactgg

SEQ ID NO: 11771 - DNA, 25 bp, Homo sapien
aatttggctgaatacaaaacactgg

SEQ ID NO: 11772 - DNA, 25 bp, Homo sapien
aatttggctgttgttctccagaacc

SEQ ID NO: 11773 - DNA, 25 bp, Homo sapien
aatttggctgtttttctccagaacc

SEQ ID NO: 11774 - DNA, 25 bp, Homo sapien
aatttgggccagatttctgtgactt

SEQ ID NO: 11775 - DNA, 25 bp, Homo sapien
aatttgggtcagatttctgtgactt

SEQ ID NO: 11776 - DNA, 25 bp, Homo sapien
aatttggtgctctaagaaccaagaa

SEQ ID NO: 11777 - DNA, 25 bp, Homo sapien
aatttggtgctgtaagaaccaagaa

SEQ ID NO: 11778 - DNA, 25 bp, Homo sapien
aatttgtaagtcctgcaagatcatg

SEQ ID NO: 11779 - DNA, 25 bp, Homo sapien
aatttgtaagtcgtgcaagatcatg

SEQ ID NO: 11780 - DNA, 25 bp, Homo sapien
aatttgtatcttattgtaaggaaag

SEQ ID NO: 11781 - DNA, 25 bp, Homo sapien
aatttgtattttattgtaaggaaag

SEQ ID NO: 11782 - DNA, 25 bp, Homo sapien
aatttgtcatttaaagatcctaatt

SEQ ID NO: 11783 - DNA, 25 bp, Homo sapien
aatttgtcatttccatgttttctat

SEQ ID NO: 11784 - DNA, 25 bp, Homo sapien
aatttgtcatttccattttttctat

SEQ ID NO: 11785 - DNA, 25 bp, Homo sapien
aatttgtcgtttaaagatcctaatt

SEQ ID NO: 11786 - DNA, 25 bp, Homo sapien
aatttgtgagataagtctgcaaact

SEQ ID NO: 11787 - DNA, 25 bp, Homo sapien
aatttgtgagatcagtctgcaaact

SEQ ID NO: 11788 - DNA, 25 bp, Homo sapien
aatttgtggattggtcttagttcat

SEQ ID NO: 11789 - DNA, 25 bp, Homo sapien
aatttgtggccaccatgagttatga

SEQ ID NO: 11790 - DNA, 25 bp, Homo sapien
aatttgtggccatcatgagttatga

SEQ ID NO: 11791 - DNA, 25 bp, Homo sapien
aatttgtgggttggtcttagttcat

SEQ ID NO: 11792 - DNA, 25 bp, Homo sapien
aatttgtgtttccctaattgctagt

SEQ ID NO: 11793 - DNA, 25 bp, Homo sapien
aatttgtgtttctctaattgctagt

SEQ ID NO: 11794 - DNA, 25 bp, Homo sapien
aatttgttagaacccatggttgcca

SEQ ID NO: 11795 - DNA, 25 bp, Homo sapien
aatttgttagaactcatggttgcca

SEQ ID NO: 11796 - DNA, 25 bp, Homo sapien
aatttgttatacgcacaattctatg

SEQ ID NO: 11797 - DNA, 25 bp, Homo sapien
aatttgttatatgcacaattctatg

SEQ ID NO: 11798 - DNA, 25 bp, Homo sapien
aatttgttcttagaataaatgacaa

SEQ ID NO: 11799 - DNA, 25 bp, Homo sapien
aatttgttcttagagtaaatgacaa

SEQ ID NO: 11800 - DNA, 25 bp, Homo sapien
aatttgtttcaaagtacatgtaaca

SEQ ID NO: 11801 - DNA, 25 bp, Homo sapien
aatttgtttcaaagtatatgtaaca

SEQ ID NO: 11802 - DNA, 25 bp, Homo sapien
aatttgtttccaattctccagcata

SEQ ID NO: 11803 - DNA, 25 bp, Homo sapien
aatttgtttccagttctccagcata

SEQ ID NO: 11804 - DNA, 25 bp, Homo sapien
aatttgtttccttaagctcttaact

SEQ ID NO: 11805 - DNA, 25 bp, Homo sapien
aatttgtttccttaggctcttaact

SEQ ID NO: 11806 - DNA, 25 bp, Homo sapien
aatttgttttagcacctgatttagt

SEQ ID NO: 11807 - DNA, 25 bp, Homo sapien
aatttgttttagtacctgatttagt

SEQ ID NO: 11808 - DNA, 25 bp, Homo sapien
aattttaaaaactgcctggtacatg

SEQ ID NO: 11809 - DNA, 25 bp, Homo sapien
aattttaaacactgcctggtacatg

SEQ ID NO: 11810 - DNA, 25 bp, Homo sapien
aattttaagcgatctacagtctggt

SEQ ID NO: 11811 - DNA, 25 bp, Homo sapien
aattttaagtgatctacagtctggt

SEQ ID NO: 11812 - DNA, 25 bp, Homo sapien
aattttaatcacaaggaacaatcag

SEQ ID NO: 11813 - DNA, 25 bp, Homo sapien
aattttaatcacacggaacaatcag

SEQ ID NO: 11814 - DNA, 25 bp, Homo sapien
aattttaatttccagaatctctttg

SEQ ID NO: 11815 - DNA, 25 bp, Homo sapien
aattttaatttccagagtctctttg

SEQ ID NO: 11816 - DNA, 25 bp, Homo sapien
aattttatcatttttctgatcctac

SEQ ID NO: 11817 - DNA, 25 bp, Homo sapien
aattttatcgtttttctgatcctac

SEQ ID NO: 11818 - DNA, 25 bp, Homo sapien
aattttattcactcatatcgaattg

SEQ ID NO: 11819 - DNA, 25 bp, Homo sapien
aattttattcactcgtatcgaattg

SEQ ID NO: 11820 - DNA, 25 bp, Homo sapien
aattttcaatatggtaattaagcag

SEQ ID NO: 11821 - DNA, 25 bp, Homo sapien
aattttcaccgggaagtgtcaagtt

SEQ ID NO: 11822 - DNA, 25 bp, Homo sapien
aattttcacctttaatcaacagcat

SEQ ID NO: 11823 - DNA, 25 bp, Homo sapien
aattttcacctttagtcaacagcat

SEQ ID NO: 11824 - DNA, 25 bp, Homo sapien
aattttcactgggaagtgtcaagtt

SEQ ID NO: 11825 - DNA, 25 bp, Homo sapien
aattttcactttgaagtctttttac

SEQ ID NO: 11826 - DNA, 25 bp, Homo sapien
aattttcacttttaagtctttttac

SEQ ID NO: 11827 - DNA, 25 bp, Homo sapien
aattttcagccacatttatttactg

SEQ ID NO: 11828 - DNA, 25 bp, Homo sapien
aattttcagccacgtttatttactg

SEQ ID NO: 11829 - DNA, 25 bp, Homo sapien
aattttcagtatggtaattaagcag

SEQ ID NO: 11830 - DNA, 25 bp, Homo sapien
aattttcatactggcatggaaagat

SEQ ID NO: 11831 - DNA, 25 bp, Homo sapien
aattttcatcctggcatggaaagat

SEQ ID NO: 11832 - DNA, 25 bp, Homo sapien
aattttccaatcttcttcagaattg

SEQ ID NO: 11833 - DNA, 25 bp, Homo sapien
aattttccgatcttcttcagaattg

SEQ ID NO: 11834 - DNA, 25 bp, Homo sapien
aattttcctgtgccaaatttttatg

SEQ ID NO: 11835 - DNA, 25 bp, Homo sapien
aattttcctgtgctaaatttttatg

SEQ ID NO: 11836 - DNA, 25 bp, Homo sapien
aattttctaaatgctgaatagctcc

SEQ ID NO: 11837 - DNA, 25 bp, Homo sapien
aattttctaaatgctgcatagctcc

SEQ ID NO: 11838 - DNA, 25 bp, Homo sapien
aattttctcctttgtttcagtggtt

SEQ ID NO: 11839 - DNA, 25 bp, Homo sapien
aattttctcttttgtttcagtggtt

SEQ ID NO: 11840 - DNA, 25 bp, Homo sapien
aattttcttttcaacagtgagtgct

SEQ ID NO: 11841 - DNA, 25 bp, Homo sapien
aattttcttttcgacagtgagtgct

SEQ ID NO: 11842 - DNA, 25 bp, Homo sapien
aattttgaagacacacaggcattca

SEQ ID NO: 11843 - DNA, 25 bp, Homo sapien
aattttgaagagacacaggcattca

SEQ ID NO: 11844 - DNA, 25 bp, Homo sapien
aattttgacagtccatatgtggtga

SEQ ID NO: 11845 - DNA, 25 bp, Homo sapien
aattttgacagttcatatgtggtga

SEQ ID NO: 11846 - DNA, 25 bp, Homo sapien
aattttgcccaaatgttatcagtag

SEQ ID NO: 11847 - DNA, 25 bp, Homo sapien
aattttgcccagatgttatcagtag

SEQ ID NO: 11848 - DNA, 25 bp, Homo sapien
aattttgctatgccattgtattcac

SEQ ID NO: 11849 - DNA, 25 bp, Homo sapien
aattttgctatgctattgtattcac

SEQ ID NO: 11850 - DNA, 25 bp, Homo sapien
aattttgctctatagccccgacagc

SEQ ID NO: 11851 - DNA, 25 bp, Homo sapien
aattttgctctatatccccgacagc

SEQ ID NO: 11852 - DNA, 25 bp, Homo sapien
aattttgctggatatgaaattttgg

SEQ ID NO: 11853 - DNA, 25 bp, Homo sapien
aattttgctggatatggaattttgg

SEQ ID NO: 11854 - DNA, 25 bp, Homo sapien
aattttggctgcactttgaaggtag

SEQ ID NO: 11855 - DNA, 25 bp, Homo sapien
aattttggctgcgctttgaaggtag

SEQ ID NO: 11856 - DNA, 25 bp, Homo sapien
aattttgtacctttcaatttcaaca

SEQ ID NO: 11857 - DNA, 25 bp, Homo sapien
aattttgtacctttcattttcaaca

SEQ ID NO: 11858 - DNA, 25 bp, Homo sapien
aattttgtactctactggctgttct

SEQ ID NO: 11859 - DNA, 25 bp, Homo sapien
aattttgtactctattggctgttct

SEQ ID NO: 11860 - DNA, 25 bp, Homo sapien
aattttgtgtcacgtaaagtgctat

SEQ ID NO: 11861 - DNA, 25 bp, Homo sapien
aattttgtgtcatgtaaagtgctat

SEQ ID NO: 11862 - DNA, 25 bp, Homo sapien
aatttttgtcaaatataggaaatac

SEQ ID NO: 11863 - DNA, 25 bp, Homo sapien
aatttttgttaaatataggaaatac

SEQ ID NO: 11864 - DNA, 25 bp, Homo sapien
aatttttgttttagtaggcagctaa

SEQ ID NO: 11865 - DNA, 25 bp, Homo sapien
aatttttgttttcgtaggcagctaa

SEQ ID NO: 11866 - DNA, 25 bp, Homo sapien
aattttttccaaaacgcgtaaatca

SEQ ID NO: 11867 - DNA, 25 bp, Homo sapien
aattttttccaaaacgtgtaaatca

SEQ ID NO: 11868 - DNA, 25 bp, Homo sapien
aatttttttatgtgtcagccagtta

SEQ ID NO: 11869 - DNA, 25 bp, Homo sapien
aatttttttcccagactatttttga

SEQ ID NO: 11870 - DNA, 25 bp, Homo sapien
aatttttttcccaggctatttttga

SEQ ID NO: 11871 - DNA, 25 bp, Homo sapien
aatttttttgtgtgtcagccagtta

SEQ ID NO: 11872 - DNA, 25 bp, Homo sapien
acaaaaaaaaaaagggaatgaggaa

SEQ ID NO: 11873 - DNA, 25 bp, Homo sapien
acaaaaaaaaaaggggaatgaggaa

SEQ ID NO: 11874 - DNA, 25 bp, Homo sapien
acaaaaaacgtatctcattaataat

SEQ ID NO: 11875 - DNA, 25 bp, Homo sapien
acaaaaaagaaaatagccaggcatg

SEQ ID NO: 11876 - DNA, 25 bp, Homo sapien
acaaaaaagaaaatcgccaggcatg

SEQ ID NO: 11877 - DNA, 25 bp, Homo sapien
acaaaaaatgtatctcattaataat

SEQ ID NO: 11878 - DNA, 25 bp, Homo sapien
acaaaaacagtgccatgttactcaa

SEQ ID NO: 11879 - DNA, 25 bp, Homo sapien
acaaaaacagtgccgtgttactcaa

SEQ ID NO: 11880 - DNA, 25 bp, Homo sapien
acaaaaaccacgtgacccttcatct

SEQ ID NO: 11881 - DNA, 25 bp, Homo sapien
acaaaaaccagcgttagagtaaaat

SEQ ID NO: 11882 - DNA, 25 bp, Homo sapien
acaaaaaccagctttagagtaaaat

SEQ ID NO: 11883 - DNA, 25 bp, Homo sapien
acaaaaactacgtgacccttcatct

SEQ ID NO: 11884 - DNA, 25 bp, Homo sapien
acaaaaactcacaaaatgcccaaag

SEQ ID NO: 11885 - DNA, 25 bp, Homo sapien
acaaaaactcacacaatgcccaaag

SEQ ID NO: 11886 - DNA, 25 bp, Homo sapien
acaaaaactccaaaagtgaaatgga

SEQ ID NO: 11887 - DNA, 25 bp, Homo sapien
acaaaaacttcaaaagtgaaatgga

SEQ ID NO: 11888 - DNA, 25 bp, Homo sapien
acaaaaagaaaaaattagtatggca

SEQ ID NO: 11889 - DNA, 25 bp, Homo sapien
acaaaaagcacactgtctcattgtt

SEQ ID NO: 11890 - DNA, 25 bp, Homo sapien
acaaaaagcacactgtttcattgtt

SEQ ID NO: 11891 - DNA, 25 bp, Homo sapien
acaaaaagccatgttaaaaaatacc

SEQ ID NO: 11892 - DNA, 25 bp, Homo sapien
acaaaaagcgttactagaaatcaag

SEQ ID NO: 11893 - DNA, 25 bp, Homo sapien
acaaaaaggaaaaattagtatggca

SEQ ID NO: 11894 - DNA, 25 bp, Homo sapien
acaaaaaggcatgttaaaaaatacc

SEQ ID NO: 11895 - DNA, 25 bp, Homo sapien
acaaaaagtaaagcaagtgtgagca

SEQ ID NO: 11896 - DNA, 25 bp, Homo sapien
acaaaaagtaaggcaagtgtgagca

SEQ ID NO: 11897 - DNA, 25 bp, Homo sapien
acaaaaagtggcgacggtatgactc

SEQ ID NO: 11898 - DNA, 25 bp, Homo sapien
acaaaaagtggcgatggtatgactc

SEQ ID NO: 11899 - DNA, 25 bp, Homo sapien
acaaaaagtgttactagaaatcaag

SEQ ID NO: 11900 - DNA, 25 bp, Homo sapien
acaaaaataatgtcctggaatttgt

SEQ ID NO: 11901 - DNA, 25 bp, Homo sapien
acaaaaataatgtcttggaatttgt

SEQ ID NO: 11902 - DNA, 25 bp, Homo sapien
acaaaaatagttcatcatatgacat

SEQ ID NO: 11903 - DNA, 25 bp, Homo sapien
acaaaaatctgagccttgcatattt

SEQ ID NO: 11904 - DNA, 25 bp, Homo sapien
acaaaaatctgagtcttgcatattt

SEQ ID NO: 11905 - DNA, 25 bp, Homo sapien
acaaaaatggttcatcatatgacat

SEQ ID NO: 11906 - DNA, 25 bp, Homo sapien
acaaaaattgtaaaatgcaagggag

SEQ ID NO: 11907 - DNA, 25 bp, Homo sapien
acaaaaattgtagaatgcaagggag

SEQ ID NO: 11908 - DNA, 25 bp, Homo sapien
acaaaacaaaaaaacttgagtgctt

SEQ ID NO: 11909 - DNA, 25 bp, Homo sapien
acaaaacaaaaaaagttgagtgctt

SEQ ID NO: 11910 - DNA, 25 bp, Homo sapien
acaaaacagaaggaccctttagact

SEQ ID NO: 11911 - DNA, 25 bp, Homo sapien
acaaaacagaaggaccttttagact

SEQ ID NO: 11912 - DNA, 25 bp, Homo sapien
acaaaacagatgtaacgctctccct

SEQ ID NO: 11913 - DNA, 25 bp, Homo sapien
acaaaacagatgtaactctctccct

SEQ ID NO: 11914 - DNA, 25 bp, Homo sapien
acaaaaccatttctctgtcaaggga

SEQ ID NO: 11915 - DNA, 25 bp, Homo sapien
acaaaaccatttctttgtcaaggga

SEQ ID NO: 11916 - DNA, 25 bp, Homo sapien
acaaaactcaatacccttcaatggc

SEQ ID NO: 11917 - DNA, 25 bp, Homo sapien
acaaaactccatacccttcaatggc

SEQ ID NO: 11918 - DNA, 25 bp, Homo sapien
acaaaactgaacaggaactcaagtc

SEQ ID NO: 11919 - DNA, 25 bp, Homo sapien
acaaaactgaataggaactcaagtc

SEQ ID NO: 11920 - DNA, 25 bp, Homo sapien
acaaaagaaattcatagtgactatt

SEQ ID NO: 11921 - DNA, 25 bp, Homo sapien
acaaaagaatttcatagtgactatt

SEQ ID NO: 11922 - DNA, 25 bp, Homo sapien
acaaaagacaagaagagagcaaacc

SEQ ID NO: 11923 - DNA, 25 bp, Homo sapien
acaaaagacatggaaaaacgatcaa

SEQ ID NO: 11924 - DNA, 25 bp, Homo sapien
acaaaagaccagaagagagcaaacc

SEQ ID NO: 11925 - DNA, 25 bp, Homo sapien
acaaaagacgacacaacccaaaagt

SEQ ID NO: 11926 - DNA, 25 bp, Homo sapien
acaaaagagatggaaaaacgatcaa

SEQ ID NO: 11927 - DNA, 25 bp, Homo sapien
acaaaagatattaccccagtgaaaa

SEQ ID NO: 11928 - DNA, 25 bp, Homo sapien
acaaaagatatttccccagtgaaaa

SEQ ID NO: 11929 - DNA, 25 bp, Homo sapien
acaaaagatgacacaacccaaaagt

SEQ ID NO: 11930 - DNA, 25 bp, Homo sapien
acaaaagctgcaacataaccatatc

SEQ ID NO: 11931 - DNA, 25 bp, Homo sapien
acaaaagctgcaatataaccatatc

SEQ ID NO: 11932 - DNA, 25 bp, Homo sapien
acaaaaggattcgatacactagtca

SEQ ID NO: 11933 - DNA, 25 bp, Homo sapien
acaaaaggatttgatacactagtca

SEQ ID NO: 11934 - DNA, 25 bp, Homo sapien
acaaaataaaacctccaagaaacaa

SEQ ID NO: 11935 - DNA, 25 bp, Homo sapien
acaaaataaataactgaagaaattt

SEQ ID NO: 11936 - DNA, 25 bp, Homo sapien
acaaaataaatcactgaagaaattt

SEQ ID NO: 11937 - DNA, 25 bp, Homo sapien
acaaaataagttttttaaaatgatc

SEQ ID NO: 11938 - DNA, 25 bp, Homo sapien
acaaaataagtttttttaaatgatc

SEQ ID NO: 11939 - DNA, 25 bp, Homo sapien
acaaaataatacctccaagaaacaa

SEQ ID NO: 11940 - DNA, 25 bp, Homo sapien
acaaaatatgcagcttgggcatgct

SEQ ID NO: 11941 - DNA, 25 bp, Homo sapien
acaaaatatgctgcttgggcatgct

SEQ ID NO: 11942 - DNA, 25 bp, Homo sapien
acaaaatcaagacgagagccactcc

SEQ ID NO: 11943 - DNA, 25 bp, Homo sapien
acaaaatcaagatgagagccactcc

SEQ ID NO: 11944 - DNA, 25 bp, Homo sapien
acaaaatccagtgcaaagctgtttt

SEQ ID NO: 11945 - DNA, 25 bp, Homo sapien
acaaaatccggtgcaaagctgtttt

SEQ ID NO: 11946 - DNA, 25 bp, Homo sapien
acaaaatgcagatgtgggactagag

SEQ ID NO: 11947 - DNA, 25 bp, Homo sapien
acaaaatgcctagcaaaatgtacgt

SEQ ID NO: 11948 - DNA, 25 bp, Homo sapien
acaaaatgcctaggaaaatgtacgt

SEQ ID NO: 11949 - DNA, 25 bp, Homo sapien
acaaaatgctacaaaacttaatcca

SEQ ID NO: 11950 - DNA, 25 bp, Homo sapien
acaaaatgctacgaaacttaatcca

SEQ ID NO: 11951 - DNA, 25 bp, Homo sapien
acaaaatgctgatgtgggactagag

SEQ ID NO: 11952 - DNA, 25 bp, Homo sapien
acaaaatggcaccgagagaaccatg

SEQ ID NO: 11953 - DNA, 25 bp, Homo sapien
acaaaatggcactgagagaaccatg

SEQ ID NO: 11954 - DNA, 25 bp, Homo sapien
acaaaattaaccctgtgtgtattga

SEQ ID NO: 11955 - DNA, 25 bp, Homo sapien
acaaaattaactctgtgtgtattga

SEQ ID NO: 11956 - DNA, 25 bp, Homo sapien
acaaaattacaaatagcaattcaca

SEQ ID NO: 11957 - DNA, 25 bp, Homo sapien
acaaaattagaaatagcaattcaca

SEQ ID NO: 11958 - DNA, 25 bp, Homo sapien
acaaaattataggcctgatttctcc

SEQ ID NO: 11959 - DNA, 25 bp, Homo sapien
acaaaattatagtcctgatttctcc

SEQ ID NO: 11960 - DNA, 25 bp, Homo sapien
acaaaattatgtatagttcctgact

SEQ ID NO: 11961 - DNA, 25 bp, Homo sapien
acaaaattatgtgtagttcctgact

SEQ ID NO: 11962 - DNA, 25 bp, Homo sapien
acaaaattcacatggtagagcttat

SEQ ID NO: 11963 - DNA, 25 bp, Homo sapien
acaaaattcgaagatttacaagaac

SEQ ID NO: 11964 - DNA, 25 bp, Homo sapien
acaaaattgcgtgatatgacaaaat

SEQ ID NO: 11965 - DNA, 25 bp, Homo sapien
acaaaattgtgtgatatgacaaaat

SEQ ID NO: 11966 - DNA, 25 bp, Homo sapien
acaaaatttacatggtagagcttat

SEQ ID NO: 11967 - DNA, 25 bp, Homo sapien
acaaaatttgaagatttacaagaac

SEQ ID NO: 11968 - DNA, 25 bp, Homo sapien
acaaacaaaattcaaacttcccagc

SEQ ID NO: 11969 - DNA, 25 bp, Homo sapien
acaaacaaacttcaaacttcccagc

SEQ ID NO: 11970 - DNA, 25 bp, Homo sapien
acaaacaaaggacatcgaaacaaac

SEQ ID NO: 11971 - DNA, 25 bp, Homo sapien
acaaacaaatgcaattacatcaggt

SEQ ID NO: 11972 - DNA, 25 bp, Homo sapien
acaaacaaatggaattacatcaggt

SEQ ID NO: 11973 - DNA, 25 bp, Homo sapien
acaaacaacggacatcgaaacaaac

SEQ ID NO: 11974 - DNA, 25 bp, Homo sapien
acaaacaagcccggacagtgaagac

SEQ ID NO: 11975 - DNA, 25 bp, Homo sapien
acaaacaagcctggacagtgaagac

SEQ ID NO: 11976 - DNA, 25 bp, Homo sapien
acaaacacaagtacaactaattgct

SEQ ID NO: 11977 - DNA, 25 bp, Homo sapien
acaaacacaggcaataaaaggacaa

SEQ ID NO: 11978 - DNA, 25 bp, Homo sapien
acaaacacaggcagtaaaaggacaa

SEQ ID NO: 11979 - DNA, 25 bp, Homo sapien
acaaacaccagtacaactaattgct

SEQ ID NO: 11980 - DNA, 25 bp, Homo sapien
acaaacacttatgccagctcttgag

SEQ ID NO: 11981 - DNA, 25 bp, Homo sapien
acaaacacttatgtcagctcttgag

SEQ ID NO: 11982 - DNA, 25 bp, Homo sapien
acaaacagcctaaactctttcacct

SEQ ID NO: 11983 - DNA, 25 bp, Homo sapien
acaaacagcgtaaactctttcacct

SEQ ID NO: 11984 - DNA, 25 bp, Homo sapien
acaaacagtagatatgacacagttc

SEQ ID NO: 11985 - DNA, 25 bp, Homo sapien
acaaacagtggatatgacacagttc

SEQ ID NO: 11986 - DNA, 25 bp, Homo sapien
acaaacataattccctctcacctag

SEQ ID NO: 11987 - DNA, 25 bp, Homo sapien
acaaacatcattccctctcacctag

SEQ ID NO: 11988 - DNA, 25 bp, Homo sapien
acaaacatgaataaaacctagtaaa

SEQ ID NO: 11989 - DNA, 25 bp, Homo sapien
acaaacatgaatgaaacctagtaaa

SEQ ID NO: 11990 - DNA, 25 bp, Homo sapien
acaaacattcccaaagctgagcagc

SEQ ID NO: 11991 - DNA, 25 bp, Homo sapien
acaaacattcccaacgctgagcagc

SEQ ID NO: 11992 - DNA, 25 bp, Homo sapien
acaaaccgactcaaaacattggatt

SEQ ID NO: 11993 - DNA, 25 bp, Homo sapien
acaaaccgactcagaacattggatt

SEQ ID NO: 11994 - DNA, 25 bp, Homo sapien
acaaaccttcaatctgcaaaaaatg

SEQ ID NO: 11995 - DNA, 25 bp, Homo sapien
acaaaccttcaatttgcaaaaaatg

SEQ ID NO: 11996 - DNA, 25 bp, Homo sapien
acaaaccttcacacaaatctaaatt

SEQ ID NO: 11997 - DNA, 25 bp, Homo sapien
acaaaccttcacacaagtctaaatt

SEQ ID NO: 11998 - DNA, 25 bp, Homo sapien
acaaacggctagtatccagaatcta

SEQ ID NO: 11999 - DNA, 25 bp, Homo sapien
acaaacggctagtgtccagaatcta

SEQ ID NO: 12000 - DNA, 25 bp, Homo sapien
acaaacgttgttaactcatttcacc

SEQ ID NO: 12001 - DNA, 25 bp, Homo sapien
acaaacgttgttagctcatttcacc

SEQ ID NO: 12002 - DNA, 25 bp, Homo sapien
acaaactaacagaaaaattggcaaa

SEQ ID NO: 12003 - DNA, 25 bp, Homo sapien
acaaactaacagagaaattggcaaa

SEQ ID NO: 12004 - DNA, 25 bp, Homo sapien
acaaactacatgactggcttctcca

SEQ ID NO: 12005 - DNA, 25 bp, Homo sapien
acaaactacctgactggcttctcca

SEQ ID NO: 12006 - DNA, 25 bp, Homo sapien
acaaactagaagatgataaatttgc

SEQ ID NO: 12007 - DNA, 25 bp, Homo sapien
acaaactataagatgataaatttgc

SEQ ID NO: 12008 - DNA, 25 bp, Homo sapien
acaaactcaaaaaaagtctgaagaa

SEQ ID NO: 12009 - DNA, 25 bp, Homo sapien
acaaactcaaaacaagtctgaagaa

SEQ ID NO: 12010 - DNA, 25 bp, Homo sapien
acaaactcggtggcataaaacaata

SEQ ID NO: 12011 - DNA, 25 bp, Homo sapien
acaaactcggtgtcataaaacaata

SEQ ID NO: 12012 - DNA, 25 bp, Homo sapien
acaaactgagccagctgtgatacta

SEQ ID NO: 12013 - DNA, 25 bp, Homo sapien
acaaactgagccagttgtgatacta

SEQ ID NO: 12014 - DNA, 25 bp, Homo sapien
acaaactgatgcacaaaaccaatgg

SEQ ID NO: 12015 - DNA, 25 bp, Homo sapien
acaaactgatggacaaaaccaatgg

SEQ ID NO: 12016 - DNA, 25 bp, Homo sapien
acaaactggtccccgataaaaactg

SEQ ID NO: 12017 - DNA, 25 bp, Homo sapien
acaaactggtccctgataaaaactg

SEQ ID NO: 12018 - DNA, 25 bp, Homo sapien
acaaactttggttttcccatcagca

SEQ ID NO: 12019 - DNA, 25 bp, Homo sapien
acaaactttggttttctcatcagca

SEQ ID NO: 12020 - DNA, 25 bp, Homo sapien
acaaactttgtcaacaaatttggac

SEQ ID NO: 12021 - DNA, 25 bp, Homo sapien
acaaactttgtcaataaatttggac

SEQ ID NO: 12022 - DNA, 25 bp, Homo sapien
acaaagaaacaaacggagaccaaaa

SEQ ID NO: 12023 - DNA, 25 bp, Homo sapien
acaaagaaacaaatggagaccaaaa

SEQ ID NO: 12024 - DNA, 25 bp, Homo sapien
acaaagaacaccattgtatgtgcta

SEQ ID NO: 12025 - DNA, 25 bp, Homo sapien
acaaagaacaggagtacccaggaac

SEQ ID NO: 12026 - DNA, 25 bp, Homo sapien
acaaagaacaggattacccaggaac

SEQ ID NO: 12027 - DNA, 25 bp, Homo sapien
acaaagaactccattgtatgtgcta

SEQ ID NO: 12028 - DNA, 25 bp, Homo sapien
acaaagacacggagaattccaggtg

SEQ ID NO: 12029 - DNA, 25 bp, Homo sapien
acaaagacatggagaattccaggtg

SEQ ID NO: 12030 - DNA, 25 bp, Homo sapien
acaaagacatggagttaggaatagc

SEQ ID NO: 12031 - DNA, 25 bp, Homo sapien
acaaagacttggagttaggaatagc

SEQ ID NO: 12032 - DNA, 25 bp, Homo sapien
acaaagagggcacgggctccgcaga

SEQ ID NO: 12033 - DNA, 25 bp, Homo sapien
acaaagagggcatgggctccgcaga

SEQ ID NO: 12034 - DNA, 25 bp, Homo sapien
acaaagagtagcatatgattctaat

SEQ ID NO: 12035 - DNA, 25 bp, Homo sapien
acaaagagtagcatgtgattctaat

SEQ ID NO: 12036 - DNA, 25 bp, Homo sapien
acaaagagtttgcagtttgctcctt

SEQ ID NO: 12037 - DNA, 25 bp, Homo sapien
acaaagagtttgccgtttgctcctt

SEQ ID NO: 12038 - DNA, 25 bp, Homo sapien
acaaagatactaataacaaacagag

SEQ ID NO: 12039 - DNA, 25 bp, Homo sapien
acaaagatagaccgaggttctggtg

SEQ ID NO: 12040 - DNA, 25 bp, Homo sapien
acaaagatagactgaggttctggtg

SEQ ID NO: 12041 - DNA, 25 bp, Homo sapien
acaaagatgaaacaagaatgaaaac

SEQ ID NO: 12042 - DNA, 25 bp, Homo sapien
acaaagatgaagcaagaatgaaaac

SEQ ID NO: 12043 - DNA, 25 bp, Homo sapien
acaaagatgcgtcttttcctgctgc

SEQ ID NO: 12044 - DNA, 25 bp, Homo sapien
acaaagatgctaataacaaacagag

SEQ ID NO: 12045 - DNA, 25 bp, Homo sapien
acaaagatgtgtcttttcctgctgc

SEQ ID NO: 12046 - DNA, 25 bp, Homo sapien
acaaagcaacaggattggatgagag

SEQ ID NO: 12047 - DNA, 25 bp, Homo sapien
acaaagcaacagggttggatgagag

SEQ ID NO: 12048 - DNA, 25 bp, Homo sapien
acaaagcaagacaaatgacctggaa

SEQ ID NO: 12049 - DNA, 25 bp, Homo sapien
acaaagcaagacagatgacctggaa

SEQ ID NO: 12050 - DNA, 25 bp, Homo sapien
acaaagcacacatgggcatttgctc

SEQ ID NO: 12051 - DNA, 25 bp, Homo sapien
acaaagcacacgtgggcatttgctc

SEQ ID NO: 12052 - DNA, 25 bp, Homo sapien
acaaagcactacactggctctcgtg

SEQ ID NO: 12053 - DNA, 25 bp, Homo sapien
acaaagcactatactggctctcgtg

SEQ ID NO: 12054 - DNA, 25 bp, Homo sapien
acaaaggaatgaatagatagaggac

SEQ ID NO: 12055 - DNA, 25 bp, Homo sapien
acaaaggaatgaataggtagaggac

SEQ ID NO: 12056 - DNA, 25 bp, Homo sapien
acaaaggagaagttctggctctgag

SEQ ID NO: 12057 - DNA, 25 bp, Homo sapien
acaaaggagaagttttggctctgag

SEQ ID NO: 12058 - DNA, 25 bp, Homo sapien
acaaaggagcttcaatgaataaaac

SEQ ID NO: 12059 - DNA, 25 bp, Homo sapien
acaaaggagcttcagtgaataaaac

SEQ ID NO: 12060 - DNA, 25 bp, Homo sapien
acaaaggaggcctttccttggttga

SEQ ID NO: 12061 - DNA, 25 bp, Homo sapien
acaaaggaggcttttccttggttga

SEQ ID NO: 12062 - DNA, 25 bp, Homo sapien
acaaaggcttcaccggttttggtca

SEQ ID NO: 12063 - DNA, 25 bp, Homo sapien
acaaaggcttcatcggttttggtca

SEQ ID NO: 12064 - DNA, 25 bp, Homo sapien
acaaagggagaccgcgtttagtttg

SEQ ID NO: 12065 - DNA, 25 bp, Homo sapien
acaaagggagacctcgtttagtttg

SEQ ID NO: 12066 - DNA, 25 bp, Homo sapien
acaaaggtcttgcattgctccctcc

SEQ ID NO: 12067 - DNA, 25 bp, Homo sapien
acaaaggtcttgcatttctccctcc

SEQ ID NO: 12068 - DNA, 25 bp, Homo sapien
acaaagtcactcacggtctaaagaa

SEQ ID NO: 12069 - DNA, 25 bp, Homo sapien
acaaagtcactcatggtctaaagaa

SEQ ID NO: 12070 - DNA, 25 bp, Homo sapien
acaaagtgacctcaaaatcaaccca

SEQ ID NO: 12071 - DNA, 25 bp, Homo sapien
acaaagtgacctcagaatcaaccca

SEQ ID NO: 12072 - DNA, 25 bp, Homo sapien
acaaagtgagtacaaaatagtctct

SEQ ID NO: 12073 - DNA, 25 bp, Homo sapien
acaaagtgagtacaaactagtctct

SEQ ID NO: 12074 - DNA, 25 bp, Homo sapien
acaaagtttccaaaaagtctccaga

SEQ ID NO: 12075 - DNA, 25 bp, Homo sapien
acaaagtttccgaaaagtctccaga

SEQ ID NO: 12076 - DNA, 25 bp, Homo sapien
acaaagttttatctcggtgaactac

SEQ ID NO: 12077 - DNA, 25 bp, Homo sapien
acaaagttttatcttggtgaactac

SEQ ID NO: 12078 - DNA, 25 bp, Homo sapien
acaaataaacaaatacaagacatag

SEQ ID NO: 12079 - DNA, 25 bp, Homo sapien
acaaataaacaactacaagacatag

SEQ ID NO: 12080 - DNA, 25 bp, Homo sapien
acaaataacaaaaactgaatgtgtc

SEQ ID NO: 12081 - DNA, 25 bp, Homo sapien
acaaataacaacaactgaatgtgtc

SEQ ID NO: 12082 - DNA, 25 bp, Homo sapien
acaaataataaaccataaatatgtg

SEQ ID NO: 12083 - DNA, 25 bp, Homo sapien
acaaataataaatcataaatatgtg

SEQ ID NO: 12084 - DNA, 25 bp, Homo sapien
acaaatacagaacaatctcaactca

SEQ ID NO: 12085 - DNA, 25 bp, Homo sapien
acaaatacagatcaatctcaactca

SEQ ID NO: 12086 - DNA, 25 bp, Homo sapien
acaaatacgaaatcttaacaaagaa

SEQ ID NO: 12087 - DNA, 25 bp, Homo sapien
acaaatactaaatcttaacaaagaa

SEQ ID NO: 12088 - DNA, 25 bp, Homo sapien
acaaatagacctcaggaggaatcgt

SEQ ID NO: 12089 - DNA, 25 bp, Homo sapien
acaaatagccctcaggaggaatcgt

SEQ ID NO: 12090 - DNA, 25 bp, Homo sapien
acaaatatgataccgacaggctatt

SEQ ID NO: 12091 - DNA, 25 bp, Homo sapien
acaaatatgatactgacaggctatt

SEQ ID NO: 12092 - DNA, 25 bp, Homo sapien
acaaatcaatgcaacagaattcagt

SEQ ID NO: 12093 - DNA, 25 bp, Homo sapien
acaaatcaatgcaacataattcagt

SEQ ID NO: 12094 - DNA, 25 bp, Homo sapien
acaaatcacattaagagagctacta

SEQ ID NO: 12095 - DNA, 25 bp, Homo sapien
acaaatcacattaatagagctacta

SEQ ID NO: 12096 - DNA, 25 bp, Homo sapien
acaaatcacattatatacatgacac

SEQ ID NO: 12097 - DNA, 25 bp, Homo sapien
acaaatcacattatgtacatgacac

SEQ ID NO: 12098 - DNA, 25 bp, Homo sapien
acaaatcacgtacacataacaccat

SEQ ID NO: 12099 - DNA, 25 bp, Homo sapien
acaaatcaggtaaggaatacaggtg

SEQ ID NO: 12100 - DNA, 25 bp, Homo sapien
acaaatcaggtaatgaatacaggtg

SEQ ID NO: 12101 - DNA, 25 bp, Homo sapien
acaaatcagtgccacagttgcacca

SEQ ID NO: 12102 - DNA, 25 bp, Homo sapien
acaaatcagtgctacagttgcacca

SEQ ID NO: 12103 - DNA, 25 bp, Homo sapien
acaaatcatgctagaaatcagtgac

SEQ ID NO: 12104 - DNA, 25 bp, Homo sapien
acaaatcatgctaggaatcagtgac

SEQ ID NO: 12105 - DNA, 25 bp, Homo sapien
acaaatcatgtacacataacaccat

SEQ ID NO: 12106 - DNA, 25 bp, Homo sapien
acaaatccacacaaaaggtcaagga

SEQ ID NO: 12107 - DNA, 25 bp, Homo sapien
acaaatccacataaaaggtcaagga

SEQ ID NO: 12108 - DNA, 25 bp, Homo sapien
acaaatctaaccagaagaggagacc

SEQ ID NO: 12109 - DNA, 25 bp, Homo sapien
acaaatctaactagaagaggagacc

SEQ ID NO: 12110 - DNA, 25 bp, Homo sapien
acaaatctccatgttgaatattccc

SEQ ID NO: 12111 - DNA, 25 bp, Homo sapien
acaaatctccatgttggatattccc

SEQ ID NO: 12112 - DNA, 25 bp, Homo sapien
acaaatctgccattgtaaagagatt

SEQ ID NO: 12113 - DNA, 25 bp, Homo sapien
acaaatctgccgttgtaaagagatt

SEQ ID NO: 12114 - DNA, 25 bp, Homo sapien
acaaatctggtgagttctcaaggag

SEQ ID NO: 12115 - DNA, 25 bp, Homo sapien
acaaatctggttagttctcaaggag

SEQ ID NO: 12116 - DNA, 25 bp, Homo sapien
acaaatgaccggggaccaaccacca

SEQ ID NO: 12117 - DNA, 25 bp, Homo sapien
acaaatgaccggtgaccaaccacca

SEQ ID NO: 12118 - DNA, 25 bp, Homo sapien
acaaatgagaacagatctaccttag

SEQ ID NO: 12119 - DNA, 25 bp, Homo sapien
acaaatgataacagatctaccttag

SEQ ID NO: 12120 - DNA, 25 bp, Homo sapien
acaaatgcctccgcataccagacaa

SEQ ID NO: 12121 - DNA, 25 bp, Homo sapien
acaaatgcctctgcataccagacaa

SEQ ID NO: 12122 - DNA, 25 bp, Homo sapien
acaaatggatgtcttttacagcaat

SEQ ID NO: 12123 - DNA, 25 bp, Homo sapien
acaaatgggtgtcttttacagcaat

SEQ ID NO: 12124 - DNA, 25 bp, Homo sapien
acaaatgtaaatagtgaaacaccat

SEQ ID NO: 12125 - DNA, 25 bp, Homo sapien
acaaatgtaaatattgaaacaccat

SEQ ID NO: 12126 - DNA, 25 bp, Homo sapien
acaaatgtacgtatgaggcacataa

SEQ ID NO: 12127 - DNA, 25 bp, Homo sapien
acaaatgtatgtatgaggcacataa

SEQ ID NO: 12128 - DNA, 25 bp, Homo sapien
acaaatgtcctcatgcctacctact

SEQ ID NO: 12129 - DNA, 25 bp, Homo sapien
acaaatgtcctcgtgcctacctact

SEQ ID NO: 12130 - DNA, 25 bp, Homo sapien
acaaattcaattgtttaaagagcaa

SEQ ID NO: 12131 - DNA, 25 bp, Homo sapien
acaaattcaattgtttcaagagcaa

SEQ ID NO: 12132 - DNA, 25 bp, Homo sapien
acaaattccacattaattcttagat

SEQ ID NO: 12133 - DNA, 25 bp, Homo sapien
acaaattccacgttaattcttagat

SEQ ID NO: 12134 - DNA, 25 bp, Homo sapien
acaaattccatgattgtcagttacc

SEQ ID NO: 12135 - DNA, 25 bp, Homo sapien
acaaattccgtgattgtcagttacc

SEQ ID NO: 12136 - DNA, 25 bp, Homo sapien
acaaattgggtcgctgaaaacaata

SEQ ID NO: 12137 - DNA, 25 bp, Homo sapien
acaaattgggtggctgaaaacaata

SEQ ID NO: 12138 - DNA, 25 bp, Homo sapien
acaaattgtggttcttgaattgtct

SEQ ID NO: 12139 - DNA, 25 bp, Homo sapien
acaaattgtggttgttgaattgtct

SEQ ID NO: 12140 - DNA, 25 bp, Homo sapien
acaaatttatagtttggttgcttta

SEQ ID NO: 12141 - DNA, 25 bp, Homo sapien
acaaatttccatacatgtcaaacaa

SEQ ID NO: 12142 - DNA, 25 bp, Homo sapien
acaaatttccatacgtgtcaaacaa

SEQ ID NO: 12143 - DNA, 25 bp, Homo sapien
acaaatttgtagtttggttgcttta

SEQ ID NO: 12144 - DNA, 25 bp, Homo sapien
acaacaaaaagaaatggcagtacca

SEQ ID NO: 12145 - DNA, 25 bp, Homo sapien
acaacaaaaagagatggcagtacca

SEQ ID NO: 12146 - DNA, 25 bp, Homo sapien
acaacaaaagctgcaacataaccat

SEQ ID NO: 12147 - DNA, 25 bp, Homo sapien
acaacaaaagctgcaatataaccat

SEQ ID NO: 12148 - DNA, 25 bp, Homo sapien
acaacaacaaaaaagggctgccttt

SEQ ID NO: 12149 - DNA, 25 bp, Homo sapien
acaacaacaaaaaggggctgccttt

SEQ ID NO: 12150 - DNA, 25 bp, Homo sapien
acaacaactggctacatggcctgaa

SEQ ID NO: 12151 - DNA, 25 bp, Homo sapien
acaacaactgggtacatggcctgaa

SEQ ID NO: 12152 - DNA, 25 bp, Homo sapien
acaacaatgggaagttaagaagaaa

SEQ ID NO: 12153 - DNA, 25 bp, Homo sapien
acaacaatgggaggttaagaagaaa

SEQ ID NO: 12154 - DNA, 25 bp, Homo sapien
acaacacaaatgtactgtatttcag

SEQ ID NO: 12155 - DNA, 25 bp, Homo sapien
acaacacaaatttactgtatttcag

SEQ ID NO: 12156 - DNA, 25 bp, Homo sapien
acaacacacatagcaatttaagaaa

SEQ ID NO: 12157 - DNA, 25 bp, Homo sapien
acaacacacgtagcaatttaagaaa

SEQ ID NO: 12158 - DNA, 25 bp, Homo sapien
acaacacaggacgaagagattaatg

SEQ ID NO: 12159 - DNA, 25 bp, Homo sapien
acaacacaggattagcacataaaaa

SEQ ID NO: 12160 - DNA, 25 bp, Homo sapien
acaacacagtattagcacataaaaa

SEQ ID NO: 12161 - DNA, 25 bp, Homo sapien
acaacacatgacgaagagattaatg

SEQ ID NO: 12162 - DNA, 25 bp, Homo sapien
acaacacctctgtctgtgtgctctt

SEQ ID NO: 12163 - DNA, 25 bp, Homo sapien
acaacacctctgtttgtgtgctctt

SEQ ID NO: 12164 - DNA, 25 bp, Homo sapien
acaacacgccatcttttcataggaa

SEQ ID NO: 12165 - DNA, 25 bp, Homo sapien
acaacacgtcatcttttcataggaa

SEQ ID NO: 12166 - DNA, 25 bp, Homo sapien
acaacagacccgataatcctcagaa

SEQ ID NO: 12167 - DNA, 25 bp, Homo sapien
acaacagaccctataatcctcagaa

SEQ ID NO: 12168 - DNA, 25 bp, Homo sapien
acaacagagatgagaaataaatatt

SEQ ID NO: 12169 - DNA, 25 bp, Homo sapien
acaacagagatgagtaataaatatt

SEQ ID NO: 12170 - DNA, 25 bp, Homo sapien
acaacagcaatgacccaaacctctc

SEQ ID NO: 12171 - DNA, 25 bp, Homo sapien
acaacagcactgacccaaacctctc

SEQ ID NO: 12172 - DNA, 25 bp, Homo sapien
acaacagtctctaatttttttattt

SEQ ID NO: 12173 - DNA, 25 bp, Homo sapien
acaacagtctctgatttttttattt

SEQ ID NO: 12174 - DNA, 25 bp, Homo sapien
acaacagtggtagacacgaaaatgg

SEQ ID NO: 12175 - DNA, 25 bp, Homo sapien
acaacagtggtagacatgaaaatgg

SEQ ID NO: 12176 - DNA, 25 bp, Homo sapien
acaacatacactaaatgtaactgga

SEQ ID NO: 12177 - DNA, 25 bp, Homo sapien
acaacatacgctaaatgtaactgga

SEQ ID NO: 12178 - DNA, 25 bp, Homo sapien
acaacatgaaattcagtcaaggcag

SEQ ID NO: 12179 - DNA, 25 bp, Homo sapien
acaacatgaaattgagtcaaggcag

SEQ ID NO: 12180 - DNA, 25 bp, Homo sapien
acaacatgactggaatgctcagaca

SEQ ID NO: 12181 - DNA, 25 bp, Homo sapien
acaacatgatgatatggaacacacg

SEQ ID NO: 12182 - DNA, 25 bp, Homo sapien
acaacatgatgttatggaacacacg

SEQ ID NO: 12183 - DNA, 25 bp, Homo sapien
acaacatggctggaatgctcagaca

SEQ ID NO: 12184 - DNA, 25 bp, Homo sapien
acaacatgttgatttacctttaaca

SEQ ID NO: 12185 - DNA, 25 bp, Homo sapien
acaacatgttgatttatctttaaca

SEQ ID NO: 12186 - DNA, 25 bp, Homo sapien
acaacattcatctcctctgagtcca

SEQ ID NO: 12187 - DNA, 25 bp, Homo sapien
acaacattcatgtcctctgagtcca

SEQ ID NO: 12188 - DNA, 25 bp, Homo sapien
acaacattctgtgaaacctttcaaa

SEQ ID NO: 12189 - DNA, 25 bp, Homo sapien
acaacattctgtgaaatctttcaaa

SEQ ID NO: 12190 - DNA, 25 bp, Homo sapien
acaaccaaagtttgaacaactagag

SEQ ID NO: 12191 - DNA, 25 bp, Homo sapien
acaaccaacgccaatttttccagtg

SEQ ID NO: 12192 - DNA, 25 bp, Homo sapien
acaaccaatgccaatttttccagtg

SEQ ID NO: 12193 - DNA, 25 bp, Homo sapien
acaaccaatgtttgaacaactagag

SEQ ID NO: 12194 - DNA, 25 bp, Homo sapien
acaaccacattttcctgctctatag

SEQ ID NO: 12195 - DNA, 25 bp, Homo sapien
acaaccaccttttcctgctctatag

SEQ ID NO: 12196 - DNA, 25 bp, Homo sapien
acaaccagacttcggaatagttgga

SEQ ID NO: 12197 - DNA, 25 bp, Homo sapien
acaaccagactttggaatagttgga

SEQ ID NO: 12198 - DNA, 25 bp, Homo sapien
acaaccatctgcaccattttacact

SEQ ID NO: 12199 - DNA, 25 bp, Homo sapien
acaaccatctgcatcattttacact

SEQ ID NO: 12200 - DNA, 25 bp, Homo sapien
acaaccatctttacatcctccaggc

SEQ ID NO: 12201 - DNA, 25 bp, Homo sapien
acaaccatctttacgtcctccaggc

SEQ ID NO: 12202 - DNA, 25 bp, Homo sapien
acaaccatgcaaaactggcactgat

SEQ ID NO: 12203 - DNA, 25 bp, Homo sapien
acaaccatgcaaaattggcactgat

SEQ ID NO: 12204 - DNA, 25 bp, Homo sapien
acaaccatgtcaccttactttgccc

SEQ ID NO: 12205 - DNA, 25 bp, Homo sapien
acaaccatgtcgccttactttgccc

SEQ ID NO: 12206 - DNA, 25 bp, Homo sapien
acaacccacaggactaaacttgcca

SEQ ID NO: 12207 - DNA, 25 bp, Homo sapien
acaacccacaggcctaaacttgcca

SEQ ID NO: 12208 - DNA, 25 bp, Homo sapien
acaaccgagtagcggagccaagatt

SEQ ID NO: 12209 - DNA, 25 bp, Homo sapien
acaaccgagtagtggagccaagatt

SEQ ID NO: 12210 - DNA, 25 bp, Homo sapien
acaaccttaacatatgcaaataata

SEQ ID NO: 12211 - DNA, 25 bp, Homo sapien
acaaccttaacatgtgcaaataata

SEQ ID NO: 12212 - DNA, 25 bp, Homo sapien
acaaccttcctttccttaacgtacc

SEQ ID NO: 12213 - DNA, 25 bp, Homo sapien
acaaccttcctttctttaacgtacc

SEQ ID NO: 12214 - DNA, 25 bp, Homo sapien
acaacgcactagaagtgtttaagag

SEQ ID NO: 12215 - DNA, 25 bp, Homo sapien
acaacgcactagcagtgtttaagag

SEQ ID NO: 12216 - DNA, 25 bp, Homo sapien
acaacggtagagtaataaactatga

SEQ ID NO: 12217 - DNA, 25 bp, Homo sapien
acaacggtagagtaatgaactatga

SEQ ID NO: 12218 - DNA, 25 bp, Homo sapien
acaacgtgcaacataggactctgat

SEQ ID NO: 12219 - DNA, 25 bp, Homo sapien
acaacgtgcaatataggactctgat

SEQ ID NO: 12220 - DNA, 25 bp, Homo sapien
acaacgtggatcaatcttggaaaca

SEQ ID NO: 12221 - DNA, 25 bp, Homo sapien
acaacgtggatgaatcttggaaaca

SEQ ID NO: 12222 - DNA, 25 bp, Homo sapien
acaactaaaatttagcccacattgc

SEQ ID NO: 12223 - DNA, 25 bp, Homo sapien
acaactaaaatttagctcacattgc

SEQ ID NO: 12224 - DNA, 25 bp, Homo sapien
acaactaaagtaggtgatccttcca

SEQ ID NO: 12225 - DNA, 25 bp, Homo sapien
acaactaaggtaggtgatccttcca

SEQ ID NO: 12226 - DNA, 25 bp, Homo sapien
acaactaccaagcgaggcagagatg

SEQ ID NO: 12227 - DNA, 25 bp, Homo sapien
acaactaccaagtgaggcagagatg

SEQ ID NO: 12228 - DNA, 25 bp, Homo sapien
acaactatatacgtttatggccttc

SEQ ID NO: 12229 - DNA, 25 bp, Homo sapien
acaactatatatgtttatggccttc

SEQ ID NO: 12230 - DNA, 25 bp, Homo sapien
acaactatctaactcagaccaatgg

SEQ ID NO: 12231 - DNA, 25 bp, Homo sapien
acaactatctaactcataccaatgg

SEQ ID NO: 12232 - DNA, 25 bp, Homo sapien
acaactatgatgcctcagcggtgac

SEQ ID NO: 12233 - DNA, 25 bp, Homo sapien
acaactatgatgcttcagcggtgac

SEQ ID NO: 12234 - DNA, 25 bp, Homo sapien
acaactcatagtatgtctacagaga

SEQ ID NO: 12235 - DNA, 25 bp, Homo sapien
acaactcatcgtatgtctacagaga

SEQ ID NO: 12236 - DNA, 25 bp, Homo sapien
acaactctgtgtggctggctgcccc

SEQ ID NO: 12237 - DNA, 25 bp, Homo sapien
acaactctgtgttgctggctgcccc

SEQ ID NO: 12238 - DNA, 25 bp, Homo sapien
acaactctttttcaattaaaacctg

SEQ ID NO: 12239 - DNA, 25 bp, Homo sapien
acaactctttttcgattaaaacctg

SEQ ID NO: 12240 - DNA, 25 bp, Homo sapien
acaactgaaatattttacaacttaa

SEQ ID NO: 12241 - DNA, 25 bp, Homo sapien
acaactgaagtattttacaacttaa

SEQ ID NO: 12242 - DNA, 25 bp, Homo sapien
acaactgagtattgctaacatacat

SEQ ID NO: 12243 - DNA, 25 bp, Homo sapien
acaactgagtattggtaacatacat

SEQ ID NO: 12244 - DNA, 25 bp, Homo sapien
acaactgctgacgatcacgagataa

SEQ ID NO: 12245 - DNA, 25 bp, Homo sapien
acaactgctgatgatcacgagataa

SEQ ID NO: 12246 - DNA, 25 bp, Homo sapien
acaactggctacatggcctgaacgt

SEQ ID NO: 12247 - DNA, 25 bp, Homo sapien
acaactggctactcttccaacgcac

SEQ ID NO: 12248 - DNA, 25 bp, Homo sapien
acaactggctactctttcaacgcac

SEQ ID NO: 12249 - DNA, 25 bp, Homo sapien
acaactgggtacatggcctgaacgt

SEQ ID NO: 12250 - DNA, 25 bp, Homo sapien
acaactggtgataccgtttgaccta

SEQ ID NO: 12251 - DNA, 25 bp, Homo sapien
acaactggtgatactgtttgaccta

SEQ ID NO: 12252 - DNA, 25 bp, Homo sapien
acaactggtttaggaaaagctactg

SEQ ID NO: 12253 - DNA, 25 bp, Homo sapien
acaactggtttatgaaaagctactg

SEQ ID NO: 12254 - DNA, 25 bp, Homo sapien
acaactgtacgctaacagaaaatta

SEQ ID NO: 12255 - DNA, 25 bp, Homo sapien
acaactgtagggtctgaagacaata

SEQ ID NO: 12256 - DNA, 25 bp, Homo sapien
acaactgtatgctaacagaaaatta

SEQ ID NO: 12257 - DNA, 25 bp, Homo sapien
acaactgtggggtctgaagacaata

SEQ ID NO: 12258 - DNA, 25 bp, Homo sapien
acaactgttcttctctctggatcct

SEQ ID NO: 12259 - DNA, 25 bp, Homo sapien
acaactgttcttgtctctggatcct

SEQ ID NO: 12260 - DNA, 25 bp, Homo sapien
acaacttacatcggttttcagattt

SEQ ID NO: 12261 - DNA, 25 bp, Homo sapien
acaacttacattggttttcagattt

SEQ ID NO: 12262 - DNA, 25 bp, Homo sapien
acaacttaccatatcttccttcccc

SEQ ID NO: 12263 - DNA, 25 bp, Homo sapien
acaacttacgatatcttccttcccc

SEQ ID NO: 12264 - DNA, 25 bp, Homo sapien
acaacttactgtgtctctttcagct

SEQ ID NO: 12265 - DNA, 25 bp, Homo sapien
acaacttactgtgtctttttcagct

SEQ ID NO: 12266 - DNA, 25 bp, Homo sapien
acaacttcaaaaggctccatggacc

SEQ ID NO: 12267 - DNA, 25 bp, Homo sapien
acaacttcaaaaggcttcatggacc

SEQ ID NO: 12268 - DNA, 25 bp, Homo sapien
acaacttcctccacagtaactgaac

SEQ ID NO: 12269 - DNA, 25 bp, Homo sapien
acaacttcctccgcagtaactgaac

SEQ ID NO: 12270 - DNA, 25 bp, Homo sapien
acaacttcctccggaaacacttgtg

SEQ ID NO: 12271 - DNA, 25 bp, Homo sapien
acaacttcctctggaaacacttgtg

SEQ ID NO: 12272 - DNA, 25 bp, Homo sapien
acaacttgaggactgtaagtaacac

SEQ ID NO: 12273 - DNA, 25 bp, Homo sapien
acaacttgaggactttaagtaacac

SEQ ID NO: 12274 - DNA, 25 bp, Homo sapien
acaacttgatcaacgaaatattaaa

SEQ ID NO: 12275 - DNA, 25 bp, Homo sapien
acaacttgatcaatgaaatattaaa

SEQ ID NO: 12276 - DNA, 25 bp, Homo sapien
acaactttaaccttccatttctatg

SEQ ID NO: 12277 - DNA, 25 bp, Homo sapien
acaactttaaccttccgtttctatg

SEQ ID NO: 12278 - DNA, 25 bp, Homo sapien
acaactttgaatcgttatataatat

SEQ ID NO: 12279 - DNA, 25 bp, Homo sapien
acaactttgaatggttatataatat

SEQ ID NO: 12280 - DNA, 25 bp, Homo sapien
acaactttgagacctgggccactcg

SEQ ID NO: 12281 - DNA, 25 bp, Homo sapien
acaactttgagacttgggccactcg

SEQ ID NO: 12282 - DNA, 25 bp, Homo sapien
acaacttttccacggactgaggttg

SEQ ID NO: 12283 - DNA, 25 bp, Homo sapien
acaacttttccatggactgaggttg

SEQ ID NO: 12284 - DNA, 25 bp, Homo sapien
acaagaaaaggagaatgtagcaatg

SEQ ID NO: 12285 - DNA, 25 bp, Homo sapien
acaagaaaatgagaatgtagcaatg

SEQ ID NO: 12286 - DNA, 25 bp, Homo sapien
acaagaaagaagcaacatggtagac

SEQ ID NO: 12287 - DNA, 25 bp, Homo sapien
acaagaaagaagcaccatggtagac

SEQ ID NO: 12288 - DNA, 25 bp, Homo sapien
acaagaaatgcctccatagagtcct

SEQ ID NO: 12289 - DNA, 25 bp, Homo sapien
acaagaaatgccttcatagagtcct

SEQ ID NO: 12290 - DNA, 25 bp, Homo sapien
acaagaaattctggccagcatcagg

SEQ ID NO: 12291 - DNA, 25 bp, Homo sapien
acaagaaattctgggcagcatcagg

SEQ ID NO: 12292 - DNA, 25 bp, Homo sapien
acaagaacatcaatgcagaatgact

SEQ ID NO: 12293 - DNA, 25 bp, Homo sapien
acaagaacatcagtgcagaatgact

SEQ ID NO: 12294 - DNA, 25 bp, Homo sapien
acaagaacatgcggttccacagcag

SEQ ID NO: 12295 - DNA, 25 bp, Homo sapien
acaagaacatgtggttccacagcag

SEQ ID NO: 12296 - DNA, 25 bp, Homo sapien
acaagaacttaagcggttcaaaagg

SEQ ID NO: 12297 - DNA, 25 bp, Homo sapien
acaagaacttaggcggttcaaaagg

SEQ ID NO: 12298 - DNA, 25 bp, Homo sapien
acaagaagctagaaaagccaaggaa

SEQ ID NO: 12299 - DNA, 25 bp, Homo sapien
acaagaagctagaagagccaaggaa

SEQ ID NO: 12300 - DNA, 25 bp, Homo sapien
acaagaataaaagacccacaatcca

SEQ ID NO: 12301 - DNA, 25 bp, Homo sapien
acaagaataaaagacctacaatcca

SEQ ID NO: 12302 - DNA, 25 bp, Homo sapien
acaagaatcgtcaagattgagacag

SEQ ID NO: 12303 - DNA, 25 bp, Homo sapien
acaagaattgtcaagattgagacag

SEQ ID NO: 12304 - DNA, 25 bp, Homo sapien
acaagaccacaaactccctgtcaca

SEQ ID NO: 12305 - DNA, 25 bp, Homo sapien
acaagaccacagactccctgtcaca

SEQ ID NO: 12306 - DNA, 25 bp, Homo sapien
acaagagaaatgcaaggagagtcgg

SEQ ID NO: 12307 - DNA, 25 bp, Homo sapien
acaagagaaatgccaggagagtcgg

SEQ ID NO: 12308 - DNA, 25 bp, Homo sapien
acaagagcatagacaaagcattagg

SEQ ID NO: 12309 - DNA, 25 bp, Homo sapien
acaagagcatagacaaggcattagg

SEQ ID NO: 12310 - DNA, 25 bp, Homo sapien
acaagagctctgtggattctggaca

SEQ ID NO: 12311 - DNA, 25 bp, Homo sapien
acaagagctctttggattctggaca

SEQ ID NO: 12312 - DNA, 25 bp, Homo sapien
acaagagtacttaacacatgcatga

SEQ ID NO: 12313 - DNA, 25 bp, Homo sapien
acaagagtacttgacacatgcatga

SEQ ID NO: 12314 - DNA, 25 bp, Homo sapien
acaagataatgccgctgtgctatga

SEQ ID NO: 12315 - DNA, 25 bp, Homo sapien
acaagataatgctgctgtgctatga

SEQ ID NO: 12316 - DNA, 25 bp, Homo sapien
acaagatacatatttactcaacaag

SEQ ID NO: 12317 - DNA, 25 bp, Homo sapien
acaagatacttatttactcaacaag

SEQ ID NO: 12318 - DNA, 25 bp, Homo sapien
acaagatattcagttcctcagccac

SEQ ID NO: 12319 - DNA, 25 bp, Homo sapien
acaagatattcggttcctcagccac

SEQ ID NO: 12320 - DNA, 25 bp, Homo sapien
acaagatcaataaccagtgtgatgt

SEQ ID NO: 12321 - DNA, 25 bp, Homo sapien
acaagatcaatagccagtgtgatgt

SEQ ID NO: 12322 - DNA, 25 bp, Homo sapien
acaagatgatgtttatatttccatg

SEQ ID NO: 12323 - DNA, 25 bp, Homo sapien
acaagatgatgtttgtatttccatg

SEQ ID NO: 12324 - DNA, 25 bp, Homo sapien
acaagatgtctgcacctgccctgag

SEQ ID NO: 12325 - DNA, 25 bp, Homo sapien
acaagatgtctggacctgccctgag

SEQ ID NO: 12326 - DNA, 25 bp, Homo sapien
acaagatgtggcacaatgggaatta

SEQ ID NO: 12327 - DNA, 25 bp, Homo sapien
acaagatgtggcataatgggaatta

SEQ ID NO: 12328 - DNA, 25 bp, Homo sapien
acaagattaatatgcaaaaatcaat

SEQ ID NO: 12329 - DNA, 25 bp, Homo sapien
acaagattagtatgcaaaaatcaat

SEQ ID NO: 12330 - DNA, 25 bp, Homo sapien
acaagattgatggctttattttcta

SEQ ID NO: 12331 - DNA, 25 bp, Homo sapien
acaagattgatggttttattttcta

SEQ ID NO: 12332 - DNA, 25 bp, Homo sapien
acaagatttgaaaagaaattgtgga

SEQ ID NO: 12333 - DNA, 25 bp, Homo sapien
acaagatttgaaaggaaattgtgga

SEQ ID NO: 12334 - DNA, 25 bp, Homo sapien
acaagatttggcatacacatacgag

SEQ ID NO: 12335 - DNA, 25 bp, Homo sapien
acaagatttggcatacgcatacgag

SEQ ID NO: 12336 - DNA, 25 bp, Homo sapien
acaagcaaccaaaaaagcttctcaa

SEQ ID NO: 12337 - DNA, 25 bp, Homo sapien
acaagcaaccacaaaagcttctcaa

SEQ ID NO: 12338 - DNA, 25 bp, Homo sapien
acaagcacttaacaaaattcaacat

SEQ ID NO: 12339 - DNA, 25 bp, Homo sapien
acaagcacttaataaaattcaacat

SEQ ID NO: 12340 - DNA, 25 bp, Homo sapien
acaagcagatgatgttgtgaggggt

SEQ ID NO: 12341 - DNA, 25 bp, Homo sapien
acaagcagctgatgttgtgaggggt

SEQ ID NO: 12342 - DNA, 25 bp, Homo sapien
acaagcatactttccagagatcaaa

SEQ ID NO: 12343 - DNA, 25 bp, Homo sapien
acaagcatattttccagagatcaaa

SEQ ID NO: 12344 - DNA, 25 bp, Homo sapien
acaagcatcaaagtattaataagaa

SEQ ID NO: 12345 - DNA, 25 bp, Homo sapien
acaagcatcaaagtgttaataagaa

SEQ ID NO: 12346 - DNA, 25 bp, Homo sapien
acaagcatgtgcatgagtctgtgta

SEQ ID NO: 12347 - DNA, 25 bp, Homo sapien
acaagcatgtgcgtgagtctgtgta

SEQ ID NO: 12348 - DNA, 25 bp, Homo sapien
acaagccaagaacacctgaggctac

SEQ ID NO: 12349 - DNA, 25 bp, Homo sapien
acaagccaggaacacctgaggctac

SEQ ID NO: 12350 - DNA, 25 bp, Homo sapien
acaagccgctttgccgtgctgattg

SEQ ID NO: 12351 - DNA, 25 bp, Homo sapien
acaagccgctttgctgtgctgattg

SEQ ID NO: 12352 - DNA, 25 bp, Homo sapien
acaagcctacctactgatgctactc

SEQ ID NO: 12353 - DNA, 25 bp, Homo sapien
acaagcctgcacatatacctcttca

SEQ ID NO: 12354 - DNA, 25 bp, Homo sapien
acaagcctgcacgtatacctcttca

SEQ ID NO: 12355 - DNA, 25 bp, Homo sapien
acaagcctggccgagcttgccacct

SEQ ID NO: 12356 - DNA, 25 bp, Homo sapien
acaagcctggctgagcttgccacct

SEQ ID NO: 12357 - DNA, 25 bp, Homo sapien
acaagccttcctactgatgctactc

SEQ ID NO: 12358 - DNA, 25 bp, Homo sapien
acaagcgtatgaaacaagattcaca

SEQ ID NO: 12359 - DNA, 25 bp, Homo sapien
acaagcgtatgaaagaagattcaca

SEQ ID NO: 12360 - DNA, 25 bp, Homo sapien
acaagctaggaagcaagccctcccc

SEQ ID NO: 12361 - DNA, 25 bp, Homo sapien
acaagctaggaagcgagccctcccc

SEQ ID NO: 12362 - DNA, 25 bp, Homo sapien
acaagctataaaccaaagaagcatc

SEQ ID NO: 12363 - DNA, 25 bp, Homo sapien
acaagctataaaccaacgaagcatc

SEQ ID NO: 12364 - DNA, 25 bp, Homo sapien
acaagctgacaagaaaaaagcattt

SEQ ID NO: 12365 - DNA, 25 bp, Homo sapien
acaagctgacaaggaaaaagcattt

SEQ ID NO: 12366 - DNA, 25 bp, Homo sapien
acaagctgactcttggtaagcacat

SEQ ID NO: 12367 - DNA, 25 bp, Homo sapien
acaagctggctcttggtaagcacat

SEQ ID NO: 12368 - DNA, 25 bp, Homo sapien
acaagctggtttcttacttaaatac

SEQ ID NO: 12369 - DNA, 25 bp, Homo sapien
acaagctggttttttacttaaatac

SEQ ID NO: 12370 - DNA, 25 bp, Homo sapien
acaagctgtaacacagtagacattc

SEQ ID NO: 12371 - DNA, 25 bp, Homo sapien
acaagctgtaacatagtagacattc

SEQ ID NO: 12372 - DNA, 25 bp, Homo sapien
acaagctgtaggcggatctaccatt

SEQ ID NO: 12373 - DNA, 25 bp, Homo sapien
acaagctgtaggtggatctaccatt

SEQ ID NO: 12374 - DNA, 25 bp, Homo sapien
acaagctttcacattgaatcagtaa

SEQ ID NO: 12375 - DNA, 25 bp, Homo sapien
acaagctttgacattgaatcagtaa

SEQ ID NO: 12376 - DNA, 25 bp, Homo sapien
acaaggaagataatcttttttaagc

SEQ ID NO: 12377 - DNA, 25 bp, Homo sapien
acaaggaagattatcttttttaagc

SEQ ID NO: 12378 - DNA, 25 bp, Homo sapien
acaaggaaggcatgagagacagcga

SEQ ID NO: 12379 - DNA, 25 bp, Homo sapien
acaaggaaggcgtgagagacagcga

SEQ ID NO: 12380 - DNA, 25 bp, Homo sapien
acaaggaagtgtaattcgcctgcct

SEQ ID NO: 12381 - DNA, 25 bp, Homo sapien
acaaggaagtgtaatttgcctgcct

SEQ ID NO: 12382 - DNA, 25 bp, Homo sapien
acaaggaatcacagctccttgcatc

SEQ ID NO: 12383 - DNA, 25 bp, Homo sapien
acaaggaatcacagcttcttgcatc

SEQ ID NO: 12384 - DNA, 25 bp, Homo sapien
acaaggacaattctttgcctttagg

SEQ ID NO: 12385 - DNA, 25 bp, Homo sapien
acaaggacagttctttgcctttagg

SEQ ID NO: 12386 - DNA, 25 bp, Homo sapien
acaaggatcctcaacattgtactgt

SEQ ID NO: 12387 - DNA, 25 bp, Homo sapien
acaaggatcctcaatattgtactgt

SEQ ID NO: 12388 - DNA, 25 bp, Homo sapien
acaaggatgatgtaattttgtatag

SEQ ID NO: 12389 - DNA, 25 bp, Homo sapien
acaaggattatgtaattttgtatag

SEQ ID NO: 12390 - DNA, 25 bp, Homo sapien
acaaggattgtgtttgcttttcctt

SEQ ID NO: 12391 - DNA, 25 bp, Homo sapien
acaaggattgtgtttgtttttcctt

SEQ ID NO: 12392 - DNA, 25 bp, Homo sapien
acaaggcacatagtatcctcagctt

SEQ ID NO: 12393 - DNA, 25 bp, Homo sapien
acaaggcacatggtatcctcagctt

SEQ ID NO: 12394 - DNA, 25 bp, Homo sapien
acaaggctcaattctgcttttccct

SEQ ID NO: 12395 - DNA, 25 bp, Homo sapien
acaaggctcaattgtgcttttccct

SEQ ID NO: 12396 - DNA, 25 bp, Homo sapien
acaagggaacacataaactgaggat

SEQ ID NO: 12397 - DNA, 25 bp, Homo sapien
acaagggaacatataaactgaggat

SEQ ID NO: 12398 - DNA, 25 bp, Homo sapien
acaagggaataatatgtgcttattg

SEQ ID NO: 12399 - DNA, 25 bp, Homo sapien
acaagggagtaatatgtgcttattg

SEQ ID NO: 12400 - DNA, 25 bp, Homo sapien
acaagggccacatgccttcaatttg

SEQ ID NO: 12401 - DNA, 25 bp, Homo sapien
acaagggccacatgtcttcaatttg

SEQ ID NO: 12402 - DNA, 25 bp, Homo sapien
acaagggtcataaaaaagattcaag

SEQ ID NO: 12403 - DNA, 25 bp, Homo sapien
acaagggtcataaacaagattcaag

SEQ ID NO: 12404 - DNA, 25 bp, Homo sapien
acaagggtgaaaactagctactcag

SEQ ID NO: 12405 - DNA, 25 bp, Homo sapien
acaagggttaaaactagctactcag

SEQ ID NO: 12406 - DNA, 25 bp, Homo sapien
acaagggttaaacgtagtggtaaga

SEQ ID NO: 12407 - DNA, 25 bp, Homo sapien
acaagggttaaatgtagtggtaaga

SEQ ID NO: 12408 - DNA, 25 bp, Homo sapien
acaaggtacggatgagtaaagcaca

SEQ ID NO: 12409 - DNA, 25 bp, Homo sapien
acaaggtacggatgtgtaaagcaca

SEQ ID NO: 12410 - DNA, 25 bp, Homo sapien
acaaggtagctaaaattaagcacat

SEQ ID NO: 12411 - DNA, 25 bp, Homo sapien
acaaggtagctataattaagcacat

SEQ ID NO: 12412 - DNA, 25 bp, Homo sapien
acaaggtcaaaagttgattataagg

SEQ ID NO: 12413 - DNA, 25 bp, Homo sapien
acaaggtcaaatgttgattataagg

SEQ ID NO: 12414 - DNA, 25 bp, Homo sapien
acaaggtcttcaacattttaacctg

SEQ ID NO: 12415 - DNA, 25 bp, Homo sapien
acaaggtcttcagcattttaacctg

SEQ ID NO: 12416 - DNA, 25 bp, Homo sapien
acaaggttagtgcatgagtaacaat

SEQ ID NO: 12417 - DNA, 25 bp, Homo sapien
acaaggttagtgtatgagtaacaat

SEQ ID NO: 12418 - DNA, 25 bp, Homo sapien
acaaggttcgagaggccaaagagac

SEQ ID NO: 12419 - DNA, 25 bp, Homo sapien
acaaggtttgagaggccaaagagac

SEQ ID NO: 12420 - DNA, 25 bp, Homo sapien
acaagtaaacacatgagtataaggc

SEQ ID NO: 12421 - DNA, 25 bp, Homo sapien
acaagtaaacagatgagtataaggc

SEQ ID NO: 12422 - DNA, 25 bp, Homo sapien
acaagtaggacccagagacagagtt

SEQ ID NO: 12423 - DNA, 25 bp, Homo sapien
acaagtaggacctagagacagagtt

SEQ ID NO: 12424 - DNA, 25 bp, Homo sapien
acaagtcaatcttcctgatgaacac

SEQ ID NO: 12425 - DNA, 25 bp, Homo sapien
acaagtcaatttggtgattttgata

SEQ ID NO: 12426 - DNA, 25 bp, Homo sapien
acaagtcacctatgaaactgttctc

SEQ ID NO: 12427 - DNA, 25 bp, Homo sapien
acaagtcagtcttcctgatgaacac

SEQ ID NO: 12428 - DNA, 25 bp, Homo sapien
acaagtcagtttggtgattttgata

SEQ ID NO: 12429 - DNA, 25 bp, Homo sapien
acaagtcatctatgaaactgttctc

SEQ ID NO: 12430 - DNA, 25 bp, Homo sapien
acaagtgtgttctttcagctcacat

SEQ ID NO: 12431 - DNA, 25 bp, Homo sapien
acaagtgtgttttttcagctcacat

SEQ ID NO: 12432 - DNA, 25 bp, Homo sapien
acaagttacctaacatctctgctga

SEQ ID NO: 12433 - DNA, 25 bp, Homo sapien
acaagttacgacaaagcagcaatga

SEQ ID NO: 12434 - DNA, 25 bp, Homo sapien
acaagttacttaacatctctgctga

SEQ ID NO: 12435 - DNA, 25 bp, Homo sapien
acaagttatgacaaagcagcaatga

SEQ ID NO: 12436 - DNA, 25 bp, Homo sapien
acaagttcttggccttctgtgtgct

SEQ ID NO: 12437 - DNA, 25 bp, Homo sapien
acaagttcttggcgttctgtgtgct

SEQ ID NO: 12438 - DNA, 25 bp, Homo sapien
acaagttttgcaatttcctgttcaa

SEQ ID NO: 12439 - DNA, 25 bp, Homo sapien
acaagttttgcattttcctgttcaa

SEQ ID NO: 12440 - DNA, 25 bp, Homo sapien
acaataaaagtagtaacctctatga

SEQ ID NO: 12441 - DNA, 25 bp, Homo sapien
acaataaaggcttgctaacaagggg

SEQ ID NO: 12442 - DNA, 25 bp, Homo sapien
acaataaaggtagtaacctctatga

SEQ ID NO: 12443 - DNA, 25 bp, Homo sapien
acaataaagtcttgctaacaagggg

SEQ ID NO: 12444 - DNA, 25 bp, Homo sapien
acaataaatgtgctacttggaattt

SEQ ID NO: 12445 - DNA, 25 bp, Homo sapien
acaataaatgtgttacttggaattt

SEQ ID NO: 12446 - DNA, 25 bp, Homo sapien
acaataacaaaatcaaggcaaaagt

SEQ ID NO: 12447 - DNA, 25 bp, Homo sapien
acaataacagaaaagctcttgtgag

SEQ ID NO: 12448 - DNA, 25 bp, Homo sapien
acaataacagaaaatctcttgtgag

SEQ ID NO: 12449 - DNA, 25 bp, Homo sapien
acaataacagaatcaaggcaaaagt

SEQ ID NO: 12450 - DNA, 25 bp, Homo sapien
acaataagactttacttagtgcatg

SEQ ID NO: 12451 - DNA, 25 bp, Homo sapien
acaataagcctttacttagtgcatg

SEQ ID NO: 12452 - DNA, 25 bp, Homo sapien
acaataagctgtagaacgaacatta

SEQ ID NO: 12453 - DNA, 25 bp, Homo sapien
acaataagctgtggaacgaacatta

SEQ ID NO: 12454 - DNA, 25 bp, Homo sapien
acaataatattacgcaccatttgtg

SEQ ID NO: 12455 - DNA, 25 bp, Homo sapien
acaataatattatgcaccatttgtg

SEQ ID NO: 12456 - DNA, 25 bp, Homo sapien
acaataatctgaactgtaagtggct

SEQ ID NO: 12457 - DNA, 25 bp, Homo sapien
acaataatgagtgacatgcctttga

SEQ ID NO: 12458 - DNA, 25 bp, Homo sapien
acaataatgagtggcatgcctttga

SEQ ID NO: 12459 - DNA, 25 bp, Homo sapien
acaataatttgaactgtaagtggct

SEQ ID NO: 12460 - DNA, 25 bp, Homo sapien
acaatacacttgaccgggccaggtc

SEQ ID NO: 12461 - DNA, 25 bp, Homo sapien
acaatacacttgactgggccaggtc

SEQ ID NO: 12462 - DNA, 25 bp, Homo sapien
acaataccaacattaaaatgcagcc

SEQ ID NO: 12463 - DNA, 25 bp, Homo sapien
acaataccaacattaagatgcagcc

SEQ ID NO: 12464 - DNA, 25 bp, Homo sapien
acaataccaatgaaggaaaaatata

SEQ ID NO: 12465 - DNA, 25 bp, Homo sapien
acaataccagtagcaagtcagtttc

SEQ ID NO: 12466 - DNA, 25 bp, Homo sapien
acaataccagtatcaagtcagtttc

SEQ ID NO: 12467 - DNA, 25 bp, Homo sapien
acaataccctttcagaggagactgt

SEQ ID NO: 12468 - DNA, 25 bp, Homo sapien
acaataccctttcggaggagactgt

SEQ ID NO: 12469 - DNA, 25 bp, Homo sapien
acaataccgatgaaggaaaaatata

SEQ ID NO: 12470 - DNA, 25 bp, Homo sapien
acaatacctaacagcttatctgtct

SEQ ID NO: 12471 - DNA, 25 bp, Homo sapien
acaatacctaatagcttatctgtct

SEQ ID NO: 12472 - DNA, 25 bp, Homo sapien
acaatactaaacgttgatgagaatg

SEQ ID NO: 12473 - DNA, 25 bp, Homo sapien
acaatactaaacgttggtgagaatg

SEQ ID NO: 12474 - DNA, 25 bp, Homo sapien
acaatactatttacattaacaccaa

SEQ ID NO: 12475 - DNA, 25 bp, Homo sapien
acaatactatttacgttaacaccaa

SEQ ID NO: 12476 - DNA, 25 bp, Homo sapien
acaatactgacccagttgttaactc

SEQ ID NO: 12477 - DNA, 25 bp, Homo sapien
acaatactgacgcagttgttaactc

SEQ ID NO: 12478 - DNA, 25 bp, Homo sapien
acaatagacctctttggggagcagt

SEQ ID NO: 12479 - DNA, 25 bp, Homo sapien
acaatagacctttttggggagcagt

SEQ ID NO: 12480 - DNA, 25 bp, Homo sapien
acaatagagaccatcaacaaaggaa

SEQ ID NO: 12481 - DNA, 25 bp, Homo sapien
acaatagagactatcaacaaaggaa

SEQ ID NO: 12482 - DNA, 25 bp, Homo sapien
acaatagccgaaacttaccagttac

SEQ ID NO: 12483 - DNA, 25 bp, Homo sapien
acaatagcggaaacttaccagttac

SEQ ID NO: 12484 - DNA, 25 bp, Homo sapien
acaataggagacttttttacataca

SEQ ID NO: 12485 - DNA, 25 bp, Homo sapien
acaataggatacttttttacataca

SEQ ID NO: 12486 - DNA, 25 bp, Homo sapien
acaataggatttactagaattagtg

SEQ ID NO: 12487 - DNA, 25 bp, Homo sapien
acaataggatttcctagaattagtg

SEQ ID NO: 12488 - DNA, 25 bp, Homo sapien
acaatatacagagaaatttttaggc

SEQ ID NO: 12489 - DNA, 25 bp, Homo sapien
acaatatacagataaatttttaggc

SEQ ID NO: 12490 - DNA, 25 bp, Homo sapien
acaatatcaatcaaatgtcagtaaa

SEQ ID NO: 12491 - DNA, 25 bp, Homo sapien
acaatatcaatcaaatttcagtaaa

SEQ ID NO: 12492 - DNA, 25 bp, Homo sapien
acaatatcagcccattaagcatcat

SEQ ID NO: 12493 - DNA, 25 bp, Homo sapien
acaatatcagctcattaagcatcat

SEQ ID NO: 12494 - DNA, 25 bp, Homo sapien
acaatatcaggttaccgtcaacatt

SEQ ID NO: 12495 - DNA, 25 bp, Homo sapien
acaatatcaggttagcgtcaacatt

SEQ ID NO: 12496 - DNA, 25 bp, Homo sapien
acaatatctgccctgcaatgttgct

SEQ ID NO: 12497 - DNA, 25 bp, Homo sapien
acaatatctgccttgcaatgttgct

SEQ ID NO: 12498 - DNA, 25 bp, Homo sapien
acaatattagacatctgctttcatc

SEQ ID NO: 12499 - DNA, 25 bp, Homo sapien
acaatattggacatctgctttcatc

SEQ ID NO: 12500 - DNA, 25 bp, Homo sapien
acaatatttaagcgtacaattcagc

SEQ ID NO: 12501 - DNA, 25 bp, Homo sapien
acaatatttaagtgtacaattcagc

SEQ ID NO: 12502 - DNA, 25 bp, Homo sapien
acaatatttgaactaacataaagaa

SEQ ID NO: 12503 - DNA, 25 bp, Homo sapien
acaatatttgaactgacataaagaa

SEQ ID NO: 12504 - DNA, 25 bp, Homo sapien
acaatcaacagaataatgtagtttt

SEQ ID NO: 12505 - DNA, 25 bp, Homo sapien
acaatcaacggaataatgtagtttt

SEQ ID NO: 12506 - DNA, 25 bp, Homo sapien
acaatcaactccgttaatttcagag

SEQ ID NO: 12507 - DNA, 25 bp, Homo sapien
acaatcaactcctttaatttcagag

SEQ ID NO: 12508 - DNA, 25 bp, Homo sapien
acaatcagcctctctctttttattt

SEQ ID NO: 12509 - DNA, 25 bp, Homo sapien
acaatcagcctttctctttttattt

SEQ ID NO: 12510 - DNA, 25 bp, Homo sapien
acaatcaggtgtaaattctgaaaca

SEQ ID NO: 12511 - DNA, 25 bp, Homo sapien
acaatcaggtgtgaattctgaaaca

SEQ ID NO: 12512 - DNA, 25 bp, Homo sapien
acaatccaagcaatggcgtcagtca

SEQ ID NO: 12513 - DNA, 25 bp, Homo sapien
acaatccaagcaatggtgtcagtca

SEQ ID NO: 12514 - DNA, 25 bp, Homo sapien
acaatccaagcatctgaaaattgta

SEQ ID NO: 12515 - DNA, 25 bp, Homo sapien
acaatccaagcgtctgaaaattgta

SEQ ID NO: 12516 - DNA, 25 bp, Homo sapien
acaatccatctcatggagactagta

SEQ ID NO: 12517 - DNA, 25 bp, Homo sapien
acaatccatttcatggagactagta

SEQ ID NO: 12518 - DNA, 25 bp, Homo sapien
acaatcctttccacaaattaccatg

SEQ ID NO: 12519 - DNA, 25 bp, Homo sapien
acaatcctttccataaattaccatg

SEQ ID NO: 12520 - DNA, 25 bp, Homo sapien
acaatctaacgccactggtaagctc

SEQ ID NO: 12521 - DNA, 25 bp, Homo sapien
acaatctaatgccactggtaagctc

SEQ ID NO: 12522 - DNA, 25 bp, Homo sapien
acaatctcgtgtatctacagcttga

SEQ ID NO: 12523 - DNA, 25 bp, Homo sapien
acaatctcttgtatctacagcttga

SEQ ID NO: 12524 - DNA, 25 bp, Homo sapien
acaatcttcatttgggagtatcagg

SEQ ID NO: 12525 - DNA, 25 bp, Homo sapien
acaatcttcgtttgggagtatcagg

SEQ ID NO: 12526 - DNA, 25 bp, Homo sapien
acaatgaacgtgtccttctgcttct

SEQ ID NO: 12527 - DNA, 25 bp, Homo sapien
acaatgaaggttcggattgtggcat

SEQ ID NO: 12528 - DNA, 25 bp, Homo sapien
acaatgaaggtttggattgtggcat

SEQ ID NO: 12529 - DNA, 25 bp, Homo sapien
acaatgaagtaccactttaacccac

SEQ ID NO: 12530 - DNA, 25 bp, Homo sapien
acaatgaagtaccattttaacccac

SEQ ID NO: 12531 - DNA, 25 bp, Homo sapien
acaatgaatacgacagcgacaactt

SEQ ID NO: 12532 - DNA, 25 bp, Homo sapien
acaatgaatacgacggcgacaactt

SEQ ID NO: 12533 - DNA, 25 bp, Homo sapien
acaatgaatctccacacaataaaac

SEQ ID NO: 12534 - DNA, 25 bp, Homo sapien
acaatgaatctctacacaataaaac

SEQ ID NO: 12535 - DNA, 25 bp, Homo sapien
acaatgaatgtgtccttctgcttct

SEQ ID NO: 12536 - DNA, 25 bp, Homo sapien
acaatgaggagacacaatttaataa

SEQ ID NO: 12537 - DNA, 25 bp, Homo sapien
acaatgaggagacgcaatttaataa

SEQ ID NO: 12538 - DNA, 25 bp, Homo sapien
acaatgagttcatgcatcaactata

SEQ ID NO: 12539 - DNA, 25 bp, Homo sapien
acaatgagttcgtgcatcaactata

SEQ ID NO: 12540 - DNA, 25 bp, Homo sapien
acaatgcaaaaggtacaaaaaccaa

SEQ ID NO: 12541 - DNA, 25 bp, Homo sapien
acaatgcaaaaggtacgaaaaccaa

SEQ ID NO: 12542 - DNA, 25 bp, Homo sapien
acaatgcaaggccatgcatggaaat

SEQ ID NO: 12543 - DNA, 25 bp, Homo sapien
acaatgcaaggtcatgcatggaaat

SEQ ID NO: 12544 - DNA, 25 bp, Homo sapien
acaatgcagaaacgacacaaagatt

SEQ ID NO: 12545 - DNA, 25 bp, Homo sapien
acaatgcagaaactacacaaagatt

SEQ ID NO: 12546 - DNA, 25 bp, Homo sapien
acaatgcctaacgcagagtaaacat

SEQ ID NO: 12547 - DNA, 25 bp, Homo sapien
acaatgcctaatgcagagtaaacat

SEQ ID NO: 12548 - DNA, 25 bp, Homo sapien
acaatgccttgccaatattgaaata

SEQ ID NO: 12549 - DNA, 25 bp, Homo sapien
acaatgccttgccagtattgaaata

SEQ ID NO: 12550 - DNA, 25 bp, Homo sapien
acaatggagtctgccagatcaacaa

SEQ ID NO: 12551 - DNA, 25 bp, Homo sapien
acaatggagtctgtcagatcaacaa

SEQ ID NO: 12552 - DNA, 25 bp, Homo sapien
acaatgggaacaagcgagacagagc

SEQ ID NO: 12553 - DNA, 25 bp, Homo sapien
acaatgggaacaagtgagacagagc

SEQ ID NO: 12554 - DNA, 25 bp, Homo sapien
acaatgggaagttaagaagaaagaa

SEQ ID NO: 12555 - DNA, 25 bp, Homo sapien
acaatgggaggttaagaagaaagaa

SEQ ID NO: 12556 - DNA, 25 bp, Homo sapien
acaatggttagaaggttaagttctg

SEQ ID NO: 12557 - DNA, 25 bp, Homo sapien
acaatggttaggaggttaagttctg

SEQ ID NO: 12558 - DNA, 25 bp, Homo sapien
acaatgtagaagagccaggtaatag

SEQ ID NO: 12559 - DNA, 25 bp, Homo sapien
acaatgtagaagatccaggtaatag

SEQ ID NO: 12560 - DNA, 25 bp, Homo sapien
acaatgtcatagaatgctaaatgcg

SEQ ID NO: 12561 - DNA, 25 bp, Homo sapien
acaatgtcgtagaatgctaaatgcg

SEQ ID NO: 12562 - DNA, 25 bp, Homo sapien
acaatgtggagaattttttaggaca

SEQ ID NO: 12563 - DNA, 25 bp, Homo sapien
acaatgtggagatttttttaggaca

SEQ ID NO: 12564 - DNA, 25 bp, Homo sapien
acaatgtttcaatcgctaaaaccaa

SEQ ID NO: 12565 - DNA, 25 bp, Homo sapien
acaatgtttcaattgctaaaaccaa

SEQ ID NO: 12566 - DNA, 25 bp, Homo sapien
acaatgtttcagtgagtacacagtc

SEQ ID NO: 12567 - DNA, 25 bp, Homo sapien
acaatgtttcagtgcgtacacagtc

SEQ ID NO: 12568 - DNA, 25 bp, Homo sapien
acaattaaataataagcacaaggga

SEQ ID NO: 12569 - DNA, 25 bp, Homo sapien
acaattaaatagtaagcacaaggga

SEQ ID NO: 12570 - DNA, 25 bp, Homo sapien
acaattaacaatatggcgttaacaa

SEQ ID NO: 12571 - DNA, 25 bp, Homo sapien
acaattaaccatatggcgttaacaa

SEQ ID NO: 12572 - DNA, 25 bp, Homo sapien
acaattacacccatctgtggaaaat

SEQ ID NO: 12573 - DNA, 25 bp, Homo sapien
acaattacacccgtctgtggaaaat

SEQ ID NO: 12574 - DNA, 25 bp, Homo sapien
acaattaccacactataaactacac

SEQ ID NO: 12575 - DNA, 25 bp, Homo sapien
acaattactacactataaactacac

SEQ ID NO: 12576 - DNA, 25 bp, Homo sapien
acaattatagtctgtatgctttcta

SEQ ID NO: 12577 - DNA, 25 bp, Homo sapien
acaattatagtttgtatgctttcta

SEQ ID NO: 12578 - DNA, 25 bp, Homo sapien
acaattatcaagcgtcaaaaattaa

SEQ ID NO: 12579 - DNA, 25 bp, Homo sapien
acaattatcaagtgtcaaaaattaa

SEQ ID NO: 12580 - DNA, 25 bp, Homo sapien
acaattattaatccattcaactgtt

SEQ ID NO: 12581 - DNA, 25 bp, Homo sapien
acaattattaatccgttcaactgtt

SEQ ID NO: 12582 - DNA, 25 bp, Homo sapien
acaattcagagtgaaatgttgggca

SEQ ID NO: 12583 - DNA, 25 bp, Homo sapien
acaattcagagttaaatgttgggca

SEQ ID NO: 12584 - DNA, 25 bp, Homo sapien
acaattcagcatacccagtttaagt

SEQ ID NO: 12585 - DNA, 25 bp, Homo sapien
acaattcagtatacccagtttaagt

SEQ ID NO: 12586 - DNA, 25 bp, Homo sapien
acaattcagttagaacagagtgctg

SEQ ID NO: 12587 - DNA, 25 bp, Homo sapien
acaattcagttagaccagagtgctg

SEQ ID NO: 12588 - DNA, 25 bp, Homo sapien
acaattccagcacgtctcaattcag

SEQ ID NO: 12589 - DNA, 25 bp, Homo sapien
acaattccagcatgtctcaattcag

SEQ ID NO: 12590 - DNA, 25 bp, Homo sapien
acaattgaggaatggaggaactgct

SEQ ID NO: 12591 - DNA, 25 bp, Homo sapien
acaattgaggactggaggaactgct

SEQ ID NO: 12592 - DNA, 25 bp, Homo sapien
acaattgggaaacactcttgccagc

SEQ ID NO: 12593 - DNA, 25 bp, Homo sapien
acaattgggaaatactcttgccagc

SEQ ID NO: 12594 - DNA, 25 bp, Homo sapien
acaattgtgtctatcctggagtttc

SEQ ID NO: 12595 - DNA, 25 bp, Homo sapien
acaattgtgtctattctggagtttc

SEQ ID NO: 12596 - DNA, 25 bp, Homo sapien
acaatttcaattatgcaagtgcttt

SEQ ID NO: 12597 - DNA, 25 bp, Homo sapien
acaatttcacacgtatgatctcatt

SEQ ID NO: 12598 - DNA, 25 bp, Homo sapien
acaatttcacatgtatgatctcatt

SEQ ID NO: 12599 - DNA, 25 bp, Homo sapien
acaatttcacttatgcaagtgcttt

SEQ ID NO: 12600 - DNA, 25 bp, Homo sapien
acaatttcatctaaagctgacattt

SEQ ID NO: 12601 - DNA, 25 bp, Homo sapien
acaatttcatctaatgctgacattt

SEQ ID NO: 12602 - DNA, 25 bp, Homo sapien
acaatttgaaaaatctgtaaaccat

SEQ ID NO: 12603 - DNA, 25 bp, Homo sapien
acaatttgcaaaagaagatatttat

SEQ ID NO: 12604 - DNA, 25 bp, Homo sapien
acaatttgcaaaatctgtaaaccat

SEQ ID NO: 12605 - DNA, 25 bp, Homo sapien
acaatttgcgaaagaagatatttat

SEQ ID NO: 12606 - DNA, 25 bp, Homo sapien
acaatttggctgaacacaaaacact

SEQ ID NO: 12607 - DNA, 25 bp, Homo sapien
acaatttggctgaatacaaaacact

SEQ ID NO: 12608 - DNA, 25 bp, Homo sapien
acaattttaagtttgccgtttaggc

SEQ ID NO: 12609 - DNA, 25 bp, Homo sapien
acaattttaagtttgctgtttaggc

SEQ ID NO: 12610 - DNA, 25 bp, Homo sapien
acaattttcttttcaacagtgagtg

SEQ ID NO: 12611 - DNA, 25 bp, Homo sapien
acaattttcttttcgacagtgagtg

SEQ ID NO: 12612 - DNA, 25 bp, Homo sapien
acaatttttacaaagaccaaagaac

SEQ ID NO: 12613 - DNA, 25 bp, Homo sapien
acaatttttacagagaccaaagaac

SEQ ID NO: 12614 - DNA, 25 bp, Homo sapien
acaatttttttcccagactattttt

SEQ ID NO: 12615 - DNA, 25 bp, Homo sapien
acaatttttttcccaggctattttt

SEQ ID NO: 12616 - DNA, 25 bp, Homo sapien
acacaaaaatgtcaatagaggcatg

SEQ ID NO: 12617 - DNA, 25 bp, Homo sapien
acacaaaacgctacatatcgtctaa

SEQ ID NO: 12618 - DNA, 25 bp, Homo sapien
acacaaaactactgcttcatcaact

SEQ ID NO: 12619 - DNA, 25 bp, Homo sapien
acacaaaagatcatctataaaccgt

SEQ ID NO: 12620 - DNA, 25 bp, Homo sapien
acacaaaagatcgtctataaaccgt

SEQ ID NO: 12621 - DNA, 25 bp, Homo sapien
acacaaaaggctacatatcgtctaa

SEQ ID NO: 12622 - DNA, 25 bp, Homo sapien
acacaaaatcaagacgagagccact

SEQ ID NO: 12623 - DNA, 25 bp, Homo sapien
acacaaaatcaagatgagagccact

SEQ ID NO: 12624 - DNA, 25 bp, Homo sapien
acacaaaattactgcttcatcaact

SEQ ID NO: 12625 - DNA, 25 bp, Homo sapien
acacaaaattatgtatagttcctga

SEQ ID NO: 12626 - DNA, 25 bp, Homo sapien
acacaaaattatgtgtagttcctga

SEQ ID NO: 12627 - DNA, 25 bp, Homo sapien
acacaaaattgtcaatagaggcatg

SEQ ID NO: 12628 - DNA, 25 bp, Homo sapien
acacaaacactcactgacccgacga

SEQ ID NO: 12629 - DNA, 25 bp, Homo sapien
acacaaacgctcactgacccgacga

SEQ ID NO: 12630 - DNA, 25 bp, Homo sapien
acacaaacttaggaacatattttat

SEQ ID NO: 12631 - DNA, 25 bp, Homo sapien
acacaaacttaggaacgtattttat

SEQ ID NO: 12632 - DNA, 25 bp, Homo sapien
acacaaagatcaatggatgtttctc

SEQ ID NO: 12633 - DNA, 25 bp, Homo sapien
acacaaaggcttcaccggttttggt

SEQ ID NO: 12634 - DNA, 25 bp, Homo sapien
acacaaaggcttcatcggttttggt

SEQ ID NO: 12635 - DNA, 25 bp, Homo sapien
acacaaagttcaatggatgtttctc

SEQ ID NO: 12636 - DNA, 25 bp, Homo sapien
acacaaatacatgtgcatatgtgtg

SEQ ID NO: 12637 - DNA, 25 bp, Homo sapien
acacaaatatatgtgcatatgtgtg

SEQ ID NO: 12638 - DNA, 25 bp, Homo sapien
acacaaatgtactgtatttcaggtc

SEQ ID NO: 12639 - DNA, 25 bp, Homo sapien
acacaaattacacgaagagtgttta

SEQ ID NO: 12640 - DNA, 25 bp, Homo sapien
acacaaattacatgaagagtgttta

SEQ ID NO: 12641 - DNA, 25 bp, Homo sapien
acacaaatttactgtatttcaggtc

SEQ ID NO: 12642 - DNA, 25 bp, Homo sapien
acacaaccatctttacatcctccag

SEQ ID NO: 12643 - DNA, 25 bp, Homo sapien
acacaaccatctttacgtcctccag

SEQ ID NO: 12644 - DNA, 25 bp, Homo sapien
acacaaccgagtagcggagccaaga

SEQ ID NO: 12645 - DNA, 25 bp, Homo sapien
acacaaccgagtagtggagccaaga

SEQ ID NO: 12646 - DNA, 25 bp, Homo sapien
acacaaccttcctttccttaacgta

SEQ ID NO: 12647 - DNA, 25 bp, Homo sapien
acacaaccttcctttctttaacgta

SEQ ID NO: 12648 - DNA, 25 bp, Homo sapien
acacaacgcactagaagtgtttaag

SEQ ID NO: 12649 - DNA, 25 bp, Homo sapien
acacaacgcactagcagtgtttaag

SEQ ID NO: 12650 - DNA, 25 bp, Homo sapien
acacaactcatagtatgtctacaga

SEQ ID NO: 12651 - DNA, 25 bp, Homo sapien
acacaactcatcgtatgtctacaga

SEQ ID NO: 12652 - DNA, 25 bp, Homo sapien
acacaacttcctccggaaacacttg

SEQ ID NO: 12653 - DNA, 25 bp, Homo sapien
acacaacttcctctggaaacacttg

SEQ ID NO: 12654 - DNA, 25 bp, Homo sapien
acacaactttgaatcgttatataat

SEQ ID NO: 12655 - DNA, 25 bp, Homo sapien
acacaactttgaatggttatataat

SEQ ID NO: 12656 - DNA, 25 bp, Homo sapien
acacaagagctctgtggattctgga

SEQ ID NO: 12657 - DNA, 25 bp, Homo sapien
acacaagagctctttggattctgga

SEQ ID NO: 12658 - DNA, 25 bp, Homo sapien
acacaagcatagaccaaaaatgtgg

SEQ ID NO: 12659 - DNA, 25 bp, Homo sapien
acacaagcataggccaaaaatgtgg

SEQ ID NO: 12660 - DNA, 25 bp, Homo sapien
acacaagcatcaaagtattaataag

SEQ ID NO: 12661 - DNA, 25 bp, Homo sapien
acacaagcatcaaagtgttaataag

SEQ ID NO: 12662 - DNA, 25 bp, Homo sapien
acacaagcctggccgagcttgccac

SEQ ID NO: 12663 - DNA, 25 bp, Homo sapien
acacaagcctggctgagcttgccac

SEQ ID NO: 12664 - DNA, 25 bp, Homo sapien
acacaagctggtttcttacttaaat

SEQ ID NO: 12665 - DNA, 25 bp, Homo sapien
acacaagctggttttttacttaaat

SEQ ID NO: 12666 - DNA, 25 bp, Homo sapien
acacaaggcatgcagaaaccctcga

SEQ ID NO: 12667 - DNA, 25 bp, Homo sapien
acacaaggctctcgacttacctgag

SEQ ID NO: 12668 - DNA, 25 bp, Homo sapien
acacaaggctcttgacttacctgag

SEQ ID NO: 12669 - DNA, 25 bp, Homo sapien
acacaaggtatgcagaaaccctcga

SEQ ID NO: 12670 - DNA, 25 bp, Homo sapien
acacaaggttagtgcatgagtaaca

SEQ ID NO: 12671 - DNA, 25 bp, Homo sapien
acacaaggttagtgtatgagtaaca

SEQ ID NO: 12672 - DNA, 25 bp, Homo sapien
acacaatacacttgaccgggccagg

SEQ ID NO: 12673 - DNA, 25 bp, Homo sapien
acacaatacacttgactgggccagg

SEQ ID NO: 12674 - DNA, 25 bp, Homo sapien
acacaatcatcagataaaaattgtg

SEQ ID NO: 12675 - DNA, 25 bp, Homo sapien
acacaatcgtcagataaaaattgtg

SEQ ID NO: 12676 - DNA, 25 bp, Homo sapien
acacaattatagtctgtatgctttc

SEQ ID NO: 12677 - DNA, 25 bp, Homo sapien
acacaattatagtttgtatgctttc

SEQ ID NO: 12678 - DNA, 25 bp, Homo sapien
acacaattttcttttcaacagtgag

SEQ ID NO: 12679 - DNA, 25 bp, Homo sapien
acacaattttcttttcgacagtgag

SEQ ID NO: 12680 - DNA, 25 bp, Homo sapien
acacacaaaatgcatttcatttaat

SEQ ID NO: 12681 - DNA, 25 bp, Homo sapien
acacacaaagtgcatttcatttaat

SEQ ID NO: 12682 - DNA, 25 bp, Homo sapien
acacacaaattacacgaagagtgtt

SEQ ID NO: 12683 - DNA, 25 bp, Homo sapien
acacacaaattacatgaagagtgtt

SEQ ID NO: 12684 - DNA, 25 bp, Homo sapien
acacacaagcatagaccaaaaatgt

SEQ ID NO: 12685 - DNA, 25 bp, Homo sapien
acacacaagcataggccaaaaatgt

SEQ ID NO: 12686 - DNA, 25 bp, Homo sapien
acacacaatgtacgctaaatgtact

SEQ ID NO: 12687 - DNA, 25 bp, Homo sapien
acacacaatgtatgctaaatgtact

SEQ ID NO: 12688 - DNA, 25 bp, Homo sapien
acacacacaaaaatgtcaatagagg

SEQ ID NO: 12689 - DNA, 25 bp, Homo sapien
acacacacaaaacatgaatttctac

SEQ ID NO: 12690 - DNA, 25 bp, Homo sapien
acacacacaaaattgtcaatagagg

SEQ ID NO: 12691 - DNA, 25 bp, Homo sapien
acacacacacatgcatgtatcttga

SEQ ID NO: 12692 - DNA, 25 bp, Homo sapien
acacacacacatgcttgtatcttga

SEQ ID NO: 12693 - DNA, 25 bp, Homo sapien
acacacacactcagccatatattga

SEQ ID NO: 12694 - DNA, 25 bp, Homo sapien
acacacacactcagccgtatattga

SEQ ID NO: 12695 - DNA, 25 bp, Homo sapien
acacacacatgcatgtatcttgagt

SEQ ID NO: 12696 - DNA, 25 bp, Homo sapien
acacacacatgcttgtatcttgagt

SEQ ID NO: 12697 - DNA, 25 bp, Homo sapien
acacacacgaaacatgaatttctac

SEQ ID NO: 12698 - DNA, 25 bp, Homo sapien
acacacactgaaactaagtaatact

SEQ ID NO: 12699 - DNA, 25 bp, Homo sapien
acacacactgaatctaagtaatact

SEQ ID NO: 12700 - DNA, 25 bp, Homo sapien
acacacagctagaagacacttacca

SEQ ID NO: 12701 - DNA, 25 bp, Homo sapien
acacacagctagatgacacttacca

SEQ ID NO: 12702 - DNA, 25 bp, Homo sapien
acacacaggagacatttgagtccaa

SEQ ID NO: 12703 - DNA, 25 bp, Homo sapien
acacacaggagacgtttgagtccaa

SEQ ID NO: 12704 - DNA, 25 bp, Homo sapien
acacacaggatagacagttatatct

SEQ ID NO: 12705 - DNA, 25 bp, Homo sapien
acacacaggatggacagttatatct

SEQ ID NO: 12706 - DNA, 25 bp, Homo sapien
acacacatccaagctcccacagtta

SEQ ID NO: 12707 - DNA, 25 bp, Homo sapien
acacacatccaaggtcccacagtta

SEQ ID NO: 12708 - DNA, 25 bp, Homo sapien
acacacatgctgtgagaccacaagg

SEQ ID NO: 12709 - DNA, 25 bp, Homo sapien
acacacatgctgtgggaccacaagg

SEQ ID NO: 12710 - DNA, 25 bp, Homo sapien
acacacatttgtgcataaatacaca

SEQ ID NO: 12711 - DNA, 25 bp, Homo sapien
acacacatttgtgcgtaaatacaca

SEQ ID NO: 12712 - DNA, 25 bp, Homo sapien
acacaccaatgtggagttgaattct

SEQ ID NO: 12713 - DNA, 25 bp, Homo sapien
acacaccaatgtggggttgaattct

SEQ ID NO: 12714 - DNA, 25 bp, Homo sapien
acacaccacataccaggatgttttg

SEQ ID NO: 12715 - DNA, 25 bp, Homo sapien
acacaccacataccgggatgttttg

SEQ ID NO: 12716 - DNA, 25 bp, Homo sapien
acacaccgatggatttggcttgctg

SEQ ID NO: 12717 - DNA, 25 bp, Homo sapien
acacaccgttggatttggcttgctg

SEQ ID NO: 12718 - DNA, 25 bp, Homo sapien
acacacctttaaccatatctcatgt

SEQ ID NO: 12719 - DNA, 25 bp, Homo sapien
acacacctttaatcatatctcatgt

SEQ ID NO: 12720 - DNA, 25 bp, Homo sapien
acacacgaaaggaaaaatgtaaatg

SEQ ID NO: 12721 - DNA, 25 bp, Homo sapien
acacacgaaaggataaatgtaaatg

SEQ ID NO: 12722 - DNA, 25 bp, Homo sapien
acacactagcaggtatatttggcat

SEQ ID NO: 12723 - DNA, 25 bp, Homo sapien
acacactagcatgtatatttggcat

SEQ ID NO: 12724 - DNA, 25 bp, Homo sapien
acacactagtataaagttgtacagg

SEQ ID NO: 12725 - DNA, 25 bp, Homo sapien
acacactagtataacgttgtacagg

SEQ ID NO: 12726 - DNA, 25 bp, Homo sapien
acacactatcttcctcattttcctg

SEQ ID NO: 12727 - DNA, 25 bp, Homo sapien
acacactatctttctcattttcctg

SEQ ID NO: 12728 - DNA, 25 bp, Homo sapien
acacactcaatgagaaaaggacatt

SEQ ID NO: 12729 - DNA, 25 bp, Homo sapien
acacactcagccatatattgatata

SEQ ID NO: 12730 - DNA, 25 bp, Homo sapien
acacactcagccgtatattgatata

SEQ ID NO: 12731 - DNA, 25 bp, Homo sapien
acacactcagtgagaaaaggacatt

SEQ ID NO: 12732 - DNA, 25 bp, Homo sapien
acacactgagaaacgaggagcagtc

SEQ ID NO: 12733 - DNA, 25 bp, Homo sapien
acacactgagaaatgaggagcagtc

SEQ ID NO: 12734 - DNA, 25 bp, Homo sapien
acacactgcacaccatcttcctgaa

SEQ ID NO: 12735 - DNA, 25 bp, Homo sapien
acacactgcacgccatcttcctgaa

SEQ ID NO: 12736 - DNA, 25 bp, Homo sapien
acacagaaaaaaaaaaccttcatca

SEQ ID NO: 12737 - DNA, 25 bp, Homo sapien
acacagaaaaaaaaaatcttcatca

SEQ ID NO: 12738 - DNA, 25 bp, Homo sapien
acacagaaaagcacggttggctgta

SEQ ID NO: 12739 - DNA, 25 bp, Homo sapien
acacagaaaagcactgttggctgta

SEQ ID NO: 12740 - DNA, 25 bp, Homo sapien
acacagaagctccgcaagaaacatg

SEQ ID NO: 12741 - DNA, 25 bp, Homo sapien
acacagaagcttcgcaagaaacatg

SEQ ID NO: 12742 - DNA, 25 bp, Homo sapien
acacagacccagtcattgaagcaag

SEQ ID NO: 12743 - DNA, 25 bp, Homo sapien
acacagacccagtcgttgaagcaag

SEQ ID NO: 12744 - DNA, 25 bp, Homo sapien
acacagagaggcgtgaaagtagata

SEQ ID NO: 12745 - DNA, 25 bp, Homo sapien
acacagagaggtgtgaaagtagata

SEQ ID NO: 12746 - DNA, 25 bp, Homo sapien
acacagagccaaaggctgcatgacc

SEQ ID NO: 12747 - DNA, 25 bp, Homo sapien
acacagagccaagggctgcatgacc

SEQ ID NO: 12748 - DNA, 25 bp, Homo sapien
acacagaggatcatgtcatctacaa

SEQ ID NO: 12749 - DNA, 25 bp, Homo sapien
acacagaggatcgtgtcatctacaa

SEQ ID NO: 12750 - DNA, 25 bp, Homo sapien
acacagaggcaggtcccgtgtaagc

SEQ ID NO: 12751 - DNA, 25 bp, Homo sapien
acacagagtcaggtcccgtgtaagc

SEQ ID NO: 12752 - DNA, 25 bp, Homo sapien
acacagatgctctcctatttaatca

SEQ ID NO: 12753 - DNA, 25 bp, Homo sapien
acacagatgttctcctatttaatca

SEQ ID NO: 12754 - DNA, 25 bp, Homo sapien
acacagcagggaacaaccttgtaca

SEQ ID NO: 12755 - DNA, 25 bp, Homo sapien
acacagcagggaaccaccttgtaca

SEQ ID NO: 12756 - DNA, 25 bp, Homo sapien
acacagccattaaacatgaacctgg

SEQ ID NO: 12757 - DNA, 25 bp, Homo sapien
acacagccattagacatgaacctgg

SEQ ID NO: 12758 - DNA, 25 bp, Homo sapien
acacaggcaataaaaggacaaagga

SEQ ID NO: 12759 - DNA, 25 bp, Homo sapien
acacaggcagtaaaaggacaaagga

SEQ ID NO: 12760 - DNA, 25 bp, Homo sapien
acacaggcccttccatacgagtcca

SEQ ID NO: 12761 - DNA, 25 bp, Homo sapien
acacaggcccttccgtacgagtcca

SEQ ID NO: 12762 - DNA, 25 bp, Homo sapien
acacaggcctcggccgctgagggtc

SEQ ID NO: 12763 - DNA, 25 bp, Homo sapien
acacaggcctcggctgctgagggtc

SEQ ID NO: 12764 - DNA, 25 bp, Homo sapien
acacagggaatatccccttctcttt

SEQ ID NO: 12765 - DNA, 25 bp, Homo sapien
acacagggactatccccttctcttt

SEQ ID NO: 12766 - DNA, 25 bp, Homo sapien
acacaggtcattaaaggtctgcagg

SEQ ID NO: 12767 - DNA, 25 bp, Homo sapien
acacaggtcgttaaaggtctgcagg

SEQ ID NO: 12768 - DNA, 25 bp, Homo sapien
acacaggtgctaacaagctaacata

SEQ ID NO: 12769 - DNA, 25 bp, Homo sapien
acacaggtgctgacaagctaacata

SEQ ID NO: 12770 - DNA, 25 bp, Homo sapien
acacagtaattattatctccaaacc

SEQ ID NO: 12771 - DNA, 25 bp, Homo sapien
acacagtaattattatttccaaacc

SEQ ID NO: 12772 - DNA, 25 bp, Homo sapien
acacagtagatgactcccctttctt

SEQ ID NO: 12773 - DNA, 25 bp, Homo sapien
acacagtagatgactctcctttctt

SEQ ID NO: 12774 - DNA, 25 bp, Homo sapien
acacagtattctcggtagtcctgta

SEQ ID NO: 12775 - DNA, 25 bp, Homo sapien
acacagtattcttggtagtcctgta

SEQ ID NO: 12776 - DNA, 25 bp, Homo sapien
acacagtcaaatacctcaaatgtct

SEQ ID NO: 12777 - DNA, 25 bp, Homo sapien
acacagtcaaataccttaaatgtct

SEQ ID NO: 12778 - DNA, 25 bp, Homo sapien
acacagtctgaaggggaattatgtt

SEQ ID NO: 12779 - DNA, 25 bp, Homo sapien
acacagtctgaatgggaattatgtt

SEQ ID NO: 12780 - DNA, 25 bp, Homo sapien
acacagtgacacgtttctgagtgtt

SEQ ID NO: 12781 - DNA, 25 bp, Homo sapien
acacagtgacacttttctgagtgtt

SEQ ID NO: 12782 - DNA, 25 bp, Homo sapien
acacagtgaggctgaacaactaact

SEQ ID NO: 12783 - DNA, 25 bp, Homo sapien
acacagtgaggctgaataactaact

SEQ ID NO: 12784 - DNA, 25 bp, Homo sapien
acacagttggataccaatacagcag

SEQ ID NO: 12785 - DNA, 25 bp, Homo sapien
acacagttggatgccaatacagcag

SEQ ID NO: 12786 - DNA, 25 bp, Homo sapien
acacagttggtccttaaaagtgggc

SEQ ID NO: 12787 - DNA, 25 bp, Homo sapien
acacagttggtccttagaagtgggc

SEQ ID NO: 12788 - DNA, 25 bp, Homo sapien
acacagtttcttctctgtgcatgtg

SEQ ID NO: 12789 - DNA, 25 bp, Homo sapien
acacagtttcttctttgtgcatgtg

SEQ ID NO: 12790 - DNA, 25 bp, Homo sapien
acacagtttgaacagttggtcacct

SEQ ID NO: 12791 - DNA, 25 bp, Homo sapien
acacagtttgaagagttggtcacct

SEQ ID NO: 12792 - DNA, 25 bp, Homo sapien
acacataacacttaccatttatcat

SEQ ID NO: 12793 - DNA, 25 bp, Homo sapien
acacataacacttaccgtttatcat

SEQ ID NO: 12794 - DNA, 25 bp, Homo sapien
acacataacccgcttgaatctgcac

SEQ ID NO: 12795 - DNA, 25 bp, Homo sapien
acacataacccgcttgtatctgcac

SEQ ID NO: 12796 - DNA, 25 bp, Homo sapien
acacataactcatagggttttcatg

SEQ ID NO: 12797 - DNA, 25 bp, Homo sapien
acacataactcgtagggttttcatg

SEQ ID NO: 12798 - DNA, 25 bp, Homo sapien
acacatacagaaaagtgcatgaatc

SEQ ID NO: 12799 - DNA, 25 bp, Homo sapien
acacatacggaaaagtgcatgaatc

SEQ ID NO: 12800 - DNA, 25 bp, Homo sapien
acacatactctcatcttctgacaaa

SEQ ID NO: 12801 - DNA, 25 bp, Homo sapien
acacatactctcgtcttctgacaaa

SEQ ID NO: 12802 - DNA, 25 bp, Homo sapien
acacatagaatagttttctcagaac

SEQ ID NO: 12803 - DNA, 25 bp, Homo sapien
acacatagaatatttttctcagaac

SEQ ID NO: 12804 - DNA, 25 bp, Homo sapien
acacatagtagattcatagtacaca

SEQ ID NO: 12805 - DNA, 25 bp, Homo sapien
acacatagtggattcatagtacaca

SEQ ID NO: 12806 - DNA, 25 bp, Homo sapien
acacatcatatcaaaatgcatggga

SEQ ID NO: 12807 - DNA, 25 bp, Homo sapien
acacatcatgtcaaaatgcatggga

SEQ ID NO: 12808 - DNA, 25 bp, Homo sapien
acacatccaagctcccacagttatc

SEQ ID NO: 12809 - DNA, 25 bp, Homo sapien
acacatccaaggtcccacagttatc

SEQ ID NO: 12810 - DNA, 25 bp, Homo sapien
acacatcctgaataaggctataagg

SEQ ID NO: 12811 - DNA, 25 bp, Homo sapien
acacatcctgagtaaggctataagg

SEQ ID NO: 12812 - DNA, 25 bp, Homo sapien
acacatctacaaatcacgtacacat

SEQ ID NO: 12813 - DNA, 25 bp, Homo sapien
acacatctacaaatcatgtacacat

SEQ ID NO: 12814 - DNA, 25 bp, Homo sapien
acacatctcttcattgtgcttgtga

SEQ ID NO: 12815 - DNA, 25 bp, Homo sapien
acacatctctttattgtgcttgtga

SEQ ID NO: 12816 - DNA, 25 bp, Homo sapien
acacatctttttgaatctactacac

SEQ ID NO: 12817 - DNA, 25 bp, Homo sapien
acacatctttttggatctactacac

SEQ ID NO: 12818 - DNA, 25 bp, Homo sapien
acacatgactttaactggtcgatct

SEQ ID NO: 12819 - DNA, 25 bp, Homo sapien
acacatgactttacctggtcgatct

SEQ ID NO: 12820 - DNA, 25 bp, Homo sapien
acacatgacttttcaggatatattc

SEQ ID NO: 12821 - DNA, 25 bp, Homo sapien
acacatgacttttcagtatatattc

SEQ ID NO: 12822 - DNA, 25 bp, Homo sapien
acacatgcatgtatcttgagtgcat

SEQ ID NO: 12823 - DNA, 25 bp, Homo sapien
acacatgccagatgggtcatctcat

SEQ ID NO: 12824 - DNA, 25 bp, Homo sapien
acacatgccagatgtgtcatctcat

SEQ ID NO: 12825 - DNA, 25 bp, Homo sapien
acacatgctgactagttgcttgtga

SEQ ID NO: 12826 - DNA, 25 bp, Homo sapien
acacatgctgattagttgcttgtga

SEQ ID NO: 12827 - DNA, 25 bp, Homo sapien
acacatgctgtgagaccacaaggcc

SEQ ID NO: 12828 - DNA, 25 bp, Homo sapien
acacatgctgtgggaccacaaggcc

SEQ ID NO: 12829 - DNA, 25 bp, Homo sapien
acacatgcttgtatcttgagtgcat

SEQ ID NO: 12830 - DNA, 25 bp, Homo sapien
acacatgtattagattgaccaaaat

SEQ ID NO: 12831 - DNA, 25 bp, Homo sapien
acacatgtgaacctgggtagtccct

SEQ ID NO: 12832 - DNA, 25 bp, Homo sapien
acacatgtgaatctgggtagtccct

SEQ ID NO: 12833 - DNA, 25 bp, Homo sapien
acacatgtgtctaatcttagctatc

SEQ ID NO: 12834 - DNA, 25 bp, Homo sapien
acacatgtgtctgatcttagctatc

SEQ ID NO: 12835 - DNA, 25 bp, Homo sapien
acacatgttttagattgaccaaaat

SEQ ID NO: 12836 - DNA, 25 bp, Homo sapien
acacattaaatttcagtcttggctt

SEQ ID NO: 12837 - DNA, 25 bp, Homo sapien
acacattaaattttagtcttggctt

SEQ ID NO: 12838 - DNA, 25 bp, Homo sapien
acacattcatctcttcttatgggaa

SEQ ID NO: 12839 - DNA, 25 bp, Homo sapien
acacattcatctgttcttatgggaa

SEQ ID NO: 12840 - DNA, 25 bp, Homo sapien
acacattccctgtcaatttcttgag

SEQ ID NO: 12841 - DNA, 25 bp, Homo sapien
acacattccctgttaatttcttgag

SEQ ID NO: 12842 - DNA, 25 bp, Homo sapien
acacattgacggacattcaggttgt

SEQ ID NO: 12843 - DNA, 25 bp, Homo sapien
acacattgatggacattcaggttgt

SEQ ID NO: 12844 - DNA, 25 bp, Homo sapien
acacatttaactgattccttggctc

SEQ ID NO: 12845 - DNA, 25 bp, Homo sapien
acacatttaactgattgcttggctc

SEQ ID NO: 12846 - DNA, 25 bp, Homo sapien
acacatttcaacaacggctaaaaac

SEQ ID NO: 12847 - DNA, 25 bp, Homo sapien
acacatttcaacaagggctaaaaac

SEQ ID NO: 12848 - DNA, 25 bp, Homo sapien
acacatttgtgcataaatacacagg

SEQ ID NO: 12849 - DNA, 25 bp, Homo sapien
acacatttgtgcgtaaatacacagg

SEQ ID NO: 12850 - DNA, 25 bp, Homo sapien
acaccaaagagcagatagaaatagg

SEQ ID NO: 12851 - DNA, 25 bp, Homo sapien
acaccaaagagcatatagaaatagg

SEQ ID NO: 12852 - DNA, 25 bp, Homo sapien
acaccaaattgtacaactatccatg

SEQ ID NO: 12853 - DNA, 25 bp, Homo sapien
acaccaaattgtacaagtatccatg

SEQ ID NO: 12854 - DNA, 25 bp, Homo sapien
acaccaagaacacgcttccttgtag

SEQ ID NO: 12855 - DNA, 25 bp, Homo sapien
acaccaagaacatgcttccttgtag

SEQ ID NO: 12856 - DNA, 25 bp, Homo sapien
acaccaagcaccatgtgttctcact

SEQ ID NO: 12857 - DNA, 25 bp, Homo sapien
acaccaagcaccgtgtgttctcact

SEQ ID NO: 12858 - DNA, 25 bp, Homo sapien
acaccaagtggagaaattgaagatc

SEQ ID NO: 12859 - DNA, 25 bp, Homo sapien
acaccaagtggaggaattgaagatc

SEQ ID NO: 12860 - DNA, 25 bp, Homo sapien
acaccaagttttatgggttctccct

SEQ ID NO: 12861 - DNA, 25 bp, Homo sapien
acaccaagttttgtgggttctccct

SEQ ID NO: 12862 - DNA, 25 bp, Homo sapien
acaccaatgtggagttgaattctga

SEQ ID NO: 12863 - DNA, 25 bp, Homo sapien
acaccaatgtggggttgaattctga

SEQ ID NO: 12864 - DNA, 25 bp, Homo sapien
acaccacaccccttgctgaatgagg

SEQ ID NO: 12865 - DNA, 25 bp, Homo sapien
acaccacaccctttgctgaatgagg

SEQ ID NO: 12866 - DNA, 25 bp, Homo sapien
acaccacaccggtgatcgctttcgt

SEQ ID NO: 12867 - DNA, 25 bp, Homo sapien
acaccacacgggagagagtttgctg

SEQ ID NO: 12868 - DNA, 25 bp, Homo sapien
acaccacagatgccagagccttaat

SEQ ID NO: 12869 - DNA, 25 bp, Homo sapien
acaccacagcggtgatcgctttcgt

SEQ ID NO: 12870 - DNA, 25 bp, Homo sapien
acaccacagctgccagagccttaat

SEQ ID NO: 12871 - DNA, 25 bp, Homo sapien
acaccacagttgatagtagtacata

SEQ ID NO: 12872 - DNA, 25 bp, Homo sapien
acaccacagttgatggtagtacata

SEQ ID NO: 12873 - DNA, 25 bp, Homo sapien
acaccacataccaggatgttttggg

SEQ ID NO: 12874 - DNA, 25 bp, Homo sapien
acaccacataccgggatgttttggg

SEQ ID NO: 12875 - DNA, 25 bp, Homo sapien
acaccacatgggagagagtttgctg

SEQ ID NO: 12876 - DNA, 25 bp, Homo sapien
acaccactatgccgtgctaattttt

SEQ ID NO: 12877 - DNA, 25 bp, Homo sapien
acaccactatgccttgctaattttt

SEQ ID NO: 12878 - DNA, 25 bp, Homo sapien
acaccactttctctcttacctcttg

SEQ ID NO: 12879 - DNA, 25 bp, Homo sapien
acaccactttctttcttacctcttg

SEQ ID NO: 12880 - DNA, 25 bp, Homo sapien
acaccacttttaaataacagcaata

SEQ ID NO: 12881 - DNA, 25 bp, Homo sapien
acaccacttttaagtaacagcaata

SEQ ID NO: 12882 - DNA, 25 bp, Homo sapien
acaccagtcaggaacggatggtact

SEQ ID NO: 12883 - DNA, 25 bp, Homo sapien
acaccagtcaggaatggatggtact

SEQ ID NO: 12884 - DNA, 25 bp, Homo sapien
acaccagtcattcaaaaatacatga

SEQ ID NO: 12885 - DNA, 25 bp, Homo sapien
acaccagtcgttcaaaaatacatga

SEQ ID NO: 12886 - DNA, 25 bp, Homo sapien
acaccataaaaaatctaccagttag

SEQ ID NO: 12887 - DNA, 25 bp, Homo sapien
acaccataaaaaatttaccagttag

SEQ ID NO: 12888 - DNA, 25 bp, Homo sapien
acaccatcatgcctaactcgggact

SEQ ID NO: 12889 - DNA, 25 bp, Homo sapien
acaccatcatggctaactcgggact

SEQ ID NO: 12890 - DNA, 25 bp, Homo sapien
acaccatcctaaattttttttcatc

SEQ ID NO: 12891 - DNA, 25 bp, Homo sapien
acaccatcctagattttttttcatc

SEQ ID NO: 12892 - DNA, 25 bp, Homo sapien
acaccatcgagagcactaacgagaa

SEQ ID NO: 12893 - DNA, 25 bp, Homo sapien
acaccatcgagagtactaacgagaa

SEQ ID NO: 12894 - DNA, 25 bp, Homo sapien
acaccattgaatcttgcgctacata

SEQ ID NO: 12895 - DNA, 25 bp, Homo sapien
acaccattgaatcttgtgctacata

SEQ ID NO: 12896 - DNA, 25 bp, Homo sapien
acacccaaacagccagttgttagta

SEQ ID NO: 12897 - DNA, 25 bp, Homo sapien
acacccaaatagccagttgttagta

SEQ ID NO: 12898 - DNA, 25 bp, Homo sapien
acacccaacgtgcaggtggtcatta

SEQ ID NO: 12899 - DNA, 25 bp, Homo sapien
acacccaatgtgcaggtggtcatta

SEQ ID NO: 12900 - DNA, 25 bp, Homo sapien
acacccagctgtattgcgtccattt

SEQ ID NO: 12901 - DNA, 25 bp, Homo sapien
acacccagctgtattgtgtccattt

SEQ ID NO: 12902 - DNA, 25 bp, Homo sapien
acacccatcagacggagagttggtc

SEQ ID NO: 12903 - DNA, 25 bp, Homo sapien
acacccatcagatggagagttggtc

SEQ ID NO: 12904 - DNA, 25 bp, Homo sapien
acacccatcctcagagctccaggtt

SEQ ID NO: 12905 - DNA, 25 bp, Homo sapien
acacccatcttcagagctccaggtt

SEQ ID NO: 12906 - DNA, 25 bp, Homo sapien
acaccccacagcacagggtcttgta

SEQ ID NO: 12907 - DNA, 25 bp, Homo sapien
acaccccacagcacagtgtcttgta

SEQ ID NO: 12908 - DNA, 25 bp, Homo sapien
acaccctccaaacgtaaccctctat

SEQ ID NO: 12909 - DNA, 25 bp, Homo sapien
acaccctccaaatgtaaccctctat

SEQ ID NO: 12910 - DNA, 25 bp, Homo sapien
acaccctccacaacaatttcttttt

SEQ ID NO: 12911 - DNA, 25 bp, Homo sapien
acaccctccacaaccatttcttttt

SEQ ID NO: 12912 - DNA, 25 bp, Homo sapien
acaccctgcaactgagcaaactacg

SEQ ID NO: 12913 - DNA, 25 bp, Homo sapien
acaccctgcaattgagcaaactacg

SEQ ID NO: 12914 - DNA, 25 bp, Homo sapien
acacccttacttacggcacagaatt

SEQ ID NO: 12915 - DNA, 25 bp, Homo sapien
acacccttacttatggcacagaatt

SEQ ID NO: 12916 - DNA, 25 bp, Homo sapien
acaccgaaaatgagtgacaccgaaa

SEQ ID NO: 12917 - DNA, 25 bp, Homo sapien
acaccgaaaattagtgacaccgaaa

SEQ ID NO: 12918 - DNA, 25 bp, Homo sapien
acaccgaagaagcctggagtaaaat

SEQ ID NO: 12919 - DNA, 25 bp, Homo sapien
acaccgaagaaggctggagtaaaat

SEQ ID NO: 12920 - DNA, 25 bp, Homo sapien
acaccgttgtcagaattaaatttct

SEQ ID NO: 12921 - DNA, 25 bp, Homo sapien
acaccgttgtcggaattaaatttct

SEQ ID NO: 12922 - DNA, 25 bp, Homo sapien
acacctacaacttatagaaactcat

SEQ ID NO: 12923 - DNA, 25 bp, Homo sapien
acacctacatcttatagaaactcat

SEQ ID NO: 12924 - DNA, 25 bp, Homo sapien
acacctactatgagtcacgagccag

SEQ ID NO: 12925 - DNA, 25 bp, Homo sapien
acacctactgtgagtcacgagccag

SEQ ID NO: 12926 - DNA, 25 bp, Homo sapien
acacctataggaactagaaaatcaa

SEQ ID NO: 12927 - DNA, 25 bp, Homo sapien
acacctataggagctagaaaatcaa

SEQ ID NO: 12928 - DNA, 25 bp, Homo sapien
acacctattttacaggtggctgaat

SEQ ID NO: 12929 - DNA, 25 bp, Homo sapien
acacctattttagaggtggctgaat

SEQ ID NO: 12930 - DNA, 25 bp, Homo sapien
acacctcaaaacagtggtgaggttg

SEQ ID NO: 12931 - DNA, 25 bp, Homo sapien
acacctcaaaacggtggtgaggttg

SEQ ID NO: 12932 - DNA, 25 bp, Homo sapien
acacctcctctttgtaatgctttca

SEQ ID NO: 12933 - DNA, 25 bp, Homo sapien
acacctcctttttgtaatgctttca

SEQ ID NO: 12934 - DNA, 25 bp, Homo sapien
acacctgatgtcagcatgtctcaga

SEQ ID NO: 12935 - DNA, 25 bp, Homo sapien
acacctgatgtccgcatgtctcaga

SEQ ID NO: 12936 - DNA, 25 bp, Homo sapien
acacctgcacagtcggcagtctgtg

SEQ ID NO: 12937 - DNA, 25 bp, Homo sapien
acacctgcacagttggcagtctgtg

SEQ ID NO: 12938 - DNA, 25 bp, Homo sapien
acacctgctaacagtacccatggta

SEQ ID NO: 12939 - DNA, 25 bp, Homo sapien
acacctgctaacattacccatggta

SEQ ID NO: 12940 - DNA, 25 bp, Homo sapien
acacctggcttctaattcacccaca

SEQ ID NO: 12941 - DNA, 25 bp, Homo sapien
acacctggcttctagttcacccaca

SEQ ID NO: 12942 - DNA, 25 bp, Homo sapien
acaccttaaaacctgctgatgactt

SEQ ID NO: 12943 - DNA, 25 bp, Homo sapien
acaccttaacacctgctgatgactt

SEQ ID NO: 12944 - DNA, 25 bp, Homo sapien
acaccttgacaccaggatgtggctg

SEQ ID NO: 12945 - DNA, 25 bp, Homo sapien
acaccttgatgaggcagaaagagct

SEQ ID NO: 12946 - DNA, 25 bp, Homo sapien
acaccttgatgaggtagaaagagct

SEQ ID NO: 12947 - DNA, 25 bp, Homo sapien
acaccttgtatgacccttagagaaa

SEQ ID NO: 12948 - DNA, 25 bp, Homo sapien
acaccttgtatgactcttagagaaa

SEQ ID NO: 12949 - DNA, 25 bp, Homo sapien
acaccttgtcaccaggatgtggctg

SEQ ID NO: 12950 - DNA, 25 bp, Homo sapien
acacgaaagcaataaagtcaagaca

SEQ ID NO: 12951 - DNA, 25 bp, Homo sapien
acacgaaagcaatgaagtcaagaca

SEQ ID NO: 12952 - DNA, 25 bp, Homo sapien
acacgaactagaactaggtttcatc

SEQ ID NO: 12953 - DNA, 25 bp, Homo sapien
acacgaactagaagtaggtttcatc

SEQ ID NO: 12954 - DNA, 25 bp, Homo sapien
acacgcacacatcatgaatgactca

SEQ ID NO: 12955 - DNA, 25 bp, Homo sapien
acacgcacacatcgtgaatgactca

SEQ ID NO: 12956 - DNA, 25 bp, Homo sapien
acacgctaacaacgtaaacggctca

SEQ ID NO: 12957 - DNA, 25 bp, Homo sapien
acacgctaacaatgtaaacggctca

SEQ ID NO: 12958 - DNA, 25 bp, Homo sapien
acacgctaatagaaaaaaagccaaa

SEQ ID NO: 12959 - DNA, 25 bp, Homo sapien
acacgctaatagagaaaaagccaaa

SEQ ID NO: 12960 - DNA, 25 bp, Homo sapien
acacggacaaactttacagaagact

SEQ ID NO: 12961 - DNA, 25 bp, Homo sapien
acacggacaaactttagagaagact

SEQ ID NO: 12962 - DNA, 25 bp, Homo sapien
acacggatttgaacatgtgatatga

SEQ ID NO: 12963 - DNA, 25 bp, Homo sapien
acacggatttgaatatgtgatatga

SEQ ID NO: 12964 - DNA, 25 bp, Homo sapien
acacgggaaggtcaaagttctagct

SEQ ID NO: 12965 - DNA, 25 bp, Homo sapien
acacgggaaggtcagagttctagct

SEQ ID NO: 12966 - DNA, 25 bp, Homo sapien
acacgggaattgacaggagagttgc

SEQ ID NO: 12967 - DNA, 25 bp, Homo sapien
acacgggaattgagaggagagttgc

SEQ ID NO: 12968 - DNA, 25 bp, Homo sapien
acacgggactccgccatcaagcgtg

SEQ ID NO: 12969 - DNA, 25 bp, Homo sapien
acacgggactctgccatcaagcgtg

SEQ ID NO: 12970 - DNA, 25 bp, Homo sapien
acacgtaaatctcaatctggaagga

SEQ ID NO: 12971 - DNA, 25 bp, Homo sapien
acacgtaaatcttaatctggaagga

SEQ ID NO: 12972 - DNA, 25 bp, Homo sapien
acacgtatttgttgaatgttgttga

SEQ ID NO: 12973 - DNA, 25 bp, Homo sapien
acacgtatttgttgcatgttgttga

SEQ ID NO: 12974 - DNA, 25 bp, Homo sapien
acacgtcaaaataacatgaattttc

SEQ ID NO: 12975 - DNA, 25 bp, Homo sapien
acacgtcagaataacatgaattttc

SEQ ID NO: 12976 - DNA, 25 bp, Homo sapien
acacgtgggtattacggttcacaat

SEQ ID NO: 12977 - DNA, 25 bp, Homo sapien
acacgtgggtattatggttcacaat

SEQ ID NO: 12978 - DNA, 25 bp, Homo sapien
acacgtgtaagacgagtacctcttc

SEQ ID NO: 12979 - DNA, 25 bp, Homo sapien
acacgtgtaagactagtacctcttc

SEQ ID NO: 12980 - DNA, 25 bp, Homo sapien
acacgtgtgaccgctgaaattaaca

SEQ ID NO: 12981 - DNA, 25 bp, Homo sapien
acacgtgtgactgctgaaattaaca

SEQ ID NO: 12982 - DNA, 25 bp, Homo sapien
acacgttcttcctcttggaccccaa

SEQ ID NO: 12983 - DNA, 25 bp, Homo sapien
acacgttcttcctgttggaccccaa

SEQ ID NO: 12984 - DNA, 25 bp, Homo sapien
acacgtttctcccgtgctcactctc

SEQ ID NO: 12985 - DNA, 25 bp, Homo sapien
acacgtttctcctgtgctcactctc

SEQ ID NO: 12986 - DNA, 25 bp, Homo sapien
acacgtttttagtctctccactcat

SEQ ID NO: 12987 - DNA, 25 bp, Homo sapien
acacgtttttagtttctccactcat

SEQ ID NO: 12988 - DNA, 25 bp, Homo sapien
acactaaacataagcaatagtaatt

SEQ ID NO: 12989 - DNA, 25 bp, Homo sapien
acactaaacgtaagcaatagtaatt

SEQ ID NO: 12990 - DNA, 25 bp, Homo sapien
acactaaatgtcggtgaagatgttg

SEQ ID NO: 12991 - DNA, 25 bp, Homo sapien
acactaaatgttggtgaagatgttg

SEQ ID NO: 12992 - DNA, 25 bp, Homo sapien
acactaagaaattcactattcaaga

SEQ ID NO: 12993 - DNA, 25 bp, Homo sapien
acactaagaaatttactattcaaga

SEQ ID NO: 12994 - DNA, 25 bp, Homo sapien
acactaatacacggatcttgacgaa

SEQ ID NO: 12995 - DNA, 25 bp, Homo sapien
acactaatacatggatcttgacgaa

SEQ ID NO: 12996 - DNA, 25 bp, Homo sapien
acactaataggtgcgttgaagggat

SEQ ID NO: 12997 - DNA, 25 bp, Homo sapien
acactaataggtgtgttgaagggat

SEQ ID NO: 12998 - DNA, 25 bp, Homo sapien
acactaccacctcagtaaagctgtt

SEQ ID NO: 12999 - DNA, 25 bp, Homo sapien
acactaccgcctcagtaaagctgtt

SEQ ID NO: 13000 - DNA, 25 bp, Homo sapien
acactacgctctctgccatcccaaa

SEQ ID NO: 13001 - DNA, 25 bp, Homo sapien
acactacgctctgtgccatcccaaa

SEQ ID NO: 13002 - DNA, 25 bp, Homo sapien
acactactgctattcactttttgct

SEQ ID NO: 13003 - DNA, 25 bp, Homo sapien
acactacttctattcactttttgct

SEQ ID NO: 13004 - DNA, 25 bp, Homo sapien
acactagacgtgcctccaccctgaa

SEQ ID NO: 13005 - DNA, 25 bp, Homo sapien
acactagatgtgcctccaccctgaa

SEQ ID NO: 13006 - DNA, 25 bp, Homo sapien
acactagcagcgagaaagagtgaga

SEQ ID NO: 13007 - DNA, 25 bp, Homo sapien
acactagcaggtatatttggcatct

SEQ ID NO: 13008 - DNA, 25 bp, Homo sapien
acactagcatgtatatttggcatct

SEQ ID NO: 13009 - DNA, 25 bp, Homo sapien
acactagcggcgagaaagagtgaga

SEQ ID NO: 13010 - DNA, 25 bp, Homo sapien
acactagtataaagttgtacaggcc

SEQ ID NO: 13011 - DNA, 25 bp, Homo sapien
acactagtataacgttgtacaggcc

SEQ ID NO: 13012 - DNA, 25 bp, Homo sapien
acactagtatttaagacactatttg

SEQ ID NO: 13013 - DNA, 25 bp, Homo sapien
acactagtatttcagacactatttg

SEQ ID NO: 13014 - DNA, 25 bp, Homo sapien
acactataggaggcgctggaaatgt

SEQ ID NO: 13015 - DNA, 25 bp, Homo sapien
acactataggaggtgctggaaatgt

SEQ ID NO: 13016 - DNA, 25 bp, Homo sapien
acactatatataccagactctgtgc

SEQ ID NO: 13017 - DNA, 25 bp, Homo sapien
acactatatgtaccagactctgtgc

SEQ ID NO: 13018 - DNA, 25 bp, Homo sapien
acactatattatctttatgcagtat

SEQ ID NO: 13019 - DNA, 25 bp, Homo sapien
acactatattatctttgtgcagtat

SEQ ID NO: 13020 - DNA, 25 bp, Homo sapien
acactatccatagagaagtttgttt

SEQ ID NO: 13021 - DNA, 25 bp, Homo sapien
acactatccatagggaagtttgttt

SEQ ID NO: 13022 - DNA, 25 bp, Homo sapien
acactatgtcctcaatatccaattc

SEQ ID NO: 13023 - DNA, 25 bp, Homo sapien
acactatgtcctcagtatccaattc

SEQ ID NO: 13024 - DNA, 25 bp, Homo sapien
acactattctctaatgaaaaggatc

SEQ ID NO: 13025 - DNA, 25 bp, Homo sapien
acactattctcttatgaaaaggatc

SEQ ID NO: 13026 - DNA, 25 bp, Homo sapien
acactatttattgacgtaccagatg

SEQ ID NO: 13027 - DNA, 25 bp, Homo sapien
acactatttattgaggtaccagatg

SEQ ID NO: 13028 - DNA, 25 bp, Homo sapien
acactcaagaaatatacatccatca

SEQ ID NO: 13029 - DNA, 25 bp, Homo sapien
acactcaagaaatatatatccatca

SEQ ID NO: 13030 - DNA, 25 bp, Homo sapien
acactcaataaaacctgttaataac

SEQ ID NO: 13031 - DNA, 25 bp, Homo sapien
acactcaataaatcctgttaataac

SEQ ID NO: 13032 - DNA, 25 bp, Homo sapien
acactcagaagatatttccttgggt

SEQ ID NO: 13033 - DNA, 25 bp, Homo sapien
acactcagaaggtatttccttgggt

SEQ ID NO: 13034 - DNA, 25 bp, Homo sapien
acactcataagcctgcaaaaataag

SEQ ID NO: 13035 - DNA, 25 bp, Homo sapien
acactcataagcctgcgaaaataag

SEQ ID NO: 13036 - DNA, 25 bp, Homo sapien
acactcatttttaaaaaagcacaaa

SEQ ID NO: 13037 - DNA, 25 bp, Homo sapien
acactcattttttaaaaagcacaaa

SEQ ID NO: 13038 - DNA, 25 bp, Homo sapien
acactccaagaagctttatcttcta

SEQ ID NO: 13039 - DNA, 25 bp, Homo sapien
acactccaagaagttttatcttcta

SEQ ID NO: 13040 - DNA, 25 bp, Homo sapien
acactcctaacacggcaagaaagta

SEQ ID NO: 13041 - DNA, 25 bp, Homo sapien
acactcctaacatggcaagaaagta

SEQ ID NO: 13042 - DNA, 25 bp, Homo sapien
acactcctgactgccgggaccggga

SEQ ID NO: 13043 - DNA, 25 bp, Homo sapien
acactcctgactgctgggaccggga

SEQ ID NO: 13044 - DNA, 25 bp, Homo sapien
acactcggtaaagcacagtaaggca

SEQ ID NO: 13045 - DNA, 25 bp, Homo sapien
acactcggtgaagcacagtaaggca

SEQ ID NO: 13046 - DNA, 25 bp, Homo sapien
acactctcaatttcccagatttaaa

SEQ ID NO: 13047 - DNA, 25 bp, Homo sapien
acactctcagcaattccacttaaga

SEQ ID NO: 13048 - DNA, 25 bp, Homo sapien
acactctcagcacttccacttaaga

SEQ ID NO: 13049 - DNA, 25 bp, Homo sapien
acactctcaggacgctgcaagttgt

SEQ ID NO: 13050 - DNA, 25 bp, Homo sapien
acactctcaggatgctgcaagttgt

SEQ ID NO: 13051 - DNA, 25 bp, Homo sapien
acactctccatttcccagatttaaa

SEQ ID NO: 13052 - DNA, 25 bp, Homo sapien
acactctgagaaccactggtttgtt

SEQ ID NO: 13053 - DNA, 25 bp, Homo sapien
acactctgagaaccgctggtttgtt

SEQ ID NO: 13054 - DNA, 25 bp, Homo sapien
acactcttactaccatactcaaaat

SEQ ID NO: 13055 - DNA, 25 bp, Homo sapien
acactcttagtaccatactcaaaat

SEQ ID NO: 13056 - DNA, 25 bp, Homo sapien
acactcttcatgtaatttgtgtgtg

SEQ ID NO: 13057 - DNA, 25 bp, Homo sapien
acactcttcgtgtaatttgtgtgtg

SEQ ID NO: 13058 - DNA, 25 bp, Homo sapien
acactgaaaaccaaaactaagaaat

SEQ ID NO: 13059 - DNA, 25 bp, Homo sapien
acactgaaaaccagaactaagaaat

SEQ ID NO: 13060 - DNA, 25 bp, Homo sapien
acactgaaactaagtaatacttttc

SEQ ID NO: 13061 - DNA, 25 bp, Homo sapien
acactgaaattggtaaagatacatt

SEQ ID NO: 13062 - DNA, 25 bp, Homo sapien
acactgaaattggtgaagatacatt

SEQ ID NO: 13063 - DNA, 25 bp, Homo sapien
acactgaacagttcattcttacaag

SEQ ID NO: 13064 - DNA, 25 bp, Homo sapien
acactgaagagttcattcttacaag

SEQ ID NO: 13065 - DNA, 25 bp, Homo sapien
acactgaatctaagtaatacttttc

SEQ ID NO: 13066 - DNA, 25 bp, Homo sapien
acactgacattggtgctagactcca

SEQ ID NO: 13067 - DNA, 25 bp, Homo sapien
acactgacgttggtgctagactcca

SEQ ID NO: 13068 - DNA, 25 bp, Homo sapien
acactgagaaacgaggagcagtctt

SEQ ID NO: 13069 - DNA, 25 bp, Homo sapien
acactgagaaatgaggagcagtctt

SEQ ID NO: 13070 - DNA, 25 bp, Homo sapien
acactgaggaactgctgaccaaggg

SEQ ID NO: 13071 - DNA, 25 bp, Homo sapien
acactgaggaattgctgaccaaggg

SEQ ID NO: 13072 - DNA, 25 bp, Homo sapien
acactgatcaccaaatcttgactgt

SEQ ID NO: 13073 - DNA, 25 bp, Homo sapien
acactgatccaaaagccatttctag

SEQ ID NO: 13074 - DNA, 25 bp, Homo sapien
acactgatccagaagccatttctag

SEQ ID NO: 13075 - DNA, 25 bp, Homo sapien
acactgatgacaacgacgatgatga

SEQ ID NO: 13076 - DNA, 25 bp, Homo sapien
acactgatgacaacgatgatgatga

SEQ ID NO: 13077 - DNA, 25 bp, Homo sapien
acactgattaccaaatcttgactgt

SEQ ID NO: 13078 - DNA, 25 bp, Homo sapien
acactgcaacgatttaaggtatcaa

SEQ ID NO: 13079 - DNA, 25 bp, Homo sapien
acactgcaatgatttaaggtatcaa

SEQ ID NO: 13080 - DNA, 25 bp, Homo sapien
acactgcacaccatcttcctgaaca

SEQ ID NO: 13081 - DNA, 25 bp, Homo sapien
acactgcacactcgtgaaacagttc

SEQ ID NO: 13082 - DNA, 25 bp, Homo sapien
acactgcacacttgtgaaacagttc

SEQ ID NO: 13083 - DNA, 25 bp, Homo sapien
acactgcacgccatcttcctgaaca

SEQ ID NO: 13084 - DNA, 25 bp, Homo sapien
acactgcagtgtcatgaccttagct

SEQ ID NO: 13085 - DNA, 25 bp, Homo sapien
acactgcagtgtcatgcccttagct

SEQ ID NO: 13086 - DNA, 25 bp, Homo sapien
acactgcgtaacagcaaaccacttc

SEQ ID NO: 13087 - DNA, 25 bp, Homo sapien
acactgcgtaacagtaaaccacttc

SEQ ID NO: 13088 - DNA, 25 bp, Homo sapien
acactgctaactctagctaaccatc

SEQ ID NO: 13089 - DNA, 25 bp, Homo sapien
acactgctaactctggctaaccatc

SEQ ID NO: 13090 - DNA, 25 bp, Homo sapien
acactgctcctcaggcgggtggtgc

SEQ ID NO: 13091 - DNA, 25 bp, Homo sapien
acactgctcctcgggcgggtggtgc

SEQ ID NO: 13092 - DNA, 25 bp, Homo sapien
acactgctgtaaaaagcgagttaag

SEQ ID NO: 13093 - DNA, 25 bp, Homo sapien
acactgctgtaaaaagtgagttaag

SEQ ID NO: 13094 - DNA, 25 bp, Homo sapien
acactgctttggttcacataagtga

SEQ ID NO: 13095 - DNA, 25 bp, Homo sapien
acactgctttgtttcacataagtga

SEQ ID NO: 13096 - DNA, 25 bp, Homo sapien
acactggagaccgaaaccatgatga

SEQ ID NO: 13097 - DNA, 25 bp, Homo sapien
acactggagactgaaaccatgatga

SEQ ID NO: 13098 - DNA, 25 bp, Homo sapien
acactggcacaacatacattgcaaa

SEQ ID NO: 13099 - DNA, 25 bp, Homo sapien
acactggcacaccatacattgcaaa

SEQ ID NO: 13100 - DNA, 25 bp, Homo sapien
acactggttttgcgggagcaggatt

SEQ ID NO: 13101 - DNA, 25 bp, Homo sapien
acactggttttgtgggagcaggatt

SEQ ID NO: 13102 - DNA, 25 bp, Homo sapien
acactgtaataacgtcactaaagct

SEQ ID NO: 13103 - DNA, 25 bp, Homo sapien
acactgtaataaggtcactaaagct

SEQ ID NO: 13104 - DNA, 25 bp, Homo sapien
acactgtacattcaatgttttttgg

SEQ ID NO: 13105 - DNA, 25 bp, Homo sapien
acactgtacattcattgttttttgg

SEQ ID NO: 13106 - DNA, 25 bp, Homo sapien
acactgtgaaacgctgccaagaaga

SEQ ID NO: 13107 - DNA, 25 bp, Homo sapien
acactgtgaaatgctgccaagaaga

SEQ ID NO: 13108 - DNA, 25 bp, Homo sapien
acactgtgctcaatatttactgttg

SEQ ID NO: 13109 - DNA, 25 bp, Homo sapien
acactgtgctcagtatttactgttg

SEQ ID NO: 13110 - DNA, 25 bp, Homo sapien
acactgtggcaacttcagaaatcag

SEQ ID NO: 13111 - DNA, 25 bp, Homo sapien
acactgtggcagcttcagaaatcag

SEQ ID NO: 13112 - DNA, 25 bp, Homo sapien
acactgtgggcccttaatacttatg

SEQ ID NO: 13113 - DNA, 25 bp, Homo sapien
acactgtgggcccttactacttatg

SEQ ID NO: 13114 - DNA, 25 bp, Homo sapien
acactgtttcgttccacacggtatc

SEQ ID NO: 13115 - DNA, 25 bp, Homo sapien
acactgtttggttccacacggtatc

SEQ ID NO: 13116 - DNA, 25 bp, Homo sapien
acacttaagtacaccattgacgcca

SEQ ID NO: 13117 - DNA, 25 bp, Homo sapien
acacttaagtataccattgacgcca

SEQ ID NO: 13118 - DNA, 25 bp, Homo sapien
acacttaccatttatcatttttgag

SEQ ID NO: 13119 - DNA, 25 bp, Homo sapien
acacttaccgtttatcatttttgag

SEQ ID NO: 13120 - DNA, 25 bp, Homo sapien
acacttacctggggatgtaaagact

SEQ ID NO: 13121 - DNA, 25 bp, Homo sapien
acacttacctgggtatgtaaagact

SEQ ID NO: 13122 - DNA, 25 bp, Homo sapien
acacttactccatatggttgaatat

SEQ ID NO: 13123 - DNA, 25 bp, Homo sapien
acacttactgcatatggttgaatat

SEQ ID NO: 13124 - DNA, 25 bp, Homo sapien
acacttagaaaaattgtgagcaaat

SEQ ID NO: 13125 - DNA, 25 bp, Homo sapien
acacttagaagagaccatatatgat

SEQ ID NO: 13126 - DNA, 25 bp, Homo sapien
acacttagaagaggccatatatgat

SEQ ID NO: 13127 - DNA, 25 bp, Homo sapien
acacttagataaattgtgagcaaat

SEQ ID NO: 13128 - DNA, 25 bp, Homo sapien
acacttatagtaaacattttctgtt

SEQ ID NO: 13129 - DNA, 25 bp, Homo sapien
acacttatattaaacattttctgtt

SEQ ID NO: 13130 - DNA, 25 bp, Homo sapien
acacttatgccagctcttgaggcag

SEQ ID NO: 13131 - DNA, 25 bp, Homo sapien
acacttatgtcagctcttgaggcag

SEQ ID NO: 13132 - DNA, 25 bp, Homo sapien
acacttcatacagagagtttggatg

SEQ ID NO: 13133 - DNA, 25 bp, Homo sapien
acacttcatacggagagtttggatg

SEQ ID NO: 13134 - DNA, 25 bp, Homo sapien
acacttctgtattaaaatcacaaga

SEQ ID NO: 13135 - DNA, 25 bp, Homo sapien
acacttctgtattaaagtcacaaga

SEQ ID NO: 13136 - DNA, 25 bp, Homo sapien
acacttgatttggaaacactgatgg

SEQ ID NO: 13137 - DNA, 25 bp, Homo sapien
acacttgatttggaaatactgatgg

SEQ ID NO: 13138 - DNA, 25 bp, Homo sapien
acacttgctgttgtctctgtgcatt

SEQ ID NO: 13139 - DNA, 25 bp, Homo sapien
acacttgcttcattgagcaggcaca

SEQ ID NO: 13140 - DNA, 25 bp, Homo sapien
acacttgcttcattgatcaggcaca

SEQ ID NO: 13141 - DNA, 25 bp, Homo sapien
acacttgcttttgtctctgtgcatt

SEQ ID NO: 13142 - DNA, 25 bp, Homo sapien
acacttgggtctccttccaaagccc

SEQ ID NO: 13143 - DNA, 25 bp, Homo sapien
acacttggttctccttccaaagccc

SEQ ID NO: 13144 - DNA, 25 bp, Homo sapien
acacttgttaccctaacactactct

SEQ ID NO: 13145 - DNA, 25 bp, Homo sapien
acacttgtttccctaacactactct

SEQ ID NO: 13146 - DNA, 25 bp, Homo sapien
acactttacccataatttccaggtg

SEQ ID NO: 13147 - DNA, 25 bp, Homo sapien
acactttacccgtaatttccaggtg

SEQ ID NO: 13148 - DNA, 25 bp, Homo sapien
acactttcattactgagatctctgc

SEQ ID NO: 13149 - DNA, 25 bp, Homo sapien
acactttctttactgagatctctgc

SEQ ID NO: 13150 - DNA, 25 bp, Homo sapien
acactttgaaaacccaaggcaggag

SEQ ID NO: 13151 - DNA, 25 bp, Homo sapien
acactttggaaacccaaggcaggag

SEQ ID NO: 13152 - DNA, 25 bp, Homo sapien
acactttggaacactgtggaaagcc

SEQ ID NO: 13153 - DNA, 25 bp, Homo sapien
acactttggaactctgtggaaagcc

SEQ ID NO: 13154 - DNA, 25 bp, Homo sapien
acacttttattcgggtacttgttgc

SEQ ID NO: 13155 - DNA, 25 bp, Homo sapien
acacttttattcgggtgcttgttgc

SEQ ID NO: 13156 - DNA, 25 bp, Homo sapien
acacttttcgtaaggaatgagacac

SEQ ID NO: 13157 - DNA, 25 bp, Homo sapien
acacttttcttaaggaatgagacac

SEQ ID NO: 13158 - DNA, 25 bp, Homo sapien
acacttttcttctgggaaatgctac

SEQ ID NO: 13159 - DNA, 25 bp, Homo sapien
acacttttcttctgtgaaatgctac

SEQ ID NO: 13160 - DNA, 25 bp, Homo sapien
acactttttaaatgaagtttcacaa

SEQ ID NO: 13161 - DNA, 25 bp, Homo sapien
acacttttttaatgaagtttcacaa

SEQ ID NO: 13162 - DNA, 25 bp, Homo sapien
acacttttttggttcaagttgattt

SEQ ID NO: 13163 - DNA, 25 bp, Homo sapien
acacttttttgtttcaagttgattt

SEQ ID NO: 13164 - DNA, 25 bp, Homo sapien
acagaaaaacgccaggacccaagag

SEQ ID NO: 13165 - DNA, 25 bp, Homo sapien
acagaaaaatgccaggacccaagag

SEQ ID NO: 13166 - DNA, 25 bp, Homo sapien
acagaaaacactagtcagccatctt

SEQ ID NO: 13167 - DNA, 25 bp, Homo sapien
acagaaaacagtaagaaatcaatga

SEQ ID NO: 13168 - DNA, 25 bp, Homo sapien
acagaaaacgctagtcagccatctt

SEQ ID NO: 13169 - DNA, 25 bp, Homo sapien
acagaaaagaaatgcttgtgttaca

SEQ ID NO: 13170 - DNA, 25 bp, Homo sapien
acagaaaagaactgcttgtgttaca

SEQ ID NO: 13171 - DNA, 25 bp, Homo sapien
acagaaaagcacggttggctgtagc

SEQ ID NO: 13172 - DNA, 25 bp, Homo sapien
acagaaaagcactgttggctgtagc

SEQ ID NO: 13173 - DNA, 25 bp, Homo sapien
acagaaaagcccagtattacttggt

SEQ ID NO: 13174 - DNA, 25 bp, Homo sapien
acagaaaagctcttgtgagggaaaa

SEQ ID NO: 13175 - DNA, 25 bp, Homo sapien
acagaaaatagtaagaaatcaatga

SEQ ID NO: 13176 - DNA, 25 bp, Homo sapien
acagaaaatcccagtattacttggt

SEQ ID NO: 13177 - DNA, 25 bp, Homo sapien
acagaaaatctcttgtgagggaaaa

SEQ ID NO: 13178 - DNA, 25 bp, Homo sapien
acagaaaatggacatttgttagttt

SEQ ID NO: 13179 - DNA, 25 bp, Homo sapien
acagaaaattgacatttgttagttt

SEQ ID NO: 13180 - DNA, 25 bp, Homo sapien
acagaaacaaagcaaaagtatctat

SEQ ID NO: 13181 - DNA, 25 bp, Homo sapien
acagaaacaaaggaaaagtatctat

SEQ ID NO: 13182 - DNA, 25 bp, Homo sapien
acagaaacaatacgtgcaactccaa

SEQ ID NO: 13183 - DNA, 25 bp, Homo sapien
acagaaacaatatgtgcaactccaa

SEQ ID NO: 13184 - DNA, 25 bp, Homo sapien
acagaaacagggcagcacaagaaca

SEQ ID NO: 13185 - DNA, 25 bp, Homo sapien
acagaaaccataaataggaaaagca

SEQ ID NO: 13186 - DNA, 25 bp, Homo sapien
acagaaaccatgaataggaaaagca

SEQ ID NO: 13187 - DNA, 25 bp, Homo sapien
acagaaacggggcagcacaagaaca

SEQ ID NO: 13188 - DNA, 25 bp, Homo sapien
acagaaaggcgttgcttacatttct

SEQ ID NO: 13189 - DNA, 25 bp, Homo sapien
acagaaaggtgttgcttacatttct

SEQ ID NO: 13190 - DNA, 25 bp, Homo sapien
acagaaagtaggtctgagcagtgaa

SEQ ID NO: 13191 - DNA, 25 bp, Homo sapien
acagaaagtaggtttgagcagtgaa

SEQ ID NO: 13192 - DNA, 25 bp, Homo sapien
acagaaattctcattaaagtcaaga

SEQ ID NO: 13193 - DNA, 25 bp, Homo sapien
acagaaattctcattacagtcaaga

SEQ ID NO: 13194 - DNA, 25 bp, Homo sapien
acagaaatttggggaagttgataaa

SEQ ID NO: 13195 - DNA, 25 bp, Homo sapien
acagaaatttgggtaagttgataaa

SEQ ID NO: 13196 - DNA, 25 bp, Homo sapien
acagaacaaaaacagagaaaaggca

SEQ ID NO: 13197 - DNA, 25 bp, Homo sapien
acagaacaaaaatagagaaaaggca

SEQ ID NO: 13198 - DNA, 25 bp, Homo sapien
acagaaccacgagctaattaatggt

SEQ ID NO: 13199 - DNA, 25 bp, Homo sapien
acagaaccatgagctaattaatggt

SEQ ID NO: 13200 - DNA, 25 bp, Homo sapien
acagaacctggagaatgaaggtgga

SEQ ID NO: 13201 - DNA, 25 bp, Homo sapien
acagaacctggcgaatgaaggtgga

SEQ ID NO: 13202 - DNA, 25 bp, Homo sapien
acagaacgacgcagttgaaggagga

SEQ ID NO: 13203 - DNA, 25 bp, Homo sapien
acagaacgatgcagttgaaggagga

SEQ ID NO: 13204 - DNA, 25 bp, Homo sapien
acagaacgcatagaacagttgtgag

SEQ ID NO: 13205 - DNA, 25 bp, Homo sapien
acagaacgcatataacagttgtgag

SEQ ID NO: 13206 - DNA, 25 bp, Homo sapien
acagaactaaattatgattatatct

SEQ ID NO: 13207 - DNA, 25 bp, Homo sapien
acagaactaaattctgattatatct

SEQ ID NO: 13208 - DNA, 25 bp, Homo sapien
acagaactatagggtgcctttcatt

SEQ ID NO: 13209 - DNA, 25 bp, Homo sapien
acagaactatagtgtgcctttcatt

SEQ ID NO: 13210 - DNA, 25 bp, Homo sapien
acagaactgatgaaaccaggaattg

SEQ ID NO: 13211 - DNA, 25 bp, Homo sapien
acagaactgatgaaactaggaattg

SEQ ID NO: 13212 - DNA, 25 bp, Homo sapien
acagaactgggatccaaggaccgta

SEQ ID NO: 13213 - DNA, 25 bp, Homo sapien
acagaactgggatccagggaccgta

SEQ ID NO: 13214 - DNA, 25 bp, Homo sapien
acagaagaacaaccacagatgcaag

SEQ ID NO: 13215 - DNA, 25 bp, Homo sapien
acagaagaacaactacagatgcaag

SEQ ID NO: 13216 - DNA, 25 bp, Homo sapien
acagaagaagagagaagtcagggta

SEQ ID NO: 13217 - DNA, 25 bp, Homo sapien
acagaagaagagggaagtcagggta

SEQ ID NO: 13218 - DNA, 25 bp, Homo sapien
acagaagaaggcatccttgaagtcc

SEQ ID NO: 13219 - DNA, 25 bp, Homo sapien
acagaagaaggcgtccttgaagtcc

SEQ ID NO: 13220 - DNA, 25 bp, Homo sapien
acagaagcagagcatggtatcccca

SEQ ID NO: 13221 - DNA, 25 bp, Homo sapien
acagaagcagaggatggtatcccca

SEQ ID NO: 13222 - DNA, 25 bp, Homo sapien
acagaagcccaagatcaagctgcca

SEQ ID NO: 13223 - DNA, 25 bp, Homo sapien
acagaagcctaagatcaagctgcca

SEQ ID NO: 13224 - DNA, 25 bp, Homo sapien
acagaagcgggtagatctgctggag

SEQ ID NO: 13225 - DNA, 25 bp, Homo sapien
acagaagcgtgtagatctgctggag

SEQ ID NO: 13226 - DNA, 25 bp, Homo sapien
acagaagctactgaaaaactgattt

SEQ ID NO: 13227 - DNA, 25 bp, Homo sapien
acagaagctactgaaacactgattt

SEQ ID NO: 13228 - DNA, 25 bp, Homo sapien
acagaagctccgcaagaaacatgac

SEQ ID NO: 13229 - DNA, 25 bp, Homo sapien
acagaagcttcgcaagaaacatgac

SEQ ID NO: 13230 - DNA, 25 bp, Homo sapien
acagaaggaccctttagactcttgg

SEQ ID NO: 13231 - DNA, 25 bp, Homo sapien
acagaaggaccttttagactcttgg

SEQ ID NO: 13232 - DNA, 25 bp, Homo sapien
acagaagtgaccagacccaggagtc

SEQ ID NO: 13233 - DNA, 25 bp, Homo sapien
acagaagtgaccggacccaggagtc

SEQ ID NO: 13234 - DNA, 25 bp, Homo sapien
acagaagtggatgagcagtaaaatg

SEQ ID NO: 13235 - DNA, 25 bp, Homo sapien
acagaagtggatgtgcagtaaaatg

SEQ ID NO: 13236 - DNA, 25 bp, Homo sapien
acagaagtgtgacctaaaccggtga

SEQ ID NO: 13237 - DNA, 25 bp, Homo sapien
acagaagtgtgagctaaaccggtga

SEQ ID NO: 13238 - DNA, 25 bp, Homo sapien
acagaagtttgatttttaaaatgct

SEQ ID NO: 13239 - DNA, 25 bp, Homo sapien
acagaagtttgttttttaaaatgct

SEQ ID NO: 13240 - DNA, 25 bp, Homo sapien
acagaataaggcagcacaagcttgg

SEQ ID NO: 13241 - DNA, 25 bp, Homo sapien
acagaataaggcagcagaagcttgg

SEQ ID NO: 13242 - DNA, 25 bp, Homo sapien
acagaatagatgtattagcaggcat

SEQ ID NO: 13243 - DNA, 25 bp, Homo sapien
acagaatagatgtgttagcaggcat

SEQ ID NO: 13244 - DNA, 25 bp, Homo sapien
acagaatccataagcgattaagtgg

SEQ ID NO: 13245 - DNA, 25 bp, Homo sapien
acagaatccataagtgattaagtgg

SEQ ID NO: 13246 - DNA, 25 bp, Homo sapien
acagaatcctttagaacatgatgaa

SEQ ID NO: 13247 - DNA, 25 bp, Homo sapien
acagaatcctttagaatatgatgaa

SEQ ID NO: 13248 - DNA, 25 bp, Homo sapien
acagaatgacatggataaatctcaa

SEQ ID NO: 13249 - DNA, 25 bp, Homo sapien
acagaatgacatggttaaatctcaa

SEQ ID NO: 13250 - DNA, 25 bp, Homo sapien
acagaatgagccagggcctagagga

SEQ ID NO: 13251 - DNA, 25 bp, Homo sapien
acagaatgagcgagggcctagagga

SEQ ID NO: 13252 - DNA, 25 bp, Homo sapien
acagaattctaaaaaaagttcaagt

SEQ ID NO: 13253 - DNA, 25 bp, Homo sapien
acagaattctaaaaaacgttcaagt

SEQ ID NO: 13254 - DNA, 25 bp, Homo sapien
acagaattggaatttagtctcagtg

SEQ ID NO: 13255 - DNA, 25 bp, Homo sapien
acagaattggagtttagtctcagtg

SEQ ID NO: 13256 - DNA, 25 bp, Homo sapien
acagaattgtaatcatgcagaaatg

SEQ ID NO: 13257 - DNA, 25 bp, Homo sapien
acagaatttacactggagcctaagt

SEQ ID NO: 13258 - DNA, 25 bp, Homo sapien
acagaatttacattggagcctaagt

SEQ ID NO: 13259 - DNA, 25 bp, Homo sapien
acagaattttaatcatgcagaaatg

SEQ ID NO: 13260 - DNA, 25 bp, Homo sapien
acagacaactgtacgctaacagaaa

SEQ ID NO: 13261 - DNA, 25 bp, Homo sapien
acagacaactgtatgctaacagaaa

SEQ ID NO: 13262 - DNA, 25 bp, Homo sapien
acagacaactgttgcattcctgtcc

SEQ ID NO: 13263 - DNA, 25 bp, Homo sapien
acagacaagtgttgcattcctgtcc

SEQ ID NO: 13264 - DNA, 25 bp, Homo sapien
acagacaatcgttatcttgctatgt

SEQ ID NO: 13265 - DNA, 25 bp, Homo sapien
acagacaatgtataaaccatttggg

SEQ ID NO: 13266 - DNA, 25 bp, Homo sapien
acagacaatgtatagaccatttggg

SEQ ID NO: 13267 - DNA, 25 bp, Homo sapien
acagacaattgttatcttgctatgt

SEQ ID NO: 13268 - DNA, 25 bp, Homo sapien
acagacaatttgcaaaagaagatat

SEQ ID NO: 13269 - DNA, 25 bp, Homo sapien
acagacaatttgcgaaagaagatat

SEQ ID NO: 13270 - DNA, 25 bp, Homo sapien
acagacacccaaacagccagttgtt

SEQ ID NO: 13271 - DNA, 25 bp, Homo sapien
acagacacccaaatagccagttgtt

SEQ ID NO: 13272 - DNA, 25 bp, Homo sapien
acagacactaactggtacagatcag

SEQ ID NO: 13273 - DNA, 25 bp, Homo sapien
acagacactaagtggtacagatcag

SEQ ID NO: 13274 - DNA, 25 bp, Homo sapien
acagacactgaggattgttccctgt

SEQ ID NO: 13275 - DNA, 25 bp, Homo sapien
acagacactgagtattgttccctgt

SEQ ID NO: 13276 - DNA, 25 bp, Homo sapien
acagacagaacaaaaacagagaaaa

SEQ ID NO: 13277 - DNA, 25 bp, Homo sapien
acagacagaacaaaaatagagaaaa

SEQ ID NO: 13278 - DNA, 25 bp, Homo sapien
acagacagagagttaatccagggta

SEQ ID NO: 13279 - DNA, 25 bp, Homo sapien
acagacagagatttaatccagggta

SEQ ID NO: 13280 - DNA, 25 bp, Homo sapien
acagacagcagaaactgtatcttgc

SEQ ID NO: 13281 - DNA, 25 bp, Homo sapien
acagacagcggaaactgtatcttgc

SEQ ID NO: 13282 - DNA, 25 bp, Homo sapien
acagacagtatctatcaacagggca

SEQ ID NO: 13283 - DNA, 25 bp, Homo sapien
acagacagtatttatcaacagggca

SEQ ID NO: 13284 - DNA, 25 bp, Homo sapien
acagacataatcaacagttagccag

SEQ ID NO: 13285 - DNA, 25 bp, Homo sapien
acagacatagaagaaacaccctatt

SEQ ID NO: 13286 - DNA, 25 bp, Homo sapien
acagacatcatcaacagttagccag

SEQ ID NO: 13287 - DNA, 25 bp, Homo sapien
acagacatggaagaaacaccctatt

SEQ ID NO: 13288 - DNA, 25 bp, Homo sapien
acagaccaagtgattccaattcttt

SEQ ID NO: 13289 - DNA, 25 bp, Homo sapien
acagaccaagtgattctaattcttt

SEQ ID NO: 13290 - DNA, 25 bp, Homo sapien
acagaccattccgcgtcagttggtg

SEQ ID NO: 13291 - DNA, 25 bp, Homo sapien
acagaccattccgtgtcagttggtg

SEQ ID NO: 13292 - DNA, 25 bp, Homo sapien
acagacccagtcattgaagcaagca

SEQ ID NO: 13293 - DNA, 25 bp, Homo sapien
acagacccagtcgttgaagcaagca

SEQ ID NO: 13294 - DNA, 25 bp, Homo sapien
acagacccgataatcctcagaagac

SEQ ID NO: 13295 - DNA, 25 bp, Homo sapien
acagaccctataatcctcagaagac

SEQ ID NO: 13296 - DNA, 25 bp, Homo sapien
acagacctagtcccgattcttgctt

SEQ ID NO: 13297 - DNA, 25 bp, Homo sapien
acagacctagtcctgattcttgctt

SEQ ID NO: 13298 - DNA, 25 bp, Homo sapien
acagacctgggtcgcaacgtgccct

SEQ ID NO: 13299 - DNA, 25 bp, Homo sapien
acagacctgggttgcaacgtgccct

SEQ ID NO: 13300 - DNA, 25 bp, Homo sapien
acagaccttcacacttatacagcaa

SEQ ID NO: 13301 - DNA, 25 bp, Homo sapien
acagaccttcacatttatacagcaa

SEQ ID NO: 13302 - DNA, 25 bp, Homo sapien
acagactacataattgaagagttta

SEQ ID NO: 13303 - DNA, 25 bp, Homo sapien
acagactacgtaattgaagagttta

SEQ ID NO: 13304 - DNA, 25 bp, Homo sapien
acagactccatcttggctctttcac

SEQ ID NO: 13305 - DNA, 25 bp, Homo sapien
acagactccatgttggctctttcac

SEQ ID NO: 13306 - DNA, 25 bp, Homo sapien
acagactctatgaaaaaaaaatata

SEQ ID NO: 13307 - DNA, 25 bp, Homo sapien
acagactctatgagaaaaaaatata

SEQ ID NO: 13308 - DNA, 25 bp, Homo sapien
acagactggaaaactcttaattcat

SEQ ID NO: 13309 - DNA, 25 bp, Homo sapien
acagactgggaaactcttaattcat

SEQ ID NO: 13310 - DNA, 25 bp, Homo sapien
acagactgtgacgactacaataaat

SEQ ID NO: 13311 - DNA, 25 bp, Homo sapien
acagactgtgatgactacaataaat

SEQ ID NO: 13312 - DNA, 25 bp, Homo sapien
acagacttccaaaacatcccctgtg

SEQ ID NO: 13313 - DNA, 25 bp, Homo sapien
acagacttccaaaagatcccctgtg

SEQ ID NO: 13314 - DNA, 25 bp, Homo sapien
acagacttggtcattaaggttattg

SEQ ID NO: 13315 - DNA, 25 bp, Homo sapien
acagacttggtcgttaaggttattg

SEQ ID NO: 13316 - DNA, 25 bp, Homo sapien
acagagaaacaatcctaaactgctg

SEQ ID NO: 13317 - DNA, 25 bp, Homo sapien
acagagaaacaatcttaaactgctg

SEQ ID NO: 13318 - DNA, 25 bp, Homo sapien
acagagaaagagaaaatgtgacagt

SEQ ID NO: 13319 - DNA, 25 bp, Homo sapien
acagagaaagataaaatgtgacagt

SEQ ID NO: 13320 - DNA, 25 bp, Homo sapien
acagagaacaatccatctcatggag

SEQ ID NO: 13321 - DNA, 25 bp, Homo sapien
acagagaacaatccatttcatggag

SEQ ID NO: 13322 - DNA, 25 bp, Homo sapien
acagagaatctcatttcttgactaa

SEQ ID NO: 13323 - DNA, 25 bp, Homo sapien
acagagaatctcgtttcttgactaa

SEQ ID NO: 13324 - DNA, 25 bp, Homo sapien
acagagaccgtgtggcctgccaaaa

SEQ ID NO: 13325 - DNA, 25 bp, Homo sapien
acagagacggtgtggcctgccaaaa

SEQ ID NO: 13326 - DNA, 25 bp, Homo sapien
acagagattagatcaccaatattag

SEQ ID NO: 13327 - DNA, 25 bp, Homo sapien
acagagattagttcaccaatattag

SEQ ID NO: 13328 - DNA, 25 bp, Homo sapien
acagagccaccttgaagcacagcca

SEQ ID NO: 13329 - DNA, 25 bp, Homo sapien
acagagccatcttgaagcacagcca

SEQ ID NO: 13330 - DNA, 25 bp, Homo sapien
acagagcggcgctgccaccacagca

SEQ ID NO: 13331 - DNA, 25 bp, Homo sapien
acagagcggtgctgccaccacagca

SEQ ID NO: 13332 - DNA, 25 bp, Homo sapien
acagaggaaactctaatattctttc

SEQ ID NO: 13333 - DNA, 25 bp, Homo sapien
acagaggaacattgtccaactcttt

SEQ ID NO: 13334 - DNA, 25 bp, Homo sapien
acagaggaacattttccaactcttt

SEQ ID NO: 13335 - DNA, 25 bp, Homo sapien
acagaggaagctctaatattctttc

SEQ ID NO: 13336 - DNA, 25 bp, Homo sapien
acagaggaggagactttggtagtca

SEQ ID NO: 13337 - DNA, 25 bp, Homo sapien
acagaggaggaggctttggtagtca

SEQ ID NO: 13338 - DNA, 25 bp, Homo sapien
acagaggataaacaggacagtgata

SEQ ID NO: 13339 - DNA, 25 bp, Homo sapien
acagaggataaataggacagtgata

SEQ ID NO: 13340 - DNA, 25 bp, Homo sapien
acagaggatcacattctagttttgc

SEQ ID NO: 13341 - DNA, 25 bp, Homo sapien
acagaggatcagattctagttttgc

SEQ ID NO: 13342 - DNA, 25 bp, Homo sapien
acagaggatttttccttgcacttta

SEQ ID NO: 13343 - DNA, 25 bp, Homo sapien
acagaggatttttctttgcacttta

SEQ ID NO: 13344 - DNA, 25 bp, Homo sapien
acagaggcacgctgatcaggaatga

SEQ ID NO: 13345 - DNA, 25 bp, Homo sapien
acagaggcatgctgatcaggaatga

SEQ ID NO: 13346 - DNA, 25 bp, Homo sapien
acagaggccattgccatgttcagct

SEQ ID NO: 13347 - DNA, 25 bp, Homo sapien
acagaggccattgctatgttcagct

SEQ ID NO: 13348 - DNA, 25 bp, Homo sapien
acagaggctcctctctactcaggct

SEQ ID NO: 13349 - DNA, 25 bp, Homo sapien
acagaggcttcaaacgactggttta

SEQ ID NO: 13350 - DNA, 25 bp, Homo sapien
acagaggcttcaaatgactggttta

SEQ ID NO: 13351 - DNA, 25 bp, Homo sapien
acagaggcttctctctactcaggct

SEQ ID NO: 13352 - DNA, 25 bp, Homo sapien
acagagggaccgaaagactctcaca

SEQ ID NO: 13353 - DNA, 25 bp, Homo sapien
acagagggagctgcaaccaatggtc

SEQ ID NO: 13354 - DNA, 25 bp, Homo sapien
acagagggagctgcgaccaatggtc

SEQ ID NO: 13355 - DNA, 25 bp, Homo sapien
acagagggaggtttacaaatgcaaa

SEQ ID NO: 13356 - DNA, 25 bp, Homo sapien
acagagggatgtttacaaatgcaaa

SEQ ID NO: 13357 - DNA, 25 bp, Homo sapien
acagagggcttctcaagtataaaac

SEQ ID NO: 13358 - DNA, 25 bp, Homo sapien
acagagggcttgtcaagtataaaac

SEQ ID NO: 13359 - DNA, 25 bp, Homo sapien
acagagggtccgaaagactctcaca

SEQ ID NO: 13360 - DNA, 25 bp, Homo sapien
acagagtacgactcccttattcatc

SEQ ID NO: 13361 - DNA, 25 bp, Homo sapien
acagagtagccttgtgtttactttg

SEQ ID NO: 13362 - DNA, 25 bp, Homo sapien
acagagtaggcttgtgtttactttg

SEQ ID NO: 13363 - DNA, 25 bp, Homo sapien
acagagtatgactcccttattcatc

SEQ ID NO: 13364 - DNA, 25 bp, Homo sapien
acagagttatcaaaatgaatgctac

SEQ ID NO: 13365 - DNA, 25 bp, Homo sapien
acagagttatcaagatgaatgctac

SEQ ID NO: 13366 - DNA, 25 bp, Homo sapien
acagagttcacagtattcatattta

SEQ ID NO: 13367 - DNA, 25 bp, Homo sapien
acagagttcacggtattcatattta

SEQ ID NO: 13368 - DNA, 25 bp, Homo sapien
acagataaacagggaggaaatgaca

SEQ ID NO: 13369 - DNA, 25 bp, Homo sapien
acagataaaccatagagaaaattaa

SEQ ID NO: 13370 - DNA, 25 bp, Homo sapien
acagataaaccatggagaaaattaa

SEQ ID NO: 13371 - DNA, 25 bp, Homo sapien
acagataaacttaccattagaagta

SEQ ID NO: 13372 - DNA, 25 bp, Homo sapien
acagataaagagggaggaaatgaca

SEQ ID NO: 13373 - DNA, 25 bp, Homo sapien
acagataaatgatcaataacagtgt

SEQ ID NO: 13374 - DNA, 25 bp, Homo sapien
acagataaatgattaataacagtgt

SEQ ID NO: 13375 - DNA, 25 bp, Homo sapien
acagataagcttaccattagaagta

SEQ ID NO: 13376 - DNA, 25 bp, Homo sapien
acagataatccactgctgtgttttc

SEQ ID NO: 13377 - DNA, 25 bp, Homo sapien
acagataatccgctgctgtgttttc

SEQ ID NO: 13378 - DNA, 25 bp, Homo sapien
acagataggcaatggtatgaaagtt

SEQ ID NO: 13379 - DNA, 25 bp, Homo sapien
acagataggcaatggtgtgaaagtt

SEQ ID NO: 13380 - DNA, 25 bp, Homo sapien
acagatatagtcaaatgtttgtctc

SEQ ID NO: 13381 - DNA, 25 bp, Homo sapien
acagatatattcaaatgtttgtctc

SEQ ID NO: 13382 - DNA, 25 bp, Homo sapien
acagatcaaagaacaactgaatgga

SEQ ID NO: 13383 - DNA, 25 bp, Homo sapien
acagatcaaagaaccactgaatgga

SEQ ID NO: 13384 - DNA, 25 bp, Homo sapien
acagatcaatatccctacatggaac

SEQ ID NO: 13385 - DNA, 25 bp, Homo sapien
acagatcaatatccctgcatggaac

SEQ ID NO: 13386 - DNA, 25 bp, Homo sapien
acagatcacatatcggcagagaacg

SEQ ID NO: 13387 - DNA, 25 bp, Homo sapien
acagatcatatatcggcagagaacg

SEQ ID NO: 13388 - DNA, 25 bp, Homo sapien
acagatcccgaataaagggtatgct

SEQ ID NO: 13389 - DNA, 25 bp, Homo sapien
acagatcctgaataaagggtatgct

SEQ ID NO: 13390 - DNA, 25 bp, Homo sapien
acagatctactcaaacaagaaagcc

SEQ ID NO: 13391 - DNA, 25 bp, Homo sapien
acagatctactcgaacaagaaagcc

SEQ ID NO: 13392 - DNA, 25 bp, Homo sapien
acagatcttaaagtggctgagcaat

SEQ ID NO: 13393 - DNA, 25 bp, Homo sapien
acagatcttcaagtggctgagcaat

SEQ ID NO: 13394 - DNA, 25 bp, Homo sapien
acagatcttgcaagcactcactcgc

SEQ ID NO: 13395 - DNA, 25 bp, Homo sapien
acagatcttgcgagcactcactcgc

SEQ ID NO: 13396 - DNA, 25 bp, Homo sapien
acagatgaaagctatccctaaacca

SEQ ID NO: 13397 - DNA, 25 bp, Homo sapien
acagatgaagactcttagtgcatga

SEQ ID NO: 13398 - DNA, 25 bp, Homo sapien
acagatgaagactcttcgtgcatga

SEQ ID NO: 13399 - DNA, 25 bp, Homo sapien
acagatgaaggctatccctaaacca

SEQ ID NO: 13400 - DNA, 25 bp, Homo sapien
acagatgacaaagaacaccattgta

SEQ ID NO: 13401 - DNA, 25 bp, Homo sapien
acagatgacaaagaactccattgta

SEQ ID NO: 13402 - DNA, 25 bp, Homo sapien
acagatgataagaaacatttgagat

SEQ ID NO: 13403 - DNA, 25 bp, Homo sapien
acagatgataaggaacatttgagat

SEQ ID NO: 13404 - DNA, 25 bp, Homo sapien
acagatgatttacaggcttttggct

SEQ ID NO: 13405 - DNA, 25 bp, Homo sapien
acagatgatttacaggtttttggct

SEQ ID NO: 13406 - DNA, 25 bp, Homo sapien
acagatgattttgcttgtccttaga

SEQ ID NO: 13407 - DNA, 25 bp, Homo sapien
acagatgattttggttgtccttaga

SEQ ID NO: 13408 - DNA, 25 bp, Homo sapien
acagatgcgtccatcccagcttctc

SEQ ID NO: 13409 - DNA, 25 bp, Homo sapien
acagatgcttccatcccagcttctc

SEQ ID NO: 13410 - DNA, 25 bp, Homo sapien
acagatggcaaattagctgggttta

SEQ ID NO: 13411 - DNA, 25 bp, Homo sapien
acagatggcaaattagttgggttta

SEQ ID NO: 13412 - DNA, 25 bp, Homo sapien
acagatgtttgcaataatcataatt

SEQ ID NO: 13413 - DNA, 25 bp, Homo sapien
acagatgtttgcagtaatcataatt

SEQ ID NO: 13414 - DNA, 25 bp, Homo sapien
acagattcctataaacaccaaagga

SEQ ID NO: 13415 - DNA, 25 bp, Homo sapien
acagattcgttcacttgaacatcat

SEQ ID NO: 13416 - DNA, 25 bp, Homo sapien
acagattcgttcatttgaacatcat

SEQ ID NO: 13417 - DNA, 25 bp, Homo sapien
acagattcttataaacaccaaagga

SEQ ID NO: 13418 - DNA, 25 bp, Homo sapien
acagattgagacagaaagagagaat

SEQ ID NO: 13419 - DNA, 25 bp, Homo sapien
acagattgagacagtaagagagaat

SEQ ID NO: 13420 - DNA, 25 bp, Homo sapien
acagattttcaaaagttttcatttt

SEQ ID NO: 13421 - DNA, 25 bp, Homo sapien
acagattttcagaagttttcatttt

SEQ ID NO: 13422 - DNA, 25 bp, Homo sapien
acagcaaaaatacccaacagtgaca

SEQ ID NO: 13423 - DNA, 25 bp, Homo sapien
acagcaaaaatacccagcagtgaca

SEQ ID NO: 13424 - DNA, 25 bp, Homo sapien
acagcaaaacctggcctttcctgaa

SEQ ID NO: 13425 - DNA, 25 bp, Homo sapien
acagcaaaatctggcctttcctgaa

SEQ ID NO: 13426 - DNA, 25 bp, Homo sapien
acagcaaacatgatctattcccctg

SEQ ID NO: 13427 - DNA, 25 bp, Homo sapien
acagcaaacatgttctattcccctg

SEQ ID NO: 13428 - DNA, 25 bp, Homo sapien
acagcaaattcaatgaaggaaatcc

SEQ ID NO: 13429 - DNA, 25 bp, Homo sapien
acagcaaattcattgaaggaaatcc

SEQ ID NO: 13430 - DNA, 25 bp, Homo sapien
acagcaacaatttgaaaaatctgta

SEQ ID NO: 13431 - DNA, 25 bp, Homo sapien
acagcaacaatttgcaaaatctgta

SEQ ID NO: 13432 - DNA, 25 bp, Homo sapien
acagcaacacaaatccattactttg

SEQ ID NO: 13433 - DNA, 25 bp, Homo sapien
acagcaacacatatccattactttg

SEQ ID NO: 13434 - DNA, 25 bp, Homo sapien
acagcaacattgccttccagtgtgc

SEQ ID NO: 13435 - DNA, 25 bp, Homo sapien
acagcaacattgtcttccagtgtgc

SEQ ID NO: 13436 - DNA, 25 bp, Homo sapien
acagcaacggcggctgctactattg

SEQ ID NO: 13437 - DNA, 25 bp, Homo sapien
acagcaactgcggctgctactattg

SEQ ID NO: 13438 - DNA, 25 bp, Homo sapien
acagcaagacttctttcctctctaa

SEQ ID NO: 13439 - DNA, 25 bp, Homo sapien
acagcaagagacgaagttgagggat

SEQ ID NO: 13440 - DNA, 25 bp, Homo sapien
acagcaagagatgaagttgagggat

SEQ ID NO: 13441 - DNA, 25 bp, Homo sapien
acagcaagcaaatcgtggtcctgga

SEQ ID NO: 13442 - DNA, 25 bp, Homo sapien
acagcaagcaaattgtggtcctgga

SEQ ID NO: 13443 - DNA, 25 bp, Homo sapien
acagcaagccttctttcctctctaa

SEQ ID NO: 13444 - DNA, 25 bp, Homo sapien
acagcaatacatttccctctaagga

SEQ ID NO: 13445 - DNA, 25 bp, Homo sapien
acagcaatatcctctttcagaacta

SEQ ID NO: 13446 - DNA, 25 bp, Homo sapien
acagcaatatcctgtttcagaacta

SEQ ID NO: 13447 - DNA, 25 bp, Homo sapien
acagcaatgcatttccctctaagga

SEQ ID NO: 13448 - DNA, 25 bp, Homo sapien
acagcacaaatcacccaaacaaatt

SEQ ID NO: 13449 - DNA, 25 bp, Homo sapien
acagcacaaatcagccaaacaaatt

SEQ ID NO: 13450 - DNA, 25 bp, Homo sapien
acagcacagggtcttgtattcaaaa

SEQ ID NO: 13451 - DNA, 25 bp, Homo sapien
acagcacagtgtcttgtattcaaaa

SEQ ID NO: 13452 - DNA, 25 bp, Homo sapien
acagcaccatgcaatagaaaagatt

SEQ ID NO: 13453 - DNA, 25 bp, Homo sapien
acagcaccatgcattagaaaagatt

SEQ ID NO: 13454 - DNA, 25 bp, Homo sapien
acagcactgaaatacagatcactga

SEQ ID NO: 13455 - DNA, 25 bp, Homo sapien
acagcactgaagtacagatcactga

SEQ ID NO: 13456 - DNA, 25 bp, Homo sapien
acagcacttaagccttctatatata

SEQ ID NO: 13457 - DNA, 25 bp, Homo sapien
acagcacttaaggcttctatatata

SEQ ID NO: 13458 - DNA, 25 bp, Homo sapien
acagcagaacgttaatcgacacgcg

SEQ ID NO: 13459 - DNA, 25 bp, Homo sapien
acagcagaatgttaatcgacacgcg

SEQ ID NO: 13460 - DNA, 25 bp, Homo sapien
acagcagagaatacatgtgtttttt

SEQ ID NO: 13461 - DNA, 25 bp, Homo sapien
acagcagagaatgcatgtgtttttt

SEQ ID NO: 13462 - DNA, 25 bp, Homo sapien
acagcagagatattattaattcatc

SEQ ID NO: 13463 - DNA, 25 bp, Homo sapien
acagcagatactatgatatccaaca

SEQ ID NO: 13464 - DNA, 25 bp, Homo sapien
acagcagatactctgatatccaaca

SEQ ID NO: 13465 - DNA, 25 bp, Homo sapien
acagcagatatattattaattcatc

SEQ ID NO: 13466 - DNA, 25 bp, Homo sapien
acagcagccaacagtaattttttaa

SEQ ID NO: 13467 - DNA, 25 bp, Homo sapien
acagcagccaacggtaattttttaa

SEQ ID NO: 13468 - DNA, 25 bp, Homo sapien
acagcaggataagcaataaagctcc

SEQ ID NO: 13469 - DNA, 25 bp, Homo sapien
acagcagggaacaaccttgtacata

SEQ ID NO: 13470 - DNA, 25 bp, Homo sapien
acagcagggaaccaccttgtacata

SEQ ID NO: 13471 - DNA, 25 bp, Homo sapien
acagcaggttaagcaataaagctcc

SEQ ID NO: 13472 - DNA, 25 bp, Homo sapien
acagcagtcttgctatcgagtcctc

SEQ ID NO: 13473 - DNA, 25 bp, Homo sapien
acagcagtcttgctgtcgagtcctc

SEQ ID NO: 13474 - DNA, 25 bp, Homo sapien
acagcataagatagctcatttacaa

SEQ ID NO: 13475 - DNA, 25 bp, Homo sapien
acagcataagatggctcatttacaa

SEQ ID NO: 13476 - DNA, 25 bp, Homo sapien
acagcatagacacaattgcagtgtt

SEQ ID NO: 13477 - DNA, 25 bp, Homo sapien
acagcatagacacgattgcagtgtt

SEQ ID NO: 13478 - DNA, 25 bp, Homo sapien
acagcatatctgattggctacaaag

SEQ ID NO: 13479 - DNA, 25 bp, Homo sapien
acagcatatctggttggctacaaag

SEQ ID NO: 13480 - DNA, 25 bp, Homo sapien
acagcatcagcaacgagttggcact

SEQ ID NO: 13481 - DNA, 25 bp, Homo sapien
acagcatcggcaacgagttggcact

SEQ ID NO: 13482 - DNA, 25 bp, Homo sapien
acagcattaaagttcagaaagtttg

SEQ ID NO: 13483 - DNA, 25 bp, Homo sapien
acagcattaaagttcataaagtttg

SEQ ID NO: 13484 - DNA, 25 bp, Homo sapien
acagcattcaccgacaggggagctt

SEQ ID NO: 13485 - DNA, 25 bp, Homo sapien
acagcattcactgacaggggagctt

SEQ ID NO: 13486 - DNA, 25 bp, Homo sapien
acagccaatataacattcagtggtg

SEQ ID NO: 13487 - DNA, 25 bp, Homo sapien
acagccaatgtaacattcagtggtg

SEQ ID NO: 13488 - DNA, 25 bp, Homo sapien
acagccagcaaggaaacgagggcca

SEQ ID NO: 13489 - DNA, 25 bp, Homo sapien
acagccagcaaggaaatgagggcca

SEQ ID NO: 13490 - DNA, 25 bp, Homo sapien
acagccaggaactactaaaaagaca

SEQ ID NO: 13491 - DNA, 25 bp, Homo sapien
acagccaggaactgctaaaaagaca

SEQ ID NO: 13492 - DNA, 25 bp, Homo sapien
acagccagggtcattgccatcccac

SEQ ID NO: 13493 - DNA, 25 bp, Homo sapien
acagccagggtcgttgccatcccac

SEQ ID NO: 13494 - DNA, 25 bp, Homo sapien
acagccatattaacagattcacaag

SEQ ID NO: 13495 - DNA, 25 bp, Homo sapien
acagccatattaacaggttcacaag

SEQ ID NO: 13496 - DNA, 25 bp, Homo sapien
acagccatcctcagtagactttaaa

SEQ ID NO: 13497 - DNA, 25 bp, Homo sapien
acagccatcctcggtagactttaaa

SEQ ID NO: 13498 - DNA, 25 bp, Homo sapien
acagccccttagatttcgttgcact

SEQ ID NO: 13499 - DNA, 25 bp, Homo sapien
acagccccttaggtttcgttgcact

SEQ ID NO: 13500 - DNA, 25 bp, Homo sapien
acagccctagtaagcgtggattcac

SEQ ID NO: 13501 - DNA, 25 bp, Homo sapien
acagccctagtaagtgtggattcac

SEQ ID NO: 13502 - DNA, 25 bp, Homo sapien
acagcctacattttaactaactctt

SEQ ID NO: 13503 - DNA, 25 bp, Homo sapien
acagcctaccttttaactaactctt

SEQ ID NO: 13504 - DNA, 25 bp, Homo sapien
acagcctattcagaattaggatgac

SEQ ID NO: 13505 - DNA, 25 bp, Homo sapien
acagcctattcaggattaggatgac

SEQ ID NO: 13506 - DNA, 25 bp, Homo sapien
acagcctcattctcaagacaaaact

SEQ ID NO: 13507 - DNA, 25 bp, Homo sapien
acagcctccttctcaagacaaaact

SEQ ID NO: 13508 - DNA, 25 bp, Homo sapien
acagcctgatatactgaatatttta

SEQ ID NO: 13509 - DNA, 25 bp, Homo sapien
acagcctggtatactgaatatttta

SEQ ID NO: 13510 - DNA, 25 bp, Homo sapien
acagccttaagcagcatagagaatg

SEQ ID NO: 13511 - DNA, 25 bp, Homo sapien
acagccttatgcagcatagagaatg

SEQ ID NO: 13512 - DNA, 25 bp, Homo sapien
acagcgagccacacctggatcacag

SEQ ID NO: 13513 - DNA, 25 bp, Homo sapien
acagcgagccacgcctggatcacag

SEQ ID NO: 13514 - DNA, 25 bp, Homo sapien
acagctaatatccagaaagggtaaa

SEQ ID NO: 13515 - DNA, 25 bp, Homo sapien
acagctaatatcctgaaagggtaaa

SEQ ID NO: 13516 - DNA, 25 bp, Homo sapien
acagctagaagacacttaccagctt

SEQ ID NO: 13517 - DNA, 25 bp, Homo sapien
acagctagaggatcgaaggccaacc

SEQ ID NO: 13518 - DNA, 25 bp, Homo sapien
acagctagaggattgaaggccaacc

SEQ ID NO: 13519 - DNA, 25 bp, Homo sapien
acagctagatgacacttaccagctt

SEQ ID NO: 13520 - DNA, 25 bp, Homo sapien
acagctagtaaatagtagacccagg

SEQ ID NO: 13521 - DNA, 25 bp, Homo sapien
acagctagtaaatggtagacccagg

SEQ ID NO: 13522 - DNA, 25 bp, Homo sapien
acagctataggtgactagatgttcg

SEQ ID NO: 13523 - DNA, 25 bp, Homo sapien
acagctataggttactagatgttcg

SEQ ID NO: 13524 - DNA, 25 bp, Homo sapien
acagctatatactcacaaaccagaa

SEQ ID NO: 13525 - DNA, 25 bp, Homo sapien
acagctatttactcacaaaccagaa

SEQ ID NO: 13526 - DNA, 25 bp, Homo sapien
acagctccaaaggtagaatcatcac

SEQ ID NO: 13527 - DNA, 25 bp, Homo sapien
acagctcccaaaccaaatcctattc

SEQ ID NO: 13528 - DNA, 25 bp, Homo sapien
acagctcccaaatcaaatcctattc

SEQ ID NO: 13529 - DNA, 25 bp, Homo sapien
acagctccgaaggtagaatcatcac

SEQ ID NO: 13530 - DNA, 25 bp, Homo sapien
acagctcttggaaaaaaggtctgtt

SEQ ID NO: 13531 - DNA, 25 bp, Homo sapien
acagctcttggacaaaaggtctgtt

SEQ ID NO: 13532 - DNA, 25 bp, Homo sapien
acagctgcaatggataacagcttcc

SEQ ID NO: 13533 - DNA, 25 bp, Homo sapien
acagctgcaatgtataacagcttcc

SEQ ID NO: 13534 - DNA, 25 bp, Homo sapien
acagctgccagtagtgccctctgcc

SEQ ID NO: 13535 - DNA, 25 bp, Homo sapien
acagctgccggtagtgccctctgcc

SEQ ID NO: 13536 - DNA, 25 bp, Homo sapien
acagctgctagggatacagtggatt

SEQ ID NO: 13537 - DNA, 25 bp, Homo sapien
acagctgctagggatatagtggatt

SEQ ID NO: 13538 - DNA, 25 bp, Homo sapien
acagctggaattcttgctatgctaa

SEQ ID NO: 13539 - DNA, 25 bp, Homo sapien
acagctgggattcttgctatgctaa

SEQ ID NO: 13540 - DNA, 25 bp, Homo sapien
acagctgtaaatatctcagtgctat

SEQ ID NO: 13541 - DNA, 25 bp, Homo sapien
acagctgtaaatatttcagtgctat

SEQ ID NO: 13542 - DNA, 25 bp, Homo sapien
acagctgtgaacagatggataaggt

SEQ ID NO: 13543 - DNA, 25 bp, Homo sapien
acagctgtgaacaggtggataaggt

SEQ ID NO: 13544 - DNA, 25 bp, Homo sapien
acagcttaaaggtctcatccgtatt

SEQ ID NO: 13545 - DNA, 25 bp, Homo sapien
acagcttaaaggtctcgtccgtatt

SEQ ID NO: 13546 - DNA, 25 bp, Homo sapien
acagcttaagggtcagcgtccccac

SEQ ID NO: 13547 - DNA, 25 bp, Homo sapien
acagcttaggggtcagcgtccccac

SEQ ID NO: 13548 - DNA, 25 bp, Homo sapien
acagcttatcttcagctcagttaag

SEQ ID NO: 13549 - DNA, 25 bp, Homo sapien
acagcttattttcagctcagttaag

SEQ ID NO: 13550 - DNA, 25 bp, Homo sapien
acagcttgcttactgactcatagat

SEQ ID NO: 13551 - DNA, 25 bp, Homo sapien
acagcttgcttgctgactcatagat

SEQ ID NO: 13552 - DNA, 25 bp, Homo sapien
acagcttgggtatggctatgtctgg

SEQ ID NO: 13553 - DNA, 25 bp, Homo sapien
acagcttggttatggctatgtctgg

SEQ ID NO: 13554 - DNA, 25 bp, Homo sapien
acagcttgtactacaacaagattcc

SEQ ID NO: 13555 - DNA, 25 bp, Homo sapien
acagcttgtactacgacaagattcc

SEQ ID NO: 13556 - DNA, 25 bp, Homo sapien
acagcttgtggctccaaaaaagact

SEQ ID NO: 13557 - DNA, 25 bp, Homo sapien
acagcttgtggctcgaaaaaagact

SEQ ID NO: 13558 - DNA, 25 bp, Homo sapien
acagctttgatagaatcagattcct

SEQ ID NO: 13559 - DNA, 25 bp, Homo sapien
acagctttgatcaaaacactcaaat

SEQ ID NO: 13560 - DNA, 25 bp, Homo sapien
acagctttgatcgaaacactcaaat

SEQ ID NO: 13561 - DNA, 25 bp, Homo sapien
acagctttgatggaatcagattcct

SEQ ID NO: 13562 - DNA, 25 bp, Homo sapien
acagctttgtgacatgcatatattg

SEQ ID NO: 13563 - DNA, 25 bp, Homo sapien
acagctttgtgacatgtatatattg

SEQ ID NO: 13564 - DNA, 25 bp, Homo sapien
acagcttttctctacctcttcccac

SEQ ID NO: 13565 - DNA, 25 bp, Homo sapien
acagcttttctctagctcttcccac

SEQ ID NO: 13566 - DNA, 25 bp, Homo sapien
acaggaaaaatgtgaaaatggtact

SEQ ID NO: 13567 - DNA, 25 bp, Homo sapien
acaggaaaaatgtgaacatggtact

SEQ ID NO: 13568 - DNA, 25 bp, Homo sapien
acaggaaacaatgtcatattcagca

SEQ ID NO: 13569 - DNA, 25 bp, Homo sapien
acaggaaactatgtcatattcagca

SEQ ID NO: 13570 - DNA, 25 bp, Homo sapien
acaggaaagacagtcataaatttct

SEQ ID NO: 13571 - DNA, 25 bp, Homo sapien
acaggaaaggcagtcataaatttct

SEQ ID NO: 13572 - DNA, 25 bp, Homo sapien
acaggaactctcaggaactctcatt

SEQ ID NO: 13573 - DNA, 25 bp, Homo sapien
acaggaactcttaatcattcctgga

SEQ ID NO: 13574 - DNA, 25 bp, Homo sapien
acaggaactcttattcattcctgga

SEQ ID NO: 13575 - DNA, 25 bp, Homo sapien
acaggaactgtcaggaactctcatt

SEQ ID NO: 13576 - DNA, 25 bp, Homo sapien
acaggaagaaaaccagacttagaga

SEQ ID NO: 13577 - DNA, 25 bp, Homo sapien
acaggaagaaaactagacttagaga

SEQ ID NO: 13578 - DNA, 25 bp, Homo sapien
acaggaagaagaaactgcagagtcc

SEQ ID NO: 13579 - DNA, 25 bp, Homo sapien
acaggaagaagaaattgcagagtcc

SEQ ID NO: 13580 - DNA, 25 bp, Homo sapien
acaggaagcagcgtgtgtgccttac

SEQ ID NO: 13581 - DNA, 25 bp, Homo sapien
acaggaagcagggtgtgtgccttac

SEQ ID NO: 13582 - DNA, 25 bp, Homo sapien
acaggaagctgaacaaattgagaac

SEQ ID NO: 13583 - DNA, 25 bp, Homo sapien
acaggaagctgaacgaattgagaac

SEQ ID NO: 13584 - DNA, 25 bp, Homo sapien
acaggaaggctgaactggatgctca

SEQ ID NO: 13585 - DNA, 25 bp, Homo sapien
acaggaaggctgaattggatgctca

SEQ ID NO: 13586 - DNA, 25 bp, Homo sapien
acaggaaggctgttcctaaatggac

SEQ ID NO: 13587 - DNA, 25 bp, Homo sapien
acaggaaggctgtttctaaatggac

SEQ ID NO: 13588 - DNA, 25 bp, Homo sapien
acaggaataattcttcagacctgca

SEQ ID NO: 13589 - DNA, 25 bp, Homo sapien
acaggaattattcttcagacctgca

SEQ ID NO: 13590 - DNA, 25 bp, Homo sapien
acaggaatttgcaacacttacacat

SEQ ID NO: 13591 - DNA, 25 bp, Homo sapien
acaggaatttgcaatacttacacat

SEQ ID NO: 13592 - DNA, 25 bp, Homo sapien
acaggacaaacaccgaaaagaatag

SEQ ID NO: 13593 - DNA, 25 bp, Homo sapien
acaggacaaacactgaaaagaatag

SEQ ID NO: 13594 - DNA, 25 bp, Homo sapien
acaggacacgtcaccttttctcatg

SEQ ID NO: 13595 - DNA, 25 bp, Homo sapien
acaggacatgtcaccttttctcatg

SEQ ID NO: 13596 - DNA, 25 bp, Homo sapien
acaggactcggcaacttcttggatg

SEQ ID NO: 13597 - DNA, 25 bp, Homo sapien
acaggactcggtaacttcttggatg

SEQ ID NO: 13598 - DNA, 25 bp, Homo sapien
acaggagacaagggttagagactat

SEQ ID NO: 13599 - DNA, 25 bp, Homo sapien
acaggagacaaggtttagagactat

SEQ ID NO: 13600 - DNA, 25 bp, Homo sapien
acaggagacatttgagtccaattct

SEQ ID NO: 13601 - DNA, 25 bp, Homo sapien
acaggagacgtttgagtccaattct

SEQ ID NO: 13602 - DNA, 25 bp, Homo sapien
acaggagactttccatacaagagag

SEQ ID NO: 13603 - DNA, 25 bp, Homo sapien
acaggagaggagacggcgcaggatc

SEQ ID NO: 13604 - DNA, 25 bp, Homo sapien
acaggagaggagatggcgcaggatc

SEQ ID NO: 13605 - DNA, 25 bp, Homo sapien
acaggagagggaaacaaatgaccaa

SEQ ID NO: 13606 - DNA, 25 bp, Homo sapien
acaggagagggaagcaaatgaccaa

SEQ ID NO: 13607 - DNA, 25 bp, Homo sapien
acaggagagtttccatacaagagag

SEQ ID NO: 13608 - DNA, 25 bp, Homo sapien
acaggagatgactgacttctcagct

SEQ ID NO: 13609 - DNA, 25 bp, Homo sapien
acaggagatgattgacttctcagct

SEQ ID NO: 13610 - DNA, 25 bp, Homo sapien
acaggagcagaactgtccaggcctt

SEQ ID NO: 13611 - DNA, 25 bp, Homo sapien
acaggagcagaactttccaggcctt

SEQ ID NO: 13612 - DNA, 25 bp, Homo sapien
acaggaggatcaggtagaataatac

SEQ ID NO: 13613 - DNA, 25 bp, Homo sapien
acaggaggatcgggtagaataatac

SEQ ID NO: 13614 - DNA, 25 bp, Homo sapien
acaggagtaaagatgtaaaacaggg

SEQ ID NO: 13615 - DNA, 25 bp, Homo sapien
acaggagtaaagatgtcaaacaggg

SEQ ID NO: 13616 - DNA, 25 bp, Homo sapien
acaggagtatgtagaattgaattct

SEQ ID NO: 13617 - DNA, 25 bp, Homo sapien
acaggagtatgtggaattgaattct

SEQ ID NO: 13618 - DNA, 25 bp, Homo sapien
acaggatgacaaagaaaagggcgca

SEQ ID NO: 13619 - DNA, 25 bp, Homo sapien
acaggatgacagagaaaagggcgca

SEQ ID NO: 13620 - DNA, 25 bp, Homo sapien
acaggatggtaatgttaagacacaa

SEQ ID NO: 13621 - DNA, 25 bp, Homo sapien
acaggatggtaatgttgagacacaa

SEQ ID NO: 13622 - DNA, 25 bp, Homo sapien
acaggatttagtcacccttgatgca

SEQ ID NO: 13623 - DNA, 25 bp, Homo sapien
acaggatttagttacccttgatgca

SEQ ID NO: 13624 - DNA, 25 bp, Homo sapien
acaggcaacatatcacataattgtg

SEQ ID NO: 13625 - DNA, 25 bp, Homo sapien
acaggcaacatatcccataattgtg

SEQ ID NO: 13626 - DNA, 25 bp, Homo sapien
acaggcaacatgttacatatagtat

SEQ ID NO: 13627 - DNA, 25 bp, Homo sapien
acaggcaacgtgttacatatagtat

SEQ ID NO: 13628 - DNA, 25 bp, Homo sapien
acaggcaccatctcggttagctgtg

SEQ ID NO: 13629 - DNA, 25 bp, Homo sapien
acaggcaccatcttggttagctgtg

SEQ ID NO: 13630 - DNA, 25 bp, Homo sapien
acaggcaggagctcgaaaggagaag

SEQ ID NO: 13631 - DNA, 25 bp, Homo sapien
acaggcaggagcttgaaaggagaag

SEQ ID NO: 13632 - DNA, 25 bp, Homo sapien
acaggcagtagcagtcctgaagaac

SEQ ID NO: 13633 - DNA, 25 bp, Homo sapien
acaggcagtagcggtcctgaagaac

SEQ ID NO: 13634 - DNA, 25 bp, Homo sapien
acaggcatttcttcttcaagtaatc

SEQ ID NO: 13635 - DNA, 25 bp, Homo sapien
acaggcatttctttttcaagtaatc

SEQ ID NO: 13636 - DNA, 25 bp, Homo sapien
acaggccaactcctccattgtacag

SEQ ID NO: 13637 - DNA, 25 bp, Homo sapien
acaggccatctcctccattgtacag

SEQ ID NO: 13638 - DNA, 25 bp, Homo sapien
acaggcccttccatacgagtccagg

SEQ ID NO: 13639 - DNA, 25 bp, Homo sapien
acaggcccttccgtacgagtccagg

SEQ ID NO: 13640 - DNA, 25 bp, Homo sapien
acaggcctcgatttacctgtggttt

SEQ ID NO: 13641 - DNA, 25 bp, Homo sapien
acaggcctcgatttacttgtggttt

SEQ ID NO: 13642 - DNA, 25 bp, Homo sapien
acaggcctcggccgctgagggtctg

SEQ ID NO: 13643 - DNA, 25 bp, Homo sapien
acaggcctcggctgctgagggtctg

SEQ ID NO: 13644 - DNA, 25 bp, Homo sapien
acaggcgtgacccactgtgcctagt

SEQ ID NO: 13645 - DNA, 25 bp, Homo sapien
acaggcgtgacctactgtgcctagt

SEQ ID NO: 13646 - DNA, 25 bp, Homo sapien
acaggctaattggaaacaggaagga

SEQ ID NO: 13647 - DNA, 25 bp, Homo sapien
acaggctaattggaaagaggaagga

SEQ ID NO: 13648 - DNA, 25 bp, Homo sapien
acaggctagtgctaaaagcaaagtg

SEQ ID NO: 13649 - DNA, 25 bp, Homo sapien
acaggctagtgctcaaagcaaagtg

SEQ ID NO: 13650 - DNA, 25 bp, Homo sapien
acaggctgaagagagagattgtctg

SEQ ID NO: 13651 - DNA, 25 bp, Homo sapien
acaggctgcatccctttttggaggc

SEQ ID NO: 13652 - DNA, 25 bp, Homo sapien
acaggctgcattcctttttggaggc

SEQ ID NO: 13653 - DNA, 25 bp, Homo sapien
acaggctggagagagagattgtctg

SEQ ID NO: 13654 - DNA, 25 bp, Homo sapien
acaggcttaaataaatgcaagaact

SEQ ID NO: 13655 - DNA, 25 bp, Homo sapien
acaggcttaaatacatgcaagaact

SEQ ID NO: 13656 - DNA, 25 bp, Homo sapien
acaggcttatttttagagacaggtg

SEQ ID NO: 13657 - DNA, 25 bp, Homo sapien
acaggcttgtttttagagacaggtg

SEQ ID NO: 13658 - DNA, 25 bp, Homo sapien
acagggaaaaactctgaaggactgt

SEQ ID NO: 13659 - DNA, 25 bp, Homo sapien
acagggaaacaaaccaaaacagcat

SEQ ID NO: 13660 - DNA, 25 bp, Homo sapien
acagggaaataatgagtcccatgga

SEQ ID NO: 13661 - DNA, 25 bp, Homo sapien
acagggaacaactctgaaggactgt

SEQ ID NO: 13662 - DNA, 25 bp, Homo sapien
acagggaagatatacaacagaatgc

SEQ ID NO: 13663 - DNA, 25 bp, Homo sapien
acagggaagatatagaacagaatgc

SEQ ID NO: 13664 - DNA, 25 bp, Homo sapien
acagggaagcaaaccaaaacagcat

SEQ ID NO: 13665 - DNA, 25 bp, Homo sapien
acagggaatcatctagggtctaatg

SEQ ID NO: 13666 - DNA, 25 bp, Homo sapien
acagggaatcatctagtgtctaatg

SEQ ID NO: 13667 - DNA, 25 bp, Homo sapien
acagggaattaatgagtcccatgga

SEQ ID NO: 13668 - DNA, 25 bp, Homo sapien
acagggacaagaaatggaaccagcc

SEQ ID NO: 13669 - DNA, 25 bp, Homo sapien
acagggaccaccgggaagctcactg

SEQ ID NO: 13670 - DNA, 25 bp, Homo sapien
acagggaccactgggaagctcactg

SEQ ID NO: 13671 - DNA, 25 bp, Homo sapien
acagggacgagaaatggaaccagcc

SEQ ID NO: 13672 - DNA, 25 bp, Homo sapien
acagggagaggcaacaaatgcaagg

SEQ ID NO: 13673 - DNA, 25 bp, Homo sapien
acagggagatgcaacaaatgcaagg

SEQ ID NO: 13674 - DNA, 25 bp, Homo sapien
acagggagcaactggccttctacag

SEQ ID NO: 13675 - DNA, 25 bp, Homo sapien
acagggagcaagtggccttctacag

SEQ ID NO: 13676 - DNA, 25 bp, Homo sapien
acagggcttcctttatggacacctt

SEQ ID NO: 13677 - DNA, 25 bp, Homo sapien
acagggctttctttatggacacctt

SEQ ID NO: 13678 - DNA, 25 bp, Homo sapien
acaggggaaagccactccaggtcag

SEQ ID NO: 13679 - DNA, 25 bp, Homo sapien
acaggggaaggccactccaggtcag

SEQ ID NO: 13680 - DNA, 25 bp, Homo sapien
acagggtaaagacacaactatggct

SEQ ID NO: 13681 - DNA, 25 bp, Homo sapien
acagggtaaagacacagctatggct

SEQ ID NO: 13682 - DNA, 25 bp, Homo sapien
acagggttagaacaaagataataat

SEQ ID NO: 13683 - DNA, 25 bp, Homo sapien
acagggttagaacagagataataat

SEQ ID NO: 13684 - DNA, 25 bp, Homo sapien
acagggttcatctattcagtacttc

SEQ ID NO: 13685 - DNA, 25 bp, Homo sapien
acagggttcatctgttcagtacttc

SEQ ID NO: 13686 - DNA, 25 bp, Homo sapien
acaggtaaaagaacagagctccaga

SEQ ID NO: 13687 - DNA, 25 bp, Homo sapien
acaggtaaaagaagagagctccaga

SEQ ID NO: 13688 - DNA, 25 bp, Homo sapien
acaggtagcagggattaggatgtga

SEQ ID NO: 13689 - DNA, 25 bp, Homo sapien
acaggtagcagggattgggatgtga

SEQ ID NO: 13690 - DNA, 25 bp, Homo sapien
acaggtagtcacaattgctaggggt

SEQ ID NO: 13691 - DNA, 25 bp, Homo sapien
acaggtagtcacatttgctaggggt

SEQ ID NO: 13692 - DNA, 25 bp, Homo sapien
acaggtctcaggataacagatgccc

SEQ ID NO: 13693 - DNA, 25 bp, Homo sapien
acaggtctcagggtaacagatgccc

SEQ ID NO: 13694 - DNA, 25 bp, Homo sapien
acaggtcttaaattcctggtctctg

SEQ ID NO: 13695 - DNA, 25 bp, Homo sapien
acaggtcttgaattcctggtctctg

SEQ ID NO: 13696 - DNA, 25 bp, Homo sapien
acaggtgaattcataaacaaactgt

SEQ ID NO: 13697 - DNA, 25 bp, Homo sapien
acaggtgaattcgtaaacaaactgt

SEQ ID NO: 13698 - DNA, 25 bp, Homo sapien
acaggtgctaacaagctaacatagc

SEQ ID NO: 13699 - DNA, 25 bp, Homo sapien
acaggtgctgacaagctaacatagc

SEQ ID NO: 13700 - DNA, 25 bp, Homo sapien
acaggtgtaacaagcattgccatat

SEQ ID NO: 13701 - DNA, 25 bp, Homo sapien
acaggtgtaaccagcattgccatat

SEQ ID NO: 13702 - DNA, 25 bp, Homo sapien
acaggtgtactgttaacgagcagta

SEQ ID NO: 13703 - DNA, 25 bp, Homo sapien
acaggtgtactgttaatgagcagta

SEQ ID NO: 13704 - DNA, 25 bp, Homo sapien
acaggttatttcccatggagcaaaa

SEQ ID NO: 13705 - DNA, 25 bp, Homo sapien
acaggttattttccatggagcaaaa

SEQ ID NO: 13706 - DNA, 25 bp, Homo sapien
acaggttttggtagtttgttccttt

SEQ ID NO: 13707 - DNA, 25 bp, Homo sapien
acaggttttggtcgtttgttccttt

SEQ ID NO: 13708 - DNA, 25 bp, Homo sapien
acagtaaaaatacgacctaaaatta

SEQ ID NO: 13709 - DNA, 25 bp, Homo sapien
acagtaaaaatatgacctaaaatta

SEQ ID NO: 13710 - DNA, 25 bp, Homo sapien
acagtaaaagaagagtaacaaacca

SEQ ID NO: 13711 - DNA, 25 bp, Homo sapien
acagtaaaagaagtgtaacaaacca

SEQ ID NO: 13712 - DNA, 25 bp, Homo sapien
acagtaaacagggccattgatagtt

SEQ ID NO: 13713 - DNA, 25 bp, Homo sapien
acagtaaatacaaataccctaagcc

SEQ ID NO: 13714 - DNA, 25 bp, Homo sapien
acagtaaataccaataccctaagcc

SEQ ID NO: 13715 - DNA, 25 bp, Homo sapien
acagtaaatagggccattgatagtt

SEQ ID NO: 13716 - DNA, 25 bp, Homo sapien
acagtaagaaacaacataatgaaga

SEQ ID NO: 13717 - DNA, 25 bp, Homo sapien
acagtaagaaataacataatgaaga

SEQ ID NO: 13718 - DNA, 25 bp, Homo sapien
acagtaattattatctccaaaccaa

SEQ ID NO: 13719 - DNA, 25 bp, Homo sapien
acagtaattattatttccaaaccaa

SEQ ID NO: 13720 - DNA, 25 bp, Homo sapien
acagtagagtgccaagcacagaagt

SEQ ID NO: 13721 - DNA, 25 bp, Homo sapien
acagtagagtgtcaagcacagaagt

SEQ ID NO: 13722 - DNA, 25 bp, Homo sapien
acagtagatgactcccctttcttct

SEQ ID NO: 13723 - DNA, 25 bp, Homo sapien
acagtagatgactctcctttcttct

SEQ ID NO: 13724 - DNA, 25 bp, Homo sapien
acagtagcttctctaaccattttgc

SEQ ID NO: 13725 - DNA, 25 bp, Homo sapien
acagtagcttctgtaaccattttgc

SEQ ID NO: 13726 - DNA, 25 bp, Homo sapien
acagtaggttaatactcagaatgtt

SEQ ID NO: 13727 - DNA, 25 bp, Homo sapien
acagtaggttagtactcagaatgtt

SEQ ID NO: 13728 - DNA, 25 bp, Homo sapien
acagtatcatggctagtgctggaca

SEQ ID NO: 13729 - DNA, 25 bp, Homo sapien
acagtatcgtggctagtgctggaca

SEQ ID NO: 13730 - DNA, 25 bp, Homo sapien
acagtattaacaatttttccataag

SEQ ID NO: 13731 - DNA, 25 bp, Homo sapien
acagtattaacagtttttccataag

SEQ ID NO: 13732 - DNA, 25 bp, Homo sapien
acagtattatagctggtacataaag

SEQ ID NO: 13733 - DNA, 25 bp, Homo sapien
acagtattatagttggtacataaag

SEQ ID NO: 13734 - DNA, 25 bp, Homo sapien
acagtcaaaatgtgaacagaccagt

SEQ ID NO: 13735 - DNA, 25 bp, Homo sapien
acagtcaaaatgtgaatagaccagt

SEQ ID NO: 13736 - DNA, 25 bp, Homo sapien
acagtcaaatacctcaaatgtctat

SEQ ID NO: 13737 - DNA, 25 bp, Homo sapien
acagtcaaataccttaaatgtctat

SEQ ID NO: 13738 - DNA, 25 bp, Homo sapien
acagtcaaattgggagcaggcatgg

SEQ ID NO: 13739 - DNA, 25 bp, Homo sapien
acagtcaagttgggagcaggcatgg

SEQ ID NO: 13740 - DNA, 25 bp, Homo sapien
acagtcaatcctctctcaaaaaaaa

SEQ ID NO: 13741 - DNA, 25 bp, Homo sapien
acagtcaatcctctcttaaaaaaaa

SEQ ID NO: 13742 - DNA, 25 bp, Homo sapien
acagtcacactgctgtacttaaact

SEQ ID NO: 13743 - DNA, 25 bp, Homo sapien
acagtcacattgctgtacttaaact

SEQ ID NO: 13744 - DNA, 25 bp, Homo sapien
acagtcacatttcatcggcaggcac

SEQ ID NO: 13745 - DNA, 25 bp, Homo sapien
acagtcacatttcatctgcaggcac

SEQ ID NO: 13746 - DNA, 25 bp, Homo sapien
acagtcagatccgttagcaaacaca

SEQ ID NO: 13747 - DNA, 25 bp, Homo sapien
acagtcaggtccgttagcaaacaca

SEQ ID NO: 13748 - DNA, 25 bp, Homo sapien
acagtcagtctcctagaacatacat

SEQ ID NO: 13749 - DNA, 25 bp, Homo sapien
acagtcagtctcctggaacatacat

SEQ ID NO: 13750 - DNA, 25 bp, Homo sapien
acagtccaaaagcggtctctcaaaa

SEQ ID NO: 13751 - DNA, 25 bp, Homo sapien
acagtccaaaagctgtctctcaaaa

SEQ ID NO: 13752 - DNA, 25 bp, Homo sapien
acagtccacaaacatgagtgtctat

SEQ ID NO: 13753 - DNA, 25 bp, Homo sapien
acagtccacaaatatgagtgtctat

SEQ ID NO: 13754 - DNA, 25 bp, Homo sapien
acagtcccaaaagaaatgttgcctg

SEQ ID NO: 13755 - DNA, 25 bp, Homo sapien
acagtcccaaaataaatgttgcctg

SEQ ID NO: 13756 - DNA, 25 bp, Homo sapien
acagtcctagagagaagaaagacac

SEQ ID NO: 13757 - DNA, 25 bp, Homo sapien
acagtcctagagggaagaaagacac

SEQ ID NO: 13758 - DNA, 25 bp, Homo sapien
acagtctacaaggaacagtaagata

SEQ ID NO: 13759 - DNA, 25 bp, Homo sapien
acagtctacgaggaacagtaagata

SEQ ID NO: 13760 - DNA, 25 bp, Homo sapien
acagtctcagttcaggtcttctagc

SEQ ID NO: 13761 - DNA, 25 bp, Homo sapien
acagtctcagttcgggtcttctagc

SEQ ID NO: 13762 - DNA, 25 bp, Homo sapien
acagtctcatacacgcaattgtgtg

SEQ ID NO: 13763 - DNA, 25 bp, Homo sapien
acagtctcatacatgcaattgtgtg

SEQ ID NO: 13764 - DNA, 25 bp, Homo sapien
acagtctctaatttttttattttta

SEQ ID NO: 13765 - DNA, 25 bp, Homo sapien
acagtctctgatttttttattttta

SEQ ID NO: 13766 - DNA, 25 bp, Homo sapien
acagtcttttaggttgtttgactga

SEQ ID NO: 13767 - DNA, 25 bp, Homo sapien
acagtcttttagtttgtttgactga

SEQ ID NO: 13768 - DNA, 25 bp, Homo sapien
acagtgaacattgatcacaagattg

SEQ ID NO: 13769 - DNA, 25 bp, Homo sapien
acagtgaacgttgatcacaagattg

SEQ ID NO: 13770 - DNA, 25 bp, Homo sapien
acagtgacataaaacggaaatataa

SEQ ID NO: 13771 - DNA, 25 bp, Homo sapien
acagtgacataaaatggaaatataa

SEQ ID NO: 13772 - DNA, 25 bp, Homo sapien
acagtgaccggaagagcttgtattt

SEQ ID NO: 13773 - DNA, 25 bp, Homo sapien
acagtgactcatagtagatcatttg

SEQ ID NO: 13774 - DNA, 25 bp, Homo sapien
acagtgactcatattagatcatttg

SEQ ID NO: 13775 - DNA, 25 bp, Homo sapien
acagtgactggaagagcttgtattt

SEQ ID NO: 13776 - DNA, 25 bp, Homo sapien
acagtgagcctgctcaaacatccag

SEQ ID NO: 13777 - DNA, 25 bp, Homo sapien
acagtgagcctgttcaaacatccag

SEQ ID NO: 13778 - DNA, 25 bp, Homo sapien
acagtgagttacatgacctggtaga

SEQ ID NO: 13779 - DNA, 25 bp, Homo sapien
acagtgagttatatgacctggtaga

SEQ ID NO: 13780 - DNA, 25 bp, Homo sapien
acagtgatgtaaaattaacaatgat

SEQ ID NO: 13781 - DNA, 25 bp, Homo sapien
acagtgatgtaaaattgacaatgat

SEQ ID NO: 13782 - DNA, 25 bp, Homo sapien
acagtgcaacagtttcatagcttag

SEQ ID NO: 13783 - DNA, 25 bp, Homo sapien
acagtgcaagaaacggcagtcatca

SEQ ID NO: 13784 - DNA, 25 bp, Homo sapien
acagtgcaagaaatggcagtcatca

SEQ ID NO: 13785 - DNA, 25 bp, Homo sapien
acagtgcacaggaaagtccctaccc

SEQ ID NO: 13786 - DNA, 25 bp, Homo sapien
acagtgcacaggacagtccctaccc

SEQ ID NO: 13787 - DNA, 25 bp, Homo sapien
acagtgcagcagtttcatagcttag

SEQ ID NO: 13788 - DNA, 25 bp, Homo sapien
acagtgccacgtaaagttctttgat

SEQ ID NO: 13789 - DNA, 25 bp, Homo sapien
acagtgccatgtaaagttctttgat

SEQ ID NO: 13790 - DNA, 25 bp, Homo sapien
acagtgccatgttactcaataagtt

SEQ ID NO: 13791 - DNA, 25 bp, Homo sapien
acagtgcccatagacggccataatc

SEQ ID NO: 13792 - DNA, 25 bp, Homo sapien
acagtgcccatggacggccataatc

SEQ ID NO: 13793 - DNA, 25 bp, Homo sapien
acagtgccgtgttactcaataagtt

SEQ ID NO: 13794 - DNA, 25 bp, Homo sapien
acagtgctataagacagtggaaaga

SEQ ID NO: 13795 - DNA, 25 bp, Homo sapien
acagtgctataaggcagtggaaaga

SEQ ID NO: 13796 - DNA, 25 bp, Homo sapien
acagtggtaaaacgagattatgtac

SEQ ID NO: 13797 - DNA, 25 bp, Homo sapien
acagtggtaaaatgagattatgtac

SEQ ID NO: 13798 - DNA, 25 bp, Homo sapien
acagtggtagacacgaaaatgggaa

SEQ ID NO: 13799 - DNA, 25 bp, Homo sapien
acagtggtagacatgaaaatgggaa

SEQ ID NO: 13800 - DNA, 25 bp, Homo sapien
acagtgtctacacatttgatgataa

SEQ ID NO: 13801 - DNA, 25 bp, Homo sapien
acagtgtctacatatttgatgataa

SEQ ID NO: 13802 - DNA, 25 bp, Homo sapien
acagtgtctcgttttcccttttaca

SEQ ID NO: 13803 - DNA, 25 bp, Homo sapien
acagtgtctctaattgtcccggtta

SEQ ID NO: 13804 - DNA, 25 bp, Homo sapien
acagtgtctctagttgtcccggtta

SEQ ID NO: 13805 - DNA, 25 bp, Homo sapien
acagtgtctggcacagaacaagcac

SEQ ID NO: 13806 - DNA, 25 bp, Homo sapien
acagtgtctggcacagcacaagcac

SEQ ID NO: 13807 - DNA, 25 bp, Homo sapien
acagtgtcttaattatcgtagctat

SEQ ID NO: 13808 - DNA, 25 bp, Homo sapien
acagtgtcttaattattgtagctat

SEQ ID NO: 13809 - DNA, 25 bp, Homo sapien
acagtgtcttgttttcccttttaca

SEQ ID NO: 13810 - DNA, 25 bp, Homo sapien
acagttaaaacacagtatgcatgaa

SEQ ID NO: 13811 - DNA, 25 bp, Homo sapien
acagttaaaacatagtatgcatgaa

SEQ ID NO: 13812 - DNA, 25 bp, Homo sapien
acagttactttcggacagtctatgc

SEQ ID NO: 13813 - DNA, 25 bp, Homo sapien
acagttactttgggacagtctatgc

SEQ ID NO: 13814 - DNA, 25 bp, Homo sapien
acagttatttttcaagtacttttat

SEQ ID NO: 13815 - DNA, 25 bp, Homo sapien
acagttattttttaagtacttttat

SEQ ID NO: 13816 - DNA, 25 bp, Homo sapien
acagttcaggcaactttacttagct

SEQ ID NO: 13817 - DNA, 25 bp, Homo sapien
acagttcaggcagctttacttagct

SEQ ID NO: 13818 - DNA, 25 bp, Homo sapien
acagttcccagctacattgtatttc

SEQ ID NO: 13819 - DNA, 25 bp, Homo sapien
acagttcctagctacattgtatttc

SEQ ID NO: 13820 - DNA, 25 bp, Homo sapien
acagttctccatacgtagcttcaag

SEQ ID NO: 13821 - DNA, 25 bp, Homo sapien
acagttctccatatgtagcttcaag

SEQ ID NO: 13822 - DNA, 25 bp, Homo sapien
acagttgatagtagtacatagtctg

SEQ ID NO: 13823 - DNA, 25 bp, Homo sapien
acagttgatggtagtacatagtctg

SEQ ID NO: 13824 - DNA, 25 bp, Homo sapien
acagttggcacagtggaaacaaaag

SEQ ID NO: 13825 - DNA, 25 bp, Homo sapien
acagttggctaaatatggcatttgt

SEQ ID NO: 13826 - DNA, 25 bp, Homo sapien
acagttggctcagtggaaacaaaag

SEQ ID NO: 13827 - DNA, 25 bp, Homo sapien
acagttggtccttaaaagtgggctt

SEQ ID NO: 13828 - DNA, 25 bp, Homo sapien
acagttggtccttagaagtgggctt

SEQ ID NO: 13829 - DNA, 25 bp, Homo sapien
acagttggttaaatatggcatttgt

SEQ ID NO: 13830 - DNA, 25 bp, Homo sapien
acagtttaacgtagccccagaattt

SEQ ID NO: 13831 - DNA, 25 bp, Homo sapien
acagtttaatgggttatgttatatt

SEQ ID NO: 13832 - DNA, 25 bp, Homo sapien
acagtttaatgtagccccagaattt

SEQ ID NO: 13833 - DNA, 25 bp, Homo sapien
acagtttagtgggttatgttatatt

SEQ ID NO: 13834 - DNA, 25 bp, Homo sapien
acagtttcaaagtgtttcaaaccat

SEQ ID NO: 13835 - DNA, 25 bp, Homo sapien
acagtttcgaagtgtttcaaaccat

SEQ ID NO: 13836 - DNA, 25 bp, Homo sapien
acagtttcttctctgtgcatgtgat

SEQ ID NO: 13837 - DNA, 25 bp, Homo sapien
acagtttcttctttgtgcatgtgat

SEQ ID NO: 13838 - DNA, 25 bp, Homo sapien
acagtttgcttcaaggtctacaacc

SEQ ID NO: 13839 - DNA, 25 bp, Homo sapien
acagtttgctttaaggtctacaacc

SEQ ID NO: 13840 - DNA, 25 bp, Homo sapien
acagttttacacaacattctgaatc

SEQ ID NO: 13841 - DNA, 25 bp, Homo sapien
acagttttacagaacattctgaatc

SEQ ID NO: 13842 - DNA, 25 bp, Homo sapien
acagttttgtaaaaataggtcattc

SEQ ID NO: 13843 - DNA, 25 bp, Homo sapien
acagttttgtaaaagtaggtcattc

SEQ ID NO: 13844 - DNA, 25 bp, Homo sapien
acagtttttatctatctgaagttgt

SEQ ID NO: 13845 - DNA, 25 bp, Homo sapien
acagtttttgtctatctgaagttgt

SEQ ID NO: 13846 - DNA, 25 bp, Homo sapien
acataaaaacagagaaacaacatgc

SEQ ID NO: 13847 - DNA, 25 bp, Homo sapien
acataaaaacagggaaacaacatgc

SEQ ID NO: 13848 - DNA, 25 bp, Homo sapien
acataaaacgatacacaaaccaagt

SEQ ID NO: 13849 - DNA, 25 bp, Homo sapien
acataaaagcacacgagaccattaa

SEQ ID NO: 13850 - DNA, 25 bp, Homo sapien
acataaaaggattcagaaagtccaa

SEQ ID NO: 13851 - DNA, 25 bp, Homo sapien
acataaaagtacacgagaccattaa

SEQ ID NO: 13852 - DNA, 25 bp, Homo sapien
acataaaatcaatacacagtggatc

SEQ ID NO: 13853 - DNA, 25 bp, Homo sapien
acataaaatcagtacacagtggatc

SEQ ID NO: 13854 - DNA, 25 bp, Homo sapien
acataaaatccatgacaacacctgg

SEQ ID NO: 13855 - DNA, 25 bp, Homo sapien
acataaaatccatggcaacacctgg

SEQ ID NO: 13856 - DNA, 25 bp, Homo sapien
acataaaatctccatagggaaatag

SEQ ID NO: 13857 - DNA, 25 bp, Homo sapien
acataaaatctccgtagggaaatag

SEQ ID NO: 13858 - DNA, 25 bp, Homo sapien
acataaaatgatacacaaaccaagt

SEQ ID NO: 13859 - DNA, 25 bp, Homo sapien
acataaaatgattcagaaagtccaa

SEQ ID NO: 13860 - DNA, 25 bp, Homo sapien
acataaacaacataagcacagggtc

SEQ ID NO: 13861 - DNA, 25 bp, Homo sapien
acataaaccaggggggaatgcttaa

SEQ ID NO: 13862 - DNA, 25 bp, Homo sapien
acataaacgacataagcacagggtc

SEQ ID NO: 13863 - DNA, 25 bp, Homo sapien
acataaactaggggggaatgcttaa

SEQ ID NO: 13864 - DNA, 25 bp, Homo sapien
acataaacttacaaaaagatgataa

SEQ ID NO: 13865 - DNA, 25 bp, Homo sapien
acataaacttacgaaaagatgataa

SEQ ID NO: 13866 - DNA, 25 bp, Homo sapien
acataaagaagaaggcatggggtga

SEQ ID NO: 13867 - DNA, 25 bp, Homo sapien
acataaagaagcaggcatggggtga

SEQ ID NO: 13868 - DNA, 25 bp, Homo sapien
acataaagaggattttattaaacgt

SEQ ID NO: 13869 - DNA, 25 bp, Homo sapien
acataaagaggattttgttaaacgt

SEQ ID NO: 13870 - DNA, 25 bp, Homo sapien
acataaagatggaaacgatgctgag

SEQ ID NO: 13871 - DNA, 25 bp, Homo sapien
acataaagatggtaacgatgctgag

SEQ ID NO: 13872 - DNA, 25 bp, Homo sapien
acataaagtagataaatgttcctaa

SEQ ID NO: 13873 - DNA, 25 bp, Homo sapien
acataaagtaggtaaatgttcctaa

SEQ ID NO: 13874 - DNA, 25 bp, Homo sapien
acataaagttcacctcatcatgtag

SEQ ID NO: 13875 - DNA, 25 bp, Homo sapien
acataaagttcatctcatcatgtag

SEQ ID NO: 13876 - DNA, 25 bp, Homo sapien
acataaatacaacgaacaaatccaa

SEQ ID NO: 13877 - DNA, 25 bp, Homo sapien
acataaatacaatgaacaaatccaa

SEQ ID NO: 13878 - DNA, 25 bp, Homo sapien
acataaatgcagccagagagaatag

SEQ ID NO: 13879 - DNA, 25 bp, Homo sapien
acataaatgcagcccgagagaatag

SEQ ID NO: 13880 - DNA, 25 bp, Homo sapien
acataacccgcttgaatctgcacta

SEQ ID NO: 13881 - DNA, 25 bp, Homo sapien
acataacccgcttgtatctgcacta

SEQ ID NO: 13882 - DNA, 25 bp, Homo sapien
acataactaaattcagagaagagct

SEQ ID NO: 13883 - DNA, 25 bp, Homo sapien
acataactaaatttagagaagagct

SEQ ID NO: 13884 - DNA, 25 bp, Homo sapien
acataactcatagggttttcatgat

SEQ ID NO: 13885 - DNA, 25 bp, Homo sapien
acataactcgtagggttttcatgat

SEQ ID NO: 13886 - DNA, 25 bp, Homo sapien
acataagaaatgatcgactagagta

SEQ ID NO: 13887 - DNA, 25 bp, Homo sapien
acataagaaatgattgactagagta

SEQ ID NO: 13888 - DNA, 25 bp, Homo sapien
acataagacaatgcctcttataatt

SEQ ID NO: 13889 - DNA, 25 bp, Homo sapien
acataagacctagatagcccatggt

SEQ ID NO: 13890 - DNA, 25 bp, Homo sapien
acataagacctagctagcccatggt

SEQ ID NO: 13891 - DNA, 25 bp, Homo sapien
acataagataatgcctcttataatt

SEQ ID NO: 13892 - DNA, 25 bp, Homo sapien
acataagcacagccagttgctctaa

SEQ ID NO: 13893 - DNA, 25 bp, Homo sapien
acataagcacagtcagttgctctaa

SEQ ID NO: 13894 - DNA, 25 bp, Homo sapien
acataaggacctgtcactatcattt

SEQ ID NO: 13895 - DNA, 25 bp, Homo sapien
acataaggacctttcactatcattt

SEQ ID NO: 13896 - DNA, 25 bp, Homo sapien
acataaggatagctgtcagtggtcc

SEQ ID NO: 13897 - DNA, 25 bp, Homo sapien
acataaggatagttgtcagtggtcc

SEQ ID NO: 13898 - DNA, 25 bp, Homo sapien
acataagtacaagtcaatttttggc

SEQ ID NO: 13899 - DNA, 25 bp, Homo sapien
acataagtataagtcaatttttggc

SEQ ID NO: 13900 - DNA, 25 bp, Homo sapien
acataatactttcaggcccaacaat

SEQ ID NO: 13901 - DNA, 25 bp, Homo sapien
acataatactttcaggtccaacaat

SEQ ID NO: 13902 - DNA, 25 bp, Homo sapien
acataataggcaatccttttgtgtg

SEQ ID NO: 13903 - DNA, 25 bp, Homo sapien
acataataggcaattcttttgtgtg

SEQ ID NO: 13904 - DNA, 25 bp, Homo sapien
acataatcaatttagatgcagacat

SEQ ID NO: 13905 - DNA, 25 bp, Homo sapien
acataatcagtttagatgcagacat

SEQ ID NO: 13906 - DNA, 25 bp, Homo sapien
acataatctgcctactatcagcact

SEQ ID NO: 13907 - DNA, 25 bp, Homo sapien
acataatctgcttactatcagcact

SEQ ID NO: 13908 - DNA, 25 bp, Homo sapien
acataatgatgacagaattaagttg

SEQ ID NO: 13909 - DNA, 25 bp, Homo sapien
acataatgatgatagaattaagttg

SEQ ID NO: 13910 - DNA, 25 bp, Homo sapien
acataatgggtaaatggtatggtaa

SEQ ID NO: 13911 - DNA, 25 bp, Homo sapien
acataatgggtcaatggtatggtaa

SEQ ID NO: 13912 - DNA, 25 bp, Homo sapien
acataatgtaccattccattttacc

SEQ ID NO: 13913 - DNA, 25 bp, Homo sapien
acataatgtactattccattttacc

SEQ ID NO: 13914 - DNA, 25 bp, Homo sapien
acataattaaaggattcaaaggaga

SEQ ID NO: 13915 - DNA, 25 bp, Homo sapien
acataattcaaggattcaaaggaga

SEQ ID NO: 13916 - DNA, 25 bp, Homo sapien
acataattctaattctcacagctaa

SEQ ID NO: 13917 - DNA, 25 bp, Homo sapien
acataattctaattttcacagctaa

SEQ ID NO: 13918 - DNA, 25 bp, Homo sapien
acatacaaaattacaaatagcaatt

SEQ ID NO: 13919 - DNA, 25 bp, Homo sapien
acatacaaaattagaaatagcaatt

SEQ ID NO: 13920 - DNA, 25 bp, Homo sapien
acatacaaactagaagatgataaat

SEQ ID NO: 13921 - DNA, 25 bp, Homo sapien
acatacaaactataagatgataaat

SEQ ID NO: 13922 - DNA, 25 bp, Homo sapien
acatacaaactcaaaaaaagtctga

SEQ ID NO: 13923 - DNA, 25 bp, Homo sapien
acatacaaactcaaaacaagtctga

SEQ ID NO: 13924 - DNA, 25 bp, Homo sapien
acatacaacgctttgataaactctt

SEQ ID NO: 13925 - DNA, 25 bp, Homo sapien
acatacaatgctttgataaactctt

SEQ ID NO: 13926 - DNA, 25 bp, Homo sapien
acatacacacaagagacatgccttc

SEQ ID NO: 13927 - DNA, 25 bp, Homo sapien
acatacacccaagagacatgccttc

SEQ ID NO: 13928 - DNA, 25 bp, Homo sapien
acatacactctcagcaattccactt

SEQ ID NO: 13929 - DNA, 25 bp, Homo sapien
acatacactctcagcacttccactt

SEQ ID NO: 13930 - DNA, 25 bp, Homo sapien
acatacactttcattactgagatct

SEQ ID NO: 13931 - DNA, 25 bp, Homo sapien
acatacactttctttactgagatct

SEQ ID NO: 13932 - DNA, 25 bp, Homo sapien
acatacagaaaccaatccaaaaagg

SEQ ID NO: 13933 - DNA, 25 bp, Homo sapien
acatacagaaatcaatccaaaaagg

SEQ ID NO: 13934 - DNA, 25 bp, Homo sapien
acatacagacatagaagaaacaccc

SEQ ID NO: 13935 - DNA, 25 bp, Homo sapien
acatacagacatggaagaaacaccc

SEQ ID NO: 13936 - DNA, 25 bp, Homo sapien
acatacagtctacaaggaacagtaa

SEQ ID NO: 13937 - DNA, 25 bp, Homo sapien
acatacagtctacgaggaacagtaa

SEQ ID NO: 13938 - DNA, 25 bp, Homo sapien
acatacatctgaaaccttgaaacaa

SEQ ID NO: 13939 - DNA, 25 bp, Homo sapien
acatacatctgaacccttgaaacaa

SEQ ID NO: 13940 - DNA, 25 bp, Homo sapien
acatacatgcacatccacaatccat

SEQ ID NO: 13941 - DNA, 25 bp, Homo sapien
acatacatgcacgtccacaatccat

SEQ ID NO: 13942 - DNA, 25 bp, Homo sapien
acatacatttgtatttgcagtcttc

SEQ ID NO: 13943 - DNA, 25 bp, Homo sapien
acatacatttgtattttcagtcttc

SEQ ID NO: 13944 - DNA, 25 bp, Homo sapien
acataccatcagagaaatctgcccc

SEQ ID NO: 13945 - DNA, 25 bp, Homo sapien
acataccatcagaggaatctgcccc

SEQ ID NO: 13946 - DNA, 25 bp, Homo sapien
acatactcaaatataagtagacata

SEQ ID NO: 13947 - DNA, 25 bp, Homo sapien
acatactcaaatgtaagtagacata

SEQ ID NO: 13948 - DNA, 25 bp, Homo sapien
acatactcgatatgttagatgatca

SEQ ID NO: 13949 - DNA, 25 bp, Homo sapien
acatactctatatgttagatgatca

SEQ ID NO: 13950 - DNA, 25 bp, Homo sapien
acatacttctaggcattttattgaa

SEQ ID NO: 13951 - DNA, 25 bp, Homo sapien
acatacttgtaggcattttattgaa

SEQ ID NO: 13952 - DNA, 25 bp, Homo sapien
acatacttgtcatgtcacgaaaaca

SEQ ID NO: 13953 - DNA, 25 bp, Homo sapien
acatacttgtcatgtcgcgaaaaca

SEQ ID NO: 13954 - DNA, 25 bp, Homo sapien
acatactttgctgcaactaattttt

SEQ ID NO: 13955 - DNA, 25 bp, Homo sapien
acatactttgctgcaattaattttt

SEQ ID NO: 13956 - DNA, 25 bp, Homo sapien
acatagaagaatgacgagagaaacg

SEQ ID NO: 13957 - DNA, 25 bp, Homo sapien
acatagaagaatgatgagagaaacg

SEQ ID NO: 13958 - DNA, 25 bp, Homo sapien
acatagaagacaatttaggagcctt

SEQ ID NO: 13959 - DNA, 25 bp, Homo sapien
acatagaagacgatttaggagcctt

SEQ ID NO: 13960 - DNA, 25 bp, Homo sapien
acatagactttcatgtaacggaaat

SEQ ID NO: 13961 - DNA, 25 bp, Homo sapien
acatagactttcatttaacggaaat

SEQ ID NO: 13962 - DNA, 25 bp, Homo sapien
acatagagatcctcgtcattgaagg

SEQ ID NO: 13963 - DNA, 25 bp, Homo sapien
acatagagatccttgtcattgaagg

SEQ ID NO: 13964 - DNA, 25 bp, Homo sapien
acatagagccttgtaaaccttggta

SEQ ID NO: 13965 - DNA, 25 bp, Homo sapien
acatagagtcttgtaaaccttggta

SEQ ID NO: 13966 - DNA, 25 bp, Homo sapien
acatagatgttacagtcagggaaat

SEQ ID NO: 13967 - DNA, 25 bp, Homo sapien
acatagatgttacattcagggaaat

SEQ ID NO: 13968 - DNA, 25 bp, Homo sapien
acatagcaaactctatgaactactg

SEQ ID NO: 13969 - DNA, 25 bp, Homo sapien
acatagcaaactttatgaactactg

SEQ ID NO: 13970 - DNA, 25 bp, Homo sapien
acatagcaagggactcctactgctt

SEQ ID NO: 13971 - DNA, 25 bp, Homo sapien
acatagcaagggattcctactgctt

SEQ ID NO: 13972 - DNA, 25 bp, Homo sapien
acatagcaggtagtgtactttttgt

SEQ ID NO: 13973 - DNA, 25 bp, Homo sapien
acatagcaggtagtgtgctttttgt

SEQ ID NO: 13974 - DNA, 25 bp, Homo sapien
acatagcatattctagcctgttagg

SEQ ID NO: 13975 - DNA, 25 bp, Homo sapien
acatagcatattctagtctgttagg

SEQ ID NO: 13976 - DNA, 25 bp, Homo sapien
acatagcggcagatgcatgatggag

SEQ ID NO: 13977 - DNA, 25 bp, Homo sapien
acatagcggcagatgcgtgatggag

SEQ ID NO: 13978 - DNA, 25 bp, Homo sapien
acatagctataactctgggagtgac

SEQ ID NO: 13979 - DNA, 25 bp, Homo sapien
acatagctataattctgggagtgac

SEQ ID NO: 13980 - DNA, 25 bp, Homo sapien
acatagctcaagaactccaacatgg

SEQ ID NO: 13981 - DNA, 25 bp, Homo sapien
acatagctcgagaactccaacatgg

SEQ ID NO: 13982 - DNA, 25 bp, Homo sapien
acatagctggcactgagaatgaaga

SEQ ID NO: 13983 - DNA, 25 bp, Homo sapien
acatagctggcattgagaatgaaga

SEQ ID NO: 13984 - DNA, 25 bp, Homo sapien
acataggcatgactggcacatatgc

SEQ ID NO: 13985 - DNA, 25 bp, Homo sapien
acataggcgtgactggcacatatgc

SEQ ID NO: 13986 - DNA, 25 bp, Homo sapien
acatagggattcctctaacagatct

SEQ ID NO: 13987 - DNA, 25 bp, Homo sapien
acatagggattcctgtaacagatct

SEQ ID NO: 13988 - DNA, 25 bp, Homo sapien
acataggtgactgagtgtgcaagaa

SEQ ID NO: 13989 - DNA, 25 bp, Homo sapien
acataggtgactgtgtgtgcaagaa

SEQ ID NO: 13990 - DNA, 25 bp, Homo sapien
acatagtatatatttctgttacagc

SEQ ID NO: 13991 - DNA, 25 bp, Homo sapien
acatagtatgtatttctgttacagc

SEQ ID NO: 13992 - DNA, 25 bp, Homo sapien
acatagtcagaggaccttaagaaag

SEQ ID NO: 13993 - DNA, 25 bp, Homo sapien
acatagtcagaggatcttaagaaag

SEQ ID NO: 13994 - DNA, 25 bp, Homo sapien
acatagtgaggaacggtagttgatt

SEQ ID NO: 13995 - DNA, 25 bp, Homo sapien
acatagtgaggaatggtagttgatt

SEQ ID NO: 13996 - DNA, 25 bp, Homo sapien
acatataaatggacgcatgcagttg

SEQ ID NO: 13997 - DNA, 25 bp, Homo sapien
acatataaatggatgcatgcagttg

SEQ ID NO: 13998 - DNA, 25 bp, Homo sapien
acatataacctatacctgtgcgctc

SEQ ID NO: 13999 - DNA, 25 bp, Homo sapien
acatataatctatacctgtgcgctc

SEQ ID NO: 14000 - DNA, 25 bp, Homo sapien
acatatacacatccgggcagcttca

SEQ ID NO: 14001 - DNA, 25 bp, Homo sapien
acatatacacatctgggcagcttca

SEQ ID NO: 14002 - DNA, 25 bp, Homo sapien
acatatacctggcatcgaatctata

SEQ ID NO: 14003 - DNA, 25 bp, Homo sapien
acatatacctggcatctaatctata

SEQ ID NO: 14004 - DNA, 25 bp, Homo sapien
acatatagtatgaagaagaaaacag

SEQ ID NO: 14005 - DNA, 25 bp, Homo sapien
acatatagtattaagaagaaaacag

SEQ ID NO: 14006 - DNA, 25 bp, Homo sapien
acatatatagcacacaatcatgtat

SEQ ID NO: 14007 - DNA, 25 bp, Homo sapien
acatatatatcacacaatcatgtat

SEQ ID NO: 14008 - DNA, 25 bp, Homo sapien
acatatatgatctcacttgttcctc

SEQ ID NO: 14009 - DNA, 25 bp, Homo sapien
acatatatgatctcgcttgttcctc

SEQ ID NO: 14010 - DNA, 25 bp, Homo sapien
acatatatttgaaaaaagacttcat

SEQ ID NO: 14011 - DNA, 25 bp, Homo sapien
acatatatttgataaaagacttcat

SEQ ID NO: 14012 - DNA, 25 bp, Homo sapien
acatatctacagaaataattgtctc

SEQ ID NO: 14013 - DNA, 25 bp, Homo sapien
acatatctacagaagtaattgtctc

SEQ ID NO: 14014 - DNA, 25 bp, Homo sapien
acatatctccaatgttcagcagctt

SEQ ID NO: 14015 - DNA, 25 bp, Homo sapien
acatatctccaatgtttagcagctt

SEQ ID NO: 14016 - DNA, 25 bp, Homo sapien
acatatgaactacggtataacacgt

SEQ ID NO: 14017 - DNA, 25 bp, Homo sapien
acatatgaactatggtataacacgt

SEQ ID NO: 14018 - DNA, 25 bp, Homo sapien
acatatgaatacacaacagacagaa

SEQ ID NO: 14019 - DNA, 25 bp, Homo sapien
acatatgacggacataatgaaaaaa

SEQ ID NO: 14020 - DNA, 25 bp, Homo sapien
acatatgactacacaacagacagaa

SEQ ID NO: 14021 - DNA, 25 bp, Homo sapien
acatatgagagcccaataactgtga

SEQ ID NO: 14022 - DNA, 25 bp, Homo sapien
acatatgagagcccgataactgtga

SEQ ID NO: 14023 - DNA, 25 bp, Homo sapien
acatatgaggctgtgtggttaaggc

SEQ ID NO: 14024 - DNA, 25 bp, Homo sapien
acatatgaggctttgtggttaaggc

SEQ ID NO: 14025 - DNA, 25 bp, Homo sapien
acatatgatggacataatgaaaaaa

SEQ ID NO: 14026 - DNA, 25 bp, Homo sapien
acatatggtctactggcggtatcct

SEQ ID NO: 14027 - DNA, 25 bp, Homo sapien
acatatggtctactggtggtatcct

SEQ ID NO: 14028 - DNA, 25 bp, Homo sapien
acatatgtcctcacaaagatatgtg

SEQ ID NO: 14029 - DNA, 25 bp, Homo sapien
acatatgtcctcacgaagatatgtg

SEQ ID NO: 14030 - DNA, 25 bp, Homo sapien
acatatgtgaaatccgcaaatagag

SEQ ID NO: 14031 - DNA, 25 bp, Homo sapien
acatatgtgaaatctgcaaatagag

SEQ ID NO: 14032 - DNA, 25 bp, Homo sapien
acatatgtgacccgtttagtgtcaa

SEQ ID NO: 14033 - DNA, 25 bp, Homo sapien
acatatgtgacctgtttagtgtcaa

SEQ ID NO: 14034 - DNA, 25 bp, Homo sapien
acatatgtgagtatctacttccttt

SEQ ID NO: 14035 - DNA, 25 bp, Homo sapien
acatatgtgagtatttacttccttt

SEQ ID NO: 14036 - DNA, 25 bp, Homo sapien
acatattacgtcatttaactctttc

SEQ ID NO: 14037 - DNA, 25 bp, Homo sapien
acatattatgcacagttggatttat

SEQ ID NO: 14038 - DNA, 25 bp, Homo sapien
acatattatgcccagttggatttat

SEQ ID NO: 14039 - DNA, 25 bp, Homo sapien
acatattatgtcatttaactctttc

SEQ ID NO: 14040 - DNA, 25 bp, Homo sapien
acatattcacagattcttgggattg

SEQ ID NO: 14041 - DNA, 25 bp, Homo sapien
acatattcctcaacaacagcatgca

SEQ ID NO: 14042 - DNA, 25 bp, Homo sapien
acatattcctcagcaacagcatgca

SEQ ID NO: 14043 - DNA, 25 bp, Homo sapien
acatattcgcagattcttgggattg

SEQ ID NO: 14044 - DNA, 25 bp, Homo sapien
acatatttaacagaggagttcaggc

SEQ ID NO: 14045 - DNA, 25 bp, Homo sapien
acatatttagcagaggagttcaggc

SEQ ID NO: 14046 - DNA, 25 bp, Homo sapien
acatatttcaggtggagcaaatgct

SEQ ID NO: 14047 - DNA, 25 bp, Homo sapien
acatatttcaggttgagcaaatgct

SEQ ID NO: 14048 - DNA, 25 bp, Homo sapien
acatatttccattttgtactggaga

SEQ ID NO: 14049 - DNA, 25 bp, Homo sapien
acatattttcattttgtactggaga

SEQ ID NO: 14050 - DNA, 25 bp, Homo sapien
acatcaaacacaatgctccgctcta

SEQ ID NO: 14051 - DNA, 25 bp, Homo sapien
acatcaaacacagtgctccgctcta

SEQ ID NO: 14052 - DNA, 25 bp, Homo sapien
acatcaaatatacaaacacaagctt

SEQ ID NO: 14053 - DNA, 25 bp, Homo sapien
acatcaaatatacaaatacaagctt

SEQ ID NO: 14054 - DNA, 25 bp, Homo sapien
acatcaagccactaaaattactctt

SEQ ID NO: 14055 - DNA, 25 bp, Homo sapien
acatcaagctactaaaattactctt

SEQ ID NO: 14056 - DNA, 25 bp, Homo sapien
acatcaagcttctaggatagtttgt

SEQ ID NO: 14057 - DNA, 25 bp, Homo sapien
acatcaagcttgtaggatagtttgt

SEQ ID NO: 14058 - DNA, 25 bp, Homo sapien
acatcacacccgaacaggcaaaagc

SEQ ID NO: 14059 - DNA, 25 bp, Homo sapien
acatcacagccgaacaggcaaaagc

SEQ ID NO: 14060 - DNA, 25 bp, Homo sapien
acatcacagtttagcctagcctacc

SEQ ID NO: 14061 - DNA, 25 bp, Homo sapien
acatcacagtttagtctagcctacc

SEQ ID NO: 14062 - DNA, 25 bp, Homo sapien
acatcacatactctctgcgatggct

SEQ ID NO: 14063 - DNA, 25 bp, Homo sapien
acatcacatactgtctgcgatggct

SEQ ID NO: 14064 - DNA, 25 bp, Homo sapien
acatcacgcaggaaagtgggggaag

SEQ ID NO: 14065 - DNA, 25 bp, Homo sapien
acatcacgcagtaaagtgggggaag

SEQ ID NO: 14066 - DNA, 25 bp, Homo sapien
acatcactgcacttgcatgagggac

SEQ ID NO: 14067 - DNA, 25 bp, Homo sapien
acatcactgcacttgcttgagggac

SEQ ID NO: 14068 - DNA, 25 bp, Homo sapien
acatcactgtggctgcagcaccgcc

SEQ ID NO: 14069 - DNA, 25 bp, Homo sapien
acatcactgtggctgcggcaccgcc

SEQ ID NO: 14070 - DNA, 25 bp, Homo sapien
acatcagaaaaagactagaccaggt

SEQ ID NO: 14071 - DNA, 25 bp, Homo sapien
acatcagaaaaatactagaccaggt

SEQ ID NO: 14072 - DNA, 25 bp, Homo sapien
acatcagagccacgctaggaaatgt

SEQ ID NO: 14073 - DNA, 25 bp, Homo sapien
acatcagagccatgctaggaaatgt

SEQ ID NO: 14074 - DNA, 25 bp, Homo sapien
acatcagatactccgccttttgtaa

SEQ ID NO: 14075 - DNA, 25 bp, Homo sapien
acatcagatactctgccttttgtaa

SEQ ID NO: 14076 - DNA, 25 bp, Homo sapien
acatcagatactgggaaggcacaat

SEQ ID NO: 14077 - DNA, 25 bp, Homo sapien
acatcagatactgtgaaggcacaat

SEQ ID NO: 14078 - DNA, 25 bp, Homo sapien
acatcagcactagccaggcagtatt

SEQ ID NO: 14079 - DNA, 25 bp, Homo sapien
acatcagcactaggcaggcagtatt

SEQ ID NO: 14080 - DNA, 25 bp, Homo sapien
acatcagtagaaagagcgctggatt

SEQ ID NO: 14081 - DNA, 25 bp, Homo sapien
acatcagtataaagagcgctggatt

SEQ ID NO: 14082 - DNA, 25 bp, Homo sapien
acatcatcaactgtgtaatagtttg

SEQ ID NO: 14083 - DNA, 25 bp, Homo sapien
acatcatcaatataatttgctaatt

SEQ ID NO: 14084 - DNA, 25 bp, Homo sapien
acatcatcacctgtgtaatagtttg

SEQ ID NO: 14085 - DNA, 25 bp, Homo sapien
acatcatcgatataatttgctaatt

SEQ ID NO: 14086 - DNA, 25 bp, Homo sapien
acatcatctacatctggattcctga

SEQ ID NO: 14087 - DNA, 25 bp, Homo sapien
acatcatctgcatctggattcctga

SEQ ID NO: 14088 - DNA, 25 bp, Homo sapien
acatcattccaaacagagactagca

SEQ ID NO: 14089 - DNA, 25 bp, Homo sapien
acatcattccaaaccgagactagca

SEQ ID NO: 14090 - DNA, 25 bp, Homo sapien
acatcattcgctatgctgagctgct

SEQ ID NO: 14091 - DNA, 25 bp, Homo sapien
acatcattggctatgctgagctgct

SEQ ID NO: 14092 - DNA, 25 bp, Homo sapien
acatcatttaggcgtctaaaggtga

SEQ ID NO: 14093 - DNA, 25 bp, Homo sapien
acatcatttaggtgtctaaaggtga

SEQ ID NO: 14094 - DNA, 25 bp, Homo sapien
acatcatttcaccgtcttctcatgg

SEQ ID NO: 14095 - DNA, 25 bp, Homo sapien
acatcatttcactgtcttctcatgg

SEQ ID NO: 14096 - DNA, 25 bp, Homo sapien
acatccaacagtgtgaaaatacaac

SEQ ID NO: 14097 - DNA, 25 bp, Homo sapien
acatccaactgtgtgaaaatacaac

SEQ ID NO: 14098 - DNA, 25 bp, Homo sapien
acatccaagctcccacagttatcca

SEQ ID NO: 14099 - DNA, 25 bp, Homo sapien
acatccaaggtcccacagttatcca

SEQ ID NO: 14100 - DNA, 25 bp, Homo sapien
acatccacaagcgtcaagaccattc

SEQ ID NO: 14101 - DNA, 25 bp, Homo sapien
acatccacaagtgtcaagaccattc

SEQ ID NO: 14102 - DNA, 25 bp, Homo sapien
acatccatcctggcattaaaaagta

SEQ ID NO: 14103 - DNA, 25 bp, Homo sapien
acatccatcctggcgttaaaaagta

SEQ ID NO: 14104 - DNA, 25 bp, Homo sapien
acatccctgattgattataactctc

SEQ ID NO: 14105 - DNA, 25 bp, Homo sapien
acatccctgattgtttataactctc

SEQ ID NO: 14106 - DNA, 25 bp, Homo sapien
acatcccttgctttcagttgtccta

SEQ ID NO: 14107 - DNA, 25 bp, Homo sapien
acatccctttctttcagttgtccta

SEQ ID NO: 14108 - DNA, 25 bp, Homo sapien
acatccgtaacttagcaaaataaaa

SEQ ID NO: 14109 - DNA, 25 bp, Homo sapien
acatccgtaacttggcaaaataaaa

SEQ ID NO: 14110 - DNA, 25 bp, Homo sapien
acatcctaaaacagcttatggacgt

SEQ ID NO: 14111 - DNA, 25 bp, Homo sapien
acatcctaaaagagcttatggacgt

SEQ ID NO: 14112 - DNA, 25 bp, Homo sapien
acatcctcattcagaagcagtcatt

SEQ ID NO: 14113 - DNA, 25 bp, Homo sapien
acatcctcattgagaagcagtcatt

SEQ ID NO: 14114 - DNA, 25 bp, Homo sapien
acatcctgaaccctggttagtcctt

SEQ ID NO: 14115 - DNA, 25 bp, Homo sapien
acatcctgaactctggttagtcctt

SEQ ID NO: 14116 - DNA, 25 bp, Homo sapien
acatcctgaataaggctataaggat

SEQ ID NO: 14117 - DNA, 25 bp, Homo sapien
acatcctgagtaaggctataaggat

SEQ ID NO: 14118 - DNA, 25 bp, Homo sapien
acatccttgcgaagtatttgtccat

SEQ ID NO: 14119 - DNA, 25 bp, Homo sapien
acatccttgtgaagtatttgtccat

SEQ ID NO: 14120 - DNA, 25 bp, Homo sapien
acatcgacaacaggggagccccttg

SEQ ID NO: 14121 - DNA, 25 bp, Homo sapien
acatcgacgacaggggagccccttg

SEQ ID NO: 14122 - DNA, 25 bp, Homo sapien
acatcgagtgaagtcagtgttgaaa

SEQ ID NO: 14123 - DNA, 25 bp, Homo sapien
acatcgagtgaggtcagtgttgaaa

SEQ ID NO: 14124 - DNA, 25 bp, Homo sapien
acatcgatttttgtatgctgaacca

SEQ ID NO: 14125 - DNA, 25 bp, Homo sapien
acatcgatttttgtgtgctgaacca

SEQ ID NO: 14126 - DNA, 25 bp, Homo sapien
acatcgcagaaaatgttaatgagta

SEQ ID NO: 14127 - DNA, 25 bp, Homo sapien
acatcgcagcaaatgttaatgagta

SEQ ID NO: 14128 - DNA, 25 bp, Homo sapien
acatcggccttttccactggcaact

SEQ ID NO: 14129 - DNA, 25 bp, Homo sapien
acatcggcctttttcactggcaact

SEQ ID NO: 14130 - DNA, 25 bp, Homo sapien
acatctaacccttacttgaatctgt

SEQ ID NO: 14131 - DNA, 25 bp, Homo sapien
acatctaacccttatttgaatctgt

SEQ ID NO: 14132 - DNA, 25 bp, Homo sapien
acatctacaaatcacgtacacataa

SEQ ID NO: 14133 - DNA, 25 bp, Homo sapien
acatctacaaatcatgtacacataa

SEQ ID NO: 14134 - DNA, 25 bp, Homo sapien
acatctactcaaccttctaatcatt

SEQ ID NO: 14135 - DNA, 25 bp, Homo sapien
acatctactcaatcttctaatcatt

SEQ ID NO: 14136 - DNA, 25 bp, Homo sapien
acatctactggccgtaagtcgggct

SEQ ID NO: 14137 - DNA, 25 bp, Homo sapien
acatctactggctgtaagtcgggct

SEQ ID NO: 14138 - DNA, 25 bp, Homo sapien
acatctagtgccactttccactcca

SEQ ID NO: 14139 - DNA, 25 bp, Homo sapien
acatctagtgccattttccactcca

SEQ ID NO: 14140 - DNA, 25 bp, Homo sapien
acatctatacacacaaagagtatga

SEQ ID NO: 14141 - DNA, 25 bp, Homo sapien
acatctatacgaacaacaaaaatat

SEQ ID NO: 14142 - DNA, 25 bp, Homo sapien
acatctatatacacaaagagtatga

SEQ ID NO: 14143 - DNA, 25 bp, Homo sapien
acatctatatgaacaacaaaaatat

SEQ ID NO: 14144 - DNA, 25 bp, Homo sapien
acatctcaaaaccaaagttcgcttt

SEQ ID NO: 14145 - DNA, 25 bp, Homo sapien
acatctcaaaaccgaagttcgcttt

SEQ ID NO: 14146 - DNA, 25 bp, Homo sapien
acatctcagggcacgacgagaagcc

SEQ ID NO: 14147 - DNA, 25 bp, Homo sapien
acatctcagggcacgatgagaagcc

SEQ ID NO: 14148 - DNA, 25 bp, Homo sapien
acatctccgcataagtcatattttg

SEQ ID NO: 14149 - DNA, 25 bp, Homo sapien
acatctccgcatgagtcatattttg

SEQ ID NO: 14150 - DNA, 25 bp, Homo sapien
acatctctattccttcaagaaaaaa

SEQ ID NO: 14151 - DNA, 25 bp, Homo sapien
acatctctattccttccagaaaaaa

SEQ ID NO: 14152 - DNA, 25 bp, Homo sapien
acatctctctgttcattcccagcac

SEQ ID NO: 14153 - DNA, 25 bp, Homo sapien
acatctctctgtttattcccagcac

SEQ ID NO: 14154 - DNA, 25 bp, Homo sapien
acatctcttcattgtgcttgtgatt

SEQ ID NO: 14155 - DNA, 25 bp, Homo sapien
acatctcttcttgttctcatggttt

SEQ ID NO: 14156 - DNA, 25 bp, Homo sapien
acatctctttattgtgcttgtgatt

SEQ ID NO: 14157 - DNA, 25 bp, Homo sapien
acatctcttttgagctagtttttat

SEQ ID NO: 14158 - DNA, 25 bp, Homo sapien
acatctcttttgagcttgtttttat

SEQ ID NO: 14159 - DNA, 25 bp, Homo sapien
acatctctttttgttctcatggttt

SEQ ID NO: 14160 - DNA, 25 bp, Homo sapien
acatctgaaaccttgaaacaagtca

SEQ ID NO: 14161 - DNA, 25 bp, Homo sapien
acatctgaacccttgaaacaagtca

SEQ ID NO: 14162 - DNA, 25 bp, Homo sapien
acatctgcgacggtttggatatggt

SEQ ID NO: 14163 - DNA, 25 bp, Homo sapien
acatctgctacggtttggatatggt

SEQ ID NO: 14164 - DNA, 25 bp, Homo sapien
acatctggataatttagaacttctc

SEQ ID NO: 14165 - DNA, 25 bp, Homo sapien
acatctggatagtttagaacttctc

SEQ ID NO: 14166 - DNA, 25 bp, Homo sapien
acatcttaactcactacagcttcaa

SEQ ID NO: 14167 - DNA, 25 bp, Homo sapien
acatcttaactcattacagcttcaa

SEQ ID NO: 14168 - DNA, 25 bp, Homo sapien
acatcttcattttagccacatgaga

SEQ ID NO: 14169 - DNA, 25 bp, Homo sapien
acatcttcattttcgccacatgaga

SEQ ID NO: 14170 - DNA, 25 bp, Homo sapien
acatcttgtggagaccattttaacc

SEQ ID NO: 14171 - DNA, 25 bp, Homo sapien
acatcttgtggagatcattttaacc

SEQ ID NO: 14172 - DNA, 25 bp, Homo sapien
acatcttgtgttcatgatattctgt

SEQ ID NO: 14173 - DNA, 25 bp, Homo sapien
acatcttgtgtttatgatattctgt

SEQ ID NO: 14174 - DNA, 25 bp, Homo sapien
acatgaaaacgagagacaggcctag

SEQ ID NO: 14175 - DNA, 25 bp, Homo sapien
acatgaaaaggagagacaggcctag

SEQ ID NO: 14176 - DNA, 25 bp, Homo sapien
acatgaaagcgttagtatgaaataa

SEQ ID NO: 14177 - DNA, 25 bp, Homo sapien
acatgaaagtgttagtatgaaataa

SEQ ID NO: 14178 - DNA, 25 bp, Homo sapien
acatgaaagttgcctaaaaaccaca

SEQ ID NO: 14179 - DNA, 25 bp, Homo sapien
acatgaaagtttcctaaaaaccaca

SEQ ID NO: 14180 - DNA, 25 bp, Homo sapien
acatgaacaggatactatgaaaaaa

SEQ ID NO: 14181 - DNA, 25 bp, Homo sapien
acatgaacaggatattatgaaaaaa

SEQ ID NO: 14182 - DNA, 25 bp, Homo sapien
acatgaaccaggaaaagctgaatca

SEQ ID NO: 14183 - DNA, 25 bp, Homo sapien
acatgaactaggaaaagctgaatca

SEQ ID NO: 14184 - DNA, 25 bp, Homo sapien
acatgaacttttccaggcttttgat

SEQ ID NO: 14185 - DNA, 25 bp, Homo sapien
acatgaacttttcccggcttttgat

SEQ ID NO: 14186 - DNA, 25 bp, Homo sapien
acatgaagattgagaaaggagatgg

SEQ ID NO: 14187 - DNA, 25 bp, Homo sapien
acatgaagattgaggaaggagatgg

SEQ ID NO: 14188 - DNA, 25 bp, Homo sapien
acatgaaggaacagctcaggtctca

SEQ ID NO: 14189 - DNA, 25 bp, Homo sapien
acatgaaggaacggctcaggtctca

SEQ ID NO: 14190 - DNA, 25 bp, Homo sapien
acatgaataaaaaagcgaaacagcc

SEQ ID NO: 14191 - DNA, 25 bp, Homo sapien
acatgaataaaaaagctaaacagcc

SEQ ID NO: 14192 - DNA, 25 bp, Homo sapien
acatgaataagtaagcccttgttaa

SEQ ID NO: 14193 - DNA, 25 bp, Homo sapien
acatgaataagtaagctcttgttaa

SEQ ID NO: 14194 - DNA, 25 bp, Homo sapien
acatgacaccagttttcagatgggg

SEQ ID NO: 14195 - DNA, 25 bp, Homo sapien
acatgacactagttttcagatgggg

SEQ ID NO: 14196 - DNA, 25 bp, Homo sapien
acatgacacttctgacaccagctgt

SEQ ID NO: 14197 - DNA, 25 bp, Homo sapien
acatgacacttttgacaccagctgt

SEQ ID NO: 14198 - DNA, 25 bp, Homo sapien
acatgaccatcccagttttctccct

SEQ ID NO: 14199 - DNA, 25 bp, Homo sapien
acatgaccatgaagtgggttcacat

SEQ ID NO: 14200 - DNA, 25 bp, Homo sapien
acatgaccatgaggtgggttcacat

SEQ ID NO: 14201 - DNA, 25 bp, Homo sapien
acatgaccgtcccagttttctccct

SEQ ID NO: 14202 - DNA, 25 bp, Homo sapien
acatgacctcactacaaactaaaca

SEQ ID NO: 14203 - DNA, 25 bp, Homo sapien
acatgacctcactacagactaaaca

SEQ ID NO: 14204 - DNA, 25 bp, Homo sapien
acatgacttttcaggatatattctt

SEQ ID NO: 14205 - DNA, 25 bp, Homo sapien
acatgacttttcagtatatattctt

SEQ ID NO: 14206 - DNA, 25 bp, Homo sapien
acatgagagattccgacagtttctt

SEQ ID NO: 14207 - DNA, 25 bp, Homo sapien
acatgagagattctgacagtttctt

SEQ ID NO: 14208 - DNA, 25 bp, Homo sapien
acatgagtaaccaaaaacaggtatg

SEQ ID NO: 14209 - DNA, 25 bp, Homo sapien
acatgagtaaccaaaaccaggtatg

SEQ ID NO: 14210 - DNA, 25 bp, Homo sapien
acatgataaaagcttgcttatttaa

SEQ ID NO: 14211 - DNA, 25 bp, Homo sapien
acatgataaaaggttgcttatttaa

SEQ ID NO: 14212 - DNA, 25 bp, Homo sapien
acatgatcaatcctggtctttatac

SEQ ID NO: 14213 - DNA, 25 bp, Homo sapien
acatgatcagtcctggtctttatac

SEQ ID NO: 14214 - DNA, 25 bp, Homo sapien
acatgatgacgacttagctctcaga

SEQ ID NO: 14215 - DNA, 25 bp, Homo sapien
acatgatgaggacttagctctcaga

SEQ ID NO: 14216 - DNA, 25 bp, Homo sapien
acatgatgttcttattccaatccat

SEQ ID NO: 14217 - DNA, 25 bp, Homo sapien
acatgatgttcttgttccaatccat

SEQ ID NO: 14218 - DNA, 25 bp, Homo sapien
acatgattcagcataatctgttttt

SEQ ID NO: 14219 - DNA, 25 bp, Homo sapien
acatgattcagcgtaatctgttttt

SEQ ID NO: 14220 - DNA, 25 bp, Homo sapien
acatgatttctttcaattgtattcc

SEQ ID NO: 14221 - DNA, 25 bp, Homo sapien
acatgatttctttccattgtattcc

SEQ ID NO: 14222 - DNA, 25 bp, Homo sapien
acatgcaagtattgacatagaggac

SEQ ID NO: 14223 - DNA, 25 bp, Homo sapien
acatgcaattattgacatagaggac

SEQ ID NO: 14224 - DNA, 25 bp, Homo sapien
acatgcacataaaaaaaattcaaca

SEQ ID NO: 14225 - DNA, 25 bp, Homo sapien
acatgcacataaaaaacattcaaca

SEQ ID NO: 14226 - DNA, 25 bp, Homo sapien
acatgcacatccacaatccatgttc

SEQ ID NO: 14227 - DNA, 25 bp, Homo sapien
acatgcacgtccacaatccatgttc

SEQ ID NO: 14228 - DNA, 25 bp, Homo sapien
acatgcagattcgttttcacccttg

SEQ ID NO: 14229 - DNA, 25 bp, Homo sapien
acatgcagatttgttttcacccttg

SEQ ID NO: 14230 - DNA, 25 bp, Homo sapien
acatgcagtccagcagaccatctag

SEQ ID NO: 14231 - DNA, 25 bp, Homo sapien
acatgcagtccagcggaccatctag

SEQ ID NO: 14232 - DNA, 25 bp, Homo sapien
acatgcatatacccatcacctccat

SEQ ID NO: 14233 - DNA, 25 bp, Homo sapien
acatgcatatacctatcacctccat

SEQ ID NO: 14234 - DNA, 25 bp, Homo sapien
acatgccaatacgacatacttttca

SEQ ID NO: 14235 - DNA, 25 bp, Homo sapien
acatgccaatactacatacttttca

SEQ ID NO: 14236 - DNA, 25 bp, Homo sapien
acatgccaccatatctggctaatct

SEQ ID NO: 14237 - DNA, 25 bp, Homo sapien
acatgccaccatttctggctaatct

SEQ ID NO: 14238 - DNA, 25 bp, Homo sapien
acatgccagatgggtcatctcatac

SEQ ID NO: 14239 - DNA, 25 bp, Homo sapien
acatgccagatgtgtcatctcatac

SEQ ID NO: 14240 - DNA, 25 bp, Homo sapien
acatgcccactttcatttctctagt

SEQ ID NO: 14241 - DNA, 25 bp, Homo sapien
acatgcccacttttatttctctagt

SEQ ID NO: 14242 - DNA, 25 bp, Homo sapien
acatgccctcaagcgatgccttttc

SEQ ID NO: 14243 - DNA, 25 bp, Homo sapien
acatgccctcaagtgatgccttttc

SEQ ID NO: 14244 - DNA, 25 bp, Homo sapien
acatgcgaagtttccttaagacaga

SEQ ID NO: 14245 - DNA, 25 bp, Homo sapien
acatgcgaagttttcttaagacaga

SEQ ID NO: 14246 - DNA, 25 bp, Homo sapien
acatgcggtttacaaacattttctc

SEQ ID NO: 14247 - DNA, 25 bp, Homo sapien
acatgcggtttacaaatattttctc

SEQ ID NO: 14248 - DNA, 25 bp, Homo sapien
acatgctccgaatttatgagtatga

SEQ ID NO: 14249 - DNA, 25 bp, Homo sapien
acatgctccttcctgattccttaaa

SEQ ID NO: 14250 - DNA, 25 bp, Homo sapien
acatgctccttcttgattccttaaa

SEQ ID NO: 14251 - DNA, 25 bp, Homo sapien
acatgctcgtccactagccctcgct

SEQ ID NO: 14252 - DNA, 25 bp, Homo sapien
acatgctcgtcgactagccctcgct

SEQ ID NO: 14253 - DNA, 25 bp, Homo sapien
acatgctctgaatttatgagtatga

SEQ ID NO: 14254 - DNA, 25 bp, Homo sapien
acatgctgactctaaccaattgaat

SEQ ID NO: 14255 - DNA, 25 bp, Homo sapien
acatgctgactttaaccaattgaat

SEQ ID NO: 14256 - DNA, 25 bp, Homo sapien
acatgctgccactgagatgttgaca

SEQ ID NO: 14257 - DNA, 25 bp, Homo sapien
acatgctgtcactgagatgttgaca

SEQ ID NO: 14258 - DNA, 25 bp, Homo sapien
acatggaaattacgggtagaaattg

SEQ ID NO: 14259 - DNA, 25 bp, Homo sapien
acatggaaattatgggtagaaattg

SEQ ID NO: 14260 - DNA, 25 bp, Homo sapien
acatggaacatcagatgaaacaatg

SEQ ID NO: 14261 - DNA, 25 bp, Homo sapien
acatggaacatcggatgaaacaatg

SEQ ID NO: 14262 - DNA, 25 bp, Homo sapien
acatggaagaaatctattattaagt

SEQ ID NO: 14263 - DNA, 25 bp, Homo sapien
acatggaagaagtctattattaagt

SEQ ID NO: 14264 - DNA, 25 bp, Homo sapien
acatggaggaaatatctactgggta

SEQ ID NO: 14265 - DNA, 25 bp, Homo sapien
acatggaggaaatgtctactgggta

SEQ ID NO: 14266 - DNA, 25 bp, Homo sapien
acatggagtgcacgtcatagccact

SEQ ID NO: 14267 - DNA, 25 bp, Homo sapien
acatggagtgcatgtcatagccact

SEQ ID NO: 14268 - DNA, 25 bp, Homo sapien
acatggagttaattaagcacaaaat

SEQ ID NO: 14269 - DNA, 25 bp, Homo sapien
acatggagttaattgagcacaaaat

SEQ ID NO: 14270 - DNA, 25 bp, Homo sapien
acatggatgaaagattgcagtaacc

SEQ ID NO: 14271 - DNA, 25 bp, Homo sapien
acatggatgaatgattgcagtaacc

SEQ ID NO: 14272 - DNA, 25 bp, Homo sapien
acatggcaaaggtatggtggccaag

SEQ ID NO: 14273 - DNA, 25 bp, Homo sapien
acatggcaaggacatcttggtcatc

SEQ ID NO: 14274 - DNA, 25 bp, Homo sapien
acatggcaaggatatcttggtcatc

SEQ ID NO: 14275 - DNA, 25 bp, Homo sapien
acatggcagaggtatggtggccaag

SEQ ID NO: 14276 - DNA, 25 bp, Homo sapien
acatggcgataaacccaagaggaag

SEQ ID NO: 14277 - DNA, 25 bp, Homo sapien
acatggcgataaacccgagaggaag

SEQ ID NO: 14278 - DNA, 25 bp, Homo sapien
acatggcttaaatatctctagctaa

SEQ ID NO: 14279 - DNA, 25 bp, Homo sapien
acatggcttaaatgtctctagctaa

SEQ ID NO: 14280 - DNA, 25 bp, Homo sapien
acatgggcaactccggcgtctcagg

SEQ ID NO: 14281 - DNA, 25 bp, Homo sapien
acatgggcaactctggcgtctcagg

SEQ ID NO: 14282 - DNA, 25 bp, Homo sapien
acatggggcctacgcctcagctctt

SEQ ID NO: 14283 - DNA, 25 bp, Homo sapien
acatggggcctatgcctcagctctt

SEQ ID NO: 14284 - DNA, 25 bp, Homo sapien
acatggggttgaaatgcatgctccc

SEQ ID NO: 14285 - DNA, 25 bp, Homo sapien
acatggggttgaattgcatgctccc

SEQ ID NO: 14286 - DNA, 25 bp, Homo sapien
acatggtactgatgataaaaaaaaa

SEQ ID NO: 14287 - DNA, 25 bp, Homo sapien
acatggtactgatgttaaaaaaaaa

SEQ ID NO: 14288 - DNA, 25 bp, Homo sapien
acatggtatagcgccaacattcgaa

SEQ ID NO: 14289 - DNA, 25 bp, Homo sapien
acatggtatagtgccaacattcgaa

SEQ ID NO: 14290 - DNA, 25 bp, Homo sapien
acatggtcttccttccggaacataa

SEQ ID NO: 14291 - DNA, 25 bp, Homo sapien
acatggtcttctttccggaacataa

SEQ ID NO: 14292 - DNA, 25 bp, Homo sapien
acatggtctttccttggtgtgtgca

SEQ ID NO: 14293 - DNA, 25 bp, Homo sapien
acatggtcttttcttggtgtgtgca

SEQ ID NO: 14294 - DNA, 25 bp, Homo sapien
acatggtggtgacaagataaaataa

SEQ ID NO: 14295 - DNA, 25 bp, Homo sapien
acatggtggtgacaaggtaaaataa

SEQ ID NO: 14296 - DNA, 25 bp, Homo sapien
acatggttaagcatcagcattccag

SEQ ID NO: 14297 - DNA, 25 bp, Homo sapien
acatggttaaggatcagcattccag

SEQ ID NO: 14298 - DNA, 25 bp, Homo sapien
acatggttacctacatatcagtttt

SEQ ID NO: 14299 - DNA, 25 bp, Homo sapien
acatggttacctacgtatcagtttt

SEQ ID NO: 14300 - DNA, 25 bp, Homo sapien
acatgtaatgtcatcacatttttct

SEQ ID NO: 14301 - DNA, 25 bp, Homo sapien
acatgtaatgtcgtcacatttttct

SEQ ID NO: 14302 - DNA, 25 bp, Homo sapien
acatgtaattcctgacattgagctt

SEQ ID NO: 14303 - DNA, 25 bp, Homo sapien
acatgtaattcctgacgttgagctt

SEQ ID NO: 14304 - DNA, 25 bp, Homo sapien
acatgtagaggcctactcctcacag

SEQ ID NO: 14305 - DNA, 25 bp, Homo sapien
acatgtagaggccttctcctcacag

SEQ ID NO: 14306 - DNA, 25 bp, Homo sapien
acatgtatacttactgacctgctgc

SEQ ID NO: 14307 - DNA, 25 bp, Homo sapien
acatgtatacttattgacctgctgc

SEQ ID NO: 14308 - DNA, 25 bp, Homo sapien
acatgtcacctaacagcatgtggcc

SEQ ID NO: 14309 - DNA, 25 bp, Homo sapien
acatgtcacctaatagcatgtggcc

SEQ ID NO: 14310 - DNA, 25 bp, Homo sapien
acatgtcagtctccctgatgattct

SEQ ID NO: 14311 - DNA, 25 bp, Homo sapien
acatgtcagtctctctgatgattct

SEQ ID NO: 14312 - DNA, 25 bp, Homo sapien
acatgtccatcacacgatttattat

SEQ ID NO: 14313 - DNA, 25 bp, Homo sapien
acatgtccatcccacgatttattat

SEQ ID NO: 14314 - DNA, 25 bp, Homo sapien
acatgtccttcccggtgtctcaggc

SEQ ID NO: 14315 - DNA, 25 bp, Homo sapien
acatgtccttcctggtgtctcaggc

SEQ ID NO: 14316 - DNA, 25 bp, Homo sapien
acatgtgaacctgggtagtccctga

SEQ ID NO: 14317 - DNA, 25 bp, Homo sapien
acatgtgaatctgggtagtccctga

SEQ ID NO: 14318 - DNA, 25 bp, Homo sapien
acatgtgacaaaagaaaagaattga

SEQ ID NO: 14319 - DNA, 25 bp, Homo sapien
acatgtgacaaaggaaaagaattga

SEQ ID NO: 14320 - DNA, 25 bp, Homo sapien
acatgtgcatacatgaattttgttt

SEQ ID NO: 14321 - DNA, 25 bp, Homo sapien
acatgtgcatacatgagttttgttt

SEQ ID NO: 14322 - DNA, 25 bp, Homo sapien
acatgtggtcaccagctgttggatg

SEQ ID NO: 14323 - DNA, 25 bp, Homo sapien
acatgtggtcacgagctgttggatg

SEQ ID NO: 14324 - DNA, 25 bp, Homo sapien
acatgtgtagaagtctccttggttt

SEQ ID NO: 14325 - DNA, 25 bp, Homo sapien
acatgtgtagacgtctccttggttt

SEQ ID NO: 14326 - DNA, 25 bp, Homo sapien
acatgtgtcctgaagaaatgacgac

SEQ ID NO: 14327 - DNA, 25 bp, Homo sapien
acatgtgtcctgcagaaatgacgac

SEQ ID NO: 14328 - DNA, 25 bp, Homo sapien
acatgtgtgtttagaaggagccttt

SEQ ID NO: 14329 - DNA, 25 bp, Homo sapien
acatgtgtgtttagtaggagccttt

SEQ ID NO: 14330 - DNA, 25 bp, Homo sapien
acatgttaagtggcaatgttccatg

SEQ ID NO: 14331 - DNA, 25 bp, Homo sapien
acatgttaagtggtaatgttccatg

SEQ ID NO: 14332 - DNA, 25 bp, Homo sapien
acatgttacatacaccatgagaatg

SEQ ID NO: 14333 - DNA, 25 bp, Homo sapien
acatgttacatagaccatgagaatg

SEQ ID NO: 14334 - DNA, 25 bp, Homo sapien
acatgttccattgctttttcttaga

SEQ ID NO: 14335 - DNA, 25 bp, Homo sapien
acatgttccattgttttttcttaga

SEQ ID NO: 14336 - DNA, 25 bp, Homo sapien
acatgttgagattagaaaggtgagc

SEQ ID NO: 14337 - DNA, 25 bp, Homo sapien
acatgttgagattggaaaggtgagc

SEQ ID NO: 14338 - DNA, 25 bp, Homo sapien
acatgttgatccataaaaaatctaa

SEQ ID NO: 14339 - DNA, 25 bp, Homo sapien
acatgttgatccgtaaaaaatctaa

SEQ ID NO: 14340 - DNA, 25 bp, Homo sapien
acatgttgatttacctttaacaaac

SEQ ID NO: 14341 - DNA, 25 bp, Homo sapien
acatgttgatttatctttaacaaac

SEQ ID NO: 14342 - DNA, 25 bp, Homo sapien
acatgttgtggcgagactgaaatcc

SEQ ID NO: 14343 - DNA, 25 bp, Homo sapien
acatgttgtggtgagactgaaatcc

SEQ ID NO: 14344 - DNA, 25 bp, Homo sapien
acatgtttagaaattttggattata

SEQ ID NO: 14345 - DNA, 25 bp, Homo sapien
acatgtttagaagttttggattata

SEQ ID NO: 14346 - DNA, 25 bp, Homo sapien
acatgttttatgagcatatgcatac

SEQ ID NO: 14347 - DNA, 25 bp, Homo sapien
acatgttttcacatcggtcacttta

SEQ ID NO: 14348 - DNA, 25 bp, Homo sapien
acatgttttcacattggtcacttta

SEQ ID NO: 14349 - DNA, 25 bp, Homo sapien
acatgttttgtgagcatatgcatac

SEQ ID NO: 14350 - DNA, 25 bp, Homo sapien
acatgttttttagtcagggtgaatg

SEQ ID NO: 14351 - DNA, 25 bp, Homo sapien
acatgttttttagtgagggtgaatg

SEQ ID NO: 14352 - DNA, 25 bp, Homo sapien
acattaaaagaccattcatatgcaa

SEQ ID NO: 14353 - DNA, 25 bp, Homo sapien
acattaaaagatcattcatatgcaa

SEQ ID NO: 14354 - DNA, 25 bp, Homo sapien
acattaaatttcagtcttggcttca

SEQ ID NO: 14355 - DNA, 25 bp, Homo sapien
acattaaattttagtcttggcttca

SEQ ID NO: 14356 - DNA, 25 bp, Homo sapien
acattaactgcccagtgatgtcaca

SEQ ID NO: 14357 - DNA, 25 bp, Homo sapien
acattaactgcccattgatgtcaca

SEQ ID NO: 14358 - DNA, 25 bp, Homo sapien
acattaataagtggatgtcctcatt

SEQ ID NO: 14359 - DNA, 25 bp, Homo sapien
acattaataagtgggtgtcctcatt

SEQ ID NO: 14360 - DNA, 25 bp, Homo sapien
acattaatatcctagtacctctcca

SEQ ID NO: 14361 - DNA, 25 bp, Homo sapien
acattaatatccttgtacctctcca

SEQ ID NO: 14362 - DNA, 25 bp, Homo sapien
acattaattttatctgcagcatcct

SEQ ID NO: 14363 - DNA, 25 bp, Homo sapien
acattaattttgtctgcagcatcct

SEQ ID NO: 14364 - DNA, 25 bp, Homo sapien
acattacaacatacactaaatgtaa

SEQ ID NO: 14365 - DNA, 25 bp, Homo sapien
acattacaacatacgctaaatgtaa

SEQ ID NO: 14366 - DNA, 25 bp, Homo sapien
acattacgtggcgatcccaattcag

SEQ ID NO: 14367 - DNA, 25 bp, Homo sapien
acattacgtggcggtcccaattcag

SEQ ID NO: 14368 - DNA, 25 bp, Homo sapien
acattagacaaataacgcattcctg

SEQ ID NO: 14369 - DNA, 25 bp, Homo sapien
acattagacgaataacgcattcctg

SEQ ID NO: 14370 - DNA, 25 bp, Homo sapien
acattatagatcacaggcatgtttt

SEQ ID NO: 14371 - DNA, 25 bp, Homo sapien
acattatagatgacaggcatgtttt

SEQ ID NO: 14372 - DNA, 25 bp, Homo sapien
acattatataggcacaccactcatc

SEQ ID NO: 14373 - DNA, 25 bp, Homo sapien
acattatataggcataccactcatc

SEQ ID NO: 14374 - DNA, 25 bp, Homo sapien
acattatgaggtccaaaaattggta

SEQ ID NO: 14375 - DNA, 25 bp, Homo sapien
acattatgaggttcaaaaattggta

SEQ ID NO: 14376 - DNA, 25 bp, Homo sapien
acattatgccaaatgaaacaaatca

SEQ ID NO: 14377 - DNA, 25 bp, Homo sapien
acattatgccaagtgaaacaaatca

SEQ ID NO: 14378 - DNA, 25 bp, Homo sapien
acattcaaattaaagagaaaaccta

SEQ ID NO: 14379 - DNA, 25 bp, Homo sapien
acattcaagcccttacgaacaaaag

SEQ ID NO: 14380 - DNA, 25 bp, Homo sapien
acattcaagcccttactaacaaaag

SEQ ID NO: 14381 - DNA, 25 bp, Homo sapien
acattcaagttaaagagaaaaccta

SEQ ID NO: 14382 - DNA, 25 bp, Homo sapien
acattcaatgcactgtattggattt

SEQ ID NO: 14383 - DNA, 25 bp, Homo sapien
acattcaatgcgctgtattggattt

SEQ ID NO: 14384 - DNA, 25 bp, Homo sapien
acattcacatacatgccataagtcc

SEQ ID NO: 14385 - DNA, 25 bp, Homo sapien
acattcacatacgtgccataagtcc

SEQ ID NO: 14386 - DNA, 25 bp, Homo sapien
acattcagaagctcgtagaattgtt

SEQ ID NO: 14387 - DNA, 25 bp, Homo sapien
acattcagaagcttgtagaattgtt

SEQ ID NO: 14388 - DNA, 25 bp, Homo sapien
acattcagattgttggtaagaggaa

SEQ ID NO: 14389 - DNA, 25 bp, Homo sapien
acattcagattgtttgtaagaggaa

SEQ ID NO: 14390 - DNA, 25 bp, Homo sapien
acattcagccacaccgggaatgatg

SEQ ID NO: 14391 - DNA, 25 bp, Homo sapien
acattcagccacgccgggaatgatg

SEQ ID NO: 14392 - DNA, 25 bp, Homo sapien
acattcagccagaaagatcatgatg

SEQ ID NO: 14393 - DNA, 25 bp, Homo sapien
acattcagccaggaagatcatgatg

SEQ ID NO: 14394 - DNA, 25 bp, Homo sapien
acattcataattgcaaaattcagac

SEQ ID NO: 14395 - DNA, 25 bp, Homo sapien
acattcatatttcttaaactagcct

SEQ ID NO: 14396 - DNA, 25 bp, Homo sapien
acattcatattttttaaactagcct

SEQ ID NO: 14397 - DNA, 25 bp, Homo sapien
acattcatcacagtaatgacaatgt

SEQ ID NO: 14398 - DNA, 25 bp, Homo sapien
acattcatcacggtaatgacaatgt

SEQ ID NO: 14399 - DNA, 25 bp, Homo sapien
acattcatcatacaaaagaatcata

SEQ ID NO: 14400 - DNA, 25 bp, Homo sapien
acattcatcatataaaagaatcata

SEQ ID NO: 14401 - DNA, 25 bp, Homo sapien
acattcatcattgcaaaattcagac

SEQ ID NO: 14402 - DNA, 25 bp, Homo sapien
acattcatccagataaaaactacct

SEQ ID NO: 14403 - DNA, 25 bp, Homo sapien
acattcatccagctaaaaactacct

SEQ ID NO: 14404 - DNA, 25 bp, Homo sapien
acattcatcctcttgcccatcagtt

SEQ ID NO: 14405 - DNA, 25 bp, Homo sapien
acattcattctcttgcccatcagtt

SEQ ID NO: 14406 - DNA, 25 bp, Homo sapien
acattccaacatatattagtctgcc

SEQ ID NO: 14407 - DNA, 25 bp, Homo sapien
acattccaacatgtattagtctgcc

SEQ ID NO: 14408 - DNA, 25 bp, Homo sapien
acattccacattctgcacaccagtc

SEQ ID NO: 14409 - DNA, 25 bp, Homo sapien
acattccacattcttcacaccagtc

SEQ ID NO: 14410 - DNA, 25 bp, Homo sapien
acattccataacatcttaatggttg

SEQ ID NO: 14411 - DNA, 25 bp, Homo sapien
acattccataacattttaatggttg

SEQ ID NO: 14412 - DNA, 25 bp, Homo sapien
acattccctatggcctatggactta

SEQ ID NO: 14413 - DNA, 25 bp, Homo sapien
acattccctatggcctgtggactta

SEQ ID NO: 14414 - DNA, 25 bp, Homo sapien
acattccctgtcaatttcttgagtt

SEQ ID NO: 14415 - DNA, 25 bp, Homo sapien
acattccctgttaatttcttgagtt

SEQ ID NO: 14416 - DNA, 25 bp, Homo sapien
acattcctaccatctgtgtaaaagc

SEQ ID NO: 14417 - DNA, 25 bp, Homo sapien
acattcctagcatctgtgtaaaagc

SEQ ID NO: 14418 - DNA, 25 bp, Homo sapien
acattcctgagtcacagagtacaaa

SEQ ID NO: 14419 - DNA, 25 bp, Homo sapien
acattcctgagtcatagagtacaaa

SEQ ID NO: 14420 - DNA, 25 bp, Homo sapien
acattccttattatacaagagaggc

SEQ ID NO: 14421 - DNA, 25 bp, Homo sapien
acattccttattctacaagagaggc

SEQ ID NO: 14422 - DNA, 25 bp, Homo sapien
acattctaaacatcataaggaaatt

SEQ ID NO: 14423 - DNA, 25 bp, Homo sapien
acattctaaacatcgtaaggaaatt

SEQ ID NO: 14424 - DNA, 25 bp, Homo sapien
acattctaactacaatttcaaaatc

SEQ ID NO: 14425 - DNA, 25 bp, Homo sapien
acattctacctacaatttcaaaatc

SEQ ID NO: 14426 - DNA, 25 bp, Homo sapien
acattctacgactctctaagtgtat

SEQ ID NO: 14427 - DNA, 25 bp, Homo sapien
acattctatgactctctaagtgtat

SEQ ID NO: 14428 - DNA, 25 bp, Homo sapien
acattctcaggcattacaggaggga

SEQ ID NO: 14429 - DNA, 25 bp, Homo sapien
acattctcaggcattagaggaggga

SEQ ID NO: 14430 - DNA, 25 bp, Homo sapien
acattctcccaggccattctaacgt

SEQ ID NO: 14431 - DNA, 25 bp, Homo sapien
acattctcccaggcgattctaacgt

SEQ ID NO: 14432 - DNA, 25 bp, Homo sapien
acattctgaacagtaccatttagat

SEQ ID NO: 14433 - DNA, 25 bp, Homo sapien
acattctgaaccgtaccatttagat

SEQ ID NO: 14434 - DNA, 25 bp, Homo sapien
acattctgtgaaacctttcaaagag

SEQ ID NO: 14435 - DNA, 25 bp, Homo sapien
acattctgtgaaatctttcaaagag

SEQ ID NO: 14436 - DNA, 25 bp, Homo sapien
acattctttcaattctgtccacctt

SEQ ID NO: 14437 - DNA, 25 bp, Homo sapien
acattctttcagttctgtccacctt

SEQ ID NO: 14438 - DNA, 25 bp, Homo sapien
acattgaaatctataacccattttg

SEQ ID NO: 14439 - DNA, 25 bp, Homo sapien
acattgaaatctgtaacccattttg

SEQ ID NO: 14440 - DNA, 25 bp, Homo sapien
acattgaacgggttcatctgaaatt

SEQ ID NO: 14441 - DNA, 25 bp, Homo sapien
acattgaatgggttcatctgaaatt

SEQ ID NO: 14442 - DNA, 25 bp, Homo sapien
acattgacaaaacgcagaaggggta

SEQ ID NO: 14443 - DNA, 25 bp, Homo sapien
acattgacaaaatgcagaaggggta

SEQ ID NO: 14444 - DNA, 25 bp, Homo sapien
acattgaccaagttagaaagctaaa

SEQ ID NO: 14445 - DNA, 25 bp, Homo sapien
acattgacccagttagaaagctaaa

SEQ ID NO: 14446 - DNA, 25 bp, Homo sapien
acattgagccaccatttaagaaatc

SEQ ID NO: 14447 - DNA, 25 bp, Homo sapien
acattgagccatcatttaagaaatc

SEQ ID NO: 14448 - DNA, 25 bp, Homo sapien
acattgatagtgacatggctttatt

SEQ ID NO: 14449 - DNA, 25 bp, Homo sapien
acattgatattgacatggctttatt

SEQ ID NO: 14450 - DNA, 25 bp, Homo sapien
acattgattacctgagttgcaaaaa

SEQ ID NO: 14451 - DNA, 25 bp, Homo sapien
acattgattacctgggttgcaaaaa

SEQ ID NO: 14452 - DNA, 25 bp, Homo sapien
acattgattgaaaggctattccatt

SEQ ID NO: 14453 - DNA, 25 bp, Homo sapien
acattgattgaagggctattccatt

SEQ ID NO: 14454 - DNA, 25 bp, Homo sapien
acattgatttgtgcatctgtaaaat

SEQ ID NO: 14455 - DNA, 25 bp, Homo sapien
acattgatttgtgtatctgtaaaat

SEQ ID NO: 14456 - DNA, 25 bp, Homo sapien
acattgcacatggcggtgatcaagc

SEQ ID NO: 14457 - DNA, 25 bp, Homo sapien
acattgcacatggtggtgatcaagc

SEQ ID NO: 14458 - DNA, 25 bp, Homo sapien
acattgcagtggatgagaaataaat

SEQ ID NO: 14459 - DNA, 25 bp, Homo sapien
acattgcagtgggtgagaaataaat

SEQ ID NO: 14460 - DNA, 25 bp, Homo sapien
acattgctaaaagtcctatgcagta

SEQ ID NO: 14461 - DNA, 25 bp, Homo sapien
acattgctatgaacataggataaga

SEQ ID NO: 14462 - DNA, 25 bp, Homo sapien
acattgctcaaagtcctatgcagta

SEQ ID NO: 14463 - DNA, 25 bp, Homo sapien
acattgctgtcatgaaaagtagtat

SEQ ID NO: 14464 - DNA, 25 bp, Homo sapien
acattgctgtcattaaaagtagtat

SEQ ID NO: 14465 - DNA, 25 bp, Homo sapien
acattgctgtgaacataggataaga

SEQ ID NO: 14466 - DNA, 25 bp, Homo sapien
acattggctccactgttggtcaaga

SEQ ID NO: 14467 - DNA, 25 bp, Homo sapien
acattggctccgctgttggtcaaga

SEQ ID NO: 14468 - DNA, 25 bp, Homo sapien
acattgggattgactgcatttgtgt

SEQ ID NO: 14469 - DNA, 25 bp, Homo sapien
acattgggattgattgcatttgtgt

SEQ ID NO: 14470 - DNA, 25 bp, Homo sapien
acattgggtctgcatattgaacttt

SEQ ID NO: 14471 - DNA, 25 bp, Homo sapien
acattgggtttgcatattgaacttt

SEQ ID NO: 14472 - DNA, 25 bp, Homo sapien
acattggttctcctgtgtgtgctga

SEQ ID NO: 14473 - DNA, 25 bp, Homo sapien
acattggttttcctgtgtgtgctga

SEQ ID NO: 14474 - DNA, 25 bp, Homo sapien
acattgtacgacaatcaatcctaca

SEQ ID NO: 14475 - DNA, 25 bp, Homo sapien
acattgtatgacaatcaatcctaca

SEQ ID NO: 14476 - DNA, 25 bp, Homo sapien
acattgtctctgctgggtgtgatat

SEQ ID NO: 14477 - DNA, 25 bp, Homo sapien
acattgtctttgctgggtgtgatat

SEQ ID NO: 14478 - DNA, 25 bp, Homo sapien
acattgtgccttgtcaacatattag

SEQ ID NO: 14479 - DNA, 25 bp, Homo sapien
acattgtgccttttcaacatattag

SEQ ID NO: 14480 - DNA, 25 bp, Homo sapien
acattgtttctaaaaattcattact

SEQ ID NO: 14481 - DNA, 25 bp, Homo sapien
acattgtttctaagaattcattact

SEQ ID NO: 14482 - DNA, 25 bp, Homo sapien
acatttaaagagccatgattattgt

SEQ ID NO: 14483 - DNA, 25 bp, Homo sapien
acatttaaagagccgtgattattgt

SEQ ID NO: 14484 - DNA, 25 bp, Homo sapien
acatttaactgattccttggctcac

SEQ ID NO: 14485 - DNA, 25 bp, Homo sapien
acatttaactgattgcttggctcac

SEQ ID NO: 14486 - DNA, 25 bp, Homo sapien
acatttaagctaactttgtcatggg

SEQ ID NO: 14487 - DNA, 25 bp, Homo sapien
acatttaagctaattttgtcatggg

SEQ ID NO: 14488 - DNA, 25 bp, Homo sapien
acatttacgtagacgtttttgtgtg

SEQ ID NO: 14489 - DNA, 25 bp, Homo sapien
acatttacgtagtcgtttttgtgtg

SEQ ID NO: 14490 - DNA, 25 bp, Homo sapien
acatttagaaaagagcaaaccgtag

SEQ ID NO: 14491 - DNA, 25 bp, Homo sapien
acatttagagaagagcaaaccgtag

SEQ ID NO: 14492 - DNA, 25 bp, Homo sapien
acatttagattggtgtaagcctttg

SEQ ID NO: 14493 - DNA, 25 bp, Homo sapien
acatttagattgttgtaagcctttg

SEQ ID NO: 14494 - DNA, 25 bp, Homo sapien
acatttagttgcgttgaactcaaaa

SEQ ID NO: 14495 - DNA, 25 bp, Homo sapien
acatttagttgggttgaactcaaaa

SEQ ID NO: 14496 - DNA, 25 bp, Homo sapien
acatttatactcaacttgcctgttt

SEQ ID NO: 14497 - DNA, 25 bp, Homo sapien
acatttatattcaacttgcctgttt

SEQ ID NO: 14498 - DNA, 25 bp, Homo sapien
acatttatcaatcacctgcaatgcc

SEQ ID NO: 14499 - DNA, 25 bp, Homo sapien
acatttatcaattacctgcaatgcc

SEQ ID NO: 14500 - DNA, 25 bp, Homo sapien
acatttatcggtttgtgtatgttaa

SEQ ID NO: 14501 - DNA, 25 bp, Homo sapien
acatttatgatctcacagttctgca

SEQ ID NO: 14502 - DNA, 25 bp, Homo sapien
acatttatgatttcacagttctgca

SEQ ID NO: 14503 - DNA, 25 bp, Homo sapien
acatttattacacgtcacaaaaagt

SEQ ID NO: 14504 - DNA, 25 bp, Homo sapien
acatttattacatgtcacaaaaagt

SEQ ID NO: 14505 - DNA, 25 bp, Homo sapien
acatttattggtttgtgtatgttaa

SEQ ID NO: 14506 - DNA, 25 bp, Homo sapien
acatttatttagccgtcactatata

SEQ ID NO: 14507 - DNA, 25 bp, Homo sapien
acatttatttagccttcactatata

SEQ ID NO: 14508 - DNA, 25 bp, Homo sapien
acatttatttgaaccttttttgacc

SEQ ID NO: 14509 - DNA, 25 bp, Homo sapien
acatttatttgaactttttttgacc

SEQ ID NO: 14510 - DNA, 25 bp, Homo sapien
acatttcaacaacggctaaaaacat

SEQ ID NO: 14511 - DNA, 25 bp, Homo sapien
acatttcaacaagggctaaaaacat

SEQ ID NO: 14512 - DNA, 25 bp, Homo sapien
acatttcaatagttgcccagctttg

SEQ ID NO: 14513 - DNA, 25 bp, Homo sapien
acatttcaccataagcgtgcatgca

SEQ ID NO: 14514 - DNA, 25 bp, Homo sapien
acatttcaccataggcgtgcatgca

SEQ ID NO: 14515 - DNA, 25 bp, Homo sapien
acatttcagaagatctcgtttaaac

SEQ ID NO: 14516 - DNA, 25 bp, Homo sapien
acatttcagaaggtctcgtttaaac

SEQ ID NO: 14517 - DNA, 25 bp, Homo sapien
acatttcaggcaaagaaagtaggtt

SEQ ID NO: 14518 - DNA, 25 bp, Homo sapien
acatttcaggcaatctgacatacta

SEQ ID NO: 14519 - DNA, 25 bp, Homo sapien
acatttcaggcagagaaagtaggtt

SEQ ID NO: 14520 - DNA, 25 bp, Homo sapien
acatttcaggcgatctgacatacta

SEQ ID NO: 14521 - DNA, 25 bp, Homo sapien
acatttcagtagttgcccagctttg

SEQ ID NO: 14522 - DNA, 25 bp, Homo sapien
acatttccatacaagaagtccagat

SEQ ID NO: 14523 - DNA, 25 bp, Homo sapien
acatttccatcagaatttgagtagc

SEQ ID NO: 14524 - DNA, 25 bp, Homo sapien
acatttccatcggaatttgagtagc

SEQ ID NO: 14525 - DNA, 25 bp, Homo sapien
acatttcccgttaggaaccacgatt

SEQ ID NO: 14526 - DNA, 25 bp, Homo sapien
acatttccctggcttgatttcttat

SEQ ID NO: 14527 - DNA, 25 bp, Homo sapien
acatttcccttcgggttccagcctc

SEQ ID NO: 14528 - DNA, 25 bp, Homo sapien
acatttccctttaggaaccacgatt

SEQ ID NO: 14529 - DNA, 25 bp, Homo sapien
acatttccctttgggttccagcctc

SEQ ID NO: 14530 - DNA, 25 bp, Homo sapien
acatttccgtacaagaagtccagat

SEQ ID NO: 14531 - DNA, 25 bp, Homo sapien
acatttccgtggcttgatttcttat

SEQ ID NO: 14532 - DNA, 25 bp, Homo sapien
acatttcctcatagtttcaccaccc

SEQ ID NO: 14533 - DNA, 25 bp, Homo sapien
acatttcctgcaaagatatttttca

SEQ ID NO: 14534 - DNA, 25 bp, Homo sapien
acatttcctgcagacaagactgctt

SEQ ID NO: 14535 - DNA, 25 bp, Homo sapien
acatttcctgcagataagactgctt

SEQ ID NO: 14536 - DNA, 25 bp, Homo sapien
acatttcctgcgaagatatttttca

SEQ ID NO: 14537 - DNA, 25 bp, Homo sapien
acatttccttatagtttcaccaccc

SEQ ID NO: 14538 - DNA, 25 bp, Homo sapien
acatttcgtaacgctatttctgcca

SEQ ID NO: 14539 - DNA, 25 bp, Homo sapien
acatttcgtaatgctatttctgcca

SEQ ID NO: 14540 - DNA, 25 bp, Homo sapien
acatttctctctgacagtcccattg

SEQ ID NO: 14541 - DNA, 25 bp, Homo sapien
acatttctctcttacagtcccattg

SEQ ID NO: 14542 - DNA, 25 bp, Homo sapien
acatttctgccattacattagtcaa

SEQ ID NO: 14543 - DNA, 25 bp, Homo sapien
acatttctgtcattacattagtcaa

SEQ ID NO: 14544 - DNA, 25 bp, Homo sapien
acatttctttcactaagttatcaca

SEQ ID NO: 14545 - DNA, 25 bp, Homo sapien
acatttctttcgctaagttatcaca

SEQ ID NO: 14546 - DNA, 25 bp, Homo sapien
acatttgcccgcaccttccatgcag

SEQ ID NO: 14547 - DNA, 25 bp, Homo sapien
acatttgcctgcaccttccatgcag

SEQ ID NO: 14548 - DNA, 25 bp, Homo sapien
acatttgctagaagaattgtctttt

SEQ ID NO: 14549 - DNA, 25 bp, Homo sapien
acatttgctagacgaattgtctttt

SEQ ID NO: 14550 - DNA, 25 bp, Homo sapien
acatttgcttcaccttctgttttca

SEQ ID NO: 14551 - DNA, 25 bp, Homo sapien
acatttgcttcgccttctgttttca

SEQ ID NO: 14552 - DNA, 25 bp, Homo sapien
acatttgtatttcagttgcatcagt

SEQ ID NO: 14553 - DNA, 25 bp, Homo sapien
acatttgtatttgcagtcttctgct

SEQ ID NO: 14554 - DNA, 25 bp, Homo sapien
acatttgtattttagttgcatcagt

SEQ ID NO: 14555 - DNA, 25 bp, Homo sapien
acatttgtattttcagtcttctgct

SEQ ID NO: 14556 - DNA, 25 bp, Homo sapien
acatttgtgactcaataacatgaac

SEQ ID NO: 14557 - DNA, 25 bp, Homo sapien
acatttgtgactcaatcacatgaac

SEQ ID NO: 14558 - DNA, 25 bp, Homo sapien
acatttgtgggagatattgaatatt

SEQ ID NO: 14559 - DNA, 25 bp, Homo sapien
acatttgttacaagtaatgggctag

SEQ ID NO: 14560 - DNA, 25 bp, Homo sapien
acatttgttgcaagtaatgggctag

SEQ ID NO: 14561 - DNA, 25 bp, Homo sapien
acatttgttggagatattgaatatt

SEQ ID NO: 14562 - DNA, 25 bp, Homo sapien
acattttacactcactgactgtgtt

SEQ ID NO: 14563 - DNA, 25 bp, Homo sapien
acattttacacttactgactgtgtt

SEQ ID NO: 14564 - DNA, 25 bp, Homo sapien
acattttactcattctttactgagt

SEQ ID NO: 14565 - DNA, 25 bp, Homo sapien
acattttactcgttctttactgagt

SEQ ID NO: 14566 - DNA, 25 bp, Homo sapien
acattttcaaaaaacggtcagctga

SEQ ID NO: 14567 - DNA, 25 bp, Homo sapien
acattttcaaaaaatggtcagctga

SEQ ID NO: 14568 - DNA, 25 bp, Homo sapien
acattttcggtttggcatagcacat

SEQ ID NO: 14569 - DNA, 25 bp, Homo sapien
acattttcggtttggcgtagcacat

SEQ ID NO: 14570 - DNA, 25 bp, Homo sapien
acattttctaccacgctcccttacc

SEQ ID NO: 14571 - DNA, 25 bp, Homo sapien
acattttctaccatgctcccttacc

SEQ ID NO: 14572 - DNA, 25 bp, Homo sapien
acattttctaggttccacattcgtc

SEQ ID NO: 14573 - DNA, 25 bp, Homo sapien
acattttctaggttgcacattcgtc

SEQ ID NO: 14574 - DNA, 25 bp, Homo sapien
acattttctattccttttggagttg

SEQ ID NO: 14575 - DNA, 25 bp, Homo sapien
acattttctatttcttttggagttg

SEQ ID NO: 14576 - DNA, 25 bp, Homo sapien
acattttctctcagtgttcttaagt

SEQ ID NO: 14577 - DNA, 25 bp, Homo sapien
acattttctgtcagtgttcttaagt

SEQ ID NO: 14578 - DNA, 25 bp, Homo sapien
acattttcttgattcaactattctc

SEQ ID NO: 14579 - DNA, 25 bp, Homo sapien
acattttcttgattcacctattctc

SEQ ID NO: 14580 - DNA, 25 bp, Homo sapien
acattttgagccaaataaccctttg

SEQ ID NO: 14581 - DNA, 25 bp, Homo sapien
acattttgagccagataaccctttg

SEQ ID NO: 14582 - DNA, 25 bp, Homo sapien
acattttgccactatcttcttagga

SEQ ID NO: 14583 - DNA, 25 bp, Homo sapien
acattttgccactgtcttcttagga

SEQ ID NO: 14584 - DNA, 25 bp, Homo sapien
acatttttatagctaaatctctttc

SEQ ID NO: 14585 - DNA, 25 bp, Homo sapien
acatttttcaaagtgcacacattgg

SEQ ID NO: 14586 - DNA, 25 bp, Homo sapien
acatttttgaaaatacggtctctgt

SEQ ID NO: 14587 - DNA, 25 bp, Homo sapien
acatttttgaaagtgcacacattgg

SEQ ID NO: 14588 - DNA, 25 bp, Homo sapien
acatttttgaagatacggtctctgt

SEQ ID NO: 14589 - DNA, 25 bp, Homo sapien
acatttttgtagctaaatctctttc

SEQ ID NO: 14590 - DNA, 25 bp, Homo sapien
acatttttgtgaacttcccaaaatc

SEQ ID NO: 14591 - DNA, 25 bp, Homo sapien
acatttttgtggacttcccaaaatc

SEQ ID NO: 14592 - DNA, 25 bp, Homo sapien
acattttttataaaggccttgagca

SEQ ID NO: 14593 - DNA, 25 bp, Homo sapien
acattttttataagggccttgagca

SEQ ID NO: 14594 - DNA, 25 bp, Homo sapien
accaaaaaaaaagtggatgtgtgga

SEQ ID NO: 14595 - DNA, 25 bp, Homo sapien
accaaaaaaaatgtggatgtgtgga

SEQ ID NO: 14596 - DNA, 25 bp, Homo sapien
accaaaaactgggcgcagtaatgag

SEQ ID NO: 14597 - DNA, 25 bp, Homo sapien
accaaaaactgggtgcagtaatgag

SEQ ID NO: 14598 - DNA, 25 bp, Homo sapien
accaaaaatcgaatgtagctctgat

SEQ ID NO: 14599 - DNA, 25 bp, Homo sapien
accaaaaatcgagtgtagctctgat

SEQ ID NO: 14600 - DNA, 25 bp, Homo sapien
accaaaacctcatgatggcctgcag

SEQ ID NO: 14601 - DNA, 25 bp, Homo sapien
accaaaacctcatgttggcctgcag

SEQ ID NO: 14602 - DNA, 25 bp, Homo sapien
accaaaagagttgttgtttgccagt

SEQ ID NO: 14603 - DNA, 25 bp, Homo sapien
accaaaagcgttgtctgtaaatcac

SEQ ID NO: 14604 - DNA, 25 bp, Homo sapien
accaaaagctttgtctgtaaatcac

SEQ ID NO: 14605 - DNA, 25 bp, Homo sapien
accaaaagggttgttgtttgccagt

SEQ ID NO: 14606 - DNA, 25 bp, Homo sapien
accaaaatcttcacttatttatcat

SEQ ID NO: 14607 - DNA, 25 bp, Homo sapien
accaaaatcttcagttatttatcat

SEQ ID NO: 14608 - DNA, 25 bp, Homo sapien
accaaacaggcagttaagaagatga

SEQ ID NO: 14609 - DNA, 25 bp, Homo sapien
accaaacaggcagttatgaagatga

SEQ ID NO: 14610 - DNA, 25 bp, Homo sapien
accaaacctgatcgcaggctcgtgt

SEQ ID NO: 14611 - DNA, 25 bp, Homo sapien
accaaacctgatctcaggctcgtgt

SEQ ID NO: 14612 - DNA, 25 bp, Homo sapien
accaaacttcaccatgatagcacaa

SEQ ID NO: 14613 - DNA, 25 bp, Homo sapien
accaaacttcactatgatagcacaa

SEQ ID NO: 14614 - DNA, 25 bp, Homo sapien
accaaagaaagaaaaaatcttaaaa

SEQ ID NO: 14615 - DNA, 25 bp, Homo sapien
accaaagaaagagaaaatcttaaaa

SEQ ID NO: 14616 - DNA, 25 bp, Homo sapien
accaaagaaggagcttttacaccag

SEQ ID NO: 14617 - DNA, 25 bp, Homo sapien
accaaagacaaagttaacagacggg

SEQ ID NO: 14618 - DNA, 25 bp, Homo sapien
accaaagagcagatagaaataggtg

SEQ ID NO: 14619 - DNA, 25 bp, Homo sapien
accaaagagcatatagaaataggtg

SEQ ID NO: 14620 - DNA, 25 bp, Homo sapien
accaaagagccaaagcagtgattat

SEQ ID NO: 14621 - DNA, 25 bp, Homo sapien
accaaagagccgaagcagtgattat

SEQ ID NO: 14622 - DNA, 25 bp, Homo sapien
accaaagagggagcttttacaccag

SEQ ID NO: 14623 - DNA, 25 bp, Homo sapien
accaaagataaagttaacagacggg

SEQ ID NO: 14624 - DNA, 25 bp, Homo sapien
accaaaggcaccactaatggctatt

SEQ ID NO: 14625 - DNA, 25 bp, Homo sapien
accaaaggcgccactaatggctatt

SEQ ID NO: 14626 - DNA, 25 bp, Homo sapien
accaaataaaatttgaggattgtct

SEQ ID NO: 14627 - DNA, 25 bp, Homo sapien
accaaataattaagaacaccagcaa

SEQ ID NO: 14628 - DNA, 25 bp, Homo sapien
accaaataattaaggacaccagcaa

SEQ ID NO: 14629 - DNA, 25 bp, Homo sapien
accaaatacaatttgaggattgtct

SEQ ID NO: 14630 - DNA, 25 bp, Homo sapien
accaaataccacatatacataacac

SEQ ID NO: 14631 - DNA, 25 bp, Homo sapien
accaaataccagacacacagtttct

SEQ ID NO: 14632 - DNA, 25 bp, Homo sapien
accaaataccagacacgcagtttct

SEQ ID NO: 14633 - DNA, 25 bp, Homo sapien
accaaatatcacatatacataacac

SEQ ID NO: 14634 - DNA, 25 bp, Homo sapien
accaaatatctaggtacggagacag

SEQ ID NO: 14635 - DNA, 25 bp, Homo sapien
accaaatatctaggtatggagacag

SEQ ID NO: 14636 - DNA, 25 bp, Homo sapien
accaaatcaagaggtaaaccaagaa

SEQ ID NO: 14637 - DNA, 25 bp, Homo sapien
accaaatccaacagttcattaaaaa

SEQ ID NO: 14638 - DNA, 25 bp, Homo sapien
accaaatccaagagttcattaaaaa

SEQ ID NO: 14639 - DNA, 25 bp, Homo sapien
accaaatcctaacagcagaactttg

SEQ ID NO: 14640 - DNA, 25 bp, Homo sapien
accaaatcctagcagcagaactttg

SEQ ID NO: 14641 - DNA, 25 bp, Homo sapien
accaaatcgagaggtaaaccaagaa

SEQ ID NO: 14642 - DNA, 25 bp, Homo sapien
accaaatgcttaaagtttcaaatgc

SEQ ID NO: 14643 - DNA, 25 bp, Homo sapien
accaaatgcttgaagtttcaaatgc

SEQ ID NO: 14644 - DNA, 25 bp, Homo sapien
accaaatgtgttaaggcactaggca

SEQ ID NO: 14645 - DNA, 25 bp, Homo sapien
accaaatgtgttgaggcactaggca

SEQ ID NO: 14646 - DNA, 25 bp, Homo sapien
accaaattcaacacaagttttagag

SEQ ID NO: 14647 - DNA, 25 bp, Homo sapien
accaaattcaacagaagttttagag

SEQ ID NO: 14648 - DNA, 25 bp, Homo sapien
accaaattctgacaatgcaagttca

SEQ ID NO: 14649 - DNA, 25 bp, Homo sapien
accaaattctgacagtgcaagttca

SEQ ID NO: 14650 - DNA, 25 bp, Homo sapien
accaaattgtacaactatccatgca

SEQ ID NO: 14651 - DNA, 25 bp, Homo sapien
accaaattgtacaagtatccatgca

SEQ ID NO: 14652 - DNA, 25 bp, Homo sapien
accaaatttatgacccaaacttagt

SEQ ID NO: 14653 - DNA, 25 bp, Homo sapien
accaaatttatgatccaaacttagt

SEQ ID NO: 14654 - DNA, 25 bp, Homo sapien
accaacaaacaacaagagctgcaac

SEQ ID NO: 14655 - DNA, 25 bp, Homo sapien
accaacaaacagcaagagctgcaac

SEQ ID NO: 14656 - DNA, 25 bp, Homo sapien
accaacaacaataaatcaggagcac

SEQ ID NO: 14657 - DNA, 25 bp, Homo sapien
accaacaataataaatcaggagcac

SEQ ID NO: 14658 - DNA, 25 bp, Homo sapien
accaacaatcctgcttctttctgtg

SEQ ID NO: 14659 - DNA, 25 bp, Homo sapien
accaacaattcatcaacgagcattt

SEQ ID NO: 14660 - DNA, 25 bp, Homo sapien
accaacaattcgtcaacgagcattt

SEQ ID NO: 14661 - DNA, 25 bp, Homo sapien
accaacaattctgcttctttctgtg

SEQ ID NO: 14662 - DNA, 25 bp, Homo sapien
accaacactgctcctcaggcgggtg

SEQ ID NO: 14663 - DNA, 25 bp, Homo sapien
accaacactgctcctcgggcgggtg

SEQ ID NO: 14664 - DNA, 25 bp, Homo sapien
accaacagccctcagtgaaccctgc

SEQ ID NO: 14665 - DNA, 25 bp, Homo sapien
accaacagctctcagtgaaccctgc

SEQ ID NO: 14666 - DNA, 25 bp, Homo sapien
accaacatcgaccctttgagcaggg

SEQ ID NO: 14667 - DNA, 25 bp, Homo sapien
accaacattgaccctttgagcaggg

SEQ ID NO: 14668 - DNA, 25 bp, Homo sapien
accaaccacaaaattccacagaaac

SEQ ID NO: 14669 - DNA, 25 bp, Homo sapien
accaaccacatttaggaagcgtcac

SEQ ID NO: 14670 - DNA, 25 bp, Homo sapien
accaaccacatttgggaagcgtcac

SEQ ID NO: 14671 - DNA, 25 bp, Homo sapien
accaaccataaaattccacagaaac

SEQ ID NO: 14672 - DNA, 25 bp, Homo sapien
accaactaaaccacttatccacttc

SEQ ID NO: 14673 - DNA, 25 bp, Homo sapien
accaactaaaccgcttatccacttc

SEQ ID NO: 14674 - DNA, 25 bp, Homo sapien
accaactcaaatttgctaatccaac

SEQ ID NO: 14675 - DNA, 25 bp, Homo sapien
accaactcagatttgctaatccaac

SEQ ID NO: 14676 - DNA, 25 bp, Homo sapien
accaactccatcatatcttcagaac

SEQ ID NO: 14677 - DNA, 25 bp, Homo sapien
accaactccgtcatatcttcagaac

SEQ ID NO: 14678 - DNA, 25 bp, Homo sapien
accaactgagatttatctcttagat

SEQ ID NO: 14679 - DNA, 25 bp, Homo sapien
accaactgggatttatctcttagat

SEQ ID NO: 14680 - DNA, 25 bp, Homo sapien
accaagaaagcacccaaaaactaat

SEQ ID NO: 14681 - DNA, 25 bp, Homo sapien
accaagaaagcactcaaaaactaat

SEQ ID NO: 14682 - DNA, 25 bp, Homo sapien
accaagaaaggaaacaattatcagt

SEQ ID NO: 14683 - DNA, 25 bp, Homo sapien
accaagaaaggaaacagttatcagt

SEQ ID NO: 14684 - DNA, 25 bp, Homo sapien
accaagaacgaaagggacgatattt

SEQ ID NO: 14685 - DNA, 25 bp, Homo sapien
accaagaagacaaaaaactctccat

SEQ ID NO: 14686 - DNA, 25 bp, Homo sapien
accaagaaggcaaaaaactctccat

SEQ ID NO: 14687 - DNA, 25 bp, Homo sapien
accaagaatgaaagggacgatattt

SEQ ID NO: 14688 - DNA, 25 bp, Homo sapien
accaagataatttgcaagctagatt

SEQ ID NO: 14689 - DNA, 25 bp, Homo sapien
accaagatattttgcaagctagatt

SEQ ID NO: 14690 - DNA, 25 bp, Homo sapien
accaagctcaatgaataaatgatat

SEQ ID NO: 14691 - DNA, 25 bp, Homo sapien
accaagctcgatgaataaatgatat

SEQ ID NO: 14692 - DNA, 25 bp, Homo sapien
accaagctgacaatgaaatgaaatc

SEQ ID NO: 14693 - DNA, 25 bp, Homo sapien
accaagctgacactgaaatgaaatc

SEQ ID NO: 14694 - DNA, 25 bp, Homo sapien
accaagctgaccatcaaggatctgc

SEQ ID NO: 14695 - DNA, 25 bp, Homo sapien
accaagctgaccatgaaggatctgc

SEQ ID NO: 14696 - DNA, 25 bp, Homo sapien
accaaggagcacaactgttgaatca

SEQ ID NO: 14697 - DNA, 25 bp, Homo sapien
accaaggagcataactgttgaatca

SEQ ID NO: 14698 - DNA, 25 bp, Homo sapien
accaaggcaacaacgattactcacc

SEQ ID NO: 14699 - DNA, 25 bp, Homo sapien
accaaggcaacaatgattactcacc

SEQ ID NO: 14700 - DNA, 25 bp, Homo sapien
accaaggccgtgaaagtatgctggt

SEQ ID NO: 14701 - DNA, 25 bp, Homo sapien
accaaggctgtgaaagtatgctggt

SEQ ID NO: 14702 - DNA, 25 bp, Homo sapien
accaagggaagactgtatgtgtata

SEQ ID NO: 14703 - DNA, 25 bp, Homo sapien
accaagggacgactgtatgtgtata

SEQ ID NO: 14704 - DNA, 25 bp, Homo sapien
accaaggtcaaagtatgtctcctca

SEQ ID NO: 14705 - DNA, 25 bp, Homo sapien
accaaggtcaaagtttgtctcctca

SEQ ID NO: 14706 - DNA, 25 bp, Homo sapien
accaagtaattgcagcaatgccaca

SEQ ID NO: 14707 - DNA, 25 bp, Homo sapien
accaagtaattgcggcaatgccaca

SEQ ID NO: 14708 - DNA, 25 bp, Homo sapien
accaagtacaataatgtcggagtct

SEQ ID NO: 14709 - DNA, 25 bp, Homo sapien
accaagtacaattatgtcggagtct

SEQ ID NO: 14710 - DNA, 25 bp, Homo sapien
accaagtattgcagccaggaaatga

SEQ ID NO: 14711 - DNA, 25 bp, Homo sapien
accaagtattgcagtcaggaaatga

SEQ ID NO: 14712 - DNA, 25 bp, Homo sapien
accaagtgattccaattctttccca

SEQ ID NO: 14713 - DNA, 25 bp, Homo sapien
accaagtgattctaattctttccca

SEQ ID NO: 14714 - DNA, 25 bp, Homo sapien
accaagtggaaccattatatcagtt

SEQ ID NO: 14715 - DNA, 25 bp, Homo sapien
accaagtggaactattatatcagtt

SEQ ID NO: 14716 - DNA, 25 bp, Homo sapien
accaagtggagaaattgaagatccc

SEQ ID NO: 14717 - DNA, 25 bp, Homo sapien
accaagtggaggaattgaagatccc

SEQ ID NO: 14718 - DNA, 25 bp, Homo sapien
accaagttgtttctgtctttttgta

SEQ ID NO: 14719 - DNA, 25 bp, Homo sapien
accaagttgtttctgtttttttgta

SEQ ID NO: 14720 - DNA, 25 bp, Homo sapien
accaagtttctcctaaaaacacaga

SEQ ID NO: 14721 - DNA, 25 bp, Homo sapien
accaagtttctcttaaaaacacaga

SEQ ID NO: 14722 - DNA, 25 bp, Homo sapien
accaatagcgtgtgaatggaagtga

SEQ ID NO: 14723 - DNA, 25 bp, Homo sapien
accaatagctcaagaaatgctgtta

SEQ ID NO: 14724 - DNA, 25 bp, Homo sapien
accaatagctcaagaagtgctgtta

SEQ ID NO: 14725 - DNA, 25 bp, Homo sapien
accaatagcttgtgaatggaagtga

SEQ ID NO: 14726 - DNA, 25 bp, Homo sapien
accaatcaagagggacatgagaatt

SEQ ID NO: 14727 - DNA, 25 bp, Homo sapien
accaatcaagaggtacatgagaatt

SEQ ID NO: 14728 - DNA, 25 bp, Homo sapien
accaatcagatcatgtatgtgttac

SEQ ID NO: 14729 - DNA, 25 bp, Homo sapien
accaatcagattatgtatgtgttac

SEQ ID NO: 14730 - DNA, 25 bp, Homo sapien
accaatccaaaaatagaccctaggt

SEQ ID NO: 14731 - DNA, 25 bp, Homo sapien
accaatccaaaaataggccctaggt

SEQ ID NO: 14732 - DNA, 25 bp, Homo sapien
accaatccactgaataagagagact

SEQ ID NO: 14733 - DNA, 25 bp, Homo sapien
accaatccgctgaataagagagact

SEQ ID NO: 14734 - DNA, 25 bp, Homo sapien
accaatctgatgaggaaagcattta

SEQ ID NO: 14735 - DNA, 25 bp, Homo sapien
accaatcttatgaggaaagcattta

SEQ ID NO: 14736 - DNA, 25 bp, Homo sapien
accaatcttattgttgtgaaattaa

SEQ ID NO: 14737 - DNA, 25 bp, Homo sapien
accaatcttgttgttgtgaaattaa

SEQ ID NO: 14738 - DNA, 25 bp, Homo sapien
accaatgagaaaacgaaggcataaa

SEQ ID NO: 14739 - DNA, 25 bp, Homo sapien
accaatgagaaaatgaaggcataaa

SEQ ID NO: 14740 - DNA, 25 bp, Homo sapien
accaatggccactaaaatcatcagc

SEQ ID NO: 14741 - DNA, 25 bp, Homo sapien
accaatggctactaaaatcatcagc

SEQ ID NO: 14742 - DNA, 25 bp, Homo sapien
accaatgtatttccagtgcagtgtt

SEQ ID NO: 14743 - DNA, 25 bp, Homo sapien
accaatgtatttccggtgcagtgtt

SEQ ID NO: 14744 - DNA, 25 bp, Homo sapien
accaatgttccactggttgacctgc

SEQ ID NO: 14745 - DNA, 25 bp, Homo sapien
accaatgtttcactggttgacctgc

SEQ ID NO: 14746 - DNA, 25 bp, Homo sapien
accaattatgaaaacctgtgattac

SEQ ID NO: 14747 - DNA, 25 bp, Homo sapien
accaattatgaaagcctgtgattac

SEQ ID NO: 14748 - DNA, 25 bp, Homo sapien
accaattctatgaaaacaagcgatc

SEQ ID NO: 14749 - DNA, 25 bp, Homo sapien
accaattctgtgaaaacaagcgatc

SEQ ID NO: 14750 - DNA, 25 bp, Homo sapien
accaatttaccatagacatgtaggt

SEQ ID NO: 14751 - DNA, 25 bp, Homo sapien
accaatttaccgtagacatgtaggt

SEQ ID NO: 14752 - DNA, 25 bp, Homo sapien
accaatttcttgaaataaatagcaa

SEQ ID NO: 14753 - DNA, 25 bp, Homo sapien
accaatttcttgaaatgaatagcaa

SEQ ID NO: 14754 - DNA, 25 bp, Homo sapien
accaatttgggccagatttctgtga

SEQ ID NO: 14755 - DNA, 25 bp, Homo sapien
accaatttgggtcagatttctgtga

SEQ ID NO: 14756 - DNA, 25 bp, Homo sapien
accaatttttttatgtgtcagccag

SEQ ID NO: 14757 - DNA, 25 bp, Homo sapien
accaatttttttgtgtgtcagccag

SEQ ID NO: 14758 - DNA, 25 bp, Homo sapien
accacaaaacgaggagaaaccagag

SEQ ID NO: 14759 - DNA, 25 bp, Homo sapien
accacaaaatatgcagcttgggcat

SEQ ID NO: 14760 - DNA, 25 bp, Homo sapien
accacaaaatatgctgcttgggcat

SEQ ID NO: 14761 - DNA, 25 bp, Homo sapien
accacaaaatgaggagaaaccagag

SEQ ID NO: 14762 - DNA, 25 bp, Homo sapien
accacaaacagaagtcccagaaatt

SEQ ID NO: 14763 - DNA, 25 bp, Homo sapien
accacaaaccgaaagctatgggaca

SEQ ID NO: 14764 - DNA, 25 bp, Homo sapien
accacaaactgaaagctatgggaca

SEQ ID NO: 14765 - DNA, 25 bp, Homo sapien
accacaaagagaagtcccagaaatt

SEQ ID NO: 14766 - DNA, 25 bp, Homo sapien
accacaaagcacacatgggcatttg

SEQ ID NO: 14767 - DNA, 25 bp, Homo sapien
accacaaagcacacgtgggcatttg

SEQ ID NO: 14768 - DNA, 25 bp, Homo sapien
accacaacaaaagtgatgcttttaa

SEQ ID NO: 14769 - DNA, 25 bp, Homo sapien
accacaacacgccatcttttcatag

SEQ ID NO: 14770 - DNA, 25 bp, Homo sapien
accacaacacgtcatcttttcatag

SEQ ID NO: 14771 - DNA, 25 bp, Homo sapien
accacaacaggaacatagccaagtc

SEQ ID NO: 14772 - DNA, 25 bp, Homo sapien
accacaaccatctgcaccattttac

SEQ ID NO: 14773 - DNA, 25 bp, Homo sapien
accacaaccatctgcatcattttac

SEQ ID NO: 14774 - DNA, 25 bp, Homo sapien
accacaaccatgtcaccttactttg

SEQ ID NO: 14775 - DNA, 25 bp, Homo sapien
accacaaccatgtcgccttactttg

SEQ ID NO: 14776 - DNA, 25 bp, Homo sapien
accacaacgaaagtgatgcttttaa

SEQ ID NO: 14777 - DNA, 25 bp, Homo sapien
accacaacgggaacatagccaagtc

SEQ ID NO: 14778 - DNA, 25 bp, Homo sapien
accacaactctgaatttctgaaatc

SEQ ID NO: 14779 - DNA, 25 bp, Homo sapien
accacaactctgattttctgaaatc

SEQ ID NO: 14780 - DNA, 25 bp, Homo sapien
accacaaggctatgacataattctt

SEQ ID NO: 14781 - DNA, 25 bp, Homo sapien
accacaaggctatgacgtaattctt

SEQ ID NO: 14782 - DNA, 25 bp, Homo sapien
accacaatcgattttatattttcat

SEQ ID NO: 14783 - DNA, 25 bp, Homo sapien
accacaattgattttatattttcat

SEQ ID NO: 14784 - DNA, 25 bp, Homo sapien
accacacacaaaatgcatttcattt

SEQ ID NO: 14785 - DNA, 25 bp, Homo sapien
accacacacaaagtgcatttcattt

SEQ ID NO: 14786 - DNA, 25 bp, Homo sapien
accacaccccttgctgaatgaggca

SEQ ID NO: 14787 - DNA, 25 bp, Homo sapien
accacaccctttgctgaatgaggca

SEQ ID NO: 14788 - DNA, 25 bp, Homo sapien
accacactccagccacttcttttat

SEQ ID NO: 14789 - DNA, 25 bp, Homo sapien
accacactccagccgcttcttttat

SEQ ID NO: 14790 - DNA, 25 bp, Homo sapien
accacagataaacttaccattagaa

SEQ ID NO: 14791 - DNA, 25 bp, Homo sapien
accacagataagcttaccattagaa

SEQ ID NO: 14792 - DNA, 25 bp, Homo sapien
accacagattcctataaacaccaaa

SEQ ID NO: 14793 - DNA, 25 bp, Homo sapien
accacagattcttataaacaccaaa

SEQ ID NO: 14794 - DNA, 25 bp, Homo sapien
accacaggtaccaaaatgattcact

SEQ ID NO: 14795 - DNA, 25 bp, Homo sapien
accacaggtaccagaatgattcact

SEQ ID NO: 14796 - DNA, 25 bp, Homo sapien
accacaggtatctcacagcaggcat

SEQ ID NO: 14797 - DNA, 25 bp, Homo sapien
accacaggtatctcgcagcaggcat

SEQ ID NO: 14798 - DNA, 25 bp, Homo sapien
accacaggtcataagaaaaagttat

SEQ ID NO: 14799 - DNA, 25 bp, Homo sapien
accacaggttataagaaaaagttat

SEQ ID NO: 14800 - DNA, 25 bp, Homo sapien
accacagttacattcaatgaatatt

SEQ ID NO: 14801 - DNA, 25 bp, Homo sapien
accacagttacattcagtgaatatt

SEQ ID NO: 14802 - DNA, 25 bp, Homo sapien
accacagttgatagtagtacatagt

SEQ ID NO: 14803 - DNA, 25 bp, Homo sapien
accacagttgatggtagtacatagt

SEQ ID NO: 14804 - DNA, 25 bp, Homo sapien
accacataaaccaggggggaatgct

SEQ ID NO: 14805 - DNA, 25 bp, Homo sapien
accacataaactaggggggaatgct

SEQ ID NO: 14806 - DNA, 25 bp, Homo sapien
accacatacttttatcttttacttc

SEQ ID NO: 14807 - DNA, 25 bp, Homo sapien
accacatacttttgtcttttacttc

SEQ ID NO: 14808 - DNA, 25 bp, Homo sapien
accacatctcctagaattgacacct

SEQ ID NO: 14809 - DNA, 25 bp, Homo sapien
accacatctgctagaattgacacct

SEQ ID NO: 14810 - DNA, 25 bp, Homo sapien
accacatgagcagaagagttaaagc

SEQ ID NO: 14811 - DNA, 25 bp, Homo sapien
accacatgagcagaggagttaaagc

SEQ ID NO: 14812 - DNA, 25 bp, Homo sapien
accacatggaaatttgtgcccctta

SEQ ID NO: 14813 - DNA, 25 bp, Homo sapien
accacatggaagtttgtgcccctta

SEQ ID NO: 14814 - DNA, 25 bp, Homo sapien
accacattagacaaataacgcattc

SEQ ID NO: 14815 - DNA, 25 bp, Homo sapien
accacattagacgaataacgcattc

SEQ ID NO: 14816 - DNA, 25 bp, Homo sapien
accacattggctccactgttggtca

SEQ ID NO: 14817 - DNA, 25 bp, Homo sapien
accacattggctccgctgttggtca

SEQ ID NO: 14818 - DNA, 25 bp, Homo sapien
accaccaagtttacctgttatataa

SEQ ID NO: 14819 - DNA, 25 bp, Homo sapien
accaccaagtttatctgttatataa

SEQ ID NO: 14820 - DNA, 25 bp, Homo sapien
accaccacaaaccgaaagctatggg

SEQ ID NO: 14821 - DNA, 25 bp, Homo sapien
accaccacaaactgaaagctatggg

SEQ ID NO: 14822 - DNA, 25 bp, Homo sapien
accaccagaaaaataaattgatgat

SEQ ID NO: 14823 - DNA, 25 bp, Homo sapien
accaccagacaaataaattgatgat

SEQ ID NO: 14824 - DNA, 25 bp, Homo sapien
accaccagctgggaagaagatgacc

SEQ ID NO: 14825 - DNA, 25 bp, Homo sapien
accaccagctgggaggaagatgacc

SEQ ID NO: 14826 - DNA, 25 bp, Homo sapien
accacccagaatatagcacagagag

SEQ ID NO: 14827 - DNA, 25 bp, Homo sapien
accacccagaatgtagcacagagag

SEQ ID NO: 14828 - DNA, 25 bp, Homo sapien
accacccctagccagaaaaaaattg

SEQ ID NO: 14829 - DNA, 25 bp, Homo sapien
accacccctagctagaaaaaaattg

SEQ ID NO: 14830 - DNA, 25 bp, Homo sapien
accaccgatattcatgagatatgcc

SEQ ID NO: 14831 - DNA, 25 bp, Homo sapien
accaccgatattcgtgagatatgcc

SEQ ID NO: 14832 - DNA, 25 bp, Homo sapien
accacctaaagcccaaaccaaaaaa

SEQ ID NO: 14833 - DNA, 25 bp, Homo sapien
accacctaaagcccaacccaaaaaa

SEQ ID NO: 14834 - DNA, 25 bp, Homo sapien
accacctacaaaatgtagataatta

SEQ ID NO: 14835 - DNA, 25 bp, Homo sapien
accacctacaagatgtagataatta

SEQ ID NO: 14836 - DNA, 25 bp, Homo sapien
accacctcaaaggcctatttcagga

SEQ ID NO: 14837 - DNA, 25 bp, Homo sapien
accacctcaaatgcctatttcagga

SEQ ID NO: 14838 - DNA, 25 bp, Homo sapien
accacgcctggcaatcatgacctct

SEQ ID NO: 14839 - DNA, 25 bp, Homo sapien
accacgcctggcagtcatgacctct

SEQ ID NO: 14840 - DNA, 25 bp, Homo sapien
accactaaacgataaataattgagg

SEQ ID NO: 14841 - DNA, 25 bp, Homo sapien
accactaagcgataaataattgagg

SEQ ID NO: 14842 - DNA, 25 bp, Homo sapien
accactatgccgtgctaattttttt

SEQ ID NO: 14843 - DNA, 25 bp, Homo sapien
accactatgccttgctaattttttt

SEQ ID NO: 14844 - DNA, 25 bp, Homo sapien
accactccaaagcgtgtgggttgct

SEQ ID NO: 14845 - DNA, 25 bp, Homo sapien
accactccaaagtgtgtgggttgct

SEQ ID NO: 14846 - DNA, 25 bp, Homo sapien
accactctccccaatacgcacagta

SEQ ID NO: 14847 - DNA, 25 bp, Homo sapien
accactctccccagtacgcacagta

SEQ ID NO: 14848 - DNA, 25 bp, Homo sapien
accactctcctgatctttcagtggt

SEQ ID NO: 14849 - DNA, 25 bp, Homo sapien
accactctcttgatctttcagtggt

SEQ ID NO: 14850 - DNA, 25 bp, Homo sapien
accactgatgtcaagattaaaaaat

SEQ ID NO: 14851 - DNA, 25 bp, Homo sapien
accactgatgtcatgattaaaaaat

SEQ ID NO: 14852 - DNA, 25 bp, Homo sapien
accactgattgtccagaattcagac

SEQ ID NO: 14853 - DNA, 25 bp, Homo sapien
accactgattgtccggaattcagac

SEQ ID NO: 14854 - DNA, 25 bp, Homo sapien
accactgcttagcataataattggc

SEQ ID NO: 14855 - DNA, 25 bp, Homo sapien
accactgcttagcatagtaattggc

SEQ ID NO: 14856 - DNA, 25 bp, Homo sapien
accactggcttaagaaactcccggg

SEQ ID NO: 14857 - DNA, 25 bp, Homo sapien
accactggcttaggaaactcccggg

SEQ ID NO: 14858 - DNA, 25 bp, Homo sapien
accacttattgattccacaccactt

SEQ ID NO: 14859 - DNA, 25 bp, Homo sapien
accacttattgatttcacaccactt

SEQ ID NO: 14860 - DNA, 25 bp, Homo sapien
accacttcaatgcatactgtagaag

SEQ ID NO: 14861 - DNA, 25 bp, Homo sapien
accacttcacaactacagagtaacc

SEQ ID NO: 14862 - DNA, 25 bp, Homo sapien
accacttcacaactgcagagtaacc

SEQ ID NO: 14863 - DNA, 25 bp, Homo sapien
accacttcaggagcaaaggccaaag

SEQ ID NO: 14864 - DNA, 25 bp, Homo sapien
accacttcattccagcttgagtgac

SEQ ID NO: 14865 - DNA, 25 bp, Homo sapien
accacttcattccggcttgagtgac

SEQ ID NO: 14866 - DNA, 25 bp, Homo sapien
accacttcccaacaggatcagacct

SEQ ID NO: 14867 - DNA, 25 bp, Homo sapien
accacttcccaataggatcagacct

SEQ ID NO: 14868 - DNA, 25 bp, Homo sapien
accacttcgatgcatactgtagaag

SEQ ID NO: 14869 - DNA, 25 bp, Homo sapien
accacttcgggagcaaaggccaaag

SEQ ID NO: 14870 - DNA, 25 bp, Homo sapien
accacttctacaacatttaatttag

SEQ ID NO: 14871 - DNA, 25 bp, Homo sapien
accacttctactacatttaatttag

SEQ ID NO: 14872 - DNA, 25 bp, Homo sapien
accacttggctttccgatagcatgg

SEQ ID NO: 14873 - DNA, 25 bp, Homo sapien
accacttggctttctgatagcatgg

SEQ ID NO: 14874 - DNA, 25 bp, Homo sapien
accactttcaaatacagagaggccc

SEQ ID NO: 14875 - DNA, 25 bp, Homo sapien
accactttcaaatagagagaggccc

SEQ ID NO: 14876 - DNA, 25 bp, Homo sapien
accacttttaaataacagcaatatt

SEQ ID NO: 14877 - DNA, 25 bp, Homo sapien
accacttttaagtaacagcaatatt

SEQ ID NO: 14878 - DNA, 25 bp, Homo sapien
accagaaaaactgttgctattaata

SEQ ID NO: 14879 - DNA, 25 bp, Homo sapien
accagaaaacctgttgctattaata

SEQ ID NO: 14880 - DNA, 25 bp, Homo sapien
accagaaacaattaacaatatggcg

SEQ ID NO: 14881 - DNA, 25 bp, Homo sapien
accagaaacaattaaccatatggcg

SEQ ID NO: 14882 - DNA, 25 bp, Homo sapien
accagaaagtgcaaaggaaaaagta

SEQ ID NO: 14883 - DNA, 25 bp, Homo sapien
accagaaagtgcgaaggaaaaagta

SEQ ID NO: 14884 - DNA, 25 bp, Homo sapien
accagaaatcaggctacggttccag

SEQ ID NO: 14885 - DNA, 25 bp, Homo sapien
accagaaatcaggctatggttccag

SEQ ID NO: 14886 - DNA, 25 bp, Homo sapien
accagaagaaagttatgtagagtgg

SEQ ID NO: 14887 - DNA, 25 bp, Homo sapien
accagaagaattcggctttataggc

SEQ ID NO: 14888 - DNA, 25 bp, Homo sapien
accagaagaatttggctttataggc

SEQ ID NO: 14889 - DNA, 25 bp, Homo sapien
accagaaggaagttatgtagagtgg

SEQ ID NO: 14890 - DNA, 25 bp, Homo sapien
accagaatattatttagcaataaga

SEQ ID NO: 14891 - DNA, 25 bp, Homo sapien
accagaatgttatttagcaataaga

SEQ ID NO: 14892 - DNA, 25 bp, Homo sapien
accagacaaccaacgccaatttttc

SEQ ID NO: 14893 - DNA, 25 bp, Homo sapien
accagacaaccaatgccaatttttc

SEQ ID NO: 14894 - DNA, 25 bp, Homo sapien
accagacacacagtttcttgacaga

SEQ ID NO: 14895 - DNA, 25 bp, Homo sapien
accagacacgcagtttcttgacaga

SEQ ID NO: 14896 - DNA, 25 bp, Homo sapien
accagactcttccttgggtgacagt

SEQ ID NO: 14897 - DNA, 25 bp, Homo sapien
accagactctttcttgggtgacagt

SEQ ID NO: 14898 - DNA, 25 bp, Homo sapien
accagacttcggaatagttggacag

SEQ ID NO: 14899 - DNA, 25 bp, Homo sapien
accagactttggaatagttggacag

SEQ ID NO: 14900 - DNA, 25 bp, Homo sapien
accagagaagatattgaagccatgg

SEQ ID NO: 14901 - DNA, 25 bp, Homo sapien
accagagaagatgttgaagccatgg

SEQ ID NO: 14902 - DNA, 25 bp, Homo sapien
accagagattcattgtaccttgtca

SEQ ID NO: 14903 - DNA, 25 bp, Homo sapien
accagagattcattgtgccttgtca

SEQ ID NO: 14904 - DNA, 25 bp, Homo sapien
accagaggatccagatttccctgtg

SEQ ID NO: 14905 - DNA, 25 bp, Homo sapien
accagaggatccagctttccctgtg

SEQ ID NO: 14906 - DNA, 25 bp, Homo sapien
accagagtggaccacaaaaataaaa

SEQ ID NO: 14907 - DNA, 25 bp, Homo sapien
accagagtggaccagaaaaataaaa

SEQ ID NO: 14908 - DNA, 25 bp, Homo sapien
accagagttggctttcaggctgctt

SEQ ID NO: 14909 - DNA, 25 bp, Homo sapien
accagagtttgctttcaggctgctt

SEQ ID NO: 14910 - DNA, 25 bp, Homo sapien
accagagtttgctttcgggctgctt

SEQ ID NO: 14911 - DNA, 25 bp, Homo sapien
accagataccaagaagacaaaaaac

SEQ ID NO: 14912 - DNA, 25 bp, Homo sapien
accagataccaagaaggcaaaaaac

SEQ ID NO: 14913 - DNA, 25 bp, Homo sapien
accagataggtgaggcagatgacag

SEQ ID NO: 14914 - DNA, 25 bp, Homo sapien
accagataggtgaggcggatgacag

SEQ ID NO: 14915 - DNA, 25 bp, Homo sapien
accagatccaaaatgccatagaaaa

SEQ ID NO: 14916 - DNA, 25 bp, Homo sapien
accagatccaaagtgccatagaaaa

SEQ ID NO: 14917 - DNA, 25 bp, Homo sapien
accagatttcacggcaatcccttga

SEQ ID NO: 14918 - DNA, 25 bp, Homo sapien
accagatttcatggcaatcccttga

SEQ ID NO: 14919 - DNA, 25 bp, Homo sapien
accagcaaacaacaatttcttccgt

SEQ ID NO: 14920 - DNA, 25 bp, Homo sapien
accagcaaacaaccatttcttccgt

SEQ ID NO: 14921 - DNA, 25 bp, Homo sapien
accagcaggaatctcactaccctca

SEQ ID NO: 14922 - DNA, 25 bp, Homo sapien
accagcaggaatctcattaccctca

SEQ ID NO: 14923 - DNA, 25 bp, Homo sapien
accagcaggtccatttggatctggt

SEQ ID NO: 14924 - DNA, 25 bp, Homo sapien
accagcaggtccctttggatctggt

SEQ ID NO: 14925 - DNA, 25 bp, Homo sapien
accagcatcaacagtagaaagatct

SEQ ID NO: 14926 - DNA, 25 bp, Homo sapien
accagcatcaatagtagaaagatct

SEQ ID NO: 14927 - DNA, 25 bp, Homo sapien
accagcattaccgagccactagtgt

SEQ ID NO: 14928 - DNA, 25 bp, Homo sapien
accagcattactgagccactagtgt

SEQ ID NO: 14929 - DNA, 25 bp, Homo sapien
accagccaatcctcagttaatagac

SEQ ID NO: 14930 - DNA, 25 bp, Homo sapien
accagccaatccttagttaatagac

SEQ ID NO: 14931 - DNA, 25 bp, Homo sapien
accagccagtcatgcaagtgaataa

SEQ ID NO: 14932 - DNA, 25 bp, Homo sapien
accagccagtcatgcaggtgaataa

SEQ ID NO: 14933 - DNA, 25 bp, Homo sapien
accagcctggtcaacacgatgaaac

SEQ ID NO: 14934 - DNA, 25 bp, Homo sapien
accagcctggtcaatacgatgaaac

SEQ ID NO: 14935 - DNA, 25 bp, Homo sapien
accagccttaaaagagatccttaaa

SEQ ID NO: 14936 - DNA, 25 bp, Homo sapien
accagccttaacagagatccttaaa

SEQ ID NO: 14937 - DNA, 25 bp, Homo sapien
accagcctttggcacgtgaagataa

SEQ ID NO: 14938 - DNA, 25 bp, Homo sapien
accagcctttggcatgtgaagataa

SEQ ID NO: 14939 - DNA, 25 bp, Homo sapien
accagctagtttcacctatacccac

SEQ ID NO: 14940 - DNA, 25 bp, Homo sapien
accagctagttttacctatacccac

SEQ ID NO: 14941 - DNA, 25 bp, Homo sapien
accagctgatgatattcaaggatgt

SEQ ID NO: 14942 - DNA, 25 bp, Homo sapien
accagctgatgatgttcaaggatgt

SEQ ID NO: 14943 - DNA, 25 bp, Homo sapien
accagctgggaagaagatgaccccc

SEQ ID NO: 14944 - DNA, 25 bp, Homo sapien
accagctgggaggaagatgaccccc

SEQ ID NO: 14945 - DNA, 25 bp, Homo sapien
accagcttaggcggctatagagtgc

SEQ ID NO: 14946 - DNA, 25 bp, Homo sapien
accagcttaggtggctatagagtgc

SEQ ID NO: 14947 - DNA, 25 bp, Homo sapien
accaggaaccagacagcagaagaaa

SEQ ID NO: 14948 - DNA, 25 bp, Homo sapien
accaggaaccaggcagcagaagaaa

SEQ ID NO: 14949 - DNA, 25 bp, Homo sapien
accaggagaaagaagacaaccagcc

SEQ ID NO: 14950 - DNA, 25 bp, Homo sapien
accaggagaaagatgacaaccagcc

SEQ ID NO: 14951 - DNA, 25 bp, Homo sapien
accaggagaagcctcagcataggct

SEQ ID NO: 14952 - DNA, 25 bp, Homo sapien
accaggagcagcctcagcataggct

SEQ ID NO: 14953 - DNA, 25 bp, Homo sapien
accaggattcagaggaggtatcaaa

SEQ ID NO: 14954 - DNA, 25 bp, Homo sapien
accaggattcagaggatgtatcaaa

SEQ ID NO: 14955 - DNA, 25 bp, Homo sapien
accaggatttagtcattcagcacag

SEQ ID NO: 14956 - DNA, 25 bp, Homo sapien
accaggatttagtcgttcagcacag

SEQ ID NO: 14957 - DNA, 25 bp, Homo sapien
accaggccacgtcttaaaaatgaga

SEQ ID NO: 14958 - DNA, 25 bp, Homo sapien
accaggccaggtcttaaaaatgaga

SEQ ID NO: 14959 - DNA, 25 bp, Homo sapien
accaggctgccctgcttgtgcctta

SEQ ID NO: 14960 - DNA, 25 bp, Homo sapien
accaggctgccctgtttgtgcctta

SEQ ID NO: 14961 - DNA, 25 bp, Homo sapien
accaggctttacctgtatcactcgt

SEQ ID NO: 14962 - DNA, 25 bp, Homo sapien
accaggctttatctgtatcactcgt

SEQ ID NO: 14963 - DNA, 25 bp, Homo sapien
accaggctttccacattttctacca

SEQ ID NO: 14964 - DNA, 25 bp, Homo sapien
accaggctttccgcattttctacca

SEQ ID NO: 14965 - DNA, 25 bp, Homo sapien
accagggataccaacaggaacaaga

SEQ ID NO: 14966 - DNA, 25 bp, Homo sapien
accagggataccaccaggaacaaga

SEQ ID NO: 14967 - DNA, 25 bp, Homo sapien
accagggcaataacgctcctgtttg

SEQ ID NO: 14968 - DNA, 25 bp, Homo sapien
accagggcaataatgctcctgtttg

SEQ ID NO: 14969 - DNA, 25 bp, Homo sapien
accagggctgcgctaattagattgc

SEQ ID NO: 14970 - DNA, 25 bp, Homo sapien
accagggctgctctaattagattgc

SEQ ID NO: 14971 - DNA, 25 bp, Homo sapien
accaggtcatttatttctcagcctg

SEQ ID NO: 14972 - DNA, 25 bp, Homo sapien
accaggtcatttatttgtcagcctg

SEQ ID NO: 14973 - DNA, 25 bp, Homo sapien
accaggttgttttgatacttaagtg

SEQ ID NO: 14974 - DNA, 25 bp, Homo sapien
accaggttgttttggtacttaagtg

SEQ ID NO: 14975 - DNA, 25 bp, Homo sapien
accagtaatatctaaactatgcatt

SEQ ID NO: 14976 - DNA, 25 bp, Homo sapien
accagtaatatttaaactatgcatt

SEQ ID NO: 14977 - DNA, 25 bp, Homo sapien
accagtatttctgcacgaaggattt

SEQ ID NO: 14978 - DNA, 25 bp, Homo sapien
accagtatttctggacgaaggattt

SEQ ID NO: 14979 - DNA, 25 bp, Homo sapien
accagtcaggaacggatggtacttc

SEQ ID NO: 14980 - DNA, 25 bp, Homo sapien
accagtcaggaatggatggtacttc

SEQ ID NO: 14981 - DNA, 25 bp, Homo sapien
accagtctccgggacatggaagtga

SEQ ID NO: 14982 - DNA, 25 bp, Homo sapien
accagtctgaataggaggatacagg

SEQ ID NO: 14983 - DNA, 25 bp, Homo sapien
accagtctggataggaggatacagg

SEQ ID NO: 14984 - DNA, 25 bp, Homo sapien
accagtcttcgggacatggaagtga

SEQ ID NO: 14985 - DNA, 25 bp, Homo sapien
accagtgaaaacataaacagactga

SEQ ID NO: 14986 - DNA, 25 bp, Homo sapien
accagtgaagtgggtgtaagagagg

SEQ ID NO: 14987 - DNA, 25 bp, Homo sapien
accagtgagaacataaacagactga

SEQ ID NO: 14988 - DNA, 25 bp, Homo sapien
accagtgaggtgggtgtaagagagg

SEQ ID NO: 14989 - DNA, 25 bp, Homo sapien
accagtgatatacgagggctgaaaa

SEQ ID NO: 14990 - DNA, 25 bp, Homo sapien
accagtgatatatgagggctgaaaa

SEQ ID NO: 14991 - DNA, 25 bp, Homo sapien
accagtgtctcatacttcttacctt

SEQ ID NO: 14992 - DNA, 25 bp, Homo sapien
accagtgtctcatatttcttacctt

SEQ ID NO: 14993 - DNA, 25 bp, Homo sapien
accagtgtgcaacaggactttggct

SEQ ID NO: 14994 - DNA, 25 bp, Homo sapien
accagtgtgcaataggactttggct

SEQ ID NO: 14995 - DNA, 25 bp, Homo sapien
accagtgtgtgcccactttcctttg

SEQ ID NO: 14996 - DNA, 25 bp, Homo sapien
accagtgtgtgcccgctttcctttg

SEQ ID NO: 14997 - DNA, 25 bp, Homo sapien
accagttaagccagaggacgaccca

SEQ ID NO: 14998 - DNA, 25 bp, Homo sapien
accagttaagccagtggacgaccca

SEQ ID NO: 14999 - DNA, 25 bp, Homo sapien
accagtttcttccaacaagttactt

SEQ ID NO: 15000 - DNA, 25 bp, Homo sapien
accagtttcttccaaccagttactt

SEQ ID NO: 15001 - DNA, 25 bp, Homo sapien
accagttttatccacgctttactgc

SEQ ID NO: 15002 - DNA, 25 bp, Homo sapien
accagttttatccatgctttactgc

SEQ ID NO: 15003 - DNA, 25 bp, Homo sapien
accataaaaaatctaccagttagtg

SEQ ID NO: 15004 - DNA, 25 bp, Homo sapien
accataaaaaatttaccagttagtg

SEQ ID NO: 15005 - DNA, 25 bp, Homo sapien
accataacatctacgaacaggtgaa

SEQ ID NO: 15006 - DNA, 25 bp, Homo sapien
accataaccagtttataaaaggagg

SEQ ID NO: 15007 - DNA, 25 bp, Homo sapien
accataaccagtttctaaaaggagg

SEQ ID NO: 15008 - DNA, 25 bp, Homo sapien
accataacgtctacgaacaggtgaa

SEQ ID NO: 15009 - DNA, 25 bp, Homo sapien
accataatgagacaagagagtagga

SEQ ID NO: 15010 - DNA, 25 bp, Homo sapien
accataatgagacaggagagtagga

SEQ ID NO: 15011 - DNA, 25 bp, Homo sapien
accatacaatcagtagattttaaac

SEQ ID NO: 15012 - DNA, 25 bp, Homo sapien
accatacaatcggtagattttaaac

SEQ ID NO: 15013 - DNA, 25 bp, Homo sapien
accatacacatacagaaaagtgcat

SEQ ID NO: 15014 - DNA, 25 bp, Homo sapien
accatacacatacggaaaagtgcat

SEQ ID NO: 15015 - DNA, 25 bp, Homo sapien
accatacatataaatccataaacaa

SEQ ID NO: 15016 - DNA, 25 bp, Homo sapien
accatacatatacatccataaacaa

SEQ ID NO: 15017 - DNA, 25 bp, Homo sapien
accatactgatgatacaaaacagtc

SEQ ID NO: 15018 - DNA, 25 bp, Homo sapien
accatactggtgatacaaaacagtc

SEQ ID NO: 15019 - DNA, 25 bp, Homo sapien
accatacttcctcctattctcttac

SEQ ID NO: 15020 - DNA, 25 bp, Homo sapien
accatacttcctcttattctcttac

SEQ ID NO: 15021 - DNA, 25 bp, Homo sapien
accatagtcaacgtaagaaaaaaat

SEQ ID NO: 15022 - DNA, 25 bp, Homo sapien
accatagtcaatgtaagaaaaaaat

SEQ ID NO: 15023 - DNA, 25 bp, Homo sapien
accatataaaacagaaactgttgga

SEQ ID NO: 15024 - DNA, 25 bp, Homo sapien
accatataaaacaggaactgttgga

SEQ ID NO: 15025 - DNA, 25 bp, Homo sapien
accatatctattacattacccagca

SEQ ID NO: 15026 - DNA, 25 bp, Homo sapien
accatatctattacgttacccagca

SEQ ID NO: 15027 - DNA, 25 bp, Homo sapien
accatatgcaccaatacttttaacg

SEQ ID NO: 15028 - DNA, 25 bp, Homo sapien
accatatgcaccagtacttttaacg

SEQ ID NO: 15029 - DNA, 25 bp, Homo sapien
accatattcagctagtcttgctata

SEQ ID NO: 15030 - DNA, 25 bp, Homo sapien
accatattcagctattcttgctata

SEQ ID NO: 15031 - DNA, 25 bp, Homo sapien
accatattcatcttcatctttattt

SEQ ID NO: 15032 - DNA, 25 bp, Homo sapien
accatattcttcttcatctttattt

SEQ ID NO: 15033 - DNA, 25 bp, Homo sapien
accatcaaattctatgaaactcaaa

SEQ ID NO: 15034 - DNA, 25 bp, Homo sapien
accatcaaattctatggaactcaaa

SEQ ID NO: 15035 - DNA, 25 bp, Homo sapien
accatcaatgggatcaatcaagaac

SEQ ID NO: 15036 - DNA, 25 bp, Homo sapien
accatcaatgggatcagtcaagaac

SEQ ID NO: 15037 - DNA, 25 bp, Homo sapien
accatcaccacaatcgattttatat

SEQ ID NO: 15038 - DNA, 25 bp, Homo sapien
accatcaccacaattgattttatat

SEQ ID NO: 15039 - DNA, 25 bp, Homo sapien
accatcagagaactcagccagccta

SEQ ID NO: 15040 - DNA, 25 bp, Homo sapien
accatcagagaattcagccagccta

SEQ ID NO: 15041 - DNA, 25 bp, Homo sapien
accatcagatcatcttaatcctatt

SEQ ID NO: 15042 - DNA, 25 bp, Homo sapien
accatcagatcgtcttaatcctatt

SEQ ID NO: 15043 - DNA, 25 bp, Homo sapien
accatcatccatacagagagggcag

SEQ ID NO: 15044 - DNA, 25 bp, Homo sapien
accatcatgcctaactcgggactca

SEQ ID NO: 15045 - DNA, 25 bp, Homo sapien
accatcatggctaactcgggactca

SEQ ID NO: 15046 - DNA, 25 bp, Homo sapien
accatcattcatacagagagggcag

SEQ ID NO: 15047 - DNA, 25 bp, Homo sapien
accatccctagacatcctgacaagt

SEQ ID NO: 15048 - DNA, 25 bp, Homo sapien
accatccctagacgtcctgacaagt

SEQ ID NO: 15049 - DNA, 25 bp, Homo sapien
accatcctgccattcagaggaggga

SEQ ID NO: 15050 - DNA, 25 bp, Homo sapien
accatcctgccgttcagaggaggga

SEQ ID NO: 15051 - DNA, 25 bp, Homo sapien
accatcgagagcactaacgagaatg

SEQ ID NO: 15052 - DNA, 25 bp, Homo sapien
accatcgagagtactaacgagaatg

SEQ ID NO: 15053 - DNA, 25 bp, Homo sapien
accatcgcctgtcaccatgttcttt

SEQ ID NO: 15054 - DNA, 25 bp, Homo sapien
accatcgcctgtcaccgtgttcttt

SEQ ID NO: 15055 - DNA, 25 bp, Homo sapien
accatctaagaactgtaaatcagaa

SEQ ID NO: 15056 - DNA, 25 bp, Homo sapien
accatctaagaattgtaaatcagaa

SEQ ID NO: 15057 - DNA, 25 bp, Homo sapien
accatctatttcagatgtggaatcg

SEQ ID NO: 15058 - DNA, 25 bp, Homo sapien
accatctatttcagatttggaatcg

SEQ ID NO: 15059 - DNA, 25 bp, Homo sapien
accatctttacatcctccaggcctc

SEQ ID NO: 15060 - DNA, 25 bp, Homo sapien
accatctttacgtcctccaggcctc

SEQ ID NO: 15061 - DNA, 25 bp, Homo sapien
accatctttcaaacgcttcagggca

SEQ ID NO: 15062 - DNA, 25 bp, Homo sapien
accatctttcaaatgcttcagggca

SEQ ID NO: 15063 - DNA, 25 bp, Homo sapien
accatgaaaataaagtgggctcctt

SEQ ID NO: 15064 - DNA, 25 bp, Homo sapien
accatgaacgtaatgaatcttcctg

SEQ ID NO: 15065 - DNA, 25 bp, Homo sapien
accatgaagacatcattgcagcatg

SEQ ID NO: 15066 - DNA, 25 bp, Homo sapien
accatgaagacgtcattgcagcatg

SEQ ID NO: 15067 - DNA, 25 bp, Homo sapien
accatgaatagagcttgcagggctg

SEQ ID NO: 15068 - DNA, 25 bp, Homo sapien
accatgaatataaagtgggctcctt

SEQ ID NO: 15069 - DNA, 25 bp, Homo sapien
accatgaatggagcttgcagggctg

SEQ ID NO: 15070 - DNA, 25 bp, Homo sapien
accatgaatgtaatgaatcttcctg

SEQ ID NO: 15071 - DNA, 25 bp, Homo sapien
accatgagtgcctgaacaaaatgga

SEQ ID NO: 15072 - DNA, 25 bp, Homo sapien
accatgagtgcctgaataaaatgga

SEQ ID NO: 15073 - DNA, 25 bp, Homo sapien
accatgatcttcccagagatttttt

SEQ ID NO: 15074 - DNA, 25 bp, Homo sapien
accatgatcttcccggagatttttt

SEQ ID NO: 15075 - DNA, 25 bp, Homo sapien
accatgatgttcgtgttgcaatttg

SEQ ID NO: 15076 - DNA, 25 bp, Homo sapien
accatgatgtttgtgttgcaatttg

SEQ ID NO: 15077 - DNA, 25 bp, Homo sapien
accatgcaatagaaaagatttgaga

SEQ ID NO: 15078 - DNA, 25 bp, Homo sapien
accatgcattagaaaagatttgaga

SEQ ID NO: 15079 - DNA, 25 bp, Homo sapien
accatgccatgtcggacttcagaac

SEQ ID NO: 15080 - DNA, 25 bp, Homo sapien
accatgccatgttggacttcagaac

SEQ ID NO: 15081 - DNA, 25 bp, Homo sapien
accatgctacaaatgtttattgaga

SEQ ID NO: 15082 - DNA, 25 bp, Homo sapien
accatgctacagatgtttattgaga

SEQ ID NO: 15083 - DNA, 25 bp, Homo sapien
accatgcttctgagaagacaggaaa

SEQ ID NO: 15084 - DNA, 25 bp, Homo sapien
accatgcttggctaacttttgtatt

SEQ ID NO: 15085 - DNA, 25 bp, Homo sapien
accatgcttgggtaacttttgtatt

SEQ ID NO: 15086 - DNA, 25 bp, Homo sapien
accatgcttttgagaagacaggaaa

SEQ ID NO: 15087 - DNA, 25 bp, Homo sapien
accatggaacaatgttcaagattaa

SEQ ID NO: 15088 - DNA, 25 bp, Homo sapien
accatggaacaatgtttaagattaa

SEQ ID NO: 15089 - DNA, 25 bp, Homo sapien
accatggagtatacaagagtcaaaa

SEQ ID NO: 15090 - DNA, 25 bp, Homo sapien
accatggagtatacgagagtcaaaa

SEQ ID NO: 15091 - DNA, 25 bp, Homo sapien
accatggatttcattcccactgctt

SEQ ID NO: 15092 - DNA, 25 bp, Homo sapien
accatggattttattcccactgctt

SEQ ID NO: 15093 - DNA, 25 bp, Homo sapien
accatggcaatgaaaaggagaaaac

SEQ ID NO: 15094 - DNA, 25 bp, Homo sapien
accatggcagtgaaaaggagaaaac

SEQ ID NO: 15095 - DNA, 25 bp, Homo sapien
accatggtaagacatgcctacttct

SEQ ID NO: 15096 - DNA, 25 bp, Homo sapien
accatggtaagacgtgcctacttct

SEQ ID NO: 15097 - DNA, 25 bp, Homo sapien
accatgtcaccttactttgccccat

SEQ ID NO: 15098 - DNA, 25 bp, Homo sapien
accatgtcgccttactttgccccat

SEQ ID NO: 15099 - DNA, 25 bp, Homo sapien
accatgtgggaatcagcaagaacaa

SEQ ID NO: 15100 - DNA, 25 bp, Homo sapien
accatgtgggaatcggcaagaacaa

SEQ ID NO: 15101 - DNA, 25 bp, Homo sapien
accatgtgggcaagcccgcctagat

SEQ ID NO: 15102 - DNA, 25 bp, Homo sapien
accatgtgggcaaggccgcctagat

SEQ ID NO: 15103 - DNA, 25 bp, Homo sapien
accattaaataaagaaacaacgtaa

SEQ ID NO: 15104 - DNA, 25 bp, Homo sapien
accattaaataaagaaccaacgtaa

SEQ ID NO: 15105 - DNA, 25 bp, Homo sapien
accattaataacaaaacacacatga

SEQ ID NO: 15106 - DNA, 25 bp, Homo sapien
accattaataacaaaatacacatga

SEQ ID NO: 15107 - DNA, 25 bp, Homo sapien
accattaccgtaactgctgtcagct

SEQ ID NO: 15108 - DNA, 25 bp, Homo sapien
accattactgtaactgctgtcagct

SEQ ID NO: 15109 - DNA, 25 bp, Homo sapien
accattaggcttcatcctggttacc

SEQ ID NO: 15110 - DNA, 25 bp, Homo sapien
accattaggctttatcctggttacc

SEQ ID NO: 15111 - DNA, 25 bp, Homo sapien
accattatgattatgccaggttaca

SEQ ID NO: 15112 - DNA, 25 bp, Homo sapien
accattatgattgtgccaggttaca

SEQ ID NO: 15113 - DNA, 25 bp, Homo sapien
accattcacttcctgccatcattat

SEQ ID NO: 15114 - DNA, 25 bp, Homo sapien
accattcactttctgccatcattat

SEQ ID NO: 15115 - DNA, 25 bp, Homo sapien
accattcctttcattcaccagtttt

SEQ ID NO: 15116 - DNA, 25 bp, Homo sapien
accattcctttcattcgccagtttt

SEQ ID NO: 15117 - DNA, 25 bp, Homo sapien
accattcgacacaggtgtggatttt

SEQ ID NO: 15118 - DNA, 25 bp, Homo sapien
accattcgacataggtgtggatttt

SEQ ID NO: 15119 - DNA, 25 bp, Homo sapien
accattcttttgatggcactgattg

SEQ ID NO: 15120 - DNA, 25 bp, Homo sapien
accattcttttgattgcactgattg

SEQ ID NO: 15121 - DNA, 25 bp, Homo sapien
accattgaatcttgcgctacataga

SEQ ID NO: 15122 - DNA, 25 bp, Homo sapien
accattgaatcttgtgctacataga

SEQ ID NO: 15123 - DNA, 25 bp, Homo sapien
accattgcaaaggaagatccacatc

SEQ ID NO: 15124 - DNA, 25 bp, Homo sapien
accattgcaaaggaggatccacatc

SEQ ID NO: 15125 - DNA, 25 bp, Homo sapien
accattgcaaataccaacaccagcg

SEQ ID NO: 15126 - DNA, 25 bp, Homo sapien
accattgcaaatatcaacaccagcg

SEQ ID NO: 15127 - DNA, 25 bp, Homo sapien
accattgccttggcgtgagactgat

SEQ ID NO: 15128 - DNA, 25 bp, Homo sapien
accattgccttggtgtgagactgat

SEQ ID NO: 15129 - DNA, 25 bp, Homo sapien
accatttaagtgcgataatttgtca

SEQ ID NO: 15130 - DNA, 25 bp, Homo sapien
accatttaagtgtgataatttgtca

SEQ ID NO: 15131 - DNA, 25 bp, Homo sapien
accatttggaaattatgttttactc

SEQ ID NO: 15132 - DNA, 25 bp, Homo sapien
accatttggaaattgtgttttactc

SEQ ID NO: 15133 - DNA, 25 bp, Homo sapien
accattttaaaaccataagagggct

SEQ ID NO: 15134 - DNA, 25 bp, Homo sapien
accattttaacacatgatataaatt

SEQ ID NO: 15135 - DNA, 25 bp, Homo sapien
accattttaacgcatgatataaatt

SEQ ID NO: 15136 - DNA, 25 bp, Homo sapien
accattttacaaccataagagggct

SEQ ID NO: 15137 - DNA, 25 bp, Homo sapien
accattttctcagctcctctttgac

SEQ ID NO: 15138 - DNA, 25 bp, Homo sapien
accattttctcagctcgtctttgac

SEQ ID NO: 15139 - DNA, 25 bp, Homo sapien
accatttttccttctttgctcttaa

SEQ ID NO: 15140 - DNA, 25 bp, Homo sapien
accatttttgagtgtgacttcattt

SEQ ID NO: 15141 - DNA, 25 bp, Homo sapien
accattttttagtgtgacttcattt

SEQ ID NO: 15142 - DNA, 25 bp, Homo sapien
accattttttcttctttgctcttaa

SEQ ID NO: 15143 - DNA, 25 bp, Homo sapien
acccaaaactaggcatttggtttct

SEQ ID NO: 15144 - DNA, 25 bp, Homo sapien
acccaaaactatgcatttggtttct

SEQ ID NO: 15145 - DNA, 25 bp, Homo sapien
acccaaaccctaccatggtcatctc

SEQ ID NO: 15146 - DNA, 25 bp, Homo sapien
acccaaaccctaccgtggtcatctc

SEQ ID NO: 15147 - DNA, 25 bp, Homo sapien
acccaaatacgcagtttcctgtaga

SEQ ID NO: 15148 - DNA, 25 bp, Homo sapien
acccaaatacgctggcttgatcatt

SEQ ID NO: 15149 - DNA, 25 bp, Homo sapien
acccaaatatgcagtttcctgtaga

SEQ ID NO: 15150 - DNA, 25 bp, Homo sapien
acccaaatatgctggcttgatcatt

SEQ ID NO: 15151 - DNA, 25 bp, Homo sapien
acccaaatattcatttcatggacat

SEQ ID NO: 15152 - DNA, 25 bp, Homo sapien
acccaaatattgatttcatggacat

SEQ ID NO: 15153 - DNA, 25 bp, Homo sapien
acccaaggttacgcatctagcaagt

SEQ ID NO: 15154 - DNA, 25 bp, Homo sapien
acccaaggttactcatctagcaagt

SEQ ID NO: 15155 - DNA, 25 bp, Homo sapien
acccaagtgagaatctttaatcaca

SEQ ID NO: 15156 - DNA, 25 bp, Homo sapien
acccaagtgagaatttttaatcaca

SEQ ID NO: 15157 - DNA, 25 bp, Homo sapien
acccacaaccacattttcctgctct

SEQ ID NO: 15158 - DNA, 25 bp, Homo sapien
acccacaaccaccttttcctgctct

SEQ ID NO: 15159 - DNA, 25 bp, Homo sapien
acccacaatcgattccttctccaat

SEQ ID NO: 15160 - DNA, 25 bp, Homo sapien
acccacaattgattccttctccaat

SEQ ID NO: 15161 - DNA, 25 bp, Homo sapien
acccacagaagtgaccagacccagg

SEQ ID NO: 15162 - DNA, 25 bp, Homo sapien
acccacagaagtgaccggacccagg

SEQ ID NO: 15163 - DNA, 25 bp, Homo sapien
acccacaggactaaacttgccatgg

SEQ ID NO: 15164 - DNA, 25 bp, Homo sapien
acccacaggcctaaacttgccatgg

SEQ ID NO: 15165 - DNA, 25 bp, Homo sapien
acccaccctatcctagtatgacttc

SEQ ID NO: 15166 - DNA, 25 bp, Homo sapien
acccaccctatcttagtatgacttc

SEQ ID NO: 15167 - DNA, 25 bp, Homo sapien
acccacctcaccatgttagagaaaa

SEQ ID NO: 15168 - DNA, 25 bp, Homo sapien
acccacctcaccgtgttagagaaaa

SEQ ID NO: 15169 - DNA, 25 bp, Homo sapien
acccaccttgcccagctgctgtttg

SEQ ID NO: 15170 - DNA, 25 bp, Homo sapien
acccaccttgcccggctgctgtttg

SEQ ID NO: 15171 - DNA, 25 bp, Homo sapien
acccacgaattgggcagtttgtaca

SEQ ID NO: 15172 - DNA, 25 bp, Homo sapien
acccacgatttgggcagtttgtaca

SEQ ID NO: 15173 - DNA, 25 bp, Homo sapien
acccactatgaggccacggaaaggg

SEQ ID NO: 15174 - DNA, 25 bp, Homo sapien
acccactatgaggccatggaaaggg

SEQ ID NO: 15175 - DNA, 25 bp, Homo sapien
acccactccctcaacaatgacatta

SEQ ID NO: 15176 - DNA, 25 bp, Homo sapien
acccactccctcaacagtgacatta

SEQ ID NO: 15177 - DNA, 25 bp, Homo sapien
acccactgaaatttgagaccctaga

SEQ ID NO: 15178 - DNA, 25 bp, Homo sapien
acccactggaatttgagaccctaga

SEQ ID NO: 15179 - DNA, 25 bp, Homo sapien
acccagaaaatagtgaaaaatgaaa

SEQ ID NO: 15180 - DNA, 25 bp, Homo sapien
acccagaaaatagtgagaaatgaaa

SEQ ID NO: 15181 - DNA, 25 bp, Homo sapien
acccagaaacaggtggcatctttgg

SEQ ID NO: 15182 - DNA, 25 bp, Homo sapien
acccagaaacagttggcatctttgg

SEQ ID NO: 15183 - DNA, 25 bp, Homo sapien
acccagaagaataaaatcagaggac

SEQ ID NO: 15184 - DNA, 25 bp, Homo sapien
acccagaagaataagatcagaggac

SEQ ID NO: 15185 - DNA, 25 bp, Homo sapien
acccagaatacagaagtacatcggt

SEQ ID NO: 15186 - DNA, 25 bp, Homo sapien
acccagaatacggaagtacatcggt

SEQ ID NO: 15187 - DNA, 25 bp, Homo sapien
acccagaatatagcacagagagata

SEQ ID NO: 15188 - DNA, 25 bp, Homo sapien
acccagaatgtagcacagagagata

SEQ ID NO: 15189 - DNA, 25 bp, Homo sapien
acccagacaaaaacaaacataagca

SEQ ID NO: 15190 - DNA, 25 bp, Homo sapien
acccagacacaaacaaacataagca

SEQ ID NO: 15191 - DNA, 25 bp, Homo sapien
acccagagtacttgacagtgtcctc

SEQ ID NO: 15192 - DNA, 25 bp, Homo sapien
acccagagtacttgacggtgtcctc

SEQ ID NO: 15193 - DNA, 25 bp, Homo sapien
acccagagtgttgcctctcagctcc

SEQ ID NO: 15194 - DNA, 25 bp, Homo sapien
acccagagtgttgcttctcagctcc

SEQ ID NO: 15195 - DNA, 25 bp, Homo sapien
acccagatacagctgcagaacagag

SEQ ID NO: 15196 - DNA, 25 bp, Homo sapien
acccagatccttcactggcaacccc

SEQ ID NO: 15197 - DNA, 25 bp, Homo sapien
acccagatccttcgctggcaacccc

SEQ ID NO: 15198 - DNA, 25 bp, Homo sapien
acccagatgcagctgcagaacagag

SEQ ID NO: 15199 - DNA, 25 bp, Homo sapien
acccagattatatagggaaacagat

SEQ ID NO: 15200 - DNA, 25 bp, Homo sapien
acccagattatatggggaaacagat

SEQ ID NO: 15201 - DNA, 25 bp, Homo sapien
acccagcagcacagggaatgaggaa

SEQ ID NO: 15202 - DNA, 25 bp, Homo sapien
acccagcagcacagtgaatgaggaa

SEQ ID NO: 15203 - DNA, 25 bp, Homo sapien
acccagcagtccaagaacttgccca

SEQ ID NO: 15204 - DNA, 25 bp, Homo sapien
acccagcagtccgagaacttgccca

SEQ ID NO: 15205 - DNA, 25 bp, Homo sapien
acccagccttgtagttcgaggagag

SEQ ID NO: 15206 - DNA, 25 bp, Homo sapien
acccagccttgtagttggaggagag

SEQ ID NO: 15207 - DNA, 25 bp, Homo sapien
acccagctgtattgcgtccatttaa

SEQ ID NO: 15208 - DNA, 25 bp, Homo sapien
acccagctgtattgtgtccatttaa

SEQ ID NO: 15209 - DNA, 25 bp, Homo sapien
acccagggaaccactgatgctgcag

SEQ ID NO: 15210 - DNA, 25 bp, Homo sapien
acccagggaaccattgatgctgcag

SEQ ID NO: 15211 - DNA, 25 bp, Homo sapien
acccagggcacaaaacaaagtcctc

SEQ ID NO: 15212 - DNA, 25 bp, Homo sapien
acccagggcacaaagcaaagtcctc

SEQ ID NO: 15213 - DNA, 25 bp, Homo sapien
acccaggtcttgcatctgccaccgg

SEQ ID NO: 15214 - DNA, 25 bp, Homo sapien
acccaggtcttgtatctgccaccgg

SEQ ID NO: 15215 - DNA, 25 bp, Homo sapien
acccaggttctatcacttcctgaaa

SEQ ID NO: 15216 - DNA, 25 bp, Homo sapien
acccaggttctatcgcttcctgaaa

SEQ ID NO: 15217 - DNA, 25 bp, Homo sapien
acccagtaccgactgatgaagtggt

SEQ ID NO: 15218 - DNA, 25 bp, Homo sapien
acccagtaccggctgatgaagtggt

SEQ ID NO: 15219 - DNA, 25 bp, Homo sapien
acccagtcactgccctaattttcca

SEQ ID NO: 15220 - DNA, 25 bp, Homo sapien
acccagtcactgccttaattttcca

SEQ ID NO: 15221 - DNA, 25 bp, Homo sapien
acccagtcattagggaaaagcacta

SEQ ID NO: 15222 - DNA, 25 bp, Homo sapien
acccagtcattgaagcaagcacctt

SEQ ID NO: 15223 - DNA, 25 bp, Homo sapien
acccagtccgccaattcaaatgtca

SEQ ID NO: 15224 - DNA, 25 bp, Homo sapien
acccagtcgttagggaaaagcacta

SEQ ID NO: 15225 - DNA, 25 bp, Homo sapien
acccagtcgttgaagcaagcacctt

SEQ ID NO: 15226 - DNA, 25 bp, Homo sapien
acccagtctgccaattcaaatgtca

SEQ ID NO: 15227 - DNA, 25 bp, Homo sapien
acccagtgagtagcttagtatcagg

SEQ ID NO: 15228 - DNA, 25 bp, Homo sapien
acccagtgagtagcttggtatcagg

SEQ ID NO: 15229 - DNA, 25 bp, Homo sapien
acccagtggctgcacgttgtagttc

SEQ ID NO: 15230 - DNA, 25 bp, Homo sapien
acccagtggctgtacgttgtagttc

SEQ ID NO: 15231 - DNA, 25 bp, Homo sapien
acccagtgggtcacgatgtttatcc

SEQ ID NO: 15232 - DNA, 25 bp, Homo sapien
acccagtgggtcaggatgtttatcc

SEQ ID NO: 15233 - DNA, 25 bp, Homo sapien
acccataagagccaataatgtagtt

SEQ ID NO: 15234 - DNA, 25 bp, Homo sapien
acccataagagcgaataatgtagtt

SEQ ID NO: 15235 - DNA, 25 bp, Homo sapien
acccataatatcattttttgcagtg

SEQ ID NO: 15236 - DNA, 25 bp, Homo sapien
acccataatattattttttgcagtg

SEQ ID NO: 15237 - DNA, 25 bp, Homo sapien
acccatagaatatacaacatgatag

SEQ ID NO: 15238 - DNA, 25 bp, Homo sapien
acccatagactatacaacatgatag

SEQ ID NO: 15239 - DNA, 25 bp, Homo sapien
acccatcagtgacgctcttctcttc

SEQ ID NO: 15240 - DNA, 25 bp, Homo sapien
acccatcagtgatgctcttctcttc

SEQ ID NO: 15241 - DNA, 25 bp, Homo sapien
acccatctcaacatgtttgtttctc

SEQ ID NO: 15242 - DNA, 25 bp, Homo sapien
acccatctctacatgtttgtttctc

SEQ ID NO: 15243 - DNA, 25 bp, Homo sapien
acccatgacttaatcatccagggta

SEQ ID NO: 15244 - DNA, 25 bp, Homo sapien
acccatgacttattcatccagggta

SEQ ID NO: 15245 - DNA, 25 bp, Homo sapien
acccatgaggagatgcactacattc

SEQ ID NO: 15246 - DNA, 25 bp, Homo sapien
acccatgaggagatgcgctacattc

SEQ ID NO: 15247 - DNA, 25 bp, Homo sapien
acccatgattacttgtccattaagg

SEQ ID NO: 15248 - DNA, 25 bp, Homo sapien
acccatgattatttgtccattaagg

SEQ ID NO: 15249 - DNA, 25 bp, Homo sapien
acccatgcagtgaatacaaactcat

SEQ ID NO: 15250 - DNA, 25 bp, Homo sapien
acccatgcagtgaatataaactcat

SEQ ID NO: 15251 - DNA, 25 bp, Homo sapien
acccatgcctatggaatttcatcct

SEQ ID NO: 15252 - DNA, 25 bp, Homo sapien
acccatgcttatggaatttcatcct

SEQ ID NO: 15253 - DNA, 25 bp, Homo sapien
acccatggaaagttatggaatcttg

SEQ ID NO: 15254 - DNA, 25 bp, Homo sapien
acccatgggaagttatggaatcttg

SEQ ID NO: 15255 - DNA, 25 bp, Homo sapien
acccattatcaattaccttctttag

SEQ ID NO: 15256 - DNA, 25 bp, Homo sapien
acccattattaattaccttctttag

SEQ ID NO: 15257 - DNA, 25 bp, Homo sapien
acccattctcaggctgttatgaaga

SEQ ID NO: 15258 - DNA, 25 bp, Homo sapien
acccattctcatgctgttatgaaga

SEQ ID NO: 15259 - DNA, 25 bp, Homo sapien
acccattgaacagcaactctccatc

SEQ ID NO: 15260 - DNA, 25 bp, Homo sapien
acccattgaacagtaactctccatc

SEQ ID NO: 15261 - DNA, 25 bp, Homo sapien
acccattgatagatcgaagcctata

SEQ ID NO: 15262 - DNA, 25 bp, Homo sapien
acccattgatagattgaagcctata

SEQ ID NO: 15263 - DNA, 25 bp, Homo sapien
acccattgttggagatgaggtcagg

SEQ ID NO: 15264 - DNA, 25 bp, Homo sapien
acccattgttggcgatgaggtcagg

SEQ ID NO: 15265 - DNA, 25 bp, Homo sapien
accccaaaactctctgattcagtag

SEQ ID NO: 15266 - DNA, 25 bp, Homo sapien
accccaaaactgtctgattcagtag

SEQ ID NO: 15267 - DNA, 25 bp, Homo sapien
accccaaaagagtgatggcgtctcc

SEQ ID NO: 15268 - DNA, 25 bp, Homo sapien
accccaaaagattgatggcgtctcc

SEQ ID NO: 15269 - DNA, 25 bp, Homo sapien
accccaaaatgatcagataatattt

SEQ ID NO: 15270 - DNA, 25 bp, Homo sapien
accccaaaatgatccgataatattt

SEQ ID NO: 15271 - DNA, 25 bp, Homo sapien
accccagctacaccattattatgtt

SEQ ID NO: 15272 - DNA, 25 bp, Homo sapien
accccagctacactattattatgtt

SEQ ID NO: 15273 - DNA, 25 bp, Homo sapien
accccatacattttctagttggcta

SEQ ID NO: 15274 - DNA, 25 bp, Homo sapien
accccatacctaacctctcagcatt

SEQ ID NO: 15275 - DNA, 25 bp, Homo sapien
accccatacctaacctttcagcatt

SEQ ID NO: 15276 - DNA, 25 bp, Homo sapien
accccatacgttttctagttggcta

SEQ ID NO: 15277 - DNA, 25 bp, Homo sapien
accccatcgtatcttcctctgtctt

SEQ ID NO: 15278 - DNA, 25 bp, Homo sapien
accccatcgtatcttcgtctgtctt

SEQ ID NO: 15279 - DNA, 25 bp, Homo sapien
accccatgaaaaattggcacctagt

SEQ ID NO: 15280 - DNA, 25 bp, Homo sapien
accccatgaaaagttggcacctagt

SEQ ID NO: 15281 - DNA, 25 bp, Homo sapien
accccattattgatgtcttgggaga

SEQ ID NO: 15282 - DNA, 25 bp, Homo sapien
accccattgttgatgtcttgggaga

SEQ ID NO: 15283 - DNA, 25 bp, Homo sapien
acccccttggtaaagctacctgaga

SEQ ID NO: 15284 - DNA, 25 bp, Homo sapien
acccccttggtagagctacctgaga

SEQ ID NO: 15285 - DNA, 25 bp, Homo sapien
accccgccttgtcacacgccttata

SEQ ID NO: 15286 - DNA, 25 bp, Homo sapien
accccgccttgttacacgccttata

SEQ ID NO: 15287 - DNA, 25 bp, Homo sapien
accccgtggcgtgctatgttgtctt

SEQ ID NO: 15288 - DNA, 25 bp, Homo sapien
accccgtggtgtgctatgttgtctt

SEQ ID NO: 15289 - DNA, 25 bp, Homo sapien
acccctagccagaaaaaaattgtcc

SEQ ID NO: 15290 - DNA, 25 bp, Homo sapien
acccctagctagaaaaaaattgtcc

SEQ ID NO: 15291 - DNA, 25 bp, Homo sapien
acccctgatagactgcaatataaga

SEQ ID NO: 15292 - DNA, 25 bp, Homo sapien
acccctgataggctgcaatataaga

SEQ ID NO: 15293 - DNA, 25 bp, Homo sapien
acccctgattcctataagatttttg

SEQ ID NO: 15294 - DNA, 25 bp, Homo sapien
acccctgattcctctaagatttttg

SEQ ID NO: 15295 - DNA, 25 bp, Homo sapien
acccctgtttccaactttctatctc

SEQ ID NO: 15296 - DNA, 25 bp, Homo sapien
acccctgtttccatctttctatctc

SEQ ID NO: 15297 - DNA, 25 bp, Homo sapien
accccttcaagtagcactggtgcag

SEQ ID NO: 15298 - DNA, 25 bp, Homo sapien
accccttcaagtcgcactggtgcag

SEQ ID NO: 15299 - DNA, 25 bp, Homo sapien
accccttcacaccttacacacctta

SEQ ID NO: 15300 - DNA, 25 bp, Homo sapien
accccttcacaccttatacacctta

SEQ ID NO: 15301 - DNA, 25 bp, Homo sapien
accccttcttggagaaaacctgtta

SEQ ID NO: 15302 - DNA, 25 bp, Homo sapien
accccttcttggagtaaacctgtta

SEQ ID NO: 15303 - DNA, 25 bp, Homo sapien
accccttttctgcatgacagatgaa

SEQ ID NO: 15304 - DNA, 25 bp, Homo sapien
accccttttctgcgtgacagatgaa

SEQ ID NO: 15305 - DNA, 25 bp, Homo sapien
acccgaatttcacatcccaggaaac

SEQ ID NO: 15306 - DNA, 25 bp, Homo sapien
acccgaatttcatatcccaggaaac

SEQ ID NO: 15307 - DNA, 25 bp, Homo sapien
acccgatatcaaagaatccaaaata

SEQ ID NO: 15308 - DNA, 25 bp, Homo sapien
acccgatatcaaataatccaaaata

SEQ ID NO: 15309 - DNA, 25 bp, Homo sapien
acccgcttgaatctgcactaccacc

SEQ ID NO: 15310 - DNA, 25 bp, Homo sapien
acccgcttgtatctgcactaccacc

SEQ ID NO: 15311 - DNA, 25 bp, Homo sapien
acccgtatttaaacagcaatccaaa

SEQ ID NO: 15312 - DNA, 25 bp, Homo sapien
acccgtatttaaccagcaatccaaa

SEQ ID NO: 15313 - DNA, 25 bp, Homo sapien
acccgtcactggttgaatccatgaa

SEQ ID NO: 15314 - DNA, 25 bp, Homo sapien
acccgtcattggttgaatccatgaa

SEQ ID NO: 15315 - DNA, 25 bp, Homo sapien
acccgtgcatttatccttccagaag

SEQ ID NO: 15316 - DNA, 25 bp, Homo sapien
acccgtgcatttattcttccagaag

SEQ ID NO: 15317 - DNA, 25 bp, Homo sapien
acccgtgtccctagccttgctctgc

SEQ ID NO: 15318 - DNA, 25 bp, Homo sapien
acccgtgtccctatccttgctctgc

SEQ ID NO: 15319 - DNA, 25 bp, Homo sapien
acccgttcaggatgaaaagagccat

SEQ ID NO: 15320 - DNA, 25 bp, Homo sapien
acccgttcagggtgaaaagagccat

SEQ ID NO: 15321 - DNA, 25 bp, Homo sapien
acccgtttatacttggtgtcccaca

SEQ ID NO: 15322 - DNA, 25 bp, Homo sapien
acccgtttttacttggtgtcccaca

SEQ ID NO: 15323 - DNA, 25 bp, Homo sapien
accctaacacatgtattagattgac

SEQ ID NO: 15324 - DNA, 25 bp, Homo sapien
accctaacacatgttttagattgac

SEQ ID NO: 15325 - DNA, 25 bp, Homo sapien
accctaaccttttattcaagccatc

SEQ ID NO: 15326 - DNA, 25 bp, Homo sapien
accctaacgttttattcaagccatc

SEQ ID NO: 15327 - DNA, 25 bp, Homo sapien
accctacaatgtctacagatgccag

SEQ ID NO: 15328 - DNA, 25 bp, Homo sapien
accctacaatgtctacggatgccag

SEQ ID NO: 15329 - DNA, 25 bp, Homo sapien
accctaccatggtcatctctactcc

SEQ ID NO: 15330 - DNA, 25 bp, Homo sapien
accctaccgtggtcatctctactcc

SEQ ID NO: 15331 - DNA, 25 bp, Homo sapien
accctagaatcatgctggaccacag

SEQ ID NO: 15332 - DNA, 25 bp, Homo sapien
accctagaatcgtgctggaccacag

SEQ ID NO: 15333 - DNA, 25 bp, Homo sapien
accctagaggccactgtactttttc

SEQ ID NO: 15334 - DNA, 25 bp, Homo sapien
accctagaggccgctgtactttttc

SEQ ID NO: 15335 - DNA, 25 bp, Homo sapien
accctagggtatagttcttgctctt

SEQ ID NO: 15336 - DNA, 25 bp, Homo sapien
accctagggtatggttcttgctctt

SEQ ID NO: 15337 - DNA, 25 bp, Homo sapien
accctataaagcaaccatgcagtag

SEQ ID NO: 15338 - DNA, 25 bp, Homo sapien
accctataaagtaaccatgcagtag

SEQ ID NO: 15339 - DNA, 25 bp, Homo sapien
accctatcactcctctactcaaaag

SEQ ID NO: 15340 - DNA, 25 bp, Homo sapien
accctatcagtcctctactcaaaag

SEQ ID NO: 15341 - DNA, 25 bp, Homo sapien
accctatcctagtatgacttcacct

SEQ ID NO: 15342 - DNA, 25 bp, Homo sapien
accctatcttagtatgacttcacct

SEQ ID NO: 15343 - DNA, 25 bp, Homo sapien
accctatgaagagtcttgagaattt

SEQ ID NO: 15344 - DNA, 25 bp, Homo sapien
accctatgatgagtcttgagaattt

SEQ ID NO: 15345 - DNA, 25 bp, Homo sapien
accctatgcttttcatcttcctcac

SEQ ID NO: 15346 - DNA, 25 bp, Homo sapien
accctatgctttttatcttcctcac

SEQ ID NO: 15347 - DNA, 25 bp, Homo sapien
accctatttttgctcgctggttata

SEQ ID NO: 15348 - DNA, 25 bp, Homo sapien
accctatttttgcttgctggttata

SEQ ID NO: 15349 - DNA, 25 bp, Homo sapien
accctcaacggacggctgcagaaga

SEQ ID NO: 15350 - DNA, 25 bp, Homo sapien
accctcaatggacggctgcagaaga

SEQ ID NO: 15351 - DNA, 25 bp, Homo sapien
accctcagagtttcggaatcagtag

SEQ ID NO: 15352 - DNA, 25 bp, Homo sapien
accctcagagttttggaatcagtag

SEQ ID NO: 15353 - DNA, 25 bp, Homo sapien
accctcagttccttcttggaaatct

SEQ ID NO: 15354 - DNA, 25 bp, Homo sapien
accctcagttcctttttggaaatct

SEQ ID NO: 15355 - DNA, 25 bp, Homo sapien
accctcatacacagctactggggat

SEQ ID NO: 15356 - DNA, 25 bp, Homo sapien
accctcatacaccgctactggggat

SEQ ID NO: 15357 - DNA, 25 bp, Homo sapien
accctccacaacaatttcttttttt

SEQ ID NO: 15358 - DNA, 25 bp, Homo sapien
accctccacaaccatttcttttttt

SEQ ID NO: 15359 - DNA, 25 bp, Homo sapien
accctctcagccacgaattaacttg

SEQ ID NO: 15360 - DNA, 25 bp, Homo sapien
accctctcagccatgaattaacttg

SEQ ID NO: 15361 - DNA, 25 bp, Homo sapien
accctctgtcaataacttactaatt

SEQ ID NO: 15362 - DNA, 25 bp, Homo sapien
accctctgtcagtaacttactaatt

SEQ ID NO: 15363 - DNA, 25 bp, Homo sapien
accctcttacctttgacgtcagagg

SEQ ID NO: 15364 - DNA, 25 bp, Homo sapien
accctcttacctttgatgtcagagg

SEQ ID NO: 15365 - DNA, 25 bp, Homo sapien
accctcttgccaaggttgatggata

SEQ ID NO: 15366 - DNA, 25 bp, Homo sapien
accctcttgccaagtttgatggata

SEQ ID NO: 15367 - DNA, 25 bp, Homo sapien
accctctttgcaccactatcacatc

SEQ ID NO: 15368 - DNA, 25 bp, Homo sapien
accctctttgcaccgctatcacatc

SEQ ID NO: 15369 - DNA, 25 bp, Homo sapien
accctgaataccgaaaaggctctct

SEQ ID NO: 15370 - DNA, 25 bp, Homo sapien
accctgaatactgaaaaggctctct

SEQ ID NO: 15371 - DNA, 25 bp, Homo sapien
accctgattgagtaaacatggcaaa

SEQ ID NO: 15372 - DNA, 25 bp, Homo sapien
accctgattgagtaaatatggcaaa

SEQ ID NO: 15373 - DNA, 25 bp, Homo sapien
accctgcaactgagcaaactacgtc

SEQ ID NO: 15374 - DNA, 25 bp, Homo sapien
accctgcaagggatccattttcagg

SEQ ID NO: 15375 - DNA, 25 bp, Homo sapien
accctgcaaggggtccattttcagg

SEQ ID NO: 15376 - DNA, 25 bp, Homo sapien
accctgcaattgagcaaactacgtc

SEQ ID NO: 15377 - DNA, 25 bp, Homo sapien
accctgcagctaagtagtattagcg

SEQ ID NO: 15378 - DNA, 25 bp, Homo sapien
accctgcagctaggtagtattagcg

SEQ ID NO: 15379 - DNA, 25 bp, Homo sapien
accctgcctctcttatattcttact

SEQ ID NO: 15380 - DNA, 25 bp, Homo sapien
accctgcctgtcttatattcttact

SEQ ID NO: 15381 - DNA, 25 bp, Homo sapien
accctgctccggtgggatttgcagt

SEQ ID NO: 15382 - DNA, 25 bp, Homo sapien
accctgctctggtgggatttgcagt

SEQ ID NO: 15383 - DNA, 25 bp, Homo sapien
accctgcttctgagttagacacact

SEQ ID NO: 15384 - DNA, 25 bp, Homo sapien
accctgcttctgggttagacacact

SEQ ID NO: 15385 - DNA, 25 bp, Homo sapien
accctgcttgccagatagcatctag

SEQ ID NO: 15386 - DNA, 25 bp, Homo sapien
accctgcttgccatatagcatctag

SEQ ID NO: 15387 - DNA, 25 bp, Homo sapien
accctggagtatcgcaatcatgact

SEQ ID NO: 15388 - DNA, 25 bp, Homo sapien
accctggagtattgcaatcatgact

SEQ ID NO: 15389 - DNA, 25 bp, Homo sapien
accctggattgctactaaaaatgca

SEQ ID NO: 15390 - DNA, 25 bp, Homo sapien
accctggattgctagtaaaaatgca

SEQ ID NO: 15391 - DNA, 25 bp, Homo sapien
accctggcattttcatgatttggtt

SEQ ID NO: 15392 - DNA, 25 bp, Homo sapien
accctggcgttttcatgatttggtt

SEQ ID NO: 15393 - DNA, 25 bp, Homo sapien
accctgggtgaacccgaacttcaaa

SEQ ID NO: 15394 - DNA, 25 bp, Homo sapien
accctgggtgaacccggacttcaaa

SEQ ID NO: 15395 - DNA, 25 bp, Homo sapien
accctggtccctgcattctagccac

SEQ ID NO: 15396 - DNA, 25 bp, Homo sapien
accctggtccctgcgttctagccac

SEQ ID NO: 15397 - DNA, 25 bp, Homo sapien
accctggtgctgtatgatcctgggc

SEQ ID NO: 15398 - DNA, 25 bp, Homo sapien
accctggtgctgtgtgatcctgggc

SEQ ID NO: 15399 - DNA, 25 bp, Homo sapien
accctgtgagcaacaggccttgtga

SEQ ID NO: 15400 - DNA, 25 bp, Homo sapien
accctgtgctctgaacattgcttac

SEQ ID NO: 15401 - DNA, 25 bp, Homo sapien
accctgtgggcaacaggccttgtga

SEQ ID NO: 15402 - DNA, 25 bp, Homo sapien
accctgtgttctgaacattgcttac

SEQ ID NO: 15403 - DNA, 25 bp, Homo sapien
accctgttgccgctctcttgctagg

SEQ ID NO: 15404 - DNA, 25 bp, Homo sapien
accctgttgcctctctcttgctagg

SEQ ID NO: 15405 - DNA, 25 bp, Homo sapien
acccttaaagaccctttctgctcca

SEQ ID NO: 15406 - DNA, 25 bp, Homo sapien
acccttaaagactctttctgctcca

SEQ ID NO: 15407 - DNA, 25 bp, Homo sapien
acccttacttacggcacagaattaa

SEQ ID NO: 15408 - DNA, 25 bp, Homo sapien
acccttacttatggcacagaattaa

SEQ ID NO: 15409 - DNA, 25 bp, Homo sapien
acccttagaagggttaatgttttgt

SEQ ID NO: 15410 - DNA, 25 bp, Homo sapien
acccttagaagggttattgttttgt

SEQ ID NO: 15411 - DNA, 25 bp, Homo sapien
acccttaggtgtagattaaaactgt

SEQ ID NO: 15412 - DNA, 25 bp, Homo sapien
acccttaggtgtaggttaaaactgt

SEQ ID NO: 15413 - DNA, 25 bp, Homo sapien
acccttcaagtcgttccattgaaac

SEQ ID NO: 15414 - DNA, 25 bp, Homo sapien
acccttcacgtcgttccattgaaac

SEQ ID NO: 15415 - DNA, 25 bp, Homo sapien
acccttccagctctacaactcacta

SEQ ID NO: 15416 - DNA, 25 bp, Homo sapien
acccttccagctttacaactcacta

SEQ ID NO: 15417 - DNA, 25 bp, Homo sapien
acccttcctcttccacagtccaaca

SEQ ID NO: 15418 - DNA, 25 bp, Homo sapien
acccttcctcttccacggtccaaca

SEQ ID NO: 15419 - DNA, 25 bp, Homo sapien
acccttgaatggaatttctggacca

SEQ ID NO: 15420 - DNA, 25 bp, Homo sapien
acccttgaatggcatttctggacca

SEQ ID NO: 15421 - DNA, 25 bp, Homo sapien
acccttgcacagtgttagtgggcat

SEQ ID NO: 15422 - DNA, 25 bp, Homo sapien
acccttgcatagtgttagtgggcat

SEQ ID NO: 15423 - DNA, 25 bp, Homo sapien
acccttgggtgcagagtagatatgg

SEQ ID NO: 15424 - DNA, 25 bp, Homo sapien
acccttgggtgcggagtagatatgg

SEQ ID NO: 15425 - DNA, 25 bp, Homo sapien
accctttacagaagagccttctccc

SEQ ID NO: 15426 - DNA, 25 bp, Homo sapien
accctttagagaagagccttctccc

SEQ ID NO: 15427 - DNA, 25 bp, Homo sapien
accctttcagaggagactgtaaaac

SEQ ID NO: 15428 - DNA, 25 bp, Homo sapien
accctttcggaggagactgtaaaac

SEQ ID NO: 15429 - DNA, 25 bp, Homo sapien
accctttctatggcaaccttgacag

SEQ ID NO: 15430 - DNA, 25 bp, Homo sapien
accctttctatggcaatcttgacag

SEQ ID NO: 15431 - DNA, 25 bp, Homo sapien
accgaaaatgagtgacaccgaaagc

SEQ ID NO: 15432 - DNA, 25 bp, Homo sapien
accgaaaattagtgacaccgaaagc

SEQ ID NO: 15433 - DNA, 25 bp, Homo sapien
accgaaccaatgctcatccagcacg

SEQ ID NO: 15434 - DNA, 25 bp, Homo sapien
accgaaccaatgttcatccagcacg

SEQ ID NO: 15435 - DNA, 25 bp, Homo sapien
accgaactggaacgggcttttggct

SEQ ID NO: 15436 - DNA, 25 bp, Homo sapien
accgaactggaatgggcttttggct

SEQ ID NO: 15437 - DNA, 25 bp, Homo sapien
accgactcaaaacattggattaaaa

SEQ ID NO: 15438 - DNA, 25 bp, Homo sapien
accgactcagaacattggattaaaa

SEQ ID NO: 15439 - DNA, 25 bp, Homo sapien
accgaggtatgaaactatcacacgc

SEQ ID NO: 15440 - DNA, 25 bp, Homo sapien
accgaggtatgaaactgtcacacgc

SEQ ID NO: 15441 - DNA, 25 bp, Homo sapien
accgagtggtgccgcggctctccct

SEQ ID NO: 15442 - DNA, 25 bp, Homo sapien
accgagtggtgctgcggctctccct

SEQ ID NO: 15443 - DNA, 25 bp, Homo sapien
accgagttggtggtgatttgttaca

SEQ ID NO: 15444 - DNA, 25 bp, Homo sapien
accgagtttgtggtgatttgttaca

SEQ ID NO: 15445 - DNA, 25 bp, Homo sapien
accgatcaaaccttaaccgtctggt

SEQ ID NO: 15446 - DNA, 25 bp, Homo sapien
accgatcaaactttaaccgtctggt

SEQ ID NO: 15447 - DNA, 25 bp, Homo sapien
accgatctctcatccccaactacca

SEQ ID NO: 15448 - DNA, 25 bp, Homo sapien
accgatctgtcatccccaactacca

SEQ ID NO: 15449 - DNA, 25 bp, Homo sapien
accgcatcaaaagaaaggtgaggcc

SEQ ID NO: 15450 - DNA, 25 bp, Homo sapien
accgcatcaaaaggaaggtgaggcc

SEQ ID NO: 15451 - DNA, 25 bp, Homo sapien
accgccgatgccggtcttccaaaga

SEQ ID NO: 15452 - DNA, 25 bp, Homo sapien
accgccgatgctggtcttccaaaga

SEQ ID NO: 15453 - DNA, 25 bp, Homo sapien
accgccttggcttgtagatgtatca

SEQ ID NO: 15454 - DNA, 25 bp, Homo sapien
accgcctttgcttgtagatgtatca

SEQ ID NO: 15455 - DNA, 25 bp, Homo sapien
accgctgaaccaactcattcaaaga

SEQ ID NO: 15456 - DNA, 25 bp, Homo sapien
accgctgaatcaactcattcaaaga

SEQ ID NO: 15457 - DNA, 25 bp, Homo sapien
accgctgccaggatccagtaacctc

SEQ ID NO: 15458 - DNA, 25 bp, Homo sapien
accgctgccaggatccggtaacctc

SEQ ID NO: 15459 - DNA, 25 bp, Homo sapien
accgggtaatctacttctaagcctt

SEQ ID NO: 15460 - DNA, 25 bp, Homo sapien
accgggtaatctgcttctaagcctt

SEQ ID NO: 15461 - DNA, 25 bp, Homo sapien
accgtcacagttaaccattacgcaa

SEQ ID NO: 15462 - DNA, 25 bp, Homo sapien
accgtcactgttaaccattacgcaa

SEQ ID NO: 15463 - DNA, 25 bp, Homo sapien
accgtcatttcaaatacttcctctt

SEQ ID NO: 15464 - DNA, 25 bp, Homo sapien
accgtcatttcgaatacttcctctt

SEQ ID NO: 15465 - DNA, 25 bp, Homo sapien
accgtggctttggtacatgctcctt

SEQ ID NO: 15466 - DNA, 25 bp, Homo sapien
accgtggcttttgtacatgctcctt

SEQ ID NO: 15467 - DNA, 25 bp, Homo sapien
accgtggtgtcgtcctcagcaccca

SEQ ID NO: 15468 - DNA, 25 bp, Homo sapien
accgtggtgtcgtcttcagcaccca

SEQ ID NO: 15469 - DNA, 25 bp, Homo sapien
accgttgtcagaattaaatttctaa

SEQ ID NO: 15470 - DNA, 25 bp, Homo sapien
accgttgtcggaattaaatttctaa

SEQ ID NO: 15471 - DNA, 25 bp, Homo sapien
accgtttcattgcctccgatttata

SEQ ID NO: 15472 - DNA, 25 bp, Homo sapien
accgtttcatttcctccgatttata

SEQ ID NO: 15473 - DNA, 25 bp, Homo sapien
accgtttctcagctctgtttgcccg

SEQ ID NO: 15474 - DNA, 25 bp, Homo sapien
accgtttctcagttctgtttgcccg

SEQ ID NO: 15475 - DNA, 25 bp, Homo sapien
acctaaaatagagttccccacaggt

SEQ ID NO: 15476 - DNA, 25 bp, Homo sapien
acctaaaatggagttccccacaggt

SEQ ID NO: 15477 - DNA, 25 bp, Homo sapien
acctaaaattctaaaggactaactt

SEQ ID NO: 15478 - DNA, 25 bp, Homo sapien
acctaaaattctaagggactaactt

SEQ ID NO: 15479 - DNA, 25 bp, Homo sapien
acctaaacattcattgccaagagta

SEQ ID NO: 15480 - DNA, 25 bp, Homo sapien
acctaaacgttcattgccaagagta

SEQ ID NO: 15481 - DNA, 25 bp, Homo sapien
acctaaatctccagcttgccagctt

SEQ ID NO: 15482 - DNA, 25 bp, Homo sapien
acctaaatctccagtttgccagctt

SEQ ID NO: 15483 - DNA, 25 bp, Homo sapien
acctaacaacataccattgccctgg

SEQ ID NO: 15484 - DNA, 25 bp, Homo sapien
acctaacaagttgtcaaaaattaac

SEQ ID NO: 15485 - DNA, 25 bp, Homo sapien
acctaacaagttgtcagaaattaac

SEQ ID NO: 15486 - DNA, 25 bp, Homo sapien
acctaacatcataccattgccctgg

SEQ ID NO: 15487 - DNA, 25 bp, Homo sapien
acctaaccccaagctgcaaagctca

SEQ ID NO: 15488 - DNA, 25 bp, Homo sapien
acctaaccctaagctgcaaagctca

SEQ ID NO: 15489 - DNA, 25 bp, Homo sapien
acctaagagatgccggatgttccta

SEQ ID NO: 15490 - DNA, 25 bp, Homo sapien
acctaagagatgctggatgttccta

SEQ ID NO: 15491 - DNA, 25 bp, Homo sapien
acctaagataactcaataatctccc

SEQ ID NO: 15492 - DNA, 25 bp, Homo sapien
acctaagatgactcaataatctccc

SEQ ID NO: 15493 - DNA, 25 bp, Homo sapien
acctaagtaatgtccattttaccta

SEQ ID NO: 15494 - DNA, 25 bp, Homo sapien
acctaagtaatgttcattttaccta

SEQ ID NO: 15495 - DNA, 25 bp, Homo sapien
acctaagttaacagacattcacaaa

SEQ ID NO: 15496 - DNA, 25 bp, Homo sapien
acctaagttaacaggcattcacaaa

SEQ ID NO: 15497 - DNA, 25 bp, Homo sapien
acctaatcatctattaaaggcccca

SEQ ID NO: 15498 - DNA, 25 bp, Homo sapien
acctaatcatctcttaaaggcccca

SEQ ID NO: 15499 - DNA, 25 bp, Homo sapien
acctaatcgggacaattgtgaaagt

SEQ ID NO: 15500 - DNA, 25 bp, Homo sapien
acctaatcgggacagttgtgaaagt

SEQ ID NO: 15501 - DNA, 25 bp, Homo sapien
acctaatgagactacaaacaatcca

SEQ ID NO: 15502 - DNA, 25 bp, Homo sapien
acctaatgagactacacacaatcca

SEQ ID NO: 15503 - DNA, 25 bp, Homo sapien
acctaattacatcattgcaattgtg

SEQ ID NO: 15504 - DNA, 25 bp, Homo sapien
acctaattatatcattgcaattgtg

SEQ ID NO: 15505 - DNA, 25 bp, Homo sapien
acctaattatcacataaatcttttg

SEQ ID NO: 15506 - DNA, 25 bp, Homo sapien
acctaattatctcataaatcttttg

SEQ ID NO: 15507 - DNA, 25 bp, Homo sapien
acctaattctcgtcaggccagtcac

SEQ ID NO: 15508 - DNA, 25 bp, Homo sapien
acctaattctcgtcgggccagtcac

SEQ ID NO: 15509 - DNA, 25 bp, Homo sapien
acctacaaaatgtagataattatcc

SEQ ID NO: 15510 - DNA, 25 bp, Homo sapien
acctacaagatgtagataattatcc

SEQ ID NO: 15511 - DNA, 25 bp, Homo sapien
acctacacatacacacaagagacat

SEQ ID NO: 15512 - DNA, 25 bp, Homo sapien
acctacacatacacccaagagacat

SEQ ID NO: 15513 - DNA, 25 bp, Homo sapien
acctacattcagccacaccgggaat

SEQ ID NO: 15514 - DNA, 25 bp, Homo sapien
acctacattcagccacgccgggaat

SEQ ID NO: 15515 - DNA, 25 bp, Homo sapien
acctacattgagaagtacgcctcag

SEQ ID NO: 15516 - DNA, 25 bp, Homo sapien
acctacatttagaagtacgcctcag

SEQ ID NO: 15517 - DNA, 25 bp, Homo sapien
acctaccactgaagccaaaattact

SEQ ID NO: 15518 - DNA, 25 bp, Homo sapien
acctaccattgaagccaaaattact

SEQ ID NO: 15519 - DNA, 25 bp, Homo sapien
acctacgaggcatgatccccaaatt

SEQ ID NO: 15520 - DNA, 25 bp, Homo sapien
acctacgaggcatgattcccaaatt

SEQ ID NO: 15521 - DNA, 25 bp, Homo sapien
acctactaactgcgtagctttagac

SEQ ID NO: 15522 - DNA, 25 bp, Homo sapien
acctactaactgtgtagctttagac

SEQ ID NO: 15523 - DNA, 25 bp, Homo sapien
acctactgaggcacaaactctaagg

SEQ ID NO: 15524 - DNA, 25 bp, Homo sapien
acctactgaggcgcaaactctaagg

SEQ ID NO: 15525 - DNA, 25 bp, Homo sapien
acctactgagtcataatctgcagac

SEQ ID NO: 15526 - DNA, 25 bp, Homo sapien
acctactgagtcgtaatctgcagac

SEQ ID NO: 15527 - DNA, 25 bp, Homo sapien
acctacttcctagagctgttgtaag

SEQ ID NO: 15528 - DNA, 25 bp, Homo sapien
acctacttcctagatctgttgtaag

SEQ ID NO: 15529 - DNA, 25 bp, Homo sapien
acctacttgaaccagctggattgtg

SEQ ID NO: 15530 - DNA, 25 bp, Homo sapien
acctactttaaccagctggattgtg

SEQ ID NO: 15531 - DNA, 25 bp, Homo sapien
acctagaaaaacgggacactctggc

SEQ ID NO: 15532 - DNA, 25 bp, Homo sapien
acctagaaaaagaaccgctgcatca

SEQ ID NO: 15533 - DNA, 25 bp, Homo sapien
acctagaaaaatgggacactctggc

SEQ ID NO: 15534 - DNA, 25 bp, Homo sapien
acctagaaatagaaccgctgcatca

SEQ ID NO: 15535 - DNA, 25 bp, Homo sapien
acctagaaccaaagctaggctgcag

SEQ ID NO: 15536 - DNA, 25 bp, Homo sapien
acctagaatagtgcatacgttatgg

SEQ ID NO: 15537 - DNA, 25 bp, Homo sapien
acctagaatagttcatacgttatgg

SEQ ID NO: 15538 - DNA, 25 bp, Homo sapien
acctagaatcaaagctaggctgcag

SEQ ID NO: 15539 - DNA, 25 bp, Homo sapien
acctagaatccacagtttacaacgc

SEQ ID NO: 15540 - DNA, 25 bp, Homo sapien
acctagaatccatagtttacaacgc

SEQ ID NO: 15541 - DNA, 25 bp, Homo sapien
acctagagaacaccaaagattctgc

SEQ ID NO: 15542 - DNA, 25 bp, Homo sapien
acctagagaacactaaagattctgc

SEQ ID NO: 15543 - DNA, 25 bp, Homo sapien
acctagaggtaacatcagatcccac

SEQ ID NO: 15544 - DNA, 25 bp, Homo sapien
acctagaggtaatatcagatcccac

SEQ ID NO: 15545 - DNA, 25 bp, Homo sapien
acctagatgctacagccactgcaca

SEQ ID NO: 15546 - DNA, 25 bp, Homo sapien
acctagatgctacagcgactgcaca

SEQ ID NO: 15547 - DNA, 25 bp, Homo sapien
acctagattttttggtttacaaagt

SEQ ID NO: 15548 - DNA, 25 bp, Homo sapien
acctagatttttttgtttacaaagt

SEQ ID NO: 15549 - DNA, 25 bp, Homo sapien
acctagctgcccatgtctgagcctt

SEQ ID NO: 15550 - DNA, 25 bp, Homo sapien
acctagctgcccttgtctgagcctt

SEQ ID NO: 15551 - DNA, 25 bp, Homo sapien
acctaggaaccgatctctcatcccc

SEQ ID NO: 15552 - DNA, 25 bp, Homo sapien
acctaggaaccgatctgtcatcccc

SEQ ID NO: 15553 - DNA, 25 bp, Homo sapien
acctaggcttttcctgaacaatagt

SEQ ID NO: 15554 - DNA, 25 bp, Homo sapien
acctaggcttttcttgaacaatagt

SEQ ID NO: 15555 - DNA, 25 bp, Homo sapien
acctagtgtgtccagtagaaacacc

SEQ ID NO: 15556 - DNA, 25 bp, Homo sapien
acctagtgtgtgcagtagaaacacc

SEQ ID NO: 15557 - DNA, 25 bp, Homo sapien
acctagttagctgcacagccagaat

SEQ ID NO: 15558 - DNA, 25 bp, Homo sapien
acctagttagctgcacggccagaat

SEQ ID NO: 15559 - DNA, 25 bp, Homo sapien
acctatatcatccagacaattctag

SEQ ID NO: 15560 - DNA, 25 bp, Homo sapien
acctatattatccagacaattctag

SEQ ID NO: 15561 - DNA, 25 bp, Homo sapien
acctatcaaggggacaatgatggca

SEQ ID NO: 15562 - DNA, 25 bp, Homo sapien
acctatcacggggacaatgatggca

SEQ ID NO: 15563 - DNA, 25 bp, Homo sapien
acctatcagattatcagtaaaacaa

SEQ ID NO: 15564 - DNA, 25 bp, Homo sapien
acctatcagattgtcagtaaaacaa

SEQ ID NO: 15565 - DNA, 25 bp, Homo sapien
acctatccttttaattgcttatagt

SEQ ID NO: 15566 - DNA, 25 bp, Homo sapien
acctatccttttatttgcttatagt

SEQ ID NO: 15567 - DNA, 25 bp, Homo sapien
acctatcgataaatatgtgtgtgga

SEQ ID NO: 15568 - DNA, 25 bp, Homo sapien
acctatcgataagtatgtgtgtgga

SEQ ID NO: 15569 - DNA, 25 bp, Homo sapien
acctatcttgactagagctttgcac

SEQ ID NO: 15570 - DNA, 25 bp, Homo sapien
acctatcttgagtagagctttgcac

SEQ ID NO: 15571 - DNA, 25 bp, Homo sapien
acctatgcacgtcatgctttacttc

SEQ ID NO: 15572 - DNA, 25 bp, Homo sapien
acctatgcccgtcatgctttacttc

SEQ ID NO: 15573 - DNA, 25 bp, Homo sapien
acctatgcctatcatatttcgctaa

SEQ ID NO: 15574 - DNA, 25 bp, Homo sapien
acctatgctcaattccaagcctcac

SEQ ID NO: 15575 - DNA, 25 bp, Homo sapien
acctatgctcagttccaagcctcac

SEQ ID NO: 15576 - DNA, 25 bp, Homo sapien
acctatgcttatcatatttcgctaa

SEQ ID NO: 15577 - DNA, 25 bp, Homo sapien
acctatgtcttttctgcattttctt

SEQ ID NO: 15578 - DNA, 25 bp, Homo sapien
acctatgtgttttctgcattttctt

SEQ ID NO: 15579 - DNA, 25 bp, Homo sapien
acctattgcacacagtagctttgag

SEQ ID NO: 15580 - DNA, 25 bp, Homo sapien
acctattgcacgcagtagctttgag

SEQ ID NO: 15581 - DNA, 25 bp, Homo sapien
acctatttactaaccattcaatccc

SEQ ID NO: 15582 - DNA, 25 bp, Homo sapien
acctatttactaactattcaatccc

SEQ ID NO: 15583 - DNA, 25 bp, Homo sapien
acctattttgcctgatgagatttac

SEQ ID NO: 15584 - DNA, 25 bp, Homo sapien
acctattttgcttgatgagatttac

SEQ ID NO: 15585 - DNA, 25 bp, Homo sapien
acctcaaaggcctatttcaggacaa

SEQ ID NO: 15586 - DNA, 25 bp, Homo sapien
acctcaaatgcctatttcaggacaa

SEQ ID NO: 15587 - DNA, 25 bp, Homo sapien
acctcaaattctcagccaaagaccc

SEQ ID NO: 15588 - DNA, 25 bp, Homo sapien
acctcaaattctcggccaaagaccc

SEQ ID NO: 15589 - DNA, 25 bp, Homo sapien
acctcaacatcactgattagtagag

SEQ ID NO: 15590 - DNA, 25 bp, Homo sapien
acctcaacatcattgattagtagag

SEQ ID NO: 15591 - DNA, 25 bp, Homo sapien
acctcaagtgatgcaccggtctcgg

SEQ ID NO: 15592 - DNA, 25 bp, Homo sapien
acctcaagtgatgtaccggtctcgg

SEQ ID NO: 15593 - DNA, 25 bp, Homo sapien
acctcaataaattctacggcacatc

SEQ ID NO: 15594 - DNA, 25 bp, Homo sapien
acctcaataaattctatggcacatc

SEQ ID NO: 15595 - DNA, 25 bp, Homo sapien
acctcaatccttatgcttcaggctg

SEQ ID NO: 15596 - DNA, 25 bp, Homo sapien
acctcaattcttatgcttcaggctg

SEQ ID NO: 15597 - DNA, 25 bp, Homo sapien
acctcacattgtcctccttggttac

SEQ ID NO: 15598 - DNA, 25 bp, Homo sapien
acctcacattgttctccttggttac

SEQ ID NO: 15599 - DNA, 25 bp, Homo sapien
acctcaccaaaagcgttgtctgtaa

SEQ ID NO: 15600 - DNA, 25 bp, Homo sapien
acctcaccaaaagctttgtctgtaa

SEQ ID NO: 15601 - DNA, 25 bp, Homo sapien
acctcaccatgttagagaaaagaaa

SEQ ID NO: 15602 - DNA, 25 bp, Homo sapien
acctcaccgtgttagagaaaagaaa

SEQ ID NO: 15603 - DNA, 25 bp, Homo sapien
acctcaccttagaggccataaaaaa

SEQ ID NO: 15604 - DNA, 25 bp, Homo sapien
acctcaccttaggggccataaaaaa

SEQ ID NO: 15605 - DNA, 25 bp, Homo sapien
acctcactacaaactaaacaaggta

SEQ ID NO: 15606 - DNA, 25 bp, Homo sapien
acctcactacagactaaacaaggta

SEQ ID NO: 15607 - DNA, 25 bp, Homo sapien
acctcactcttcacatgaagaattc

SEQ ID NO: 15608 - DNA, 25 bp, Homo sapien
acctcactctttacatgaagaattc

SEQ ID NO: 15609 - DNA, 25 bp, Homo sapien
acctcactgcaggaagaaactcagt

SEQ ID NO: 15610 - DNA, 25 bp, Homo sapien
acctcactgcgaataaggaagatca

SEQ ID NO: 15611 - DNA, 25 bp, Homo sapien
acctcactgtaggaagaaactcagt

SEQ ID NO: 15612 - DNA, 25 bp, Homo sapien
acctcactgtgaataaggaagatca

SEQ ID NO: 15613 - DNA, 25 bp, Homo sapien
acctcagccgtggacatcatctgca

SEQ ID NO: 15614 - DNA, 25 bp, Homo sapien
acctcagccttggacatcatctgca

SEQ ID NO: 15615 - DNA, 25 bp, Homo sapien
acctcaggatgtgtaaaacacttca

SEQ ID NO: 15616 - DNA, 25 bp, Homo sapien
acctcaggatgtgtaagacacttca

SEQ ID NO: 15617 - DNA, 25 bp, Homo sapien
acctcaggcaagactgatgagggaa

SEQ ID NO: 15618 - DNA, 25 bp, Homo sapien
acctcaggcaagtctgatgagggaa

SEQ ID NO: 15619 - DNA, 25 bp, Homo sapien
acctcagggatcctttcgatgcact

SEQ ID NO: 15620 - DNA, 25 bp, Homo sapien
acctcagggatccttttgatgcact

SEQ ID NO: 15621 - DNA, 25 bp, Homo sapien
acctcagtacagtctaggagagaac

SEQ ID NO: 15622 - DNA, 25 bp, Homo sapien
acctcagtacagtgtaggagagaac

SEQ ID NO: 15623 - DNA, 25 bp, Homo sapien
acctcagtattatgtgtatgaagtt

SEQ ID NO: 15624 - DNA, 25 bp, Homo sapien
acctcagtgttatgtgtatgaagtt

SEQ ID NO: 15625 - DNA, 25 bp, Homo sapien
acctcatcaccaacagaaaccatac

SEQ ID NO: 15626 - DNA, 25 bp, Homo sapien
acctcatcaccaagagaaaccatac

SEQ ID NO: 15627 - DNA, 25 bp, Homo sapien
acctcatcacgcatttcttagagtg

SEQ ID NO: 15628 - DNA, 25 bp, Homo sapien
acctcatcacttttccccaacatta

SEQ ID NO: 15629 - DNA, 25 bp, Homo sapien
acctcatcagttttccccaacatta

SEQ ID NO: 15630 - DNA, 25 bp, Homo sapien
acctcatcatgcatttcttagagtg

SEQ ID NO: 15631 - DNA, 25 bp, Homo sapien
acctcatctgctctgacgccctagg

SEQ ID NO: 15632 - DNA, 25 bp, Homo sapien
acctcatctgctctgatgccctagg

SEQ ID NO: 15633 - DNA, 25 bp, Homo sapien
acctcattaagaaggtggaacagga

SEQ ID NO: 15634 - DNA, 25 bp, Homo sapien
acctcattaagatggtggaacagga

SEQ ID NO: 15635 - DNA, 25 bp, Homo sapien
acctcattagcacgtcactaactaa

SEQ ID NO: 15636 - DNA, 25 bp, Homo sapien
acctcattagcatgtcactaactaa

SEQ ID NO: 15637 - DNA, 25 bp, Homo sapien
acctccaacagttttgctccactga

SEQ ID NO: 15638 - DNA, 25 bp, Homo sapien
acctccaatagttttgctccactga

SEQ ID NO: 15639 - DNA, 25 bp, Homo sapien
acctccagccacacacagcaggtcc

SEQ ID NO: 15640 - DNA, 25 bp, Homo sapien
acctccagccacgcacagcaggtcc

SEQ ID NO: 15641 - DNA, 25 bp, Homo sapien
acctccataatcataagataatatt

SEQ ID NO: 15642 - DNA, 25 bp, Homo sapien
acctccataatcgtaagataatatt

SEQ ID NO: 15643 - DNA, 25 bp, Homo sapien
acctccatataatacattcaggtct

SEQ ID NO: 15644 - DNA, 25 bp, Homo sapien
acctccatgtaatacattcaggtct

SEQ ID NO: 15645 - DNA, 25 bp, Homo sapien
acctccctttgtatctcactctgcc

SEQ ID NO: 15646 - DNA, 25 bp, Homo sapien
acctccctttgtctctcactctgcc

SEQ ID NO: 15647 - DNA, 25 bp, Homo sapien
acctcctcaatgtaggacttcatat

SEQ ID NO: 15648 - DNA, 25 bp, Homo sapien
acctcctcaatgtgggacttcatat

SEQ ID NO: 15649 - DNA, 25 bp, Homo sapien
acctcctgccgctggactttttcct

SEQ ID NO: 15650 - DNA, 25 bp, Homo sapien
acctcctgctgctggactttttcct

SEQ ID NO: 15651 - DNA, 25 bp, Homo sapien
acctcctgtgtatccttcaccactt

SEQ ID NO: 15652 - DNA, 25 bp, Homo sapien
acctcctgtgtgtccttcaccactt

SEQ ID NO: 15653 - DNA, 25 bp, Homo sapien
acctcgaacattgctatggtctctt

SEQ ID NO: 15654 - DNA, 25 bp, Homo sapien
acctcgaacattgttatggtctctt

SEQ ID NO: 15655 - DNA, 25 bp, Homo sapien
acctcgacgtcctggccttaggtga

SEQ ID NO: 15656 - DNA, 25 bp, Homo sapien
acctcgacgtcttggccttaggtga

SEQ ID NO: 15657 - DNA, 25 bp, Homo sapien
acctcggagctaccgtagttctgtg

SEQ ID NO: 15658 - DNA, 25 bp, Homo sapien
acctcggagctactgtagttctgtg

SEQ ID NO: 15659 - DNA, 25 bp, Homo sapien
acctcgtccttcaagacttcttcat

SEQ ID NO: 15660 - DNA, 25 bp, Homo sapien
acctcgtccttcgagacttcttcat

SEQ ID NO: 15661 - DNA, 25 bp, Homo sapien
acctcgtgccaatccatcatgtcag

SEQ ID NO: 15662 - DNA, 25 bp, Homo sapien
acctcgtgccaatctatcatgtcag

SEQ ID NO: 15663 - DNA, 25 bp, Homo sapien
acctctaccatgcttacagaatata

SEQ ID NO: 15664 - DNA, 25 bp, Homo sapien
acctctaccatgtttacagaatata

SEQ ID NO: 15665 - DNA, 25 bp, Homo sapien
acctctagagtaagatgtgatggta

SEQ ID NO: 15666 - DNA, 25 bp, Homo sapien
acctctagagtcagatgtgatggta

SEQ ID NO: 15667 - DNA, 25 bp, Homo sapien
acctctctagttctctctcttctgc

SEQ ID NO: 15668 - DNA, 25 bp, Homo sapien
acctctcttaatgaagaaaatgaga

SEQ ID NO: 15669 - DNA, 25 bp, Homo sapien
acctctcttaatggagaaaatgaga

SEQ ID NO: 15670 - DNA, 25 bp, Homo sapien
acctctcttgttctctctcttctgc

SEQ ID NO: 15671 - DNA, 25 bp, Homo sapien
acctctgaggaactgaatgccaggg

SEQ ID NO: 15672 - DNA, 25 bp, Homo sapien
acctctgaggaattgaatgccaggg

SEQ ID NO: 15673 - DNA, 25 bp, Homo sapien
acctctgcagacatgtggagaccaa

SEQ ID NO: 15674 - DNA, 25 bp, Homo sapien
acctctgcagacgtgtggagaccaa

SEQ ID NO: 15675 - DNA, 25 bp, Homo sapien
acctctggattcagtaattggtagt

SEQ ID NO: 15676 - DNA, 25 bp, Homo sapien
acctctggattcggtaattggtagt

SEQ ID NO: 15677 - DNA, 25 bp, Homo sapien
acctctgtaacagcacatagcacat

SEQ ID NO: 15678 - DNA, 25 bp, Homo sapien
acctctgtaacaggacatagcacat

SEQ ID NO: 15679 - DNA, 25 bp, Homo sapien
acctctgtaataacttgcctggtat

SEQ ID NO: 15680 - DNA, 25 bp, Homo sapien
acctctgtaataagttgcctggtat

SEQ ID NO: 15681 - DNA, 25 bp, Homo sapien
acctctgtctgtgtgctcttcactt

SEQ ID NO: 15682 - DNA, 25 bp, Homo sapien
acctctgtgctaaatacgagtggtg

SEQ ID NO: 15683 - DNA, 25 bp, Homo sapien
acctctgtgctaaataggagtggtg

SEQ ID NO: 15684 - DNA, 25 bp, Homo sapien
acctctgtttgtgtgctcttcactt

SEQ ID NO: 15685 - DNA, 25 bp, Homo sapien
acctcttataacacaactatgtaat

SEQ ID NO: 15686 - DNA, 25 bp, Homo sapien
acctcttataacacaattatgtaat

SEQ ID NO: 15687 - DNA, 25 bp, Homo sapien
acctcttattacaacctggaaatta

SEQ ID NO: 15688 - DNA, 25 bp, Homo sapien
acctcttattaccacctggaaatta

SEQ ID NO: 15689 - DNA, 25 bp, Homo sapien
acctcttcatcattcagaatttgtt

SEQ ID NO: 15690 - DNA, 25 bp, Homo sapien
acctcttctctgagcttagaattgc

SEQ ID NO: 15691 - DNA, 25 bp, Homo sapien
acctcttctctgtgcttagaattgc

SEQ ID NO: 15692 - DNA, 25 bp, Homo sapien
acctcttcttcattcagaatttgtt

SEQ ID NO: 15693 - DNA, 25 bp, Homo sapien
acctcttgatgagagaagctgtaaa

SEQ ID NO: 15694 - DNA, 25 bp, Homo sapien
acctcttgatgggagaagctgtaaa

SEQ ID NO: 15695 - DNA, 25 bp, Homo sapien
acctcttgcctaaatgtgttctttt

SEQ ID NO: 15696 - DNA, 25 bp, Homo sapien
acctcttgcttaaatgtgttctttt

SEQ ID NO: 15697 - DNA, 25 bp, Homo sapien
acctcttttcctccagccaacaacc

SEQ ID NO: 15698 - DNA, 25 bp, Homo sapien
acctcttttcctccggccaacaacc

SEQ ID NO: 15699 - DNA, 25 bp, Homo sapien
acctgaacaaagatcagtagacagc

SEQ ID NO: 15700 - DNA, 25 bp, Homo sapien
acctgaaccaagatcagtagacagc

SEQ ID NO: 15701 - DNA, 25 bp, Homo sapien
acctgaagaactgtttcaccttccc

SEQ ID NO: 15702 - DNA, 25 bp, Homo sapien
acctgaagaactttttcaccttccc

SEQ ID NO: 15703 - DNA, 25 bp, Homo sapien
acctgaagaatattatgtgaagtga

SEQ ID NO: 15704 - DNA, 25 bp, Homo sapien
acctgaagagtattatgtgaagtga

SEQ ID NO: 15705 - DNA, 25 bp, Homo sapien
acctgaagtgaaagattaatgtccc

SEQ ID NO: 15706 - DNA, 25 bp, Homo sapien
acctgaagtgaaatattaatgtccc

SEQ ID NO: 15707 - DNA, 25 bp, Homo sapien
acctgaataaaggatccaaaaacca

SEQ ID NO: 15708 - DNA, 25 bp, Homo sapien
acctgaataaagggtccaaaaacca

SEQ ID NO: 15709 - DNA, 25 bp, Homo sapien
acctgaatacatacaccctaataag

SEQ ID NO: 15710 - DNA, 25 bp, Homo sapien
acctgaatacatataccctaataag

SEQ ID NO: 15711 - DNA, 25 bp, Homo sapien
acctgaatggcatggctttccatca

SEQ ID NO: 15712 - DNA, 25 bp, Homo sapien
acctgaatggcgtggctttccatca

SEQ ID NO: 15713 - DNA, 25 bp, Homo sapien
acctgaattatttcaaaaactgcat

SEQ ID NO: 15714 - DNA, 25 bp, Homo sapien
acctgaattatttcaacaactgcat

SEQ ID NO: 15715 - DNA, 25 bp, Homo sapien
acctgacgcctctgctttccttcca

SEQ ID NO: 15716 - DNA, 25 bp, Homo sapien
acctgacgcctgtgctttccttcca

SEQ ID NO: 15717 - DNA, 25 bp, Homo sapien
acctgactctctaaatctgtttggg

SEQ ID NO: 15718 - DNA, 25 bp, Homo sapien
acctgactctctaaatttgtttggg

SEQ ID NO: 15719 - DNA, 25 bp, Homo sapien
acctgactctgaagccagggccggc

SEQ ID NO: 15720 - DNA, 25 bp, Homo sapien
acctgactctgaagccggggccggc

SEQ ID NO: 15721 - DNA, 25 bp, Homo sapien
acctgactgctcacctttaccctac

SEQ ID NO: 15722 - DNA, 25 bp, Homo sapien
acctgactgctcacttttaccctac

SEQ ID NO: 15723 - DNA, 25 bp, Homo sapien
acctgagtaatacagtgaccaaagc

SEQ ID NO: 15724 - DNA, 25 bp, Homo sapien
acctgagtcatacagtgaccaaagc

SEQ ID NO: 15725 - DNA, 25 bp, Homo sapien
acctgagtgaaggttgatatcattt

SEQ ID NO: 15726 - DNA, 25 bp, Homo sapien
acctgagtgaaggttggtatcattt

SEQ ID NO: 15727 - DNA, 25 bp, Homo sapien
acctgataggactttagccttttac

SEQ ID NO: 15728 - DNA, 25 bp, Homo sapien
acctgataggattttagccttttac

SEQ ID NO: 15729 - DNA, 25 bp, Homo sapien
acctgatcgcaggctcgtgttaaca

SEQ ID NO: 15730 - DNA, 25 bp, Homo sapien
acctgatctcaggctcgtgttaaca

SEQ ID NO: 15731 - DNA, 25 bp, Homo sapien
acctgattagccacaataacacatt

SEQ ID NO: 15732 - DNA, 25 bp, Homo sapien
acctgattagccagaataacacatt

SEQ ID NO: 15733 - DNA, 25 bp, Homo sapien
acctgattcctaccaccttccagtc

SEQ ID NO: 15734 - DNA, 25 bp, Homo sapien
acctgattcctacgaccttccagtc

SEQ ID NO: 15735 - DNA, 25 bp, Homo sapien
acctgattttacgaatagtttccat

SEQ ID NO: 15736 - DNA, 25 bp, Homo sapien
acctgattttatgaatagtttccat

SEQ ID NO: 15737 - DNA, 25 bp, Homo sapien
acctgcaaaagtaaaaaacaccagg

SEQ ID NO: 15738 - DNA, 25 bp, Homo sapien
acctgcaaaagtcaaaaacaccagg

SEQ ID NO: 15739 - DNA, 25 bp, Homo sapien
acctgcacagtcggcagtctgtgtc

SEQ ID NO: 15740 - DNA, 25 bp, Homo sapien
acctgcacagttggcagtctgtgtc

SEQ ID NO: 15741 - DNA, 25 bp, Homo sapien
acctgcacatatagaatcaattgat

SEQ ID NO: 15742 - DNA, 25 bp, Homo sapien
acctgcacctctccggcaccaccac

SEQ ID NO: 15743 - DNA, 25 bp, Homo sapien
acctgcacctctcctgcaccaccac

SEQ ID NO: 15744 - DNA, 25 bp, Homo sapien
acctgcacgtatagaatcaattgat

SEQ ID NO: 15745 - DNA, 25 bp, Homo sapien
acctgcaggagaagtgggcttcagg

SEQ ID NO: 15746 - DNA, 25 bp, Homo sapien
acctgcaggagaattgggcttcagg

SEQ ID NO: 15747 - DNA, 25 bp, Homo sapien
acctgcctttgcccaccacatgata

SEQ ID NO: 15748 - DNA, 25 bp, Homo sapien
acctgcctttgcccgccacatgata

SEQ ID NO: 15749 - DNA, 25 bp, Homo sapien
acctgcggttaggaaggttgtcaaa

SEQ ID NO: 15750 - DNA, 25 bp, Homo sapien
acctgcggttaggaagtttgtcaaa

SEQ ID NO: 15751 - DNA, 25 bp, Homo sapien
acctgctaacagtacccatggtaat

SEQ ID NO: 15752 - DNA, 25 bp, Homo sapien
acctgctaacattacccatggtaat

SEQ ID NO: 15753 - DNA, 25 bp, Homo sapien
acctgctaacgcaatctagctaata

SEQ ID NO: 15754 - DNA, 25 bp, Homo sapien
acctgctaacggaatctagctaata

SEQ ID NO: 15755 - DNA, 25 bp, Homo sapien
acctgctatttgctgtttgtctttt

SEQ ID NO: 15756 - DNA, 25 bp, Homo sapien
acctgctattttctgtttgtctttt

SEQ ID NO: 15757 - DNA, 25 bp, Homo sapien
acctgctccaccagctcatgttgcc

SEQ ID NO: 15758 - DNA, 25 bp, Homo sapien
acctgctccaccagttcatgttgcc

SEQ ID NO: 15759 - DNA, 25 bp, Homo sapien
acctgctggataattgtaacataga

SEQ ID NO: 15760 - DNA, 25 bp, Homo sapien
acctgctggctaattgtaacataga

SEQ ID NO: 15761 - DNA, 25 bp, Homo sapien
acctggaaagaacccactgcttatt

SEQ ID NO: 15762 - DNA, 25 bp, Homo sapien
acctggaaagaacctactgcttatt

SEQ ID NO: 15763 - DNA, 25 bp, Homo sapien
acctggaagcgctcatgcagccaga

SEQ ID NO: 15764 - DNA, 25 bp, Homo sapien
acctggaagcgctcgtgcagccaga

SEQ ID NO: 15765 - DNA, 25 bp, Homo sapien
acctggactatgatagccacagcag

SEQ ID NO: 15766 - DNA, 25 bp, Homo sapien
acctggactatgatggccacagcag

SEQ ID NO: 15767 - DNA, 25 bp, Homo sapien
acctggagatgacaactttaattat

SEQ ID NO: 15768 - DNA, 25 bp, Homo sapien
acctggagatggcaactttaattat

SEQ ID NO: 15769 - DNA, 25 bp, Homo sapien
acctggatcatcgcaataactgtct

SEQ ID NO: 15770 - DNA, 25 bp, Homo sapien
acctggatcattgcaataactgtct

SEQ ID NO: 15771 - DNA, 25 bp, Homo sapien
acctggcaatccaaattgtcctcat

SEQ ID NO: 15772 - DNA, 25 bp, Homo sapien
acctggcagagacaacagaaaaaac

SEQ ID NO: 15773 - DNA, 25 bp, Homo sapien
acctggcagagataacagaaaaaac

SEQ ID NO: 15774 - DNA, 25 bp, Homo sapien
acctggcagtccaaattgtcctcat

SEQ ID NO: 15775 - DNA, 25 bp, Homo sapien
acctggccaggttgcaatagtacct

SEQ ID NO: 15776 - DNA, 25 bp, Homo sapien
acctggccaggttgcagtagtacct

SEQ ID NO: 15777 - DNA, 25 bp, Homo sapien
acctggcctcgatactaaattctgc

SEQ ID NO: 15778 - DNA, 25 bp, Homo sapien
acctggcctcttcatgaattgatcg

SEQ ID NO: 15779 - DNA, 25 bp, Homo sapien
acctggcctcttcttgaattgatcg

SEQ ID NO: 15780 - DNA, 25 bp, Homo sapien
acctggccttgatactaaattctgc

SEQ ID NO: 15781 - DNA, 25 bp, Homo sapien
acctggctatgctacagaagacaag

SEQ ID NO: 15782 - DNA, 25 bp, Homo sapien
acctggctatgctatagaagacaag

SEQ ID NO: 15783 - DNA, 25 bp, Homo sapien
acctggctcaatacattactggaaa

SEQ ID NO: 15784 - DNA, 25 bp, Homo sapien
acctggctcaatccattactggaaa

SEQ ID NO: 15785 - DNA, 25 bp, Homo sapien
acctggcttctaattcacccacact

SEQ ID NO: 15786 - DNA, 25 bp, Homo sapien
acctggcttctagttcacccacact

SEQ ID NO: 15787 - DNA, 25 bp, Homo sapien
acctgggatactcgagtttggtggg

SEQ ID NO: 15788 - DNA, 25 bp, Homo sapien
acctgggatacttgagtttggtggg

SEQ ID NO: 15789 - DNA, 25 bp, Homo sapien
acctgggcaattcaacctattggtg

SEQ ID NO: 15790 - DNA, 25 bp, Homo sapien
acctgggcaattcagcctattggtg

SEQ ID NO: 15791 - DNA, 25 bp, Homo sapien
acctgggctctctattctcctttgc

SEQ ID NO: 15792 - DNA, 25 bp, Homo sapien
acctgggctctcttttctcctttgc

SEQ ID NO: 15793 - DNA, 25 bp, Homo sapien
acctgggtcatgggcagagatggtg

SEQ ID NO: 15794 - DNA, 25 bp, Homo sapien
acctgggtcatggtcagagatggtg

SEQ ID NO: 15795 - DNA, 25 bp, Homo sapien
acctgggttcaagccacgactctgc

SEQ ID NO: 15796 - DNA, 25 bp, Homo sapien
acctgggttcaagtcacgactctgc

SEQ ID NO: 15797 - DNA, 25 bp, Homo sapien
acctggtggcaaattgattacattg

SEQ ID NO: 15798 - DNA, 25 bp, Homo sapien
acctggtggcagattgattacattg

SEQ ID NO: 15799 - DNA, 25 bp, Homo sapien
acctggttagtcttcttgttctaag

SEQ ID NO: 15800 - DNA, 25 bp, Homo sapien
acctggttagtgttcttgttctaag

SEQ ID NO: 15801 - DNA, 25 bp, Homo sapien
acctggttcctaacacgtctattct

SEQ ID NO: 15802 - DNA, 25 bp, Homo sapien
acctggtttctaacacgtctattct

SEQ ID NO: 15803 - DNA, 25 bp, Homo sapien
acctgtaaaattgcaaatggtatgt

SEQ ID NO: 15804 - DNA, 25 bp, Homo sapien
acctgtaacattgcaaatggtatgt

SEQ ID NO: 15805 - DNA, 25 bp, Homo sapien
acctgtagcaggagaaaggcacttg

SEQ ID NO: 15806 - DNA, 25 bp, Homo sapien
acctgtagcaggataaaggcacttg

SEQ ID NO: 15807 - DNA, 25 bp, Homo sapien
acctgtagttcctgttacttaggag

SEQ ID NO: 15808 - DNA, 25 bp, Homo sapien
acctgtagttcttgttacttaggag

SEQ ID NO: 15809 - DNA, 25 bp, Homo sapien
acctgtatctcttcacagtcatgat

SEQ ID NO: 15810 - DNA, 25 bp, Homo sapien
acctgtatctcttcgcagtcatgat

SEQ ID NO: 15811 - DNA, 25 bp, Homo sapien
acctgtatcttcagtagaaaacata

SEQ ID NO: 15812 - DNA, 25 bp, Homo sapien
acctgtatcttgagtagaaaacata

SEQ ID NO: 15813 - DNA, 25 bp, Homo sapien
acctgtatctttcttgctttgtaga

SEQ ID NO: 15814 - DNA, 25 bp, Homo sapien
acctgtatcttttgcagtgtttaaa

SEQ ID NO: 15815 - DNA, 25 bp, Homo sapien
acctgtatcttttgtagtgtttaaa

SEQ ID NO: 15816 - DNA, 25 bp, Homo sapien
acctgtatcttttttgctttgtaga

SEQ ID NO: 15817 - DNA, 25 bp, Homo sapien
acctgtcagcaccgcacactgcatc

SEQ ID NO: 15818 - DNA, 25 bp, Homo sapien
acctgtcagcacggcacactgcatc

SEQ ID NO: 15819 - DNA, 25 bp, Homo sapien
acctgtcgataacatttgcattgtt

SEQ ID NO: 15820 - DNA, 25 bp, Homo sapien
acctgtcgatagcatttgcattgtt

SEQ ID NO: 15821 - DNA, 25 bp, Homo sapien
acctgtctcttcacgcctgcagcaa

SEQ ID NO: 15822 - DNA, 25 bp, Homo sapien
acctgtctcttcatgcctgcagcaa

SEQ ID NO: 15823 - DNA, 25 bp, Homo sapien
acctgtctggtgagctagtttgtat

SEQ ID NO: 15824 - DNA, 25 bp, Homo sapien
acctgtctggtgagcttgtttgtat

SEQ ID NO: 15825 - DNA, 25 bp, Homo sapien
acctgtcttctgtacgtaagccact

SEQ ID NO: 15826 - DNA, 25 bp, Homo sapien
acctgtcttctgtatgtaagccact

SEQ ID NO: 15827 - DNA, 25 bp, Homo sapien
acctgtgactacagaacatttttcg

SEQ ID NO: 15828 - DNA, 25 bp, Homo sapien
acctgtgactatagaacatttttcg

SEQ ID NO: 15829 - DNA, 25 bp, Homo sapien
acctgtgatgatggccctgagttgt

SEQ ID NO: 15830 - DNA, 25 bp, Homo sapien
acctgtgatgatgtccctgagttgt

SEQ ID NO: 15831 - DNA, 25 bp, Homo sapien
acctgtgtacacaaaaagttgaaaa

SEQ ID NO: 15832 - DNA, 25 bp, Homo sapien
acctgtgtacagaaaaagttgaaaa

SEQ ID NO: 15833 - DNA, 25 bp, Homo sapien
acctgtgtgaccttggagaaatagc

SEQ ID NO: 15834 - DNA, 25 bp, Homo sapien
acctgtgtgctccctgactggcaat

SEQ ID NO: 15835 - DNA, 25 bp, Homo sapien
acctgtgtgctctctgactggcaat

SEQ ID NO: 15836 - DNA, 25 bp, Homo sapien
acctgtgtgtccttggagaaatagc

SEQ ID NO: 15837 - DNA, 25 bp, Homo sapien
acctgttaaagttctacacctcatt

SEQ ID NO: 15838 - DNA, 25 bp, Homo sapien
acctgttaaagttctatacctcatt

SEQ ID NO: 15839 - DNA, 25 bp, Homo sapien
acctgttgcgccactgcagttcttc

SEQ ID NO: 15840 - DNA, 25 bp, Homo sapien
acctgttgtatcccttgctgtgttc

SEQ ID NO: 15841 - DNA, 25 bp, Homo sapien
acctgttgtatcctttgctgtgttc

SEQ ID NO: 15842 - DNA, 25 bp, Homo sapien
acctgttgtgccactgcagttcttc

SEQ ID NO: 15843 - DNA, 25 bp, Homo sapien
acctgtttatgtaaataatgtttta

SEQ ID NO: 15844 - DNA, 25 bp, Homo sapien
acctgtttttgtaaataatgtttta

SEQ ID NO: 15845 - DNA, 25 bp, Homo sapien
accttaaaacggacacatcctaatc

SEQ ID NO: 15846 - DNA, 25 bp, Homo sapien
accttaaaatggacacatcctaatc

SEQ ID NO: 15847 - DNA, 25 bp, Homo sapien
accttaaactgaaactcgattaaaa

SEQ ID NO: 15848 - DNA, 25 bp, Homo sapien
accttaaattgaaactcgattaaaa

SEQ ID NO: 15849 - DNA, 25 bp, Homo sapien
accttacccagtccgccaattcaaa

SEQ ID NO: 15850 - DNA, 25 bp, Homo sapien
accttacccagtctgccaattcaaa

SEQ ID NO: 15851 - DNA, 25 bp, Homo sapien
accttacttgcataggcactttata

SEQ ID NO: 15852 - DNA, 25 bp, Homo sapien
accttactttcataggcactttata

SEQ ID NO: 15853 - DNA, 25 bp, Homo sapien
accttagaatgtgaacgcctaatag

SEQ ID NO: 15854 - DNA, 25 bp, Homo sapien
accttagagtgtgaacgcctaatag

SEQ ID NO: 15855 - DNA, 25 bp, Homo sapien
accttagttgttacatcttcaaagt

SEQ ID NO: 15856 - DNA, 25 bp, Homo sapien
accttagtttttacatcttcaaagt

SEQ ID NO: 15857 - DNA, 25 bp, Homo sapien
accttataagtgcagtcttccaggg

SEQ ID NO: 15858 - DNA, 25 bp, Homo sapien
accttataagtgcggtcttccaggg

SEQ ID NO: 15859 - DNA, 25 bp, Homo sapien
accttcaaaccaaaagcttaatctt

SEQ ID NO: 15860 - DNA, 25 bp, Homo sapien
accttcaaaccgaaagcttaatctt

SEQ ID NO: 15861 - DNA, 25 bp, Homo sapien
accttcaatctgcaaaaaatgcagt

SEQ ID NO: 15862 - DNA, 25 bp, Homo sapien
accttcaatttgcaaaaaatgcagt

SEQ ID NO: 15863 - DNA, 25 bp, Homo sapien
accttcacacaaatctaaattttat

SEQ ID NO: 15864 - DNA, 25 bp, Homo sapien
accttcacacaagtctaaattttat

SEQ ID NO: 15865 - DNA, 25 bp, Homo sapien
accttcacacttatacagcaatgag

SEQ ID NO: 15866 - DNA, 25 bp, Homo sapien
accttcacatttatacagcaatgag

SEQ ID NO: 15867 - DNA, 25 bp, Homo sapien
accttccatgtcctctctgggcgtg

SEQ ID NO: 15868 - DNA, 25 bp, Homo sapien
accttccatgtcgtctctgggcgtg

SEQ ID NO: 15869 - DNA, 25 bp, Homo sapien
accttctaccttaaactctctctcc

SEQ ID NO: 15870 - DNA, 25 bp, Homo sapien
accttctaccttcaactctctctcc

SEQ ID NO: 15871 - DNA, 25 bp, Homo sapien
accttctctgtcccatctctttttg

SEQ ID NO: 15872 - DNA, 25 bp, Homo sapien
accttctctttcccatctctttttg

SEQ ID NO: 15873 - DNA, 25 bp, Homo sapien
accttcttcatctatgcacactcct

SEQ ID NO: 15874 - DNA, 25 bp, Homo sapien
accttcttcttctatgcacactcct

SEQ ID NO: 15875 - DNA, 25 bp, Homo sapien
accttgaaaataacagcggttaaag

SEQ ID NO: 15876 - DNA, 25 bp, Homo sapien
accttgaaaataacagtggttaaag

SEQ ID NO: 15877 - DNA, 25 bp, Homo sapien
accttgaaagctaccaccaaatcac

SEQ ID NO: 15878 - DNA, 25 bp, Homo sapien
accttgaaagctactaccaaatcac

SEQ ID NO: 15879 - DNA, 25 bp, Homo sapien
accttgaacatgcgcacagaaaggg

SEQ ID NO: 15880 - DNA, 25 bp, Homo sapien
accttgaacatgtgcacagaaaggg

SEQ ID NO: 15881 - DNA, 25 bp, Homo sapien
accttgaatataaacagaactcaag

SEQ ID NO: 15882 - DNA, 25 bp, Homo sapien
accttgaatataaagagaactcaag

SEQ ID NO: 15883 - DNA, 25 bp, Homo sapien
accttgacatttttatagctaaatc

SEQ ID NO: 15884 - DNA, 25 bp, Homo sapien
accttgacatttttgtagctaaatc

SEQ ID NO: 15885 - DNA, 25 bp, Homo sapien
accttgagagtggaagattattttg

SEQ ID NO: 15886 - DNA, 25 bp, Homo sapien
accttgagagtgggagattattttg

SEQ ID NO: 15887 - DNA, 25 bp, Homo sapien
accttgagatcaaaaacataaaaga

SEQ ID NO: 15888 - DNA, 25 bp, Homo sapien
accttgagatcagaaacataaaaga

SEQ ID NO: 15889 - DNA, 25 bp, Homo sapien
accttgaggccaaagcccatggaac

SEQ ID NO: 15890 - DNA, 25 bp, Homo sapien
accttgaggccaaggcccatggaac

SEQ ID NO: 15891 - DNA, 25 bp, Homo sapien
accttgatgaggcagaaagagctac

SEQ ID NO: 15892 - DNA, 25 bp, Homo sapien
accttgatgaggtagaaagagctac

SEQ ID NO: 15893 - DNA, 25 bp, Homo sapien
accttgcaaattacaaaactcttgg

SEQ ID NO: 15894 - DNA, 25 bp, Homo sapien
accttgcaaattagaaaactcttgg

SEQ ID NO: 15895 - DNA, 25 bp, Homo sapien
accttgcagtgaaatataacagtat

SEQ ID NO: 15896 - DNA, 25 bp, Homo sapien
accttgcagtgaattataacagtat

SEQ ID NO: 15897 - DNA, 25 bp, Homo sapien
accttgcattgtagcagttttgcaa

SEQ ID NO: 15898 - DNA, 25 bp, Homo sapien
accttgcattgtagtagttttgcaa

SEQ ID NO: 15899 - DNA, 25 bp, Homo sapien
accttgccatgttaagtgatgtaga

SEQ ID NO: 15900 - DNA, 25 bp, Homo sapien
accttgcccagctgctgtttgagag

SEQ ID NO: 15901 - DNA, 25 bp, Homo sapien
accttgcccggctgctgtttgagag

SEQ ID NO: 15902 - DNA, 25 bp, Homo sapien
accttgccgtgttaagtgatgtaga

SEQ ID NO: 15903 - DNA, 25 bp, Homo sapien
accttgcctaacgcaaggcaatccg

SEQ ID NO: 15904 - DNA, 25 bp, Homo sapien
accttgcctaatgcaaggcaatccg

SEQ ID NO: 15905 - DNA, 25 bp, Homo sapien
accttgcctcgtcagtgttctgttc

SEQ ID NO: 15906 - DNA, 25 bp, Homo sapien
accttgcctggctaaactttattct

SEQ ID NO: 15907 - DNA, 25 bp, Homo sapien
accttgcctggctatactttattct

SEQ ID NO: 15908 - DNA, 25 bp, Homo sapien
accttgcctgtcgtgttcacctgtc

SEQ ID NO: 15909 - DNA, 25 bp, Homo sapien
accttgcctgtcttgttcacctgtc

SEQ ID NO: 15910 - DNA, 25 bp, Homo sapien
accttgccttgtcagtgttctgttc

SEQ ID NO: 15911 - DNA, 25 bp, Homo sapien
accttggaagaaaatggacactctg

SEQ ID NO: 15912 - DNA, 25 bp, Homo sapien
accttggaagaaattggacactctg

SEQ ID NO: 15913 - DNA, 25 bp, Homo sapien
accttggaccctgacacagtagcta

SEQ ID NO: 15914 - DNA, 25 bp, Homo sapien
accttggactctgacacagtagcta

SEQ ID NO: 15915 - DNA, 25 bp, Homo sapien
accttggctccctgctcatatttaa

SEQ ID NO: 15916 - DNA, 25 bp, Homo sapien
accttggctccctgttcatatttaa

SEQ ID NO: 15917 - DNA, 25 bp, Homo sapien
accttggctcttgacactagagttc

SEQ ID NO: 15918 - DNA, 25 bp, Homo sapien
accttggctcttggcactagagttc

SEQ ID NO: 15919 - DNA, 25 bp, Homo sapien
accttgtatcgttctatggaaattt

SEQ ID NO: 15920 - DNA, 25 bp, Homo sapien
accttgtatgacccttagagaaagg

SEQ ID NO: 15921 - DNA, 25 bp, Homo sapien
accttgtatgactcttagagaaagg

SEQ ID NO: 15922 - DNA, 25 bp, Homo sapien
accttgtattgttctatggaaattt

SEQ ID NO: 15923 - DNA, 25 bp, Homo sapien
accttgtgattccacgagtcaacac

SEQ ID NO: 15924 - DNA, 25 bp, Homo sapien
accttgtgattccgcgagtcaacac

SEQ ID NO: 15925 - DNA, 25 bp, Homo sapien
accttgttaggctgcttctttgcct

SEQ ID NO: 15926 - DNA, 25 bp, Homo sapien
accttgttaggcttcttctttgcct

SEQ ID NO: 15927 - DNA, 25 bp, Homo sapien
accttgttctcacgtcttctaagag

SEQ ID NO: 15928 - DNA, 25 bp, Homo sapien
accttgttctcatgtcttctaagag

SEQ ID NO: 15929 - DNA, 25 bp, Homo sapien
accttgttggtccttccagatctta

SEQ ID NO: 15930 - DNA, 25 bp, Homo sapien
accttgttggttcttccagatctta

SEQ ID NO: 15931 - DNA, 25 bp, Homo sapien
accttgttgtgagaccagacaaaga

SEQ ID NO: 15932 - DNA, 25 bp, Homo sapien
accttgttgtgagatcagacaaaga

SEQ ID NO: 15933 - DNA, 25 bp, Homo sapien
acctttaaccatatctcatgtgaac

SEQ ID NO: 15934 - DNA, 25 bp, Homo sapien
acctttaatcatatctcatgtgaac

SEQ ID NO: 15935 - DNA, 25 bp, Homo sapien
acctttaatgcaactccatcaaaat

SEQ ID NO: 15936 - DNA, 25 bp, Homo sapien
acctttaatgcacctccatcaaaat

SEQ ID NO: 15937 - DNA, 25 bp, Homo sapien
acctttagatccaacaatatttgct

SEQ ID NO: 15938 - DNA, 25 bp, Homo sapien
acctttagatccatcaatatttgct

SEQ ID NO: 15939 - DNA, 25 bp, Homo sapien
acctttcaaaataggagccaaagat

SEQ ID NO: 15940 - DNA, 25 bp, Homo sapien
acctttcaagaaaatgcacagggtc

SEQ ID NO: 15941 - DNA, 25 bp, Homo sapien
acctttcaagaaactgcacagggtc

SEQ ID NO: 15942 - DNA, 25 bp, Homo sapien
acctttcaatataggagccaaagat

SEQ ID NO: 15943 - DNA, 25 bp, Homo sapien
acctttcaccttgactatatggcat

SEQ ID NO: 15944 - DNA, 25 bp, Homo sapien
acctttcaccttgtctatatggcat

SEQ ID NO: 15945 - DNA, 25 bp, Homo sapien
acctttccgtgaactctaggggacc

SEQ ID NO: 15946 - DNA, 25 bp, Homo sapien
acctttccgtggactctaggggacc

SEQ ID NO: 15947 - DNA, 25 bp, Homo sapien
acctttcctacctggcaacatagac

SEQ ID NO: 15948 - DNA, 25 bp, Homo sapien
acctttcctgcctggcaacatagac

SEQ ID NO: 15949 - DNA, 25 bp, Homo sapien
acctttctcaaaatctcctttacca

SEQ ID NO: 15950 - DNA, 25 bp, Homo sapien
acctttctcaaaatttcctttacca

SEQ ID NO: 15951 - DNA, 25 bp, Homo sapien
acctttctcttacaaggacactgtg

SEQ ID NO: 15952 - DNA, 25 bp, Homo sapien
acctttctcttataaggacactgtg

SEQ ID NO: 15953 - DNA, 25 bp, Homo sapien
acctttctgattccctttctcactc

SEQ ID NO: 15954 - DNA, 25 bp, Homo sapien
acctttcttacaatagaaccatcct

SEQ ID NO: 15955 - DNA, 25 bp, Homo sapien
acctttcttacagtagaaccatcct

SEQ ID NO: 15956 - DNA, 25 bp, Homo sapien
acctttcttattccctttctcactc

SEQ ID NO: 15957 - DNA, 25 bp, Homo sapien
acctttgacgtcagaggccacatca

SEQ ID NO: 15958 - DNA, 25 bp, Homo sapien
acctttgatgtcagaggccacatca

SEQ ID NO: 15959 - DNA, 25 bp, Homo sapien
acctttggaaagtgatgtcttgact

SEQ ID NO: 15960 - DNA, 25 bp, Homo sapien
acctttggaaagtggtgtcttgact

SEQ ID NO: 15961 - DNA, 25 bp, Homo sapien
acctttgtcagtcatcacctttgtc

SEQ ID NO: 15962 - DNA, 25 bp, Homo sapien
acctttgtcagtcgtcacctttgtc

SEQ ID NO: 15963 - DNA, 25 bp, Homo sapien
accttttaatggatagattacacag

SEQ ID NO: 15964 - DNA, 25 bp, Homo sapien
accttttaatggatggattacacag

SEQ ID NO: 15965 - DNA, 25 bp, Homo sapien
accttttctgaatgataaaaaagtg

SEQ ID NO: 15966 - DNA, 25 bp, Homo sapien
accttttctgattgataaaaaagtg

SEQ ID NO: 15967 - DNA, 25 bp, Homo sapien
accttttcttcagacgtagaatgcc

SEQ ID NO: 15968 - DNA, 25 bp, Homo sapien
accttttcttccgacgtagaatgcc

SEQ ID NO: 15969 - DNA, 25 bp, Homo sapien
accttttgtggaaggaaggactatt

SEQ ID NO: 15970 - DNA, 25 bp, Homo sapien
accttttgtggcaggaaggactatt

SEQ ID NO: 15971 - DNA, 25 bp, Homo sapien
acctttttatgagaagagataatag

SEQ ID NO: 15972 - DNA, 25 bp, Homo sapien
acctttttatgaggagagataatag

SEQ ID NO: 15973 - DNA, 25 bp, Homo sapien
acctttttatgtggctaacttcaat

SEQ ID NO: 15974 - DNA, 25 bp, Homo sapien
acctttttatgtggttaacttcaat

SEQ ID NO: 15975 - DNA, 25 bp, Homo sapien
acctttttcacaccaaggaccagtt

SEQ ID NO: 15976 - DNA, 25 bp, Homo sapien
acctttttcgcaccaaggaccagtt

SEQ ID NO: 15977 - DNA, 25 bp, Homo sapien
acctttttctgggagactgttccct

SEQ ID NO: 15978 - DNA, 25 bp, Homo sapien
acctttttctgggagagtgttccct

SEQ ID NO: 15979 - DNA, 25 bp, Homo sapien
acgaaaaagcacttcatagcttgga

SEQ ID NO: 15980 - DNA, 25 bp, Homo sapien
acgaaaaagcagttcatagcttgga

SEQ ID NO: 15981 - DNA, 25 bp, Homo sapien
acgaaagcaataaagtcaagacagt

SEQ ID NO: 15982 - DNA, 25 bp, Homo sapien
acgaaagcaatgaagtcaagacagt

SEQ ID NO: 15983 - DNA, 25 bp, Homo sapien
acgaaagtgagatgtgaaatcgcaa

SEQ ID NO: 15984 - DNA, 25 bp, Homo sapien
acgaaagtgtgatgtgaaatcgcaa

SEQ ID NO: 15985 - DNA, 25 bp, Homo sapien
acgaaatccaaacgcagggagagtg

SEQ ID NO: 15986 - DNA, 25 bp, Homo sapien
acgaaatccaaatgcagggagagtg

SEQ ID NO: 15987 - DNA, 25 bp, Homo sapien
acgaacaagatcaataaccagtgtg

SEQ ID NO: 15988 - DNA, 25 bp, Homo sapien
acgaacaagatcaatagccagtgtg

SEQ ID NO: 15989 - DNA, 25 bp, Homo sapien
acgaacaatgtcaaataacaatgat

SEQ ID NO: 15990 - DNA, 25 bp, Homo sapien
acgaacaatgtcaagtaacaatgat

SEQ ID NO: 15991 - DNA, 25 bp, Homo sapien
acgaacaggtgataggtcctttctc

SEQ ID NO: 15992 - DNA, 25 bp, Homo sapien
acgaacaggtgttaggtcctttctc

SEQ ID NO: 15993 - DNA, 25 bp, Homo sapien
acgaacatgcaccctttagctgctc

SEQ ID NO: 15994 - DNA, 25 bp, Homo sapien
acgaacatgcactctttagctgctc

SEQ ID NO: 15995 - DNA, 25 bp, Homo sapien
acgaactagaactaggtttcatcta

SEQ ID NO: 15996 - DNA, 25 bp, Homo sapien
acgaactagaagtaggtttcatcta

SEQ ID NO: 15997 - DNA, 25 bp, Homo sapien
acgaagaagatggcaaagatttgtc

SEQ ID NO: 15998 - DNA, 25 bp, Homo sapien
acgaagaaggtggcaaagatttgtc

SEQ ID NO: 15999 - DNA, 25 bp, Homo sapien
acgaagagagccctgaaaaatctca

SEQ ID NO: 16000 - DNA, 25 bp, Homo sapien
acgaagagagccttgaaaaatctca

SEQ ID NO: 16001 - DNA, 25 bp, Homo sapien
acgaagcaaaaaccttctctcattt

SEQ ID NO: 16002 - DNA, 25 bp, Homo sapien
acgaagcaaaaacgttctctcattt

SEQ ID NO: 16003 - DNA, 25 bp, Homo sapien
acgaaggtcagccgaagaagtagaa

SEQ ID NO: 16004 - DNA, 25 bp, Homo sapien
acgaaggtcagctgaagaagtagaa

SEQ ID NO: 16005 - DNA, 25 bp, Homo sapien
acgaagtagccagggacatttgtct

SEQ ID NO: 16006 - DNA, 25 bp, Homo sapien
acgaagtagccagggatatttgtct

SEQ ID NO: 16007 - DNA, 25 bp, Homo sapien
acgaatacttgggttactcccagtg

SEQ ID NO: 16008 - DNA, 25 bp, Homo sapien
acgaatacttggtttactcccagtg

SEQ ID NO: 16009 - DNA, 25 bp, Homo sapien
acgaatagctcatgaatttgttcac

SEQ ID NO: 16010 - DNA, 25 bp, Homo sapien
acgaatagctcgtgaatttgttcac

SEQ ID NO: 16011 - DNA, 25 bp, Homo sapien
acgacacaacaacttgagaaatcta

SEQ ID NO: 16012 - DNA, 25 bp, Homo sapien
acgacacagcaacttgagaaatcta

SEQ ID NO: 16013 - DNA, 25 bp, Homo sapien
acgacagaagacaagtatgaatgtg

SEQ ID NO: 16014 - DNA, 25 bp, Homo sapien
acgacagaggacaagtatgaatgtg

SEQ ID NO: 16015 - DNA, 25 bp, Homo sapien
acgagactgtgttgaaagtaatgaa

SEQ ID NO: 16016 - DNA, 25 bp, Homo sapien
acgagactgtgttgaacgtaatgaa

SEQ ID NO: 16017 - DNA, 25 bp, Homo sapien
acgagagatatttaccaaagggatt

SEQ ID NO: 16018 - DNA, 25 bp, Homo sapien
acgagagatatttaccgaagggatt

SEQ ID NO: 16019 - DNA, 25 bp, Homo sapien
acgagccaccttttccatgaagagg

SEQ ID NO: 16020 - DNA, 25 bp, Homo sapien
acgagccactttttccatgaagagg

SEQ ID NO: 16021 - DNA, 25 bp, Homo sapien
acgagcctacaacatcttgttctac

SEQ ID NO: 16022 - DNA, 25 bp, Homo sapien
acgagcctacaatatcttgttctac

SEQ ID NO: 16023 - DNA, 25 bp, Homo sapien
acgagctattcttcgtacatatggt

SEQ ID NO: 16024 - DNA, 25 bp, Homo sapien
acgagctattctttgtacatatggt

SEQ ID NO: 16025 - DNA, 25 bp, Homo sapien
acgagctcactaagaagggtctggt

SEQ ID NO: 16026 - DNA, 25 bp, Homo sapien
acgagctcattaagaagggtctggt

SEQ ID NO: 16027 - DNA, 25 bp, Homo sapien
acgaggacacagggtctgacactag

SEQ ID NO: 16028 - DNA, 25 bp, Homo sapien
acgaggacacatggtctgacactag

SEQ ID NO: 16029 - DNA, 25 bp, Homo sapien
acgaggaggccatgagaagaggctg

SEQ ID NO: 16030 - DNA, 25 bp, Homo sapien
acgaggaggccgtgagaagaggctg

SEQ ID NO: 16031 - DNA, 25 bp, Homo sapien
acgaggcatgatccccaaattgaag

SEQ ID NO: 16032 - DNA, 25 bp, Homo sapien
acgaggcatgattcccaaattgaag

SEQ ID NO: 16033 - DNA, 25 bp, Homo sapien
acgaggtccattgtggccactgttt

SEQ ID NO: 16034 - DNA, 25 bp, Homo sapien
acgaggtctattgtggccactgttt

SEQ ID NO: 16035 - DNA, 25 bp, Homo sapien
acgaggtgcaatgataagttaacat

SEQ ID NO: 16036 - DNA, 25 bp, Homo sapien
acgaggtgcaattataagttaacat

SEQ ID NO: 16037 - DNA, 25 bp, Homo sapien
acgagtagagtttgtttcaagaaac

SEQ ID NO: 16038 - DNA, 25 bp, Homo sapien
acgagtagattttgtttcaagaaac

SEQ ID NO: 16039 - DNA, 25 bp, Homo sapien
acgagtcctacgggaaaccagctgc

SEQ ID NO: 16040 - DNA, 25 bp, Homo sapien
acgagtcctgcggctgattgcttag

SEQ ID NO: 16041 - DNA, 25 bp, Homo sapien
acgagtcctgcgggaaaccagctgc

SEQ ID NO: 16042 - DNA, 25 bp, Homo sapien
acgagtcctgctgctgattgcttag

SEQ ID NO: 16043 - DNA, 25 bp, Homo sapien
acgagttaccctgtcttcttccatg

SEQ ID NO: 16044 - DNA, 25 bp, Homo sapien
acgagttaccctttcttcttccatg

SEQ ID NO: 16045 - DNA, 25 bp, Homo sapien
acgagttgagtcaaaggccatagtg

SEQ ID NO: 16046 - DNA, 25 bp, Homo sapien
acgagttgagtccaaggccatagtg

SEQ ID NO: 16047 - DNA, 25 bp, Homo sapien
acgagttttcacatatgcatatacc

SEQ ID NO: 16048 - DNA, 25 bp, Homo sapien
acgagttttcacatgtgcatatacc

SEQ ID NO: 16049 - DNA, 25 bp, Homo sapien
acgatactgggcagcgaaacaacac

SEQ ID NO: 16050 - DNA, 25 bp, Homo sapien
acgatactgggcagtgaaacaacac

SEQ ID NO: 16051 - DNA, 25 bp, Homo sapien
acgatacttatcgcgtttccatcat

SEQ ID NO: 16052 - DNA, 25 bp, Homo sapien
acgatacttatctcgtttccatcat

SEQ ID NO: 16053 - DNA, 25 bp, Homo sapien
acgatatttggaaaaccataaaggg

SEQ ID NO: 16054 - DNA, 25 bp, Homo sapien
acgatatttggaaagccataaaggg

SEQ ID NO: 16055 - DNA, 25 bp, Homo sapien
acgatcagaatttaagccactcttt

SEQ ID NO: 16056 - DNA, 25 bp, Homo sapien
acgatcagaatttaagtcactcttt

SEQ ID NO: 16057 - DNA, 25 bp, Homo sapien
acgatcagcttcaagaaccttcatg

SEQ ID NO: 16058 - DNA, 25 bp, Homo sapien
acgatcagtttcaagaaccttcatg

SEQ ID NO: 16059 - DNA, 25 bp, Homo sapien
acgatcattcagattgaggtagcag

SEQ ID NO: 16060 - DNA, 25 bp, Homo sapien
acgatcattcaggttgaggtagcag

SEQ ID NO: 16061 - DNA, 25 bp, Homo sapien
acgatgaaaacgatatgataaaaag

SEQ ID NO: 16062 - DNA, 25 bp, Homo sapien
acgatgaaaactatatgataaaaag

SEQ ID NO: 16063 - DNA, 25 bp, Homo sapien
acgatgggactctctcaactgtccc

SEQ ID NO: 16064 - DNA, 25 bp, Homo sapien
acgatgggattctctcaactgtccc

SEQ ID NO: 16065 - DNA, 25 bp, Homo sapien
acgattggataagtgaaaacaatga

SEQ ID NO: 16066 - DNA, 25 bp, Homo sapien
acgattggataattgaaaacaatga

SEQ ID NO: 16067 - DNA, 25 bp, Homo sapien
acgatttctactcagcttcaaactc

SEQ ID NO: 16068 - DNA, 25 bp, Homo sapien
acgatttctacttagcttcaaactc

SEQ ID NO: 16069 - DNA, 25 bp, Homo sapien
acgatttgtctacataagatcctgc

SEQ ID NO: 16070 - DNA, 25 bp, Homo sapien
acgatttgtctatataagatcctgc

SEQ ID NO: 16071 - DNA, 25 bp, Homo sapien
acgattttcctacttaatttctgta

SEQ ID NO: 16072 - DNA, 25 bp, Homo sapien
acgattttcctacttattttctgta

SEQ ID NO: 16073 - DNA, 25 bp, Homo sapien
acgcaaaaactggtaacacaagcag

SEQ ID NO: 16074 - DNA, 25 bp, Homo sapien
acgcaaaaattggtaacacaagcag

SEQ ID NO: 16075 - DNA, 25 bp, Homo sapien
acgcacacatcatgaatgactcaaa

SEQ ID NO: 16076 - DNA, 25 bp, Homo sapien
acgcacacatcgtgaatgactcaaa

SEQ ID NO: 16077 - DNA, 25 bp, Homo sapien
acgcacatacatgcacatccacaat

SEQ ID NO: 16078 - DNA, 25 bp, Homo sapien
acgcacatacatgcacgtccacaat

SEQ ID NO: 16079 - DNA, 25 bp, Homo sapien
acgcacattttaataagttgcatat

SEQ ID NO: 16080 - DNA, 25 bp, Homo sapien
acgcacattttaatgagttgcatat

SEQ ID NO: 16081 - DNA, 25 bp, Homo sapien
acgcactagaagtgtttaagagagt

SEQ ID NO: 16082 - DNA, 25 bp, Homo sapien
acgcactagcagtgtttaagagagt

SEQ ID NO: 16083 - DNA, 25 bp, Homo sapien
acgcagaaaagacttgataaaattc

SEQ ID NO: 16084 - DNA, 25 bp, Homo sapien
acgcagaaaagtcttgataaaattc

SEQ ID NO: 16085 - DNA, 25 bp, Homo sapien
acgcagagattaagaagtgactgtc

SEQ ID NO: 16086 - DNA, 25 bp, Homo sapien
acgcagagattaggaagtgactgtc

SEQ ID NO: 16087 - DNA, 25 bp, Homo sapien
acgcagggatgcagcatccaatacc

SEQ ID NO: 16088 - DNA, 25 bp, Homo sapien
acgcagggatgcggcatccaatacc

SEQ ID NO: 16089 - DNA, 25 bp, Homo sapien
acgcagggtttatcgtatcgtgaac

SEQ ID NO: 16090 - DNA, 25 bp, Homo sapien
acgcagggtttattgtatcgtgaac

SEQ ID NO: 16091 - DNA, 25 bp, Homo sapien
acgcaggtagtgagaacactaggaa

SEQ ID NO: 16092 - DNA, 25 bp, Homo sapien
acgcaggtagtgagaatactaggaa

SEQ ID NO: 16093 - DNA, 25 bp, Homo sapien
acgcatcactcctatatctgcctcc

SEQ ID NO: 16094 - DNA, 25 bp, Homo sapien
acgcatcactcgtatatctgcctcc

SEQ ID NO: 16095 - DNA, 25 bp, Homo sapien
acgcatctcgcctcaagttgtgaga

SEQ ID NO: 16096 - DNA, 25 bp, Homo sapien
acgcatcttgcctcaagttgtgaga

SEQ ID NO: 16097 - DNA, 25 bp, Homo sapien
acgcatgctctaatcactgaattaa

SEQ ID NO: 16098 - DNA, 25 bp, Homo sapien
acgcatgctctaatcattgaattaa

SEQ ID NO: 16099 - DNA, 25 bp, Homo sapien
acgcatgtacacaaacactcactga

SEQ ID NO: 16100 - DNA, 25 bp, Homo sapien
acgcatgtacacaaacgctcactga

SEQ ID NO: 16101 - DNA, 25 bp, Homo sapien
acgccaggcacagtgctaaacactg

SEQ ID NO: 16102 - DNA, 25 bp, Homo sapien
acgccaggcaccgtgctaaacactg

SEQ ID NO: 16103 - DNA, 25 bp, Homo sapien
acgccagtgttctaaagtttttgat

SEQ ID NO: 16104 - DNA, 25 bp, Homo sapien
acgccagtgttctgaagtttttgat

SEQ ID NO: 16105 - DNA, 25 bp, Homo sapien
acgccatgtaccgtaggatgcttag

SEQ ID NO: 16106 - DNA, 25 bp, Homo sapien
acgccatgtaccttaggatgcttag

SEQ ID NO: 16107 - DNA, 25 bp, Homo sapien
acgccatgttatataaatatgcaca

SEQ ID NO: 16108 - DNA, 25 bp, Homo sapien
acgccatgttatgtaaatatgcaca

SEQ ID NO: 16109 - DNA, 25 bp, Homo sapien
acgccctcttcatgcatctttaatt

SEQ ID NO: 16110 - DNA, 25 bp, Homo sapien
acgccctcttcatggatctttaatt

SEQ ID NO: 16111 - DNA, 25 bp, Homo sapien
acgccctgcgagacatagcctgtgc

SEQ ID NO: 16112 - DNA, 25 bp, Homo sapien
acgccctgcgagacgtagcctgtgc

SEQ ID NO: 16113 - DNA, 25 bp, Homo sapien
acgcctacaaataaatgaataacca

SEQ ID NO: 16114 - DNA, 25 bp, Homo sapien
acgcctacaaatagatgaataacca

SEQ ID NO: 16115 - DNA, 25 bp, Homo sapien
acgcctagatacaataagtttctca

SEQ ID NO: 16116 - DNA, 25 bp, Homo sapien
acgcctaggtacaataagtttctca

SEQ ID NO: 16117 - DNA, 25 bp, Homo sapien
acgcctcactgccccacttctctcc

SEQ ID NO: 16118 - DNA, 25 bp, Homo sapien
acgcctcattgccccacttctctcc

SEQ ID NO: 16119 - DNA, 25 bp, Homo sapien
acgccttcgtggtgcttccatatac

SEQ ID NO: 16120 - DNA, 25 bp, Homo sapien
acgccttcttggtgcttccatatac

SEQ ID NO: 16121 - DNA, 25 bp, Homo sapien
acgcctttaggttcaggaagtagat

SEQ ID NO: 16122 - DNA, 25 bp, Homo sapien
acgcctttaggttcgggaagtagat

SEQ ID NO: 16123 - DNA, 25 bp, Homo sapien
acgcggaccgtaaagaagtgccagg

SEQ ID NO: 16124 - DNA, 25 bp, Homo sapien
acgcggaccgtaaagaggtgccagg

SEQ ID NO: 16125 - DNA, 25 bp, Homo sapien
acgctaaaactgagattctttcagc

SEQ ID NO: 16126 - DNA, 25 bp, Homo sapien
acgctaaaattgagattctttcagc

SEQ ID NO: 16127 - DNA, 25 bp, Homo sapien
acgctaaataaagcgatcctggtgt

SEQ ID NO: 16128 - DNA, 25 bp, Homo sapien
acgctaaataaagctatcctggtgt

SEQ ID NO: 16129 - DNA, 25 bp, Homo sapien
acgctaagtcaacttgtgcaatttt

SEQ ID NO: 16130 - DNA, 25 bp, Homo sapien
acgctaagtcatcttgtgcaatttt

SEQ ID NO: 16131 - DNA, 25 bp, Homo sapien
acgctaatagaaaaaaagccaaaca

SEQ ID NO: 16132 - DNA, 25 bp, Homo sapien
acgctaatagagaaaaagccaaaca

SEQ ID NO: 16133 - DNA, 25 bp, Homo sapien
acgctcctagtggccaatgaacatt

SEQ ID NO: 16134 - DNA, 25 bp, Homo sapien
acgctcctagtggctaatgaacatt

SEQ ID NO: 16135 - DNA, 25 bp, Homo sapien
acgctgacaaacccaatctaagatg

SEQ ID NO: 16136 - DNA, 25 bp, Homo sapien
acgctgaccaacccaatctaagatg

SEQ ID NO: 16137 - DNA, 25 bp, Homo sapien
acgctgattattcatcctacgttgt

SEQ ID NO: 16138 - DNA, 25 bp, Homo sapien
acgctgattattcttcctacgttgt

SEQ ID NO: 16139 - DNA, 25 bp, Homo sapien
acgctgccatcgtgttccctcagtt

SEQ ID NO: 16140 - DNA, 25 bp, Homo sapien
acgctgccgtcgtgttccctcagtt

SEQ ID NO: 16141 - DNA, 25 bp, Homo sapien
acgctggcaaatacttggatgggca

SEQ ID NO: 16142 - DNA, 25 bp, Homo sapien
acgctggcatatacttggatgggca

SEQ ID NO: 16143 - DNA, 25 bp, Homo sapien
acgctgttaaaaatcacccaattgt

SEQ ID NO: 16144 - DNA, 25 bp, Homo sapien
acgctgttaaaaattacccaattgt

SEQ ID NO: 16145 - DNA, 25 bp, Homo sapien
acgcttacgtgttcatcccagtgtc

SEQ ID NO: 16146 - DNA, 25 bp, Homo sapien
acgcttacgtgttgatcccagtgtc

SEQ ID NO: 16147 - DNA, 25 bp, Homo sapien
acgcttctgactttccaaaatgctt

SEQ ID NO: 16148 - DNA, 25 bp, Homo sapien
acgcttctgactttgcaaaatgctt

SEQ ID NO: 16149 - DNA, 25 bp, Homo sapien
acggaaatatgattgcatcagacaa

SEQ ID NO: 16150 - DNA, 25 bp, Homo sapien
acggaaatatgtttgcatcagacaa

SEQ ID NO: 16151 - DNA, 25 bp, Homo sapien
acggaatgagaagaaccttacagta

SEQ ID NO: 16152 - DNA, 25 bp, Homo sapien
acggaatgagaagacccttacagta

SEQ ID NO: 16153 - DNA, 25 bp, Homo sapien
acggacaaactttacagaagactag

SEQ ID NO: 16154 - DNA, 25 bp, Homo sapien
acggacaaactttagagaagactag

SEQ ID NO: 16155 - DNA, 25 bp, Homo sapien
acggactactcaataatttatccag

SEQ ID NO: 16156 - DNA, 25 bp, Homo sapien
acggactactcagtaatttatccag

SEQ ID NO: 16157 - DNA, 25 bp, Homo sapien
acggactcttaagatgcagtggcga

SEQ ID NO: 16158 - DNA, 25 bp, Homo sapien
acggactcttaagctgcagtggcga

SEQ ID NO: 16159 - DNA, 25 bp, Homo sapien
acggagcagcaccttcgtagtgcca

SEQ ID NO: 16160 - DNA, 25 bp, Homo sapien
acggagcagcatcttcgtagtgcca

SEQ ID NO: 16161 - DNA, 25 bp, Homo sapien
acggaggacaccaccctgaaaggac

SEQ ID NO: 16162 - DNA, 25 bp, Homo sapien
acggaggacaccatcctgaaaggac

SEQ ID NO: 16163 - DNA, 25 bp, Homo sapien
acggagttagttataccgatcttca

SEQ ID NO: 16164 - DNA, 25 bp, Homo sapien
acggagttagttatactgatcttca

SEQ ID NO: 16165 - DNA, 25 bp, Homo sapien
acggatttgaacatgtgatatgaac

SEQ ID NO: 16166 - DNA, 25 bp, Homo sapien
acggatttgaatatgtgatatgaac

SEQ ID NO: 16167 - DNA, 25 bp, Homo sapien
acggcagacaaaaacaaagttttca

SEQ ID NO: 16168 - DNA, 25 bp, Homo sapien
acggcagacaaaagcaaagttttca

SEQ ID NO: 16169 - DNA, 25 bp, Homo sapien
acggcatcacacccagtcctctcca

SEQ ID NO: 16170 - DNA, 25 bp, Homo sapien
acggcatcgcacccagtcctctcca

SEQ ID NO: 16171 - DNA, 25 bp, Homo sapien
acggcccaatcaatgagtggtgggt

SEQ ID NO: 16172 - DNA, 25 bp, Homo sapien
acggcccaatcagtgagtggtgggt

SEQ ID NO: 16173 - DNA, 25 bp, Homo sapien
acggcccttaattttggtttgaaaa

SEQ ID NO: 16174 - DNA, 25 bp, Homo sapien
acggcccttaattttgttttgaaaa

SEQ ID NO: 16175 - DNA, 25 bp, Homo sapien
acggctgtaatacagggataataaa

SEQ ID NO: 16176 - DNA, 25 bp, Homo sapien
acggctgtaatacggggataataaa

SEQ ID NO: 16177 - DNA, 25 bp, Homo sapien
acggcttggattttgcacaaattgg

SEQ ID NO: 16178 - DNA, 25 bp, Homo sapien
acggcttggattttgcgcaaattgg

SEQ ID NO: 16179 - DNA, 25 bp, Homo sapien
acgggaaggtcaaagttctagcttc

SEQ ID NO: 16180 - DNA, 25 bp, Homo sapien
acgggaaggtcagagttctagcttc

SEQ ID NO: 16181 - DNA, 25 bp, Homo sapien
acgggaatgatgtgaccataagcca

SEQ ID NO: 16182 - DNA, 25 bp, Homo sapien
acgggaatgatgtggccataagcca

SEQ ID NO: 16183 - DNA, 25 bp, Homo sapien
acgggaattgacaggagagttgctt

SEQ ID NO: 16184 - DNA, 25 bp, Homo sapien
acgggaattgagaggagagttgctt

SEQ ID NO: 16185 - DNA, 25 bp, Homo sapien
acgggactccgccatcaagcgtggc

SEQ ID NO: 16186 - DNA, 25 bp, Homo sapien
acgggactctgccatcaagcgtggc

SEQ ID NO: 16187 - DNA, 25 bp, Homo sapien
acgggcaatggaatgagacccccat

SEQ ID NO: 16188 - DNA, 25 bp, Homo sapien
acgggcaatggagtgagacccccat

SEQ ID NO: 16189 - DNA, 25 bp, Homo sapien
acgggcacgtcaatgagtggctggc

SEQ ID NO: 16190 - DNA, 25 bp, Homo sapien
acgggcacgtccatgagtggctggc

SEQ ID NO: 16191 - DNA, 25 bp, Homo sapien
acgggctcttttccgttctatataa

SEQ ID NO: 16192 - DNA, 25 bp, Homo sapien
acgggctctttttcgttctatataa

SEQ ID NO: 16193 - DNA, 25 bp, Homo sapien
acggggtgagatattgatgtattag

SEQ ID NO: 16194 - DNA, 25 bp, Homo sapien
acggggtgagatattggtgtattag

SEQ ID NO: 16195 - DNA, 25 bp, Homo sapien
acggtataagccaccacagcggtta

SEQ ID NO: 16196 - DNA, 25 bp, Homo sapien
acggtataggccaccacagcggtta

SEQ ID NO: 16197 - DNA, 25 bp, Homo sapien
acggtgctgccaaaaactatcactt

SEQ ID NO: 16198 - DNA, 25 bp, Homo sapien
acggtgctgtcaaaaactatcactt

SEQ ID NO: 16199 - DNA, 25 bp, Homo sapien
acggtggctgtgtgatctgctttgg

SEQ ID NO: 16200 - DNA, 25 bp, Homo sapien
acggtggctgtgtgatttgctttgg

SEQ ID NO: 16201 - DNA, 25 bp, Homo sapien
acggtgttcatcaattcctatggta

SEQ ID NO: 16202 - DNA, 25 bp, Homo sapien
acggtgttcgtcaattcctatggta

SEQ ID NO: 16203 - DNA, 25 bp, Homo sapien
acggttagaggcattcctgggtatt

SEQ ID NO: 16204 - DNA, 25 bp, Homo sapien
acggttagatgcattcctgggtatt

SEQ ID NO: 16205 - DNA, 25 bp, Homo sapien
acggttcaacaagcttcccctaaca

SEQ ID NO: 16206 - DNA, 25 bp, Homo sapien
acggttcagcaagcttcccctaaca

SEQ ID NO: 16207 - DNA, 25 bp, Homo sapien
acggttgcactgctgactaagtata

SEQ ID NO: 16208 - DNA, 25 bp, Homo sapien
acggttgcattgctgactaagtata

SEQ ID NO: 16209 - DNA, 25 bp, Homo sapien
acggtttacgttttcacaccacaat

SEQ ID NO: 16210 - DNA, 25 bp, Homo sapien
acggtttatgttttcacaccacaat

SEQ ID NO: 16211 - DNA, 25 bp, Homo sapien
acggtttttcaagagaagatactgt

SEQ ID NO: 16212 - DNA, 25 bp, Homo sapien
acggtttttcaggagaagatactgt

SEQ ID NO: 16213 - DNA, 25 bp, Homo sapien
acgtaacgtctttcgatgccacatt

SEQ ID NO: 16214 - DNA, 25 bp, Homo sapien
acgtaacgtcttttgatgccacatt

SEQ ID NO: 16215 - DNA, 25 bp, Homo sapien
acgtaccaattataatgctgttaaa

SEQ ID NO: 16216 - DNA, 25 bp, Homo sapien
acgtaccaattatactgctgttaaa

SEQ ID NO: 16217 - DNA, 25 bp, Homo sapien
acgtacctatgcttcttttaagccc

SEQ ID NO: 16218 - DNA, 25 bp, Homo sapien
acgtacctgtgcttcttttaagccc

SEQ ID NO: 16219 - DNA, 25 bp, Homo sapien
acgtactggctttggctttctgttc

SEQ ID NO: 16220 - DNA, 25 bp, Homo sapien
acgtactgtctttggctttctgttc

SEQ ID NO: 16221 - DNA, 25 bp, Homo sapien
acgtagtctatgctggacacttcct

SEQ ID NO: 16222 - DNA, 25 bp, Homo sapien
acgtagtctatgttggacacttcct

SEQ ID NO: 16223 - DNA, 25 bp, Homo sapien
acgtataaggtccaaaatcacactt

SEQ ID NO: 16224 - DNA, 25 bp, Homo sapien
acgtataaggtcccaaatcacactt

SEQ ID NO: 16225 - DNA, 25 bp, Homo sapien
acgtatgaacgatacagtttacttt

SEQ ID NO: 16226 - DNA, 25 bp, Homo sapien
acgtatgaatgatacagtttacttt

SEQ ID NO: 16227 - DNA, 25 bp, Homo sapien
acgtattctcacctacagaaaagag

SEQ ID NO: 16228 - DNA, 25 bp, Homo sapien
acgtattctcatctacagaaaagag

SEQ ID NO: 16229 - DNA, 25 bp, Homo sapien
acgtatttgttgaatgttgttgaag

SEQ ID NO: 16230 - DNA, 25 bp, Homo sapien
acgtatttgttgcatgttgttgaag

SEQ ID NO: 16231 - DNA, 25 bp, Homo sapien
acgtcgtaaccccgtctggacgtat

SEQ ID NO: 16232 - DNA, 25 bp, Homo sapien
acgtcgtaaccctgtctggacgtat

SEQ ID NO: 16233 - DNA, 25 bp, Homo sapien
acgtcgtatgttctatgaagagcca

SEQ ID NO: 16234 - DNA, 25 bp, Homo sapien
acgtcgtatgttctgtgaagagcca

SEQ ID NO: 16235 - DNA, 25 bp, Homo sapien
acgtctatactcagcaaaatgacat

SEQ ID NO: 16236 - DNA, 25 bp, Homo sapien
acgtctatacttagcaaaatgacat

SEQ ID NO: 16237 - DNA, 25 bp, Homo sapien
acgtctcaaagcagttcctcagaat

SEQ ID NO: 16238 - DNA, 25 bp, Homo sapien
acgtctcaaagcggttcctcagaat

SEQ ID NO: 16239 - DNA, 25 bp, Homo sapien
acgtctttaataatggctacttgat

SEQ ID NO: 16240 - DNA, 25 bp, Homo sapien
acgtctttaataattgctacttgat

SEQ ID NO: 16241 - DNA, 25 bp, Homo sapien
acgtgaagctcaagggatagaagat

SEQ ID NO: 16242 - DNA, 25 bp, Homo sapien
acgtgaagttcaagggatagaagat

SEQ ID NO: 16243 - DNA, 25 bp, Homo sapien
acgtgagaaacctaggccattatac

SEQ ID NO: 16244 - DNA, 25 bp, Homo sapien
acgtgagaaacttaggccattatac

SEQ ID NO: 16245 - DNA, 25 bp, Homo sapien
acgtgatgacccatatgcaaatgtt

SEQ ID NO: 16246 - DNA, 25 bp, Homo sapien
acgtgatgacccctatgcaaatgtt

SEQ ID NO: 16247 - DNA, 25 bp, Homo sapien
acgtgatgcaaaagagcataagagc

SEQ ID NO: 16248 - DNA, 25 bp, Homo sapien
acgtgatgcaaaatagcataagagc

SEQ ID NO: 16249 - DNA, 25 bp, Homo sapien
acgtgcaacataggactctgattct

SEQ ID NO: 16250 - DNA, 25 bp, Homo sapien
acgtgcaatataggactctgattct

SEQ ID NO: 16251 - DNA, 25 bp, Homo sapien
acgtgcactttgccgaacatggatc

SEQ ID NO: 16252 - DNA, 25 bp, Homo sapien
acgtgcactttgctgaacatggatc

SEQ ID NO: 16253 - DNA, 25 bp, Homo sapien
acgtggagactcagaagcaagcgca

SEQ ID NO: 16254 - DNA, 25 bp, Homo sapien
acgtggagactgagaagcaagcgca

SEQ ID NO: 16255 - DNA, 25 bp, Homo sapien
acgtggatcaatcttggaaacatca

SEQ ID NO: 16256 - DNA, 25 bp, Homo sapien
acgtggatgaatcttggaaacatca

SEQ ID NO: 16257 - DNA, 25 bp, Homo sapien
acgtggcaacacggcaggactgtgg

SEQ ID NO: 16258 - DNA, 25 bp, Homo sapien
acgtggcaacactgcaggactgtgg

SEQ ID NO: 16259 - DNA, 25 bp, Homo sapien
acgtggcgatcccaattcagaatgg

SEQ ID NO: 16260 - DNA, 25 bp, Homo sapien
acgtggcggtcccaattcagaatgg

SEQ ID NO: 16261 - DNA, 25 bp, Homo sapien
acgtgggtattacggttcacaatga

SEQ ID NO: 16262 - DNA, 25 bp, Homo sapien
acgtgggtattatggttcacaatga

SEQ ID NO: 16263 - DNA, 25 bp, Homo sapien
acgtggtgtatctgttcttactttc

SEQ ID NO: 16264 - DNA, 25 bp, Homo sapien
acgtggtgtgtctgttcttactttc

SEQ ID NO: 16265 - DNA, 25 bp, Homo sapien
acgtgtaagacgagtacctcttcag

SEQ ID NO: 16266 - DNA, 25 bp, Homo sapien
acgtgtaagactagtacctcttcag

SEQ ID NO: 16267 - DNA, 25 bp, Homo sapien
acgtgtgcatgtatcatctgtttac

SEQ ID NO: 16268 - DNA, 25 bp, Homo sapien
acgtgtgcatgtatgatctgtttac

SEQ ID NO: 16269 - DNA, 25 bp, Homo sapien
acgtgtgtaggagcataaatgggga

SEQ ID NO: 16270 - DNA, 25 bp, Homo sapien
acgtgtgtgggagcataaatgggga

SEQ ID NO: 16271 - DNA, 25 bp, Homo sapien
acgtgttcagctaattgcaaaaaca

SEQ ID NO: 16272 - DNA, 25 bp, Homo sapien
acgtgttcggctaattgcaaaaaca

SEQ ID NO: 16273 - DNA, 25 bp, Homo sapien
acgtgttgctcaaagttgaagagat

SEQ ID NO: 16274 - DNA, 25 bp, Homo sapien
acgtgttgctcgaagttgaagagat

SEQ ID NO: 16275 - DNA, 25 bp, Homo sapien
acgttaatctccagatcctgttaag

SEQ ID NO: 16276 - DNA, 25 bp, Homo sapien
acgttaatctccagattctgttaag

SEQ ID NO: 16277 - DNA, 25 bp, Homo sapien
acgttaggctctaatgaaacctcag

SEQ ID NO: 16278 - DNA, 25 bp, Homo sapien
acgttaggctctgatgaaacctcag

SEQ ID NO: 16279 - DNA, 25 bp, Homo sapien
acgttattgggatgaccccttgaat

SEQ ID NO: 16280 - DNA, 25 bp, Homo sapien
acgttattgggatgcccccttgaat

SEQ ID NO: 16281 - DNA, 25 bp, Homo sapien
acgttcttcctcttggaccccaagc

SEQ ID NO: 16282 - DNA, 25 bp, Homo sapien
acgttcttcctgttggaccccaagc

SEQ ID NO: 16283 - DNA, 25 bp, Homo sapien
acgttgtggacagcaaagccagtgt

SEQ ID NO: 16284 - DNA, 25 bp, Homo sapien
acgttgtgggcagcaaagccagtgt

SEQ ID NO: 16285 - DNA, 25 bp, Homo sapien
acgttgttaactcatttcacccttg

SEQ ID NO: 16286 - DNA, 25 bp, Homo sapien
acgttgttagctcatttcacccttg

SEQ ID NO: 16287 - DNA, 25 bp, Homo sapien
acgttgtttctacgagtagagctca

SEQ ID NO: 16288 - DNA, 25 bp, Homo sapien
acgttgtttctatgagtagagctca

SEQ ID NO: 16289 - DNA, 25 bp, Homo sapien
acgtttagaagtggtccatgtataa

SEQ ID NO: 16290 - DNA, 25 bp, Homo sapien
acgtttagaagttgtccatgtataa

SEQ ID NO: 16291 - DNA, 25 bp, Homo sapien
acgtttatccaaaagcatctcacct

SEQ ID NO: 16292 - DNA, 25 bp, Homo sapien
acgtttattcaaaagcatctcacct

SEQ ID NO: 16293 - DNA, 25 bp, Homo sapien
acgtttcatagtgcgagttcagata

SEQ ID NO: 16294 - DNA, 25 bp, Homo sapien
acgtttcatagtgggagttcagata

SEQ ID NO: 16295 - DNA, 25 bp, Homo sapien
acgtttgcatggaacagtctcaaac

SEQ ID NO: 16296 - DNA, 25 bp, Homo sapien
acgtttgcatgggacagtctcaaac

SEQ ID NO: 16297 - DNA, 25 bp, Homo sapien
acgttttacgaacgtccagacttct

SEQ ID NO: 16298 - DNA, 25 bp, Homo sapien
acgttttacgaatgtccagacttct

SEQ ID NO: 16299 - DNA, 25 bp, Homo sapien
acgttttatgcaccgaacttactgc

SEQ ID NO: 16300 - DNA, 25 bp, Homo sapien
acgttttatgcacggaacttactgc

SEQ ID NO: 16301 - DNA, 25 bp, Homo sapien
acgttttatttgtacactgggcctt

SEQ ID NO: 16302 - DNA, 25 bp, Homo sapien
acgttttatttgtagactgggcctt

SEQ ID NO: 16303 - DNA, 25 bp, Homo sapien
acgttttctatatttgcaccaacac

SEQ ID NO: 16304 - DNA, 25 bp, Homo sapien
acgttttctgtatttgcaccaacac

SEQ ID NO: 16305 - DNA, 25 bp, Homo sapien
acgtttttagtctctccactcatta

SEQ ID NO: 16306 - DNA, 25 bp, Homo sapien
acgtttttagtttctccactcatta

SEQ ID NO: 16307 - DNA, 25 bp, Homo sapien
acgttttttgctagacagaactatc

SEQ ID NO: 16308 - DNA, 25 bp, Homo sapien
acgttttttgctggacagaactatc

SEQ ID NO: 16309 - DNA, 25 bp, Homo sapien
actaaaaaactgctgtgccttttgt

SEQ ID NO: 16310 - DNA, 25 bp, Homo sapien
actaaaaaactgctttgccttttgt

SEQ ID NO: 16311 - DNA, 25 bp, Homo sapien
actaaaaaattacacgatttgtgca

SEQ ID NO: 16312 - DNA, 25 bp, Homo sapien
actaaaaaattacatgatttgtgca

SEQ ID NO: 16313 - DNA, 25 bp, Homo sapien
actaaaaaatttattggaggctctc

SEQ ID NO: 16314 - DNA, 25 bp, Homo sapien
actaaaaacaggttacaaataggta

SEQ ID NO: 16315 - DNA, 25 bp, Homo sapien
actaaaaacgggttacaaataggta

SEQ ID NO: 16316 - DNA, 25 bp, Homo sapien
actaaaaagtttattggaggctctc

SEQ ID NO: 16317 - DNA, 25 bp, Homo sapien
actaaaatcaggtggtggaagtgag

SEQ ID NO: 16318 - DNA, 25 bp, Homo sapien
actaaaatcagttggtggaagtgag

SEQ ID NO: 16319 - DNA, 25 bp, Homo sapien
actaaaatgatggcaaataaggcaa

SEQ ID NO: 16320 - DNA, 25 bp, Homo sapien
actaaaatgatgtcaaataaggcaa

SEQ ID NO: 16321 - DNA, 25 bp, Homo sapien
actaaaattatggaaaaccagacac

SEQ ID NO: 16322 - DNA, 25 bp, Homo sapien
actaaaattatggagaaccagacac

SEQ ID NO: 16323 - DNA, 25 bp, Homo sapien
actaaaatttagcccacattgccaa

SEQ ID NO: 16324 - DNA, 25 bp, Homo sapien
actaaaatttagctcacattgccaa

SEQ ID NO: 16325 - DNA, 25 bp, Homo sapien
actaaacaacaacttctgagttaac

SEQ ID NO: 16326 - DNA, 25 bp, Homo sapien
actaaacaacaatttctgagttaac

SEQ ID NO: 16327 - DNA, 25 bp, Homo sapien
actaaacataaaacgatacacaaac

SEQ ID NO: 16328 - DNA, 25 bp, Homo sapien
actaaacataaaatgatacacaaac

SEQ ID NO: 16329 - DNA, 25 bp, Homo sapien
actaaaccaatcttattgttgtgaa

SEQ ID NO: 16330 - DNA, 25 bp, Homo sapien
actaaaccaatcttgttgttgtgaa

SEQ ID NO: 16331 - DNA, 25 bp, Homo sapien
actaaaccacttatccacttctcgt

SEQ ID NO: 16332 - DNA, 25 bp, Homo sapien
actaaaccattactgtagattaata

SEQ ID NO: 16333 - DNA, 25 bp, Homo sapien
actaaaccattattgtagattaata

SEQ ID NO: 16334 - DNA, 25 bp, Homo sapien
actaaaccgcttatccacttctcgt

SEQ ID NO: 16335 - DNA, 25 bp, Homo sapien
actaaacgatacgtgttttgcagtt

SEQ ID NO: 16336 - DNA, 25 bp, Homo sapien
actaaacgatatgtgttttgcagtt

SEQ ID NO: 16337 - DNA, 25 bp, Homo sapien
actaaacgttgatgagaatgtggag

SEQ ID NO: 16338 - DNA, 25 bp, Homo sapien
actaaacgttggtgagaatgtggag

SEQ ID NO: 16339 - DNA, 25 bp, Homo sapien
actaaactggcaaaatgtcttatga

SEQ ID NO: 16340 - DNA, 25 bp, Homo sapien
actaaactggcacaatgtcttatga

SEQ ID NO: 16341 - DNA, 25 bp, Homo sapien
actaaactgggcatcttgagtttta

SEQ ID NO: 16342 - DNA, 25 bp, Homo sapien
actaaactgggcattttgagtttta

SEQ ID NO: 16343 - DNA, 25 bp, Homo sapien
actaaagaactcctacatagcaaaa

SEQ ID NO: 16344 - DNA, 25 bp, Homo sapien
actaaagaagcttcatctatttctc

SEQ ID NO: 16345 - DNA, 25 bp, Homo sapien
actaaagaagcttcatttatttctc

SEQ ID NO: 16346 - DNA, 25 bp, Homo sapien
actaaagaagtcctacatagcaaaa

SEQ ID NO: 16347 - DNA, 25 bp, Homo sapien
actaaagcctttcaatgttacacta

SEQ ID NO: 16348 - DNA, 25 bp, Homo sapien
actaaagcctttcattgttacacta

SEQ ID NO: 16349 - DNA, 25 bp, Homo sapien
actaaaggcactgtctgacaaaact

SEQ ID NO: 16350 - DNA, 25 bp, Homo sapien
actaaaggcactgtttgacaaaact

SEQ ID NO: 16351 - DNA, 25 bp, Homo sapien
actaaaggcataaactatctaaatg

SEQ ID NO: 16352 - DNA, 25 bp, Homo sapien
actaaaggcatagactatctaaatg

SEQ ID NO: 16353 - DNA, 25 bp, Homo sapien
actaaagttcagatagatcttacca

SEQ ID NO: 16354 - DNA, 25 bp, Homo sapien
actaaagttcagattgatcttacca

SEQ ID NO: 16355 - DNA, 25 bp, Homo sapien
actaaataactgcacaggcttagat

SEQ ID NO: 16356 - DNA, 25 bp, Homo sapien
actaaatagctgcacaggcttagat

SEQ ID NO: 16357 - DNA, 25 bp, Homo sapien
actaaatagcttacatttcagagcc

SEQ ID NO: 16358 - DNA, 25 bp, Homo sapien
actaaatagcttgcatttcagagcc

SEQ ID NO: 16359 - DNA, 25 bp, Homo sapien
actaaatccaattataatccatttc

SEQ ID NO: 16360 - DNA, 25 bp, Homo sapien
actaaatccaattatagtccatttc

SEQ ID NO: 16361 - DNA, 25 bp, Homo sapien
actaaatctgaacttacgactacat

SEQ ID NO: 16362 - DNA, 25 bp, Homo sapien
actaaatctgaacttatgactacat

SEQ ID NO: 16363 - DNA, 25 bp, Homo sapien
actaaatgcccacagaagacagcag

SEQ ID NO: 16364 - DNA, 25 bp, Homo sapien
actaaatgcccacggaagacagcag

SEQ ID NO: 16365 - DNA, 25 bp, Homo sapien
actaaatgtcggtgaagatgttgag

SEQ ID NO: 16366 - DNA, 25 bp, Homo sapien
actaaatgttggtgaagatgttgag

SEQ ID NO: 16367 - DNA, 25 bp, Homo sapien
actaaattatgattatatctgtctg

SEQ ID NO: 16368 - DNA, 25 bp, Homo sapien
actaaattcagagaagagctgaagg

SEQ ID NO: 16369 - DNA, 25 bp, Homo sapien
actaaattctgattatatctgtctg

SEQ ID NO: 16370 - DNA, 25 bp, Homo sapien
actaaatttagagaagagctgaagg

SEQ ID NO: 16371 - DNA, 25 bp, Homo sapien
actaacaaccatattaatagggatg

SEQ ID NO: 16372 - DNA, 25 bp, Homo sapien
actaacaagcatattaatagggatg

SEQ ID NO: 16373 - DNA, 25 bp, Homo sapien
actaacactaccacctcagtaaagc

SEQ ID NO: 16374 - DNA, 25 bp, Homo sapien
actaacactaccgcctcagtaaagc

SEQ ID NO: 16375 - DNA, 25 bp, Homo sapien
actaacagaaaaattggcaaaggat

SEQ ID NO: 16376 - DNA, 25 bp, Homo sapien
actaacagagaaattggcaaaggat

SEQ ID NO: 16377 - DNA, 25 bp, Homo sapien
actaacagcagagatattattaatt

SEQ ID NO: 16378 - DNA, 25 bp, Homo sapien
actaacagcagatatattattaatt

SEQ ID NO: 16379 - DNA, 25 bp, Homo sapien
actaacatcacatccatatctatgt

SEQ ID NO: 16380 - DNA, 25 bp, Homo sapien
actaacatcccatccatatctatgt

SEQ ID NO: 16381 - DNA, 25 bp, Homo sapien
actaacatgaaccaggaaaagctga

SEQ ID NO: 16382 - DNA, 25 bp, Homo sapien
actaacatgaactaggaaaagctga

SEQ ID NO: 16383 - DNA, 25 bp, Homo sapien
actaacatgcgtcaaagaatacaat

SEQ ID NO: 16384 - DNA, 25 bp, Homo sapien
actaacatgtgtcaaagaatacaat

SEQ ID NO: 16385 - DNA, 25 bp, Homo sapien
actaacctttctgattccctttctc

SEQ ID NO: 16386 - DNA, 25 bp, Homo sapien
actaacctttcttattccctttctc

SEQ ID NO: 16387 - DNA, 25 bp, Homo sapien
actaacgcagccataactggtatgg

SEQ ID NO: 16388 - DNA, 25 bp, Homo sapien
actaacgcagccgtaactggtatgg

SEQ ID NO: 16389 - DNA, 25 bp, Homo sapien
actaacgcagtaacagtacaaagat

SEQ ID NO: 16390 - DNA, 25 bp, Homo sapien
actaacgcagtgacagtacaaagat

SEQ ID NO: 16391 - DNA, 25 bp, Homo sapien
actaactgaacacttgcagcatata

SEQ ID NO: 16392 - DNA, 25 bp, Homo sapien
actaactgagcacttgcagcatata

SEQ ID NO: 16393 - DNA, 25 bp, Homo sapien
actaactgcctcatgttctgtggct

SEQ ID NO: 16394 - DNA, 25 bp, Homo sapien
actaactgcctcgtgttctgtggct

SEQ ID NO: 16395 - DNA, 25 bp, Homo sapien
actaactgcgtagctttagacttgt

SEQ ID NO: 16396 - DNA, 25 bp, Homo sapien
actaactgtacctgagcagtgctga

SEQ ID NO: 16397 - DNA, 25 bp, Homo sapien
actaactgtacctgggcagtgctga

SEQ ID NO: 16398 - DNA, 25 bp, Homo sapien
actaactgtgtagctttagacttgt

SEQ ID NO: 16399 - DNA, 25 bp, Homo sapien
actaacttgccaagaatcatgcatg

SEQ ID NO: 16400 - DNA, 25 bp, Homo sapien
actaacttgccaataatcatgcatg

SEQ ID NO: 16401 - DNA, 25 bp, Homo sapien
actaacttggctatccaggaaaact

SEQ ID NO: 16402 - DNA, 25 bp, Homo sapien
actaacttggctttccaggaaaact

SEQ ID NO: 16403 - DNA, 25 bp, Homo sapien
actaagaaaaatccgtagactgtga

SEQ ID NO: 16404 - DNA, 25 bp, Homo sapien
actaagaaaaatctgtagactgtga

SEQ ID NO: 16405 - DNA, 25 bp, Homo sapien
actaagaaattcactattcaagata

SEQ ID NO: 16406 - DNA, 25 bp, Homo sapien
actaagaaatttactattcaagata

SEQ ID NO: 16407 - DNA, 25 bp, Homo sapien
actaagaatcaaacgaatggttatt

SEQ ID NO: 16408 - DNA, 25 bp, Homo sapien
actaagaatcaaatgaatggttatt

SEQ ID NO: 16409 - DNA, 25 bp, Homo sapien
actaagacaaaaaagaccacatgtg

SEQ ID NO: 16410 - DNA, 25 bp, Homo sapien
actaagacaaaaaagatcacatgtg

SEQ ID NO: 16411 - DNA, 25 bp, Homo sapien
actaagatgatacccaagttgcaag

SEQ ID NO: 16412 - DNA, 25 bp, Homo sapien
actaagatggtacccaagttgcaag

SEQ ID NO: 16413 - DNA, 25 bp, Homo sapien
actaagggcacactggtttctggaa

SEQ ID NO: 16414 - DNA, 25 bp, Homo sapien
actaagggcacattggtttctggaa

SEQ ID NO: 16415 - DNA, 25 bp, Homo sapien
actaagtctaatagttcctactgcc

SEQ ID NO: 16416 - DNA, 25 bp, Homo sapien
actaagtctaatggttcctactgcc

SEQ ID NO: 16417 - DNA, 25 bp, Homo sapien
actaagtgagctcttaggatgtctg

SEQ ID NO: 16418 - DNA, 25 bp, Homo sapien
actaagtgagcttttaggatgtctg

SEQ ID NO: 16419 - DNA, 25 bp, Homo sapien
actaagtgtaacaagtagtgtgctg

SEQ ID NO: 16420 - DNA, 25 bp, Homo sapien
actaagtgtaacaggtagtgtgctg

SEQ ID NO: 16421 - DNA, 25 bp, Homo sapien
actaataaagaagataatagagaag

SEQ ID NO: 16422 - DNA, 25 bp, Homo sapien
actaataaagaaggtaatagagaag

SEQ ID NO: 16423 - DNA, 25 bp, Homo sapien
actaatacaacaagcaatctatcct

SEQ ID NO: 16424 - DNA, 25 bp, Homo sapien
actaatacaacaagcagtctatcct

SEQ ID NO: 16425 - DNA, 25 bp, Homo sapien
actaatacacggatcttgacgaagt

SEQ ID NO: 16426 - DNA, 25 bp, Homo sapien
actaatacatggatcttgacgaagt

SEQ ID NO: 16427 - DNA, 25 bp, Homo sapien
actaataccaaccatactcaaacta

SEQ ID NO: 16428 - DNA, 25 bp, Homo sapien
actaataccaaccgtactcaaacta

SEQ ID NO: 16429 - DNA, 25 bp, Homo sapien
actaatactctgcttttggttaaga

SEQ ID NO: 16430 - DNA, 25 bp, Homo sapien
actaatactgtgcttttggttaaga

SEQ ID NO: 16431 - DNA, 25 bp, Homo sapien
actaatatcacaaagagatgttctt

SEQ ID NO: 16432 - DNA, 25 bp, Homo sapien
actaatatcacagagagatgttctt

SEQ ID NO: 16433 - DNA, 25 bp, Homo sapien
actaatatcatgaaactgattttgc

SEQ ID NO: 16434 - DNA, 25 bp, Homo sapien
actaatatcgtgaaactgattttgc

SEQ ID NO: 16435 - DNA, 25 bp, Homo sapien
actaatatggtcaactcttataaaa

SEQ ID NO: 16436 - DNA, 25 bp, Homo sapien
actaatatgttcaactcttataaaa

SEQ ID NO: 16437 - DNA, 25 bp, Homo sapien
actaatcccattctagctacatata

SEQ ID NO: 16438 - DNA, 25 bp, Homo sapien
actaatccctttctagctacatata

SEQ ID NO: 16439 - DNA, 25 bp, Homo sapien
actaatgctatgcttctattttggt

SEQ ID NO: 16440 - DNA, 25 bp, Homo sapien
actaatgctgtgcttctattttggt

SEQ ID NO: 16441 - DNA, 25 bp, Homo sapien
actaattaccaccaaagaatgtgtg

SEQ ID NO: 16442 - DNA, 25 bp, Homo sapien
actaattaccatcaaagaatgtgtg

SEQ ID NO: 16443 - DNA, 25 bp, Homo sapien
actaattcaaagctgtagtttttgt

SEQ ID NO: 16444 - DNA, 25 bp, Homo sapien
actaattcaaagttgtagtttttgt

SEQ ID NO: 16445 - DNA, 25 bp, Homo sapien
actaattcaactaatccctaacctt

SEQ ID NO: 16446 - DNA, 25 bp, Homo sapien
actaattcaactagtccctaacctt

SEQ ID NO: 16447 - DNA, 25 bp, Homo sapien
actaattgctataacgaatctaaag

SEQ ID NO: 16448 - DNA, 25 bp, Homo sapien
actaattgctataatgaatctaaag

SEQ ID NO: 16449 - DNA, 25 bp, Homo sapien
actaattttcacaatagtttgttca

SEQ ID NO: 16450 - DNA, 25 bp, Homo sapien
actaattttgtccagacctagaaac

SEQ ID NO: 16451 - DNA, 25 bp, Homo sapien
actaatttttacaatagtttgttca

SEQ ID NO: 16452 - DNA, 25 bp, Homo sapien
actaattttttccagacctagaaac

SEQ ID NO: 16453 - DNA, 25 bp, Homo sapien
actacaaaagattgaagcaaaaagg

SEQ ID NO: 16454 - DNA, 25 bp, Homo sapien
actacaaaggattgaagcaaaaagg

SEQ ID NO: 16455 - DNA, 25 bp, Homo sapien
actacaaagggagaccgcgtttagt

SEQ ID NO: 16456 - DNA, 25 bp, Homo sapien
actacaaagggagacctcgtttagt

SEQ ID NO: 16457 - DNA, 25 bp, Homo sapien
actacaagaaattatgaagctattt

SEQ ID NO: 16458 - DNA, 25 bp, Homo sapien
actacaagaaattttgaagctattt

SEQ ID NO: 16459 - DNA, 25 bp, Homo sapien
actacaaggataagaaaacaaaaag

SEQ ID NO: 16460 - DNA, 25 bp, Homo sapien
actacaaggataaggaaacaaaaag

SEQ ID NO: 16461 - DNA, 25 bp, Homo sapien
actacaatcaacagaataatgtagt

SEQ ID NO: 16462 - DNA, 25 bp, Homo sapien
actacaatcaacggaataatgtagt

SEQ ID NO: 16463 - DNA, 25 bp, Homo sapien
actacacctacaacttatagaaact

SEQ ID NO: 16464 - DNA, 25 bp, Homo sapien
actacacctacatcttatagaaact

SEQ ID NO: 16465 - DNA, 25 bp, Homo sapien
actacagaaaattggactcccccta

SEQ ID NO: 16466 - DNA, 25 bp, Homo sapien
actacagagaattggactcccccta

SEQ ID NO: 16467 - DNA, 25 bp, Homo sapien
actacatacatgagctgtagattct

SEQ ID NO: 16468 - DNA, 25 bp, Homo sapien
actacatacgtgagctgtagattct

SEQ ID NO: 16469 - DNA, 25 bp, Homo sapien
actacatataaagcgctctggaagg

SEQ ID NO: 16470 - DNA, 25 bp, Homo sapien
actacatataaagtgctctggaagg

SEQ ID NO: 16471 - DNA, 25 bp, Homo sapien
actacatcactgcagctgcaaatgt

SEQ ID NO: 16472 - DNA, 25 bp, Homo sapien
actacatcgagtgaagtcagtgttg

SEQ ID NO: 16473 - DNA, 25 bp, Homo sapien
actacatcgagtgaggtcagtgttg

SEQ ID NO: 16474 - DNA, 25 bp, Homo sapien
actacatcgctgcagctgcaaatgt

SEQ ID NO: 16475 - DNA, 25 bp, Homo sapien
actacattgagatacaccagtctaa

SEQ ID NO: 16476 - DNA, 25 bp, Homo sapien
actacattgcgatacaccagtctaa

SEQ ID NO: 16477 - DNA, 25 bp, Homo sapien
actacattttttataaaggccttga

SEQ ID NO: 16478 - DNA, 25 bp, Homo sapien
actacattttttataagggccttga

SEQ ID NO: 16479 - DNA, 25 bp, Homo sapien
actaccaacaattcatcaacgagca

SEQ ID NO: 16480 - DNA, 25 bp, Homo sapien
actaccaacaattcgtcaacgagca

SEQ ID NO: 16481 - DNA, 25 bp, Homo sapien
actaccaatgggccgaatggggcag

SEQ ID NO: 16482 - DNA, 25 bp, Homo sapien
actaccaatgggctgaatggggcag

SEQ ID NO: 16483 - DNA, 25 bp, Homo sapien
actaccactctcctgatctttcagt

SEQ ID NO: 16484 - DNA, 25 bp, Homo sapien
actaccactctcttgatctttcagt

SEQ ID NO: 16485 - DNA, 25 bp, Homo sapien
actaccatactgatgatacaaaaca

SEQ ID NO: 16486 - DNA, 25 bp, Homo sapien
actaccatactggtgatacaaaaca

SEQ ID NO: 16487 - DNA, 25 bp, Homo sapien
actacctgctatattcaagagaccc

SEQ ID NO: 16488 - DNA, 25 bp, Homo sapien
actacctgctatcttcaagagaccc

SEQ ID NO: 16489 - DNA, 25 bp, Homo sapien
actacctgtgtgaccttggagaaat

SEQ ID NO: 16490 - DNA, 25 bp, Homo sapien
actacctgtgtgtccttggagaaat

SEQ ID NO: 16491 - DNA, 25 bp, Homo sapien
actacgaacaaaaggagaacagatg

SEQ ID NO: 16492 - DNA, 25 bp, Homo sapien
actacgaacgaaaggagaacagatg

SEQ ID NO: 16493 - DNA, 25 bp, Homo sapien
actacgaacgtttcgtctttggtgg

SEQ ID NO: 16494 - DNA, 25 bp, Homo sapien
actacgaacgttttgtctttggtgg

SEQ ID NO: 16495 - DNA, 25 bp, Homo sapien
actacgcactgtttcgtgtaaggct

SEQ ID NO: 16496 - DNA, 25 bp, Homo sapien
actacgcactgttttgtgtaaggct

SEQ ID NO: 16497 - DNA, 25 bp, Homo sapien
actacggcattttcttttttttgcc

SEQ ID NO: 16498 - DNA, 25 bp, Homo sapien
actacggcatttttttttttttgcc

SEQ ID NO: 16499 - DNA, 25 bp, Homo sapien
actacgtggacagcaaatctagaat

SEQ ID NO: 16500 - DNA, 25 bp, Homo sapien
actacgtgggcagcaaatctagaat

SEQ ID NO: 16501 - DNA, 25 bp, Homo sapien
actactaaaatcagccttttttcat

SEQ ID NO: 16502 - DNA, 25 bp, Homo sapien
actactaaaatcaggcttttttcat

SEQ ID NO: 16503 - DNA, 25 bp, Homo sapien
actactaacgcagtaacagtacaaa

SEQ ID NO: 16504 - DNA, 25 bp, Homo sapien
actactaacgcagtgacagtacaaa

SEQ ID NO: 16505 - DNA, 25 bp, Homo sapien
actactactctgaatttgagaattt

SEQ ID NO: 16506 - DNA, 25 bp, Homo sapien
actactactttgaatttgagaattt

SEQ ID NO: 16507 - DNA, 25 bp, Homo sapien
actactcaataatttatccagctga

SEQ ID NO: 16508 - DNA, 25 bp, Homo sapien
actactcagtaatttatccagctga

SEQ ID NO: 16509 - DNA, 25 bp, Homo sapien
actactgatttgcactacaaaaggg

SEQ ID NO: 16510 - DNA, 25 bp, Homo sapien
actactgatttgcgctacaaaaggg

SEQ ID NO: 16511 - DNA, 25 bp, Homo sapien
actactgcagggtaatcagagtagc

SEQ ID NO: 16512 - DNA, 25 bp, Homo sapien
actactgccacagtacagccaggtt

SEQ ID NO: 16513 - DNA, 25 bp, Homo sapien
actactgccacggtacagccaggtt

SEQ ID NO: 16514 - DNA, 25 bp, Homo sapien
actactgcggggtaatcagagtagc

SEQ ID NO: 16515 - DNA, 25 bp, Homo sapien
actactgtccttgttgttcaaaaag

SEQ ID NO: 16516 - DNA, 25 bp, Homo sapien
actactgtcgttgttgttcaaaaag

SEQ ID NO: 16517 - DNA, 25 bp, Homo sapien
actactgtgaagctccaacagtccc

SEQ ID NO: 16518 - DNA, 25 bp, Homo sapien
actactgtgaagctgcaacagtccc

SEQ ID NO: 16519 - DNA, 25 bp, Homo sapien
actactgtgccaatgtattaaccag

SEQ ID NO: 16520 - DNA, 25 bp, Homo sapien
actactgtgccattgtattaaccag

SEQ ID NO: 16521 - DNA, 25 bp, Homo sapien
actactgttaatgaatatactgctt

SEQ ID NO: 16522 - DNA, 25 bp, Homo sapien
actactgttaatggatatactgctt

SEQ ID NO: 16523 - DNA, 25 bp, Homo sapien
actacttaatactgagccaagtaac

SEQ ID NO: 16524 - DNA, 25 bp, Homo sapien
actacttactactgagccaagtaac

SEQ ID NO: 16525 - DNA, 25 bp, Homo sapien
actacttgactttcaacattataca

SEQ ID NO: 16526 - DNA, 25 bp, Homo sapien
actacttgacttttaacattataca

SEQ ID NO: 16527 - DNA, 25 bp, Homo sapien
actacttgcttcctggacttgccat

SEQ ID NO: 16528 - DNA, 25 bp, Homo sapien
actacttgcttcgtggacttgccat

SEQ ID NO: 16529 - DNA, 25 bp, Homo sapien
actactttacctgctctttcactta

SEQ ID NO: 16530 - DNA, 25 bp, Homo sapien
actactttacctgttctttcactta

SEQ ID NO: 16531 - DNA, 25 bp, Homo sapien
actactttttataaatgttgaacac

SEQ ID NO: 16532 - DNA, 25 bp, Homo sapien
actactttttataaattttgaacac

SEQ ID NO: 16533 - DNA, 25 bp, Homo sapien
actagaaatgtatagcctttgtctt

SEQ ID NO: 16534 - DNA, 25 bp, Homo sapien
actagaaatttatagcctttgtctt

SEQ ID NO: 16535 - DNA, 25 bp, Homo sapien
actagaacaatggtgctggagaaag

SEQ ID NO: 16536 - DNA, 25 bp, Homo sapien
actagaacgatggtgctggagaaag

SEQ ID NO: 16537 - DNA, 25 bp, Homo sapien
actagaagctacctttttcctagga

SEQ ID NO: 16538 - DNA, 25 bp, Homo sapien
actagaagctacttttttcctagga

SEQ ID NO: 16539 - DNA, 25 bp, Homo sapien
actagaaggatgctcaccaaatgcc

SEQ ID NO: 16540 - DNA, 25 bp, Homo sapien
actagaagtatgctcaccaaatgcc

SEQ ID NO: 16541 - DNA, 25 bp, Homo sapien
actagaatagcagagaaaatgaaga

SEQ ID NO: 16542 - DNA, 25 bp, Homo sapien
actagaatagcagagataatgaaga

SEQ ID NO: 16543 - DNA, 25 bp, Homo sapien
actagaatcaattaactccagtgcc

SEQ ID NO: 16544 - DNA, 25 bp, Homo sapien
actagaatgaattaactccagtgcc

SEQ ID NO: 16545 - DNA, 25 bp, Homo sapien
actagaattatgctcatattacagg

SEQ ID NO: 16546 - DNA, 25 bp, Homo sapien
actagaattatgctgatattacagg

SEQ ID NO: 16547 - DNA, 25 bp, Homo sapien
actagaatttgaaagacgctaagaa

SEQ ID NO: 16548 - DNA, 25 bp, Homo sapien
actagaatttgaaagatgctaagaa

SEQ ID NO: 16549 - DNA, 25 bp, Homo sapien
actagaccagccttaaaagagatcc

SEQ ID NO: 16550 - DNA, 25 bp, Homo sapien
actagaccagccttaacagagatcc

SEQ ID NO: 16551 - DNA, 25 bp, Homo sapien
actagacgaaactttcttttgattg

SEQ ID NO: 16552 - DNA, 25 bp, Homo sapien
actagacgagactttcttttgattg

SEQ ID NO: 16553 - DNA, 25 bp, Homo sapien
actagagcagaaaagaatggtcaaa

SEQ ID NO: 16554 - DNA, 25 bp, Homo sapien
actagagcagagaagaatggtcaaa

SEQ ID NO: 16555 - DNA, 25 bp, Homo sapien
actagatggagtgtgttttataaag

SEQ ID NO: 16556 - DNA, 25 bp, Homo sapien
actagatggagtttgttttataaag

SEQ ID NO: 16557 - DNA, 25 bp, Homo sapien
actagatgttcagcgtatttgggag

SEQ ID NO: 16558 - DNA, 25 bp, Homo sapien
actagatgttcagtgtatttgggag

SEQ ID NO: 16559 - DNA, 25 bp, Homo sapien
actagcacatcctgaatgacaaggt

SEQ ID NO: 16560 - DNA, 25 bp, Homo sapien
actagcacatcttgaatgacaaggt

SEQ ID NO: 16561 - DNA, 25 bp, Homo sapien
actagccacatagaataagtttgga

SEQ ID NO: 16562 - DNA, 25 bp, Homo sapien
actagccacgtagaataagtttgga

SEQ ID NO: 16563 - DNA, 25 bp, Homo sapien
actagccagcggacaaatggcagat

SEQ ID NO: 16564 - DNA, 25 bp, Homo sapien
actagccagcggccaaatggcagat

SEQ ID NO: 16565 - DNA, 25 bp, Homo sapien
actagctaaaaatcctttaaatcag

SEQ ID NO: 16566 - DNA, 25 bp, Homo sapien
actagctaaaaatcttttaaatcag

SEQ ID NO: 16567 - DNA, 25 bp, Homo sapien
actagctctgtcataagagtcacag

SEQ ID NO: 16568 - DNA, 25 bp, Homo sapien
actagctctgtcgtaagagtcacag

SEQ ID NO: 16569 - DNA, 25 bp, Homo sapien
actagctgatacagttaagcctaag

SEQ ID NO: 16570 - DNA, 25 bp, Homo sapien
actagctgcatatataatcctgtga

SEQ ID NO: 16571 - DNA, 25 bp, Homo sapien
actagctgcatatgtaatcctgtga

SEQ ID NO: 16572 - DNA, 25 bp, Homo sapien
actagctggtacagttaagcctaag

SEQ ID NO: 16573 - DNA, 25 bp, Homo sapien
actaggaactccagctgctgctgtg

SEQ ID NO: 16574 - DNA, 25 bp, Homo sapien
actaggaactctagctgctgctgtg

SEQ ID NO: 16575 - DNA, 25 bp, Homo sapien
actaggaggcaacggcgagggagct

SEQ ID NO: 16576 - DNA, 25 bp, Homo sapien
actaggaggcaatggcgagggagct

SEQ ID NO: 16577 - DNA, 25 bp, Homo sapien
actaggctctgaggagataattaaa

SEQ ID NO: 16578 - DNA, 25 bp, Homo sapien
actaggctttgaggagataattaaa

SEQ ID NO: 16579 - DNA, 25 bp, Homo sapien
actagggcttgaaatagatctttct

SEQ ID NO: 16580 - DNA, 25 bp, Homo sapien
actagggcttgagatagatctttct

SEQ ID NO: 16581 - DNA, 25 bp, Homo sapien
actaggggtcttaaacttgctagga

SEQ ID NO: 16582 - DNA, 25 bp, Homo sapien
actaggggtcttaagcttgctagga

SEQ ID NO: 16583 - DNA, 25 bp, Homo sapien
actaggtacctgtcctgagcatgca

SEQ ID NO: 16584 - DNA, 25 bp, Homo sapien
actaggtacgtgtcctgagcatgca

SEQ ID NO: 16585 - DNA, 25 bp, Homo sapien
actaggtactacggaggagacaaca

SEQ ID NO: 16586 - DNA, 25 bp, Homo sapien
actaggtactatggaggagacaaca

SEQ ID NO: 16587 - DNA, 25 bp, Homo sapien
actaggtccgtgttaagtgtattct

SEQ ID NO: 16588 - DNA, 25 bp, Homo sapien
actaggtctgcagtagaggctgtgc

SEQ ID NO: 16589 - DNA, 25 bp, Homo sapien
actaggtctgcggtagaggctgtgc

SEQ ID NO: 16590 - DNA, 25 bp, Homo sapien
actaggtctgtgttaagtgtattct

SEQ ID NO: 16591 - DNA, 25 bp, Homo sapien
actaggtgctggatgtgctggagaa

SEQ ID NO: 16592 - DNA, 25 bp, Homo sapien
actaggtgttggatgtgctggagaa

SEQ ID NO: 16593 - DNA, 25 bp, Homo sapien
actaggttcctaagagcaaggaagt

SEQ ID NO: 16594 - DNA, 25 bp, Homo sapien
actaggttcctacgagcaaggaagt

SEQ ID NO: 16595 - DNA, 25 bp, Homo sapien
actagtaatcactcactctgctatt

SEQ ID NO: 16596 - DNA, 25 bp, Homo sapien
actagtaatcactctctctgctatt

SEQ ID NO: 16597 - DNA, 25 bp, Homo sapien
actagtggcacctcttcaccttcca

SEQ ID NO: 16598 - DNA, 25 bp, Homo sapien
actagtggcacctcttgaccttcca

SEQ ID NO: 16599 - DNA, 25 bp, Homo sapien
actagttcactcgaaaatgcaggaa

SEQ ID NO: 16600 - DNA, 25 bp, Homo sapien
actagttcacttgaaaatgcaggaa

SEQ ID NO: 16601 - DNA, 25 bp, Homo sapien
actagttcatcttctataagatcag

SEQ ID NO: 16602 - DNA, 25 bp, Homo sapien
actagttcgtcttctataagatcag

SEQ ID NO: 16603 - DNA, 25 bp, Homo sapien
actagttgcctagactataaacttt

SEQ ID NO: 16604 - DNA, 25 bp, Homo sapien
actagttgcctagactgtaaacttt

SEQ ID NO: 16605 - DNA, 25 bp, Homo sapien
actagtttaatgaagtatggttgca

SEQ ID NO: 16606 - DNA, 25 bp, Homo sapien
actagtttaatgacgtatggttgca

SEQ ID NO: 16607 - DNA, 25 bp, Homo sapien
actagtttccattacagaggtcttt

SEQ ID NO: 16608 - DNA, 25 bp, Homo sapien
actagtttccattatagaggtcttt

SEQ ID NO: 16609 - DNA, 25 bp, Homo sapien
actataaagaagaacaaagtgtggc

SEQ ID NO: 16610 - DNA, 25 bp, Homo sapien
actataaagaagaccaaagtgtggc

SEQ ID NO: 16611 - DNA, 25 bp, Homo sapien
actataaagtcacacactcttggat

SEQ ID NO: 16612 - DNA, 25 bp, Homo sapien
actataaagtcagacactcttggat

SEQ ID NO: 16613 - DNA, 25 bp, Homo sapien
actataacacaaagcaagatgtgat

SEQ ID NO: 16614 - DNA, 25 bp, Homo sapien
actataacacaaagcaggatgtgat

SEQ ID NO: 16615 - DNA, 25 bp, Homo sapien
actataactccaaagctcatttgat

SEQ ID NO: 16616 - DNA, 25 bp, Homo sapien
actataactccaatgctcatttgat

SEQ ID NO: 16617 - DNA, 25 bp, Homo sapien
actataatcatggcagatgaaataa

SEQ ID NO: 16618 - DNA, 25 bp, Homo sapien
actataatcatggcggatgaaataa

SEQ ID NO: 16619 - DNA, 25 bp, Homo sapien
actataattggtgattcctatcatc

SEQ ID NO: 16620 - DNA, 25 bp, Homo sapien
actataattggtggttcctatcatc

SEQ ID NO: 16621 - DNA, 25 bp, Homo sapien
actataattgtactgaggaatcatt

SEQ ID NO: 16622 - DNA, 25 bp, Homo sapien
actataattgtagtgaggaatcatt

SEQ ID NO: 16623 - DNA, 25 bp, Homo sapien
actatacaaaactcaatacccttca

SEQ ID NO: 16624 - DNA, 25 bp, Homo sapien
actatacaaaactccatacccttca

SEQ ID NO: 16625 - DNA, 25 bp, Homo sapien
actatactatgtttggcaagcatgt

SEQ ID NO: 16626 - DNA, 25 bp, Homo sapien
actatactatgtttggtaagcatgt

SEQ ID NO: 16627 - DNA, 25 bp, Homo sapien
actatactttggttcaaaagcgggg

SEQ ID NO: 16628 - DNA, 25 bp, Homo sapien
actatactttggtttaaaagcgggg

SEQ ID NO: 16629 - DNA, 25 bp, Homo sapien
actatagatacaaattcaggaaagc

SEQ ID NO: 16630 - DNA, 25 bp, Homo sapien
actatagatacgaattcaggaaagc

SEQ ID NO: 16631 - DNA, 25 bp, Homo sapien
actataggaggcgctggaaatgtaa

SEQ ID NO: 16632 - DNA, 25 bp, Homo sapien
actataggaggtgctggaaatgtaa

SEQ ID NO: 16633 - DNA, 25 bp, Homo sapien
actataggcatcagaaatgtgagaa

SEQ ID NO: 16634 - DNA, 25 bp, Homo sapien
actataggcattagaaatgtgagaa

SEQ ID NO: 16635 - DNA, 25 bp, Homo sapien
actataggtgtgctagaatgtactc

SEQ ID NO: 16636 - DNA, 25 bp, Homo sapien
actataggtgtgttagaatgtactc

SEQ ID NO: 16637 - DNA, 25 bp, Homo sapien
actatagtgggaccaaagagagaga

SEQ ID NO: 16638 - DNA, 25 bp, Homo sapien
actatagtgggatcaaagagagaga

SEQ ID NO: 16639 - DNA, 25 bp, Homo sapien
actatataatagaactgcagccttc

SEQ ID NO: 16640 - DNA, 25 bp, Homo sapien
actatatacgtttatggccttcagg

SEQ ID NO: 16641 - DNA, 25 bp, Homo sapien
actatatatgtttatggccttcagg

SEQ ID NO: 16642 - DNA, 25 bp, Homo sapien
actatatattagaactgcagccttc

SEQ ID NO: 16643 - DNA, 25 bp, Homo sapien
actatatgaatgtaagctggatgta

SEQ ID NO: 16644 - DNA, 25 bp, Homo sapien
actatatgaatgtaagttggatgta

SEQ ID NO: 16645 - DNA, 25 bp, Homo sapien
actatatgagtactaatagcagttt

SEQ ID NO: 16646 - DNA, 25 bp, Homo sapien
actatatgccaaatactgtgaagtg

SEQ ID NO: 16647 - DNA, 25 bp, Homo sapien
actatatgccaattactgtgaagtg

SEQ ID NO: 16648 - DNA, 25 bp, Homo sapien
actatatgggtactaatagcagttt

SEQ ID NO: 16649 - DNA, 25 bp, Homo sapien
actatattatctttatgcagtatcc

SEQ ID NO: 16650 - DNA, 25 bp, Homo sapien
actatattatctttgtgcagtatcc

SEQ ID NO: 16651 - DNA, 25 bp, Homo sapien
actatcaaaacatacgaaaacctaa

SEQ ID NO: 16652 - DNA, 25 bp, Homo sapien
actatcaaaacatatgaaaacctaa

SEQ ID NO: 16653 - DNA, 25 bp, Homo sapien
actatcaagcacgttcatgaggagt

SEQ ID NO: 16654 - DNA, 25 bp, Homo sapien
actatcaagcactttcatgaggagt

SEQ ID NO: 16655 - DNA, 25 bp, Homo sapien
actatcactatgcctacttgtaata

SEQ ID NO: 16656 - DNA, 25 bp, Homo sapien
actatcactatgcctatttgtaata

SEQ ID NO: 16657 - DNA, 25 bp, Homo sapien
actatcactggcctgactaccactg

SEQ ID NO: 16658 - DNA, 25 bp, Homo sapien
actatcactggcttgactaccactg

SEQ ID NO: 16659 - DNA, 25 bp, Homo sapien
actatcatctactacccattctaga

SEQ ID NO: 16660 - DNA, 25 bp, Homo sapien
actatcatttactacccattctaga

SEQ ID NO: 16661 - DNA, 25 bp, Homo sapien
actatccaaagaaggcataagttgt

SEQ ID NO: 16662 - DNA, 25 bp, Homo sapien
actatccaaagatggcataagttgt

SEQ ID NO: 16663 - DNA, 25 bp, Homo sapien
actatccataattctgtttcttttt

SEQ ID NO: 16664 - DNA, 25 bp, Homo sapien
actatccataattttgtttcttttt

SEQ ID NO: 16665 - DNA, 25 bp, Homo sapien
actatccatagagaagtttgtttga

SEQ ID NO: 16666 - DNA, 25 bp, Homo sapien
actatccatagcaggcttcttggcc

SEQ ID NO: 16667 - DNA, 25 bp, Homo sapien
actatccatagggaagtttgtttga

SEQ ID NO: 16668 - DNA, 25 bp, Homo sapien
actatccatcgcaggcttcttggcc

SEQ ID NO: 16669 - DNA, 25 bp, Homo sapien
actatcccagtttataagcagccct

SEQ ID NO: 16670 - DNA, 25 bp, Homo sapien
actatcccagtttctaagcagccct

SEQ ID NO: 16671 - DNA, 25 bp, Homo sapien
actatccttggcaagagttcactgc

SEQ ID NO: 16672 - DNA, 25 bp, Homo sapien
actatccttggcgagagttcactgc

SEQ ID NO: 16673 - DNA, 25 bp, Homo sapien
actatctaactcagaccaatgggtg

SEQ ID NO: 16674 - DNA, 25 bp, Homo sapien
actatctaactcataccaatgggtg

SEQ ID NO: 16675 - DNA, 25 bp, Homo sapien
actatctctctccgttgcatcatat

SEQ ID NO: 16676 - DNA, 25 bp, Homo sapien
actatctctctctgttgcatcatat

SEQ ID NO: 16677 - DNA, 25 bp, Homo sapien
actatctggtttttgtctcagttct

SEQ ID NO: 16678 - DNA, 25 bp, Homo sapien
actatctgtattacactttaaagca

SEQ ID NO: 16679 - DNA, 25 bp, Homo sapien
actatctgtattatactttaaagca

SEQ ID NO: 16680 - DNA, 25 bp, Homo sapien
actatctgttttttgtctcagttct

SEQ ID NO: 16681 - DNA, 25 bp, Homo sapien
actatcttcctcattttcctgttac

SEQ ID NO: 16682 - DNA, 25 bp, Homo sapien
actatcttgatcccctgaaaaaaag

SEQ ID NO: 16683 - DNA, 25 bp, Homo sapien
actatcttgatctcctgaaaaaaag

SEQ ID NO: 16684 - DNA, 25 bp, Homo sapien
actatctttctcattttcctgttac

SEQ ID NO: 16685 - DNA, 25 bp, Homo sapien
actatgaacgatattgaggtgactg

SEQ ID NO: 16686 - DNA, 25 bp, Homo sapien
actatgaacgatgttgaggtgactg

SEQ ID NO: 16687 - DNA, 25 bp, Homo sapien
actatgaattgacaatttgtagcct

SEQ ID NO: 16688 - DNA, 25 bp, Homo sapien
actatgaattggcaatttgtagcct

SEQ ID NO: 16689 - DNA, 25 bp, Homo sapien
actatgactaaaaaaatgcacatcc

SEQ ID NO: 16690 - DNA, 25 bp, Homo sapien
actatgactaaaacaatgcacatcc

SEQ ID NO: 16691 - DNA, 25 bp, Homo sapien
actatgagcgtccaggcagctagca

SEQ ID NO: 16692 - DNA, 25 bp, Homo sapien
actatgaggccacggaaagggtgga

SEQ ID NO: 16693 - DNA, 25 bp, Homo sapien
actatgaggccatggaaagggtgga

SEQ ID NO: 16694 - DNA, 25 bp, Homo sapien
actatgagggtccaggcagctagca

SEQ ID NO: 16695 - DNA, 25 bp, Homo sapien
actatgatttacgaaattcacatat

SEQ ID NO: 16696 - DNA, 25 bp, Homo sapien
actatgatttatgaaattcacatat

SEQ ID NO: 16697 - DNA, 25 bp, Homo sapien
actatgcccaacatgttttcatttc

SEQ ID NO: 16698 - DNA, 25 bp, Homo sapien
actatgcccaatatgttttcatttc

SEQ ID NO: 16699 - DNA, 25 bp, Homo sapien
actatgccctttcactctttgtctt

SEQ ID NO: 16700 - DNA, 25 bp, Homo sapien
actatgccgtgctaatttttttttt

SEQ ID NO: 16701 - DNA, 25 bp, Homo sapien
actatgcctacccgattctgatagt

SEQ ID NO: 16702 - DNA, 25 bp, Homo sapien
actatgcctacctgattctgatagt

SEQ ID NO: 16703 - DNA, 25 bp, Homo sapien
actatgcctctccactcgcaaagtc

SEQ ID NO: 16704 - DNA, 25 bp, Homo sapien
actatgcctctctactcgcaaagtc

SEQ ID NO: 16705 - DNA, 25 bp, Homo sapien
actatgcctgtgatgtgactaactt

SEQ ID NO: 16706 - DNA, 25 bp, Homo sapien
actatgcctgtgatttgactaactt

SEQ ID NO: 16707 - DNA, 25 bp, Homo sapien
actatgccttgctaatttttttttt

SEQ ID NO: 16708 - DNA, 25 bp, Homo sapien
actatgccttttcactctttgtctt

SEQ ID NO: 16709 - DNA, 25 bp, Homo sapien
actatgctacactacacaacttgat

SEQ ID NO: 16710 - DNA, 25 bp, Homo sapien
actatgctacactatacaacttgat

SEQ ID NO: 16711 - DNA, 25 bp, Homo sapien
actatgctatatcttatatgatggt

SEQ ID NO: 16712 - DNA, 25 bp, Homo sapien
actatgctgtatcttatatgatggt

SEQ ID NO: 16713 - DNA, 25 bp, Homo sapien
actatggaaactaatatctttgaac

SEQ ID NO: 16714 - DNA, 25 bp, Homo sapien
actatggaaactagtatctttgaac

SEQ ID NO: 16715 - DNA, 25 bp, Homo sapien
actatggatacctgggttctaatct

SEQ ID NO: 16716 - DNA, 25 bp, Homo sapien
actatggatacctgtgttctaatct

SEQ ID NO: 16717 - DNA, 25 bp, Homo sapien
actatggcagcaaatcctgcaaaat

SEQ ID NO: 16718 - DNA, 25 bp, Homo sapien
actatggcggcaaatcctgcaaaat

SEQ ID NO: 16719 - DNA, 25 bp, Homo sapien
actatgggaagacttctgcattgaa

SEQ ID NO: 16720 - DNA, 25 bp, Homo sapien
actatgggaagccttctgcattgaa

SEQ ID NO: 16721 - DNA, 25 bp, Homo sapien
actatggtctctgagtgatagtgat

SEQ ID NO: 16722 - DNA, 25 bp, Homo sapien
actatggtctcttagtgatagtgat

SEQ ID NO: 16723 - DNA, 25 bp, Homo sapien
actatgtaaggttactcaagggttt

SEQ ID NO: 16724 - DNA, 25 bp, Homo sapien
actatgtaatgttactcaagggttt

SEQ ID NO: 16725 - DNA, 25 bp, Homo sapien
actatgtcctcaatatccaattcac

SEQ ID NO: 16726 - DNA, 25 bp, Homo sapien
actatgtcctcagtatccaattcac

SEQ ID NO: 16727 - DNA, 25 bp, Homo sapien
actatgtggcaacaaatggtggaaa

SEQ ID NO: 16728 - DNA, 25 bp, Homo sapien
actatgtggcaataaatggtggaaa

SEQ ID NO: 16729 - DNA, 25 bp, Homo sapien
actatgtttggcaagcatgtgggaa

SEQ ID NO: 16730 - DNA, 25 bp, Homo sapien
actatgtttggtaagcatgtgggaa

SEQ ID NO: 16731 - DNA, 25 bp, Homo sapien
actattaacttacccaatccttaca

SEQ ID NO: 16732 - DNA, 25 bp, Homo sapien
actattaacttacctaatccttaca

SEQ ID NO: 16733 - DNA, 25 bp, Homo sapien
actattaccaggcaaatatatgaag

SEQ ID NO: 16734 - DNA, 25 bp, Homo sapien
actattactaggcaaatatatgaag

SEQ ID NO: 16735 - DNA, 25 bp, Homo sapien
actattactccacacttcaaggtca

SEQ ID NO: 16736 - DNA, 25 bp, Homo sapien
actattactccatacttcaaggtca

SEQ ID NO: 16737 - DNA, 25 bp, Homo sapien
actattatggactaaacattgggtc

SEQ ID NO: 16738 - DNA, 25 bp, Homo sapien
actattatggactagacattgggtc

SEQ ID NO: 16739 - DNA, 25 bp, Homo sapien
actattatgtggagaagcaactgct

SEQ ID NO: 16740 - DNA, 25 bp, Homo sapien
actattatgtggaggagcaactgct

SEQ ID NO: 16741 - DNA, 25 bp, Homo sapien
actattccaaaaacaatgcccgcaa

SEQ ID NO: 16742 - DNA, 25 bp, Homo sapien
actattccaaagacaatgcccgcaa

SEQ ID NO: 16743 - DNA, 25 bp, Homo sapien
actattccggtattctagctactct

SEQ ID NO: 16744 - DNA, 25 bp, Homo sapien
actattcctgtattctagctactct

SEQ ID NO: 16745 - DNA, 25 bp, Homo sapien
actattcttttccaactgaattgtc

SEQ ID NO: 16746 - DNA, 25 bp, Homo sapien
actattcttttccgactgaattgtc

SEQ ID NO: 16747 - DNA, 25 bp, Homo sapien
actattgaaggtgctgtcattgttg

SEQ ID NO: 16748 - DNA, 25 bp, Homo sapien
actattgaaggttctgtcattgttg

SEQ ID NO: 16749 - DNA, 25 bp, Homo sapien
actattgctcagttattctcattca

SEQ ID NO: 16750 - DNA, 25 bp, Homo sapien
actattgctcatttattctcattca

SEQ ID NO: 16751 - DNA, 25 bp, Homo sapien
actattggaaagggcctccgaacag

SEQ ID NO: 16752 - DNA, 25 bp, Homo sapien
actattggcaagggcctccgaacag

SEQ ID NO: 16753 - DNA, 25 bp, Homo sapien
actatttattacataccaactcaag

SEQ ID NO: 16754 - DNA, 25 bp, Homo sapien
actatttattacctaccaactcaag

SEQ ID NO: 16755 - DNA, 25 bp, Homo sapien
actatttattgacgtaccagatggt

SEQ ID NO: 16756 - DNA, 25 bp, Homo sapien
actatttattgaggtaccagatggt

SEQ ID NO: 16757 - DNA, 25 bp, Homo sapien
actatttcagttttctccttctgcc

SEQ ID NO: 16758 - DNA, 25 bp, Homo sapien
actatttcagttttgtccttctgcc

SEQ ID NO: 16759 - DNA, 25 bp, Homo sapien
actatttccacatctcattggcctt

SEQ ID NO: 16760 - DNA, 25 bp, Homo sapien
actatttccacgtctcattggcctt

SEQ ID NO: 16761 - DNA, 25 bp, Homo sapien
actatttctatttagccaaccataa

SEQ ID NO: 16762 - DNA, 25 bp, Homo sapien
actatttctgtttagccaaccataa

SEQ ID NO: 16763 - DNA, 25 bp, Homo sapien
actatttgcttaaaaaggaatgcaa

SEQ ID NO: 16764 - DNA, 25 bp, Homo sapien
actatttgcttgaaaaggaatgcaa

SEQ ID NO: 16765 - DNA, 25 bp, Homo sapien
actatttgcttggcctcggaaccca

SEQ ID NO: 16766 - DNA, 25 bp, Homo sapien
actatttgcttggccttggaaccca

SEQ ID NO: 16767 - DNA, 25 bp, Homo sapien
actattttaaaacgaggtaagagtt

SEQ ID NO: 16768 - DNA, 25 bp, Homo sapien
actattttaaaacgagttaagagtt

SEQ ID NO: 16769 - DNA, 25 bp, Homo sapien
actattttaagctcaccgttgagag

SEQ ID NO: 16770 - DNA, 25 bp, Homo sapien
actattttaagctcactgttgagag

SEQ ID NO: 16771 - DNA, 25 bp, Homo sapien
actattttgccatctatcaaggtat

SEQ ID NO: 16772 - DNA, 25 bp, Homo sapien
actattttgccgtctatcaaggtat

SEQ ID NO: 16773 - DNA, 25 bp, Homo sapien
actcaaaaaaagtctgaagaagaga

SEQ ID NO: 16774 - DNA, 25 bp, Homo sapien
actcaaaacaagtctgaagaagaga

SEQ ID NO: 16775 - DNA, 25 bp, Homo sapien
actcaaaatcatcttcagacagcta

SEQ ID NO: 16776 - DNA, 25 bp, Homo sapien
actcaaaatcattttcagacagcta

SEQ ID NO: 16777 - DNA, 25 bp, Homo sapien
actcaaaatgaccgtgaaaggagat

SEQ ID NO: 16778 - DNA, 25 bp, Homo sapien
actcaaaatgacggtgaaaggagat

SEQ ID NO: 16779 - DNA, 25 bp, Homo sapien
actcaaacatgatataaacagtgaa

SEQ ID NO: 16780 - DNA, 25 bp, Homo sapien
actcaaacatggtataaacagtgaa

SEQ ID NO: 16781 - DNA, 25 bp, Homo sapien
actcaaagaacaatgacgactataa

SEQ ID NO: 16782 - DNA, 25 bp, Homo sapien
actcaaagaacaatgatgactataa

SEQ ID NO: 16783 - DNA, 25 bp, Homo sapien
actcaaagttccggtggctctggtg

SEQ ID NO: 16784 - DNA, 25 bp, Homo sapien
actcaaagttctggtggctctggtg

SEQ ID NO: 16785 - DNA, 25 bp, Homo sapien
actcaaatataagtagacataagta

SEQ ID NO: 16786 - DNA, 25 bp, Homo sapien
actcaaatgtaagtagacataagta

SEQ ID NO: 16787 - DNA, 25 bp, Homo sapien
actcaaatgtcaatttcctctggca

SEQ ID NO: 16788 - DNA, 25 bp, Homo sapien
actcaaatgtcagtttcctctggca

SEQ ID NO: 16789 - DNA, 25 bp, Homo sapien
actcaacaaaaccgatagctgagtg

SEQ ID NO: 16790 - DNA, 25 bp, Homo sapien
actcaacaaaactgatagctgagtg

SEQ ID NO: 16791 - DNA, 25 bp, Homo sapien
actcaacaagatacatatttactca

SEQ ID NO: 16792 - DNA, 25 bp, Homo sapien
actcaacaagatacttatttactca

SEQ ID NO: 16793 - DNA, 25 bp, Homo sapien
actcaaccatgctacaaatgtttat

SEQ ID NO: 16794 - DNA, 25 bp, Homo sapien
actcaaccatgctacagatgtttat

SEQ ID NO: 16795 - DNA, 25 bp, Homo sapien
actcaagaaatatacatccatcatc

SEQ ID NO: 16796 - DNA, 25 bp, Homo sapien
actcaagaaatatatatccatcatc

SEQ ID NO: 16797 - DNA, 25 bp, Homo sapien
actcaagccacaatattcacattat

SEQ ID NO: 16798 - DNA, 25 bp, Homo sapien
actcaagccacagtattcacattat

SEQ ID NO: 16799 - DNA, 25 bp, Homo sapien
actcaaggaattgaaagaaataatg

SEQ ID NO: 16800 - DNA, 25 bp, Homo sapien
actcaaggaattgcaagaaataatg

SEQ ID NO: 16801 - DNA, 25 bp, Homo sapien
actcaaggatggccaggtgtgttcc

SEQ ID NO: 16802 - DNA, 25 bp, Homo sapien
actcaaggatggtcaggtgtgttcc

SEQ ID NO: 16803 - DNA, 25 bp, Homo sapien
actcaagttgatataggtttaagtt

SEQ ID NO: 16804 - DNA, 25 bp, Homo sapien
actcaagttgatgtaggtttaagtt

SEQ ID NO: 16805 - DNA, 25 bp, Homo sapien
actcaataattctatcattttgtca

SEQ ID NO: 16806 - DNA, 25 bp, Homo sapien
actcaataattctatccttttgtca

SEQ ID NO: 16807 - DNA, 25 bp, Homo sapien
actcaatacggcggcaggttctgca

SEQ ID NO: 16808 - DNA, 25 bp, Homo sapien
actcaatacggtggcaggttctgca

SEQ ID NO: 16809 - DNA, 25 bp, Homo sapien
actcaatgaagattcagagggctgc

SEQ ID NO: 16810 - DNA, 25 bp, Homo sapien
actcaatgaaggttcagagggctgc

SEQ ID NO: 16811 - DNA, 25 bp, Homo sapien
actcaattagacatttgtcagcaca

SEQ ID NO: 16812 - DNA, 25 bp, Homo sapien
actcaattagacttttgtcagcaca

SEQ ID NO: 16813 - DNA, 25 bp, Homo sapien
actcaattcgtgctcagcatgcgag

SEQ ID NO: 16814 - DNA, 25 bp, Homo sapien
actcaatttgtgctcagcatgcgag

SEQ ID NO: 16815 - DNA, 25 bp, Homo sapien
actcacaaaggacgtgtctctcaca

SEQ ID NO: 16816 - DNA, 25 bp, Homo sapien
actcacaaaggatgtgtctctcaca

SEQ ID NO: 16817 - DNA, 25 bp, Homo sapien
actcacaaccaggatgtcaggaggg

SEQ ID NO: 16818 - DNA, 25 bp, Homo sapien
actcacaatcaggatgtcaggaggg

SEQ ID NO: 16819 - DNA, 25 bp, Homo sapien
actcacaattcagcatacccagttt

SEQ ID NO: 16820 - DNA, 25 bp, Homo sapien
actcacaattcagtatacccagttt

SEQ ID NO: 16821 - DNA, 25 bp, Homo sapien
actcacacaaaactactgcttcatc

SEQ ID NO: 16822 - DNA, 25 bp, Homo sapien
actcacacaaaattactgcttcatc

SEQ ID NO: 16823 - DNA, 25 bp, Homo sapien
actcacaccaccaatgaggcagttc

SEQ ID NO: 16824 - DNA, 25 bp, Homo sapien
actcacaccgccaatgaggcagttc

SEQ ID NO: 16825 - DNA, 25 bp, Homo sapien
actcacagatcacatatcggcagag

SEQ ID NO: 16826 - DNA, 25 bp, Homo sapien
actcacagatcatatatcggcagag

SEQ ID NO: 16827 - DNA, 25 bp, Homo sapien
actcacaggactcaaaaaagctgtt

SEQ ID NO: 16828 - DNA, 25 bp, Homo sapien
actcacagggctcaaaaaagctgtt

SEQ ID NO: 16829 - DNA, 25 bp, Homo sapien
actcacagtttcaaagtgtttcaaa

SEQ ID NO: 16830 - DNA, 25 bp, Homo sapien
actcacagtttcgaagtgtttcaaa

SEQ ID NO: 16831 - DNA, 25 bp, Homo sapien
actcacatgcaagtattgacataga

SEQ ID NO: 16832 - DNA, 25 bp, Homo sapien
actcacatgcaattattgacataga

SEQ ID NO: 16833 - DNA, 25 bp, Homo sapien
actcacccacaagcagcatgagggc

SEQ ID NO: 16834 - DNA, 25 bp, Homo sapien
actcacccacaagcggcatgagggc

SEQ ID NO: 16835 - DNA, 25 bp, Homo sapien
actcacccatggaaagttatggaat

SEQ ID NO: 16836 - DNA, 25 bp, Homo sapien
actcacccatgggaagttatggaat

SEQ ID NO: 16837 - DNA, 25 bp, Homo sapien
actcactattcccacagaggctgtg

SEQ ID NO: 16838 - DNA, 25 bp, Homo sapien
actcactattcccgcagaggctgtg

SEQ ID NO: 16839 - DNA, 25 bp, Homo sapien
actcactccgaaacatgctggaggg

SEQ ID NO: 16840 - DNA, 25 bp, Homo sapien
actcactctgaaacatgctggaggg

SEQ ID NO: 16841 - DNA, 25 bp, Homo sapien
actcactgagattttgggcaggtca

SEQ ID NO: 16842 - DNA, 25 bp, Homo sapien
actcactgtgattttgggcaggtca

SEQ ID NO: 16843 - DNA, 25 bp, Homo sapien
actcactgttttcctgaagtgggaa

SEQ ID NO: 16844 - DNA, 25 bp, Homo sapien
actcactgtttttctgaagtgggaa

SEQ ID NO: 16845 - DNA, 25 bp, Homo sapien
actcacttactatcatgcgaacagc

SEQ ID NO: 16846 - DNA, 25 bp, Homo sapien
actcacttactatcgtgcgaacagc

SEQ ID NO: 16847 - DNA, 25 bp, Homo sapien
actcacttccagctctaggcaacca

SEQ ID NO: 16848 - DNA, 25 bp, Homo sapien
actcacttgcagctctaggcaacca

SEQ ID NO: 16849 - DNA, 25 bp, Homo sapien
actcagaaatgtctccgcaatctgg

SEQ ID NO: 16850 - DNA, 25 bp, Homo sapien
actcagaattgtctccgcaatctgg

SEQ ID NO: 16851 - DNA, 25 bp, Homo sapien
actcagataatcatagtgcccctgt

SEQ ID NO: 16852 - DNA, 25 bp, Homo sapien
actcagatagtcatagtgcccctgt

SEQ ID NO: 16853 - DNA, 25 bp, Homo sapien
actcagatctacctcacatttaaaa

SEQ ID NO: 16854 - DNA, 25 bp, Homo sapien
actcagatctatctcacatttaaaa

SEQ ID NO: 16855 - DNA, 25 bp, Homo sapien
actcagatttgatataagaggacag

SEQ ID NO: 16856 - DNA, 25 bp, Homo sapien
actcagatttggtataagaggacag

SEQ ID NO: 16857 - DNA, 25 bp, Homo sapien
actcagcatcttcgtcgtctcctat

SEQ ID NO: 16858 - DNA, 25 bp, Homo sapien
actcagcatcttcttcgtctcctat

SEQ ID NO: 16859 - DNA, 25 bp, Homo sapien
actcagccaatgtggtaagcattta

SEQ ID NO: 16860 - DNA, 25 bp, Homo sapien
actcagccatatattgatatacacg

SEQ ID NO: 16861 - DNA, 25 bp, Homo sapien
actcagccgatgtggtaagcattta

SEQ ID NO: 16862 - DNA, 25 bp, Homo sapien
actcagccgtatattgatatacacg

SEQ ID NO: 16863 - DNA, 25 bp, Homo sapien
actcagctcaagtcttcactgaccc

SEQ ID NO: 16864 - DNA, 25 bp, Homo sapien
actcagctcaagttttcactgaccc

SEQ ID NO: 16865 - DNA, 25 bp, Homo sapien
actcaggagagggggaatctgttct

SEQ ID NO: 16866 - DNA, 25 bp, Homo sapien
actcaggagagggggagtctgttct

SEQ ID NO: 16867 - DNA, 25 bp, Homo sapien
actcaggatgccggatgacgggcag

SEQ ID NO: 16868 - DNA, 25 bp, Homo sapien
actcaggatgctggatgacgggcag

SEQ ID NO: 16869 - DNA, 25 bp, Homo sapien
actcagggcaaacgtcaactccact

SEQ ID NO: 16870 - DNA, 25 bp, Homo sapien
actcagggcaaatgtcaactccact

SEQ ID NO: 16871 - DNA, 25 bp, Homo sapien
actcaggtaaacaaagggagcatga

SEQ ID NO: 16872 - DNA, 25 bp, Homo sapien
actcaggtaaacaaagtgagcatga

SEQ ID NO: 16873 - DNA, 25 bp, Homo sapien
actcaggttcccgataatgtttgtc

SEQ ID NO: 16874 - DNA, 25 bp, Homo sapien
actcaggttcctgataatgtttgtc

SEQ ID NO: 16875 - DNA, 25 bp, Homo sapien
actcagtctgctgtcttgttatagc

SEQ ID NO: 16876 - DNA, 25 bp, Homo sapien
actcagtcttctgtcttgttatagc

SEQ ID NO: 16877 - DNA, 25 bp, Homo sapien
actcagtgatacaacccttttataa

SEQ ID NO: 16878 - DNA, 25 bp, Homo sapien
actcagtgatacgacccttttataa

SEQ ID NO: 16879 - DNA, 25 bp, Homo sapien
actcagttacaccctacgcacatga

SEQ ID NO: 16880 - DNA, 25 bp, Homo sapien
actcagttacaccctatgcacatga

SEQ ID NO: 16881 - DNA, 25 bp, Homo sapien
actcataaacaaaggaagctaggat

SEQ ID NO: 16882 - DNA, 25 bp, Homo sapien
actcataaacaagggaagctaggat

SEQ ID NO: 16883 - DNA, 25 bp, Homo sapien
actcataagcccaggtttgaactgg

SEQ ID NO: 16884 - DNA, 25 bp, Homo sapien
actcataagcctaggtttgaactgg

SEQ ID NO: 16885 - DNA, 25 bp, Homo sapien
actcataaggttactaagaggattg

SEQ ID NO: 16886 - DNA, 25 bp, Homo sapien
actcataaggttactatgaggattg

SEQ ID NO: 16887 - DNA, 25 bp, Homo sapien
actcatatattctttggtctgctac

SEQ ID NO: 16888 - DNA, 25 bp, Homo sapien
actcatatattttttggtctgctac

SEQ ID NO: 16889 - DNA, 25 bp, Homo sapien
actcatcatcgcatttgctttatag

SEQ ID NO: 16890 - DNA, 25 bp, Homo sapien
actcatcattgcatttgctttatag

SEQ ID NO: 16891 - DNA, 25 bp, Homo sapien
actcatcccatttttcaagttaggt

SEQ ID NO: 16892 - DNA, 25 bp, Homo sapien
actcatcccatttttccagttaggt

SEQ ID NO: 16893 - DNA, 25 bp, Homo sapien
actcatctagccacaggtatgctgg

SEQ ID NO: 16894 - DNA, 25 bp, Homo sapien
actcatctcgccacaggtatgctgg

SEQ ID NO: 16895 - DNA, 25 bp, Homo sapien
actcatctctgtaacagttcaagta

SEQ ID NO: 16896 - DNA, 25 bp, Homo sapien
actcatctttgtaacagttcaagta

SEQ ID NO: 16897 - DNA, 25 bp, Homo sapien
actcatgaacaattttaagaattac

SEQ ID NO: 16898 - DNA, 25 bp, Homo sapien
actcatgaacacttttaagaattac

SEQ ID NO: 16899 - DNA, 25 bp, Homo sapien
actcatgcctgtaaagtttctcatt

SEQ ID NO: 16900 - DNA, 25 bp, Homo sapien
actcatgcctgttaagtttctcatt

SEQ ID NO: 16901 - DNA, 25 bp, Homo sapien
actcattacgtttaacatgcaagac

SEQ ID NO: 16902 - DNA, 25 bp, Homo sapien
actcattatgcctcgaattttttca

SEQ ID NO: 16903 - DNA, 25 bp, Homo sapien
actcattatgcttcgaattttttca

SEQ ID NO: 16904 - DNA, 25 bp, Homo sapien
actcattatgtttaacatgcaagac

SEQ ID NO: 16905 - DNA, 25 bp, Homo sapien
actcattcagggttagaatcatggt

SEQ ID NO: 16906 - DNA, 25 bp, Homo sapien
actcattcattacctgccattcaat

SEQ ID NO: 16907 - DNA, 25 bp, Homo sapien
actcattcattacgtgccattcaat

SEQ ID NO: 16908 - DNA, 25 bp, Homo sapien
actcattccgggttagaatcatggt

SEQ ID NO: 16909 - DNA, 25 bp, Homo sapien
actcattctttccttactgcaggac

SEQ ID NO: 16910 - DNA, 25 bp, Homo sapien
actcattctttccttattgcaggac

SEQ ID NO: 16911 - DNA, 25 bp, Homo sapien
actcatttaccctgagttagtgttt

SEQ ID NO: 16912 - DNA, 25 bp, Homo sapien
actcatttaccgtgagttagtgttt

SEQ ID NO: 16913 - DNA, 25 bp, Homo sapien
actcatttttaatattttttccaat

SEQ ID NO: 16914 - DNA, 25 bp, Homo sapien
actcatttttaatgttttttccaat

SEQ ID NO: 16915 - DNA, 25 bp, Homo sapien
actccaaaacataacggctaaagcc

SEQ ID NO: 16916 - DNA, 25 bp, Homo sapien
actccaaaacataatggctaaagcc

SEQ ID NO: 16917 - DNA, 25 bp, Homo sapien
actccaagcctaactctctgcttta

SEQ ID NO: 16918 - DNA, 25 bp, Homo sapien
actccaagcctgactctctgcttta

SEQ ID NO: 16919 - DNA, 25 bp, Homo sapien
actccacaatcatgtgaaccaattc

SEQ ID NO: 16920 - DNA, 25 bp, Homo sapien
actccacatgacacttctgacacca

SEQ ID NO: 16921 - DNA, 25 bp, Homo sapien
actccacatgacacttttgacacca

SEQ ID NO: 16922 - DNA, 25 bp, Homo sapien
actccacattcatgtgaaccaattc

SEQ ID NO: 16923 - DNA, 25 bp, Homo sapien
actccaccccagactgcttttctga

SEQ ID NO: 16924 - DNA, 25 bp, Homo sapien
actccacccgagactgcttttctga

SEQ ID NO: 16925 - DNA, 25 bp, Homo sapien
actccactaacaatcttgctccgac

SEQ ID NO: 16926 - DNA, 25 bp, Homo sapien
actccactaacagtcttgctccgac

SEQ ID NO: 16927 - DNA, 25 bp, Homo sapien
actccactatccttcagaccttctc

SEQ ID NO: 16928 - DNA, 25 bp, Homo sapien
actccactctccttcagaccttctc

SEQ ID NO: 16929 - DNA, 25 bp, Homo sapien
actccactgcattcccagtacctgg

SEQ ID NO: 16930 - DNA, 25 bp, Homo sapien
actccacttcattcccagtacctgg

SEQ ID NO: 16931 - DNA, 25 bp, Homo sapien
actccagaggccagctaagctcaat

SEQ ID NO: 16932 - DNA, 25 bp, Homo sapien
actccagaggccagctcagctcaat

SEQ ID NO: 16933 - DNA, 25 bp, Homo sapien
actccagccacttcttttatcaggc

SEQ ID NO: 16934 - DNA, 25 bp, Homo sapien
actccagccgcttcttttatcaggc

SEQ ID NO: 16935 - DNA, 25 bp, Homo sapien
actccagtcagcatgacaagagtga

SEQ ID NO: 16936 - DNA, 25 bp, Homo sapien
actccagtcagcgtgacaagagtga

SEQ ID NO: 16937 - DNA, 25 bp, Homo sapien
actccatattttaggagactccaag

SEQ ID NO: 16938 - DNA, 25 bp, Homo sapien
actccatattttgggagactccaag

SEQ ID NO: 16939 - DNA, 25 bp, Homo sapien
actccattgagacagtagttagact

SEQ ID NO: 16940 - DNA, 25 bp, Homo sapien
actccattgagacggtagttagact

SEQ ID NO: 16941 - DNA, 25 bp, Homo sapien
actccatttgaaaaaaacaatcatt

SEQ ID NO: 16942 - DNA, 25 bp, Homo sapien
actccatttgaagaaaacaatcatt

SEQ ID NO: 16943 - DNA, 25 bp, Homo sapien
actcccaatctcattatctttccat

SEQ ID NO: 16944 - DNA, 25 bp, Homo sapien
actcccaatctcgttatctttccat

SEQ ID NO: 16945 - DNA, 25 bp, Homo sapien
actcccacgtccattcagcagaatc

SEQ ID NO: 16946 - DNA, 25 bp, Homo sapien
actcccacttccattcagcagaatc

SEQ ID NO: 16947 - DNA, 25 bp, Homo sapien
actcccagaatgttctgtataaagc

SEQ ID NO: 16948 - DNA, 25 bp, Homo sapien
actcccagactgttctgtataaagc

SEQ ID NO: 16949 - DNA, 25 bp, Homo sapien
actcccagatacgtacccaagagaa

SEQ ID NO: 16950 - DNA, 25 bp, Homo sapien
actcccagatatgtacccaagagaa

SEQ ID NO: 16951 - DNA, 25 bp, Homo sapien
actcccatacagaaaaaaaaatcaa

SEQ ID NO: 16952 - DNA, 25 bp, Homo sapien
actcccatatagaaaaaaaaatcaa

SEQ ID NO: 16953 - DNA, 25 bp, Homo sapien
actccctagcaaaaggagcctcgcc

SEQ ID NO: 16954 - DNA, 25 bp, Homo sapien
actccctagcagaaggagcctcgcc

SEQ ID NO: 16955 - DNA, 25 bp, Homo sapien
actccctcaacaatgacattaattc

SEQ ID NO: 16956 - DNA, 25 bp, Homo sapien
actccctcaacagtgacattaattc

SEQ ID NO: 16957 - DNA, 25 bp, Homo sapien
actccctggcctagtatttaaggtg

SEQ ID NO: 16958 - DNA, 25 bp, Homo sapien
actccctggcctggtatttaaggtg

SEQ ID NO: 16959 - DNA, 25 bp, Homo sapien
actcccttctcccaaggactgagct

SEQ ID NO: 16960 - DNA, 25 bp, Homo sapien
actcccttctcccgaggactgagct

SEQ ID NO: 16961 - DNA, 25 bp, Homo sapien
actccgactgcagtgcggacaatgt

SEQ ID NO: 16962 - DNA, 25 bp, Homo sapien
actccgactgcggtgcggacaatgt

SEQ ID NO: 16963 - DNA, 25 bp, Homo sapien
actccggtggccaaggcatgaaaat

SEQ ID NO: 16964 - DNA, 25 bp, Homo sapien
actccggtggccgaggcatgaaaat

SEQ ID NO: 16965 - DNA, 25 bp, Homo sapien
actcctaacctagtgacgaattagt

SEQ ID NO: 16966 - DNA, 25 bp, Homo sapien
actcctaacctagtgatgaattagt

SEQ ID NO: 16967 - DNA, 25 bp, Homo sapien
actcctaccactacaagagacacct

SEQ ID NO: 16968 - DNA, 25 bp, Homo sapien
actcctaccgctacaagagacacct

SEQ ID NO: 16969 - DNA, 25 bp, Homo sapien
actcctatagaacataaacccatgc

SEQ ID NO: 16970 - DNA, 25 bp, Homo sapien
actcctatagaatataaacccatgc

SEQ ID NO: 16971 - DNA, 25 bp, Homo sapien
actcctatgtctatatctaagagaa

SEQ ID NO: 16972 - DNA, 25 bp, Homo sapien
actcctatgtctgtatctaagagaa

SEQ ID NO: 16973 - DNA, 25 bp, Homo sapien
actcctcaaagaaggttcagttgga

SEQ ID NO: 16974 - DNA, 25 bp, Homo sapien
actcctcaaagaagtttcagttgga

SEQ ID NO: 16975 - DNA, 25 bp, Homo sapien
actcctgaactactgcagggtaatc

SEQ ID NO: 16976 - DNA, 25 bp, Homo sapien
actcctgaactactgcggggtaatc

SEQ ID NO: 16977 - DNA, 25 bp, Homo sapien
actcctgaagtcaaacaagaccatg

SEQ ID NO: 16978 - DNA, 25 bp, Homo sapien
actcctgaagtcaagcaagaccatg

SEQ ID NO: 16979 - DNA, 25 bp, Homo sapien
actcctgacatccttgcgaagtatt

SEQ ID NO: 16980 - DNA, 25 bp, Homo sapien
actcctgacatccttgtgaagtatt

SEQ ID NO: 16981 - DNA, 25 bp, Homo sapien
actcctgactacagaagatcactcc

SEQ ID NO: 16982 - DNA, 25 bp, Homo sapien
actcctgactacataagatcactcc

SEQ ID NO: 16983 - DNA, 25 bp, Homo sapien
actcctgactgccgggaccgggacc

SEQ ID NO: 16984 - DNA, 25 bp, Homo sapien
actcctgactgctgggaccgggacc

SEQ ID NO: 16985 - DNA, 25 bp, Homo sapien
actcctgagtgattgcctcagctaa

SEQ ID NO: 16986 - DNA, 25 bp, Homo sapien
actcctgattgattgcctcagctaa

SEQ ID NO: 16987 - DNA, 25 bp, Homo sapien
actcctgcttaccgcacgattattt

SEQ ID NO: 16988 - DNA, 25 bp, Homo sapien
actcctgcttaccgcatgattattt

SEQ ID NO: 16989 - DNA, 25 bp, Homo sapien
actcctgtgtccttttgacatactt

SEQ ID NO: 16990 - DNA, 25 bp, Homo sapien
actcctgtgtcctttttacatactt

SEQ ID NO: 16991 - DNA, 25 bp, Homo sapien
actcctttcggatgtcacactgtca

SEQ ID NO: 16992 - DNA, 25 bp, Homo sapien
actcctttcttattataccacatgc

SEQ ID NO: 16993 - DNA, 25 bp, Homo sapien
actcctttcttgttataccacatgc

SEQ ID NO: 16994 - DNA, 25 bp, Homo sapien
actccttttggatgtcacactgtca

SEQ ID NO: 16995 - DNA, 25 bp, Homo sapien
actcctttttcctatccttgctgct

SEQ ID NO: 16996 - DNA, 25 bp, Homo sapien
actcctttttcttatccttgctgct

SEQ ID NO: 16997 - DNA, 25 bp, Homo sapien
actcgagtgcataacattttttact

SEQ ID NO: 16998 - DNA, 25 bp, Homo sapien
actcgagtgcatagcattttttact

SEQ ID NO: 16999 - DNA, 25 bp, Homo sapien
actcgatgcgctgactgcacctgta

SEQ ID NO: 17000 - DNA, 25 bp, Homo sapien
actcgatgtgctgactgcacctgta

SEQ ID NO: 17001 - DNA, 25 bp, Homo sapien
actcgctgtaaggtgaaggcctgat

SEQ ID NO: 17002 - DNA, 25 bp, Homo sapien
actcgctgtaagttgaaggcctgat

SEQ ID NO: 17003 - DNA, 25 bp, Homo sapien
actcggaccgcttcacaggtgtcca

SEQ ID NO: 17004 - DNA, 25 bp, Homo sapien
actcggactgcttcacaggtgtcca

SEQ ID NO: 17005 - DNA, 25 bp, Homo sapien
actcggatccttaaaaataggaatt

SEQ ID NO: 17006 - DNA, 25 bp, Homo sapien
actcggatccttagaaataggaatt

SEQ ID NO: 17007 - DNA, 25 bp, Homo sapien
actcggattgaggtctcaatatctg

SEQ ID NO: 17008 - DNA, 25 bp, Homo sapien
actcggattgaggtttcaatatctg

SEQ ID NO: 17009 - DNA, 25 bp, Homo sapien
actcggtgatttgttcaatatttca

SEQ ID NO: 17010 - DNA, 25 bp, Homo sapien
actcggtgattttttcaatatttca

SEQ ID NO: 17011 - DNA, 25 bp, Homo sapien
actcggtggcataaaacaatagaaa

SEQ ID NO: 17012 - DNA, 25 bp, Homo sapien
actcggtgtcataaaacaatagaaa

SEQ ID NO: 17013 - DNA, 25 bp, Homo sapien
actctaactccacatagaaagtatc

SEQ ID NO: 17014 - DNA, 25 bp, Homo sapien
actctaactccacgtagaaagtatc

SEQ ID NO: 17015 - DNA, 25 bp, Homo sapien
actctaagatacttctcttttattg

SEQ ID NO: 17016 - DNA, 25 bp, Homo sapien
actctaagatacttttcttttattg

SEQ ID NO: 17017 - DNA, 25 bp, Homo sapien
actctaaggtccgaagagaagttgt

SEQ ID NO: 17018 - DNA, 25 bp, Homo sapien
actctaaggtccggagagaagttgt

SEQ ID NO: 17019 - DNA, 25 bp, Homo sapien
actctaagtacacactggaaaatta

SEQ ID NO: 17020 - DNA, 25 bp, Homo sapien
actctaagtacaccctggaaaatta

SEQ ID NO: 17021 - DNA, 25 bp, Homo sapien
actctaatatattccaatgcaatcc

SEQ ID NO: 17022 - DNA, 25 bp, Homo sapien
actctaatatattccagtgcaatcc

SEQ ID NO: 17023 - DNA, 25 bp, Homo sapien
actctaatcatgagaataattgtaa

SEQ ID NO: 17024 - DNA, 25 bp, Homo sapien
actctaatcatgggaataattgtaa

SEQ ID NO: 17025 - DNA, 25 bp, Homo sapien
actctacagaagatgttggaagctt

SEQ ID NO: 17026 - DNA, 25 bp, Homo sapien
actctacagaagattttggaagctt

SEQ ID NO: 17027 - DNA, 25 bp, Homo sapien
actctaccatgaccctagaataaat

SEQ ID NO: 17028 - DNA, 25 bp, Homo sapien
actctaccgtgaccctagaataaat

SEQ ID NO: 17029 - DNA, 25 bp, Homo sapien
actctacctattattgataaactct

SEQ ID NO: 17030 - DNA, 25 bp, Homo sapien
actctacctatttttgataaactct

SEQ ID NO: 17031 - DNA, 25 bp, Homo sapien
actctaggtggaccatcatgcatac

SEQ ID NO: 17032 - DNA, 25 bp, Homo sapien
actctaggtggactatcatgcatac

SEQ ID NO: 17033 - DNA, 25 bp, Homo sapien
actctataaaaccctgtaaaatctt

SEQ ID NO: 17034 - DNA, 25 bp, Homo sapien
actctataaaatcctgtaaaatctt

SEQ ID NO: 17035 - DNA, 25 bp, Homo sapien
actctatctggtataaattttcttc

SEQ ID NO: 17036 - DNA, 25 bp, Homo sapien
actctatctggtataatttttcttc

SEQ ID NO: 17037 - DNA, 25 bp, Homo sapien
actctatgaaaaaaaaatatattac

SEQ ID NO: 17038 - DNA, 25 bp, Homo sapien
actctatgagaaaaaaatatattac

SEQ ID NO: 17039 - DNA, 25 bp, Homo sapien
actctattgcacggaatatatagta

SEQ ID NO: 17040 - DNA, 25 bp, Homo sapien
actctattgcatggaatatatagta

SEQ ID NO: 17041 - DNA, 25 bp, Homo sapien
actctatttggggtgttatcttttg

SEQ ID NO: 17042 - DNA, 25 bp, Homo sapien
actctatttgggttgttatcttttg

SEQ ID NO: 17043 - DNA, 25 bp, Homo sapien
actctcaccataggtaacttgcaga

SEQ ID NO: 17044 - DNA, 25 bp, Homo sapien
actctcactataggtaacttgcaga

SEQ ID NO: 17045 - DNA, 25 bp, Homo sapien
actctcagaactagtttattcaatt

SEQ ID NO: 17046 - DNA, 25 bp, Homo sapien
actctcagaactggtttattcaatt

SEQ ID NO: 17047 - DNA, 25 bp, Homo sapien
actctcagtgtctccgtaaatttgt

SEQ ID NO: 17048 - DNA, 25 bp, Homo sapien
actctcagtgtttccgtaaatttgt

SEQ ID NO: 17049 - DNA, 25 bp, Homo sapien
actctccatgtaatctgaaaaatca

SEQ ID NO: 17050 - DNA, 25 bp, Homo sapien
actctccatgtattctgaaaaatca

SEQ ID NO: 17051 - DNA, 25 bp, Homo sapien
actctccttgccacggaatttgctg

SEQ ID NO: 17052 - DNA, 25 bp, Homo sapien
actctccttgccatggaatttgctg

SEQ ID NO: 17053 - DNA, 25 bp, Homo sapien
actctctaaatctgtttgggatttc

SEQ ID NO: 17054 - DNA, 25 bp, Homo sapien
actctctaaatttgtttgggatttc

SEQ ID NO: 17055 - DNA, 25 bp, Homo sapien
actctctcctccacgttactttgat

SEQ ID NO: 17056 - DNA, 25 bp, Homo sapien
actctctcctccatgttactttgat

SEQ ID NO: 17057 - DNA, 25 bp, Homo sapien
actctgaagtaacagtcacaacagc

SEQ ID NO: 17058 - DNA, 25 bp, Homo sapien
actctgaagtaacagttacaacagc

SEQ ID NO: 17059 - DNA, 25 bp, Homo sapien
actctgaatcccatttcatttattg

SEQ ID NO: 17060 - DNA, 25 bp, Homo sapien
actctgaatcctatttcatttattg

SEQ ID NO: 17061 - DNA, 25 bp, Homo sapien
actctgacaatcggatctccatgaa

SEQ ID NO: 17062 - DNA, 25 bp, Homo sapien
actctgacaatcgggtctccatgaa

SEQ ID NO: 17063 - DNA, 25 bp, Homo sapien
actctgacaggtacttaaaaccaag

SEQ ID NO: 17064 - DNA, 25 bp, Homo sapien
actctgacaggtccttaaaaccaag

SEQ ID NO: 17065 - DNA, 25 bp, Homo sapien
actctgagaaccactggtttgtttg

SEQ ID NO: 17066 - DNA, 25 bp, Homo sapien
actctgagaaccgctggtttgtttg

SEQ ID NO: 17067 - DNA, 25 bp, Homo sapien
actctgagcactaaaatatactctg

SEQ ID NO: 17068 - DNA, 25 bp, Homo sapien
actctgagctctaaaatatactctg

SEQ ID NO: 17069 - DNA, 25 bp, Homo sapien
actctgaggtttaagcactctgctt

SEQ ID NO: 17070 - DNA, 25 bp, Homo sapien
actctgaggtttgagcactctgctt

SEQ ID NO: 17071 - DNA, 25 bp, Homo sapien
actctgagtgtgaacgaaaagtaca

SEQ ID NO: 17072 - DNA, 25 bp, Homo sapien
actctgagtttgaacgaaaagtaca

SEQ ID NO: 17073 - DNA, 25 bp, Homo sapien
actctgatacaggatattttactat

SEQ ID NO: 17074 - DNA, 25 bp, Homo sapien
actctgatataggatattttactat

SEQ ID NO: 17075 - DNA, 25 bp, Homo sapien
actctgatattgctaaacttctggt

SEQ ID NO: 17076 - DNA, 25 bp, Homo sapien
actctgatattgctaatcttctggt

SEQ ID NO: 17077 - DNA, 25 bp, Homo sapien
actctgatgcatacggaattgtgac

SEQ ID NO: 17078 - DNA, 25 bp, Homo sapien
actctgatgcatatggaattgtgac

SEQ ID NO: 17079 - DNA, 25 bp, Homo sapien
actctgcctaagacaccacactctg

SEQ ID NO: 17080 - DNA, 25 bp, Homo sapien
actctgcctaagacgccacactctg

SEQ ID NO: 17081 - DNA, 25 bp, Homo sapien
actctgcgatgttggaaaggcttgg

SEQ ID NO: 17082 - DNA, 25 bp, Homo sapien
actctgcgctgttggaaaggcttgg

SEQ ID NO: 17083 - DNA, 25 bp, Homo sapien
actctgctctttgtactctagctga

SEQ ID NO: 17084 - DNA, 25 bp, Homo sapien
actctgctgtctaaaatccttttca

SEQ ID NO: 17085 - DNA, 25 bp, Homo sapien
actctgctgtctaagatccttttca

SEQ ID NO: 17086 - DNA, 25 bp, Homo sapien
actctgctttttgtactctagctga

SEQ ID NO: 17087 - DNA, 25 bp, Homo sapien
actctggaaaatggcttgacagttt

SEQ ID NO: 17088 - DNA, 25 bp, Homo sapien
actctggaaaatggtttgacagttt

SEQ ID NO: 17089 - DNA, 25 bp, Homo sapien
actctggaccggctcactggactca

SEQ ID NO: 17090 - DNA, 25 bp, Homo sapien
actctggaccggcttactggactca

SEQ ID NO: 17091 - DNA, 25 bp, Homo sapien
actctggctgtaactcactgaaact

SEQ ID NO: 17092 - DNA, 25 bp, Homo sapien
actctggctgtgactcactgaaact

SEQ ID NO: 17093 - DNA, 25 bp, Homo sapien
actctgggaagtgggcattatggtc

SEQ ID NO: 17094 - DNA, 25 bp, Homo sapien
actctgggaagtgggcgttatggtc

SEQ ID NO: 17095 - DNA, 25 bp, Homo sapien
actctgtacgataccataatggtgg

SEQ ID NO: 17096 - DNA, 25 bp, Homo sapien
actctgtacgatatcataatggtgg

SEQ ID NO: 17097 - DNA, 25 bp, Homo sapien
actctgtatactttacttgccttta

SEQ ID NO: 17098 - DNA, 25 bp, Homo sapien
actctgtatactttccttgccttta

SEQ ID NO: 17099 - DNA, 25 bp, Homo sapien
actctgtcagtgttgtgaaaggaaa

SEQ ID NO: 17100 - DNA, 25 bp, Homo sapien
actctgtcagtgttttgaaaggaaa

SEQ ID NO: 17101 - DNA, 25 bp, Homo sapien
actctgtctgcagatttaaatgtta

SEQ ID NO: 17102 - DNA, 25 bp, Homo sapien
actctgtcttcagatttaaatgtta

SEQ ID NO: 17103 - DNA, 25 bp, Homo sapien
actctgtgactctgaagatggataa

SEQ ID NO: 17104 - DNA, 25 bp, Homo sapien
actctgtgactttgaagatggataa

SEQ ID NO: 17105 - DNA, 25 bp, Homo sapien
actctgtgtctctaaccgtctgtag

SEQ ID NO: 17106 - DNA, 25 bp, Homo sapien
actctgtgtggctggctgcccccac

SEQ ID NO: 17107 - DNA, 25 bp, Homo sapien
actctgtgttgctggctgcccccac

SEQ ID NO: 17108 - DNA, 25 bp, Homo sapien
actctgtgtttctaaccgtctgtag

SEQ ID NO: 17109 - DNA, 25 bp, Homo sapien
actcttaatgcagcaatctcaggct

SEQ ID NO: 17110 - DNA, 25 bp, Homo sapien
actcttaatgcagcgatctcaggct

SEQ ID NO: 17111 - DNA, 25 bp, Homo sapien
actcttaccagtcaataaggcagac

SEQ ID NO: 17112 - DNA, 25 bp, Homo sapien
actcttaccggtcaataaggcagac

SEQ ID NO: 17113 - DNA, 25 bp, Homo sapien
actcttagaaccataataatgcttc

SEQ ID NO: 17114 - DNA, 25 bp, Homo sapien
actcttagaaccgtaataatgcttc

SEQ ID NO: 17115 - DNA, 25 bp, Homo sapien
actcttagactcaggaaattattgt

SEQ ID NO: 17116 - DNA, 25 bp, Homo sapien
actcttagattcaggaaattattgt

SEQ ID NO: 17117 - DNA, 25 bp, Homo sapien
actcttatgtcagcctatttaactg

SEQ ID NO: 17118 - DNA, 25 bp, Homo sapien
actcttatgtcatcctatttaactg

SEQ ID NO: 17119 - DNA, 25 bp, Homo sapien
actcttccattaattgcgtctcttt

SEQ ID NO: 17120 - DNA, 25 bp, Homo sapien
actcttccattaattgtgtctcttt

SEQ ID NO: 17121 - DNA, 25 bp, Homo sapien
actcttcctcgagtcagtgcaggtg

SEQ ID NO: 17122 - DNA, 25 bp, Homo sapien
actcttccttgagtcagtgcaggtg

SEQ ID NO: 17123 - DNA, 25 bp, Homo sapien
actcttctaaactaaattaacaagg

SEQ ID NO: 17124 - DNA, 25 bp, Homo sapien
actcttctatactaaattaacaagg

SEQ ID NO: 17125 - DNA, 25 bp, Homo sapien
actcttctcgtggaaacaagaaatt

SEQ ID NO: 17126 - DNA, 25 bp, Homo sapien
actcttctcgtggaaataagaaatt

SEQ ID NO: 17127 - DNA, 25 bp, Homo sapien
actcttctgtcccatttctacgggc

SEQ ID NO: 17128 - DNA, 25 bp, Homo sapien
actcttctgtcccgtttctacgggc

SEQ ID NO: 17129 - DNA, 25 bp, Homo sapien
actcttcttcacaactgttggaccg

SEQ ID NO: 17130 - DNA, 25 bp, Homo sapien
actcttcttcacagctgttggaccg

SEQ ID NO: 17131 - DNA, 25 bp, Homo sapien
actcttgagaagacacagcagggga

SEQ ID NO: 17132 - DNA, 25 bp, Homo sapien
actcttgagaagacgcagcagggga

SEQ ID NO: 17133 - DNA, 25 bp, Homo sapien
actcttggattcaggcttaggacaa

SEQ ID NO: 17134 - DNA, 25 bp, Homo sapien
actcttggatttaggcttaggacaa

SEQ ID NO: 17135 - DNA, 25 bp, Homo sapien
actctttcattttactgaaatgtta

SEQ ID NO: 17136 - DNA, 25 bp, Homo sapien
actctttccttttactgaaatgtta

SEQ ID NO: 17137 - DNA, 25 bp, Homo sapien
actctttctcgccgctagtgttctg

SEQ ID NO: 17138 - DNA, 25 bp, Homo sapien
actctttctcgctgctagtgttctg

SEQ ID NO: 17139 - DNA, 25 bp, Homo sapien
actctttcttgaatttaatatactt

SEQ ID NO: 17140 - DNA, 25 bp, Homo sapien
actctttcttgattttaatatactt

SEQ ID NO: 17141 - DNA, 25 bp, Homo sapien
actctttgacatgtagggcaaaatt

SEQ ID NO: 17142 - DNA, 25 bp, Homo sapien
actctttggcatgtagggcaaaatt

SEQ ID NO: 17143 - DNA, 25 bp, Homo sapien
actctttgtacaacaaattacaggg

SEQ ID NO: 17144 - DNA, 25 bp, Homo sapien
actctttgtacaataaattacaggg

SEQ ID NO: 17145 - DNA, 25 bp, Homo sapien
actcttttccacaactccccttcta

SEQ ID NO: 17146 - DNA, 25 bp, Homo sapien
actcttttccacaacttcccttcta

SEQ ID NO: 17147 - DNA, 25 bp, Homo sapien
actcttttgaacatacaattcggtg

SEQ ID NO: 17148 - DNA, 25 bp, Homo sapien
actcttttgaacgtacaattcggtg

SEQ ID NO: 17149 - DNA, 25 bp, Homo sapien
actcttttgtctaggcacattgtcc

SEQ ID NO: 17150 - DNA, 25 bp, Homo sapien
actcttttgtctagtcacattgtcc

SEQ ID NO: 17151 - DNA, 25 bp, Homo sapien
actctttttccagtggactcaagta

SEQ ID NO: 17152 - DNA, 25 bp, Homo sapien
actctttttcccgtggactcaagta

SEQ ID NO: 17153 - DNA, 25 bp, Homo sapien
actgaaaacggaactgaaagtgaaa

SEQ ID NO: 17154 - DNA, 25 bp, Homo sapien
actgaaaactgaactgaaagtgaaa

SEQ ID NO: 17155 - DNA, 25 bp, Homo sapien
actgaaacatcgctaaaatgatttt

SEQ ID NO: 17156 - DNA, 25 bp, Homo sapien
actgaaacatcgttaaaatgatttt

SEQ ID NO: 17157 - DNA, 25 bp, Homo sapien
actgaaacatctgtactgtaaaggc

SEQ ID NO: 17158 - DNA, 25 bp, Homo sapien
actgaaacgtctgtactgtaaaggc

SEQ ID NO: 17159 - DNA, 25 bp, Homo sapien
actgaaaggattaatgctgccatca

SEQ ID NO: 17160 - DNA, 25 bp, Homo sapien
actgaaaggattaatgttgccatca

SEQ ID NO: 17161 - DNA, 25 bp, Homo sapien
actgaaataaaaatctcaatgaatg

SEQ ID NO: 17162 - DNA, 25 bp, Homo sapien
actgaaataaaactctcaatgaatg

SEQ ID NO: 17163 - DNA, 25 bp, Homo sapien
actgaaatcagaaatgagcaggctt

SEQ ID NO: 17164 - DNA, 25 bp, Homo sapien
actgaaatcagaaatgtgcaggctt

SEQ ID NO: 17165 - DNA, 25 bp, Homo sapien
actgaaatgaacctttctaaacttt

SEQ ID NO: 17166 - DNA, 25 bp, Homo sapien
actgaaatgaatctttctaaacttt

SEQ ID NO: 17167 - DNA, 25 bp, Homo sapien
actgaaatgtcattatgtggtatgt

SEQ ID NO: 17168 - DNA, 25 bp, Homo sapien
actgaaatgtcgttatgtggtatgt

SEQ ID NO: 17169 - DNA, 25 bp, Homo sapien
actgaaattggtaaagatacattaa

SEQ ID NO: 17170 - DNA, 25 bp, Homo sapien
actgaaattggtgaagatacattaa

SEQ ID NO: 17171 - DNA, 25 bp, Homo sapien
actgaacataagcagaaaaagtgac

SEQ ID NO: 17172 - DNA, 25 bp, Homo sapien
actgaacataagcagagaaagtgac

SEQ ID NO: 17173 - DNA, 25 bp, Homo sapien
actgaacttaactcatcccaggctg

SEQ ID NO: 17174 - DNA, 25 bp, Homo sapien
actgaacttaactcatgccaggctg

SEQ ID NO: 17175 - DNA, 25 bp, Homo sapien
actgaagaaaccttgggccatgatt

SEQ ID NO: 17176 - DNA, 25 bp, Homo sapien
actgaagaacccttgggccatgatt

SEQ ID NO: 17177 - DNA, 25 bp, Homo sapien
actgaagaagatttgtttatgctcc

SEQ ID NO: 17178 - DNA, 25 bp, Homo sapien
actgaagagaagagcatcaagagac

SEQ ID NO: 17179 - DNA, 25 bp, Homo sapien
actgaagagaagatcatcaagagac

SEQ ID NO: 17180 - DNA, 25 bp, Homo sapien
actgaagagaatgtcctactcagct

SEQ ID NO: 17181 - DNA, 25 bp, Homo sapien
actgaagagaatttcctactcagct

SEQ ID NO: 17182 - DNA, 25 bp, Homo sapien
actgaagaggatttgtttatgctcc

SEQ ID NO: 17183 - DNA, 25 bp, Homo sapien
actgaagcaacagcaatcgtattca

SEQ ID NO: 17184 - DNA, 25 bp, Homo sapien
actgaagcaacagcgatcgtattca

SEQ ID NO: 17185 - DNA, 25 bp, Homo sapien
actgaagcgcacatttgatctaatt

SEQ ID NO: 17186 - DNA, 25 bp, Homo sapien
actgaagcgcacgtttgatctaatt

SEQ ID NO: 17187 - DNA, 25 bp, Homo sapien
actgaagctgttcttagcctcttaa

SEQ ID NO: 17188 - DNA, 25 bp, Homo sapien
actgaagctgtttttagcctcttaa

SEQ ID NO: 17189 - DNA, 25 bp, Homo sapien
actgaaggcttgaaacttccagggg

SEQ ID NO: 17190 - DNA, 25 bp, Homo sapien
actgaaggcttgcaacttccagggg

SEQ ID NO: 17191 - DNA, 25 bp, Homo sapien
actgaagtgactttcaaactagggt

SEQ ID NO: 17192 - DNA, 25 bp, Homo sapien
actgaagtgactttcatactagggt

SEQ ID NO: 17193 - DNA, 25 bp, Homo sapien
actgaatataacaaaacaaatgtag

SEQ ID NO: 17194 - DNA, 25 bp, Homo sapien
actgaatataacaaaataaatgtag

SEQ ID NO: 17195 - DNA, 25 bp, Homo sapien
actgaatccgaataaagctgaataa

SEQ ID NO: 17196 - DNA, 25 bp, Homo sapien
actgaatccgaatagagctgaataa

SEQ ID NO: 17197 - DNA, 25 bp, Homo sapien
actgaatcctgagttctaactaact

SEQ ID NO: 17198 - DNA, 25 bp, Homo sapien
actgaatcttgagttctaactaact

SEQ ID NO: 17199 - DNA, 25 bp, Homo sapien
actgaatgaataaagacgaaaggat

SEQ ID NO: 17200 - DNA, 25 bp, Homo sapien
actgaatgaataaagatgaaaggat

SEQ ID NO: 17201 - DNA, 25 bp, Homo sapien
actgaattaccatatgtcccagcaa

SEQ ID NO: 17202 - DNA, 25 bp, Homo sapien
actgaattaccgtatgtcccagcaa

SEQ ID NO: 17203 - DNA, 25 bp, Homo sapien
actgaattatctcaaccaaggagat

SEQ ID NO: 17204 - DNA, 25 bp, Homo sapien
actgaattatctcgaccaaggagat

SEQ ID NO: 17205 - DNA, 25 bp, Homo sapien
actgacaatagccgaaacttaccag

SEQ ID NO: 17206 - DNA, 25 bp, Homo sapien
actgacaatagcggaaacttaccag

SEQ ID NO: 17207 - DNA, 25 bp, Homo sapien
actgacactgtttcgttccacacgg

SEQ ID NO: 17208 - DNA, 25 bp, Homo sapien
actgacactgtttggttccacacgg

SEQ ID NO: 17209 - DNA, 25 bp, Homo sapien
actgacagcaatacatttccctcta

SEQ ID NO: 17210 - DNA, 25 bp, Homo sapien
actgacagcaatgcatttccctcta

SEQ ID NO: 17211 - DNA, 25 bp, Homo sapien
actgacataatctcattgcaatatt

SEQ ID NO: 17212 - DNA, 25 bp, Homo sapien
actgacataatctccttgcaatatt

SEQ ID NO: 17213 - DNA, 25 bp, Homo sapien
actgacatcaagacctaaggtaatt

SEQ ID NO: 17214 - DNA, 25 bp, Homo sapien
actgacatcaagagctaaggtaatt

SEQ ID NO: 17215 - DNA, 25 bp, Homo sapien
actgacatcattaaaaaattagcta

SEQ ID NO: 17216 - DNA, 25 bp, Homo sapien
actgacatcattgaaaaattagcta

SEQ ID NO: 17217 - DNA, 25 bp, Homo sapien
actgacatgtttcctcactttcttc

SEQ ID NO: 17218 - DNA, 25 bp, Homo sapien
actgacattcatatttcttaaacta

SEQ ID NO: 17219 - DNA, 25 bp, Homo sapien
actgacattcatattttttaaacta

SEQ ID NO: 17220 - DNA, 25 bp, Homo sapien
actgacatttttcctcactttcttc

SEQ ID NO: 17221 - DNA, 25 bp, Homo sapien
actgacgttagtaataggccttaaa

SEQ ID NO: 17222 - DNA, 25 bp, Homo sapien
actgacgttagtattaggccttaaa

SEQ ID NO: 17223 - DNA, 25 bp, Homo sapien
actgactcaaatgtcaatttcctct

SEQ ID NO: 17224 - DNA, 25 bp, Homo sapien
actgactcaaatgtcagtttcctct

SEQ ID NO: 17225 - DNA, 25 bp, Homo sapien
actgacttcgtttgcagcagagcat

SEQ ID NO: 17226 - DNA, 25 bp, Homo sapien
actgactttcatacaatggcttttt

SEQ ID NO: 17227 - DNA, 25 bp, Homo sapien
actgactttgtttgcagcagagcat

SEQ ID NO: 17228 - DNA, 25 bp, Homo sapien
actgacttttatacaatggcttttt

SEQ ID NO: 17229 - DNA, 25 bp, Homo sapien
actgagaaacgaggagcagtcttct

SEQ ID NO: 17230 - DNA, 25 bp, Homo sapien
actgagaaataattgatacattaaa

SEQ ID NO: 17231 - DNA, 25 bp, Homo sapien
actgagaaatgaggagcagtcttct

SEQ ID NO: 17232 - DNA, 25 bp, Homo sapien
actgagaactaattgatacattaaa

SEQ ID NO: 17233 - DNA, 25 bp, Homo sapien
actgagaagtgcaaggatcaaaggc

SEQ ID NO: 17234 - DNA, 25 bp, Homo sapien
actgagaagtgcaagggtcaaaggc

SEQ ID NO: 17235 - DNA, 25 bp, Homo sapien
actgagacaactcatgaagactctg

SEQ ID NO: 17236 - DNA, 25 bp, Homo sapien
actgagacagctcatgaagactctg

SEQ ID NO: 17237 - DNA, 25 bp, Homo sapien
actgagacaggtgcatatctgattg

SEQ ID NO: 17238 - DNA, 25 bp, Homo sapien
actgagacaggtgcgtatctgattg

SEQ ID NO: 17239 - DNA, 25 bp, Homo sapien
actgagacatgaatggactgtactc

SEQ ID NO: 17240 - DNA, 25 bp, Homo sapien
actgagacatgagtggactgtactc

SEQ ID NO: 17241 - DNA, 25 bp, Homo sapien
actgagaccattcactttcctttaa

SEQ ID NO: 17242 - DNA, 25 bp, Homo sapien
actgagaccattcattttcctttaa

SEQ ID NO: 17243 - DNA, 25 bp, Homo sapien
actgagacttacgagattcgcttgg

SEQ ID NO: 17244 - DNA, 25 bp, Homo sapien
actgagacttatgagattcgcttgg

SEQ ID NO: 17245 - DNA, 25 bp, Homo sapien
actgagagatctcggttgtgaaggt

SEQ ID NO: 17246 - DNA, 25 bp, Homo sapien
actgagagatctgggttgtgaaggt

SEQ ID NO: 17247 - DNA, 25 bp, Homo sapien
actgagagctcagagaagcacgtgt

SEQ ID NO: 17248 - DNA, 25 bp, Homo sapien
actgagagctcagagaggcacgtgt

SEQ ID NO: 17249 - DNA, 25 bp, Homo sapien
actgagatgtcaaaatcccatctct

SEQ ID NO: 17250 - DNA, 25 bp, Homo sapien
actgagatgtcagaatcccatctct

SEQ ID NO: 17251 - DNA, 25 bp, Homo sapien
actgagccatattacctgagcccaa

SEQ ID NO: 17252 - DNA, 25 bp, Homo sapien
actgagccatattccctgagcccaa

SEQ ID NO: 17253 - DNA, 25 bp, Homo sapien
actgagccttcaatcttctaagatc

SEQ ID NO: 17254 - DNA, 25 bp, Homo sapien
actgagccttcagtcttctaagatc

SEQ ID NO: 17255 - DNA, 25 bp, Homo sapien
actgagctgcgactcaggctgtgcc

SEQ ID NO: 17256 - DNA, 25 bp, Homo sapien
actgagctgtcacacgtgctgctag

SEQ ID NO: 17257 - DNA, 25 bp, Homo sapien
actgagctgtcacatgtgctgctag

SEQ ID NO: 17258 - DNA, 25 bp, Homo sapien
actgagctgtgactcaggctgtgcc

SEQ ID NO: 17259 - DNA, 25 bp, Homo sapien
actgaggaactacctaccccattca

SEQ ID NO: 17260 - DNA, 25 bp, Homo sapien
actgaggaactacctatcccattca

SEQ ID NO: 17261 - DNA, 25 bp, Homo sapien
actgaggaactgctgaccaaggggt

SEQ ID NO: 17262 - DNA, 25 bp, Homo sapien
actgaggaattgctgaccaaggggt

SEQ ID NO: 17263 - DNA, 25 bp, Homo sapien
actgaggatcattcacctgaagaga

SEQ ID NO: 17264 - DNA, 25 bp, Homo sapien
actgaggattattcacctgaagaga

SEQ ID NO: 17265 - DNA, 25 bp, Homo sapien
actgaggcacaaactctaaggtgag

SEQ ID NO: 17266 - DNA, 25 bp, Homo sapien
actgaggcgcaaactctaaggtgag

SEQ ID NO: 17267 - DNA, 25 bp, Homo sapien
actgaggctagcaagcaaaacacct

SEQ ID NO: 17268 - DNA, 25 bp, Homo sapien
actgaggctagcacgcaaaacacct

SEQ ID NO: 17269 - DNA, 25 bp, Homo sapien
actgaggttaaacagccagcaaggg

SEQ ID NO: 17270 - DNA, 25 bp, Homo sapien
actgaggttaaacggccagcaaggg

SEQ ID NO: 17271 - DNA, 25 bp, Homo sapien
actgagtattgctaacatacattaa

SEQ ID NO: 17272 - DNA, 25 bp, Homo sapien
actgagtattggtaacatacattaa

SEQ ID NO: 17273 - DNA, 25 bp, Homo sapien
actgagtcataatctgcagactaac

SEQ ID NO: 17274 - DNA, 25 bp, Homo sapien
actgagtcgtaatctgcagactaac

SEQ ID NO: 17275 - DNA, 25 bp, Homo sapien
actgagtctcgctccaaggctagag

SEQ ID NO: 17276 - DNA, 25 bp, Homo sapien
actgagtcttctctccagcagaaat

SEQ ID NO: 17277 - DNA, 25 bp, Homo sapien
actgagtcttctctccggcagaaat

SEQ ID NO: 17278 - DNA, 25 bp, Homo sapien
actgagtcttgctccaaggctagag

SEQ ID NO: 17279 - DNA, 25 bp, Homo sapien
actgagttattcttgagaatcctat

SEQ ID NO: 17280 - DNA, 25 bp, Homo sapien
actgagttatttttgagaatcctat

SEQ ID NO: 17281 - DNA, 25 bp, Homo sapien
actgataatagacttggcaaaaaca

SEQ ID NO: 17282 - DNA, 25 bp, Homo sapien
actgataatagatttggcaaaaaca

SEQ ID NO: 17283 - DNA, 25 bp, Homo sapien
actgatacaatcatgtcaaaggtat

SEQ ID NO: 17284 - DNA, 25 bp, Homo sapien
actgatacacttttttgcagatgta

SEQ ID NO: 17285 - DNA, 25 bp, Homo sapien
actgatacatttttttgcagatgta

SEQ ID NO: 17286 - DNA, 25 bp, Homo sapien
actgatacgatcatgtcaaaggtat

SEQ ID NO: 17287 - DNA, 25 bp, Homo sapien
actgatatacagtttgtaagaaaaa

SEQ ID NO: 17288 - DNA, 25 bp, Homo sapien
actgatatattggaacaattaatat

SEQ ID NO: 17289 - DNA, 25 bp, Homo sapien
actgatatattgtaacaattaatat

SEQ ID NO: 17290 - DNA, 25 bp, Homo sapien
actgatatccagtttgtaagaaaaa

SEQ ID NO: 17291 - DNA, 25 bp, Homo sapien
actgatattctcttccatagcactg

SEQ ID NO: 17292 - DNA, 25 bp, Homo sapien
actgatattgtcttccatagcactg

SEQ ID NO: 17293 - DNA, 25 bp, Homo sapien
actgatcaaatatctccggcatttc

SEQ ID NO: 17294 - DNA, 25 bp, Homo sapien
actgatcaaatatctctggcatttc

SEQ ID NO: 17295 - DNA, 25 bp, Homo sapien
actgatctcatttatctccacattc

SEQ ID NO: 17296 - DNA, 25 bp, Homo sapien
actgatctcatttgtctccacattc

SEQ ID NO: 17297 - DNA, 25 bp, Homo sapien
actgatgaaactgggtatctgcgtt

SEQ ID NO: 17298 - DNA, 25 bp, Homo sapien
actgatgaaactggttatctgcgtt

SEQ ID NO: 17299 - DNA, 25 bp, Homo sapien
actgatgacaacgacgatgatgatg

SEQ ID NO: 17300 - DNA, 25 bp, Homo sapien
actgatgacaacgatgatgatgatg

SEQ ID NO: 17301 - DNA, 25 bp, Homo sapien
actgatgagattcttcatggtgcat

SEQ ID NO: 17302 - DNA, 25 bp, Homo sapien
actgatgagatttttcatggtgcat

SEQ ID NO: 17303 - DNA, 25 bp, Homo sapien
actgatgctggatctgctttactag

SEQ ID NO: 17304 - DNA, 25 bp, Homo sapien
actgatgctggatctgttttactag

SEQ ID NO: 17305 - DNA, 25 bp, Homo sapien
actgatgctttctgtacgtgcttcc

SEQ ID NO: 17306 - DNA, 25 bp, Homo sapien
actgatgctttgtgtacgtgcttcc

SEQ ID NO: 17307 - DNA, 25 bp, Homo sapien
actgatggggaatctggacttattt

SEQ ID NO: 17308 - DNA, 25 bp, Homo sapien
actgatggggaatttggacttattt

SEQ ID NO: 17309 - DNA, 25 bp, Homo sapien
actgatggtactccaaatcacctta

SEQ ID NO: 17310 - DNA, 25 bp, Homo sapien
actgatggtactcgaaatcacctta

SEQ ID NO: 17311 - DNA, 25 bp, Homo sapien
actgatgtaaacgtacaaaattcag

SEQ ID NO: 17312 - DNA, 25 bp, Homo sapien
actgatgtaaatgtacaaaattcag

SEQ ID NO: 17313 - DNA, 25 bp, Homo sapien
actgattcagtacgaacactggaaa

SEQ ID NO: 17314 - DNA, 25 bp, Homo sapien
actgattcagtatgaacactggaaa

SEQ ID NO: 17315 - DNA, 25 bp, Homo sapien
actgattgcatgagcagatccacgt

SEQ ID NO: 17316 - DNA, 25 bp, Homo sapien
actgattgcatgaggagatccacgt

SEQ ID NO: 17317 - DNA, 25 bp, Homo sapien
actgattgtaaacattaatgccatc

SEQ ID NO: 17318 - DNA, 25 bp, Homo sapien
actgattgtaaacgttaatgccatc

SEQ ID NO: 17319 - DNA, 25 bp, Homo sapien
actgattgtccagaattcagaccac

SEQ ID NO: 17320 - DNA, 25 bp, Homo sapien
actgattgtccggaattcagaccac

SEQ ID NO: 17321 - DNA, 25 bp, Homo sapien
actgatttctaaaactatgcaactc

SEQ ID NO: 17322 - DNA, 25 bp, Homo sapien
actgatttctaaaattatgcaactc

SEQ ID NO: 17323 - DNA, 25 bp, Homo sapien
actgcaaacatactaatggagagta

SEQ ID NO: 17324 - DNA, 25 bp, Homo sapien
actgcaaacctactaatggagagta

SEQ ID NO: 17325 - DNA, 25 bp, Homo sapien
actgcaaatcgcatcagactgaggg

SEQ ID NO: 17326 - DNA, 25 bp, Homo sapien
actgcaaatggcatcagactgaggg

SEQ ID NO: 17327 - DNA, 25 bp, Homo sapien
actgcaacaatctgacttgacaacc

SEQ ID NO: 17328 - DNA, 25 bp, Homo sapien
actgcaacaatttgacttgacaacc

SEQ ID NO: 17329 - DNA, 25 bp, Homo sapien
actgcaagactgcaagaaataccta

SEQ ID NO: 17330 - DNA, 25 bp, Homo sapien
actgcaagactgcgagaaataccta

SEQ ID NO: 17331 - DNA, 25 bp, Homo sapien
actgcaatagcataaaccagtacac

SEQ ID NO: 17332 - DNA, 25 bp, Homo sapien
actgcaatagcatgaaccagtacac

SEQ ID NO: 17333 - DNA, 25 bp, Homo sapien
actgcaatctgtgcagaagaaagta

SEQ ID NO: 17334 - DNA, 25 bp, Homo sapien
actgcaatctgtgcaggagaaagta

SEQ ID NO: 17335 - DNA, 25 bp, Homo sapien
actgcacaaagatactaataacaaa

SEQ ID NO: 17336 - DNA, 25 bp, Homo sapien
actgcacaaagatgctaataacaaa

SEQ ID NO: 17337 - DNA, 25 bp, Homo sapien
actgcacacatgttctccaagaagc

SEQ ID NO: 17338 - DNA, 25 bp, Homo sapien
actgcacacgtgttctccaagaagc

SEQ ID NO: 17339 - DNA, 25 bp, Homo sapien
actgcacacttgttaccctaacact

SEQ ID NO: 17340 - DNA, 25 bp, Homo sapien
actgcacacttgtttccctaacact

SEQ ID NO: 17341 - DNA, 25 bp, Homo sapien
actgcacagatcaaaagtgtcgaac

SEQ ID NO: 17342 - DNA, 25 bp, Homo sapien
actgcacagatcgaaagtgtcgaac

SEQ ID NO: 17343 - DNA, 25 bp, Homo sapien
actgcacatcacaccagaagactcc

SEQ ID NO: 17344 - DNA, 25 bp, Homo sapien
actgcacattacaccagaagactcc

SEQ ID NO: 17345 - DNA, 25 bp, Homo sapien
actgcactagacatttttttctgat

SEQ ID NO: 17346 - DNA, 25 bp, Homo sapien
actgcactatacatttttttctgat

SEQ ID NO: 17347 - DNA, 25 bp, Homo sapien
actgcactccaacaaacagagccag

SEQ ID NO: 17348 - DNA, 25 bp, Homo sapien
actgcactccatcaaacagagccag

SEQ ID NO: 17349 - DNA, 25 bp, Homo sapien
actgcactgcctagctaacacagga

SEQ ID NO: 17350 - DNA, 25 bp, Homo sapien
actgcactgcctagctgacacagga

SEQ ID NO: 17351 - DNA, 25 bp, Homo sapien
actgcactgctgctttcctatgatt

SEQ ID NO: 17352 - DNA, 25 bp, Homo sapien
actgcactgctgttttcctatgatt

SEQ ID NO: 17353 - DNA, 25 bp, Homo sapien
actgcactgtgtgttacatggagag

SEQ ID NO: 17354 - DNA, 25 bp, Homo sapien
actgcacttagctacacattaaggg

SEQ ID NO: 17355 - DNA, 25 bp, Homo sapien
actgcacttagttacacattaaggg

SEQ ID NO: 17356 - DNA, 25 bp, Homo sapien
actgcacttgcatgagggacttgga

SEQ ID NO: 17357 - DNA, 25 bp, Homo sapien
actgcacttgcttgagggacttgga

SEQ ID NO: 17358 - DNA, 25 bp, Homo sapien
actgcactttgtgttacatggagag

SEQ ID NO: 17359 - DNA, 25 bp, Homo sapien
actgcagcaataaggaagtaataca

SEQ ID NO: 17360 - DNA, 25 bp, Homo sapien
actgcagcaatagggaagtaataca

SEQ ID NO: 17361 - DNA, 25 bp, Homo sapien
actgcagcacagcgaagacacggat

SEQ ID NO: 17362 - DNA, 25 bp, Homo sapien
actgcagcacagtgaagacacggat

SEQ ID NO: 17363 - DNA, 25 bp, Homo sapien
actgcagccagatccctaaccccat

SEQ ID NO: 17364 - DNA, 25 bp, Homo sapien
actgcagccggatccctaaccccat

SEQ ID NO: 17365 - DNA, 25 bp, Homo sapien
actgcaggattcgggcagccaggat

SEQ ID NO: 17366 - DNA, 25 bp, Homo sapien
actgcaggatttgggcagccaggat

SEQ ID NO: 17367 - DNA, 25 bp, Homo sapien
actgcagtccatttatgcaaaataa

SEQ ID NO: 17368 - DNA, 25 bp, Homo sapien
actgcagtccatttgtgcaaaataa

SEQ ID NO: 17369 - DNA, 25 bp, Homo sapien
actgcagtctataatatataaccct

SEQ ID NO: 17370 - DNA, 25 bp, Homo sapien
actgcagtctatgatatataaccct

SEQ ID NO: 17371 - DNA, 25 bp, Homo sapien
actgcagtttacacttttctctgaa

SEQ ID NO: 17372 - DNA, 25 bp, Homo sapien
actgcagtttatacttttctctgaa

SEQ ID NO: 17373 - DNA, 25 bp, Homo sapien
actgcagtttgtctcagccaagaac

SEQ ID NO: 17374 - DNA, 25 bp, Homo sapien
actgcagtttgtttcagccaagaac

SEQ ID NO: 17375 - DNA, 25 bp, Homo sapien
actgcataatccaatcacaaaagaa

SEQ ID NO: 17376 - DNA, 25 bp, Homo sapien
actgcataatccagtcacaaaagaa

SEQ ID NO: 17377 - DNA, 25 bp, Homo sapien
actgcataattgacctgattcaagg

SEQ ID NO: 17378 - DNA, 25 bp, Homo sapien
actgcatactactgatctttaaaaa

SEQ ID NO: 17379 - DNA, 25 bp, Homo sapien
actgcatactattgatctttaaaaa

SEQ ID NO: 17380 - DNA, 25 bp, Homo sapien
actgcatagttgacctgattcaagg

SEQ ID NO: 17381 - DNA, 25 bp, Homo sapien
actgcatcattaattttttcctctc

SEQ ID NO: 17382 - DNA, 25 bp, Homo sapien
actgcatcgttaattttttcctctc

SEQ ID NO: 17383 - DNA, 25 bp, Homo sapien
actgcatgcattcccaggcttgtca

SEQ ID NO: 17384 - DNA, 25 bp, Homo sapien
actgcatgcatttccaggcttgtca

SEQ ID NO: 17385 - DNA, 25 bp, Homo sapien
actgcattatatcaatttttctaca

SEQ ID NO: 17386 - DNA, 25 bp, Homo sapien
actgcattatatcagtttttctaca

SEQ ID NO: 17387 - DNA, 25 bp, Homo sapien
actgcattcgagtcaacacattctt

SEQ ID NO: 17388 - DNA, 25 bp, Homo sapien
actgcattcgattcaacacattctt

SEQ ID NO: 17389 - DNA, 25 bp, Homo sapien
actgcattgtcaaacctgaattcca

SEQ ID NO: 17390 - DNA, 25 bp, Homo sapien
actgcattgtcgaacctgaattcca

SEQ ID NO: 17391 - DNA, 25 bp, Homo sapien
actgccaataggtaagttcttactc

SEQ ID NO: 17392 - DNA, 25 bp, Homo sapien
actgccaatagttaagttcttactc

SEQ ID NO: 17393 - DNA, 25 bp, Homo sapien
actgccacagtacagccaggttcca

SEQ ID NO: 17394 - DNA, 25 bp, Homo sapien
actgccacggtacagccaggttcca

SEQ ID NO: 17395 - DNA, 25 bp, Homo sapien
actgccagatcactcacactgtttg

SEQ ID NO: 17396 - DNA, 25 bp, Homo sapien
actgccagatcactcatactgtttg

SEQ ID NO: 17397 - DNA, 25 bp, Homo sapien
actgccagcatcatgagattatagt

SEQ ID NO: 17398 - DNA, 25 bp, Homo sapien
actgccagcatcgtgagattatagt

SEQ ID NO: 17399 - DNA, 25 bp, Homo sapien
actgccatttccaagtctgggttaa

SEQ ID NO: 17400 - DNA, 25 bp, Homo sapien
actgccatttccaagtttgggttaa

SEQ ID NO: 17401 - DNA, 25 bp, Homo sapien
actgcccacaatgcagctgcagatg

SEQ ID NO: 17402 - DNA, 25 bp, Homo sapien
actgcccaccatgcagctgcagatg

SEQ ID NO: 17403 - DNA, 25 bp, Homo sapien
actgccctcagcacaaagtgtgtaa

SEQ ID NO: 17404 - DNA, 25 bp, Homo sapien
actgccctcagcgcaaagtgtgtaa

SEQ ID NO: 17405 - DNA, 25 bp, Homo sapien
actgccgatctaaactatttcttct

SEQ ID NO: 17406 - DNA, 25 bp, Homo sapien
actgccgatttaaactatttcttct

SEQ ID NO: 17407 - DNA, 25 bp, Homo sapien
actgcctagattacttatgttttag

SEQ ID NO: 17408 - DNA, 25 bp, Homo sapien
actgcctagattgcttatgttttag

SEQ ID NO: 17409 - DNA, 25 bp, Homo sapien
actgcctcaaggaagatgtaagtaa

SEQ ID NO: 17410 - DNA, 25 bp, Homo sapien
actgcctcaaggaggatgtaagtaa

SEQ ID NO: 17411 - DNA, 25 bp, Homo sapien
actgcctcatgttctgtggcttaac

SEQ ID NO: 17412 - DNA, 25 bp, Homo sapien
actgcctcgtgttctgtggcttaac

SEQ ID NO: 17413 - DNA, 25 bp, Homo sapien
actgcctgccattctccagggaact

SEQ ID NO: 17414 - DNA, 25 bp, Homo sapien
actgcctgctattctccagggaact

SEQ ID NO: 17415 - DNA, 25 bp, Homo sapien
actgcctgctgcactttctcagtat

SEQ ID NO: 17416 - DNA, 25 bp, Homo sapien
actgcctgctgcagtttctcagtat

SEQ ID NO: 17417 - DNA, 25 bp, Homo sapien
actgccttcattgctatccgactca

SEQ ID NO: 17418 - DNA, 25 bp, Homo sapien
actgccttcgttgctatccgactca

SEQ ID NO: 17419 - DNA, 25 bp, Homo sapien
actgcgtaaaattagttttattttg

SEQ ID NO: 17420 - DNA, 25 bp, Homo sapien
actgcgtaaaattatttttattttg

SEQ ID NO: 17421 - DNA, 25 bp, Homo sapien
actgcgtaacagcaaaccacttcaa

SEQ ID NO: 17422 - DNA, 25 bp, Homo sapien
actgcgtaacagtaaaccacttcaa

SEQ ID NO: 17423 - DNA, 25 bp, Homo sapien
actgctaactctagctaaccatctc

SEQ ID NO: 17424 - DNA, 25 bp, Homo sapien
actgctaactctggctaaccatctc

SEQ ID NO: 17425 - DNA, 25 bp, Homo sapien
actgctaactgatttgaacatgaag

SEQ ID NO: 17426 - DNA, 25 bp, Homo sapien
actgctaactggtttgaacatgaag

SEQ ID NO: 17427 - DNA, 25 bp, Homo sapien
actgctacatgctaaaatgtgaatg

SEQ ID NO: 17428 - DNA, 25 bp, Homo sapien
actgctacatgctataatgtgaatg

SEQ ID NO: 17429 - DNA, 25 bp, Homo sapien
actgctacccatcagcagtgagttc

SEQ ID NO: 17430 - DNA, 25 bp, Homo sapien
actgctacccatcagctgtgagttc

SEQ ID NO: 17431 - DNA, 25 bp, Homo sapien
actgctcaatccatacagtgagtaa

SEQ ID NO: 17432 - DNA, 25 bp, Homo sapien
actgctcaatccgtacagtgagtaa

SEQ ID NO: 17433 - DNA, 25 bp, Homo sapien
actgctcttaaagcccttatttctc

SEQ ID NO: 17434 - DNA, 25 bp, Homo sapien
actgctcttaaagctcttatttctc

SEQ ID NO: 17435 - DNA, 25 bp, Homo sapien
actgctgccttagtctcttctgccc

SEQ ID NO: 17436 - DNA, 25 bp, Homo sapien
actgctgccttagtcttttctgccc

SEQ ID NO: 17437 - DNA, 25 bp, Homo sapien
actgctgggaatttgagaagtctca

SEQ ID NO: 17438 - DNA, 25 bp, Homo sapien
actgctgggcatttgagaagtctca

SEQ ID NO: 17439 - DNA, 25 bp, Homo sapien
actgctggtgcatatggtaagtgtg

SEQ ID NO: 17440 - DNA, 25 bp, Homo sapien
actgctggtgcgtatggtaagtgtg

SEQ ID NO: 17441 - DNA, 25 bp, Homo sapien
actgctgtaaaaagcgagttaagaa

SEQ ID NO: 17442 - DNA, 25 bp, Homo sapien
actgctgtaaaaagtgagttaagaa

SEQ ID NO: 17443 - DNA, 25 bp, Homo sapien
actgctgtaatatcctactcctctt

SEQ ID NO: 17444 - DNA, 25 bp, Homo sapien
actgctgtaatatgctactcctctt

SEQ ID NO: 17445 - DNA, 25 bp, Homo sapien
actgctgttcccccagatagcattg

SEQ ID NO: 17446 - DNA, 25 bp, Homo sapien
actgctgtttccccagatagcattg

SEQ ID NO: 17447 - DNA, 25 bp, Homo sapien
actgcttagcataataattggcatt

SEQ ID NO: 17448 - DNA, 25 bp, Homo sapien
actgcttagcatagtaattggcatt

SEQ ID NO: 17449 - DNA, 25 bp, Homo sapien
actgcttagtatcgttgtctcctat

SEQ ID NO: 17450 - DNA, 25 bp, Homo sapien
actgcttagtatctttgtctcctat

SEQ ID NO: 17451 - DNA, 25 bp, Homo sapien
actgcttatctactgacactgtttt

SEQ ID NO: 17452 - DNA, 25 bp, Homo sapien
actgcttatctactgatactgtttt

SEQ ID NO: 17453 - DNA, 25 bp, Homo sapien
actgcttccattctgaggcttggcc

SEQ ID NO: 17454 - DNA, 25 bp, Homo sapien
actgcttccgttctgaggcttggcc

SEQ ID NO: 17455 - DNA, 25 bp, Homo sapien
actgctttagctacttctcataagt

SEQ ID NO: 17456 - DNA, 25 bp, Homo sapien
actgctttcgctacttctcataagt

SEQ ID NO: 17457 - DNA, 25 bp, Homo sapien
actgctttggttcacataagtgatt

SEQ ID NO: 17458 - DNA, 25 bp, Homo sapien
actgctttgtttcacataagtgatt

SEQ ID NO: 17459 - DNA, 25 bp, Homo sapien
actggaactgcaatattggatctcc

SEQ ID NO: 17460 - DNA, 25 bp, Homo sapien
actggaactgcagtattggatctcc

SEQ ID NO: 17461 - DNA, 25 bp, Homo sapien
actggaagtaccataaaaataaata

SEQ ID NO: 17462 - DNA, 25 bp, Homo sapien
actggaagtacgataaaaataaata

SEQ ID NO: 17463 - DNA, 25 bp, Homo sapien
actggaataaggacacagggaataa

SEQ ID NO: 17464 - DNA, 25 bp, Homo sapien
actggaatccagtatctgcctttgg

SEQ ID NO: 17465 - DNA, 25 bp, Homo sapien
actggaatccagtgtctgcctttgg

SEQ ID NO: 17466 - DNA, 25 bp, Homo sapien
actggaatgaggacacagggaataa

SEQ ID NO: 17467 - DNA, 25 bp, Homo sapien
actggaatgcataagattaatgaag

SEQ ID NO: 17468 - DNA, 25 bp, Homo sapien
actggaatggaacaaaattaagaag

SEQ ID NO: 17469 - DNA, 25 bp, Homo sapien
actggaatggaacagaattaagaag

SEQ ID NO: 17470 - DNA, 25 bp, Homo sapien
actggaatggataagattaatgaag

SEQ ID NO: 17471 - DNA, 25 bp, Homo sapien
actggaattcacacgcttactgaac

SEQ ID NO: 17472 - DNA, 25 bp, Homo sapien
actggaattcacatgcttactgaac

SEQ ID NO: 17473 - DNA, 25 bp, Homo sapien
actggaattcttagactgaaaggaa

SEQ ID NO: 17474 - DNA, 25 bp, Homo sapien
actggaatttttagactgaaaggaa

SEQ ID NO: 17475 - DNA, 25 bp, Homo sapien
actggacaatcgaacaatgtgattt

SEQ ID NO: 17476 - DNA, 25 bp, Homo sapien
actggacaatctaacaatgtgattt

SEQ ID NO: 17477 - DNA, 25 bp, Homo sapien
actggacaatttacataagggtatg

SEQ ID NO: 17478 - DNA, 25 bp, Homo sapien
actggacaatttagataagggtatg

SEQ ID NO: 17479 - DNA, 25 bp, Homo sapien
actggacatctactgggaatccaga

SEQ ID NO: 17480 - DNA, 25 bp, Homo sapien
actggacatctattgggaatccaga

SEQ ID NO: 17481 - DNA, 25 bp, Homo sapien
actggactgaaactgaaaggaaacc

SEQ ID NO: 17482 - DNA, 25 bp, Homo sapien
actggactgaaattgaaaggaaacc

SEQ ID NO: 17483 - DNA, 25 bp, Homo sapien
actggactgggtactccctattgtt

SEQ ID NO: 17484 - DNA, 25 bp, Homo sapien
actggactgggtattccctattgtt

SEQ ID NO: 17485 - DNA, 25 bp, Homo sapien
actggactgttccttttggttagca

SEQ ID NO: 17486 - DNA, 25 bp, Homo sapien
actggactgttctttttggttagca

SEQ ID NO: 17487 - DNA, 25 bp, Homo sapien
actggagacgaggtacagttttatt

SEQ ID NO: 17488 - DNA, 25 bp, Homo sapien
actggagagagaaaaattatgtttc

SEQ ID NO: 17489 - DNA, 25 bp, Homo sapien
actggagagagaaatattatgtttc

SEQ ID NO: 17490 - DNA, 25 bp, Homo sapien
actggagagttcatcaccaatagac

SEQ ID NO: 17491 - DNA, 25 bp, Homo sapien
actggagagttcgtcaccaatagac

SEQ ID NO: 17492 - DNA, 25 bp, Homo sapien
actggagatgaggtacagttttatt

SEQ ID NO: 17493 - DNA, 25 bp, Homo sapien
actggagattacagcgcattctttc

SEQ ID NO: 17494 - DNA, 25 bp, Homo sapien
actggagattacagtgcattctttc

SEQ ID NO: 17495 - DNA, 25 bp, Homo sapien
actggagcccaatagcttcattggg

SEQ ID NO: 17496 - DNA, 25 bp, Homo sapien
actggagcctaatagcttcattggg

SEQ ID NO: 17497 - DNA, 25 bp, Homo sapien
actggaggcaagaaatctgagctca

SEQ ID NO: 17498 - DNA, 25 bp, Homo sapien
actggaggcaagaagtctgagctca

SEQ ID NO: 17499 - DNA, 25 bp, Homo sapien
actggagtagacacactaacacata

SEQ ID NO: 17500 - DNA, 25 bp, Homo sapien
actggagtagacaccctaacacata

SEQ ID NO: 17501 - DNA, 25 bp, Homo sapien
actggatactcaaactgttcttagg

SEQ ID NO: 17502 - DNA, 25 bp, Homo sapien
actggatactcaaacttttcttagg

SEQ ID NO: 17503 - DNA, 25 bp, Homo sapien
actggatcccggactaggaaaagga

SEQ ID NO: 17504 - DNA, 25 bp, Homo sapien
actggatcctggactaggaaaagga

SEQ ID NO: 17505 - DNA, 25 bp, Homo sapien
actggatctaatcttatttatgcaa

SEQ ID NO: 17506 - DNA, 25 bp, Homo sapien
actggatctcatcttatttatgcaa

SEQ ID NO: 17507 - DNA, 25 bp, Homo sapien
actggatgaaactgaaggtcacggc

SEQ ID NO: 17508 - DNA, 25 bp, Homo sapien
actggatgaaattgaaggtcacggc

SEQ ID NO: 17509 - DNA, 25 bp, Homo sapien
actggattaaaacaaattgtgatta

SEQ ID NO: 17510 - DNA, 25 bp, Homo sapien
actggattaatcccatgtgtttgag

SEQ ID NO: 17511 - DNA, 25 bp, Homo sapien
actggattaatcccttgtgtttgag

SEQ ID NO: 17512 - DNA, 25 bp, Homo sapien
actggattaattggatgctttacaa

SEQ ID NO: 17513 - DNA, 25 bp, Homo sapien
actggattacaacaaattgtgatta

SEQ ID NO: 17514 - DNA, 25 bp, Homo sapien
actggattgattggatgctttacaa

SEQ ID NO: 17515 - DNA, 25 bp, Homo sapien
actggatttagtaactgcaggtaag

SEQ ID NO: 17516 - DNA, 25 bp, Homo sapien
actggatttagtaattgcaggtaag

SEQ ID NO: 17517 - DNA, 25 bp, Homo sapien
actggcaaaaccagctcgtggacaa

SEQ ID NO: 17518 - DNA, 25 bp, Homo sapien
actggcaaaaccagcttgtggacaa

SEQ ID NO: 17519 - DNA, 25 bp, Homo sapien
actggcaagactgaaatttgaactc

SEQ ID NO: 17520 - DNA, 25 bp, Homo sapien
actggcaagactggaatttgaactc

SEQ ID NO: 17521 - DNA, 25 bp, Homo sapien
actggcacaacatacattgcaaata

SEQ ID NO: 17522 - DNA, 25 bp, Homo sapien
actggcacaccatacattgcaaata

SEQ ID NO: 17523 - DNA, 25 bp, Homo sapien
actggcattagtgaaattgcttcct

SEQ ID NO: 17524 - DNA, 25 bp, Homo sapien
actggcattagtgacattgcttcct

SEQ ID NO: 17525 - DNA, 25 bp, Homo sapien
actggccaccgaactgggaaggcct

SEQ ID NO: 17526 - DNA, 25 bp, Homo sapien
actggccactgaactgggaaggcct

SEQ ID NO: 17527 - DNA, 25 bp, Homo sapien
actggccagtcagataagaaataca

SEQ ID NO: 17528 - DNA, 25 bp, Homo sapien
actggccagtcaggtaagaaataca

SEQ ID NO: 17529 - DNA, 25 bp, Homo sapien
actggccatccagaactaatgccca

SEQ ID NO: 17530 - DNA, 25 bp, Homo sapien
actggccatccggaactaatgccca

SEQ ID NO: 17531 - DNA, 25 bp, Homo sapien
actggcccagtacagccgatggaag

SEQ ID NO: 17532 - DNA, 25 bp, Homo sapien
actggcccagtatagccgatggaag

SEQ ID NO: 17533 - DNA, 25 bp, Homo sapien
actggccttagctggccgaatcttc

SEQ ID NO: 17534 - DNA, 25 bp, Homo sapien
actggccttggctggccgaatcttc

SEQ ID NO: 17535 - DNA, 25 bp, Homo sapien
actggctactcttccaacgcaccat

SEQ ID NO: 17536 - DNA, 25 bp, Homo sapien
actggctactctttcaacgcaccat

SEQ ID NO: 17537 - DNA, 25 bp, Homo sapien
actggctcatgactcatactagggg

SEQ ID NO: 17538 - DNA, 25 bp, Homo sapien
actggctcatggctcatactagggg

SEQ ID NO: 17539 - DNA, 25 bp, Homo sapien
actggctgtccataattggtaaaca

SEQ ID NO: 17540 - DNA, 25 bp, Homo sapien
actggctgtccgtaattggtaaaca

SEQ ID NO: 17541 - DNA, 25 bp, Homo sapien
actggcttaagaaactcccgggagg

SEQ ID NO: 17542 - DNA, 25 bp, Homo sapien
actggcttaggaaactcccgggagg

SEQ ID NO: 17543 - DNA, 25 bp, Homo sapien
actggcttcacataattttcatata

SEQ ID NO: 17544 - DNA, 25 bp, Homo sapien
actggcttcccgtgccgactccacg

SEQ ID NO: 17545 - DNA, 25 bp, Homo sapien
actggcttcgcataattttcatata

SEQ ID NO: 17546 - DNA, 25 bp, Homo sapien
actggcttgaaggttgatgaaaatc

SEQ ID NO: 17547 - DNA, 25 bp, Homo sapien
actggcttgaagtttgatgaaaatc

SEQ ID NO: 17548 - DNA, 25 bp, Homo sapien
actggctttccgtgccgactccacg

SEQ ID NO: 17549 - DNA, 25 bp, Homo sapien
actgggaacaagccgagaatattgt

SEQ ID NO: 17550 - DNA, 25 bp, Homo sapien
actgggaaccacattaaggtatata

SEQ ID NO: 17551 - DNA, 25 bp, Homo sapien
actgggaaccacgttaaggtatata

SEQ ID NO: 17552 - DNA, 25 bp, Homo sapien
actgggaagaatgacgccttctata

SEQ ID NO: 17553 - DNA, 25 bp, Homo sapien
actgggaagaatgatgccttctata

SEQ ID NO: 17554 - DNA, 25 bp, Homo sapien
actgggaataagccgagaatattgt

SEQ ID NO: 17555 - DNA, 25 bp, Homo sapien
actgggaggttccgattttgttgtc

SEQ ID NO: 17556 - DNA, 25 bp, Homo sapien
actgggaggttctgattttgttgtc

SEQ ID NO: 17557 - DNA, 25 bp, Homo sapien
actgggatacaaaaaacaatgaaga

SEQ ID NO: 17558 - DNA, 25 bp, Homo sapien
actgggatacagaaaacaatgaaga

SEQ ID NO: 17559 - DNA, 25 bp, Homo sapien
actgggatccaaggaccgtacattc

SEQ ID NO: 17560 - DNA, 25 bp, Homo sapien
actgggatccagggaccgtacattc

SEQ ID NO: 17561 - DNA, 25 bp, Homo sapien
actgggatttccgacattcattcca

SEQ ID NO: 17562 - DNA, 25 bp, Homo sapien
actgggatttctgacattcattcca

SEQ ID NO: 17563 - DNA, 25 bp, Homo sapien
actgggcagcgaaacaacacatcca

SEQ ID NO: 17564 - DNA, 25 bp, Homo sapien
actgggcagtgaaacaacacatcca

SEQ ID NO: 17565 - DNA, 25 bp, Homo sapien
actgggccactcggccttccatgtc

SEQ ID NO: 17566 - DNA, 25 bp, Homo sapien
actgggccactcgggcttccatgtc

SEQ ID NO: 17567 - DNA, 25 bp, Homo sapien
actgggctacgtgttcagctaattg

SEQ ID NO: 17568 - DNA, 25 bp, Homo sapien
actgggctacgtgttcggctaattg

SEQ ID NO: 17569 - DNA, 25 bp, Homo sapien
actggggaatcccttacatttcagt

SEQ ID NO: 17570 - DNA, 25 bp, Homo sapien
actggggaatcctttacatttcagt

SEQ ID NO: 17571 - DNA, 25 bp, Homo sapien
actggggagatgcaattcagcccat

SEQ ID NO: 17572 - DNA, 25 bp, Homo sapien
actggggagatgcatttcagcccat

SEQ ID NO: 17573 - DNA, 25 bp, Homo sapien
actgggggcgcaaagagcttcgttt

SEQ ID NO: 17574 - DNA, 25 bp, Homo sapien
actgggggtgcaaagagcttcgttt

SEQ ID NO: 17575 - DNA, 25 bp, Homo sapien
actgggtactccctattgtttctgg

SEQ ID NO: 17576 - DNA, 25 bp, Homo sapien
actgggtattccctattgtttctgg

SEQ ID NO: 17577 - DNA, 25 bp, Homo sapien
actgggtgccagatacatacaaagc

SEQ ID NO: 17578 - DNA, 25 bp, Homo sapien
actgggtgccagatacgtacaaagc

SEQ ID NO: 17579 - DNA, 25 bp, Homo sapien
actggtacaatacaaacacataaat

SEQ ID NO: 17580 - DNA, 25 bp, Homo sapien
actggtacaatacagacacataaat

SEQ ID NO: 17581 - DNA, 25 bp, Homo sapien
actggtctccttgcgtaattgagag

SEQ ID NO: 17582 - DNA, 25 bp, Homo sapien
actggtctccttgtgtaattgagag

SEQ ID NO: 17583 - DNA, 25 bp, Homo sapien
actggtgataaagcatcatgaaatt

SEQ ID NO: 17584 - DNA, 25 bp, Homo sapien
actggtgatgaagcatcatgaaatt

SEQ ID NO: 17585 - DNA, 25 bp, Homo sapien
actggtggacctacaagtaagtaat

SEQ ID NO: 17586 - DNA, 25 bp, Homo sapien
actggtggccctacaagtaagtaat

SEQ ID NO: 17587 - DNA, 25 bp, Homo sapien
actggtggtactaccaaggctttga

SEQ ID NO: 17588 - DNA, 25 bp, Homo sapien
actggtggtactatcaaggctttga

SEQ ID NO: 17589 - DNA, 25 bp, Homo sapien
actggttactcctccgtgcactatc

SEQ ID NO: 17590 - DNA, 25 bp, Homo sapien
actggttatataatcatagacaagt

SEQ ID NO: 17591 - DNA, 25 bp, Homo sapien
actggttatgtaatcatagacaagt

SEQ ID NO: 17592 - DNA, 25 bp, Homo sapien
actggttattcctccgtgcactatc

SEQ ID NO: 17593 - DNA, 25 bp, Homo sapien
actggttctgtcaaaaccctaactt

SEQ ID NO: 17594 - DNA, 25 bp, Homo sapien
actggttctgtcaaaagcctaactt

SEQ ID NO: 17595 - DNA, 25 bp, Homo sapien
actggttgcgtgttaactggtatgt

SEQ ID NO: 17596 - DNA, 25 bp, Homo sapien
actggttgtgtgttaactggtatgt

SEQ ID NO: 17597 - DNA, 25 bp, Homo sapien
actggttttgctattacggtaatgc

SEQ ID NO: 17598 - DNA, 25 bp, Homo sapien
actggttttgctattagggtaatgc

SEQ ID NO: 17599 - DNA, 25 bp, Homo sapien
actgtaacaaaactgaagggttagg

SEQ ID NO: 17600 - DNA, 25 bp, Homo sapien
actgtaacaaaattgaagggttagg

SEQ ID NO: 17601 - DNA, 25 bp, Homo sapien
actgtacaaccagcaagtagagtct

SEQ ID NO: 17602 - DNA, 25 bp, Homo sapien
actgtacatccagcaagtagagtct

SEQ ID NO: 17603 - DNA, 25 bp, Homo sapien
actgtacattcaatgttttttgggg

SEQ ID NO: 17604 - DNA, 25 bp, Homo sapien
actgtacattcattgttttttgggg

SEQ ID NO: 17605 - DNA, 25 bp, Homo sapien
actgtactatgcgtctgcctcttta

SEQ ID NO: 17606 - DNA, 25 bp, Homo sapien
actgtactgtgcgtctgcctcttta

SEQ ID NO: 17607 - DNA, 25 bp, Homo sapien
actgtactttaaaactgccacaggc

SEQ ID NO: 17608 - DNA, 25 bp, Homo sapien
actgtactttaaaattgccacaggc

SEQ ID NO: 17609 - DNA, 25 bp, Homo sapien
actgtagaactctaacatgggatcc

SEQ ID NO: 17610 - DNA, 25 bp, Homo sapien
actgtagaagtctaacatgggatcc

SEQ ID NO: 17611 - DNA, 25 bp, Homo sapien
actgtagaccactgcatacatctgt

SEQ ID NO: 17612 - DNA, 25 bp, Homo sapien
actgtagacttttccagataggata

SEQ ID NO: 17613 - DNA, 25 bp, Homo sapien
actgtagactttttcagataggata

SEQ ID NO: 17614 - DNA, 25 bp, Homo sapien
actgtagagattcatcggctcctcc

SEQ ID NO: 17615 - DNA, 25 bp, Homo sapien
actgtagagcactgcatacatctgt

SEQ ID NO: 17616 - DNA, 25 bp, Homo sapien
actgtagagtttcatcggctcctcc

SEQ ID NO: 17617 - DNA, 25 bp, Homo sapien
actgtagatccatcaaccttgcaat

SEQ ID NO: 17618 - DNA, 25 bp, Homo sapien
actgtagattcatcaaccttgcaat

SEQ ID NO: 17619 - DNA, 25 bp, Homo sapien
actgtagcacaatattgattgcaca

SEQ ID NO: 17620 - DNA, 25 bp, Homo sapien
actgtagcacaatatttattgcaca

SEQ ID NO: 17621 - DNA, 25 bp, Homo sapien
actgtagcactagacttgtgaattt

SEQ ID NO: 17622 - DNA, 25 bp, Homo sapien
actgtagcactagtcttgtgaattt

SEQ ID NO: 17623 - DNA, 25 bp, Homo sapien
actgtaggttgattgacagaaataa

SEQ ID NO: 17624 - DNA, 25 bp, Homo sapien
actgtaggttgattgatagaaataa

SEQ ID NO: 17625 - DNA, 25 bp, Homo sapien
actgtatgttttcattcgctttgtt

SEQ ID NO: 17626 - DNA, 25 bp, Homo sapien
actgtatgttttcatttgctttgtt

SEQ ID NO: 17627 - DNA, 25 bp, Homo sapien
actgtattaagcgtccagtcagata

SEQ ID NO: 17628 - DNA, 25 bp, Homo sapien
actgtattaagtgtccagtcagata

SEQ ID NO: 17629 - DNA, 25 bp, Homo sapien
actgtattcacacacttcttttgga

SEQ ID NO: 17630 - DNA, 25 bp, Homo sapien
actgtattcacatacttcttttgga

SEQ ID NO: 17631 - DNA, 25 bp, Homo sapien
actgtattgacatgaataaattccc

SEQ ID NO: 17632 - DNA, 25 bp, Homo sapien
actgtattgagcattacaataagtg

SEQ ID NO: 17633 - DNA, 25 bp, Homo sapien
actgtattgagcattataataagtg

SEQ ID NO: 17634 - DNA, 25 bp, Homo sapien
actgtattggacaaaactagagggg

SEQ ID NO: 17635 - DNA, 25 bp, Homo sapien
actgtattggataaaactagagggg

SEQ ID NO: 17636 - DNA, 25 bp, Homo sapien
actgtattgtcatgaataaattccc

SEQ ID NO: 17637 - DNA, 25 bp, Homo sapien
actgtatttaaaattggcttattcc

SEQ ID NO: 17638 - DNA, 25 bp, Homo sapien
actgtattttaaattggcttattcc

SEQ ID NO: 17639 - DNA, 25 bp, Homo sapien
actgtattttaacgtaaaacatgca

SEQ ID NO: 17640 - DNA, 25 bp, Homo sapien
actgtattttaatgtaaaacatgca

SEQ ID NO: 17641 - DNA, 25 bp, Homo sapien
actgtattttcaccgcaattttcta

SEQ ID NO: 17642 - DNA, 25 bp, Homo sapien
actgtattttcactgcaattttcta

SEQ ID NO: 17643 - DNA, 25 bp, Homo sapien
actgtcaagaccggagtttcagtgt

SEQ ID NO: 17644 - DNA, 25 bp, Homo sapien
actgtcaagacctgagtttcagtgt

SEQ ID NO: 17645 - DNA, 25 bp, Homo sapien
actgtcaagtttcttattccatgtt

SEQ ID NO: 17646 - DNA, 25 bp, Homo sapien
actgtcaagttttttattccatgtt

SEQ ID NO: 17647 - DNA, 25 bp, Homo sapien
actgtcacagcagaaagtgtcatca

SEQ ID NO: 17648 - DNA, 25 bp, Homo sapien
actgtcaccaccagataacaacaaa

SEQ ID NO: 17649 - DNA, 25 bp, Homo sapien
actgtcaccactagataacaacaaa

SEQ ID NO: 17650 - DNA, 25 bp, Homo sapien
actgtcacctgaatgagactatgag

SEQ ID NO: 17651 - DNA, 25 bp, Homo sapien
actgtcacctgagtgagactatgag

SEQ ID NO: 17652 - DNA, 25 bp, Homo sapien
actgtcacggcagaaagtgtcatca

SEQ ID NO: 17653 - DNA, 25 bp, Homo sapien
actgtccaagattaaacctttctac

SEQ ID NO: 17654 - DNA, 25 bp, Homo sapien
actgtccaagattcaacctttctac

SEQ ID NO: 17655 - DNA, 25 bp, Homo sapien
actgtccactccatagaagaacaag

SEQ ID NO: 17656 - DNA, 25 bp, Homo sapien
actgtccactccgtagaagaacaag

SEQ ID NO: 17657 - DNA, 25 bp, Homo sapien
actgtccctaggcatgaagccattg

SEQ ID NO: 17658 - DNA, 25 bp, Homo sapien
actgtccctaggcgtgaagccattg

SEQ ID NO: 17659 - DNA, 25 bp, Homo sapien
actgtcctcagatatccgtcctctt

SEQ ID NO: 17660 - DNA, 25 bp, Homo sapien
actgtcctcagatatctgtcctctt

SEQ ID NO: 17661 - DNA, 25 bp, Homo sapien
actgtccttcccgaaagcagccctc

SEQ ID NO: 17662 - DNA, 25 bp, Homo sapien
actgtccttcctgaaagcagccctc

SEQ ID NO: 17663 - DNA, 25 bp, Homo sapien
actgtctaaaacataagtgctattt

SEQ ID NO: 17664 - DNA, 25 bp, Homo sapien
actgtctaaaacgtaagtgctattt

SEQ ID NO: 17665 - DNA, 25 bp, Homo sapien
actgtctaacacacggcagctgctt

SEQ ID NO: 17666 - DNA, 25 bp, Homo sapien
actgtctaacacatggcagctgctt

SEQ ID NO: 17667 - DNA, 25 bp, Homo sapien
actgtctaatgcccagaggtgaagc

SEQ ID NO: 17668 - DNA, 25 bp, Homo sapien
actgtctactgcaagaaagagaaaa

SEQ ID NO: 17669 - DNA, 25 bp, Homo sapien
actgtctactgcacgaaagagaaaa

SEQ ID NO: 17670 - DNA, 25 bp, Homo sapien
actgtctactgcccagaggtgaagc

SEQ ID NO: 17671 - DNA, 25 bp, Homo sapien
actgtcttcctatacattttcagaa

SEQ ID NO: 17672 - DNA, 25 bp, Homo sapien
actgtcttcctattcattttcagaa

SEQ ID NO: 17673 - DNA, 25 bp, Homo sapien
actgtgaaacgctgccaagaagagg

SEQ ID NO: 17674 - DNA, 25 bp, Homo sapien
actgtgaaagaacagctagagaaat

SEQ ID NO: 17675 - DNA, 25 bp, Homo sapien
actgtgaaatgctgccaagaagagg

SEQ ID NO: 17676 - DNA, 25 bp, Homo sapien
actgtgaagccatactatcaatagg

SEQ ID NO: 17677 - DNA, 25 bp, Homo sapien
actgtgaagccatactgtcaatagg

SEQ ID NO: 17678 - DNA, 25 bp, Homo sapien
actgtgaagctccaacagtcccaac

SEQ ID NO: 17679 - DNA, 25 bp, Homo sapien
actgtgaagctgcaacagtcccaac

SEQ ID NO: 17680 - DNA, 25 bp, Homo sapien
actgtgaaggaacagctagagaaat

SEQ ID NO: 17681 - DNA, 25 bp, Homo sapien
actgtgacctatagcatgtccttga

SEQ ID NO: 17682 - DNA, 25 bp, Homo sapien
actgtgacctatggcatgtccttga

SEQ ID NO: 17683 - DNA, 25 bp, Homo sapien
actgtgagtaaagtacattcttagg

SEQ ID NO: 17684 - DNA, 25 bp, Homo sapien
actgtgagtaaagtacgttcttagg

SEQ ID NO: 17685 - DNA, 25 bp, Homo sapien
actgtgagtagttacagcagtgaaa

SEQ ID NO: 17686 - DNA, 25 bp, Homo sapien
actgtgagtagttatagcagtgaaa

SEQ ID NO: 17687 - DNA, 25 bp, Homo sapien
actgtgatgacaccacttgatcaaa

SEQ ID NO: 17688 - DNA, 25 bp, Homo sapien
actgtgatgacaccgcttgatcaaa

SEQ ID NO: 17689 - DNA, 25 bp, Homo sapien
actgtgccaatgtattaaccagtat

SEQ ID NO: 17690 - DNA, 25 bp, Homo sapien
actgtgccattgtattaaccagtat

SEQ ID NO: 17691 - DNA, 25 bp, Homo sapien
actgtgcccatttcatattatagca

SEQ ID NO: 17692 - DNA, 25 bp, Homo sapien
actgtgcctatttcatattatagca

SEQ ID NO: 17693 - DNA, 25 bp, Homo sapien
actgtgctaagcagtgaagtcctca

SEQ ID NO: 17694 - DNA, 25 bp, Homo sapien
actgtgctaagtagtgaagtcctca

SEQ ID NO: 17695 - DNA, 25 bp, Homo sapien
actgtgctaagtcatttctttgcca

SEQ ID NO: 17696 - DNA, 25 bp, Homo sapien
actgtgctaagtcctttctttgcca

SEQ ID NO: 17697 - DNA, 25 bp, Homo sapien
actgtgctctcaatttcaatacatc

SEQ ID NO: 17698 - DNA, 25 bp, Homo sapien
actgtgctctcgatttcaatacatc

SEQ ID NO: 17699 - DNA, 25 bp, Homo sapien
actgtgcttataacgattgccagtt

SEQ ID NO: 17700 - DNA, 25 bp, Homo sapien
actgtgcttataatgattgccagtt

SEQ ID NO: 17701 - DNA, 25 bp, Homo sapien
actgtggagcaaccaagcatcctaa

SEQ ID NO: 17702 - DNA, 25 bp, Homo sapien
actgtggagcaagcaagcatcctaa

SEQ ID NO: 17703 - DNA, 25 bp, Homo sapien
actgtgggcccttaatacttatgga

SEQ ID NO: 17704 - DNA, 25 bp, Homo sapien
actgtgggcccttactacttatgga

SEQ ID NO: 17705 - DNA, 25 bp, Homo sapien
actgtggtcacacttccggacagca

SEQ ID NO: 17706 - DNA, 25 bp, Homo sapien
actgtggtcacacttctggacagca

SEQ ID NO: 17707 - DNA, 25 bp, Homo sapien
actgtggtggattccactgttcctt

SEQ ID NO: 17708 - DNA, 25 bp, Homo sapien
actgtggtggatttcactgttcctt

SEQ ID NO: 17709 - DNA, 25 bp, Homo sapien
actgtgtacattttcatagcttatc

SEQ ID NO: 17710 - DNA, 25 bp, Homo sapien
actgtgtacattttgatagcttatc

SEQ ID NO: 17711 - DNA, 25 bp, Homo sapien
actgtgtatccaccagtagtcactt

SEQ ID NO: 17712 - DNA, 25 bp, Homo sapien
actgtgtatccaccggtagtcactt

SEQ ID NO: 17713 - DNA, 25 bp, Homo sapien
actgtgtcaccctttaccaagcaag

SEQ ID NO: 17714 - DNA, 25 bp, Homo sapien
actgtgtcgccctttaccaagcaag

SEQ ID NO: 17715 - DNA, 25 bp, Homo sapien
actgtgtctctttcagctttaacac

SEQ ID NO: 17716 - DNA, 25 bp, Homo sapien
actgtgtctttttcagctttaacac

SEQ ID NO: 17717 - DNA, 25 bp, Homo sapien
actgtgtgcgttaacacgtaattta

SEQ ID NO: 17718 - DNA, 25 bp, Homo sapien
actgtgtgcgttaacatgtaattta

SEQ ID NO: 17719 - DNA, 25 bp, Homo sapien
actgtgttcagaaacctctcacatg

SEQ ID NO: 17720 - DNA, 25 bp, Homo sapien
actgtgttcagaaccctctcacatg

SEQ ID NO: 17721 - DNA, 25 bp, Homo sapien
actgtgttgaaagtaatgaaaaggc

SEQ ID NO: 17722 - DNA, 25 bp, Homo sapien
actgtgttgaacgtaatgaaaaggc

SEQ ID NO: 17723 - DNA, 25 bp, Homo sapien
actgtgttggggtctagcatgtatt

SEQ ID NO: 17724 - DNA, 25 bp, Homo sapien
actgtgttgggttctagcatgtatt

SEQ ID NO: 17725 - DNA, 25 bp, Homo sapien
actgtgttgtgcactagatagatat

SEQ ID NO: 17726 - DNA, 25 bp, Homo sapien
actgtgttgtgcattagatagatat

SEQ ID NO: 17727 - DNA, 25 bp, Homo sapien
actgtgttttaggcgataacatttc

SEQ ID NO: 17728 - DNA, 25 bp, Homo sapien
actgtgttttaggtgataacatttc

SEQ ID NO: 17729 - DNA, 25 bp, Homo sapien
actgtgttttgcccagagttaggac

SEQ ID NO: 17730 - DNA, 25 bp, Homo sapien
actgtgttttgcgcagagttaggac

SEQ ID NO: 17731 - DNA, 25 bp, Homo sapien
actgttaccatgaaaagagggcctg

SEQ ID NO: 17732 - DNA, 25 bp, Homo sapien
actgttaccatgagaagagggcctg

SEQ ID NO: 17733 - DNA, 25 bp, Homo sapien
actgttactgtccccgtaaaggtaa

SEQ ID NO: 17734 - DNA, 25 bp, Homo sapien
actgttactgtccctgtaaaggtaa

SEQ ID NO: 17735 - DNA, 25 bp, Homo sapien
actgttagccgatttaacagctgtt

SEQ ID NO: 17736 - DNA, 25 bp, Homo sapien
actgttagctgatttaacagctgtt

SEQ ID NO: 17737 - DNA, 25 bp, Homo sapien
actgttcaatgtccatattcctacc

SEQ ID NO: 17738 - DNA, 25 bp, Homo sapien
actgttcaatgttcatattcctacc

SEQ ID NO: 17739 - DNA, 25 bp, Homo sapien
actgttcacacacttgagaccaacc

SEQ ID NO: 17740 - DNA, 25 bp, Homo sapien
actgttcacacatttgagaccaacc

SEQ ID NO: 17741 - DNA, 25 bp, Homo sapien
actgttccattcctgttacacttgg

SEQ ID NO: 17742 - DNA, 25 bp, Homo sapien
actgttccattcttgttacacttgg

SEQ ID NO: 17743 - DNA, 25 bp, Homo sapien
actgttcttctctctggatcctgat

SEQ ID NO: 17744 - DNA, 25 bp, Homo sapien
actgttcttgtctctggatcctgat

SEQ ID NO: 17745 - DNA, 25 bp, Homo sapien
actgttgacagagctgtcgtcctca

SEQ ID NO: 17746 - DNA, 25 bp, Homo sapien
actgttgacagtgctgtcgtcctca

SEQ ID NO: 17747 - DNA, 25 bp, Homo sapien
actgtttaatagcaggttaagatga

SEQ ID NO: 17748 - DNA, 25 bp, Homo sapien
actgtttaatagcgggttaagatga

SEQ ID NO: 17749 - DNA, 25 bp, Homo sapien
actgtttataagacgcctacaataa

SEQ ID NO: 17750 - DNA, 25 bp, Homo sapien
actgtttataagatgcctacaataa

SEQ ID NO: 17751 - DNA, 25 bp, Homo sapien
actgtttattcccaattgcactgga

SEQ ID NO: 17752 - DNA, 25 bp, Homo sapien
actgtttattcctaattgcactgga

SEQ ID NO: 17753 - DNA, 25 bp, Homo sapien
actgtttcctcacgtggcagaaagg

SEQ ID NO: 17754 - DNA, 25 bp, Homo sapien
actgtttcctcacttggcagaaagg

SEQ ID NO: 17755 - DNA, 25 bp, Homo sapien
actgtttgcaacataaccacagctg

SEQ ID NO: 17756 - DNA, 25 bp, Homo sapien
actgtttgcaacataatcacagctg

SEQ ID NO: 17757 - DNA, 25 bp, Homo sapien
actgttttattcgtccagaaagact

SEQ ID NO: 17758 - DNA, 25 bp, Homo sapien
actgttttatttgtccagaaagact

SEQ ID NO: 17759 - DNA, 25 bp, Homo sapien
actgttttcaacgaggtttgattag

SEQ ID NO: 17760 - DNA, 25 bp, Homo sapien
actgttttcaatgaggtttgattag

SEQ ID NO: 17761 - DNA, 25 bp, Homo sapien
actgttttcctgaagtgggaagagg

SEQ ID NO: 17762 - DNA, 25 bp, Homo sapien
actgttttctgtagcacaatgcatc

SEQ ID NO: 17763 - DNA, 25 bp, Homo sapien
actgttttctgtagcataatgcatc

SEQ ID NO: 17764 - DNA, 25 bp, Homo sapien
actgtttttatactggagttctgtt

SEQ ID NO: 17765 - DNA, 25 bp, Homo sapien
actgtttttctgaagtgggaagagg

SEQ ID NO: 17766 - DNA, 25 bp, Homo sapien
actgtttttgtactggagttctgtt

SEQ ID NO: 17767 - DNA, 25 bp, Homo sapien
acttaaaaacctaaaatattagatg

SEQ ID NO: 17768 - DNA, 25 bp, Homo sapien
acttaaaaacctacaatattagatg

SEQ ID NO: 17769 - DNA, 25 bp, Homo sapien
acttaaaacttcttgcgccaaactg

SEQ ID NO: 17770 - DNA, 25 bp, Homo sapien
acttaaaacttcttgctccaaactg

SEQ ID NO: 17771 - DNA, 25 bp, Homo sapien
acttaaaatataccattcatcagtt

SEQ ID NO: 17772 - DNA, 25 bp, Homo sapien
acttaaaatcaacagatagaaattg

SEQ ID NO: 17773 - DNA, 25 bp, Homo sapien
acttaaaatcaacggatagaaattg

SEQ ID NO: 17774 - DNA, 25 bp, Homo sapien
acttaaaatgtaccattcatcagtt

SEQ ID NO: 17775 - DNA, 25 bp, Homo sapien
acttaaagctcaagcgctcttcaat

SEQ ID NO: 17776 - DNA, 25 bp, Homo sapien
acttaaagctcaagggctcttcaat

SEQ ID NO: 17777 - DNA, 25 bp, Homo sapien
acttaaatgacacccttgttattta

SEQ ID NO: 17778 - DNA, 25 bp, Homo sapien
acttaaatgtcacccttgttattta

SEQ ID NO: 17779 - DNA, 25 bp, Homo sapien
acttaacagaattgtaatcatgcag

SEQ ID NO: 17780 - DNA, 25 bp, Homo sapien
acttaacagaattttaatcatgcag

SEQ ID NO: 17781 - DNA, 25 bp, Homo sapien
acttaacatacagtaagcaatcaat

SEQ ID NO: 17782 - DNA, 25 bp, Homo sapien
acttaacatacggtaagcaatcaat

SEQ ID NO: 17783 - DNA, 25 bp, Homo sapien
acttaacatggccataattctctcc

SEQ ID NO: 17784 - DNA, 25 bp, Homo sapien
acttaacatggctataattctctcc

SEQ ID NO: 17785 - DNA, 25 bp, Homo sapien
acttaacgttacgccctctcaaaaa

SEQ ID NO: 17786 - DNA, 25 bp, Homo sapien
acttaacgttatgccctctcaaaaa

SEQ ID NO: 17787 - DNA, 25 bp, Homo sapien
acttaactactaatagcccactctg

SEQ ID NO: 17788 - DNA, 25 bp, Homo sapien
acttaactactgatagcccactctg

SEQ ID NO: 17789 - DNA, 25 bp, Homo sapien
acttaactcatcccaggctgaaggg

SEQ ID NO: 17790 - DNA, 25 bp, Homo sapien
acttaactcatgccaggctgaaggg

SEQ ID NO: 17791 - DNA, 25 bp, Homo sapien
acttaactccaccccagactgcttt

SEQ ID NO: 17792 - DNA, 25 bp, Homo sapien
acttaactccacccgagactgcttt

SEQ ID NO: 17793 - DNA, 25 bp, Homo sapien
acttaactctgagtgtgaacgaaaa

SEQ ID NO: 17794 - DNA, 25 bp, Homo sapien
acttaactctgagtttgaacgaaaa

SEQ ID NO: 17795 - DNA, 25 bp, Homo sapien
acttaactggaaaatgaaacactta

SEQ ID NO: 17796 - DNA, 25 bp, Homo sapien
acttaactggaaagtgaaacactta

SEQ ID NO: 17797 - DNA, 25 bp, Homo sapien
acttaactttcaactagtatccagt

SEQ ID NO: 17798 - DNA, 25 bp, Homo sapien
acttaactttcatctagtatccagt

SEQ ID NO: 17799 - DNA, 25 bp, Homo sapien
acttaagctcatagacatgtttaaa

SEQ ID NO: 17800 - DNA, 25 bp, Homo sapien
acttaagctcataggcatgtttaaa

SEQ ID NO: 17801 - DNA, 25 bp, Homo sapien
acttaagggtgcatttatctgctga

SEQ ID NO: 17802 - DNA, 25 bp, Homo sapien
acttaagggtgcatttgtctgctga

SEQ ID NO: 17803 - DNA, 25 bp, Homo sapien
acttaaggttacgtacagcagtcag

SEQ ID NO: 17804 - DNA, 25 bp, Homo sapien
acttaaggttaggtacagcagtcag

SEQ ID NO: 17805 - DNA, 25 bp, Homo sapien
acttaagtacacttgctttacaggg

SEQ ID NO: 17806 - DNA, 25 bp, Homo sapien
acttaagtacatttgctttacaggg

SEQ ID NO: 17807 - DNA, 25 bp, Homo sapien
acttaatatccataagcaaaatcaa

SEQ ID NO: 17808 - DNA, 25 bp, Homo sapien
acttaatatccgtaagcaaaatcaa

SEQ ID NO: 17809 - DNA, 25 bp, Homo sapien
acttaatcatccagcagtgtcctaa

SEQ ID NO: 17810 - DNA, 25 bp, Homo sapien
acttaatcattacagttgtggggaa

SEQ ID NO: 17811 - DNA, 25 bp, Homo sapien
acttaatcattacggttgtggggaa

SEQ ID NO: 17812 - DNA, 25 bp, Homo sapien
acttaatcgtccagcagtgtcctaa

SEQ ID NO: 17813 - DNA, 25 bp, Homo sapien
acttaatgaatgaatactgaccatg

SEQ ID NO: 17814 - DNA, 25 bp, Homo sapien
acttaatgaatgaatattgaccatg

SEQ ID NO: 17815 - DNA, 25 bp, Homo sapien
acttacaaactgcatctcaatttcc

SEQ ID NO: 17816 - DNA, 25 bp, Homo sapien
acttacaaactgtatctcaatttcc

SEQ ID NO: 17817 - DNA, 25 bp, Homo sapien
acttacaaatgctaccagtgtggat

SEQ ID NO: 17818 - DNA, 25 bp, Homo sapien
acttacaaatgttaccagtgtggat

SEQ ID NO: 17819 - DNA, 25 bp, Homo sapien
acttacacaaaaaatttcgcagtga

SEQ ID NO: 17820 - DNA, 25 bp, Homo sapien
acttacacagaaaatttcgcagtga

SEQ ID NO: 17821 - DNA, 25 bp, Homo sapien
acttacactgactctctcagttcct

SEQ ID NO: 17822 - DNA, 25 bp, Homo sapien
acttacactgagtctctcagttcct

SEQ ID NO: 17823 - DNA, 25 bp, Homo sapien
acttacagacaatcgttatcttgct

SEQ ID NO: 17824 - DNA, 25 bp, Homo sapien
acttacagacaattgttatcttgct

SEQ ID NO: 17825 - DNA, 25 bp, Homo sapien
acttacagcaagcgacaagtcaaag

SEQ ID NO: 17826 - DNA, 25 bp, Homo sapien
acttacagcaagtgacaagtcaaag

SEQ ID NO: 17827 - DNA, 25 bp, Homo sapien
acttacagcagttacacagtagtta

SEQ ID NO: 17828 - DNA, 25 bp, Homo sapien
acttacagcggttacacagtagtta

SEQ ID NO: 17829 - DNA, 25 bp, Homo sapien
acttaccatgcaatacttttccaat

SEQ ID NO: 17830 - DNA, 25 bp, Homo sapien
acttaccatgcagtacttttccaat

SEQ ID NO: 17831 - DNA, 25 bp, Homo sapien
acttacctagctgcccatgtctgag

SEQ ID NO: 17832 - DNA, 25 bp, Homo sapien
acttacctagctgcccttgtctgag

SEQ ID NO: 17833 - DNA, 25 bp, Homo sapien
acttacctccatataatacattcag

SEQ ID NO: 17834 - DNA, 25 bp, Homo sapien
acttacctccatgtaatacattcag

SEQ ID NO: 17835 - DNA, 25 bp, Homo sapien
acttactatctctctccgttgcatc

SEQ ID NO: 17836 - DNA, 25 bp, Homo sapien
acttactatctctctctgttgcatc

SEQ ID NO: 17837 - DNA, 25 bp, Homo sapien
acttactggttatataatcatagac

SEQ ID NO: 17838 - DNA, 25 bp, Homo sapien
acttactggttatgtaatcatagac

SEQ ID NO: 17839 - DNA, 25 bp, Homo sapien
acttactggttttcaggacagtgtc

SEQ ID NO: 17840 - DNA, 25 bp, Homo sapien
acttactggttttcgggacagtgtc

SEQ ID NO: 17841 - DNA, 25 bp, Homo sapien
acttactgtaacagagcttgatttc

SEQ ID NO: 17842 - DNA, 25 bp, Homo sapien
acttactgtaatagagcttgatttc

SEQ ID NO: 17843 - DNA, 25 bp, Homo sapien
acttacttcagtgtctgagctttaa

SEQ ID NO: 17844 - DNA, 25 bp, Homo sapien
acttactttagtgtctgagctttaa

SEQ ID NO: 17845 - DNA, 25 bp, Homo sapien
acttagaaaccagtttagagaactg

SEQ ID NO: 17846 - DNA, 25 bp, Homo sapien
acttagaaaccggtttagagaactg

SEQ ID NO: 17847 - DNA, 25 bp, Homo sapien
acttagaacttcaacttttgaatct

SEQ ID NO: 17848 - DNA, 25 bp, Homo sapien
acttagaacttcaatttttgaatct

SEQ ID NO: 17849 - DNA, 25 bp, Homo sapien
acttagactgagtaaaagtattgct

SEQ ID NO: 17850 - DNA, 25 bp, Homo sapien
acttagactgagtgaaagtattgct

SEQ ID NO: 17851 - DNA, 25 bp, Homo sapien
acttagcagagacgaaataccaaaa

SEQ ID NO: 17852 - DNA, 25 bp, Homo sapien
acttagcagagatgaaataccaaaa

SEQ ID NO: 17853 - DNA, 25 bp, Homo sapien
acttagcatcacactctgcatgcag

SEQ ID NO: 17854 - DNA, 25 bp, Homo sapien
acttagcatcacgctctgcatgcag

SEQ ID NO: 17855 - DNA, 25 bp, Homo sapien
acttagctgaaaccaccatatagag

SEQ ID NO: 17856 - DNA, 25 bp, Homo sapien
acttagctgaatccaccatatagag

SEQ ID NO: 17857 - DNA, 25 bp, Homo sapien
acttaggaaactgaatctatcctgt

SEQ ID NO: 17858 - DNA, 25 bp, Homo sapien
acttaggaaacttaatctatcctgt

SEQ ID NO: 17859 - DNA, 25 bp, Homo sapien
acttaggcacccaagagaaaatctt

SEQ ID NO: 17860 - DNA, 25 bp, Homo sapien
acttaggcacccaggagaaaatctt

SEQ ID NO: 17861 - DNA, 25 bp, Homo sapien
acttaggcaggctatcccaagaaaa

SEQ ID NO: 17862 - DNA, 25 bp, Homo sapien
acttaggcaggttatcccaagaaaa

SEQ ID NO: 17863 - DNA, 25 bp, Homo sapien
acttaggcattcgttcttatcaggt

SEQ ID NO: 17864 - DNA, 25 bp, Homo sapien
acttaggcatttgttcttatcaggt

SEQ ID NO: 17865 - DNA, 25 bp, Homo sapien
acttagggtagcacatggcacacag

SEQ ID NO: 17866 - DNA, 25 bp, Homo sapien
acttagggtagcacgtggcacacag

SEQ ID NO: 17867 - DNA, 25 bp, Homo sapien
acttagtcatatttctcttgcattc

SEQ ID NO: 17868 - DNA, 25 bp, Homo sapien
acttagtccatgactttcccttgct

SEQ ID NO: 17869 - DNA, 25 bp, Homo sapien
acttagtccatgattttcccttgct

SEQ ID NO: 17870 - DNA, 25 bp, Homo sapien
acttagtccgagtaaaggtcacaag

SEQ ID NO: 17871 - DNA, 25 bp, Homo sapien
acttagtcgatacatctcttcgtgt

SEQ ID NO: 17872 - DNA, 25 bp, Homo sapien
acttagtcgatatatctcttcgtgt

SEQ ID NO: 17873 - DNA, 25 bp, Homo sapien
acttagtcgtatttctcttgcattc

SEQ ID NO: 17874 - DNA, 25 bp, Homo sapien
acttagtctgagtaaaggtcacaag

SEQ ID NO: 17875 - DNA, 25 bp, Homo sapien
acttagtgaaagttaagataacaca

SEQ ID NO: 17876 - DNA, 25 bp, Homo sapien
acttagtgaaatttaagataacaca

SEQ ID NO: 17877 - DNA, 25 bp, Homo sapien
acttagtgagtcaaattcgaccatt

SEQ ID NO: 17878 - DNA, 25 bp, Homo sapien
acttagtgagttaaattcgaccatt

SEQ ID NO: 17879 - DNA, 25 bp, Homo sapien
acttagttcagagtcgctctttgac

SEQ ID NO: 17880 - DNA, 25 bp, Homo sapien
acttagttcagagttgctctttgac

SEQ ID NO: 17881 - DNA, 25 bp, Homo sapien
acttagttcggagctaccttgagta

SEQ ID NO: 17882 - DNA, 25 bp, Homo sapien
acttagttcttcgacgcagagcttt

SEQ ID NO: 17883 - DNA, 25 bp, Homo sapien
acttagttctttgacgcagagcttt

SEQ ID NO: 17884 - DNA, 25 bp, Homo sapien
acttagtttggagctaccttgagta

SEQ ID NO: 17885 - DNA, 25 bp, Homo sapien
acttataaaacatatagcaaacatg

SEQ ID NO: 17886 - DNA, 25 bp, Homo sapien
acttataaaacgtatagcaaacatg

SEQ ID NO: 17887 - DNA, 25 bp, Homo sapien
acttataaaccactgactgcttccc

SEQ ID NO: 17888 - DNA, 25 bp, Homo sapien
acttataaaccattgactgcttccc

SEQ ID NO: 17889 - DNA, 25 bp, Homo sapien
acttatatatttaaagctgtgtgcc

SEQ ID NO: 17890 - DNA, 25 bp, Homo sapien
acttatatatttaaagttgtgtgcc

SEQ ID NO: 17891 - DNA, 25 bp, Homo sapien
acttatctcggtctgagtcagtatc

SEQ ID NO: 17892 - DNA, 25 bp, Homo sapien
acttatctgatctatacgtaaccaa

SEQ ID NO: 17893 - DNA, 25 bp, Homo sapien
acttatctgatctgtacgtaaccaa

SEQ ID NO: 17894 - DNA, 25 bp, Homo sapien
acttatctgtgacaggtataccctt

SEQ ID NO: 17895 - DNA, 25 bp, Homo sapien
acttatctgtggcaggtataccctt

SEQ ID NO: 17896 - DNA, 25 bp, Homo sapien
acttatcttggtctgagtcagtatc

SEQ ID NO: 17897 - DNA, 25 bp, Homo sapien
acttatgaggataactaatacattg

SEQ ID NO: 17898 - DNA, 25 bp, Homo sapien
acttatgaggatagctaatacattg

SEQ ID NO: 17899 - DNA, 25 bp, Homo sapien
acttatgattgccctcattacgtag

SEQ ID NO: 17900 - DNA, 25 bp, Homo sapien
acttatgattgctctcattacgtag

SEQ ID NO: 17901 - DNA, 25 bp, Homo sapien
acttatgcaagtaacaatccaggaa

SEQ ID NO: 17902 - DNA, 25 bp, Homo sapien
acttatgcaagtaagtcagattttg

SEQ ID NO: 17903 - DNA, 25 bp, Homo sapien
acttatgcaagtgagtcagattttg

SEQ ID NO: 17904 - DNA, 25 bp, Homo sapien
acttatgcatagtctctttgtgaaa

SEQ ID NO: 17905 - DNA, 25 bp, Homo sapien
acttatgcatattctctttgtgaaa

SEQ ID NO: 17906 - DNA, 25 bp, Homo sapien
acttatgccattcaagaataaaaat

SEQ ID NO: 17907 - DNA, 25 bp, Homo sapien
acttatgccattcaaggataaaaat

SEQ ID NO: 17908 - DNA, 25 bp, Homo sapien
acttatgcgagtaacaatccaggaa

SEQ ID NO: 17909 - DNA, 25 bp, Homo sapien
acttatgtcaaagcgcagggtcaca

SEQ ID NO: 17910 - DNA, 25 bp, Homo sapien
acttatgtcaaagctcagggtcaca

SEQ ID NO: 17911 - DNA, 25 bp, Homo sapien
acttattatcttacagtttcagaga

SEQ ID NO: 17912 - DNA, 25 bp, Homo sapien
acttattatcttatagtttcagaga

SEQ ID NO: 17913 - DNA, 25 bp, Homo sapien
acttattattgtgagcagtaggtct

SEQ ID NO: 17914 - DNA, 25 bp, Homo sapien
acttattattgtgagcggtaggtct

SEQ ID NO: 17915 - DNA, 25 bp, Homo sapien
acttattgattccacaccacttact

SEQ ID NO: 17916 - DNA, 25 bp, Homo sapien
acttattgatttcacaccacttact

SEQ ID NO: 17917 - DNA, 25 bp, Homo sapien
acttattgcgaagaatgtacttcag

SEQ ID NO: 17918 - DNA, 25 bp, Homo sapien
acttattgtgaagaatgtacttcag

SEQ ID NO: 17919 - DNA, 25 bp, Homo sapien
acttatttattctcgtggatggtct

SEQ ID NO: 17920 - DNA, 25 bp, Homo sapien
acttatttattcttgtggatggtct

SEQ ID NO: 17921 - DNA, 25 bp, Homo sapien
acttatttgaatagcccgaagtggc

SEQ ID NO: 17922 - DNA, 25 bp, Homo sapien
acttatttgaatagccggaagtggc

SEQ ID NO: 17923 - DNA, 25 bp, Homo sapien
acttatttggagcagtgattgatga

SEQ ID NO: 17924 - DNA, 25 bp, Homo sapien
acttatttggagtagtgattgatga

SEQ ID NO: 17925 - DNA, 25 bp, Homo sapien
acttcaaaaggctccatggacccta

SEQ ID NO: 17926 - DNA, 25 bp, Homo sapien
acttcaaaaggcttcatggacccta

SEQ ID NO: 17927 - DNA, 25 bp, Homo sapien
acttcaaagatggcatagctgatag

SEQ ID NO: 17928 - DNA, 25 bp, Homo sapien
acttcaaagatggcgtagctgatag

SEQ ID NO: 17929 - DNA, 25 bp, Homo sapien
acttcaacccaggattttcacagca

SEQ ID NO: 17930 - DNA, 25 bp, Homo sapien
acttcaacgacttaaaatcatctgc

SEQ ID NO: 17931 - DNA, 25 bp, Homo sapien
acttcaacgacttacaatcatctgc

SEQ ID NO: 17932 - DNA, 25 bp, Homo sapien
acttcaactcaggattttcacagca

SEQ ID NO: 17933 - DNA, 25 bp, Homo sapien
acttcaactgtaaccttttaagaga

SEQ ID NO: 17934 - DNA, 25 bp, Homo sapien
acttcaactgtaatcttttaagaga

SEQ ID NO: 17935 - DNA, 25 bp, Homo sapien
acttcacaactactagggtggctgt

SEQ ID NO: 17936 - DNA, 25 bp, Homo sapien
acttcacaactgctagggtggctgt

SEQ ID NO: 17937 - DNA, 25 bp, Homo sapien
acttcacaccataaaatgatacatt

SEQ ID NO: 17938 - DNA, 25 bp, Homo sapien
acttcacaccataagatgatacatt

SEQ ID NO: 17939 - DNA, 25 bp, Homo sapien
acttcacaccgggatggctggcatg

SEQ ID NO: 17940 - DNA, 25 bp, Homo sapien
acttcacactgggatggctggcatg

SEQ ID NO: 17941 - DNA, 25 bp, Homo sapien
acttcaccaacacgtttgccctgta

SEQ ID NO: 17942 - DNA, 25 bp, Homo sapien
acttcaccaacccgtttgccctgta

SEQ ID NO: 17943 - DNA, 25 bp, Homo sapien
acttcagaagtaagtttctatgtta

SEQ ID NO: 17944 - DNA, 25 bp, Homo sapien
acttcagaagtatgtttctatgtta

SEQ ID NO: 17945 - DNA, 25 bp, Homo sapien
acttcagacttactaagcaaaaact

SEQ ID NO: 17946 - DNA, 25 bp, Homo sapien
acttcagagaacgatttcttaagca

SEQ ID NO: 17947 - DNA, 25 bp, Homo sapien
acttcagagaatgatttcttaagca

SEQ ID NO: 17948 - DNA, 25 bp, Homo sapien
acttcagatcctcgagtgctaacat

SEQ ID NO: 17949 - DNA, 25 bp, Homo sapien
acttcagatccttgagtgctaacat

SEQ ID NO: 17950 - DNA, 25 bp, Homo sapien
acttcagatttactaagcaaaaact

SEQ ID NO: 17951 - DNA, 25 bp, Homo sapien
acttcagccattacaaagttaggaa

SEQ ID NO: 17952 - DNA, 25 bp, Homo sapien
acttcagccattacaaggttaggaa

SEQ ID NO: 17953 - DNA, 25 bp, Homo sapien
acttcagctcttctctcatggtaat

SEQ ID NO: 17954 - DNA, 25 bp, Homo sapien
acttcagctcttctcttatggtaat

SEQ ID NO: 17955 - DNA, 25 bp, Homo sapien
acttcaggattcacagttcagctaa

SEQ ID NO: 17956 - DNA, 25 bp, Homo sapien
acttcaggattcatagttcagctaa

SEQ ID NO: 17957 - DNA, 25 bp, Homo sapien
acttcaggcttcacaggccatgcag

SEQ ID NO: 17958 - DNA, 25 bp, Homo sapien
acttcaggcttcgcaggccatgcag

SEQ ID NO: 17959 - DNA, 25 bp, Homo sapien
acttcaggtacaaagcatcaatgga

SEQ ID NO: 17960 - DNA, 25 bp, Homo sapien
acttcaggtgcaaagcatcaatgga

SEQ ID NO: 17961 - DNA, 25 bp, Homo sapien
acttcatacagagagtttggatgct

SEQ ID NO: 17962 - DNA, 25 bp, Homo sapien
acttcatacggagagtttggatgct

SEQ ID NO: 17963 - DNA, 25 bp, Homo sapien
acttcatataatgaattgcagttcc

SEQ ID NO: 17964 - DNA, 25 bp, Homo sapien
acttcatataatggattgcagttcc

SEQ ID NO: 17965 - DNA, 25 bp, Homo sapien
acttcatctcatattcacagagaca

SEQ ID NO: 17966 - DNA, 25 bp, Homo sapien
acttcatctccaagaataagtctca

SEQ ID NO: 17967 - DNA, 25 bp, Homo sapien
acttcatctccaataataagtctca

SEQ ID NO: 17968 - DNA, 25 bp, Homo sapien
acttcatctctgtaagcctgttttg

SEQ ID NO: 17969 - DNA, 25 bp, Homo sapien
acttcatctctgtaagtctgttttg

SEQ ID NO: 17970 - DNA, 25 bp, Homo sapien
acttcatcttatattcacagagaca

SEQ ID NO: 17971 - DNA, 25 bp, Homo sapien
acttcatcttcgtgtttcagcttac

SEQ ID NO: 17972 - DNA, 25 bp, Homo sapien
acttcatcttcgtttttcagcttac

SEQ ID NO: 17973 - DNA, 25 bp, Homo sapien
acttcatgcagtaatttcacccttg

SEQ ID NO: 17974 - DNA, 25 bp, Homo sapien
acttcatgcagtactttcacccttg

SEQ ID NO: 17975 - DNA, 25 bp, Homo sapien
acttccaaccaccaccatctgggtg

SEQ ID NO: 17976 - DNA, 25 bp, Homo sapien
acttccaaccaccgccatctgggtg

SEQ ID NO: 17977 - DNA, 25 bp, Homo sapien
acttccaagtcctatcttcttttca

SEQ ID NO: 17978 - DNA, 25 bp, Homo sapien
acttccaagtcctgtcttcttttca

SEQ ID NO: 17979 - DNA, 25 bp, Homo sapien
acttccagctttctgtcgggaaatc

SEQ ID NO: 17980 - DNA, 25 bp, Homo sapien
acttccagctttctgttgggaaatc

SEQ ID NO: 17981 - DNA, 25 bp, Homo sapien
acttcccaacaggatcagacctggg

SEQ ID NO: 17982 - DNA, 25 bp, Homo sapien
acttcccaataggatcagacctggg

SEQ ID NO: 17983 - DNA, 25 bp, Homo sapien
acttcccagacacgatgtggcaaga

SEQ ID NO: 17984 - DNA, 25 bp, Homo sapien
acttcccagacactatgtggcaaga

SEQ ID NO: 17985 - DNA, 25 bp, Homo sapien
acttccgctcatttccagtgatcca

SEQ ID NO: 17986 - DNA, 25 bp, Homo sapien
acttccgctcattttcagtgatcca

SEQ ID NO: 17987 - DNA, 25 bp, Homo sapien
acttcctaacaataaaccacattct

SEQ ID NO: 17988 - DNA, 25 bp, Homo sapien
acttcctaacactaaaccacattct

SEQ ID NO: 17989 - DNA, 25 bp, Homo sapien
acttcctagagacggccggagccag

SEQ ID NO: 17990 - DNA, 25 bp, Homo sapien
acttcctagagatggccggagccag

SEQ ID NO: 17991 - DNA, 25 bp, Homo sapien
acttcctcatgatacaatggcatgc

SEQ ID NO: 17992 - DNA, 25 bp, Homo sapien
acttcctcatgatagaatggcatgc

SEQ ID NO: 17993 - DNA, 25 bp, Homo sapien
acttcctggcagatgtatcctaaag

SEQ ID NO: 17994 - DNA, 25 bp, Homo sapien
acttcctggcagatttatcctaaag

SEQ ID NO: 17995 - DNA, 25 bp, Homo sapien
acttcctgtcgatgggccaaacggt

SEQ ID NO: 17996 - DNA, 25 bp, Homo sapien
acttcctgttgatgggccaaacggt

SEQ ID NO: 17997 - DNA, 25 bp, Homo sapien
acttctaaaattcactgtgatgtag

SEQ ID NO: 17998 - DNA, 25 bp, Homo sapien
acttctaaaatttactgtgatgtag

SEQ ID NO: 17999 - DNA, 25 bp, Homo sapien
acttctacaacatttaatttagcct

SEQ ID NO: 18000 - DNA, 25 bp, Homo sapien
acttctactacatttaatttagcct

SEQ ID NO: 18001 - DNA, 25 bp, Homo sapien
acttctagacagctgctttttacaa

SEQ ID NO: 18002 - DNA, 25 bp, Homo sapien
acttctagacagttgctttttacaa

SEQ ID NO: 18003 - DNA, 25 bp, Homo sapien
acttctagagacatcacgaatcctg

SEQ ID NO: 18004 - DNA, 25 bp, Homo sapien
acttctagagacttcacgaatcctg

SEQ ID NO: 18005 - DNA, 25 bp, Homo sapien
acttctatgcttattggtttataat

SEQ ID NO: 18006 - DNA, 25 bp, Homo sapien
acttctatgtttattggtttataat

SEQ ID NO: 18007 - DNA, 25 bp, Homo sapien
acttctcagtctccatagttatatg

SEQ ID NO: 18008 - DNA, 25 bp, Homo sapien
acttctcagtctgcatagttatatg

SEQ ID NO: 18009 - DNA, 25 bp, Homo sapien
acttctcattaacatgcaatcatca

SEQ ID NO: 18010 - DNA, 25 bp, Homo sapien
acttctcattaatatgcaatcatca

SEQ ID NO: 18011 - DNA, 25 bp, Homo sapien
acttctccagatagcaggatagctg

SEQ ID NO: 18012 - DNA, 25 bp, Homo sapien
acttctccagatcgcaggatagctg

SEQ ID NO: 18013 - DNA, 25 bp, Homo sapien
acttctctattcagtttatgattct

SEQ ID NO: 18014 - DNA, 25 bp, Homo sapien
acttctctattcggtttatgattct

SEQ ID NO: 18015 - DNA, 25 bp, Homo sapien
acttctctttggataacgacagtga

SEQ ID NO: 18016 - DNA, 25 bp, Homo sapien
acttctctttggataatgacagtga

SEQ ID NO: 18017 - DNA, 25 bp, Homo sapien
acttctgaaatgcaactttctggaa

SEQ ID NO: 18018 - DNA, 25 bp, Homo sapien
acttctgaaatgcgactttctggaa

SEQ ID NO: 18019 - DNA, 25 bp, Homo sapien
acttctgagcctctatattttcatt

SEQ ID NO: 18020 - DNA, 25 bp, Homo sapien
acttctgagcctctatgttttcatt

SEQ ID NO: 18021 - DNA, 25 bp, Homo sapien
acttctgattttgcatttcatttcc

SEQ ID NO: 18022 - DNA, 25 bp, Homo sapien
acttctgattttgtatttcatttcc

SEQ ID NO: 18023 - DNA, 25 bp, Homo sapien
acttctgcatttactcattgaattt

SEQ ID NO: 18024 - DNA, 25 bp, Homo sapien
acttctgccgtcaattacgaagttt

SEQ ID NO: 18025 - DNA, 25 bp, Homo sapien
acttctgccgtcagttacgaagttt

SEQ ID NO: 18026 - DNA, 25 bp, Homo sapien
acttctgccttaaccgaagagctct

SEQ ID NO: 18027 - DNA, 25 bp, Homo sapien
acttctgccttaatcgaagagctct

SEQ ID NO: 18028 - DNA, 25 bp, Homo sapien
acttctgcctttactcattgaattt

SEQ ID NO: 18029 - DNA, 25 bp, Homo sapien
acttctggttgaaagaatgcttgtc

SEQ ID NO: 18030 - DNA, 25 bp, Homo sapien
acttctggttgaaagagtgcttgtc

SEQ ID NO: 18031 - DNA, 25 bp, Homo sapien
acttctgtattcccttgcagatcct

SEQ ID NO: 18032 - DNA, 25 bp, Homo sapien
acttctgtattcctttgcagatcct

SEQ ID NO: 18033 - DNA, 25 bp, Homo sapien
acttctgtcttcttaaaaaatccag

SEQ ID NO: 18034 - DNA, 25 bp, Homo sapien
acttctgtcttcttgaaaaatccag

SEQ ID NO: 18035 - DNA, 25 bp, Homo sapien
acttcttagcttcataatgcaatgt

SEQ ID NO: 18036 - DNA, 25 bp, Homo sapien
acttcttagcttcgtaatgcaatgt

SEQ ID NO: 18037 - DNA, 25 bp, Homo sapien
acttcttatttgatccatgtgttac

SEQ ID NO: 18038 - DNA, 25 bp, Homo sapien
acttcttatttgattcatgtgttac

SEQ ID NO: 18039 - DNA, 25 bp, Homo sapien
acttcttcatataatagtcagatag

SEQ ID NO: 18040 - DNA, 25 bp, Homo sapien
acttcttcatatgatagtcagatag

SEQ ID NO: 18041 - DNA, 25 bp, Homo sapien
acttcttcccaagtccaaatcagtt

SEQ ID NO: 18042 - DNA, 25 bp, Homo sapien
acttcttcccaagtccgaatcagtt

SEQ ID NO: 18043 - DNA, 25 bp, Homo sapien
acttcttgcatgttatatggctttt

SEQ ID NO: 18044 - DNA, 25 bp, Homo sapien
acttcttgcatgttttatggctttt

SEQ ID NO: 18045 - DNA, 25 bp, Homo sapien
acttctttgctccacagctactaag

SEQ ID NO: 18046 - DNA, 25 bp, Homo sapien
acttctttgctccatagctactaag

SEQ ID NO: 18047 - DNA, 25 bp, Homo sapien
acttctttttgcccaatttgtaaga

SEQ ID NO: 18048 - DNA, 25 bp, Homo sapien
acttctttttgcgcaatttgtaaga

SEQ ID NO: 18049 - DNA, 25 bp, Homo sapien
acttgaaaacgggccttgtgtccac

SEQ ID NO: 18050 - DNA, 25 bp, Homo sapien
acttgaaaatgggccttgtgtccac

SEQ ID NO: 18051 - DNA, 25 bp, Homo sapien
acttgaaatcagcactattaggaca

SEQ ID NO: 18052 - DNA, 25 bp, Homo sapien
acttgaaattagcactattaggaca

SEQ ID NO: 18053 - DNA, 25 bp, Homo sapien
acttgaacatttcccaagtttggca

SEQ ID NO: 18054 - DNA, 25 bp, Homo sapien
acttgaacgtttcccaagtttggca

SEQ ID NO: 18055 - DNA, 25 bp, Homo sapien
acttgaactgacaaataagcataac

SEQ ID NO: 18056 - DNA, 25 bp, Homo sapien
acttgaactgacagataagcataac

SEQ ID NO: 18057 - DNA, 25 bp, Homo sapien
acttgaagcatcacactaggaactc

SEQ ID NO: 18058 - DNA, 25 bp, Homo sapien
acttgaagcgtcacactaggaactc

SEQ ID NO: 18059 - DNA, 25 bp, Homo sapien
acttgaaggtgaacttggcatcaga

SEQ ID NO: 18060 - DNA, 25 bp, Homo sapien
acttgaaggtgaactttgcatcaga

SEQ ID NO: 18061 - DNA, 25 bp, Homo sapien
acttgacatttgaagaaactaggct

SEQ ID NO: 18062 - DNA, 25 bp, Homo sapien
acttgacattttaagaaactaggct

SEQ ID NO: 18063 - DNA, 25 bp, Homo sapien
acttgactctatatcgaatgcacag

SEQ ID NO: 18064 - DNA, 25 bp, Homo sapien
acttgactctatattgaatgcacag

SEQ ID NO: 18065 - DNA, 25 bp, Homo sapien
acttgagacactcgagattcgggga

SEQ ID NO: 18066 - DNA, 25 bp, Homo sapien
acttgagacactcgggattcgggga

SEQ ID NO: 18067 - DNA, 25 bp, Homo sapien
acttgagggtagcacacatccagaa

SEQ ID NO: 18068 - DNA, 25 bp, Homo sapien
acttgagggtagcacatatccagaa

SEQ ID NO: 18069 - DNA, 25 bp, Homo sapien
acttgagtagtcactggtaaagagg

SEQ ID NO: 18070 - DNA, 25 bp, Homo sapien
acttgagtagtgactggtaaagagg

SEQ ID NO: 18071 - DNA, 25 bp, Homo sapien
acttgagtggatataacctgtgagc

SEQ ID NO: 18072 - DNA, 25 bp, Homo sapien
acttgagtggatgtaacctgtgagc

SEQ ID NO: 18073 - DNA, 25 bp, Homo sapien
acttgatagtaaaagactgaatgct

SEQ ID NO: 18074 - DNA, 25 bp, Homo sapien
acttgatagtaaaatactgaatgct

SEQ ID NO: 18075 - DNA, 25 bp, Homo sapien
acttgattttttcagttaccggcat

SEQ ID NO: 18076 - DNA, 25 bp, Homo sapien
acttgattttttcggttaccggcat

SEQ ID NO: 18077 - DNA, 25 bp, Homo sapien
acttgcacgagacctgtatcctctc

SEQ ID NO: 18078 - DNA, 25 bp, Homo sapien
acttgcacgggacctgtatcctctc

SEQ ID NO: 18079 - DNA, 25 bp, Homo sapien
acttgcagcggccatagcagaaaca

SEQ ID NO: 18080 - DNA, 25 bp, Homo sapien
acttgcagtggccatagcagaaaca

SEQ ID NO: 18081 - DNA, 25 bp, Homo sapien
acttgcattacacctatgggtctta

SEQ ID NO: 18082 - DNA, 25 bp, Homo sapien
acttgcattacatctatgggtctta

SEQ ID NO: 18083 - DNA, 25 bp, Homo sapien
acttgcattatatgccaaatgaaag

SEQ ID NO: 18084 - DNA, 25 bp, Homo sapien
acttgcattatttgccaaatgaaag

SEQ ID NO: 18085 - DNA, 25 bp, Homo sapien
acttgcattcatctaaacattttta

SEQ ID NO: 18086 - DNA, 25 bp, Homo sapien
acttgcattcatctgaacattttta

SEQ ID NO: 18087 - DNA, 25 bp, Homo sapien
acttgccaaaaacagactgagcccc

SEQ ID NO: 18088 - DNA, 25 bp, Homo sapien
acttgccaaaaacagattgagcccc

SEQ ID NO: 18089 - DNA, 25 bp, Homo sapien
acttgccaagaatcatgcatgcagt

SEQ ID NO: 18090 - DNA, 25 bp, Homo sapien
acttgccaataatcatgcatgcagt

SEQ ID NO: 18091 - DNA, 25 bp, Homo sapien
acttgccattggcagataaaaaatt

SEQ ID NO: 18092 - DNA, 25 bp, Homo sapien
acttgccattggtagataaaaaatt

SEQ ID NO: 18093 - DNA, 25 bp, Homo sapien
acttgccctggagtcactggtgtag

SEQ ID NO: 18094 - DNA, 25 bp, Homo sapien
acttgccctggagtcattggtgtag

SEQ ID NO: 18095 - DNA, 25 bp, Homo sapien
acttgctcaacttagacatgcattc

SEQ ID NO: 18096 - DNA, 25 bp, Homo sapien
acttgctcaagaaggtggccacagc

SEQ ID NO: 18097 - DNA, 25 bp, Homo sapien
acttgctcaccttagacatgcattc

SEQ ID NO: 18098 - DNA, 25 bp, Homo sapien
acttgctcagaccagaaactctgaa

SEQ ID NO: 18099 - DNA, 25 bp, Homo sapien
acttgctcagatcagaaactctgaa

SEQ ID NO: 18100 - DNA, 25 bp, Homo sapien
acttgctcatgaaggtggccacagc

SEQ ID NO: 18101 - DNA, 25 bp, Homo sapien
acttgctctcactttatggacttgc

SEQ ID NO: 18102 - DNA, 25 bp, Homo sapien
acttgctctcagtttatggacttgc

SEQ ID NO: 18103 - DNA, 25 bp, Homo sapien
acttgctctttcggaaaggtgtgct

SEQ ID NO: 18104 - DNA, 25 bp, Homo sapien
acttgctcttttggaaaggtgtgct

SEQ ID NO: 18105 - DNA, 25 bp, Homo sapien
acttgcttcattgagcaggcacagg

SEQ ID NO: 18106 - DNA, 25 bp, Homo sapien
acttgcttcattgatcaggcacagg

SEQ ID NO: 18107 - DNA, 25 bp, Homo sapien
acttggaaagaactgattacctgaa

SEQ ID NO: 18108 - DNA, 25 bp, Homo sapien
acttggaaagaattgattacctgaa

SEQ ID NO: 18109 - DNA, 25 bp, Homo sapien
acttggaaattgatggcctcaaaag

SEQ ID NO: 18110 - DNA, 25 bp, Homo sapien
acttggaaattgatggtctcaaaag

SEQ ID NO: 18111 - DNA, 25 bp, Homo sapien
acttggaacccatgctgtggtatca

SEQ ID NO: 18112 - DNA, 25 bp, Homo sapien
acttggaacccgtgctgtggtatca

SEQ ID NO: 18113 - DNA, 25 bp, Homo sapien
acttggatactattaaaagcattta

SEQ ID NO: 18114 - DNA, 25 bp, Homo sapien
acttggatactgttaaaagcattta

SEQ ID NO: 18115 - DNA, 25 bp, Homo sapien
acttggcaagaacgttacaaatgaa

SEQ ID NO: 18116 - DNA, 25 bp, Homo sapien
acttggcaagaatgttacaaatgaa

SEQ ID NO: 18117 - DNA, 25 bp, Homo sapien
acttggctatccaggaaaacttcgt

SEQ ID NO: 18118 - DNA, 25 bp, Homo sapien
acttggctccgctgtatttcctcac

SEQ ID NO: 18119 - DNA, 25 bp, Homo sapien
acttggctctgctgtatttcctcac

SEQ ID NO: 18120 - DNA, 25 bp, Homo sapien
acttggctttccaggaaaacttcgt

SEQ ID NO: 18121 - DNA, 25 bp, Homo sapien
acttggctttccgatagcatgggaa

SEQ ID NO: 18122 - DNA, 25 bp, Homo sapien
acttggctttctgatagcatgggaa

SEQ ID NO: 18123 - DNA, 25 bp, Homo sapien
acttggctttttaagtgatagcttg

SEQ ID NO: 18124 - DNA, 25 bp, Homo sapien
acttggctttttaggtgatagcttg

SEQ ID NO: 18125 - DNA, 25 bp, Homo sapien
acttggggtggttgcccagctcatt

SEQ ID NO: 18126 - DNA, 25 bp, Homo sapien
acttggggtggttggccagctcatt

SEQ ID NO: 18127 - DNA, 25 bp, Homo sapien
acttgggttatgaaaagacatccta

SEQ ID NO: 18128 - DNA, 25 bp, Homo sapien
acttgggttatgaaaatacatccta

SEQ ID NO: 18129 - DNA, 25 bp, Homo sapien
acttgggttccgctcagcaacaaag

SEQ ID NO: 18130 - DNA, 25 bp, Homo sapien
acttgggttctgagacatactggtt

SEQ ID NO: 18131 - DNA, 25 bp, Homo sapien
acttgggttctgagacgtactggtt

SEQ ID NO: 18132 - DNA, 25 bp, Homo sapien
acttgggtttcgctcagcaacaaag

SEQ ID NO: 18133 - DNA, 25 bp, Homo sapien
acttggtaaaatattggtctatacc

SEQ ID NO: 18134 - DNA, 25 bp, Homo sapien
acttggtacctccactgaattaaag

SEQ ID NO: 18135 - DNA, 25 bp, Homo sapien
acttggtacctccattgaattaaag

SEQ ID NO: 18136 - DNA, 25 bp, Homo sapien
acttggtacctgccacctcggcatc

SEQ ID NO: 18137 - DNA, 25 bp, Homo sapien
acttggtacctgcctcctcggcatc

SEQ ID NO: 18138 - DNA, 25 bp, Homo sapien
acttggtagaatattggtctatacc

SEQ ID NO: 18139 - DNA, 25 bp, Homo sapien
acttggtatttcgttcattcttaga

SEQ ID NO: 18140 - DNA, 25 bp, Homo sapien
acttggtatttctttcattcttaga

SEQ ID NO: 18141 - DNA, 25 bp, Homo sapien
acttggtgagcatcatcactaaggc

SEQ ID NO: 18142 - DNA, 25 bp, Homo sapien
acttggtgagcgtcatcactaaggc

SEQ ID NO: 18143 - DNA, 25 bp, Homo sapien
acttggtgcaatatcttatacaaag

SEQ ID NO: 18144 - DNA, 25 bp, Homo sapien
acttggtgcaatgtcttatacaaag

SEQ ID NO: 18145 - DNA, 25 bp, Homo sapien
acttggttggatttgacttcttctt

SEQ ID NO: 18146 - DNA, 25 bp, Homo sapien
acttggttggatttgatttcttctt

SEQ ID NO: 18147 - DNA, 25 bp, Homo sapien
acttggttttatacattgaaggaga

SEQ ID NO: 18148 - DNA, 25 bp, Homo sapien
acttggttttatgcattgaaggaga

SEQ ID NO: 18149 - DNA, 25 bp, Homo sapien
acttgtaaagacgagtgatgttatc

SEQ ID NO: 18150 - DNA, 25 bp, Homo sapien
acttgtaaagatgagtgatgttatc

SEQ ID NO: 18151 - DNA, 25 bp, Homo sapien
acttgtaatagcaaaatgtccttca

SEQ ID NO: 18152 - DNA, 25 bp, Homo sapien
acttgtaatagcgaaatgtccttca

SEQ ID NO: 18153 - DNA, 25 bp, Homo sapien
acttgtacgctaggaattttctcat

SEQ ID NO: 18154 - DNA, 25 bp, Homo sapien
acttgtacgctaggcattttctcat

SEQ ID NO: 18155 - DNA, 25 bp, Homo sapien
acttgtactaacgttatgacatgtc

SEQ ID NO: 18156 - DNA, 25 bp, Homo sapien
acttgtactaatgttatgacatgtc

SEQ ID NO: 18157 - DNA, 25 bp, Homo sapien
acttgtactttaagtttgattgacc

SEQ ID NO: 18158 - DNA, 25 bp, Homo sapien
acttgtactttgagtttgattgacc

SEQ ID NO: 18159 - DNA, 25 bp, Homo sapien
acttgtagtcaactggagaagacag

SEQ ID NO: 18160 - DNA, 25 bp, Homo sapien
acttgtagtcaattggagaagacag

SEQ ID NO: 18161 - DNA, 25 bp, Homo sapien
acttgtatatcagagcatcaagaac

SEQ ID NO: 18162 - DNA, 25 bp, Homo sapien
acttgtatatcagagcgtcaagaac

SEQ ID NO: 18163 - DNA, 25 bp, Homo sapien
acttgtatcacataagaaagcaccc

SEQ ID NO: 18164 - DNA, 25 bp, Homo sapien
acttgtatcacgtaagaaagcaccc

SEQ ID NO: 18165 - DNA, 25 bp, Homo sapien
acttgtatttgctcggtgaagtgaa

SEQ ID NO: 18166 - DNA, 25 bp, Homo sapien
acttgtatttgcttggtgaagtgaa

SEQ ID NO: 18167 - DNA, 25 bp, Homo sapien
acttgtcacgtcacaatgttcaaca

SEQ ID NO: 18168 - DNA, 25 bp, Homo sapien
acttgtcatgtcacaatgttcaaca

SEQ ID NO: 18169 - DNA, 25 bp, Homo sapien
acttgtcatgtcacgaaaacatcta

SEQ ID NO: 18170 - DNA, 25 bp, Homo sapien
acttgtcatgtcgcgaaaacatcta

SEQ ID NO: 18171 - DNA, 25 bp, Homo sapien
acttgtggatgtagaacctgtggat

SEQ ID NO: 18172 - DNA, 25 bp, Homo sapien
acttgtggatgtagaagctgtggat

SEQ ID NO: 18173 - DNA, 25 bp, Homo sapien
acttgtggccgatgagttgtgctaa

SEQ ID NO: 18174 - DNA, 25 bp, Homo sapien
acttgtggtcgatgagttgtgctaa

SEQ ID NO: 18175 - DNA, 25 bp, Homo sapien
acttgtgtgattaaagtgggctcac

SEQ ID NO: 18176 - DNA, 25 bp, Homo sapien
acttgtgtgattgaagtgggctcac

SEQ ID NO: 18177 - DNA, 25 bp, Homo sapien
acttgttcagcaatttcctagctga

SEQ ID NO: 18178 - DNA, 25 bp, Homo sapien
acttgttcagcactttcctagctga

SEQ ID NO: 18179 - DNA, 25 bp, Homo sapien
acttgttcgtaatgctagacacatc

SEQ ID NO: 18180 - DNA, 25 bp, Homo sapien
acttgttcgtaatgctggacacatc

SEQ ID NO: 18181 - DNA, 25 bp, Homo sapien
acttgttcttttacttttttaaatc

SEQ ID NO: 18182 - DNA, 25 bp, Homo sapien
acttgttctttttcttttttaaatc

SEQ ID NO: 18183 - DNA, 25 bp, Homo sapien
acttgttgcactccatcacattaaa

SEQ ID NO: 18184 - DNA, 25 bp, Homo sapien
acttgttgcactctatcacattaaa

SEQ ID NO: 18185 - DNA, 25 bp, Homo sapien
acttgtttatgttcctattgcctgt

SEQ ID NO: 18186 - DNA, 25 bp, Homo sapien
acttgtttatgtttctattgcctgt

SEQ ID NO: 18187 - DNA, 25 bp, Homo sapien
acttgtttgagattttatatcatac

SEQ ID NO: 18188 - DNA, 25 bp, Homo sapien
acttgtttgagattttgtatcatac

SEQ ID NO: 18189 - DNA, 25 bp, Homo sapien
acttgtttggtctgcctgtaacatt

SEQ ID NO: 18190 - DNA, 25 bp, Homo sapien
acttgtttgttctgcctgtaacatt

SEQ ID NO: 18191 - DNA, 25 bp, Homo sapien
acttgtttttacactaattcacaaa

SEQ ID NO: 18192 - DNA, 25 bp, Homo sapien
acttgtttttacgctaattcacaaa

SEQ ID NO: 18193 - DNA, 25 bp, Homo sapien
actttaaaactgccacaggcagtct

SEQ ID NO: 18194 - DNA, 25 bp, Homo sapien
actttaaaattgccacaggcagtct

SEQ ID NO: 18195 - DNA, 25 bp, Homo sapien
actttaaaccactgaaatgtacttg

SEQ ID NO: 18196 - DNA, 25 bp, Homo sapien
actttaaactactgaaatgtacttg

SEQ ID NO: 18197 - DNA, 25 bp, Homo sapien
actttaaccggtcgatctcaaaaaa

SEQ ID NO: 18198 - DNA, 25 bp, Homo sapien
actttaaccttccatttctatgata

SEQ ID NO: 18199 - DNA, 25 bp, Homo sapien
actttaaccttccgtttctatgata

SEQ ID NO: 18200 - DNA, 25 bp, Homo sapien
actttaactggtcgatctcaaaaaa

SEQ ID NO: 18201 - DNA, 25 bp, Homo sapien
actttaacttaaggttctcaatcgg

SEQ ID NO: 18202 - DNA, 25 bp, Homo sapien
actttaacttaaggttttcaatcgg

SEQ ID NO: 18203 - DNA, 25 bp, Homo sapien
actttaagtcaagtatataatgaca

SEQ ID NO: 18204 - DNA, 25 bp, Homo sapien
actttaagtcaagtatgtaatgaca

SEQ ID NO: 18205 - DNA, 25 bp, Homo sapien
actttaatctacataacactggaag

SEQ ID NO: 18206 - DNA, 25 bp, Homo sapien
actttaatctacgtaacactggaag

SEQ ID NO: 18207 - DNA, 25 bp, Homo sapien
actttaatcttaacctctaatatgt

SEQ ID NO: 18208 - DNA, 25 bp, Homo sapien
actttaattcttcctacttgacttg

SEQ ID NO: 18209 - DNA, 25 bp, Homo sapien
actttaattttaacctctaatatgt

SEQ ID NO: 18210 - DNA, 25 bp, Homo sapien
actttaatttttcctacttgacttg

SEQ ID NO: 18211 - DNA, 25 bp, Homo sapien
actttaccacataggcatgactggc

SEQ ID NO: 18212 - DNA, 25 bp, Homo sapien
actttaccacataggcgtgactggc

SEQ ID NO: 18213 - DNA, 25 bp, Homo sapien
actttactctttccataatcactcc

SEQ ID NO: 18214 - DNA, 25 bp, Homo sapien
actttactcttttcataatcactcc

SEQ ID NO: 18215 - DNA, 25 bp, Homo sapien
actttagacagtaacagaaagtata

SEQ ID NO: 18216 - DNA, 25 bp, Homo sapien
actttagacagtaatagaaagtata

SEQ ID NO: 18217 - DNA, 25 bp, Homo sapien
actttagcccaaaaagaaagccatt

SEQ ID NO: 18218 - DNA, 25 bp, Homo sapien
actttagcccataaagaaagccatt

SEQ ID NO: 18219 - DNA, 25 bp, Homo sapien
actttaggaacttagactctagtta

SEQ ID NO: 18220 - DNA, 25 bp, Homo sapien
actttaggaacttagagtctagtta

SEQ ID NO: 18221 - DNA, 25 bp, Homo sapien
actttagttcaccaaacctagaacc

SEQ ID NO: 18222 - DNA, 25 bp, Homo sapien
actttagttcatcaaacctagaacc

SEQ ID NO: 18223 - DNA, 25 bp, Homo sapien
actttatattagacacaagtactta

SEQ ID NO: 18224 - DNA, 25 bp, Homo sapien
actttatattagacgcaagtactta

SEQ ID NO: 18225 - DNA, 25 bp, Homo sapien
actttatcactacacaatgcccttc

SEQ ID NO: 18226 - DNA, 25 bp, Homo sapien
actttatcattacacaatgcccttc

SEQ ID NO: 18227 - DNA, 25 bp, Homo sapien
actttatctgatactaatatagcca

SEQ ID NO: 18228 - DNA, 25 bp, Homo sapien
actttatctgatactagtatagcca

SEQ ID NO: 18229 - DNA, 25 bp, Homo sapien
actttatggaaaccatgacatacac

SEQ ID NO: 18230 - DNA, 25 bp, Homo sapien
actttatggaaaccgtgacatacac

SEQ ID NO: 18231 - DNA, 25 bp, Homo sapien
actttatggctaatcatttgtctcc

SEQ ID NO: 18232 - DNA, 25 bp, Homo sapien
actttatggctagtcatttgtctcc

SEQ ID NO: 18233 - DNA, 25 bp, Homo sapien
actttattctccaaacaaatctatc

SEQ ID NO: 18234 - DNA, 25 bp, Homo sapien
actttattctccatacaaatctatc

SEQ ID NO: 18235 - DNA, 25 bp, Homo sapien
actttattggaaatgtagtccttgt

SEQ ID NO: 18236 - DNA, 25 bp, Homo sapien
actttattggagatgtagtccttgt

SEQ ID NO: 18237 - DNA, 25 bp, Homo sapien
actttatttctcagcacataattca

SEQ ID NO: 18238 - DNA, 25 bp, Homo sapien
actttatttgtcagcacataattca

SEQ ID NO: 18239 - DNA, 25 bp, Homo sapien
actttcaagtattaacaatcgagtc

SEQ ID NO: 18240 - DNA, 25 bp, Homo sapien
actttcaagtattagcaatcgagtc

SEQ ID NO: 18241 - DNA, 25 bp, Homo sapien
actttcacctgggttatctcattcg

SEQ ID NO: 18242 - DNA, 25 bp, Homo sapien
actttcacctgtgttatctcattcg

SEQ ID NO: 18243 - DNA, 25 bp, Homo sapien
actttcatagaatagaacaggacag

SEQ ID NO: 18244 - DNA, 25 bp, Homo sapien
actttcatagactagaacaggacag

SEQ ID NO: 18245 - DNA, 25 bp, Homo sapien
actttcatatcaaatatatcacttc

SEQ ID NO: 18246 - DNA, 25 bp, Homo sapien
actttcatatgctgtactggcttgt

SEQ ID NO: 18247 - DNA, 25 bp, Homo sapien
actttcatctatgtcatggtcagtc

SEQ ID NO: 18248 - DNA, 25 bp, Homo sapien
actttcatgtaacggaaatggcttc

SEQ ID NO: 18249 - DNA, 25 bp, Homo sapien
actttcatgtcaaatatatcacttc

SEQ ID NO: 18250 - DNA, 25 bp, Homo sapien
actttcatgtgctgtactggcttgt

SEQ ID NO: 18251 - DNA, 25 bp, Homo sapien
actttcatttaacggaaatggcttc

SEQ ID NO: 18252 - DNA, 25 bp, Homo sapien
actttcatttatgtcatggtcagtc

SEQ ID NO: 18253 - DNA, 25 bp, Homo sapien
actttcattttgtattcctgctctg

SEQ ID NO: 18254 - DNA, 25 bp, Homo sapien
actttcattttgtatttctgctctg

SEQ ID NO: 18255 - DNA, 25 bp, Homo sapien
actttccaaaattcatctcaaatta

SEQ ID NO: 18256 - DNA, 25 bp, Homo sapien
actttccaaaattcgtctcaaatta

SEQ ID NO: 18257 - DNA, 25 bp, Homo sapien
actttccacccgtttttcccttcag

SEQ ID NO: 18258 - DNA, 25 bp, Homo sapien
actttccacccttttttcccttcag

SEQ ID NO: 18259 - DNA, 25 bp, Homo sapien
actttccatttgagatacagctctg

SEQ ID NO: 18260 - DNA, 25 bp, Homo sapien
actttccatttgagttacagctctg

SEQ ID NO: 18261 - DNA, 25 bp, Homo sapien
actttccgtcactccgaaaacatga

SEQ ID NO: 18262 - DNA, 25 bp, Homo sapien
actttccgtcactctgaaaacatga

SEQ ID NO: 18263 - DNA, 25 bp, Homo sapien
actttcctcatgaactggcattctt

SEQ ID NO: 18264 - DNA, 25 bp, Homo sapien
actttcctcatgaattggcattctt

SEQ ID NO: 18265 - DNA, 25 bp, Homo sapien
actttctacaaggacaattctttgc

SEQ ID NO: 18266 - DNA, 25 bp, Homo sapien
actttctacaaggacagttctttgc

SEQ ID NO: 18267 - DNA, 25 bp, Homo sapien
actttctacagttctgatttcattc

SEQ ID NO: 18268 - DNA, 25 bp, Homo sapien
actttctacagttttgatttcattc

SEQ ID NO: 18269 - DNA, 25 bp, Homo sapien
actttctactccgaagctgttttat

SEQ ID NO: 18270 - DNA, 25 bp, Homo sapien
actttctactcctaagctgttttat

SEQ ID NO: 18271 - DNA, 25 bp, Homo sapien
actttctagtaaaaattctaaacag

SEQ ID NO: 18272 - DNA, 25 bp, Homo sapien
actttctagtaaagattctaaacag

SEQ ID NO: 18273 - DNA, 25 bp, Homo sapien
actttctcatggcggaaggcacggg

SEQ ID NO: 18274 - DNA, 25 bp, Homo sapien
actttctcatggtggaaggcacggg

SEQ ID NO: 18275 - DNA, 25 bp, Homo sapien
actttctccagcggcagaaatcttt

SEQ ID NO: 18276 - DNA, 25 bp, Homo sapien
actttctccagtggcagaaatcttt

SEQ ID NO: 18277 - DNA, 25 bp, Homo sapien
actttctccataacaataggctgtt

SEQ ID NO: 18278 - DNA, 25 bp, Homo sapien
actttctccatatcaataggctgtt

SEQ ID NO: 18279 - DNA, 25 bp, Homo sapien
actttctcccaaatgaacagtgttc

SEQ ID NO: 18280 - DNA, 25 bp, Homo sapien
actttctcccaactgaacagtgttc

SEQ ID NO: 18281 - DNA, 25 bp, Homo sapien
actttctcttcttgctattgtcaga

SEQ ID NO: 18282 - DNA, 25 bp, Homo sapien
actttctcttcttgctgttgtcaga

SEQ ID NO: 18283 - DNA, 25 bp, Homo sapien
actttctgaaatcagattgtgtctc

SEQ ID NO: 18284 - DNA, 25 bp, Homo sapien
actttctgaaccaactaacgatggc

SEQ ID NO: 18285 - DNA, 25 bp, Homo sapien
actttctgaaccagctaacgatggc

SEQ ID NO: 18286 - DNA, 25 bp, Homo sapien
actttctgatatcagattgtgtctc

SEQ ID NO: 18287 - DNA, 25 bp, Homo sapien
actttcttaccatacacgacagggt

SEQ ID NO: 18288 - DNA, 25 bp, Homo sapien
actttcttaccgtacacgacagggt

SEQ ID NO: 18289 - DNA, 25 bp, Homo sapien
actttcttactcccttgacggtggc

SEQ ID NO: 18290 - DNA, 25 bp, Homo sapien
actttcttactctcttgacggtggc

SEQ ID NO: 18291 - DNA, 25 bp, Homo sapien
actttcttactgggactgtgaaaaa

SEQ ID NO: 18292 - DNA, 25 bp, Homo sapien
actttcttactggggctgtgaaaaa

SEQ ID NO: 18293 - DNA, 25 bp, Homo sapien
actttcttagcactttttgagtata

SEQ ID NO: 18294 - DNA, 25 bp, Homo sapien
actttcttagcagtttttgagtata

SEQ ID NO: 18295 - DNA, 25 bp, Homo sapien
actttcttcttcggtgccaattaga

SEQ ID NO: 18296 - DNA, 25 bp, Homo sapien
actttcttctttggtgccaattaga

SEQ ID NO: 18297 - DNA, 25 bp, Homo sapien
actttcttttacaccacttcttgga

SEQ ID NO: 18298 - DNA, 25 bp, Homo sapien
actttcttttacaccatttcttgga

SEQ ID NO: 18299 - DNA, 25 bp, Homo sapien
actttgaaatacagaaaatcagaga

SEQ ID NO: 18300 - DNA, 25 bp, Homo sapien
actttgaaatacggaaaatcagaga

SEQ ID NO: 18301 - DNA, 25 bp, Homo sapien
actttgaacaagataagttgagatt

SEQ ID NO: 18302 - DNA, 25 bp, Homo sapien
actttgaacaagatgagttgagatt

SEQ ID NO: 18303 - DNA, 25 bp, Homo sapien
actttgaagacccattagtaatatc

SEQ ID NO: 18304 - DNA, 25 bp, Homo sapien
actttgaagactcattagtaatatc

SEQ ID NO: 18305 - DNA, 25 bp, Homo sapien
actttgacaaaagtgccacaatgga

SEQ ID NO: 18306 - DNA, 25 bp, Homo sapien
actttgacactgaaatcatatcttg

SEQ ID NO: 18307 - DNA, 25 bp, Homo sapien
actttgacactgaaatgatatcttg

SEQ ID NO: 18308 - DNA, 25 bp, Homo sapien
actttgacagaagtgccacaatgga

SEQ ID NO: 18309 - DNA, 25 bp, Homo sapien
actttgagccatacagctgtgaaga

SEQ ID NO: 18310 - DNA, 25 bp, Homo sapien
actttgagtcatacagctgtgaaga

SEQ ID NO: 18311 - DNA, 25 bp, Homo sapien
actttgatttcagatttctaacctt

SEQ ID NO: 18312 - DNA, 25 bp, Homo sapien
actttgatttcagctttctaacctt

SEQ ID NO: 18313 - DNA, 25 bp, Homo sapien
actttgcaaacacaagcgcaataaa

SEQ ID NO: 18314 - DNA, 25 bp, Homo sapien
actttgcaaacacaagtgcaataaa

SEQ ID NO: 18315 - DNA, 25 bp, Homo sapien
actttgcacctagaagaattagaaa

SEQ ID NO: 18316 - DNA, 25 bp, Homo sapien
actttgcacctagaggaattagaaa

SEQ ID NO: 18317 - DNA, 25 bp, Homo sapien
actttgcattgtaggatcagagtcc

SEQ ID NO: 18318 - DNA, 25 bp, Homo sapien
actttgcattgtgggatcagagtcc

SEQ ID NO: 18319 - DNA, 25 bp, Homo sapien
actttgctgcaactaattttttcca

SEQ ID NO: 18320 - DNA, 25 bp, Homo sapien
actttgctgcaattaattttttcca

SEQ ID NO: 18321 - DNA, 25 bp, Homo sapien
actttggagaaattacctaatcagc

SEQ ID NO: 18322 - DNA, 25 bp, Homo sapien
actttggagaaattacttaatcagc

SEQ ID NO: 18323 - DNA, 25 bp, Homo sapien
actttggagtgtggactgttcggtt

SEQ ID NO: 18324 - DNA, 25 bp, Homo sapien
actttggagtgtgtactgttcggtt

SEQ ID NO: 18325 - DNA, 25 bp, Homo sapien
actttggcatttgatgatctagtca

SEQ ID NO: 18326 - DNA, 25 bp, Homo sapien
actttggcatttgatggtctagtca

SEQ ID NO: 18327 - DNA, 25 bp, Homo sapien
actttggctgcatgttggtgtctct

SEQ ID NO: 18328 - DNA, 25 bp, Homo sapien
actttggctgcctgttggtgtctct

SEQ ID NO: 18329 - DNA, 25 bp, Homo sapien
actttggctgtaaatatatagcaat

SEQ ID NO: 18330 - DNA, 25 bp, Homo sapien
actttggctgtaagtatatagcaat

SEQ ID NO: 18331 - DNA, 25 bp, Homo sapien
actttggcttttaacaacatggtag

SEQ ID NO: 18332 - DNA, 25 bp, Homo sapien
actttggctttttacaacatggtag

SEQ ID NO: 18333 - DNA, 25 bp, Homo sapien
actttgggcaaatagcctacccttt

SEQ ID NO: 18334 - DNA, 25 bp, Homo sapien
actttgggcaaatagcttacccttt

SEQ ID NO: 18335 - DNA, 25 bp, Homo sapien
actttggtcttcggcctcctgcttc

SEQ ID NO: 18336 - DNA, 25 bp, Homo sapien
actttggtctttggcctcctgcttc

SEQ ID NO: 18337 - DNA, 25 bp, Homo sapien
actttggttttcccatcagcagatg

SEQ ID NO: 18338 - DNA, 25 bp, Homo sapien
actttggttttctcatcagcagatg

SEQ ID NO: 18339 - DNA, 25 bp, Homo sapien
actttgtatttcaatcattttgatt

SEQ ID NO: 18340 - DNA, 25 bp, Homo sapien
actttgtattttaatcattttgatt

SEQ ID NO: 18341 - DNA, 25 bp, Homo sapien
actttgtcacgattgtgttcactgt

SEQ ID NO: 18342 - DNA, 25 bp, Homo sapien
actttgtcacggttgtgttcactgt

SEQ ID NO: 18343 - DNA, 25 bp, Homo sapien
actttgtccagtatcttcttttttg

SEQ ID NO: 18344 - DNA, 25 bp, Homo sapien
actttgtccagtatgttcttttttg

SEQ ID NO: 18345 - DNA, 25 bp, Homo sapien
actttgtgacttccatatgctaagc

SEQ ID NO: 18346 - DNA, 25 bp, Homo sapien
actttgtgccactctgatgctaact

SEQ ID NO: 18347 - DNA, 25 bp, Homo sapien
actttgtgtcactctgatgctaact

SEQ ID NO: 18348 - DNA, 25 bp, Homo sapien
actttgtgtcttccatatgctaagc

SEQ ID NO: 18349 - DNA, 25 bp, Homo sapien
actttgttaaatgtccagtaccagg

SEQ ID NO: 18350 - DNA, 25 bp, Homo sapien
actttgttaaatgtccggtaccagg

SEQ ID NO: 18351 - DNA, 25 bp, Homo sapien
actttgtttgactagttctcattca

SEQ ID NO: 18352 - DNA, 25 bp, Homo sapien
actttgtttgactggttctcattca

SEQ ID NO: 18353 - DNA, 25 bp, Homo sapien
acttttaaaatactagtgctacaaa

SEQ ID NO: 18354 - DNA, 25 bp, Homo sapien
acttttaaaattctagtgctacaaa

SEQ ID NO: 18355 - DNA, 25 bp, Homo sapien
acttttaaataacagcaatattaat

SEQ ID NO: 18356 - DNA, 25 bp, Homo sapien
acttttaagtaacagcaatattaat

SEQ ID NO: 18357 - DNA, 25 bp, Homo sapien
acttttacaatgatggcagaattgg

SEQ ID NO: 18358 - DNA, 25 bp, Homo sapien
acttttacaatggtggcagaattgg

SEQ ID NO: 18359 - DNA, 25 bp, Homo sapien
acttttactctgagcatgaagagct

SEQ ID NO: 18360 - DNA, 25 bp, Homo sapien
acttttactttgagcatgaagagct

SEQ ID NO: 18361 - DNA, 25 bp, Homo sapien
acttttagacccaacactcagggaa

SEQ ID NO: 18362 - DNA, 25 bp, Homo sapien
acttttagatccaacactcagggaa

SEQ ID NO: 18363 - DNA, 25 bp, Homo sapien
acttttagcgatggcaacttggatt

SEQ ID NO: 18364 - DNA, 25 bp, Homo sapien
acttttagtgatggcaacttggatt

SEQ ID NO: 18365 - DNA, 25 bp, Homo sapien
acttttataactaacttactgacaa

SEQ ID NO: 18366 - DNA, 25 bp, Homo sapien
acttttataactaatttactgacaa

SEQ ID NO: 18367 - DNA, 25 bp, Homo sapien
acttttcaaaagcctacattatata

SEQ ID NO: 18368 - DNA, 25 bp, Homo sapien
acttttcaaaagcttacattatata

SEQ ID NO: 18369 - DNA, 25 bp, Homo sapien
acttttccaggcttttgatccatct

SEQ ID NO: 18370 - DNA, 25 bp, Homo sapien
acttttccatagcagctgtgcccat

SEQ ID NO: 18371 - DNA, 25 bp, Homo sapien
acttttcccggcttttgatccatct

SEQ ID NO: 18372 - DNA, 25 bp, Homo sapien
acttttccgtagcagctgtgcccat

SEQ ID NO: 18373 - DNA, 25 bp, Homo sapien
acttttcctgaggcacctgtttgga

SEQ ID NO: 18374 - DNA, 25 bp, Homo sapien
acttttcctgaggcgcctgtttgga

SEQ ID NO: 18375 - DNA, 25 bp, Homo sapien
acttttcctgtgagcttgcattgcc

SEQ ID NO: 18376 - DNA, 25 bp, Homo sapien
acttttcctgtgatcttgcattgcc

SEQ ID NO: 18377 - DNA, 25 bp, Homo sapien
acttttcttctgggaaatgctaccc

SEQ ID NO: 18378 - DNA, 25 bp, Homo sapien
acttttcttctgtgaaatgctaccc

SEQ ID NO: 18379 - DNA, 25 bp, Homo sapien
acttttgaggatggctgttatcctt

SEQ ID NO: 18380 - DNA, 25 bp, Homo sapien
acttttgaggatgggtgttatcctt

SEQ ID NO: 18381 - DNA, 25 bp, Homo sapien
acttttgatttcctctttaactcat

SEQ ID NO: 18382 - DNA, 25 bp, Homo sapien
acttttgatttcttctttaactcat

SEQ ID NO: 18383 - DNA, 25 bp, Homo sapien
acttttgcaatgtgttgattcttta

SEQ ID NO: 18384 - DNA, 25 bp, Homo sapien
acttttgcagaataatttcgcaggg

SEQ ID NO: 18385 - DNA, 25 bp, Homo sapien
acttttgccatggtcctggtgtgtt

SEQ ID NO: 18386 - DNA, 25 bp, Homo sapien
acttttgccatgtgttgattcttta

SEQ ID NO: 18387 - DNA, 25 bp, Homo sapien
acttttgccattgtcctggtgtgtt

SEQ ID NO: 18388 - DNA, 25 bp, Homo sapien
acttttgcggaataatttcgcaggg

SEQ ID NO: 18389 - DNA, 25 bp, Homo sapien
acttttgctgaaaacgtgaacttgt

SEQ ID NO: 18390 - DNA, 25 bp, Homo sapien
acttttgctgaaaatgtgaacttgt

SEQ ID NO: 18391 - DNA, 25 bp, Homo sapien
acttttgctgacataaaagctgcag

SEQ ID NO: 18392 - DNA, 25 bp, Homo sapien
acttttgctgacataagagctgcag

SEQ ID NO: 18393 - DNA, 25 bp, Homo sapien
acttttgctttgcatgctgtgtacg

SEQ ID NO: 18394 - DNA, 25 bp, Homo sapien
acttttgctttgcatgttgtgtacg

SEQ ID NO: 18395 - DNA, 25 bp, Homo sapien
actttttataaatgttgaacacgat

SEQ ID NO: 18396 - DNA, 25 bp, Homo sapien
actttttataaattttgaacacgat

SEQ ID NO: 18397 - DNA, 25 bp, Homo sapien
actttttcagcaaaaccctaagact

SEQ ID NO: 18398 - DNA, 25 bp, Homo sapien
actttttcagcgaaaccctaagact

SEQ ID NO: 18399 - DNA, 25 bp, Homo sapien
actttttcctccaaatgactccata

SEQ ID NO: 18400 - DNA, 25 bp, Homo sapien
actttttcctccacatgactccata

SEQ ID NO: 18401 - DNA, 25 bp, Homo sapien
actttttctcaacgtatcaataact

SEQ ID NO: 18402 - DNA, 25 bp, Homo sapien
actttttctcaatgtatcaataact

SEQ ID NO: 18403 - DNA, 25 bp, Homo sapien
actttttctgataccacaccctggt

SEQ ID NO: 18404 - DNA, 25 bp, Homo sapien
actttttctgatatcacaccctggt

SEQ ID NO: 18405 - DNA, 25 bp, Homo sapien
actttttcttttagctcccacacgt

SEQ ID NO: 18406 - DNA, 25 bp, Homo sapien
actttttcttttagttcccacacgt

SEQ ID NO: 18407 - DNA, 25 bp, Homo sapien
actttttgccatccactctattttc

SEQ ID NO: 18408 - DNA, 25 bp, Homo sapien
actttttgccattcactctattttc

SEQ ID NO: 18409 - DNA, 25 bp, Homo sapien
actttttggcatcatacaataagtg

SEQ ID NO: 18410 - DNA, 25 bp, Homo sapien
actttttggcatcatataataagtg

SEQ ID NO: 18411 - DNA, 25 bp, Homo sapien
actttttggcttaagcatatatatg

SEQ ID NO: 18412 - DNA, 25 bp, Homo sapien
actttttggcttaagcgtatatatg

SEQ ID NO: 18413 - DNA, 25 bp, Homo sapien
actttttgtgacatgtaataaatgt

SEQ ID NO: 18414 - DNA, 25 bp, Homo sapien
actttttgtgacgtgtaataaatgt

SEQ ID NO: 18415 - DNA, 25 bp, Homo sapien
acttttttttgcagtgcatttattc

SEQ ID NO: 18416 - DNA, 25 bp, Homo sapien
acttttttttgcattgcatttattc

SEQ ID NO: 18417 - DNA, 25 bp, Homo sapien
agaaaaaaaaaaccttcatcattta

SEQ ID NO: 18418 - DNA, 25 bp, Homo sapien
agaaaaaaaaaagtcccaattcaga

SEQ ID NO: 18419 - DNA, 25 bp, Homo sapien
agaaaaaaaaaagttccaattcaga

SEQ ID NO: 18420 - DNA, 25 bp, Homo sapien
agaaaaaaaaaatcttcatcattta

SEQ ID NO: 18421 - DNA, 25 bp, Homo sapien
agaaaaaaaactgaagattcattac

SEQ ID NO: 18422 - DNA, 25 bp, Homo sapien
agaaaaaaacatcacttgacattcg

SEQ ID NO: 18423 - DNA, 25 bp, Homo sapien
agaaaaaaacatcccttgacattcg

SEQ ID NO: 18424 - DNA, 25 bp, Homo sapien
agaaaaaaacctgaagattcattac

SEQ ID NO: 18425 - DNA, 25 bp, Homo sapien
agaaaaaaatggaccacgcagtgtt

SEQ ID NO: 18426 - DNA, 25 bp, Homo sapien
agaaaaaaatggaccatgcagtgtt

SEQ ID NO: 18427 - DNA, 25 bp, Homo sapien
agaaaaaaatgttccctctgagaga

SEQ ID NO: 18428 - DNA, 25 bp, Homo sapien
agaaaaaaattatgaaagtgtctag

SEQ ID NO: 18429 - DNA, 25 bp, Homo sapien
agaaaaaaattatggaagtgtctag

SEQ ID NO: 18430 - DNA, 25 bp, Homo sapien
agaaaaaacatctatcagcataact

SEQ ID NO: 18431 - DNA, 25 bp, Homo sapien
agaaaaaacatctttcagcataact

SEQ ID NO: 18432 - DNA, 25 bp, Homo sapien
agaaaaaactgaattgccattatta

SEQ ID NO: 18433 - DNA, 25 bp, Homo sapien
agaaaaaagagttactacacaatgg

SEQ ID NO: 18434 - DNA, 25 bp, Homo sapien
agaaaaaagagttacttcacaatgg

SEQ ID NO: 18435 - DNA, 25 bp, Homo sapien
agaaaaaagtgtgccttcacaataa

SEQ ID NO: 18436 - DNA, 25 bp, Homo sapien
agaaaaaagtgtggcttcacaataa

SEQ ID NO: 18437 - DNA, 25 bp, Homo sapien
agaaaaaatcgacatatttgactac

SEQ ID NO: 18438 - DNA, 25 bp, Homo sapien
agaaaaaatcggcatatttgactac

SEQ ID NO: 18439 - DNA, 25 bp, Homo sapien
agaaaaaattgaattgccattatta

SEQ ID NO: 18440 - DNA, 25 bp, Homo sapien
agaaaaaattgttccctctgagaga

SEQ ID NO: 18441 - DNA, 25 bp, Homo sapien
agaaaaaccttcgatttatgtccat

SEQ ID NO: 18442 - DNA, 25 bp, Homo sapien
agaaaaaccttggatttatgtccat

SEQ ID NO: 18443 - DNA, 25 bp, Homo sapien
agaaaaacgtgacctcatcaaatga

SEQ ID NO: 18444 - DNA, 25 bp, Homo sapien
agaaaaacgtgacctcgtcaaatga

SEQ ID NO: 18445 - DNA, 25 bp, Homo sapien
agaaaaagaccacctaagatcaggg

SEQ ID NO: 18446 - DNA, 25 bp, Homo sapien
agaaaaagaccgcctaagatcaggg

SEQ ID NO: 18447 - DNA, 25 bp, Homo sapien
agaaaaaggctgtattcagtgcaga

SEQ ID NO: 18448 - DNA, 25 bp, Homo sapien
agaaaaaggctgttttcagtgcaga

SEQ ID NO: 18449 - DNA, 25 bp, Homo sapien
agaaaaagggaaaaattaaagcata

SEQ ID NO: 18450 - DNA, 25 bp, Homo sapien
agaaaaagggaaaatttaaagcata

SEQ ID NO: 18451 - DNA, 25 bp, Homo sapien
agaaaaagtgagtcagtgagacata

SEQ ID NO: 18452 - DNA, 25 bp, Homo sapien
agaaaaagtgagttagtgagacata

SEQ ID NO: 18453 - DNA, 25 bp, Homo sapien
agaaaaatatagaaggaaactgaag

SEQ ID NO: 18454 - DNA, 25 bp, Homo sapien
agaaaaatatagagggaaactgaag

SEQ ID NO: 18455 - DNA, 25 bp, Homo sapien
agaaaaatcctgattcacttagctt

SEQ ID NO: 18456 - DNA, 25 bp, Homo sapien
agaaaaatcctgattcgcttagctt

SEQ ID NO: 18457 - DNA, 25 bp, Homo sapien
agaaaaatcgagcagaaagcacaga

SEQ ID NO: 18458 - DNA, 25 bp, Homo sapien
agaaaaatcgagcggaaagcacaga

SEQ ID NO: 18459 - DNA, 25 bp, Homo sapien
agaaaaatcgtataccctgtgatga

SEQ ID NO: 18460 - DNA, 25 bp, Homo sapien
agaaaaatcgtataccttgtgatga

SEQ ID NO: 18461 - DNA, 25 bp, Homo sapien
agaaaaatgctctagtctcattctt

SEQ ID NO: 18462 - DNA, 25 bp, Homo sapien
agaaaaatgctgtagtctcattctt

SEQ ID NO: 18463 - DNA, 25 bp, Homo sapien
agaaaacaaaatccacagatgttca

SEQ ID NO: 18464 - DNA, 25 bp, Homo sapien
agaaaacaaaatccacggatgttca

SEQ ID NO: 18465 - DNA, 25 bp, Homo sapien
agaaaacaaacaaaaaattctaata

SEQ ID NO: 18466 - DNA, 25 bp, Homo sapien
agaaaacaaacgaaaaattctaata

SEQ ID NO: 18467 - DNA, 25 bp, Homo sapien
agaaaacaaattcgtgaacaatgtg

SEQ ID NO: 18468 - DNA, 25 bp, Homo sapien
agaaaacaaattcgtgcacaatgtg

SEQ ID NO: 18469 - DNA, 25 bp, Homo sapien
agaaaacaatcataaagaaggcaat

SEQ ID NO: 18470 - DNA, 25 bp, Homo sapien
agaaaacaatcgtaaagaaggcaat

SEQ ID NO: 18471 - DNA, 25 bp, Homo sapien
agaaaacacaggtgctaacaagcta

SEQ ID NO: 18472 - DNA, 25 bp, Homo sapien
agaaaacacaggtgctgacaagcta

SEQ ID NO: 18473 - DNA, 25 bp, Homo sapien
agaaaacagaaaagcccagtattac

SEQ ID NO: 18474 - DNA, 25 bp, Homo sapien
agaaaacagaaaatcccagtattac

SEQ ID NO: 18475 - DNA, 25 bp, Homo sapien
agaaaacctgaagacttgaagattc

SEQ ID NO: 18476 - DNA, 25 bp, Homo sapien
agaaaacctgaagtcttgaagattc

SEQ ID NO: 18477 - DNA, 25 bp, Homo sapien
agaaaacgaggtccattgtggccac

SEQ ID NO: 18478 - DNA, 25 bp, Homo sapien
agaaaacgaggtctattgtggccac

SEQ ID NO: 18479 - DNA, 25 bp, Homo sapien
agaaaactacaagtcaatcttcctg

SEQ ID NO: 18480 - DNA, 25 bp, Homo sapien
agaaaactacaagtcagtcttcctg

SEQ ID NO: 18481 - DNA, 25 bp, Homo sapien
agaaaactcaaaaacaaacaatata

SEQ ID NO: 18482 - DNA, 25 bp, Homo sapien
agaaaactcgaaaacaaacaatata

SEQ ID NO: 18483 - DNA, 25 bp, Homo sapien
agaaaactgaaacatctgtactgta

SEQ ID NO: 18484 - DNA, 25 bp, Homo sapien
agaaaactgaaacgtctgtactgta

SEQ ID NO: 18485 - DNA, 25 bp, Homo sapien
agaaaactgtacactttccacattt

SEQ ID NO: 18486 - DNA, 25 bp, Homo sapien
agaaaactgtacgctttccacattt

SEQ ID NO: 18487 - DNA, 25 bp, Homo sapien
agaaaagaaaatttcgatgaggttc

SEQ ID NO: 18488 - DNA, 25 bp, Homo sapien
agaaaagaaaattttgatgaggttc

SEQ ID NO: 18489 - DNA, 25 bp, Homo sapien
agaaaagaaatgcttgtgttacaca

SEQ ID NO: 18490 - DNA, 25 bp, Homo sapien
agaaaagaacccagatactctggag

SEQ ID NO: 18491 - DNA, 25 bp, Homo sapien
agaaaagaacctagatactctggag

SEQ ID NO: 18492 - DNA, 25 bp, Homo sapien
agaaaagaactgcttgtgttacaca

SEQ ID NO: 18493 - DNA, 25 bp, Homo sapien
agaaaagataccacgctgcaaagtc

SEQ ID NO: 18494 - DNA, 25 bp, Homo sapien
agaaaagataccatgctgcaaagtc

SEQ ID NO: 18495 - DNA, 25 bp, Homo sapien
agaaaaggaattataaaaacagtca

SEQ ID NO: 18496 - DNA, 25 bp, Homo sapien
agaaaaggaattataagaacagtca

SEQ ID NO: 18497 - DNA, 25 bp, Homo sapien
agaaaagtaacagttgtcccaagta

SEQ ID NO: 18498 - DNA, 25 bp, Homo sapien
agaaaagtacataggttaatgacaa

SEQ ID NO: 18499 - DNA, 25 bp, Homo sapien
agaaaagtacatagtttaatgacaa

SEQ ID NO: 18500 - DNA, 25 bp, Homo sapien
agaaaagtatgcaaaacattaaaca

SEQ ID NO: 18501 - DNA, 25 bp, Homo sapien
agaaaagtgtgcaaaacattaaaca

SEQ ID NO: 18502 - DNA, 25 bp, Homo sapien
agaaaagttacagttgtcccaagta

SEQ ID NO: 18503 - DNA, 25 bp, Homo sapien
agaaaataaaacgttagggtgaatg

SEQ ID NO: 18504 - DNA, 25 bp, Homo sapien
agaaaataaaagttggcattagcaa

SEQ ID NO: 18505 - DNA, 25 bp, Homo sapien
agaaaataaaatgttagggtgaatg

SEQ ID NO: 18506 - DNA, 25 bp, Homo sapien
agaaaataaagagttatatcagaaa

SEQ ID NO: 18507 - DNA, 25 bp, Homo sapien
agaaaataaaggaagttggtaagag

SEQ ID NO: 18508 - DNA, 25 bp, Homo sapien
agaaaataaaggaatttggtaagag

SEQ ID NO: 18509 - DNA, 25 bp, Homo sapien
agaaaataacgagttatatcagaaa

SEQ ID NO: 18510 - DNA, 25 bp, Homo sapien
agaaaataaggggacatgatggatt

SEQ ID NO: 18511 - DNA, 25 bp, Homo sapien
agaaaataaggggagatgatggatt

SEQ ID NO: 18512 - DNA, 25 bp, Homo sapien
agaaaatacaagttggcattagcaa

SEQ ID NO: 18513 - DNA, 25 bp, Homo sapien
agaaaatactacaatggaaaaagta

SEQ ID NO: 18514 - DNA, 25 bp, Homo sapien
agaaaatactgcaattactgatatg

SEQ ID NO: 18515 - DNA, 25 bp, Homo sapien
agaaaatactgcagttactgatatg

SEQ ID NO: 18516 - DNA, 25 bp, Homo sapien
agaaaatagagctgatcaaagaagt

SEQ ID NO: 18517 - DNA, 25 bp, Homo sapien
agaaaatagagctgatgaaagaagt

SEQ ID NO: 18518 - DNA, 25 bp, Homo sapien
agaaaatagtacaatggaaaaagta

SEQ ID NO: 18519 - DNA, 25 bp, Homo sapien
agaaaatagtgaaaaatgaaaatca

SEQ ID NO: 18520 - DNA, 25 bp, Homo sapien
agaaaatagtgagaaatgaaaatca

SEQ ID NO: 18521 - DNA, 25 bp, Homo sapien
agaaaatcaggatattggtggaact

SEQ ID NO: 18522 - DNA, 25 bp, Homo sapien
agaaaatcaggatatttgtggaact

SEQ ID NO: 18523 - DNA, 25 bp, Homo sapien
agaaaatctgggataaataattggt

SEQ ID NO: 18524 - DNA, 25 bp, Homo sapien
agaaaatcttgatatgctaaatgag

SEQ ID NO: 18525 - DNA, 25 bp, Homo sapien
agaaaatcttggataaataattggt

SEQ ID NO: 18526 - DNA, 25 bp, Homo sapien
agaaaatcttggtatgctaaatgag

SEQ ID NO: 18527 - DNA, 25 bp, Homo sapien
agaaaatgaatataagtgtggtatg

SEQ ID NO: 18528 - DNA, 25 bp, Homo sapien
agaaaatgaatgtaagtgtggtatg

SEQ ID NO: 18529 - DNA, 25 bp, Homo sapien
agaaaatgccttcagtaccacaaaa

SEQ ID NO: 18530 - DNA, 25 bp, Homo sapien
agaaaatggagtgaccatgagtgaa

SEQ ID NO: 18531 - DNA, 25 bp, Homo sapien
agaaaatggagtgaccgtgagtgaa

SEQ ID NO: 18532 - DNA, 25 bp, Homo sapien
agaaaatggcttcagtaccacaaaa

SEQ ID NO: 18533 - DNA, 25 bp, Homo sapien
agaaaatgtaggccttttaattcca

SEQ ID NO: 18534 - DNA, 25 bp, Homo sapien
agaaaatgtagggcttttaattcca

SEQ ID NO: 18535 - DNA, 25 bp, Homo sapien
agaaaatgtcatcccacatttctcc

SEQ ID NO: 18536 - DNA, 25 bp, Homo sapien
agaaaatgtcatctcacatttctcc

SEQ ID NO: 18537 - DNA, 25 bp, Homo sapien
agaaaatgtgcagtaaaaatatggt

SEQ ID NO: 18538 - DNA, 25 bp, Homo sapien
agaaaatgtgcattaaaaatatggt

SEQ ID NO: 18539 - DNA, 25 bp, Homo sapien
agaaaattatgccggggaatgcctt

SEQ ID NO: 18540 - DNA, 25 bp, Homo sapien
agaaaattatgctggggaatgcctt

SEQ ID NO: 18541 - DNA, 25 bp, Homo sapien
agaaaattcaccatatagttgaagg

SEQ ID NO: 18542 - DNA, 25 bp, Homo sapien
agaaaattcaccgtatagttgaagg

SEQ ID NO: 18543 - DNA, 25 bp, Homo sapien
agaaaattcatatcagaacatacag

SEQ ID NO: 18544 - DNA, 25 bp, Homo sapien
agaaaattcatatcagcacatacag

SEQ ID NO: 18545 - DNA, 25 bp, Homo sapien
agaaaattctttcatgggctaagct

SEQ ID NO: 18546 - DNA, 25 bp, Homo sapien
agaaaattctttcgtgggctaagct

SEQ ID NO: 18547 - DNA, 25 bp, Homo sapien
agaaaattgagtctgaattaatttc

SEQ ID NO: 18548 - DNA, 25 bp, Homo sapien
agaaaattgagttccagggcagtaa

SEQ ID NO: 18549 - DNA, 25 bp, Homo sapien
agaaaattgagtttcagggcagtaa

SEQ ID NO: 18550 - DNA, 25 bp, Homo sapien
agaaaattgagtttgaattaatttc

SEQ ID NO: 18551 - DNA, 25 bp, Homo sapien
agaaacaaacggagaccaaaataag

SEQ ID NO: 18552 - DNA, 25 bp, Homo sapien
agaaacaaagtgcgaagttcagaag

SEQ ID NO: 18553 - DNA, 25 bp, Homo sapien
agaaacaaagtgtgaagttcagaag

SEQ ID NO: 18554 - DNA, 25 bp, Homo sapien
agaaacaaatggagaccaaaataag

SEQ ID NO: 18555 - DNA, 25 bp, Homo sapien
agaaacaaccagaccgttagaagtg

SEQ ID NO: 18556 - DNA, 25 bp, Homo sapien
agaaacaaccagactgttagaagtg

SEQ ID NO: 18557 - DNA, 25 bp, Homo sapien
agaaacaacgaagcaagcctacaag

SEQ ID NO: 18558 - DNA, 25 bp, Homo sapien
agaaacaatgaagcaagcctacaag

SEQ ID NO: 18559 - DNA, 25 bp, Homo sapien
agaaacaattgtcgatggtggaaat

SEQ ID NO: 18560 - DNA, 25 bp, Homo sapien
agaaacaattgtcggtggtggaaat

SEQ ID NO: 18561 - DNA, 25 bp, Homo sapien
agaaacagaaaacactagtcagcca

SEQ ID NO: 18562 - DNA, 25 bp, Homo sapien
agaaacagaaaacgctagtcagcca

SEQ ID NO: 18563 - DNA, 25 bp, Homo sapien
agaaacagcaagacttctttcctct

SEQ ID NO: 18564 - DNA, 25 bp, Homo sapien
agaaacagcaagccttctttcctct

SEQ ID NO: 18565 - DNA, 25 bp, Homo sapien
agaaacagcagtatcatgaaaacaa

SEQ ID NO: 18566 - DNA, 25 bp, Homo sapien
agaaacaggagtatcatgaaaacaa

SEQ ID NO: 18567 - DNA, 25 bp, Homo sapien
agaaacaggtggcatctttggtagt

SEQ ID NO: 18568 - DNA, 25 bp, Homo sapien
agaaacagttggcatctttggtagt

SEQ ID NO: 18569 - DNA, 25 bp, Homo sapien
agaaacataaagttcacctcatcat

SEQ ID NO: 18570 - DNA, 25 bp, Homo sapien
agaaacataaagttcatctcatcat

SEQ ID NO: 18571 - DNA, 25 bp, Homo sapien
agaaacatacatccatcatgctagt

SEQ ID NO: 18572 - DNA, 25 bp, Homo sapien
agaaacatacatccgtcatgctagt

SEQ ID NO: 18573 - DNA, 25 bp, Homo sapien
agaaacatgtaataggccctctacg

SEQ ID NO: 18574 - DNA, 25 bp, Homo sapien
agaaacatttaataggccctctacg

SEQ ID NO: 18575 - DNA, 25 bp, Homo sapien
agaaaccaagaccctggagatacaa

SEQ ID NO: 18576 - DNA, 25 bp, Homo sapien
agaaaccaagatcctggagatacaa

SEQ ID NO: 18577 - DNA, 25 bp, Homo sapien
agaaaccactaaacgataaataatt

SEQ ID NO: 18578 - DNA, 25 bp, Homo sapien
agaaaccactaagcgataaataatt

SEQ ID NO: 18579 - DNA, 25 bp, Homo sapien
agaaaccataaactggaaggtaaat

SEQ ID NO: 18580 - DNA, 25 bp, Homo sapien
agaaaccataaataggaaaagcaaa

SEQ ID NO: 18581 - DNA, 25 bp, Homo sapien
agaaaccataatctggaaggtaaat

SEQ ID NO: 18582 - DNA, 25 bp, Homo sapien
agaaaccatctgcacatctagtcca

SEQ ID NO: 18583 - DNA, 25 bp, Homo sapien
agaaaccatctgcagatctagtcca

SEQ ID NO: 18584 - DNA, 25 bp, Homo sapien
agaaaccatgaataggaaaagcaaa

SEQ ID NO: 18585 - DNA, 25 bp, Homo sapien
agaaaccgtttctcagctctgtttg

SEQ ID NO: 18586 - DNA, 25 bp, Homo sapien
agaaaccgtttctcagttctgtttg

SEQ ID NO: 18587 - DNA, 25 bp, Homo sapien
agaaacgaactaataactaagtgat

SEQ ID NO: 18588 - DNA, 25 bp, Homo sapien
agaaacgacctaataactaagtgat

SEQ ID NO: 18589 - DNA, 25 bp, Homo sapien
agaaactacagccttgttctttgca

SEQ ID NO: 18590 - DNA, 25 bp, Homo sapien
agaaactacggccttgttctttgca

SEQ ID NO: 18591 - DNA, 25 bp, Homo sapien
agaaactcaataaatacttgctagt

SEQ ID NO: 18592 - DNA, 25 bp, Homo sapien
agaaactcaatgaatacttgctagt

SEQ ID NO: 18593 - DNA, 25 bp, Homo sapien
agaaactcgctgtaaggtgaaggcc

SEQ ID NO: 18594 - DNA, 25 bp, Homo sapien
agaaactcgctgtaagttgaaggcc

SEQ ID NO: 18595 - DNA, 25 bp, Homo sapien
agaaactgaaagggcatgagtcgtg

SEQ ID NO: 18596 - DNA, 25 bp, Homo sapien
agaaactgacaatatctatgggtat

SEQ ID NO: 18597 - DNA, 25 bp, Homo sapien
agaaactgacagtatctatgggtat

SEQ ID NO: 18598 - DNA, 25 bp, Homo sapien
agaaactggaagggcatgagtcgtg

SEQ ID NO: 18599 - DNA, 25 bp, Homo sapien
agaaactggagcaaaaaaccctatg

SEQ ID NO: 18600 - DNA, 25 bp, Homo sapien
agaaactggagtaaaaaaccctatg

SEQ ID NO: 18601 - DNA, 25 bp, Homo sapien
agaaacttcatctcatattcacaga

SEQ ID NO: 18602 - DNA, 25 bp, Homo sapien
agaaacttcatcttatattcacaga

SEQ ID NO: 18603 - DNA, 25 bp, Homo sapien
agaaagaaactcaggtttggcatgt

SEQ ID NO: 18604 - DNA, 25 bp, Homo sapien
agaaagaaactcagttttggcatgt

SEQ ID NO: 18605 - DNA, 25 bp, Homo sapien
agaaagaaagtctcagaagaattta

SEQ ID NO: 18606 - DNA, 25 bp, Homo sapien
agaaagaaagtctcagcagaattta

SEQ ID NO: 18607 - DNA, 25 bp, Homo sapien
agaaagaagcaacatggtagacatc

SEQ ID NO: 18608 - DNA, 25 bp, Homo sapien
agaaagaagcaccatggtagacatc

SEQ ID NO: 18609 - DNA, 25 bp, Homo sapien
agaaagaaggagcacaagagggtca

SEQ ID NO: 18610 - DNA, 25 bp, Homo sapien
agaaagaaggaggacaagagggtca

SEQ ID NO: 18611 - DNA, 25 bp, Homo sapien
agaaagaattaggtaatgtggccat

SEQ ID NO: 18612 - DNA, 25 bp, Homo sapien
agaaagaattagttaatgtggccat

SEQ ID NO: 18613 - DNA, 25 bp, Homo sapien
agaaagacagaaacagacaggaact

SEQ ID NO: 18614 - DNA, 25 bp, Homo sapien
agaaagacagaaatagacaggaact

SEQ ID NO: 18615 - DNA, 25 bp, Homo sapien
agaaagacaggcccggagggagaag

SEQ ID NO: 18616 - DNA, 25 bp, Homo sapien
agaaagacaggcctggagggagaag

SEQ ID NO: 18617 - DNA, 25 bp, Homo sapien
agaaagaccatatgcaagctaaaac

SEQ ID NO: 18618 - DNA, 25 bp, Homo sapien
agaaagaccgtatgcaagctaaaac

SEQ ID NO: 18619 - DNA, 25 bp, Homo sapien
agaaagagcaactgaatatgttggt

SEQ ID NO: 18620 - DNA, 25 bp, Homo sapien
agaaagagcaattgaatatgttggt

SEQ ID NO: 18621 - DNA, 25 bp, Homo sapien
agaaagagcatacctcaaaataata

SEQ ID NO: 18622 - DNA, 25 bp, Homo sapien
agaaagagcatacctcgaaataata

SEQ ID NO: 18623 - DNA, 25 bp, Homo sapien
agaaagagcatgtcaggaaaatgaa

SEQ ID NO: 18624 - DNA, 25 bp, Homo sapien
agaaagagcatgttaggaaaatgaa

SEQ ID NO: 18625 - DNA, 25 bp, Homo sapien
agaaagagctttcaataaaatcaaa

SEQ ID NO: 18626 - DNA, 25 bp, Homo sapien
agaaagagggcacgcgagtcccact

SEQ ID NO: 18627 - DNA, 25 bp, Homo sapien
agaaagagggcatgcgagtcccact

SEQ ID NO: 18628 - DNA, 25 bp, Homo sapien
agaaagaggttgggtcttagtgtct

SEQ ID NO: 18629 - DNA, 25 bp, Homo sapien
agaaagagtagcaaggcaatttagt

SEQ ID NO: 18630 - DNA, 25 bp, Homo sapien
agaaagagtagcgaggcaatttagt

SEQ ID NO: 18631 - DNA, 25 bp, Homo sapien
agaaagagtttgggtcttagtgtct

SEQ ID NO: 18632 - DNA, 25 bp, Homo sapien
agaaagagttttcaataaaatcaaa

SEQ ID NO: 18633 - DNA, 25 bp, Homo sapien
agaaagatgaagattcaggcattac

SEQ ID NO: 18634 - DNA, 25 bp, Homo sapien
agaaagatgaaggttcaggcattac

SEQ ID NO: 18635 - DNA, 25 bp, Homo sapien
agaaagatggaggccaaaagactaa

SEQ ID NO: 18636 - DNA, 25 bp, Homo sapien
agaaagatggaggtcaaaagactaa

SEQ ID NO: 18637 - DNA, 25 bp, Homo sapien
agaaagatttgaactacatataatt

SEQ ID NO: 18638 - DNA, 25 bp, Homo sapien
agaaagatttgaagtacatataatt

SEQ ID NO: 18639 - DNA, 25 bp, Homo sapien
agaaagcaagacacgaagagatcac

SEQ ID NO: 18640 - DNA, 25 bp, Homo sapien
agaaagcaagacatgaagagatcac

SEQ ID NO: 18641 - DNA, 25 bp, Homo sapien
agaaagcaatgtgacaacctcagca

SEQ ID NO: 18642 - DNA, 25 bp, Homo sapien
agaaagcagtaccttttccataagc

SEQ ID NO: 18643 - DNA, 25 bp, Homo sapien
agaaagcagtgtgacaacctcagca

SEQ ID NO: 18644 - DNA, 25 bp, Homo sapien
agaaagcataaaatccaaatctcga

SEQ ID NO: 18645 - DNA, 25 bp, Homo sapien
agaaagcataaaatccgaatctcga

SEQ ID NO: 18646 - DNA, 25 bp, Homo sapien
agaaagcatcataataatgtgggtg

SEQ ID NO: 18647 - DNA, 25 bp, Homo sapien
agaaagcatcatagtaatgtgggtg

SEQ ID NO: 18648 - DNA, 25 bp, Homo sapien
agaaagcattaccttttccataagc

SEQ ID NO: 18649 - DNA, 25 bp, Homo sapien
agaaagcatttgcccgtacagcatt

SEQ ID NO: 18650 - DNA, 25 bp, Homo sapien
agaaagcatttgcctgtacagcatt

SEQ ID NO: 18651 - DNA, 25 bp, Homo sapien
agaaagcccacctaaaatgatgatc

SEQ ID NO: 18652 - DNA, 25 bp, Homo sapien
agaaagcccacctgaaatgatgatc

SEQ ID NO: 18653 - DNA, 25 bp, Homo sapien
agaaagcccgggtgtttccttctgt

SEQ ID NO: 18654 - DNA, 25 bp, Homo sapien
agaaagccgatgattaacaccaggt

SEQ ID NO: 18655 - DNA, 25 bp, Homo sapien
agaaagccgatgattaccaccaggt

SEQ ID NO: 18656 - DNA, 25 bp, Homo sapien
agaaagcctcagcaaagaaatagaa

SEQ ID NO: 18657 - DNA, 25 bp, Homo sapien
agaaagcctcatcaaagaaatagaa

SEQ ID NO: 18658 - DNA, 25 bp, Homo sapien
agaaagcctgggtgtttccttctgt

SEQ ID NO: 18659 - DNA, 25 bp, Homo sapien
agaaagctcctgccatgtgttcact

SEQ ID NO: 18660 - DNA, 25 bp, Homo sapien
agaaagctcctgccgtgtgttcact

SEQ ID NO: 18661 - DNA, 25 bp, Homo sapien
agaaagctcttcaagacaggacaaa

SEQ ID NO: 18662 - DNA, 25 bp, Homo sapien
agaaagctcttcaagagaggacaaa

SEQ ID NO: 18663 - DNA, 25 bp, Homo sapien
agaaagctcttgaattcgtttccta

SEQ ID NO: 18664 - DNA, 25 bp, Homo sapien
agaaagctcttgcattcgtttccta

SEQ ID NO: 18665 - DNA, 25 bp, Homo sapien
agaaagcttctttcagtttggctga

SEQ ID NO: 18666 - DNA, 25 bp, Homo sapien
agaaagcttgtttcagtttggctga

SEQ ID NO: 18667 - DNA, 25 bp, Homo sapien
agaaaggaaacaattatcagtacta

SEQ ID NO: 18668 - DNA, 25 bp, Homo sapien
agaaaggaaacagttatcagtacta

SEQ ID NO: 18669 - DNA, 25 bp, Homo sapien
agaaaggaaactagcaggagatgat

SEQ ID NO: 18670 - DNA, 25 bp, Homo sapien
agaaaggaaactggcaggagatgat

SEQ ID NO: 18671 - DNA, 25 bp, Homo sapien
agaaaggaaatccagacacagacat

SEQ ID NO: 18672 - DNA, 25 bp, Homo sapien
agaaaggaaatccagatacagacat

SEQ ID NO: 18673 - DNA, 25 bp, Homo sapien
agaaaggaaggtcacagtgattgtc

SEQ ID NO: 18674 - DNA, 25 bp, Homo sapien
agaaaggaaggtcagagtgattgtc

SEQ ID NO: 18675 - DNA, 25 bp, Homo sapien
agaaaggaattcaagctgtacattg

SEQ ID NO: 18676 - DNA, 25 bp, Homo sapien
agaaaggaattcgagctgtacattg

SEQ ID NO: 18677 - DNA, 25 bp, Homo sapien
agaaaggaggactccacggtgcagg

SEQ ID NO: 18678 - DNA, 25 bp, Homo sapien
agaaaggaggactccatggtgcagg

SEQ ID NO: 18679 - DNA, 25 bp, Homo sapien
agaaaggagtaaacggtcctttcac

SEQ ID NO: 18680 - DNA, 25 bp, Homo sapien
agaaaggagtaagcggtcctttcac

SEQ ID NO: 18681 - DNA, 25 bp, Homo sapien
agaaaggccatgctgcaccctcttc

SEQ ID NO: 18682 - DNA, 25 bp, Homo sapien
agaaaggccattctgcaccctcttc

SEQ ID NO: 18683 - DNA, 25 bp, Homo sapien
agaaaggctctgttacaactctcct

SEQ ID NO: 18684 - DNA, 25 bp, Homo sapien
agaaaggctctgttacgactctcct

SEQ ID NO: 18685 - DNA, 25 bp, Homo sapien
agaaaggcttgttagcataagccac

SEQ ID NO: 18686 - DNA, 25 bp, Homo sapien
agaaaggcttgttagcgtaagccac

SEQ ID NO: 18687 - DNA, 25 bp, Homo sapien
agaaagggaccttaaaaagatcatc

SEQ ID NO: 18688 - DNA, 25 bp, Homo sapien
agaaagggagcttaaaaagatcatc

SEQ ID NO: 18689 - DNA, 25 bp, Homo sapien
agaaagggtcttacgagccattgaa

SEQ ID NO: 18690 - DNA, 25 bp, Homo sapien
agaaagggtcttatgagccattgaa

SEQ ID NO: 18691 - DNA, 25 bp, Homo sapien
agaaaggtcttgcctctaaagcccg

SEQ ID NO: 18692 - DNA, 25 bp, Homo sapien
agaaaggtcttgtctctaaagcccg

SEQ ID NO: 18693 - DNA, 25 bp, Homo sapien
agaaaggttattagagatagttggg

SEQ ID NO: 18694 - DNA, 25 bp, Homo sapien
agaaaggttattggagatagttggg

SEQ ID NO: 18695 - DNA, 25 bp, Homo sapien
agaaaggttctcaatccagtccgtg

SEQ ID NO: 18696 - DNA, 25 bp, Homo sapien
agaaaggttctcgatccagtccgtg

SEQ ID NO: 18697 - DNA, 25 bp, Homo sapien
agaaagtaacccgaggacttgaagg

SEQ ID NO: 18698 - DNA, 25 bp, Homo sapien
agaaagtaacctgaggacttgaagg

SEQ ID NO: 18699 - DNA, 25 bp, Homo sapien
agaaagtaggtctgagcagtgaaaa

SEQ ID NO: 18700 - DNA, 25 bp, Homo sapien
agaaagtaggtttgagcagtgaaaa

SEQ ID NO: 18701 - DNA, 25 bp, Homo sapien
agaaagtcaggcttcagctcagatc

SEQ ID NO: 18702 - DNA, 25 bp, Homo sapien
agaaagtcatgcttcagctcagatc

SEQ ID NO: 18703 - DNA, 25 bp, Homo sapien
agaaagtcctatctgctttaatctt

SEQ ID NO: 18704 - DNA, 25 bp, Homo sapien
agaaagtcctatcttctttaatctt

SEQ ID NO: 18705 - DNA, 25 bp, Homo sapien
agaaagtctcagaagaatttaccaa

SEQ ID NO: 18706 - DNA, 25 bp, Homo sapien
agaaagtctcagcagaatttaccaa

SEQ ID NO: 18707 - DNA, 25 bp, Homo sapien
agaaagtctcttatgccatggatct

SEQ ID NO: 18708 - DNA, 25 bp, Homo sapien
agaaagtctgcatacatatagcctc

SEQ ID NO: 18709 - DNA, 25 bp, Homo sapien
agaaagtctgcgtacatatagcctc

SEQ ID NO: 18710 - DNA, 25 bp, Homo sapien
agaaagtcttttatgccatggatct

SEQ ID NO: 18711 - DNA, 25 bp, Homo sapien
agaaagtgagggcaagaacagaaac

SEQ ID NO: 18712 - DNA, 25 bp, Homo sapien
agaaagtgagggcgagaacagaaac

SEQ ID NO: 18713 - DNA, 25 bp, Homo sapien
agaaagttctcagtagattggtcgg

SEQ ID NO: 18714 - DNA, 25 bp, Homo sapien
agaaagttctcggtagattggtcgg

SEQ ID NO: 18715 - DNA, 25 bp, Homo sapien
agaaagtttcaataaattaaccaga

SEQ ID NO: 18716 - DNA, 25 bp, Homo sapien
agaaagtttgaataaattaaccaga

SEQ ID NO: 18717 - DNA, 25 bp, Homo sapien
agaaataaaatccgaggcccaaagc

SEQ ID NO: 18718 - DNA, 25 bp, Homo sapien
agaaataacatccgaggcccaaagc

SEQ ID NO: 18719 - DNA, 25 bp, Homo sapien
agaaataagctaagaaacaatggga

SEQ ID NO: 18720 - DNA, 25 bp, Homo sapien
agaaataagctaagcaacaatggga

SEQ ID NO: 18721 - DNA, 25 bp, Homo sapien
agaaataccaaagtcctcaaagcac

SEQ ID NO: 18722 - DNA, 25 bp, Homo sapien
agaaataccaaggtcctcaaagcac

SEQ ID NO: 18723 - DNA, 25 bp, Homo sapien
agaaataccattgcttgcatgtcaa

SEQ ID NO: 18724 - DNA, 25 bp, Homo sapien
agaaataccattgtttgcatgtcaa

SEQ ID NO: 18725 - DNA, 25 bp, Homo sapien
agaaatacctgcacgtcatttctac

SEQ ID NO: 18726 - DNA, 25 bp, Homo sapien
agaaatacctgcccgtcatttctac

SEQ ID NO: 18727 - DNA, 25 bp, Homo sapien
agaaatagaaaaaactgaattgcca

SEQ ID NO: 18728 - DNA, 25 bp, Homo sapien
agaaatagaaaaaattgaattgcca

SEQ ID NO: 18729 - DNA, 25 bp, Homo sapien
agaaatagccaacccacactaaagc

SEQ ID NO: 18730 - DNA, 25 bp, Homo sapien
agaaatagccaactcacactaaagc

SEQ ID NO: 18731 - DNA, 25 bp, Homo sapien
agaaatagctgcaaagttacaaatt

SEQ ID NO: 18732 - DNA, 25 bp, Homo sapien
agaaatagctgcatagttacaaatt

SEQ ID NO: 18733 - DNA, 25 bp, Homo sapien
agaaatagcttcaatacagtccaga

SEQ ID NO: 18734 - DNA, 25 bp, Homo sapien
agaaatagcttcagtacagtccaga

SEQ ID NO: 18735 - DNA, 25 bp, Homo sapien
agaaataggcaaaaatttgttaagt

SEQ ID NO: 18736 - DNA, 25 bp, Homo sapien
agaaataggcataaatttgttaagt

SEQ ID NO: 18737 - DNA, 25 bp, Homo sapien
agaaatagtaaatttgacaacatta

SEQ ID NO: 18738 - DNA, 25 bp, Homo sapien
agaaatagtcaatttgacaacatta

SEQ ID NO: 18739 - DNA, 25 bp, Homo sapien
agaaatatacatccatcatctatga

SEQ ID NO: 18740 - DNA, 25 bp, Homo sapien
agaaatatatatccatcatctatga

SEQ ID NO: 18741 - DNA, 25 bp, Homo sapien
agaaatatggagtacacattctgct

SEQ ID NO: 18742 - DNA, 25 bp, Homo sapien
agaaatatggagtatacattctgct

SEQ ID NO: 18743 - DNA, 25 bp, Homo sapien
agaaatatgtctatgacgatttgct

SEQ ID NO: 18744 - DNA, 25 bp, Homo sapien
agaaatatgtctatgatgatttgct

SEQ ID NO: 18745 - DNA, 25 bp, Homo sapien
agaaatattgtcacatctaatttgc

SEQ ID NO: 18746 - DNA, 25 bp, Homo sapien
agaaatattgtcccatctaatttgc

SEQ ID NO: 18747 - DNA, 25 bp, Homo sapien
agaaatcaacaaaggatgcacggga

SEQ ID NO: 18748 - DNA, 25 bp, Homo sapien
agaaatcaattatgcctgtgttgtt

SEQ ID NO: 18749 - DNA, 25 bp, Homo sapien
agaaatcagagaagacttttccttt

SEQ ID NO: 18750 - DNA, 25 bp, Homo sapien
agaaatcagagaagccttttccttt

SEQ ID NO: 18751 - DNA, 25 bp, Homo sapien
agaaatcagcaaaggatgcacggga

SEQ ID NO: 18752 - DNA, 25 bp, Homo sapien
agaaatcaggctacggttccagcta

SEQ ID NO: 18753 - DNA, 25 bp, Homo sapien
agaaatcaggctatggttccagcta

SEQ ID NO: 18754 - DNA, 25 bp, Homo sapien
agaaatcagttatgcctgtgttgtt

SEQ ID NO: 18755 - DNA, 25 bp, Homo sapien
agaaatcctgtttacttcactcagg

SEQ ID NO: 18756 - DNA, 25 bp, Homo sapien
agaaatcctgttttcttcactcagg

SEQ ID NO: 18757 - DNA, 25 bp, Homo sapien
agaaatctataatgaacggttaata

SEQ ID NO: 18758 - DNA, 25 bp, Homo sapien
agaaatctataatgaatggttaata

SEQ ID NO: 18759 - DNA, 25 bp, Homo sapien
agaaatcttatacccactagctgtc

SEQ ID NO: 18760 - DNA, 25 bp, Homo sapien
agaaatcttatactcactagctgtc

SEQ ID NO: 18761 - DNA, 25 bp, Homo sapien
agaaatgaatagagagtgcgttgag

SEQ ID NO: 18762 - DNA, 25 bp, Homo sapien
agaaatgaatagatagtgcgttgag

SEQ ID NO: 18763 - DNA, 25 bp, Homo sapien
agaaatgacaattgactttgaaatc

SEQ ID NO: 18764 - DNA, 25 bp, Homo sapien
agaaatgactcaaacaaagttaaat

SEQ ID NO: 18765 - DNA, 25 bp, Homo sapien
agaaatgactcaaagaaagttaaat

SEQ ID NO: 18766 - DNA, 25 bp, Homo sapien
agaaatgagcccagctgaacactct

SEQ ID NO: 18767 - DNA, 25 bp, Homo sapien
agaaatgagcccagttgaacactct

SEQ ID NO: 18768 - DNA, 25 bp, Homo sapien
agaaatgaggtcaccaagtgatgga

SEQ ID NO: 18769 - DNA, 25 bp, Homo sapien
agaaatgaggtcgccaagtgatgga

SEQ ID NO: 18770 - DNA, 25 bp, Homo sapien
agaaatgataattgactttgaaatc

SEQ ID NO: 18771 - DNA, 25 bp, Homo sapien
agaaatgatattcaccgccgactgc

SEQ ID NO: 18772 - DNA, 25 bp, Homo sapien
agaaatgatattcgccgccgactgc

SEQ ID NO: 18773 - DNA, 25 bp, Homo sapien
agaaatgatcaggctaaatcgccag

SEQ ID NO: 18774 - DNA, 25 bp, Homo sapien
agaaatgatcaggttaaatcgccag

SEQ ID NO: 18775 - DNA, 25 bp, Homo sapien
agaaatgatcgactagagtactgag

SEQ ID NO: 18776 - DNA, 25 bp, Homo sapien
agaaatgatgttggtatcactactt

SEQ ID NO: 18777 - DNA, 25 bp, Homo sapien
agaaatgatgtttgtatcactactt

SEQ ID NO: 18778 - DNA, 25 bp, Homo sapien
agaaatgattgactagagtactgag

SEQ ID NO: 18779 - DNA, 25 bp, Homo sapien
agaaatgcaaggagagtcggaagaa

SEQ ID NO: 18780 - DNA, 25 bp, Homo sapien
agaaatgccaacggctacagacaaa

SEQ ID NO: 18781 - DNA, 25 bp, Homo sapien
agaaatgccaatggctacagacaaa

SEQ ID NO: 18782 - DNA, 25 bp, Homo sapien
agaaatgccaggagagtcggaagaa

SEQ ID NO: 18783 - DNA, 25 bp, Homo sapien
agaaatgcctgacgaaggagttcct

SEQ ID NO: 18784 - DNA, 25 bp, Homo sapien
agaaatgcctgatgaaggagttcct

SEQ ID NO: 18785 - DNA, 25 bp, Homo sapien
agaaatggcctctccgtgagctagt

SEQ ID NO: 18786 - DNA, 25 bp, Homo sapien
agaaatgggcttaaatctgcatttg

SEQ ID NO: 18787 - DNA, 25 bp, Homo sapien
agaaatgggtttaaatctgcatttg

SEQ ID NO: 18788 - DNA, 25 bp, Homo sapien
agaaatggtaaagtgggatgccaag

SEQ ID NO: 18789 - DNA, 25 bp, Homo sapien
agaaatggtaacgtgggatgccaag

SEQ ID NO: 18790 - DNA, 25 bp, Homo sapien
agaaatggtctctccgtgagctagt

SEQ ID NO: 18791 - DNA, 25 bp, Homo sapien
agaaatgtttttgcatatggcttcc

SEQ ID NO: 18792 - DNA, 25 bp, Homo sapien
agaaatgtttttgcgtatggcttcc

SEQ ID NO: 18793 - DNA, 25 bp, Homo sapien
agaaattaactctccttgcttatct

SEQ ID NO: 18794 - DNA, 25 bp, Homo sapien
agaaattaactcttcttgcttatct

SEQ ID NO: 18795 - DNA, 25 bp, Homo sapien
agaaattacctaatcagcctgcaca

SEQ ID NO: 18796 - DNA, 25 bp, Homo sapien
agaaattacttaatcagcctgcaca

SEQ ID NO: 18797 - DNA, 25 bp, Homo sapien
agaaattcaagactagagacgaggt

SEQ ID NO: 18798 - DNA, 25 bp, Homo sapien
agaaattcacgactagagacgaggt

SEQ ID NO: 18799 - DNA, 25 bp, Homo sapien
agaaattctaaggtacagtaacaac

SEQ ID NO: 18800 - DNA, 25 bp, Homo sapien
agaaattctaaggtacggtaacaac

SEQ ID NO: 18801 - DNA, 25 bp, Homo sapien
agaaattctcattaaagtcaagact

SEQ ID NO: 18802 - DNA, 25 bp, Homo sapien
agaaattctcattacagtcaagact

SEQ ID NO: 18803 - DNA, 25 bp, Homo sapien
agaaattgaaaataaacactctcac

SEQ ID NO: 18804 - DNA, 25 bp, Homo sapien
agaaattgaacttacgcaaagcttc

SEQ ID NO: 18805 - DNA, 25 bp, Homo sapien
agaaattgaacttatgcaaagcttc

SEQ ID NO: 18806 - DNA, 25 bp, Homo sapien
agaaattgctaatgaaagatatgtt

SEQ ID NO: 18807 - DNA, 25 bp, Homo sapien
agaaattgctaatgaaggatatgtt

SEQ ID NO: 18808 - DNA, 25 bp, Homo sapien
agaaattggaaataaacactctcac

SEQ ID NO: 18809 - DNA, 25 bp, Homo sapien
agaaattgtattcattggttttcat

SEQ ID NO: 18810 - DNA, 25 bp, Homo sapien
agaaattgtattcatttgttttcat

SEQ ID NO: 18811 - DNA, 25 bp, Homo sapien
agaaatttcagaaagagaaccacac

SEQ ID NO: 18812 - DNA, 25 bp, Homo sapien
agaaatttcagaaggagaaccacac

SEQ ID NO: 18813 - DNA, 25 bp, Homo sapien
agaaatttcccagaacaaaagacag

SEQ ID NO: 18814 - DNA, 25 bp, Homo sapien
agaaatttcccataacaaaagacag

SEQ ID NO: 18815 - DNA, 25 bp, Homo sapien
agaaatttggggaagttgataaaag

SEQ ID NO: 18816 - DNA, 25 bp, Homo sapien
agaaatttgggtaagttgataaaag

SEQ ID NO: 18817 - DNA, 25 bp, Homo sapien
agaacaaaaactccaaaagtgaaat

SEQ ID NO: 18818 - DNA, 25 bp, Homo sapien
agaacaaaaacttcaaaagtgaaat

SEQ ID NO: 18819 - DNA, 25 bp, Homo sapien
agaacaaaatcattcaagcccatga

SEQ ID NO: 18820 - DNA, 25 bp, Homo sapien
agaacaaaatcgttcaagcccatga

SEQ ID NO: 18821 - DNA, 25 bp, Homo sapien
agaacaaacacaagtacaactaatt

SEQ ID NO: 18822 - DNA, 25 bp, Homo sapien
agaacaaacaccagtacaactaatt

SEQ ID NO: 18823 - DNA, 25 bp, Homo sapien
agaacaaatgcagcgaaatgttaat

SEQ ID NO: 18824 - DNA, 25 bp, Homo sapien
agaacaaatgcagtgaaatgttaat

SEQ ID NO: 18825 - DNA, 25 bp, Homo sapien
agaacaacactttcccaatatccct

SEQ ID NO: 18826 - DNA, 25 bp, Homo sapien
agaacaacactttcccgatatccct

SEQ ID NO: 18827 - DNA, 25 bp, Homo sapien
agaacaatccatctcatggagacta

SEQ ID NO: 18828 - DNA, 25 bp, Homo sapien
agaacaatccatttcatggagacta

SEQ ID NO: 18829 - DNA, 25 bp, Homo sapien
agaacaattagtggcatgagcccat

SEQ ID NO: 18830 - DNA, 25 bp, Homo sapien
agaacaattcgtggcatgagcccat

SEQ ID NO: 18831 - DNA, 25 bp, Homo sapien
agaacacatcgacaacaggggagcc

SEQ ID NO: 18832 - DNA, 25 bp, Homo sapien
agaacacatcgacgacaggggagcc

SEQ ID NO: 18833 - DNA, 25 bp, Homo sapien
agaacaccatttaatctttaaaaca

SEQ ID NO: 18834 - DNA, 25 bp, Homo sapien
agaacaccatttgatctttaaaaca

SEQ ID NO: 18835 - DNA, 25 bp, Homo sapien
agaacacgaactagaactaggtttc

SEQ ID NO: 18836 - DNA, 25 bp, Homo sapien
agaacacgaactagaagtaggtttc

SEQ ID NO: 18837 - DNA, 25 bp, Homo sapien
agaacacgtgagaaacctaggccat

SEQ ID NO: 18838 - DNA, 25 bp, Homo sapien
agaacacgtgagaaacttaggccat

SEQ ID NO: 18839 - DNA, 25 bp, Homo sapien
agaacacttagaagagaccatatat

SEQ ID NO: 18840 - DNA, 25 bp, Homo sapien
agaacacttagaagaggccatatat

SEQ ID NO: 18841 - DNA, 25 bp, Homo sapien
agaacaggaataattcttcagacct

SEQ ID NO: 18842 - DNA, 25 bp, Homo sapien
agaacaggaattattcttcagacct

SEQ ID NO: 18843 - DNA, 25 bp, Homo sapien
agaacaggagtacccaggaacatga

SEQ ID NO: 18844 - DNA, 25 bp, Homo sapien
agaacaggattacccaggaacatga

SEQ ID NO: 18845 - DNA, 25 bp, Homo sapien
agaacagtaagaaacaacataatga

SEQ ID NO: 18846 - DNA, 25 bp, Homo sapien
agaacagtaagaaataacataatga

SEQ ID NO: 18847 - DNA, 25 bp, Homo sapien
agaacataaacctaagtgaaaaaga

SEQ ID NO: 18848 - DNA, 25 bp, Homo sapien
agaacataaattgctattcctcttc

SEQ ID NO: 18849 - DNA, 25 bp, Homo sapien
agaacataaattgttattcctcttc

SEQ ID NO: 18850 - DNA, 25 bp, Homo sapien
agaacataatataaagcagtatgag

SEQ ID NO: 18851 - DNA, 25 bp, Homo sapien
agaacataatcctaagtgaaaaaga

SEQ ID NO: 18852 - DNA, 25 bp, Homo sapien
agaacatatatataaaggaccttga

SEQ ID NO: 18853 - DNA, 25 bp, Homo sapien
agaacatatgtataaaggaccttga

SEQ ID NO: 18854 - DNA, 25 bp, Homo sapien
agaacatattataaagcagtatgag

SEQ ID NO: 18855 - DNA, 25 bp, Homo sapien
agaacatcaatgcagaatgactatg

SEQ ID NO: 18856 - DNA, 25 bp, Homo sapien
agaacatcagtgcagaatgactatg

SEQ ID NO: 18857 - DNA, 25 bp, Homo sapien
agaacatctcttcttgttctcatgg

SEQ ID NO: 18858 - DNA, 25 bp, Homo sapien
agaacatctctttttgttctcatgg

SEQ ID NO: 18859 - DNA, 25 bp, Homo sapien
agaacatgctgccactgagatgttg

SEQ ID NO: 18860 - DNA, 25 bp, Homo sapien
agaacatgctgtcactgagatgttg

SEQ ID NO: 18861 - DNA, 25 bp, Homo sapien
agaaccaaatttatgacccaaactt

SEQ ID NO: 18862 - DNA, 25 bp, Homo sapien
agaaccaaatttatgatccaaactt

SEQ ID NO: 18863 - DNA, 25 bp, Homo sapien
agaaccacagcactagagaaggcca

SEQ ID NO: 18864 - DNA, 25 bp, Homo sapien
agaaccacggcactagagaaggcca

SEQ ID NO: 18865 - DNA, 25 bp, Homo sapien
agaaccagatttctgctttctctta

SEQ ID NO: 18866 - DNA, 25 bp, Homo sapien
agaaccaggtttctgctttctctta

SEQ ID NO: 18867 - DNA, 25 bp, Homo sapien
agaaccagtgaaaacataaacagac

SEQ ID NO: 18868 - DNA, 25 bp, Homo sapien
agaaccagtgagaacataaacagac

SEQ ID NO: 18869 - DNA, 25 bp, Homo sapien
agaaccatatcatcaatgtcatgtg

SEQ ID NO: 18870 - DNA, 25 bp, Homo sapien
agaaccatatcgtcaatgtcatgtg

SEQ ID NO: 18871 - DNA, 25 bp, Homo sapien
agaaccattgccttggcgtgagact

SEQ ID NO: 18872 - DNA, 25 bp, Homo sapien
agaaccattgccttggtgtgagact

SEQ ID NO: 18873 - DNA, 25 bp, Homo sapien
agaaccctaaagcttaatgaatttg

SEQ ID NO: 18874 - DNA, 25 bp, Homo sapien
agaaccctacagcttaatgaatttg

SEQ ID NO: 18875 - DNA, 25 bp, Homo sapien
agaaccctgctccggtgggatttgc

SEQ ID NO: 18876 - DNA, 25 bp, Homo sapien
agaaccctgctctggtgggatttgc

SEQ ID NO: 18877 - DNA, 25 bp, Homo sapien
agaacctagatgcaaaagtgtccag

SEQ ID NO: 18878 - DNA, 25 bp, Homo sapien
agaacctagatgcgaaagtgtccag

SEQ ID NO: 18879 - DNA, 25 bp, Homo sapien
agaacctcaaaaatatatctgtgct

SEQ ID NO: 18880 - DNA, 25 bp, Homo sapien
agaacctcactgcgaataaggaaga

SEQ ID NO: 18881 - DNA, 25 bp, Homo sapien
agaacctcactgtgaataaggaaga

SEQ ID NO: 18882 - DNA, 25 bp, Homo sapien
agaacctcagaaatatatctgtgct

SEQ ID NO: 18883 - DNA, 25 bp, Homo sapien
agaacctggagaatgaaggtggaag

SEQ ID NO: 18884 - DNA, 25 bp, Homo sapien
agaacctggcgaatgaaggtggaag

SEQ ID NO: 18885 - DNA, 25 bp, Homo sapien
agaacctgtggatatgcaccttgtg

SEQ ID NO: 18886 - DNA, 25 bp, Homo sapien
agaacctgtggatatgtaccttgtg

SEQ ID NO: 18887 - DNA, 25 bp, Homo sapien
agaacgaagaagatggcaaagattt

SEQ ID NO: 18888 - DNA, 25 bp, Homo sapien
agaacgaagaaggtggcaaagattt

SEQ ID NO: 18889 - DNA, 25 bp, Homo sapien
agaacgtggcttaacgaacctcata

SEQ ID NO: 18890 - DNA, 25 bp, Homo sapien
agaacgtggcttaatgaacctcata

SEQ ID NO: 18891 - DNA, 25 bp, Homo sapien
agaactacataagcttctgaaatag

SEQ ID NO: 18892 - DNA, 25 bp, Homo sapien
agaactacgtaagcttctgaaatag

SEQ ID NO: 18893 - DNA, 25 bp, Homo sapien
agaactacgtggagacaaaagtgct

SEQ ID NO: 18894 - DNA, 25 bp, Homo sapien
agaactacgtggtgacaaaagtgct

SEQ ID NO: 18895 - DNA, 25 bp, Homo sapien
agaactcaatacggcggcaggttct

SEQ ID NO: 18896 - DNA, 25 bp, Homo sapien
agaactcaatacggtggcaggttct

SEQ ID NO: 18897 - DNA, 25 bp, Homo sapien
agaactcacaggactcaaaaaagct

SEQ ID NO: 18898 - DNA, 25 bp, Homo sapien
agaactcacagggctcaaaaaagct

SEQ ID NO: 18899 - DNA, 25 bp, Homo sapien
agaactcacatcagtagaaagagcg

SEQ ID NO: 18900 - DNA, 25 bp, Homo sapien
agaactcacatcagtataaagagcg

SEQ ID NO: 18901 - DNA, 25 bp, Homo sapien
agaactgaacctgctcttgctgagg

SEQ ID NO: 18902 - DNA, 25 bp, Homo sapien
agaactgaatctgctcttgctgagg

SEQ ID NO: 18903 - DNA, 25 bp, Homo sapien
agaactgatgaaaccaggaattgcc

SEQ ID NO: 18904 - DNA, 25 bp, Homo sapien
agaactgatgaaactaggaattgcc

SEQ ID NO: 18905 - DNA, 25 bp, Homo sapien
agaactgcattaaattatttcatcc

SEQ ID NO: 18906 - DNA, 25 bp, Homo sapien
agaactgccataaccagaaaagatt

SEQ ID NO: 18907 - DNA, 25 bp, Homo sapien
agaactgccgtaaccagaaaagatt

SEQ ID NO: 18908 - DNA, 25 bp, Homo sapien
agaactgcgttaaattatttcatcc

SEQ ID NO: 18909 - DNA, 25 bp, Homo sapien
agaactgggatccaaggaccgtaca

SEQ ID NO: 18910 - DNA, 25 bp, Homo sapien
agaactgggatccagggaccgtaca

SEQ ID NO: 18911 - DNA, 25 bp, Homo sapien
agaactgtctgtatgttaactactt

SEQ ID NO: 18912 - DNA, 25 bp, Homo sapien
agaactgtctgtattttaactactt

SEQ ID NO: 18913 - DNA, 25 bp, Homo sapien
agaactgttcaacttccaagcaaat

SEQ ID NO: 18914 - DNA, 25 bp, Homo sapien
agaactgtttaacttccaagcaaat

SEQ ID NO: 18915 - DNA, 25 bp, Homo sapien
agaacttaagaaacttgtccaagat

SEQ ID NO: 18916 - DNA, 25 bp, Homo sapien
agaacttaagaaatttgtccaagat

SEQ ID NO: 18917 - DNA, 25 bp, Homo sapien
agaacttaagcggttcaaaaggcca

SEQ ID NO: 18918 - DNA, 25 bp, Homo sapien
agaacttaccaacttaactgataaa

SEQ ID NO: 18919 - DNA, 25 bp, Homo sapien
agaacttaggcggttcaaaaggcca

SEQ ID NO: 18920 - DNA, 25 bp, Homo sapien
agaacttaggggcaaactgattgca

SEQ ID NO: 18921 - DNA, 25 bp, Homo sapien
agaacttaggggcaaattgattgca

SEQ ID NO: 18922 - DNA, 25 bp, Homo sapien
agaacttatcaacttaactgataaa

SEQ ID NO: 18923 - DNA, 25 bp, Homo sapien
agaacttccgactgaaagctagaga

SEQ ID NO: 18924 - DNA, 25 bp, Homo sapien
agaacttctgactgaaagctagaga

SEQ ID NO: 18925 - DNA, 25 bp, Homo sapien
agaacttcttgttaaacgctaatct

SEQ ID NO: 18926 - DNA, 25 bp, Homo sapien
agaacttcttgttaaatgctaatct

SEQ ID NO: 18927 - DNA, 25 bp, Homo sapien
agaacttcttttgcaccttaaaata

SEQ ID NO: 18928 - DNA, 25 bp, Homo sapien
agaacttcttttgctccttaaaata

SEQ ID NO: 18929 - DNA, 25 bp, Homo sapien
agaacttgaaaacgggccttgtgtc

SEQ ID NO: 18930 - DNA, 25 bp, Homo sapien
agaacttgaaaatgggccttgtgtc

SEQ ID NO: 18931 - DNA, 25 bp, Homo sapien
agaactttcattcagtgatatgtat

SEQ ID NO: 18932 - DNA, 25 bp, Homo sapien
agaactttcattgagtgatatgtat

SEQ ID NO: 18933 - DNA, 25 bp, Homo sapien
agaagaaaacaaacaaaaaattcta

SEQ ID NO: 18934 - DNA, 25 bp, Homo sapien
agaagaaaacaaacgaaaaattcta

SEQ ID NO: 18935 - DNA, 25 bp, Homo sapien
agaagaaaactttccagcaagtagg

SEQ ID NO: 18936 - DNA, 25 bp, Homo sapien
agaagaaaagagaaagaactgctaa

SEQ ID NO: 18937 - DNA, 25 bp, Homo sapien
agaagaaaatatacgctatcacagg

SEQ ID NO: 18938 - DNA, 25 bp, Homo sapien
agaagaaaatatatgctatcacagg

SEQ ID NO: 18939 - DNA, 25 bp, Homo sapien
agaagaaacatgtttgaggccacaa

SEQ ID NO: 18940 - DNA, 25 bp, Homo sapien
agaagaaacctttccagcaagtagg

SEQ ID NO: 18941 - DNA, 25 bp, Homo sapien
agaagaaactgcagagtccctgcct

SEQ ID NO: 18942 - DNA, 25 bp, Homo sapien
agaagaaaggagaaagaactgctaa

SEQ ID NO: 18943 - DNA, 25 bp, Homo sapien
agaagaaatatgtttgaggccacaa

SEQ ID NO: 18944 - DNA, 25 bp, Homo sapien
agaagaaattgcagagtccctgcct

SEQ ID NO: 18945 - DNA, 25 bp, Homo sapien
agaagaacaagtgatgattagagtg

SEQ ID NO: 18946 - DNA, 25 bp, Homo sapien
agaagaacaggtgatgattagagtg

SEQ ID NO: 18947 - DNA, 25 bp, Homo sapien
agaagaacgaatgagcgagcttgaa

SEQ ID NO: 18948 - DNA, 25 bp, Homo sapien
agaagaacgcatgagcgagcttgaa

SEQ ID NO: 18949 - DNA, 25 bp, Homo sapien
agaagaagaaaatggagtccttgct

SEQ ID NO: 18950 - DNA, 25 bp, Homo sapien
agaagaagaaaattgagtccttgct

SEQ ID NO: 18951 - DNA, 25 bp, Homo sapien
agaagaagcctgaagggtgagctaa

SEQ ID NO: 18952 - DNA, 25 bp, Homo sapien
agaagaaggctgaagggtgagctaa

SEQ ID NO: 18953 - DNA, 25 bp, Homo sapien
agaagaatatcatcttgaagagtac

SEQ ID NO: 18954 - DNA, 25 bp, Homo sapien
agaagaatatcgtcttgaagagtac

SEQ ID NO: 18955 - DNA, 25 bp, Homo sapien
agaagaattccaaataatcatggag

SEQ ID NO: 18956 - DNA, 25 bp, Homo sapien
agaagaattccgaataatcatggag

SEQ ID NO: 18957 - DNA, 25 bp, Homo sapien
agaagaattcggctttataggcaga

SEQ ID NO: 18958 - DNA, 25 bp, Homo sapien
agaagaatttggctttataggcaga

SEQ ID NO: 18959 - DNA, 25 bp, Homo sapien
agaagacaaatctaaccagaagagg

SEQ ID NO: 18960 - DNA, 25 bp, Homo sapien
agaagacaaatctaactagaagagg

SEQ ID NO: 18961 - DNA, 25 bp, Homo sapien
agaagacatctgcaggttctaatgg

SEQ ID NO: 18962 - DNA, 25 bp, Homo sapien
agaagacatctggaggttctaatgg

SEQ ID NO: 18963 - DNA, 25 bp, Homo sapien
agaagagaaaatccatagacaccca

SEQ ID NO: 18964 - DNA, 25 bp, Homo sapien
agaagagaagaaagtaccaggactt

SEQ ID NO: 18965 - DNA, 25 bp, Homo sapien
agaagagaagaaattaccaggactt

SEQ ID NO: 18966 - DNA, 25 bp, Homo sapien
agaagagaagatccatagacaccca

SEQ ID NO: 18967 - DNA, 25 bp, Homo sapien
agaagagagaactccggacactcta

SEQ ID NO: 18968 - DNA, 25 bp, Homo sapien
agaagagagaactctggacactcta

SEQ ID NO: 18969 - DNA, 25 bp, Homo sapien
agaagagaggcaggaagacttacct

SEQ ID NO: 18970 - DNA, 25 bp, Homo sapien
agaagagaggcagggagacttacct

SEQ ID NO: 18971 - DNA, 25 bp, Homo sapien
agaagagatgtcacatgttgcattg

SEQ ID NO: 18972 - DNA, 25 bp, Homo sapien
agaagagatgttacatgttgcattg

SEQ ID NO: 18973 - DNA, 25 bp, Homo sapien
agaagagattcctttacttattcca

SEQ ID NO: 18974 - DNA, 25 bp, Homo sapien
agaagagattcctttatttattcca

SEQ ID NO: 18975 - DNA, 25 bp, Homo sapien
agaagagcccagaggatagcgacgg

SEQ ID NO: 18976 - DNA, 25 bp, Homo sapien
agaagagcccagagtatagcgacgg

SEQ ID NO: 18977 - DNA, 25 bp, Homo sapien
agaagaggaaaatatgatctcagac

SEQ ID NO: 18978 - DNA, 25 bp, Homo sapien
agaagaggacaatatgatctcagac

SEQ ID NO: 18979 - DNA, 25 bp, Homo sapien
agaagagtaattccaagacacgtaa

SEQ ID NO: 18980 - DNA, 25 bp, Homo sapien
agaagagtcaggtaaatataaatct

SEQ ID NO: 18981 - DNA, 25 bp, Homo sapien
agaagagtcgggtaaatataaatct

SEQ ID NO: 18982 - DNA, 25 bp, Homo sapien
agaagagtctcacactttctttcag

SEQ ID NO: 18983 - DNA, 25 bp, Homo sapien
agaagagtctcacattttctttcag

SEQ ID NO: 18984 - DNA, 25 bp, Homo sapien
agaagagtgattaagacagatggaa

SEQ ID NO: 18985 - DNA, 25 bp, Homo sapien
agaagagtgattccaagacacgtaa

SEQ ID NO: 18986 - DNA, 25 bp, Homo sapien
agaagagtgggaagccttgattata

SEQ ID NO: 18987 - DNA, 25 bp, Homo sapien
agaagagtgggaaggcttgattata

SEQ ID NO: 18988 - DNA, 25 bp, Homo sapien
agaagagtggttaagacagatggaa

SEQ ID NO: 18989 - DNA, 25 bp, Homo sapien
agaagatactcggtctccttaattc

SEQ ID NO: 18990 - DNA, 25 bp, Homo sapien
agaagatactcggtcttcttaattc

SEQ ID NO: 18991 - DNA, 25 bp, Homo sapien
agaagatagtgttagaaactgggaa

SEQ ID NO: 18992 - DNA, 25 bp, Homo sapien
agaagatagtgttagagactgggaa

SEQ ID NO: 18993 - DNA, 25 bp, Homo sapien
agaagatataagacgaagttcaaat

SEQ ID NO: 18994 - DNA, 25 bp, Homo sapien
agaagatataagccgaagttcaaat

SEQ ID NO: 18995 - DNA, 25 bp, Homo sapien
agaagatatgactcgtaactttcca

SEQ ID NO: 18996 - DNA, 25 bp, Homo sapien
agaagatatgacttgtaactttcca

SEQ ID NO: 18997 - DNA, 25 bp, Homo sapien
agaagatctcagcgcagctcctgct

SEQ ID NO: 18998 - DNA, 25 bp, Homo sapien
agaagatctcagtgcagctcctgct

SEQ ID NO: 18999 - DNA, 25 bp, Homo sapien
agaagatgaaagacgcttaataatg

SEQ ID NO: 19000 - DNA, 25 bp, Homo sapien
agaagatgaaagatgcttaataatg

SEQ ID NO: 19001 - DNA, 25 bp, Homo sapien
agaagattacacatggtgtattgag

SEQ ID NO: 19002 - DNA, 25 bp, Homo sapien
agaagattacacgtggtgtattgag

SEQ ID NO: 19003 - DNA, 25 bp, Homo sapien
agaagattcctcaggtgaaaaattt

SEQ ID NO: 19004 - DNA, 25 bp, Homo sapien
agaagattcctcgggtgaaaaattt

SEQ ID NO: 19005 - DNA, 25 bp, Homo sapien
agaagattcttgcactcaaccatga

SEQ ID NO: 19006 - DNA, 25 bp, Homo sapien
agaagattcttgccctcaaccatga

SEQ ID NO: 19007 - DNA, 25 bp, Homo sapien
agaagcacaataccatatgttagct

SEQ ID NO: 19008 - DNA, 25 bp, Homo sapien
agaagcacaatatcatatgttagct

SEQ ID NO: 19009 - DNA, 25 bp, Homo sapien
agaagcacacatagctgtttcactg

SEQ ID NO: 19010 - DNA, 25 bp, Homo sapien
agaagcacacatagttgtttcactg

SEQ ID NO: 19011 - DNA, 25 bp, Homo sapien
agaagcatatttccgaagttttgcc

SEQ ID NO: 19012 - DNA, 25 bp, Homo sapien
agaagcatatttctgaagttttgcc

SEQ ID NO: 19013 - DNA, 25 bp, Homo sapien
agaagcatgagaaaagctaggaaag

SEQ ID NO: 19014 - DNA, 25 bp, Homo sapien
agaagcatgggaaaagctaggaaag

SEQ ID NO: 19015 - DNA, 25 bp, Homo sapien
agaagcatttctacattaaacatga

SEQ ID NO: 19016 - DNA, 25 bp, Homo sapien
agaagcatttctgcattaaacatga

SEQ ID NO: 19017 - DNA, 25 bp, Homo sapien
agaagccttttaaaaagcaggtgcc

SEQ ID NO: 19018 - DNA, 25 bp, Homo sapien
agaagccttttaaaaatcaggtgcc

SEQ ID NO: 19019 - DNA, 25 bp, Homo sapien
agaagctaacagaatatgtttacca

SEQ ID NO: 19020 - DNA, 25 bp, Homo sapien
agaagctaacagagtatgtttacca

SEQ ID NO: 19021 - DNA, 25 bp, Homo sapien
agaagctaatcataaagtggaccca

SEQ ID NO: 19022 - DNA, 25 bp, Homo sapien
agaagctaatcgtaaagtggaccca

SEQ ID NO: 19023 - DNA, 25 bp, Homo sapien
agaagctagaaaaataaaaccatca

SEQ ID NO: 19024 - DNA, 25 bp, Homo sapien
agaagctagaaaagccaaggaagga

SEQ ID NO: 19025 - DNA, 25 bp, Homo sapien
agaagctagaaaagtaaaaccatca

SEQ ID NO: 19026 - DNA, 25 bp, Homo sapien
agaagctagaagagccaaggaagga

SEQ ID NO: 19027 - DNA, 25 bp, Homo sapien
agaagctcagacaatctgtgctcag

SEQ ID NO: 19028 - DNA, 25 bp, Homo sapien
agaagctctcagtgtagggaacaag

SEQ ID NO: 19029 - DNA, 25 bp, Homo sapien
agaagctctcagtttagggaacaag

SEQ ID NO: 19030 - DNA, 25 bp, Homo sapien
agaagctctgacaatctgtgctcag

SEQ ID NO: 19031 - DNA, 25 bp, Homo sapien
agaagctggaagcagtcaggaacat

SEQ ID NO: 19032 - DNA, 25 bp, Homo sapien
agaagctggaagcagtgaggaacat

SEQ ID NO: 19033 - DNA, 25 bp, Homo sapien
agaagctgtggaaagaaaaagaggg

SEQ ID NO: 19034 - DNA, 25 bp, Homo sapien
agaagctgtgggaagaaaaagaggg

SEQ ID NO: 19035 - DNA, 25 bp, Homo sapien
agaagctgtgtgctaaacctaacac

SEQ ID NO: 19036 - DNA, 25 bp, Homo sapien
agaagctgtgtgttaaacctaacac

SEQ ID NO: 19037 - DNA, 25 bp, Homo sapien
agaagcttcaaatgacaatagttta

SEQ ID NO: 19038 - DNA, 25 bp, Homo sapien
agaagcttcaaatgacgatagttta

SEQ ID NO: 19039 - DNA, 25 bp, Homo sapien
agaagcttcatctatttctccagct

SEQ ID NO: 19040 - DNA, 25 bp, Homo sapien
agaagcttcatttatttctccagct

SEQ ID NO: 19041 - DNA, 25 bp, Homo sapien
agaaggaaaagtcagggaaatgtca

SEQ ID NO: 19042 - DNA, 25 bp, Homo sapien
agaaggaaaattccgcactggtgct

SEQ ID NO: 19043 - DNA, 25 bp, Homo sapien
agaaggaaaattctgcactggtgct

SEQ ID NO: 19044 - DNA, 25 bp, Homo sapien
agaaggaaatgtcagggaaatgtca

SEQ ID NO: 19045 - DNA, 25 bp, Homo sapien
agaaggaacctcagcaaatttttta

SEQ ID NO: 19046 - DNA, 25 bp, Homo sapien
agaaggaacctcggcaaatttttta

SEQ ID NO: 19047 - DNA, 25 bp, Homo sapien
agaaggaagcaatgtgagttgaaaa

SEQ ID NO: 19048 - DNA, 25 bp, Homo sapien
agaaggaagcaatttgagttgaaaa

SEQ ID NO: 19049 - DNA, 25 bp, Homo sapien
agaaggacaattctactcagtgaaa

SEQ ID NO: 19050 - DNA, 25 bp, Homo sapien
agaaggacagtacttgtgctgaaga

SEQ ID NO: 19051 - DNA, 25 bp, Homo sapien
agaaggacagtatttgtgctgaaga

SEQ ID NO: 19052 - DNA, 25 bp, Homo sapien
agaaggacagttctactcagtgaaa

SEQ ID NO: 19053 - DNA, 25 bp, Homo sapien
agaaggacctaagagctccctaatc

SEQ ID NO: 19054 - DNA, 25 bp, Homo sapien
agaaggacctatgagctccctaatc

SEQ ID NO: 19055 - DNA, 25 bp, Homo sapien
agaaggagataccgtatataaagaa

SEQ ID NO: 19056 - DNA, 25 bp, Homo sapien
agaaggaggattgcattgtgaggac

SEQ ID NO: 19057 - DNA, 25 bp, Homo sapien
agaaggagggttgcattgtgaggac

SEQ ID NO: 19058 - DNA, 25 bp, Homo sapien
agaaggaggtaccgtatataaagaa

SEQ ID NO: 19059 - DNA, 25 bp, Homo sapien
agaaggatgttttcattttcagttt

SEQ ID NO: 19060 - DNA, 25 bp, Homo sapien
agaaggatgttttcgttttcagttt

SEQ ID NO: 19061 - DNA, 25 bp, Homo sapien
agaaggcaaaacagatgagagcaaa

SEQ ID NO: 19062 - DNA, 25 bp, Homo sapien
agaaggcaaaagagatgagagcaaa

SEQ ID NO: 19063 - DNA, 25 bp, Homo sapien
agaaggcatgaagacatttatgtgg

SEQ ID NO: 19064 - DNA, 25 bp, Homo sapien
agaaggcatgaaggcatttatgtgg

SEQ ID NO: 19065 - DNA, 25 bp, Homo sapien
agaaggccacctggcaggaatccct

SEQ ID NO: 19066 - DNA, 25 bp, Homo sapien
agaaggccacctgtcaggaatccct

SEQ ID NO: 19067 - DNA, 25 bp, Homo sapien
agaagggaggatcaatcgcttgagc

SEQ ID NO: 19068 - DNA, 25 bp, Homo sapien
agaagggaggatcgatcgcttgagc

SEQ ID NO: 19069 - DNA, 25 bp, Homo sapien
agaagggcatacgttgcggcaagga

SEQ ID NO: 19070 - DNA, 25 bp, Homo sapien
agaagggcatacgttgtggcaagga

SEQ ID NO: 19071 - DNA, 25 bp, Homo sapien
agaagggccactccaaactcttgaa

SEQ ID NO: 19072 - DNA, 25 bp, Homo sapien
agaagggccactctaaactcttgaa

SEQ ID NO: 19073 - DNA, 25 bp, Homo sapien
agaaggggtttgagttgagccagga

SEQ ID NO: 19074 - DNA, 25 bp, Homo sapien
agaaggggtttgatttgagccagga

SEQ ID NO: 19075 - DNA, 25 bp, Homo sapien
agaaggtacgtggattagaaaggaa

SEQ ID NO: 19076 - DNA, 25 bp, Homo sapien
agaaggtagacatttactctcccct

SEQ ID NO: 19077 - DNA, 25 bp, Homo sapien
agaaggtagacgtttactctcccct

SEQ ID NO: 19078 - DNA, 25 bp, Homo sapien
agaaggtagagattcagttgctggg

SEQ ID NO: 19079 - DNA, 25 bp, Homo sapien
agaaggtagaggttcagttgctggg

SEQ ID NO: 19080 - DNA, 25 bp, Homo sapien
agaaggtagggcactacagaacaag

SEQ ID NO: 19081 - DNA, 25 bp, Homo sapien
agaaggtagggcgctacagaacaag

SEQ ID NO: 19082 - DNA, 25 bp, Homo sapien
agaaggtatgtggattagaaaggaa

SEQ ID NO: 19083 - DNA, 25 bp, Homo sapien
agaaggtattccgctgtttactgaa

SEQ ID NO: 19084 - DNA, 25 bp, Homo sapien
agaaggtattctgctgtttactgaa

SEQ ID NO: 19085 - DNA, 25 bp, Homo sapien
agaaggtgaccactcctcgggaata

SEQ ID NO: 19086 - DNA, 25 bp, Homo sapien
agaaggtgaccagtcctcgggaata

SEQ ID NO: 19087 - DNA, 25 bp, Homo sapien
agaaggttaaattataggtcaagaa

SEQ ID NO: 19088 - DNA, 25 bp, Homo sapien
agaaggttaaattgtaggtcaagaa

SEQ ID NO: 19089 - DNA, 25 bp, Homo sapien
agaaggttctctgcagaacaaggca

SEQ ID NO: 19090 - DNA, 25 bp, Homo sapien
agaaggttctctgtagaacaaggca

SEQ ID NO: 19091 - DNA, 25 bp, Homo sapien
agaagtaagaaaatgacagagttga

SEQ ID NO: 19092 - DNA, 25 bp, Homo sapien
agaagtaagaagatgacagagttga

SEQ ID NO: 19093 - DNA, 25 bp, Homo sapien
agaagtagtaaaaggaaatctgtgg

SEQ ID NO: 19094 - DNA, 25 bp, Homo sapien
agaagtagtaaaaggagatctgtgg

SEQ ID NO: 19095 - DNA, 25 bp, Homo sapien
agaagtataacttgaaagaggcagc

SEQ ID NO: 19096 - DNA, 25 bp, Homo sapien
agaagtatctgaattttattctgtg

SEQ ID NO: 19097 - DNA, 25 bp, Homo sapien
agaagtatggacactaaccaactct

SEQ ID NO: 19098 - DNA, 25 bp, Homo sapien
agaagtatggacactacccaactct

SEQ ID NO: 19099 - DNA, 25 bp, Homo sapien
agaagtattaatagcagaagagaca

SEQ ID NO: 19100 - DNA, 25 bp, Homo sapien
agaagtattaatggcagaagagaca

SEQ ID NO: 19101 - DNA, 25 bp, Homo sapien
agaagtattacttgaaagaggcagc

SEQ ID NO: 19102 - DNA, 25 bp, Homo sapien
agaagtatttgaattttattctgtg

SEQ ID NO: 19103 - DNA, 25 bp, Homo sapien
agaagtcaatgtgaaaaaggaggaa

SEQ ID NO: 19104 - DNA, 25 bp, Homo sapien
agaagtcactgtgaaaaaggaggaa

SEQ ID NO: 19105 - DNA, 25 bp, Homo sapien
agaagtctcccatcaaagaaaatcc

SEQ ID NO: 19106 - DNA, 25 bp, Homo sapien
agaagtctcccgtcaaagaaaatcc

SEQ ID NO: 19107 - DNA, 25 bp, Homo sapien
agaagtctctttcatcagttggagg

SEQ ID NO: 19108 - DNA, 25 bp, Homo sapien
agaagtctctttcgtcagttggagg

SEQ ID NO: 19109 - DNA, 25 bp, Homo sapien
agaagtcttagaagcgttgtttttt

SEQ ID NO: 19110 - DNA, 25 bp, Homo sapien
agaagtcttagaagggttgtttttt

SEQ ID NO: 19111 - DNA, 25 bp, Homo sapien
agaagtgaaaatgatatgtagaatc

SEQ ID NO: 19112 - DNA, 25 bp, Homo sapien
agaagtgaaaattatatgtagaatc

SEQ ID NO: 19113 - DNA, 25 bp, Homo sapien
agaagtgaacttagttcggagctac

SEQ ID NO: 19114 - DNA, 25 bp, Homo sapien
agaagtgaacttagtttggagctac

SEQ ID NO: 19115 - DNA, 25 bp, Homo sapien
agaagtgagaagttctgcctgtgga

SEQ ID NO: 19116 - DNA, 25 bp, Homo sapien
agaagtgagaagttttgcctgtgga

SEQ ID NO: 19117 - DNA, 25 bp, Homo sapien
agaagtgcaaggatcaaaggctcac

SEQ ID NO: 19118 - DNA, 25 bp, Homo sapien
agaagtgcaagggtcaaaggctcac

SEQ ID NO: 19119 - DNA, 25 bp, Homo sapien
agaagtgcatacgccgaagaggcat

SEQ ID NO: 19120 - DNA, 25 bp, Homo sapien
agaagtgcatacgctgaagaggcat

SEQ ID NO: 19121 - DNA, 25 bp, Homo sapien
agaagtggactttttaccttaatgt

SEQ ID NO: 19122 - DNA, 25 bp, Homo sapien
agaagtggactttttagcttaatgt

SEQ ID NO: 19123 - DNA, 25 bp, Homo sapien
agaagtggttgcacatggttctttt

SEQ ID NO: 19124 - DNA, 25 bp, Homo sapien
agaagtggttgtacatggttctttt

SEQ ID NO: 19125 - DNA, 25 bp, Homo sapien
agaagtgttcctcaatcttggtgct

SEQ ID NO: 19126 - DNA, 25 bp, Homo sapien
agaagtgttcctcagtcttggtgct

SEQ ID NO: 19127 - DNA, 25 bp, Homo sapien
agaagtttatatatctgtctccaaa

SEQ ID NO: 19128 - DNA, 25 bp, Homo sapien
agaagtttcaaaacagggccactcc

SEQ ID NO: 19129 - DNA, 25 bp, Homo sapien
agaagtttcaaaacggggccactcc

SEQ ID NO: 19130 - DNA, 25 bp, Homo sapien
agaagtttcagtttcaattcagttt

SEQ ID NO: 19131 - DNA, 25 bp, Homo sapien
agaagtttcagtttcagttcagttt

SEQ ID NO: 19132 - DNA, 25 bp, Homo sapien
agaagtttgatttttaaaatgctga

SEQ ID NO: 19133 - DNA, 25 bp, Homo sapien
agaagtttgcataagtctgtccatt

SEQ ID NO: 19134 - DNA, 25 bp, Homo sapien
agaagtttgcatgagtctgtccatt

SEQ ID NO: 19135 - DNA, 25 bp, Homo sapien
agaagtttgtatatctgtctccaaa

SEQ ID NO: 19136 - DNA, 25 bp, Homo sapien
agaagtttgttttttaaaatgctga

SEQ ID NO: 19137 - DNA, 25 bp, Homo sapien
agaataaaaatacggtcatagtcct

SEQ ID NO: 19138 - DNA, 25 bp, Homo sapien
agaataaaaatgcggtcatagtcct

SEQ ID NO: 19139 - DNA, 25 bp, Homo sapien
agaataaaagacccacaatccaatt

SEQ ID NO: 19140 - DNA, 25 bp, Homo sapien
agaataaaagacctacaatccaatt

SEQ ID NO: 19141 - DNA, 25 bp, Homo sapien
agaataagaatggtacgtagaacac

SEQ ID NO: 19142 - DNA, 25 bp, Homo sapien
agaataagacccaggaaaaatcgat

SEQ ID NO: 19143 - DNA, 25 bp, Homo sapien
agaataagacccgggaaaaatcgat

SEQ ID NO: 19144 - DNA, 25 bp, Homo sapien
agaataagagtggtacgtagaacac

SEQ ID NO: 19145 - DNA, 25 bp, Homo sapien
agaataaggcagcacaagcttgggt

SEQ ID NO: 19146 - DNA, 25 bp, Homo sapien
agaataaggcagcagaagcttgggt

SEQ ID NO: 19147 - DNA, 25 bp, Homo sapien
agaataagtccaattgctttttcat

SEQ ID NO: 19148 - DNA, 25 bp, Homo sapien
agaataagtccagttgctttttcat

SEQ ID NO: 19149 - DNA, 25 bp, Homo sapien
agaataatacactacaattgagcac

SEQ ID NO: 19150 - DNA, 25 bp, Homo sapien
agaataatacactacagttgagcac

SEQ ID NO: 19151 - DNA, 25 bp, Homo sapien
agaataccacataaaccagggggga

SEQ ID NO: 19152 - DNA, 25 bp, Homo sapien
agaataccacataaactagggggga

SEQ ID NO: 19153 - DNA, 25 bp, Homo sapien
agaatacctgggatatctgggatat

SEQ ID NO: 19154 - DNA, 25 bp, Homo sapien
agaatacctgggttatctgggatat

SEQ ID NO: 19155 - DNA, 25 bp, Homo sapien
agaataccttttgatagaagacacg

SEQ ID NO: 19156 - DNA, 25 bp, Homo sapien
agaatacctttttatagaagacacg

SEQ ID NO: 19157 - DNA, 25 bp, Homo sapien
agaatactctccatccatagccatt

SEQ ID NO: 19158 - DNA, 25 bp, Homo sapien
agaatactctctatccatagccatt

SEQ ID NO: 19159 - DNA, 25 bp, Homo sapien
agaatactttaaatacactctaggc

SEQ ID NO: 19160 - DNA, 25 bp, Homo sapien
agaatactttaaatactctctaggc

SEQ ID NO: 19161 - DNA, 25 bp, Homo sapien
agaatagacccattgcttcaaatcc

SEQ ID NO: 19162 - DNA, 25 bp, Homo sapien
agaatagacccgttgcttcaaatcc

SEQ ID NO: 19163 - DNA, 25 bp, Homo sapien
agaatagatgtattagcaggcatga

SEQ ID NO: 19164 - DNA, 25 bp, Homo sapien
agaatagatgtgttagcaggcatga

SEQ ID NO: 19165 - DNA, 25 bp, Homo sapien
agaatagcaataaaacctacttctt

SEQ ID NO: 19166 - DNA, 25 bp, Homo sapien
agaatagcaattaaacctacttctt

SEQ ID NO: 19167 - DNA, 25 bp, Homo sapien
agaatagcctcatggtctgcttgtc

SEQ ID NO: 19168 - DNA, 25 bp, Homo sapien
agaatagcctcatggtttgcttgtc

SEQ ID NO: 19169 - DNA, 25 bp, Homo sapien
agaatagctgcaaggagtactgaaa

SEQ ID NO: 19170 - DNA, 25 bp, Homo sapien
agaatagctgcaatgagtactgaaa

SEQ ID NO: 19171 - DNA, 25 bp, Homo sapien
agaataggcctgagtcttgctgtag

SEQ ID NO: 19172 - DNA, 25 bp, Homo sapien
agaataggtctgagtcttgctgtag

SEQ ID NO: 19173 - DNA, 25 bp, Homo sapien
agaatagtgagcgaaaataaatgtc

SEQ ID NO: 19174 - DNA, 25 bp, Homo sapien
agaatagtgcatacgttatggtaga

SEQ ID NO: 19175 - DNA, 25 bp, Homo sapien
agaatagtgcgcgaaaataaatgtc

SEQ ID NO: 19176 - DNA, 25 bp, Homo sapien
agaatagttcatacgttatggtaga

SEQ ID NO: 19177 - DNA, 25 bp, Homo sapien
agaatatactcacaggctccagggt

SEQ ID NO: 19178 - DNA, 25 bp, Homo sapien
agaatatactcacgggctccagggt

SEQ ID NO: 19179 - DNA, 25 bp, Homo sapien
agaatatacttggcgcatgctattc

SEQ ID NO: 19180 - DNA, 25 bp, Homo sapien
agaatatacttggtgcatgctattc

SEQ ID NO: 19181 - DNA, 25 bp, Homo sapien
agaatatcatcttgaagagtaccat

SEQ ID NO: 19182 - DNA, 25 bp, Homo sapien
agaatatccaaattgaagtcgagag

SEQ ID NO: 19183 - DNA, 25 bp, Homo sapien
agaatatccgaattgaagtcgagag

SEQ ID NO: 19184 - DNA, 25 bp, Homo sapien
agaatatcgctattattcaatgtgg

SEQ ID NO: 19185 - DNA, 25 bp, Homo sapien
agaatatcgctattgttcaatgtgg

SEQ ID NO: 19186 - DNA, 25 bp, Homo sapien
agaatatcgtcttgaagagtaccat

SEQ ID NO: 19187 - DNA, 25 bp, Homo sapien
agaatatgctccttatccaaggtcc

SEQ ID NO: 19188 - DNA, 25 bp, Homo sapien
agaatatgggtgctagacatttgac

SEQ ID NO: 19189 - DNA, 25 bp, Homo sapien
agaatatgggtgttagacatttgac

SEQ ID NO: 19190 - DNA, 25 bp, Homo sapien
agaatatgtgacggatcatcttctt

SEQ ID NO: 19191 - DNA, 25 bp, Homo sapien
agaatatgtgatggatcatcttctt

SEQ ID NO: 19192 - DNA, 25 bp, Homo sapien
agaatatgttccttatccaaggtcc

SEQ ID NO: 19193 - DNA, 25 bp, Homo sapien
agaatattttcaaataactccatgg

SEQ ID NO: 19194 - DNA, 25 bp, Homo sapien
agaatattttcaagtaactccatgg

SEQ ID NO: 19195 - DNA, 25 bp, Homo sapien
agaatatttttaagtcaaatggaca

SEQ ID NO: 19196 - DNA, 25 bp, Homo sapien
agaatatttttaggtcaaatggaca

SEQ ID NO: 19197 - DNA, 25 bp, Homo sapien
agaatcaaacgaatggttattttct

SEQ ID NO: 19198 - DNA, 25 bp, Homo sapien
agaatcaaatgaatggttattttct

SEQ ID NO: 19199 - DNA, 25 bp, Homo sapien
agaatcacctattcaaaaggcgaat

SEQ ID NO: 19200 - DNA, 25 bp, Homo sapien
agaatcacctattcgaaaggcgaat

SEQ ID NO: 19201 - DNA, 25 bp, Homo sapien
agaatccacagtttacaacgccttt

SEQ ID NO: 19202 - DNA, 25 bp, Homo sapien
agaatccagtatcggtggcccactg

SEQ ID NO: 19203 - DNA, 25 bp, Homo sapien
agaatccagtattggtggcccactg

SEQ ID NO: 19204 - DNA, 25 bp, Homo sapien
agaatccataagcgattaagtggta

SEQ ID NO: 19205 - DNA, 25 bp, Homo sapien
agaatccataagtgattaagtggta

SEQ ID NO: 19206 - DNA, 25 bp, Homo sapien
agaatccatagtttacaacgccttt

SEQ ID NO: 19207 - DNA, 25 bp, Homo sapien
agaatcctcacatggctgtaaaaac

SEQ ID NO: 19208 - DNA, 25 bp, Homo sapien
agaatcctcacctggctgtaaaaac

SEQ ID NO: 19209 - DNA, 25 bp, Homo sapien
agaatctatggttccgtgatgctga

SEQ ID NO: 19210 - DNA, 25 bp, Homo sapien
agaatctatggttctgtgatgctga

SEQ ID NO: 19211 - DNA, 25 bp, Homo sapien
agaatctcatttcttgactaagcaa

SEQ ID NO: 19212 - DNA, 25 bp, Homo sapien
agaatctcgtttcttgactaagcaa

SEQ ID NO: 19213 - DNA, 25 bp, Homo sapien
agaatctgaagcaacgacagcaaag

SEQ ID NO: 19214 - DNA, 25 bp, Homo sapien
agaatctgaagcaatgacagcaaag

SEQ ID NO: 19215 - DNA, 25 bp, Homo sapien
agaatctgaagctaggtatgcctga

SEQ ID NO: 19216 - DNA, 25 bp, Homo sapien
agaatctgacgctaggtatgcctga

SEQ ID NO: 19217 - DNA, 25 bp, Homo sapien
agaatctgctcctcgaagtagggac

SEQ ID NO: 19218 - DNA, 25 bp, Homo sapien
agaatctgctccttgaagtagggac

SEQ ID NO: 19219 - DNA, 25 bp, Homo sapien
agaatctgctgactgattcacacta

SEQ ID NO: 19220 - DNA, 25 bp, Homo sapien
agaatctggtgactgattcacacta

SEQ ID NO: 19221 - DNA, 25 bp, Homo sapien
agaatcttgagtccaataattaggt

SEQ ID NO: 19222 - DNA, 25 bp, Homo sapien
agaatcttgagtgcaataattaggt

SEQ ID NO: 19223 - DNA, 25 bp, Homo sapien
agaatgaaaacagagataagcatat

SEQ ID NO: 19224 - DNA, 25 bp, Homo sapien
agaatgaaaagtcaagtgctgaatg

SEQ ID NO: 19225 - DNA, 25 bp, Homo sapien
agaatgaaaagtcaggtgctgaatg

SEQ ID NO: 19226 - DNA, 25 bp, Homo sapien
agaatgaaagcagagataagcatat

SEQ ID NO: 19227 - DNA, 25 bp, Homo sapien
agaatgaacttacgccaataacttg

SEQ ID NO: 19228 - DNA, 25 bp, Homo sapien
agaatgaacttatgccaataacttg

SEQ ID NO: 19229 - DNA, 25 bp, Homo sapien
agaatgacaatcaccgtggtgggtt

SEQ ID NO: 19230 - DNA, 25 bp, Homo sapien
agaatgacaatcactgtggtgggtt

SEQ ID NO: 19231 - DNA, 25 bp, Homo sapien
agaatgacatggataaatctcaaaa

SEQ ID NO: 19232 - DNA, 25 bp, Homo sapien
agaatgacatggttaaatctcaaaa

SEQ ID NO: 19233 - DNA, 25 bp, Homo sapien
agaatgacttcctcgaagccagtgt

SEQ ID NO: 19234 - DNA, 25 bp, Homo sapien
agaatgacttccttgaagccagtgt

SEQ ID NO: 19235 - DNA, 25 bp, Homo sapien
agaatgagaagggaaggggtttggg

SEQ ID NO: 19236 - DNA, 25 bp, Homo sapien
agaatgagaggggaaggggtttggg

SEQ ID NO: 19237 - DNA, 25 bp, Homo sapien
agaatgagcagaaataggagacctg

SEQ ID NO: 19238 - DNA, 25 bp, Homo sapien
agaatgagcagaagtaggagacctg

SEQ ID NO: 19239 - DNA, 25 bp, Homo sapien
agaatgagccagggcctagaggaaa

SEQ ID NO: 19240 - DNA, 25 bp, Homo sapien
agaatgagcgagggcctagaggaaa

SEQ ID NO: 19241 - DNA, 25 bp, Homo sapien
agaatgattgaatcggctaaatatc

SEQ ID NO: 19242 - DNA, 25 bp, Homo sapien
agaatgattgaattggctaaatatc

SEQ ID NO: 19243 - DNA, 25 bp, Homo sapien
agaatgcaaaaaaatcaaaatggca

SEQ ID NO: 19244 - DNA, 25 bp, Homo sapien
agaatgcaaatgagccttttttcct

SEQ ID NO: 19245 - DNA, 25 bp, Homo sapien
agaatgcaaatgagtcttttttcct

SEQ ID NO: 19246 - DNA, 25 bp, Homo sapien
agaatgcacggtcccaaacaattcc

SEQ ID NO: 19247 - DNA, 25 bp, Homo sapien
agaatgcactaggacctgcaaaggt

SEQ ID NO: 19248 - DNA, 25 bp, Homo sapien
agaatgcagaaaaatcaaaatggca

SEQ ID NO: 19249 - DNA, 25 bp, Homo sapien
agaatgcagtaggacctgcaaaggt

SEQ ID NO: 19250 - DNA, 25 bp, Homo sapien
agaatgcagttttaagatgcagaat

SEQ ID NO: 19251 - DNA, 25 bp, Homo sapien
agaatgcagttttaggatgcagaat

SEQ ID NO: 19252 - DNA, 25 bp, Homo sapien
agaatgcatggtcccaaacaattcc

SEQ ID NO: 19253 - DNA, 25 bp, Homo sapien
agaatgccaattaaatgcacacctg

SEQ ID NO: 19254 - DNA, 25 bp, Homo sapien
agaatgccgattaaatgcacacctg

SEQ ID NO: 19255 - DNA, 25 bp, Homo sapien
agaatgccttcctttgtacttcagt

SEQ ID NO: 19256 - DNA, 25 bp, Homo sapien
agaatgccttcttttgtacttcagt

SEQ ID NO: 19257 - DNA, 25 bp, Homo sapien
agaatgctgtggtaagagaggaaga

SEQ ID NO: 19258 - DNA, 25 bp, Homo sapien
agaatgctgtggtacgagaggaaga

SEQ ID NO: 19259 - DNA, 25 bp, Homo sapien
agaatggagcatgaagctgcacagg

SEQ ID NO: 19260 - DNA, 25 bp, Homo sapien
agaatggagcatgaagttgcacagg

SEQ ID NO: 19261 - DNA, 25 bp, Homo sapien
agaatggagtgtcggcatgaaatat

SEQ ID NO: 19262 - DNA, 25 bp, Homo sapien
agaatggagtgttggcatgaaatat

SEQ ID NO: 19263 - DNA, 25 bp, Homo sapien
agaatggatgtcgagtttatcccat

SEQ ID NO: 19264 - DNA, 25 bp, Homo sapien
agaatggatgttgagtttatcccat

SEQ ID NO: 19265 - DNA, 25 bp, Homo sapien
agaatggcgtcctcagagagtagaa

SEQ ID NO: 19266 - DNA, 25 bp, Homo sapien
agaatggcgtcctcggagagtagaa

SEQ ID NO: 19267 - DNA, 25 bp, Homo sapien
agaatggctttgatagtttgataga

SEQ ID NO: 19268 - DNA, 25 bp, Homo sapien
agaatggctttgatggtttgataga

SEQ ID NO: 19269 - DNA, 25 bp, Homo sapien
agaatgggctaatacagtaaatgca

SEQ ID NO: 19270 - DNA, 25 bp, Homo sapien
agaatgggctaatatagtaaatgca

SEQ ID NO: 19271 - DNA, 25 bp, Homo sapien
agaatggtcctgcacaagttggatt

SEQ ID NO: 19272 - DNA, 25 bp, Homo sapien
agaatggtcctgtacaagttggatt

SEQ ID NO: 19273 - DNA, 25 bp, Homo sapien
agaatggtgtcatggcttgtatcag

SEQ ID NO: 19274 - DNA, 25 bp, Homo sapien
agaatggtttcatggcttgtatcag

SEQ ID NO: 19275 - DNA, 25 bp, Homo sapien
agaatgtataaattgatgtgttttt

SEQ ID NO: 19276 - DNA, 25 bp, Homo sapien
agaatgtataagttgatgtgttttt

SEQ ID NO: 19277 - DNA, 25 bp, Homo sapien
agaatgtcaaaaacggtatctgaca

SEQ ID NO: 19278 - DNA, 25 bp, Homo sapien
agaatgtcaaacacggtatctgaca

SEQ ID NO: 19279 - DNA, 25 bp, Homo sapien
agaatgttaaaagtcaaccgtttac

SEQ ID NO: 19280 - DNA, 25 bp, Homo sapien
agaatgttaaaagtcagccgtttac

SEQ ID NO: 19281 - DNA, 25 bp, Homo sapien
agaattaaactgatggtaagaaaat

SEQ ID NO: 19282 - DNA, 25 bp, Homo sapien
agaattaaagatatacattttcata

SEQ ID NO: 19283 - DNA, 25 bp, Homo sapien
agaattaaagatgtacattttcata

SEQ ID NO: 19284 - DNA, 25 bp, Homo sapien
agaattaaattgatggtaagaaaat

SEQ ID NO: 19285 - DNA, 25 bp, Homo sapien
agaattaaattgttgtgagaccacc

SEQ ID NO: 19286 - DNA, 25 bp, Homo sapien
agaattaaattgttttgagaccacc

SEQ ID NO: 19287 - DNA, 25 bp, Homo sapien
agaattacacaaacaaactgatctt

SEQ ID NO: 19288 - DNA, 25 bp, Homo sapien
agaattacactttaatgccctcaaa

SEQ ID NO: 19289 - DNA, 25 bp, Homo sapien
agaattacacttttatgccctcaaa

SEQ ID NO: 19290 - DNA, 25 bp, Homo sapien
agaattacgcaaacaaactgatctt

SEQ ID NO: 19291 - DNA, 25 bp, Homo sapien
agaattacggtgttgttagaagaga

SEQ ID NO: 19292 - DNA, 25 bp, Homo sapien
agaattacggttttgttagaagaga

SEQ ID NO: 19293 - DNA, 25 bp, Homo sapien
agaattactggactgtgcattcctc

SEQ ID NO: 19294 - DNA, 25 bp, Homo sapien
agaattactgggctgtgcattcctc

SEQ ID NO: 19295 - DNA, 25 bp, Homo sapien
agaattactgtcaccggtttacaga

SEQ ID NO: 19296 - DNA, 25 bp, Homo sapien
agaattactgtcaccgttttacaga

SEQ ID NO: 19297 - DNA, 25 bp, Homo sapien
agaattagcaggtggcagaccccag

SEQ ID NO: 19298 - DNA, 25 bp, Homo sapien
agaattagcagttggcagaccccag

SEQ ID NO: 19299 - DNA, 25 bp, Homo sapien
agaattagcgaaacagaaaagtatc

SEQ ID NO: 19300 - DNA, 25 bp, Homo sapien
agaattagctaaacagaaaagtatc

SEQ ID NO: 19301 - DNA, 25 bp, Homo sapien
agaattaggtaatgtggccatactg

SEQ ID NO: 19302 - DNA, 25 bp, Homo sapien
agaattagtccacacaggtagccaa

SEQ ID NO: 19303 - DNA, 25 bp, Homo sapien
agaattagtccagacaggtagccaa

SEQ ID NO: 19304 - DNA, 25 bp, Homo sapien
agaattagttaatgtggccatactg

SEQ ID NO: 19305 - DNA, 25 bp, Homo sapien
agaattatgcagattgatttagctt

SEQ ID NO: 19306 - DNA, 25 bp, Homo sapien
agaattattcagattgatttagctt

SEQ ID NO: 19307 - DNA, 25 bp, Homo sapien
agaattattgcaactatcttttaac

SEQ ID NO: 19308 - DNA, 25 bp, Homo sapien
agaattattgcaattatcttttaac

SEQ ID NO: 19309 - DNA, 25 bp, Homo sapien
agaattcaaaccattatctgcggtt

SEQ ID NO: 19310 - DNA, 25 bp, Homo sapien
agaattcacataggattcatgaatt

SEQ ID NO: 19311 - DNA, 25 bp, Homo sapien
agaattcacgccctgctaactgaag

SEQ ID NO: 19312 - DNA, 25 bp, Homo sapien
agaattcacgtaggattcatgaatt

SEQ ID NO: 19313 - DNA, 25 bp, Homo sapien
agaattcagaccattatctgcggtt

SEQ ID NO: 19314 - DNA, 25 bp, Homo sapien
agaattcagacccaaaatttttgct

SEQ ID NO: 19315 - DNA, 25 bp, Homo sapien
agaattcagacccagaatttttgct

SEQ ID NO: 19316 - DNA, 25 bp, Homo sapien
agaattcatgccctgctaactgaag

SEQ ID NO: 19317 - DNA, 25 bp, Homo sapien
agaattctgactcgctgatttatcg

SEQ ID NO: 19318 - DNA, 25 bp, Homo sapien
agaattctgacttgctgatttatcg

SEQ ID NO: 19319 - DNA, 25 bp, Homo sapien
agaattctggtacaagcctaattgg

SEQ ID NO: 19320 - DNA, 25 bp, Homo sapien
agaattctggtacaagtctaattgg

SEQ ID NO: 19321 - DNA, 25 bp, Homo sapien
agaattgaacaaccaaatatctgct

SEQ ID NO: 19322 - DNA, 25 bp, Homo sapien
agaattgaactaatggtggcttgta

SEQ ID NO: 19323 - DNA, 25 bp, Homo sapien
agaattgaactgatggtggcttgta

SEQ ID NO: 19324 - DNA, 25 bp, Homo sapien
agaattgaccaaccaaatatctgct

SEQ ID NO: 19325 - DNA, 25 bp, Homo sapien
agaattgccgtccacgctaagcctt

SEQ ID NO: 19326 - DNA, 25 bp, Homo sapien
agaattgccgtctacgctaagcctt

SEQ ID NO: 19327 - DNA, 25 bp, Homo sapien
agaattgcctggaaatgtgacggtc

SEQ ID NO: 19328 - DNA, 25 bp, Homo sapien
agaattgcctggaaatttgacggtc

SEQ ID NO: 19329 - DNA, 25 bp, Homo sapien
agaattgcctttggtgcctctttca

SEQ ID NO: 19330 - DNA, 25 bp, Homo sapien
agaattgctgtcattgaaccgccag

SEQ ID NO: 19331 - DNA, 25 bp, Homo sapien
agaattgctgtcattggaccgccag

SEQ ID NO: 19332 - DNA, 25 bp, Homo sapien
agaattgcttttggtgcctctttca

SEQ ID NO: 19333 - DNA, 25 bp, Homo sapien
agaattggaatcagaagaagaacgc

SEQ ID NO: 19334 - DNA, 25 bp, Homo sapien
agaattggagtcagaagaagaacgc

SEQ ID NO: 19335 - DNA, 25 bp, Homo sapien
agaattgttttcctatcttgggaga

SEQ ID NO: 19336 - DNA, 25 bp, Homo sapien
agaattgttttcctctcttgggaga

SEQ ID NO: 19337 - DNA, 25 bp, Homo sapien
agaatttcccacgtgtagcattcaa

SEQ ID NO: 19338 - DNA, 25 bp, Homo sapien
agaatttcccatgtgtagcattcaa

SEQ ID NO: 19339 - DNA, 25 bp, Homo sapien
agaatttccgtccttgttgtctcaa

SEQ ID NO: 19340 - DNA, 25 bp, Homo sapien
agaatttctcccacatgattaagct

SEQ ID NO: 19341 - DNA, 25 bp, Homo sapien
agaatttctcccacgtgattaagct

SEQ ID NO: 19342 - DNA, 25 bp, Homo sapien
agaatttctgtccttgttgtctcaa

SEQ ID NO: 19343 - DNA, 25 bp, Homo sapien
agaatttgcaggtctaacaagtttc

SEQ ID NO: 19344 - DNA, 25 bp, Homo sapien
agaatttgtaggtctaacaagtttc

SEQ ID NO: 19345 - DNA, 25 bp, Homo sapien
agaatttgttggctcatataatggt

SEQ ID NO: 19346 - DNA, 25 bp, Homo sapien
agaatttgttggttcatataatggt

SEQ ID NO: 19347 - DNA, 25 bp, Homo sapien
agaattttgaagacacacaggcatt

SEQ ID NO: 19348 - DNA, 25 bp, Homo sapien
agaattttgaagagacacaggcatt

SEQ ID NO: 19349 - DNA, 25 bp, Homo sapien
agaattttgacagtccatatgtggt

SEQ ID NO: 19350 - DNA, 25 bp, Homo sapien
agaattttgacagttcatatgtggt

SEQ ID NO: 19351 - DNA, 25 bp, Homo sapien
agaattttgcaagtgcttcaggccg

SEQ ID NO: 19352 - DNA, 25 bp, Homo sapien
agaattttgcataggcatctactac

SEQ ID NO: 19353 - DNA, 25 bp, Homo sapien
agaattttgcattggcatctactac

SEQ ID NO: 19354 - DNA, 25 bp, Homo sapien
agaattttggaagtgcttcaggccg

SEQ ID NO: 19355 - DNA, 25 bp, Homo sapien
agaatttttgacagattttaatgaa

SEQ ID NO: 19356 - DNA, 25 bp, Homo sapien
agaatttttgacggattttaatgaa

SEQ ID NO: 19357 - DNA, 25 bp, Homo sapien
agacaaaaaagaccacatgtgaaga

SEQ ID NO: 19358 - DNA, 25 bp, Homo sapien
agacaaaaaagatcacatgtgaaga

SEQ ID NO: 19359 - DNA, 25 bp, Homo sapien
agacaaaacaacagctggaaagctc

SEQ ID NO: 19360 - DNA, 25 bp, Homo sapien
agacaaaacgacagctggaaagctc

SEQ ID NO: 19361 - DNA, 25 bp, Homo sapien
agacaaactgatgcacaaaaccaat

SEQ ID NO: 19362 - DNA, 25 bp, Homo sapien
agacaaactgatggacaaaaccaat

SEQ ID NO: 19363 - DNA, 25 bp, Homo sapien
agacaaagacaccataaataggata

SEQ ID NO: 19364 - DNA, 25 bp, Homo sapien
agacaaagacactataaataggata

SEQ ID NO: 19365 - DNA, 25 bp, Homo sapien
agacaaaggagaaaggtccttgatt

SEQ ID NO: 19366 - DNA, 25 bp, Homo sapien
agacaaaggagataggtccttgatt

SEQ ID NO: 19367 - DNA, 25 bp, Homo sapien
agacaaatcacattaagagagctac

SEQ ID NO: 19368 - DNA, 25 bp, Homo sapien
agacaaatcacattaatagagctac

SEQ ID NO: 19369 - DNA, 25 bp, Homo sapien
agacaaattaaacctctgacttccc

SEQ ID NO: 19370 - DNA, 25 bp, Homo sapien
agacaaattaaatctctgacttccc

SEQ ID NO: 19371 - DNA, 25 bp, Homo sapien
agacaaatttaagtattagttggca

SEQ ID NO: 19372 - DNA, 25 bp, Homo sapien
agacaaatttacgtattagttggca

SEQ ID NO: 19373 - DNA, 25 bp, Homo sapien
agacaacaactggctacatggcctg

SEQ ID NO: 19374 - DNA, 25 bp, Homo sapien
agacaacaactgggtacatggcctg

SEQ ID NO: 19375 - DNA, 25 bp, Homo sapien
agacaacacacatagcaatttaaga

SEQ ID NO: 19376 - DNA, 25 bp, Homo sapien
agacaacacacgtagcaatttaaga

SEQ ID NO: 19377 - DNA, 25 bp, Homo sapien
agacaaccaatccactgaataagag

SEQ ID NO: 19378 - DNA, 25 bp, Homo sapien
agacaaccaatccgctgaataagag

SEQ ID NO: 19379 - DNA, 25 bp, Homo sapien
agacaaccttcctacagctaaccta

SEQ ID NO: 19380 - DNA, 25 bp, Homo sapien
agacaaccttcttacagctaaccta

SEQ ID NO: 19381 - DNA, 25 bp, Homo sapien
agacaactgcatcctaagtactaat

SEQ ID NO: 19382 - DNA, 25 bp, Homo sapien
agacaactggatcctaagtactaat

SEQ ID NO: 19383 - DNA, 25 bp, Homo sapien
agacaactgtacgctaacagaaaat

SEQ ID NO: 19384 - DNA, 25 bp, Homo sapien
agacaactgtatgctaacagaaaat

SEQ ID NO: 19385 - DNA, 25 bp, Homo sapien
agacaacttttccacggactgaggt

SEQ ID NO: 19386 - DNA, 25 bp, Homo sapien
agacaacttttccatggactgaggt

SEQ ID NO: 19387 - DNA, 25 bp, Homo sapien
agacaagagaagcctgtaaatccgt

SEQ ID NO: 19388 - DNA, 25 bp, Homo sapien
agacaagagaaggctgtaaatccgt

SEQ ID NO: 19389 - DNA, 25 bp, Homo sapien
agacaagagataaaaagataataaa

SEQ ID NO: 19390 - DNA, 25 bp, Homo sapien
agacaagagatagaaagataataaa

SEQ ID NO: 19391 - DNA, 25 bp, Homo sapien
agacaagggttagagactattgaga

SEQ ID NO: 19392 - DNA, 25 bp, Homo sapien
agacaaggtcaaaagttgattataa

SEQ ID NO: 19393 - DNA, 25 bp, Homo sapien
agacaaggtcaaatgttgattataa

SEQ ID NO: 19394 - DNA, 25 bp, Homo sapien
agacaaggtttagagactattgaga

SEQ ID NO: 19395 - DNA, 25 bp, Homo sapien
agacaagtaggactgaaatcaatgg

SEQ ID NO: 19396 - DNA, 25 bp, Homo sapien
agacaagtcgccaaaaattctaggt

SEQ ID NO: 19397 - DNA, 25 bp, Homo sapien
agacaagtcgcccaaaattctaggt

SEQ ID NO: 19398 - DNA, 25 bp, Homo sapien
agacaagtcggactgaaatcaatgg

SEQ ID NO: 19399 - DNA, 25 bp, Homo sapien
agacaagttacctaacatctctgct

SEQ ID NO: 19400 - DNA, 25 bp, Homo sapien
agacaagttacttaacatctctgct

SEQ ID NO: 19401 - DNA, 25 bp, Homo sapien
agacaataatacgacttgattagtt

SEQ ID NO: 19402 - DNA, 25 bp, Homo sapien
agacaataatacggcttgattagtt

SEQ ID NO: 19403 - DNA, 25 bp, Homo sapien
agacaataggagacttttttacata

SEQ ID NO: 19404 - DNA, 25 bp, Homo sapien
agacaataggatacttttttacata

SEQ ID NO: 19405 - DNA, 25 bp, Homo sapien
agacaatatcaggttaccgtcaaca

SEQ ID NO: 19406 - DNA, 25 bp, Homo sapien
agacaatatcaggttagcgtcaaca

SEQ ID NO: 19407 - DNA, 25 bp, Homo sapien
agacaatgtataaaccatttgggca

SEQ ID NO: 19408 - DNA, 25 bp, Homo sapien
agacaatgtatagaccatttgggca

SEQ ID NO: 19409 - DNA, 25 bp, Homo sapien
agacaattcagagtgaaatgttggg

SEQ ID NO: 19410 - DNA, 25 bp, Homo sapien
agacaattcagagttaaatgttggg

SEQ ID NO: 19411 - DNA, 25 bp, Homo sapien
agacaattgaccaactgtgcgtgga

SEQ ID NO: 19412 - DNA, 25 bp, Homo sapien
agacaattgaccgactgtgcgtgga

SEQ ID NO: 19413 - DNA, 25 bp, Homo sapien
agacaatttgcaaaagaagatattt

SEQ ID NO: 19414 - DNA, 25 bp, Homo sapien
agacaatttgcgaaagaagatattt

SEQ ID NO: 19415 - DNA, 25 bp, Homo sapien
agacacaaaagatcatctataaacc

SEQ ID NO: 19416 - DNA, 25 bp, Homo sapien
agacacaaaagatcgtctataaacc

SEQ ID NO: 19417 - DNA, 25 bp, Homo sapien
agacacaaccgagtagcggagccaa

SEQ ID NO: 19418 - DNA, 25 bp, Homo sapien
agacacaaccgagtagtggagccaa

SEQ ID NO: 19419 - DNA, 25 bp, Homo sapien
agacacaagggaataatatgtgctt

SEQ ID NO: 19420 - DNA, 25 bp, Homo sapien
agacacaagggagtaatatgtgctt

SEQ ID NO: 19421 - DNA, 25 bp, Homo sapien
agacacacaatgtacgctaaatgta

SEQ ID NO: 19422 - DNA, 25 bp, Homo sapien
agacacacaatgtatgctaaatgta

SEQ ID NO: 19423 - DNA, 25 bp, Homo sapien
agacacagtcagatccgttagcaaa

SEQ ID NO: 19424 - DNA, 25 bp, Homo sapien
agacacagtcaggtccgttagcaaa

SEQ ID NO: 19425 - DNA, 25 bp, Homo sapien
agacacatatctctgtctctttcag

SEQ ID NO: 19426 - DNA, 25 bp, Homo sapien
agacacatttctctgtctctttcag

SEQ ID NO: 19427 - DNA, 25 bp, Homo sapien
agacacccaaacagccagttgttag

SEQ ID NO: 19428 - DNA, 25 bp, Homo sapien
agacacccaaatagccagttgttag

SEQ ID NO: 19429 - DNA, 25 bp, Homo sapien
agacacggaggtatcagaaatacaa

SEQ ID NO: 19430 - DNA, 25 bp, Homo sapien
agacacggcggtatcagaaatacaa

SEQ ID NO: 19431 - DNA, 25 bp, Homo sapien
agacactaactggtacagatcagct

SEQ ID NO: 19432 - DNA, 25 bp, Homo sapien
agacactaagtggtacagatcagct

SEQ ID NO: 19433 - DNA, 25 bp, Homo sapien
agacactaatgcctttggatgcctt

SEQ ID NO: 19434 - DNA, 25 bp, Homo sapien
agacactaatgtctttggatgcctt

SEQ ID NO: 19435 - DNA, 25 bp, Homo sapien
agacactcaccgtaaagatcagtaa

SEQ ID NO: 19436 - DNA, 25 bp, Homo sapien
agacactcatcgtaaagatcagtaa

SEQ ID NO: 19437 - DNA, 25 bp, Homo sapien
agacactcttactaccatactcaaa

SEQ ID NO: 19438 - DNA, 25 bp, Homo sapien
agacactcttagtaccatactcaaa

SEQ ID NO: 19439 - DNA, 25 bp, Homo sapien
agacactgtgctcaatatttactgt

SEQ ID NO: 19440 - DNA, 25 bp, Homo sapien
agacactgtgctcagtatttactgt

SEQ ID NO: 19441 - DNA, 25 bp, Homo sapien
agacacttacattttacactgtgaa

SEQ ID NO: 19442 - DNA, 25 bp, Homo sapien
agacacttatattttacactgtgaa

SEQ ID NO: 19443 - DNA, 25 bp, Homo sapien
agacacttttcgtaaggaatgagac

SEQ ID NO: 19444 - DNA, 25 bp, Homo sapien
agacacttttcttaaggaatgagac

SEQ ID NO: 19445 - DNA, 25 bp, Homo sapien
agacagaaacaaagcaaaagtatct

SEQ ID NO: 19446 - DNA, 25 bp, Homo sapien
agacagaaacaaaggaaaagtatct

SEQ ID NO: 19447 - DNA, 25 bp, Homo sapien
agacagaaacagacaggaactttct

SEQ ID NO: 19448 - DNA, 25 bp, Homo sapien
agacagaaatagacaggaactttct

SEQ ID NO: 19449 - DNA, 25 bp, Homo sapien
agacagaacctggagaatgaaggtg

SEQ ID NO: 19450 - DNA, 25 bp, Homo sapien
agacagaacctggcgaatgaaggtg

SEQ ID NO: 19451 - DNA, 25 bp, Homo sapien
agacagaagatataagacgaagttc

SEQ ID NO: 19452 - DNA, 25 bp, Homo sapien
agacagaagatataagccgaagttc

SEQ ID NO: 19453 - DNA, 25 bp, Homo sapien
agacagaatgagccagggcctagag

SEQ ID NO: 19454 - DNA, 25 bp, Homo sapien
agacagaatgagcgagggcctagag

SEQ ID NO: 19455 - DNA, 25 bp, Homo sapien
agacagaattggaatttagtctcag

SEQ ID NO: 19456 - DNA, 25 bp, Homo sapien
agacagaattggagtttagtctcag

SEQ ID NO: 19457 - DNA, 25 bp, Homo sapien
agacagaattgtatcctctctgcaa

SEQ ID NO: 19458 - DNA, 25 bp, Homo sapien
agacagaattgtgtcctctctgcaa

SEQ ID NO: 19459 - DNA, 25 bp, Homo sapien
agacagacggaacaaaagcccacag

SEQ ID NO: 19460 - DNA, 25 bp, Homo sapien
agacagacggaacgaaagcccacag

SEQ ID NO: 19461 - DNA, 25 bp, Homo sapien
agacagactccatcttggctctttc

SEQ ID NO: 19462 - DNA, 25 bp, Homo sapien
agacagactccatgttggctctttc

SEQ ID NO: 19463 - DNA, 25 bp, Homo sapien
agacagagaaagagaaaatgtgaca

SEQ ID NO: 19464 - DNA, 25 bp, Homo sapien
agacagagaaagataaaatgtgaca

SEQ ID NO: 19465 - DNA, 25 bp, Homo sapien
agacagagagttaatccagggtaag

SEQ ID NO: 19466 - DNA, 25 bp, Homo sapien
agacagagatttaatccagggtaag

SEQ ID NO: 19467 - DNA, 25 bp, Homo sapien
agacagagcctttggaagacagaaa

SEQ ID NO: 19468 - DNA, 25 bp, Homo sapien
agacagaggccattgccatgttcag

SEQ ID NO: 19469 - DNA, 25 bp, Homo sapien
agacagaggccattgctatgttcag

SEQ ID NO: 19470 - DNA, 25 bp, Homo sapien
agacagaggcttcaaacgactggtt

SEQ ID NO: 19471 - DNA, 25 bp, Homo sapien
agacagaggcttcaaatgactggtt

SEQ ID NO: 19472 - DNA, 25 bp, Homo sapien
agacagaggctttggaagacagaaa

SEQ ID NO: 19473 - DNA, 25 bp, Homo sapien
agacagagggaggtttacaaatgca

SEQ ID NO: 19474 - DNA, 25 bp, Homo sapien
agacagagggatgtttacaaatgca

SEQ ID NO: 19475 - DNA, 25 bp, Homo sapien
agacagagggcttctcaagtataaa

SEQ ID NO: 19476 - DNA, 25 bp, Homo sapien
agacagagggcttgtcaagtataaa

SEQ ID NO: 19477 - DNA, 25 bp, Homo sapien
agacagatgctttagtttggaaatc

SEQ ID NO: 19478 - DNA, 25 bp, Homo sapien
agacagatgttttagtttggaaatc

SEQ ID NO: 19479 - DNA, 25 bp, Homo sapien
agacagcaaacatgatctattcccc

SEQ ID NO: 19480 - DNA, 25 bp, Homo sapien
agacagcaaacatgttctattcccc

SEQ ID NO: 19481 - DNA, 25 bp, Homo sapien
agacagcagccaacagtaatttttt

SEQ ID NO: 19482 - DNA, 25 bp, Homo sapien
agacagcagccaacggtaatttttt

SEQ ID NO: 19483 - DNA, 25 bp, Homo sapien
agacagcagggacatgcctctcagc

SEQ ID NO: 19484 - DNA, 25 bp, Homo sapien
agacagcagggacatggctctcagc

SEQ ID NO: 19485 - DNA, 25 bp, Homo sapien
agacagctcccaaaccaaatcctat

SEQ ID NO: 19486 - DNA, 25 bp, Homo sapien
agacagctcccaaatcaaatcctat

SEQ ID NO: 19487 - DNA, 25 bp, Homo sapien
agacagcttttctctacctcttccc

SEQ ID NO: 19488 - DNA, 25 bp, Homo sapien
agacagcttttctctagctcttccc

SEQ ID NO: 19489 - DNA, 25 bp, Homo sapien
agacaggaaacaatacagtccaacc

SEQ ID NO: 19490 - DNA, 25 bp, Homo sapien
agacaggagacaatacagtccaacc

SEQ ID NO: 19491 - DNA, 25 bp, Homo sapien
agacaggagatgactgacttctcag

SEQ ID NO: 19492 - DNA, 25 bp, Homo sapien
agacaggagatgattgacttctcag

SEQ ID NO: 19493 - DNA, 25 bp, Homo sapien
agacaggaggatcaggtagaataat

SEQ ID NO: 19494 - DNA, 25 bp, Homo sapien
agacaggaggatcgggtagaataat

SEQ ID NO: 19495 - DNA, 25 bp, Homo sapien
agacaggatgacaaagaaaagggcg

SEQ ID NO: 19496 - DNA, 25 bp, Homo sapien
agacaggatgacagagaaaagggcg

SEQ ID NO: 19497 - DNA, 25 bp, Homo sapien
agacagggaaaatactataacacaa

SEQ ID NO: 19498 - DNA, 25 bp, Homo sapien
agacagggaaaatactgtaacacaa

SEQ ID NO: 19499 - DNA, 25 bp, Homo sapien
agacagggagaggcaacaaatgcaa

SEQ ID NO: 19500 - DNA, 25 bp, Homo sapien
agacagggagatgcaacaaatgcaa

SEQ ID NO: 19501 - DNA, 25 bp, Homo sapien
agacaggttcacattgctttccact

SEQ ID NO: 19502 - DNA, 25 bp, Homo sapien
agacaggttcacattgttttccact

SEQ ID NO: 19503 - DNA, 25 bp, Homo sapien
agacagtgcaaccctgctggttgtt

SEQ ID NO: 19504 - DNA, 25 bp, Homo sapien
agacagtgccacgtaaagttctttg

SEQ ID NO: 19505 - DNA, 25 bp, Homo sapien
agacagtgccatgtaaagttctttg

SEQ ID NO: 19506 - DNA, 25 bp, Homo sapien
agacagtgcccatagacggccataa

SEQ ID NO: 19507 - DNA, 25 bp, Homo sapien
agacagtgcccatggacggccataa

SEQ ID NO: 19508 - DNA, 25 bp, Homo sapien
agacagtgcgaccctgctggttgtt

SEQ ID NO: 19509 - DNA, 25 bp, Homo sapien
agacagttaacaaatccactattag

SEQ ID NO: 19510 - DNA, 25 bp, Homo sapien
agacagttagtcatcaagatccatt

SEQ ID NO: 19511 - DNA, 25 bp, Homo sapien
agacagttattcatcaagatccatt

SEQ ID NO: 19512 - DNA, 25 bp, Homo sapien
agacagttctgcgtaggcggccagg

SEQ ID NO: 19513 - DNA, 25 bp, Homo sapien
agacagttctgtgtaggcggccagg

SEQ ID NO: 19514 - DNA, 25 bp, Homo sapien
agacagttgacaaatccactattag

SEQ ID NO: 19515 - DNA, 25 bp, Homo sapien
agacataaagaagaaggcatggggt

SEQ ID NO: 19516 - DNA, 25 bp, Homo sapien
agacataaagaagcaggcatggggt

SEQ ID NO: 19517 - DNA, 25 bp, Homo sapien
agacataacatgcttattttgtgga

SEQ ID NO: 19518 - DNA, 25 bp, Homo sapien
agacataatatgcttattttgtgga

SEQ ID NO: 19519 - DNA, 25 bp, Homo sapien
agacatacatacaaaaggttaatgt

SEQ ID NO: 19520 - DNA, 25 bp, Homo sapien
agacatacatacagaaggttaatgt

SEQ ID NO: 19521 - DNA, 25 bp, Homo sapien
agacatactgttcggatctgccaaa

SEQ ID NO: 19522 - DNA, 25 bp, Homo sapien
agacatactgtttggatctgccaaa

SEQ ID NO: 19523 - DNA, 25 bp, Homo sapien
agacatagctggcactgagaatgaa

SEQ ID NO: 19524 - DNA, 25 bp, Homo sapien
agacatagctggcattgagaatgaa

SEQ ID NO: 19525 - DNA, 25 bp, Homo sapien
agacatcaaccatttgagcacgttg

SEQ ID NO: 19526 - DNA, 25 bp, Homo sapien
agacatcaagcatttgagcacgttg

SEQ ID NO: 19527 - DNA, 25 bp, Homo sapien
agacatcaatttctgtggtttgtaa

SEQ ID NO: 19528 - DNA, 25 bp, Homo sapien
agacatcaatttctgttgtttgtaa

SEQ ID NO: 19529 - DNA, 25 bp, Homo sapien
agacatctcagtatgtatatgcaaa

SEQ ID NO: 19530 - DNA, 25 bp, Homo sapien
agacatctgagtatgtatatgcaaa

SEQ ID NO: 19531 - DNA, 25 bp, Homo sapien
agacatctgcatgattttccttaaa

SEQ ID NO: 19532 - DNA, 25 bp, Homo sapien
agacatctgcatgtttttccttaaa

SEQ ID NO: 19533 - DNA, 25 bp, Homo sapien
agacatgaatggactgtactccctg

SEQ ID NO: 19534 - DNA, 25 bp, Homo sapien
agacatgacagagatctggtgaatc

SEQ ID NO: 19535 - DNA, 25 bp, Homo sapien
agacatgacagttttacaatgccaa

SEQ ID NO: 19536 - DNA, 25 bp, Homo sapien
agacatgaccgtgacagttaaaaat

SEQ ID NO: 19537 - DNA, 25 bp, Homo sapien
agacatgacggttttacaatgccaa

SEQ ID NO: 19538 - DNA, 25 bp, Homo sapien
agacatgactgtgacagttaaaaat

SEQ ID NO: 19539 - DNA, 25 bp, Homo sapien
agacatgagtggactgtactccctg

SEQ ID NO: 19540 - DNA, 25 bp, Homo sapien
agacatgatagagatctggtgaatc

SEQ ID NO: 19541 - DNA, 25 bp, Homo sapien
agacattaaaccaagaaggaagtcc

SEQ ID NO: 19542 - DNA, 25 bp, Homo sapien
agacattaaaccgagaaggaagtcc

SEQ ID NO: 19543 - DNA, 25 bp, Homo sapien
agacattaccggactcactaacgca

SEQ ID NO: 19544 - DNA, 25 bp, Homo sapien
agacattactggactcactaacgca

SEQ ID NO: 19545 - DNA, 25 bp, Homo sapien
agacattatagatcacaggcatgtt

SEQ ID NO: 19546 - DNA, 25 bp, Homo sapien
agacattatagatgacaggcatgtt

SEQ ID NO: 19547 - DNA, 25 bp, Homo sapien
agacattctaaaaggcagtttattt

SEQ ID NO: 19548 - DNA, 25 bp, Homo sapien
agacattctaaagggcagtttattt

SEQ ID NO: 19549 - DNA, 25 bp, Homo sapien
agacattgggtctgcatattgaact

SEQ ID NO: 19550 - DNA, 25 bp, Homo sapien
agacattgggtttgcatattgaact

SEQ ID NO: 19551 - DNA, 25 bp, Homo sapien
agacattgtagcatcagagatatgt

SEQ ID NO: 19552 - DNA, 25 bp, Homo sapien
agacattgtagcgtcagagatatgt

SEQ ID NO: 19553 - DNA, 25 bp, Homo sapien
agacatttacgtagacgtttttgtg

SEQ ID NO: 19554 - DNA, 25 bp, Homo sapien
agacatttacgtagtcgtttttgtg

SEQ ID NO: 19555 - DNA, 25 bp, Homo sapien
agaccaacaaacaacaagagctgca

SEQ ID NO: 19556 - DNA, 25 bp, Homo sapien
agaccaacaaacagcaagagctgca

SEQ ID NO: 19557 - DNA, 25 bp, Homo sapien
agaccaacattccttgttaagtgaa

SEQ ID NO: 19558 - DNA, 25 bp, Homo sapien
agaccaacattctttgttaagtgaa

SEQ ID NO: 19559 - DNA, 25 bp, Homo sapien
agaccaagaatttaaaaatagatac

SEQ ID NO: 19560 - DNA, 25 bp, Homo sapien
agaccaaggatttaaaaatagatac

SEQ ID NO: 19561 - DNA, 25 bp, Homo sapien
agaccaagtgattccaattctttcc

SEQ ID NO: 19562 - DNA, 25 bp, Homo sapien
agaccaagtgattctaattctttcc

SEQ ID NO: 19563 - DNA, 25 bp, Homo sapien
agaccacctagaaaaacgggacact

SEQ ID NO: 19564 - DNA, 25 bp, Homo sapien
agaccacctagaaaaatgggacact

SEQ ID NO: 19565 - DNA, 25 bp, Homo sapien
agaccactatctacacggaagctgg

SEQ ID NO: 19566 - DNA, 25 bp, Homo sapien
agaccactctctacacggaagctgg

SEQ ID NO: 19567 - DNA, 25 bp, Homo sapien
agaccactgtgcatttcacaaattg

SEQ ID NO: 19568 - DNA, 25 bp, Homo sapien
agaccactgtgcttttcacaaattg

SEQ ID NO: 19569 - DNA, 25 bp, Homo sapien
agaccacttggctttccgatagcat

SEQ ID NO: 19570 - DNA, 25 bp, Homo sapien
agaccacttggctttctgatagcat

SEQ ID NO: 19571 - DNA, 25 bp, Homo sapien
agaccagaagagcaaaccagcctaa

SEQ ID NO: 19572 - DNA, 25 bp, Homo sapien
agaccagaagagtaaaccagcctaa

SEQ ID NO: 19573 - DNA, 25 bp, Homo sapien
agaccagacccgataaggatgctca

SEQ ID NO: 19574 - DNA, 25 bp, Homo sapien
agaccagacccgctaaggatgctca

SEQ ID NO: 19575 - DNA, 25 bp, Homo sapien
agaccagagaagatattgaagccat

SEQ ID NO: 19576 - DNA, 25 bp, Homo sapien
agaccagagaagatgttgaagccat

SEQ ID NO: 19577 - DNA, 25 bp, Homo sapien
agaccagatgtgagcacagagattc

SEQ ID NO: 19578 - DNA, 25 bp, Homo sapien
agaccagatgtgggcacagagattc

SEQ ID NO: 19579 - DNA, 25 bp, Homo sapien
agaccagcctggtcaacacgatgaa

SEQ ID NO: 19580 - DNA, 25 bp, Homo sapien
agaccagcctggtcaatacgatgaa

SEQ ID NO: 19581 - DNA, 25 bp, Homo sapien
agaccagtacaggagtgaacagatg

SEQ ID NO: 19582 - DNA, 25 bp, Homo sapien
agaccagtacagtagtgaacagatg

SEQ ID NO: 19583 - DNA, 25 bp, Homo sapien
agaccatcagagaactcagccagcc

SEQ ID NO: 19584 - DNA, 25 bp, Homo sapien
agaccatcagagaattcagccagcc

SEQ ID NO: 19585 - DNA, 25 bp, Homo sapien
agaccatctgagcacaagtgatggg

SEQ ID NO: 19586 - DNA, 25 bp, Homo sapien
agaccatctgagtacaagtgatggg

SEQ ID NO: 19587 - DNA, 25 bp, Homo sapien
agaccattgaaagatccctgtctca

SEQ ID NO: 19588 - DNA, 25 bp, Homo sapien
agaccatttaaagatccctgtctca

SEQ ID NO: 19589 - DNA, 25 bp, Homo sapien
agaccatttacttacaagtgcaaaa

SEQ ID NO: 19590 - DNA, 25 bp, Homo sapien
agaccatttgcttacaagtgcaaaa

SEQ ID NO: 19591 - DNA, 25 bp, Homo sapien
agacccaaaggccatagttataaaa

SEQ ID NO: 19592 - DNA, 25 bp, Homo sapien
agacccaaaggccgtagttataaaa

SEQ ID NO: 19593 - DNA, 25 bp, Homo sapien
agacccataagagccaataatgtag

SEQ ID NO: 19594 - DNA, 25 bp, Homo sapien
agacccataagagcgaataatgtag

SEQ ID NO: 19595 - DNA, 25 bp, Homo sapien
agaccccaggtcatcagctgcacta

SEQ ID NO: 19596 - DNA, 25 bp, Homo sapien
agaccccaggtgatcagctgcacta

SEQ ID NO: 19597 - DNA, 25 bp, Homo sapien
agaccccgccttgtcacacgcctta

SEQ ID NO: 19598 - DNA, 25 bp, Homo sapien
agaccccgccttgttacacgcctta

SEQ ID NO: 19599 - DNA, 25 bp, Homo sapien
agaccctaaagaaatgaagatttgt

SEQ ID NO: 19600 - DNA, 25 bp, Homo sapien
agaccctaaagaaatggagatttgt

SEQ ID NO: 19601 - DNA, 25 bp, Homo sapien
agaccctagaatcatgctggaccac

SEQ ID NO: 19602 - DNA, 25 bp, Homo sapien
agaccctagaatcgtgctggaccac

SEQ ID NO: 19603 - DNA, 25 bp, Homo sapien
agaccgaactggaacgggcttttgg

SEQ ID NO: 19604 - DNA, 25 bp, Homo sapien
agaccgaactggaatgggcttttgg

SEQ ID NO: 19605 - DNA, 25 bp, Homo sapien
agaccgagtggtgccgcggctctcc

SEQ ID NO: 19606 - DNA, 25 bp, Homo sapien
agaccgagtggtgctgcggctctcc

SEQ ID NO: 19607 - DNA, 25 bp, Homo sapien
agacctactgaggcacaaactctaa

SEQ ID NO: 19608 - DNA, 25 bp, Homo sapien
agacctactgaggcgcaaactctaa

SEQ ID NO: 19609 - DNA, 25 bp, Homo sapien
agacctagagagcacctggctatag

SEQ ID NO: 19610 - DNA, 25 bp, Homo sapien
agacctagagagtacctggctatag

SEQ ID NO: 19611 - DNA, 25 bp, Homo sapien
agacctagatagcccatggtaggca

SEQ ID NO: 19612 - DNA, 25 bp, Homo sapien
agacctagctagcccatggtaggca

SEQ ID NO: 19613 - DNA, 25 bp, Homo sapien
agacctagtcccgattcttgcttct

SEQ ID NO: 19614 - DNA, 25 bp, Homo sapien
agacctagtcctgattcttgcttct

SEQ ID NO: 19615 - DNA, 25 bp, Homo sapien
agacctatcgcaagccctcagttga

SEQ ID NO: 19616 - DNA, 25 bp, Homo sapien
agacctattgcaagccctcagttga

SEQ ID NO: 19617 - DNA, 25 bp, Homo sapien
agacctcatcacttttccccaacat

SEQ ID NO: 19618 - DNA, 25 bp, Homo sapien
agacctcatcagttttccccaacat

SEQ ID NO: 19619 - DNA, 25 bp, Homo sapien
agacctgacagcaactggaactctc

SEQ ID NO: 19620 - DNA, 25 bp, Homo sapien
agacctgatagcaactggaactctc

SEQ ID NO: 19621 - DNA, 25 bp, Homo sapien
agacctgcgttcatgggcaactgta

SEQ ID NO: 19622 - DNA, 25 bp, Homo sapien
agacctgcgttcgtgggcaactgta

SEQ ID NO: 19623 - DNA, 25 bp, Homo sapien
agaccttcacacttatacagcaatg

SEQ ID NO: 19624 - DNA, 25 bp, Homo sapien
agaccttcacatttatacagcaatg

SEQ ID NO: 19625 - DNA, 25 bp, Homo sapien
agaccttccatgtcctctctgggcg

SEQ ID NO: 19626 - DNA, 25 bp, Homo sapien
agaccttccatgtcgtctctgggcg

SEQ ID NO: 19627 - DNA, 25 bp, Homo sapien
agaccttgatttttgttaagagtga

SEQ ID NO: 19628 - DNA, 25 bp, Homo sapien
agaccttgcctgtcgtgttcacctg

SEQ ID NO: 19629 - DNA, 25 bp, Homo sapien
agaccttgcctgtcttgttcacctg

SEQ ID NO: 19630 - DNA, 25 bp, Homo sapien
agaccttggtttttgttaagagtga

SEQ ID NO: 19631 - DNA, 25 bp, Homo sapien
agacgatcattcagattgaggtagc

SEQ ID NO: 19632 - DNA, 25 bp, Homo sapien
agacgatcattcaggttgaggtagc

SEQ ID NO: 19633 - DNA, 25 bp, Homo sapien
agacgattggataagtgaaaacaat

SEQ ID NO: 19634 - DNA, 25 bp, Homo sapien
agacgattggataattgaaaacaat

SEQ ID NO: 19635 - DNA, 25 bp, Homo sapien
agacgcagaaaagacttgataaaat

SEQ ID NO: 19636 - DNA, 25 bp, Homo sapien
agacgcagaaaagtcttgataaaat

SEQ ID NO: 19637 - DNA, 25 bp, Homo sapien
agacgccaggcacagtgctaaacac

SEQ ID NO: 19638 - DNA, 25 bp, Homo sapien
agacgccaggcaccgtgctaaacac

SEQ ID NO: 19639 - DNA, 25 bp, Homo sapien
agacgccctgcgagacatagcctgt

SEQ ID NO: 19640 - DNA, 25 bp, Homo sapien
agacgccctgcgagacgtagcctgt

SEQ ID NO: 19641 - DNA, 25 bp, Homo sapien
agacggaacaaaagcccacagcttt

SEQ ID NO: 19642 - DNA, 25 bp, Homo sapien
agacggaacgaaagcccacagcttt

SEQ ID NO: 19643 - DNA, 25 bp, Homo sapien
agacggctacgtaacggaaacccag

SEQ ID NO: 19644 - DNA, 25 bp, Homo sapien
agacggctacgtgacggaaacccag

SEQ ID NO: 19645 - DNA, 25 bp, Homo sapien
agacgggaatgatgtgaccataagc

SEQ ID NO: 19646 - DNA, 25 bp, Homo sapien
agacgggaatgatgtggccataagc

SEQ ID NO: 19647 - DNA, 25 bp, Homo sapien
agacggggcaaggccactttttgaa

SEQ ID NO: 19648 - DNA, 25 bp, Homo sapien
agacggggctaggccactttttgaa

SEQ ID NO: 19649 - DNA, 25 bp, Homo sapien
agacgtgcatcagtagtaagaactg

SEQ ID NO: 19650 - DNA, 25 bp, Homo sapien
agacgtgcatcattagtaagaactg

SEQ ID NO: 19651 - DNA, 25 bp, Homo sapien
agactaagaagccataataactgaa

SEQ ID NO: 19652 - DNA, 25 bp, Homo sapien
agactaagaagccatagtaactgaa

SEQ ID NO: 19653 - DNA, 25 bp, Homo sapien
agactaagtggatagaaaagacatg

SEQ ID NO: 19654 - DNA, 25 bp, Homo sapien
agactaagtggttagaaaagacatg

SEQ ID NO: 19655 - DNA, 25 bp, Homo sapien
agactaatggataaaataaggcaga

SEQ ID NO: 19656 - DNA, 25 bp, Homo sapien
agactaatggatacaataaggcaga

SEQ ID NO: 19657 - DNA, 25 bp, Homo sapien
agactaattgagaggccctctgaat

SEQ ID NO: 19658 - DNA, 25 bp, Homo sapien
agactaattgagaggctctctgaat

SEQ ID NO: 19659 - DNA, 25 bp, Homo sapien
agactaattttgtccagacctagaa

SEQ ID NO: 19660 - DNA, 25 bp, Homo sapien
agactaattttttccagacctagaa

SEQ ID NO: 19661 - DNA, 25 bp, Homo sapien
agactacaaacaatccagcctctac

SEQ ID NO: 19662 - DNA, 25 bp, Homo sapien
agactacacacaatccagcctctac

SEQ ID NO: 19663 - DNA, 25 bp, Homo sapien
agactatcaccaacaacaataaatc

SEQ ID NO: 19664 - DNA, 25 bp, Homo sapien
agactatcaccaacaataataaatc

SEQ ID NO: 19665 - DNA, 25 bp, Homo sapien
agactatgaagccagcagcagggtg

SEQ ID NO: 19666 - DNA, 25 bp, Homo sapien
agactatgaggccagcagcagggtg

SEQ ID NO: 19667 - DNA, 25 bp, Homo sapien
agactatgatttacgaaattcacat

SEQ ID NO: 19668 - DNA, 25 bp, Homo sapien
agactatgatttatgaaattcacat

SEQ ID NO: 19669 - DNA, 25 bp, Homo sapien
agactatttttccatataaacgaat

SEQ ID NO: 19670 - DNA, 25 bp, Homo sapien
agactatttttctatataaacgaat

SEQ ID NO: 19671 - DNA, 25 bp, Homo sapien
agactcaaaggcctggggtatctca

SEQ ID NO: 19672 - DNA, 25 bp, Homo sapien
agactcaaaggcttggggtatctca

SEQ ID NO: 19673 - DNA, 25 bp, Homo sapien
agactcaaagttccggtggctctgg

SEQ ID NO: 19674 - DNA, 25 bp, Homo sapien
agactcaaagttctggtggctctgg

SEQ ID NO: 19675 - DNA, 25 bp, Homo sapien
agactcaagatacgtttgaccatag

SEQ ID NO: 19676 - DNA, 25 bp, Homo sapien
agactcaagatatgtttgaccatag

SEQ ID NO: 19677 - DNA, 25 bp, Homo sapien
agactcaatgaagattcagagggct

SEQ ID NO: 19678 - DNA, 25 bp, Homo sapien
agactcaatgaaggttcagagggct

SEQ ID NO: 19679 - DNA, 25 bp, Homo sapien
agactcaattatataaaagccatta

SEQ ID NO: 19680 - DNA, 25 bp, Homo sapien
agactcaattatttaaaagccatta

SEQ ID NO: 19681 - DNA, 25 bp, Homo sapien
agactcacacggcaaaaggaaaatg

SEQ ID NO: 19682 - DNA, 25 bp, Homo sapien
agactcacatggcaaaaggaaaatg

SEQ ID NO: 19683 - DNA, 25 bp, Homo sapien
agactcaccatacaaggagaagttc

SEQ ID NO: 19684 - DNA, 25 bp, Homo sapien
agactcaccatacgaggagaagttc

SEQ ID NO: 19685 - DNA, 25 bp, Homo sapien
agactcatcaggctggctggactct

SEQ ID NO: 19686 - DNA, 25 bp, Homo sapien
agactcatcaggctggttggactct

SEQ ID NO: 19687 - DNA, 25 bp, Homo sapien
agactcatgcctgtaaagtttctca

SEQ ID NO: 19688 - DNA, 25 bp, Homo sapien
agactcatgcctgttaagtttctca

SEQ ID NO: 19689 - DNA, 25 bp, Homo sapien
agactccaagcctaactctctgctt

SEQ ID NO: 19690 - DNA, 25 bp, Homo sapien
agactccaagcctgactctctgctt

SEQ ID NO: 19691 - DNA, 25 bp, Homo sapien
agactccatcttggctctttcactg

SEQ ID NO: 19692 - DNA, 25 bp, Homo sapien
agactccatgttggctctttcactg

SEQ ID NO: 19693 - DNA, 25 bp, Homo sapien
agactcctgagtaaatattatctgt

SEQ ID NO: 19694 - DNA, 25 bp, Homo sapien
agactcctgggtaaatattatctgt

SEQ ID NO: 19695 - DNA, 25 bp, Homo sapien
agactctacaaggacatggcatgga

SEQ ID NO: 19696 - DNA, 25 bp, Homo sapien
agactctacttcagtctagctcagc

SEQ ID NO: 19697 - DNA, 25 bp, Homo sapien
agactctataaggacatggcatgga

SEQ ID NO: 19698 - DNA, 25 bp, Homo sapien
agactctatgaaaaaaaaatatatt

SEQ ID NO: 19699 - DNA, 25 bp, Homo sapien
agactctatgagaaaaaaatatatt

SEQ ID NO: 19700 - DNA, 25 bp, Homo sapien
agactctatttcagtctagctcagc

SEQ ID NO: 19701 - DNA, 25 bp, Homo sapien
agactctcagaactagtttattcaa

SEQ ID NO: 19702 - DNA, 25 bp, Homo sapien
agactctcagaactggtttattcaa

SEQ ID NO: 19703 - DNA, 25 bp, Homo sapien
agactctctctacgtaattttaggc

SEQ ID NO: 19704 - DNA, 25 bp, Homo sapien
agactctcttctcttttatagatgt

SEQ ID NO: 19705 - DNA, 25 bp, Homo sapien
agactctcttctgttttatagatgt

SEQ ID NO: 19706 - DNA, 25 bp, Homo sapien
agactctctttaaaaaatgaaaatt

SEQ ID NO: 19707 - DNA, 25 bp, Homo sapien
agactctctttacgtaattttaggc

SEQ ID NO: 19708 - DNA, 25 bp, Homo sapien
agactctctttgaaaaatgaaaatt

SEQ ID NO: 19709 - DNA, 25 bp, Homo sapien
agactctgcctcattgaggatattt

SEQ ID NO: 19710 - DNA, 25 bp, Homo sapien
agactctgcctcgttgaggatattt

SEQ ID NO: 19711 - DNA, 25 bp, Homo sapien
agactcttagtgcatgatatttccg

SEQ ID NO: 19712 - DNA, 25 bp, Homo sapien
agactcttccttgggtgacagtgtc

SEQ ID NO: 19713 - DNA, 25 bp, Homo sapien
agactcttcgtgcatgatatttccg

SEQ ID NO: 19714 - DNA, 25 bp, Homo sapien
agactcttggattcaggcttaggac

SEQ ID NO: 19715 - DNA, 25 bp, Homo sapien
agactcttggatttaggcttaggac

SEQ ID NO: 19716 - DNA, 25 bp, Homo sapien
agactctttcttgggtgacagtgtc

SEQ ID NO: 19717 - DNA, 25 bp, Homo sapien
agactgaaaataatcatcatctcca

SEQ ID NO: 19718 - DNA, 25 bp, Homo sapien
agactgaaaatagtcatcatctcca

SEQ ID NO: 19719 - DNA, 25 bp, Homo sapien
agactgaaataacgcaactacaaac

SEQ ID NO: 19720 - DNA, 25 bp, Homo sapien
agactgaaataacgcatctacaaac

SEQ ID NO: 19721 - DNA, 25 bp, Homo sapien
agactgaagcgcacatttgatctaa

SEQ ID NO: 19722 - DNA, 25 bp, Homo sapien
agactgaagcgcacgtttgatctaa

SEQ ID NO: 19723 - DNA, 25 bp, Homo sapien
agactgagatcaacgctttatttat

SEQ ID NO: 19724 - DNA, 25 bp, Homo sapien
agactgagatcaatgctttatttat

SEQ ID NO: 19725 - DNA, 25 bp, Homo sapien
agactgagcatagggttcccagttc

SEQ ID NO: 19726 - DNA, 25 bp, Homo sapien
agactgagcatgtggaaataaggag

SEQ ID NO: 19727 - DNA, 25 bp, Homo sapien
agactgagcgtagggttcccagttc

SEQ ID NO: 19728 - DNA, 25 bp, Homo sapien
agactgagcgtgtggaaataaggag

SEQ ID NO: 19729 - DNA, 25 bp, Homo sapien
agactgaggccacaaagttaactgt

SEQ ID NO: 19730 - DNA, 25 bp, Homo sapien
agactgaggccagaaagttaactgt

SEQ ID NO: 19731 - DNA, 25 bp, Homo sapien
agactgagtaaaagtattgctgaat

SEQ ID NO: 19732 - DNA, 25 bp, Homo sapien
agactgagtgaaagtattgctgaat

SEQ ID NO: 19733 - DNA, 25 bp, Homo sapien
agactgataaatgagaaaacatgtc

SEQ ID NO: 19734 - DNA, 25 bp, Homo sapien
agactgataaatgggaaaacatgtc

SEQ ID NO: 19735 - DNA, 25 bp, Homo sapien
agactgcattatatcaatttttcta

SEQ ID NO: 19736 - DNA, 25 bp, Homo sapien
agactgcattatatcagtttttcta

SEQ ID NO: 19737 - DNA, 25 bp, Homo sapien
agactggaagtaccataaaaataaa

SEQ ID NO: 19738 - DNA, 25 bp, Homo sapien
agactggaagtacgataaaaataaa

SEQ ID NO: 19739 - DNA, 25 bp, Homo sapien
agactggacatctactgggaatcca

SEQ ID NO: 19740 - DNA, 25 bp, Homo sapien
agactggacatctattgggaatcca

SEQ ID NO: 19741 - DNA, 25 bp, Homo sapien
agactggagattacagcgcattctt

SEQ ID NO: 19742 - DNA, 25 bp, Homo sapien
agactggagattacagtgcattctt

SEQ ID NO: 19743 - DNA, 25 bp, Homo sapien
agactggcaacactgagcttttgtc

SEQ ID NO: 19744 - DNA, 25 bp, Homo sapien
agactggcaacattgagcttttgtc

SEQ ID NO: 19745 - DNA, 25 bp, Homo sapien
agactggcaccaaagttccaccagc

SEQ ID NO: 19746 - DNA, 25 bp, Homo sapien
agactggcaccagagttccaccagc

SEQ ID NO: 19747 - DNA, 25 bp, Homo sapien
agactggctaaatggattttttaaa

SEQ ID NO: 19748 - DNA, 25 bp, Homo sapien
agactggctcccactatgtaaaggc

SEQ ID NO: 19749 - DNA, 25 bp, Homo sapien
agactggctcccgctatgtaaaggc

SEQ ID NO: 19750 - DNA, 25 bp, Homo sapien
agactggctgaatggattttttaaa

SEQ ID NO: 19751 - DNA, 25 bp, Homo sapien
agactgggagctctttggaaacaga

SEQ ID NO: 19752 - DNA, 25 bp, Homo sapien
agactgggagctttttggaaacaga

SEQ ID NO: 19753 - DNA, 25 bp, Homo sapien
agactgggatacaaaaaacaatgaa

SEQ ID NO: 19754 - DNA, 25 bp, Homo sapien
agactgggatacagaaaacaatgaa

SEQ ID NO: 19755 - DNA, 25 bp, Homo sapien
agactgtattgacatgaataaattc

SEQ ID NO: 19756 - DNA, 25 bp, Homo sapien
agactgtattgtcatgaataaattc

SEQ ID NO: 19757 - DNA, 25 bp, Homo sapien
agactgtgacgaactgggcaaatta

SEQ ID NO: 19758 - DNA, 25 bp, Homo sapien
agactgtgatgaactgggcaaatta

SEQ ID NO: 19759 - DNA, 25 bp, Homo sapien
agactgtgtacattgaacttctgag

SEQ ID NO: 19760 - DNA, 25 bp, Homo sapien
agactgtgtacgttgaacttctgag

SEQ ID NO: 19761 - DNA, 25 bp, Homo sapien
agactgtgttgaaagtaatgaaaag

SEQ ID NO: 19762 - DNA, 25 bp, Homo sapien
agactgtgttgaacgtaatgaaaag

SEQ ID NO: 19763 - DNA, 25 bp, Homo sapien
agacttacgcctgggatacctttta

SEQ ID NO: 19764 - DNA, 25 bp, Homo sapien
agacttacgccttggatacctttta

SEQ ID NO: 19765 - DNA, 25 bp, Homo sapien
agacttaggcattcgttcttatcag

SEQ ID NO: 19766 - DNA, 25 bp, Homo sapien
agacttaggcatttgttcttatcag

SEQ ID NO: 19767 - DNA, 25 bp, Homo sapien
agacttcagtgccgattttctgact

SEQ ID NO: 19768 - DNA, 25 bp, Homo sapien
agacttcagtgctgattttctgact

SEQ ID NO: 19769 - DNA, 25 bp, Homo sapien
agacttccaaaacatcccctgtgag

SEQ ID NO: 19770 - DNA, 25 bp, Homo sapien
agacttccaaaagatcccctgtgag

SEQ ID NO: 19771 - DNA, 25 bp, Homo sapien
agacttcctgtcgatgggccaaacg

SEQ ID NO: 19772 - DNA, 25 bp, Homo sapien
agacttcctgttgatgggccaaacg

SEQ ID NO: 19773 - DNA, 25 bp, Homo sapien
agacttctaaaattcactgtgatgt

SEQ ID NO: 19774 - DNA, 25 bp, Homo sapien
agacttctaaaatttactgtgatgt

SEQ ID NO: 19775 - DNA, 25 bp, Homo sapien
agacttgaaatcagcactattagga

SEQ ID NO: 19776 - DNA, 25 bp, Homo sapien
agacttgaaattagcactattagga

SEQ ID NO: 19777 - DNA, 25 bp, Homo sapien
agacttgcccacaaatagtcacagc

SEQ ID NO: 19778 - DNA, 25 bp, Homo sapien
agacttgcccaccaatagtcacagc

SEQ ID NO: 19779 - DNA, 25 bp, Homo sapien
agactttatttttccgcattgtttt

SEQ ID NO: 19780 - DNA, 25 bp, Homo sapien
agactttatttttccgtattgtttt

SEQ ID NO: 19781 - DNA, 25 bp, Homo sapien
agactttctggaagaaataaaagtg

SEQ ID NO: 19782 - DNA, 25 bp, Homo sapien
agactttctgggagaaataaaagtg

SEQ ID NO: 19783 - DNA, 25 bp, Homo sapien
agactttcttttgcttcgggcaata

SEQ ID NO: 19784 - DNA, 25 bp, Homo sapien
agactttcttttgctttgggcaata

SEQ ID NO: 19785 - DNA, 25 bp, Homo sapien
agactttgaacaagataagttgaga

SEQ ID NO: 19786 - DNA, 25 bp, Homo sapien
agactttgaacaagatgagttgaga

SEQ ID NO: 19787 - DNA, 25 bp, Homo sapien
agactttgatttcctaatatgggat

SEQ ID NO: 19788 - DNA, 25 bp, Homo sapien
agactttgatttgctaatatgggat

SEQ ID NO: 19789 - DNA, 25 bp, Homo sapien
agagaaaaaccttcgatttatgtcc

SEQ ID NO: 19790 - DNA, 25 bp, Homo sapien
agagaaaaaccttggatttatgtcc

SEQ ID NO: 19791 - DNA, 25 bp, Homo sapien
agagaaaaagcgattggttagtttg

SEQ ID NO: 19792 - DNA, 25 bp, Homo sapien
agagaaaaatcattactatcttcac

SEQ ID NO: 19793 - DNA, 25 bp, Homo sapien
agagaaaaatccttactatcttcac

SEQ ID NO: 19794 - DNA, 25 bp, Homo sapien
agagaaaaggcgattggttagtttg

SEQ ID NO: 19795 - DNA, 25 bp, Homo sapien
agagaaaaggctagaaaacctcttc

SEQ ID NO: 19796 - DNA, 25 bp, Homo sapien
agagaaaaggctggaaaacctcttc

SEQ ID NO: 19797 - DNA, 25 bp, Homo sapien
agagaaaagtgaataatgactgact

SEQ ID NO: 19798 - DNA, 25 bp, Homo sapien
agagaaaagtgactaatgactgact

SEQ ID NO: 19799 - DNA, 25 bp, Homo sapien
agagaaaataaaggaagttggtaag

SEQ ID NO: 19800 - DNA, 25 bp, Homo sapien
agagaaaataaaggaatttggtaag

SEQ ID NO: 19801 - DNA, 25 bp, Homo sapien
agagaaaattatgccggggaatgcc

SEQ ID NO: 19802 - DNA, 25 bp, Homo sapien
agagaaaattatgctggggaatgcc

SEQ ID NO: 19803 - DNA, 25 bp, Homo sapien
agagaaacaatcctaaactgctgaa

SEQ ID NO: 19804 - DNA, 25 bp, Homo sapien
agagaaacaatcttaaactgctgaa

SEQ ID NO: 19805 - DNA, 25 bp, Homo sapien
agagaaaccacaaattactggagca

SEQ ID NO: 19806 - DNA, 25 bp, Homo sapien
agagaaaccacaacttactggagca

SEQ ID NO: 19807 - DNA, 25 bp, Homo sapien
agagaaactataaaagcagtgtggc

SEQ ID NO: 19808 - DNA, 25 bp, Homo sapien
agagaaactctaaaagcagtgtggc

SEQ ID NO: 19809 - DNA, 25 bp, Homo sapien
agagaaagcataggacaaggcccat

SEQ ID NO: 19810 - DNA, 25 bp, Homo sapien
agagaaagcgtaggacaaggcccat

SEQ ID NO: 19811 - DNA, 25 bp, Homo sapien
agagaaataaactagtccatgcccc

SEQ ID NO: 19812 - DNA, 25 bp, Homo sapien
agagaaatacactagtccatgcccc

SEQ ID NO: 19813 - DNA, 25 bp, Homo sapien
agagaacaatccatctcatggagac

SEQ ID NO: 19814 - DNA, 25 bp, Homo sapien
agagaacaatccatttcatggagac

SEQ ID NO: 19815 - DNA, 25 bp, Homo sapien
agagaacaccaaagattctgccaaa

SEQ ID NO: 19816 - DNA, 25 bp, Homo sapien
agagaacactaaagattctgccaaa

SEQ ID NO: 19817 - DNA, 25 bp, Homo sapien
agagaacattgacattaaagagaaa

SEQ ID NO: 19818 - DNA, 25 bp, Homo sapien
agagaacattgatattaaagagaaa

SEQ ID NO: 19819 - DNA, 25 bp, Homo sapien
agagaaccgtgtaggagactcctgc

SEQ ID NO: 19820 - DNA, 25 bp, Homo sapien
agagaaccgtgtgggagactcctgc

SEQ ID NO: 19821 - DNA, 25 bp, Homo sapien
agagaacgctaaacatgggatcaaa

SEQ ID NO: 19822 - DNA, 25 bp, Homo sapien
agagaacgctaagcatgggatcaaa

SEQ ID NO: 19823 - DNA, 25 bp, Homo sapien
agagaactccggacactctacaata

SEQ ID NO: 19824 - DNA, 25 bp, Homo sapien
agagaactctggacactctacaata

SEQ ID NO: 19825 - DNA, 25 bp, Homo sapien
agagaacttaacggttttccagacc

SEQ ID NO: 19826 - DNA, 25 bp, Homo sapien
agagaacttaatggttttccagacc

SEQ ID NO: 19827 - DNA, 25 bp, Homo sapien
agagaagaaatgtgggttcctggta

SEQ ID NO: 19828 - DNA, 25 bp, Homo sapien
agagaagaaatttgggttcctggta

SEQ ID NO: 19829 - DNA, 25 bp, Homo sapien
agagaagaacaagaaagtgaatttg

SEQ ID NO: 19830 - DNA, 25 bp, Homo sapien
agagaagaacaggaaagtgaatttg

SEQ ID NO: 19831 - DNA, 25 bp, Homo sapien
agagaagacacactctttggatagt

SEQ ID NO: 19832 - DNA, 25 bp, Homo sapien
agagaagacacgctctttggatagt

SEQ ID NO: 19833 - DNA, 25 bp, Homo sapien
agagaagacagatctaattcccaaa

SEQ ID NO: 19834 - DNA, 25 bp, Homo sapien
agagaagacgcacctcagggaacag

SEQ ID NO: 19835 - DNA, 25 bp, Homo sapien
agagaagacggatctaattcccaaa

SEQ ID NO: 19836 - DNA, 25 bp, Homo sapien
agagaagagcatcaagagacgggta

SEQ ID NO: 19837 - DNA, 25 bp, Homo sapien
agagaagagggtcggtttctcatat

SEQ ID NO: 19838 - DNA, 25 bp, Homo sapien
agagaagagggttggtttctcatat

SEQ ID NO: 19839 - DNA, 25 bp, Homo sapien
agagaagatattgaagccatggagg

SEQ ID NO: 19840 - DNA, 25 bp, Homo sapien
agagaagatcatcaagagacgggta

SEQ ID NO: 19841 - DNA, 25 bp, Homo sapien
agagaagatgcacctcagggaacag

SEQ ID NO: 19842 - DNA, 25 bp, Homo sapien
agagaagatgttgaagccatggagg

SEQ ID NO: 19843 - DNA, 25 bp, Homo sapien
agagaagattcctcaggtgaaaaat

SEQ ID NO: 19844 - DNA, 25 bp, Homo sapien
agagaagattcctcgggtgaaaaat

SEQ ID NO: 19845 - DNA, 25 bp, Homo sapien
agagaagcagaagataaaaagccat

SEQ ID NO: 19846 - DNA, 25 bp, Homo sapien
agagaagcgagtcttttttgaatgg

SEQ ID NO: 19847 - DNA, 25 bp, Homo sapien
agagaagcggaagataaaaagccat

SEQ ID NO: 19848 - DNA, 25 bp, Homo sapien
agagaagctagtcttttttgaatgg

SEQ ID NO: 19849 - DNA, 25 bp, Homo sapien
agagaaggacaacaagtagtgtgaa

SEQ ID NO: 19850 - DNA, 25 bp, Homo sapien
agagaaggacaagaagtagtgtgaa

SEQ ID NO: 19851 - DNA, 25 bp, Homo sapien
agagaagggaaccatcctgaattac

SEQ ID NO: 19852 - DNA, 25 bp, Homo sapien
agagaagggaaccgtcctgaattac

SEQ ID NO: 19853 - DNA, 25 bp, Homo sapien
agagaagtatgcaagaattcagaac

SEQ ID NO: 19854 - DNA, 25 bp, Homo sapien
agagaagtgaaccgatgttctgttt

SEQ ID NO: 19855 - DNA, 25 bp, Homo sapien
agagaagtgaactgatgttctgttt

SEQ ID NO: 19856 - DNA, 25 bp, Homo sapien
agagaagtgcatacgccgaagaggc

SEQ ID NO: 19857 - DNA, 25 bp, Homo sapien
agagaagtgcatacgctgaagaggc

SEQ ID NO: 19858 - DNA, 25 bp, Homo sapien
agagaagtttgcaagaattcagaac

SEQ ID NO: 19859 - DNA, 25 bp, Homo sapien
agagaataagacccaggaaaaatcg

SEQ ID NO: 19860 - DNA, 25 bp, Homo sapien
agagaataagacccgggaaaaatcg

SEQ ID NO: 19861 - DNA, 25 bp, Homo sapien
agagaatagaatagtggttatcaga

SEQ ID NO: 19862 - DNA, 25 bp, Homo sapien
agagaatagaatggtggttatcaga

SEQ ID NO: 19863 - DNA, 25 bp, Homo sapien
agagaatatggaacaacttactttg

SEQ ID NO: 19864 - DNA, 25 bp, Homo sapien
agagaatatggagcaacttactttg

SEQ ID NO: 19865 - DNA, 25 bp, Homo sapien
agagaatatgggtgctagacatttg

SEQ ID NO: 19866 - DNA, 25 bp, Homo sapien
agagaatatgggtgttagacatttg

SEQ ID NO: 19867 - DNA, 25 bp, Homo sapien
agagaatcaatgtattccttttgat

SEQ ID NO: 19868 - DNA, 25 bp, Homo sapien
agagaatcagtgtattccttttgat

SEQ ID NO: 19869 - DNA, 25 bp, Homo sapien
agagaatcctgctaagcaataccca

SEQ ID NO: 19870 - DNA, 25 bp, Homo sapien
agagaatcctgttaagcaataccca

SEQ ID NO: 19871 - DNA, 25 bp, Homo sapien
agagaatgaaaattaaaatatagct

SEQ ID NO: 19872 - DNA, 25 bp, Homo sapien
agagaatgctcaaatagattttcta

SEQ ID NO: 19873 - DNA, 25 bp, Homo sapien
agagaatgctcgaatagattttcta

SEQ ID NO: 19874 - DNA, 25 bp, Homo sapien
agagaatgctgtggtaagagaggaa

SEQ ID NO: 19875 - DNA, 25 bp, Homo sapien
agagaatgctgtggtacgagaggaa

SEQ ID NO: 19876 - DNA, 25 bp, Homo sapien
agagaatggaaattaaaatatagct

SEQ ID NO: 19877 - DNA, 25 bp, Homo sapien
agagaattagagtaagcgtacatct

SEQ ID NO: 19878 - DNA, 25 bp, Homo sapien
agagaattagagtaagtgtacatct

SEQ ID NO: 19879 - DNA, 25 bp, Homo sapien
agagaattcactatgatcttctatt

SEQ ID NO: 19880 - DNA, 25 bp, Homo sapien
agagaattcactgtgatcttctatt

SEQ ID NO: 19881 - DNA, 25 bp, Homo sapien
agagaattggaatcagaagaagaac

SEQ ID NO: 19882 - DNA, 25 bp, Homo sapien
agagaattggagtcagaagaagaac

SEQ ID NO: 19883 - DNA, 25 bp, Homo sapien
agagaattgggcatgagtttagagt

SEQ ID NO: 19884 - DNA, 25 bp, Homo sapien
agagaattgggcgtgagtttagagt

SEQ ID NO: 19885 - DNA, 25 bp, Homo sapien
agagaattttctcgggtgatagaaa

SEQ ID NO: 19886 - DNA, 25 bp, Homo sapien
agagaattttcttgggtgatagaaa

SEQ ID NO: 19887 - DNA, 25 bp, Homo sapien
agagacaaaacaacagctggaaagc

SEQ ID NO: 19888 - DNA, 25 bp, Homo sapien
agagacaaaacgacagctggaaagc

SEQ ID NO: 19889 - DNA, 25 bp, Homo sapien
agagacaacaaggcctatagtaaaa

SEQ ID NO: 19890 - DNA, 25 bp, Homo sapien
agagacaaccaccaatagtgagggt

SEQ ID NO: 19891 - DNA, 25 bp, Homo sapien
agagacaactaggcctatagtaaaa

SEQ ID NO: 19892 - DNA, 25 bp, Homo sapien
agagacaactgcatcctaagtacta

SEQ ID NO: 19893 - DNA, 25 bp, Homo sapien
agagacaactggatcctaagtacta

SEQ ID NO: 19894 - DNA, 25 bp, Homo sapien
agagacaatcaccaatagtgagggt

SEQ ID NO: 19895 - DNA, 25 bp, Homo sapien
agagacagctcccaaaccaaatcct

SEQ ID NO: 19896 - DNA, 25 bp, Homo sapien
agagacagctcccaaatcaaatcct

SEQ ID NO: 19897 - DNA, 25 bp, Homo sapien
agagacagtcttttaggttgtttga

SEQ ID NO: 19898 - DNA, 25 bp, Homo sapien
agagacagtcttttagtttgtttga

SEQ ID NO: 19899 - DNA, 25 bp, Homo sapien
agagacagttcccagctacattgta

SEQ ID NO: 19900 - DNA, 25 bp, Homo sapien
agagacagttcctagctacattgta

SEQ ID NO: 19901 - DNA, 25 bp, Homo sapien
agagaccaaaactcactgaacactt

SEQ ID NO: 19902 - DNA, 25 bp, Homo sapien
agagaccaacactcactgaacactt

SEQ ID NO: 19903 - DNA, 25 bp, Homo sapien
agagaccacaggtcataagaaaaag

SEQ ID NO: 19904 - DNA, 25 bp, Homo sapien
agagaccacaggttataagaaaaag

SEQ ID NO: 19905 - DNA, 25 bp, Homo sapien
agagaccctgtgagcaacaggcctt

SEQ ID NO: 19906 - DNA, 25 bp, Homo sapien
agagaccctgtgggcaacaggcctt

SEQ ID NO: 19907 - DNA, 25 bp, Homo sapien
agagaccttgcctgtcgtgttcacc

SEQ ID NO: 19908 - DNA, 25 bp, Homo sapien
agagaccttgcctgtcttgttcacc

SEQ ID NO: 19909 - DNA, 25 bp, Homo sapien
agagacgaaaattctaagaaagaac

SEQ ID NO: 19910 - DNA, 25 bp, Homo sapien
agagacgaacattctaagaaagaac

SEQ ID NO: 19911 - DNA, 25 bp, Homo sapien
agagacgcattggtaattgtgtaca

SEQ ID NO: 19912 - DNA, 25 bp, Homo sapien
agagacgcgttggtaattgtgtaca

SEQ ID NO: 19913 - DNA, 25 bp, Homo sapien
agagacgtcaacatggaaggtacag

SEQ ID NO: 19914 - DNA, 25 bp, Homo sapien
agagacgtcaatatggaaggtacag

SEQ ID NO: 19915 - DNA, 25 bp, Homo sapien
agagacgtccgcaaacaggttttca

SEQ ID NO: 19916 - DNA, 25 bp, Homo sapien
agagacgtctgcaaacaggttttca

SEQ ID NO: 19917 - DNA, 25 bp, Homo sapien
agagactgattcagtacgaacactg

SEQ ID NO: 19918 - DNA, 25 bp, Homo sapien
agagactgattcagtatgaacactg

SEQ ID NO: 19919 - DNA, 25 bp, Homo sapien
agagactgtgaaagaacagctagag

SEQ ID NO: 19920 - DNA, 25 bp, Homo sapien
agagactgtgaaggaacagctagag

SEQ ID NO: 19921 - DNA, 25 bp, Homo sapien
agagacttaaaaagagcaacagtag

SEQ ID NO: 19922 - DNA, 25 bp, Homo sapien
agagacttaaatagagcaacagtag

SEQ ID NO: 19923 - DNA, 25 bp, Homo sapien
agagacttcaacccaggattttcac

SEQ ID NO: 19924 - DNA, 25 bp, Homo sapien
agagacttcaactcaggattttcac

SEQ ID NO: 19925 - DNA, 25 bp, Homo sapien
agagagaaaaatcattactatcttc

SEQ ID NO: 19926 - DNA, 25 bp, Homo sapien
agagagaaaaatccttactatcttc

SEQ ID NO: 19927 - DNA, 25 bp, Homo sapien
agagagaaaaattatgtttcaaaaa

SEQ ID NO: 19928 - DNA, 25 bp, Homo sapien
agagagaaaaggctagaaaacctct

SEQ ID NO: 19929 - DNA, 25 bp, Homo sapien
agagagaaaaggctggaaaacctct

SEQ ID NO: 19930 - DNA, 25 bp, Homo sapien
agagagaaaagtgaataatgactga

SEQ ID NO: 19931 - DNA, 25 bp, Homo sapien
agagagaaaagtgactaatgactga

SEQ ID NO: 19932 - DNA, 25 bp, Homo sapien
agagagaaagcaatgtgacaacctc

SEQ ID NO: 19933 - DNA, 25 bp, Homo sapien
agagagaaagcagtgtgacaacctc

SEQ ID NO: 19934 - DNA, 25 bp, Homo sapien
agagagaaataaactagtccatgcc

SEQ ID NO: 19935 - DNA, 25 bp, Homo sapien
agagagaaatacactagtccatgcc

SEQ ID NO: 19936 - DNA, 25 bp, Homo sapien
agagagaaatattatgtttcaaaaa

SEQ ID NO: 19937 - DNA, 25 bp, Homo sapien
agagagaactccagcaaggtggatt

SEQ ID NO: 19938 - DNA, 25 bp, Homo sapien
agagagaactccggacactctacaa

SEQ ID NO: 19939 - DNA, 25 bp, Homo sapien
agagagaactctagcaaggtggatt

SEQ ID NO: 19940 - DNA, 25 bp, Homo sapien
agagagaactctggacactctacaa

SEQ ID NO: 19941 - DNA, 25 bp, Homo sapien
agagagaagaacaagaaagtgaatt

SEQ ID NO: 19942 - DNA, 25 bp, Homo sapien
agagagaagaacaggaaagtgaatt

SEQ ID NO: 19943 - DNA, 25 bp, Homo sapien
agagagaagtcaatgcttagctttg

SEQ ID NO: 19944 - DNA, 25 bp, Homo sapien
agagagaagtcgatgcttagctttg

SEQ ID NO: 19945 - DNA, 25 bp, Homo sapien
agagagaataacagttttcattctt

SEQ ID NO: 19946 - DNA, 25 bp, Homo sapien
agagagaataacatttttcattctt

SEQ ID NO: 19947 - DNA, 25 bp, Homo sapien
agagagaatggtgtcatggcttgta

SEQ ID NO: 19948 - DNA, 25 bp, Homo sapien
agagagaatggtttcatggcttgta

SEQ ID NO: 19949 - DNA, 25 bp, Homo sapien
agagagacacattgagctagagatg

SEQ ID NO: 19950 - DNA, 25 bp, Homo sapien
agagagacatattgagctagagatg

SEQ ID NO: 19951 - DNA, 25 bp, Homo sapien
agagagaccatacaacttttggcag

SEQ ID NO: 19952 - DNA, 25 bp, Homo sapien
agagagaccatctgagcacaagtga

SEQ ID NO: 19953 - DNA, 25 bp, Homo sapien
agagagaccatctgagtacaagtga

SEQ ID NO: 19954 - DNA, 25 bp, Homo sapien
agagagactatacaacttttggcag

SEQ ID NO: 19955 - DNA, 25 bp, Homo sapien
agagagagaactccagcaaggtgga

SEQ ID NO: 19956 - DNA, 25 bp, Homo sapien
agagagagaactctagcaaggtgga

SEQ ID NO: 19957 - DNA, 25 bp, Homo sapien
agagagagatattcacatttaatta

SEQ ID NO: 19958 - DNA, 25 bp, Homo sapien
agagagagatattgacatttaatta

SEQ ID NO: 19959 - DNA, 25 bp, Homo sapien
agagagagatcaagataaaacgaaa

SEQ ID NO: 19960 - DNA, 25 bp, Homo sapien
agagagagatcaaggtaaaacgaaa

SEQ ID NO: 19961 - DNA, 25 bp, Homo sapien
agagagagcacggactgtgaacggc

SEQ ID NO: 19962 - DNA, 25 bp, Homo sapien
agagagagtacggactgtgaacggc

SEQ ID NO: 19963 - DNA, 25 bp, Homo sapien
agagagagtattaaagagtcttgtc

SEQ ID NO: 19964 - DNA, 25 bp, Homo sapien
agagagagtattaaagggtcttgtc

SEQ ID NO: 19965 - DNA, 25 bp, Homo sapien
agagagatcaagataaaacgaaaaa

SEQ ID NO: 19966 - DNA, 25 bp, Homo sapien
agagagatcaaggtaaaacgaaaaa

SEQ ID NO: 19967 - DNA, 25 bp, Homo sapien
agagagatcagcattcctacttcac

SEQ ID NO: 19968 - DNA, 25 bp, Homo sapien
agagagatcagcattcttacttcac

SEQ ID NO: 19969 - DNA, 25 bp, Homo sapien
agagagcaatttgacaagagggtaa

SEQ ID NO: 19970 - DNA, 25 bp, Homo sapien
agagagcaatttgacaggagggtaa

SEQ ID NO: 19971 - DNA, 25 bp, Homo sapien
agagagccagaaggctagcatggtt

SEQ ID NO: 19972 - DNA, 25 bp, Homo sapien
agagagccagagggctagcatggtt

SEQ ID NO: 19973 - DNA, 25 bp, Homo sapien
agagagccttattctgtggcagggc

SEQ ID NO: 19974 - DNA, 25 bp, Homo sapien
agagagccttattttgtggcagggc

SEQ ID NO: 19975 - DNA, 25 bp, Homo sapien
agagagcttatctactgaatgacct

SEQ ID NO: 19976 - DNA, 25 bp, Homo sapien
agagagcttatctattgaatgacct

SEQ ID NO: 19977 - DNA, 25 bp, Homo sapien
agagaggaaaatacgtttggagagt

SEQ ID NO: 19978 - DNA, 25 bp, Homo sapien
agagaggaaaataggcagcatcatt

SEQ ID NO: 19979 - DNA, 25 bp, Homo sapien
agagaggaaaataggtttggagagt

SEQ ID NO: 19980 - DNA, 25 bp, Homo sapien
agagaggaaaatgggcagcatcatt

SEQ ID NO: 19981 - DNA, 25 bp, Homo sapien
agagaggacatcgctactattatta

SEQ ID NO: 19982 - DNA, 25 bp, Homo sapien
agagaggacattgctactattatta

SEQ ID NO: 19983 - DNA, 25 bp, Homo sapien
agagaggagcagacggcttcttgtt

SEQ ID NO: 19984 - DNA, 25 bp, Homo sapien
agagaggagcagatggcttcttgtt

SEQ ID NO: 19985 - DNA, 25 bp, Homo sapien
agagaggagctcagggcttggcagc

SEQ ID NO: 19986 - DNA, 25 bp, Homo sapien
agagaggagctcatggcttggcagc

SEQ ID NO: 19987 - DNA, 25 bp, Homo sapien
agagaggaggcacattgtactcact

SEQ ID NO: 19988 - DNA, 25 bp, Homo sapien
agagaggaggcatattgtactcact

SEQ ID NO: 19989 - DNA, 25 bp, Homo sapien
agagaggcacttgcaggatctcagc

SEQ ID NO: 19990 - DNA, 25 bp, Homo sapien
agagaggcactttcaggatctcagc

SEQ ID NO: 19991 - DNA, 25 bp, Homo sapien
agagaggcccagtcaggtgaaggca

SEQ ID NO: 19992 - DNA, 25 bp, Homo sapien
agagaggcccagtcagttgaaggca

SEQ ID NO: 19993 - DNA, 25 bp, Homo sapien
agagaggcctacgaaaaggttccaa

SEQ ID NO: 19994 - DNA, 25 bp, Homo sapien
agagaggcctatgaaaaggttccaa

SEQ ID NO: 19995 - DNA, 25 bp, Homo sapien
agagaggctcacatcaagtggaagt

SEQ ID NO: 19996 - DNA, 25 bp, Homo sapien
agagaggctcacgtcaagtggaagt

SEQ ID NO: 19997 - DNA, 25 bp, Homo sapien
agagaggtaaacgattcttctcatt

SEQ ID NO: 19998 - DNA, 25 bp, Homo sapien
agagaggtaaatgattcttctcatt

SEQ ID NO: 19999 - DNA, 25 bp, Homo sapien
agagaggtccggcatgtgaggaaga

SEQ ID NO: 20000 - DNA, 25 bp, Homo sapien
agagaggtctggcatgtgaggaaga

SEQ ID NO: 20001 - DNA, 25 bp, Homo sapien
agagaggttcgtctgagaaaactca

SEQ ID NO: 20002 - DNA, 25 bp, Homo sapien
agagaggtttgtctgagaaaactca

SEQ ID NO: 20003 - DNA, 25 bp, Homo sapien
agagagtattaaagagtcttgtcaa

SEQ ID NO: 20004 - DNA, 25 bp, Homo sapien
agagagtattaaagggtcttgtcaa

SEQ ID NO: 20005 - DNA, 25 bp, Homo sapien
agagagtgaagatacattacctaca

SEQ ID NO: 20006 - DNA, 25 bp, Homo sapien
agagagtgaagatagattacctaca

SEQ ID NO: 20007 - DNA, 25 bp, Homo sapien
agagagtgactacgtcaggcagcaa

SEQ ID NO: 20008 - DNA, 25 bp, Homo sapien
agagagtgactatgtcaggcagcaa

SEQ ID NO: 20009 - DNA, 25 bp, Homo sapien
agagagtgactgatcctgacaaggg

SEQ ID NO: 20010 - DNA, 25 bp, Homo sapien
agagagtggctgatcctgacaaggg

SEQ ID NO: 20011 - DNA, 25 bp, Homo sapien
agagagttacaatggtgaaaaaagg

SEQ ID NO: 20012 - DNA, 25 bp, Homo sapien
agagagttataatggtgaaaaaagg

SEQ ID NO: 20013 - DNA, 25 bp, Homo sapien
agagagttttaaaactgacatgcaa

SEQ ID NO: 20014 - DNA, 25 bp, Homo sapien
agagagttttaaaattgacatgcaa

SEQ ID NO: 20015 - DNA, 25 bp, Homo sapien
agagataaacaattaaattcagcag

SEQ ID NO: 20016 - DNA, 25 bp, Homo sapien
agagataaacaccaaataaatgcaa

SEQ ID NO: 20017 - DNA, 25 bp, Homo sapien
agagataaacagcaaataaatgcaa

SEQ ID NO: 20018 - DNA, 25 bp, Homo sapien
agagataacagcagagaagatattt

SEQ ID NO: 20019 - DNA, 25 bp, Homo sapien
agagataacagcagaggagatattt

SEQ ID NO: 20020 - DNA, 25 bp, Homo sapien
agagataagcaattaaattcagcag

SEQ ID NO: 20021 - DNA, 25 bp, Homo sapien
agagatagcagtaccttgcatcaac

SEQ ID NO: 20022 - DNA, 25 bp, Homo sapien
agagatagcggatatggcaaaaatg

SEQ ID NO: 20023 - DNA, 25 bp, Homo sapien
agagatagggctatagtaaggagta

SEQ ID NO: 20024 - DNA, 25 bp, Homo sapien
agagatagggctgtagtaaggagta

SEQ ID NO: 20025 - DNA, 25 bp, Homo sapien
agagatagtagtaccttgcatcaac

SEQ ID NO: 20026 - DNA, 25 bp, Homo sapien
agagatagtggatatggcaaaaatg

SEQ ID NO: 20027 - DNA, 25 bp, Homo sapien
agagatattcacatttaattactga

SEQ ID NO: 20028 - DNA, 25 bp, Homo sapien
agagatattgacatttaattactga

SEQ ID NO: 20029 - DNA, 25 bp, Homo sapien
agagatcaaccttgaagtgacatac

SEQ ID NO: 20030 - DNA, 25 bp, Homo sapien
agagatcaacctttaagtgacatac

SEQ ID NO: 20031 - DNA, 25 bp, Homo sapien
agagatcagcattcctacttcacca

SEQ ID NO: 20032 - DNA, 25 bp, Homo sapien
agagatcagcattcttacttcacca

SEQ ID NO: 20033 - DNA, 25 bp, Homo sapien
agagatcctcgtcattgaaggaagc

SEQ ID NO: 20034 - DNA, 25 bp, Homo sapien
agagatccttgtcattgaaggaagc

SEQ ID NO: 20035 - DNA, 25 bp, Homo sapien
agagatcgacatgcaggatatttat

SEQ ID NO: 20036 - DNA, 25 bp, Homo sapien
agagatcggcatgcaggatatttat

SEQ ID NO: 20037 - DNA, 25 bp, Homo sapien
agagatctcggttgtgaaggttgag

SEQ ID NO: 20038 - DNA, 25 bp, Homo sapien
agagatctgggttgtgaaggttgag

SEQ ID NO: 20039 - DNA, 25 bp, Homo sapien
agagatcttgtatatttggacaatg

SEQ ID NO: 20040 - DNA, 25 bp, Homo sapien
agagatcttgtgtatttggacaatg

SEQ ID NO: 20041 - DNA, 25 bp, Homo sapien
agagatgacaaagatcaatcacttt

SEQ ID NO: 20042 - DNA, 25 bp, Homo sapien
agagatgacaaaggtcaatcacttt

SEQ ID NO: 20043 - DNA, 25 bp, Homo sapien
agagatgagaaataaatattaaaca

SEQ ID NO: 20044 - DNA, 25 bp, Homo sapien
agagatgagattagcaaacaaaagt

SEQ ID NO: 20045 - DNA, 25 bp, Homo sapien
agagatgagattaggaaacaaaagt

SEQ ID NO: 20046 - DNA, 25 bp, Homo sapien
agagatgagtaataaatattaaaca

SEQ ID NO: 20047 - DNA, 25 bp, Homo sapien
agagatgatttgaacagccatgcca

SEQ ID NO: 20048 - DNA, 25 bp, Homo sapien
agagatgatttgagcagccatgcca

SEQ ID NO: 20049 - DNA, 25 bp, Homo sapien
agagatgcaatatatacctgtaatc

SEQ ID NO: 20050 - DNA, 25 bp, Homo sapien
agagatgcaatatatatctgtaatc

SEQ ID NO: 20051 - DNA, 25 bp, Homo sapien
agagatgtcacatgttgcattgaga

SEQ ID NO: 20052 - DNA, 25 bp, Homo sapien
agagatgttacatgttgcattgaga

SEQ ID NO: 20053 - DNA, 25 bp, Homo sapien
agagattaaattgcttgtccaagtt

SEQ ID NO: 20054 - DNA, 25 bp, Homo sapien
agagattaacacgtcaaaataacat

SEQ ID NO: 20055 - DNA, 25 bp, Homo sapien
agagattaacacgtcagaataacat

SEQ ID NO: 20056 - DNA, 25 bp, Homo sapien
agagattaagttgcttgtccaagtt

SEQ ID NO: 20057 - DNA, 25 bp, Homo sapien
agagattagatcaccaatattagaa

SEQ ID NO: 20058 - DNA, 25 bp, Homo sapien
agagattagttcaccaatattagaa

SEQ ID NO: 20059 - DNA, 25 bp, Homo sapien
agagattccgacagtttcttgccac

SEQ ID NO: 20060 - DNA, 25 bp, Homo sapien
agagattcctttacttattccatat

SEQ ID NO: 20061 - DNA, 25 bp, Homo sapien
agagattcctttatttattccatat

SEQ ID NO: 20062 - DNA, 25 bp, Homo sapien
agagattctatcaattgccaagtgc

SEQ ID NO: 20063 - DNA, 25 bp, Homo sapien
agagattctatcagttgccaagtgc

SEQ ID NO: 20064 - DNA, 25 bp, Homo sapien
agagattctgacagtttcttgccac

SEQ ID NO: 20065 - DNA, 25 bp, Homo sapien
agagattgacagtctaagcattcgt

SEQ ID NO: 20066 - DNA, 25 bp, Homo sapien
agagattggcagtctaagcattcgt

SEQ ID NO: 20067 - DNA, 25 bp, Homo sapien
agagatttcacatccagaggttaat

SEQ ID NO: 20068 - DNA, 25 bp, Homo sapien
agagatttcacatccataggttaat

SEQ ID NO: 20069 - DNA, 25 bp, Homo sapien
agagatttcttttgacagcttacag

SEQ ID NO: 20070 - DNA, 25 bp, Homo sapien
agagatttcttttgtcagcttacag

SEQ ID NO: 20071 - DNA, 25 bp, Homo sapien
agagattttcggttttatccattga

SEQ ID NO: 20072 - DNA, 25 bp, Homo sapien
agagattttgaaggagcaagactgg

SEQ ID NO: 20073 - DNA, 25 bp, Homo sapien
agagattttgagggagcaagactgg

SEQ ID NO: 20074 - DNA, 25 bp, Homo sapien
agagatttttggttttatccattga

SEQ ID NO: 20075 - DNA, 25 bp, Homo sapien
agagcaaacagatgcaggatgatcc

SEQ ID NO: 20076 - DNA, 25 bp, Homo sapien
agagcaaacagattcaggatgatcc

SEQ ID NO: 20077 - DNA, 25 bp, Homo sapien
agagcaaacgttcaatattctatac

SEQ ID NO: 20078 - DNA, 25 bp, Homo sapien
agagcaaatgttcaatattctatac

SEQ ID NO: 20079 - DNA, 25 bp, Homo sapien
agagcaacacacgattcttgcggct

SEQ ID NO: 20080 - DNA, 25 bp, Homo sapien
agagcaacacaggattcttgcggct

SEQ ID NO: 20081 - DNA, 25 bp, Homo sapien
agagcaaccaggaagctgtgagctt

SEQ ID NO: 20082 - DNA, 25 bp, Homo sapien
agagcaaccagggagctgtgagctt

SEQ ID NO: 20083 - DNA, 25 bp, Homo sapien
agagcaagataccttttagtctatt

SEQ ID NO: 20084 - DNA, 25 bp, Homo sapien
agagcaagatatcttttagtctatt

SEQ ID NO: 20085 - DNA, 25 bp, Homo sapien
agagcaagcagaagagacttaaact

SEQ ID NO: 20086 - DNA, 25 bp, Homo sapien
agagcaagcggaagagacttaaact

SEQ ID NO: 20087 - DNA, 25 bp, Homo sapien
agagcaaggaaaagttataaatcta

SEQ ID NO: 20088 - DNA, 25 bp, Homo sapien
agagcaagtaaaagttataaatcta

SEQ ID NO: 20089 - DNA, 25 bp, Homo sapien
agagcaagtatgatacaatgccttt

SEQ ID NO: 20090 - DNA, 25 bp, Homo sapien
agagcaagtatgatccaatgccttt

SEQ ID NO: 20091 - DNA, 25 bp, Homo sapien
agagcaagttgtttagttttcatat

SEQ ID NO: 20092 - DNA, 25 bp, Homo sapien
agagcaagttgtttggttttcatat

SEQ ID NO: 20093 - DNA, 25 bp, Homo sapien
agagcaatagtcaatgcatagcata

SEQ ID NO: 20094 - DNA, 25 bp, Homo sapien
agagcaatagtcgatgcatagcata

SEQ ID NO: 20095 - DNA, 25 bp, Homo sapien
agagcaatattgtcttggctatgac

SEQ ID NO: 20096 - DNA, 25 bp, Homo sapien
agagcaatattttcttggctatgac

SEQ ID NO: 20097 - DNA, 25 bp, Homo sapien
agagcaatttgacaagagggtaagg

SEQ ID NO: 20098 - DNA, 25 bp, Homo sapien
agagcaatttgacaggagggtaagg

SEQ ID NO: 20099 - DNA, 25 bp, Homo sapien
agagcacaaaaacaatcatcagcct

SEQ ID NO: 20100 - DNA, 25 bp, Homo sapien
agagcacaaaagcaatcatcagcct

SEQ ID NO: 20101 - DNA, 25 bp, Homo sapien
agagcacaatgtaacgcacatttta

SEQ ID NO: 20102 - DNA, 25 bp, Homo sapien
agagcacaatgttacgcacatttta

SEQ ID NO: 20103 - DNA, 25 bp, Homo sapien
agagcacagatagaggagcctgagg

SEQ ID NO: 20104 - DNA, 25 bp, Homo sapien
agagcacagcatgaaggaagcaggg

SEQ ID NO: 20105 - DNA, 25 bp, Homo sapien
agagcacaggatgaaggaagcaggg

SEQ ID NO: 20106 - DNA, 25 bp, Homo sapien
agagcacagttagaggagcctgagg

SEQ ID NO: 20107 - DNA, 25 bp, Homo sapien
agagcacatcaacctagtaagaatc

SEQ ID NO: 20108 - DNA, 25 bp, Homo sapien
agagcacatcagcctagtaagaatc

SEQ ID NO: 20109 - DNA, 25 bp, Homo sapien
agagcaccacaagaaagatcactga

SEQ ID NO: 20110 - DNA, 25 bp, Homo sapien
agagcaccacaaggaagatcactga

SEQ ID NO: 20111 - DNA, 25 bp, Homo sapien
agagcacccaaatgttatattgttc

SEQ ID NO: 20112 - DNA, 25 bp, Homo sapien
agagcacccaagtgttatattgttc

SEQ ID NO: 20113 - DNA, 25 bp, Homo sapien
agagcagacagggagaggcaacaaa

SEQ ID NO: 20114 - DNA, 25 bp, Homo sapien
agagcagacagggagatgcaacaaa

SEQ ID NO: 20115 - DNA, 25 bp, Homo sapien
agagcagagcgcaaggaatgatcta

SEQ ID NO: 20116 - DNA, 25 bp, Homo sapien
agagcagagtgcaaggaatgatcta

SEQ ID NO: 20117 - DNA, 25 bp, Homo sapien
agagcagatcaaacaacaccacttt

SEQ ID NO: 20118 - DNA, 25 bp, Homo sapien
agagcagatcaagcaacaccacttt

SEQ ID NO: 20119 - DNA, 25 bp, Homo sapien
agagcagattcattttcagaccaga

SEQ ID NO: 20120 - DNA, 25 bp, Homo sapien
agagcagattcgttttcagaccaga

SEQ ID NO: 20121 - DNA, 25 bp, Homo sapien
agagcagcattagccagacctttgg

SEQ ID NO: 20122 - DNA, 25 bp, Homo sapien
agagcagcgttagccagacctttgg

SEQ ID NO: 20123 - DNA, 25 bp, Homo sapien
agagcaggcagagccgttcttcacg

SEQ ID NO: 20124 - DNA, 25 bp, Homo sapien
agagcaggtagagccgttcttcacg

SEQ ID NO: 20125 - DNA, 25 bp, Homo sapien
agagcagtggttgttaagttttcat

SEQ ID NO: 20126 - DNA, 25 bp, Homo sapien
agagcagtggttgttacgttttcat

SEQ ID NO: 20127 - DNA, 25 bp, Homo sapien
agagcataaaaaaatggtgttctcc

SEQ ID NO: 20128 - DNA, 25 bp, Homo sapien
agagcataaaaaattggtgttctcc

SEQ ID NO: 20129 - DNA, 25 bp, Homo sapien
agagcataagatcatttttcagtag

SEQ ID NO: 20130 - DNA, 25 bp, Homo sapien
agagcataagatcgtttttcagtag

SEQ ID NO: 20131 - DNA, 25 bp, Homo sapien
agagcatacctcaaaataataaatg

SEQ ID NO: 20132 - DNA, 25 bp, Homo sapien
agagcatacctcgaaataataaatg

SEQ ID NO: 20133 - DNA, 25 bp, Homo sapien
agagcatagacaaagcattaggaga

SEQ ID NO: 20134 - DNA, 25 bp, Homo sapien
agagcatagacaaggcattaggaga

SEQ ID NO: 20135 - DNA, 25 bp, Homo sapien
agagcatagctaattggcctaacag

SEQ ID NO: 20136 - DNA, 25 bp, Homo sapien
agagcatagcttattggcctaacag

SEQ ID NO: 20137 - DNA, 25 bp, Homo sapien
agagcataggttttattcatttcca

SEQ ID NO: 20138 - DNA, 25 bp, Homo sapien
agagcataggttttgttcatttcca

SEQ ID NO: 20139 - DNA, 25 bp, Homo sapien
agagcatcaaatgtgctttgaacat

SEQ ID NO: 20140 - DNA, 25 bp, Homo sapien
agagcatcagatgtgctttgaacat

SEQ ID NO: 20141 - DNA, 25 bp, Homo sapien
agagcattagatacaaagaggcctt

SEQ ID NO: 20142 - DNA, 25 bp, Homo sapien
agagcattagatagaaagaggcctt

SEQ ID NO: 20143 - DNA, 25 bp, Homo sapien
agagcatttcaaatttcagattttc

SEQ ID NO: 20144 - DNA, 25 bp, Homo sapien
agagcatttcagatttcagattttc

SEQ ID NO: 20145 - DNA, 25 bp, Homo sapien
agagcatttcaggaatggataatct

SEQ ID NO: 20146 - DNA, 25 bp, Homo sapien
agagcatttgaggaatggataatct

SEQ ID NO: 20147 - DNA, 25 bp, Homo sapien
agagcatttgatactgagttgggtg

SEQ ID NO: 20148 - DNA, 25 bp, Homo sapien
agagcatttgatattgagttgggtg

SEQ ID NO: 20149 - DNA, 25 bp, Homo sapien
agagccaaaggctgcatgacctaca

SEQ ID NO: 20150 - DNA, 25 bp, Homo sapien
agagccaagggctgcatgacctaca

SEQ ID NO: 20151 - DNA, 25 bp, Homo sapien
agagccaccagacagtatacctgag

SEQ ID NO: 20152 - DNA, 25 bp, Homo sapien
agagccaccagacagtgtacctgag

SEQ ID NO: 20153 - DNA, 25 bp, Homo sapien
agagccagaacctctgccctcttgc

SEQ ID NO: 20154 - DNA, 25 bp, Homo sapien
agagccagaacctttgccctcttgc

SEQ ID NO: 20155 - DNA, 25 bp, Homo sapien
agagccagaaggctagcatggttgg

SEQ ID NO: 20156 - DNA, 25 bp, Homo sapien
agagccagacatatattccgcaatg

SEQ ID NO: 20157 - DNA, 25 bp, Homo sapien
agagccagacatttattccgcaatg

SEQ ID NO: 20158 - DNA, 25 bp, Homo sapien
agagccagagggctagcatggttgg

SEQ ID NO: 20159 - DNA, 25 bp, Homo sapien
agagccataatgcaaaataagccta

SEQ ID NO: 20160 - DNA, 25 bp, Homo sapien
agagccataatgcgaaataagccta

SEQ ID NO: 20161 - DNA, 25 bp, Homo sapien
agagccatcaggcacaggaaagctg

SEQ ID NO: 20162 - DNA, 25 bp, Homo sapien
agagccatcaggcgcaggaaagctg

SEQ ID NO: 20163 - DNA, 25 bp, Homo sapien
agagccatttatttcttgcattgtt

SEQ ID NO: 20164 - DNA, 25 bp, Homo sapien
agagccatttatttgttgcattgtt

SEQ ID NO: 20165 - DNA, 25 bp, Homo sapien
agagcccacagctttcaaatttata

SEQ ID NO: 20166 - DNA, 25 bp, Homo sapien
agagcccacaggtttcaaatttata

SEQ ID NO: 20167 - DNA, 25 bp, Homo sapien
agagcccagaacagcagaatataac

SEQ ID NO: 20168 - DNA, 25 bp, Homo sapien
agagcccagaatagcagaatataac

SEQ ID NO: 20169 - DNA, 25 bp, Homo sapien
agagccccttacgtggcacagctgg

SEQ ID NO: 20170 - DNA, 25 bp, Homo sapien
agagccccttatgtggcacagctgg

SEQ ID NO: 20171 - DNA, 25 bp, Homo sapien
agagccctgacgtacatacttgtgt

SEQ ID NO: 20172 - DNA, 25 bp, Homo sapien
agagccctgacgtgcatacttgtgt

SEQ ID NO: 20173 - DNA, 25 bp, Homo sapien
agagccctgagacagcaaatgtctg

SEQ ID NO: 20174 - DNA, 25 bp, Homo sapien
agagccctgagagagcaaatgtctg

SEQ ID NO: 20175 - DNA, 25 bp, Homo sapien
agagcctacataaattagagttaat

SEQ ID NO: 20176 - DNA, 25 bp, Homo sapien
agagcctacctaaattagagttaat

SEQ ID NO: 20177 - DNA, 25 bp, Homo sapien
agagcctcggagacaatttgtaggt

SEQ ID NO: 20178 - DNA, 25 bp, Homo sapien
agagcctcggagactatttgtaggt

SEQ ID NO: 20179 - DNA, 25 bp, Homo sapien
agagcctgtataaaatggctgttca

SEQ ID NO: 20180 - DNA, 25 bp, Homo sapien
agagcctgtatacaatggctgttca

SEQ ID NO: 20181 - DNA, 25 bp, Homo sapien
agagcgcatagtacgacagaatcag

SEQ ID NO: 20182 - DNA, 25 bp, Homo sapien
agagcgcatagtatgacagaatcag

SEQ ID NO: 20183 - DNA, 25 bp, Homo sapien
agagctaaaagtcggtcacacaaga

SEQ ID NO: 20184 - DNA, 25 bp, Homo sapien
agagctaaaagtgggtcacacaaga

SEQ ID NO: 20185 - DNA, 25 bp, Homo sapien
agagctaagagttacctcaaattca

SEQ ID NO: 20186 - DNA, 25 bp, Homo sapien
agagctaatagttacctcaaattca

SEQ ID NO: 20187 - DNA, 25 bp, Homo sapien
agagctaatgaaatacataactgcc

SEQ ID NO: 20188 - DNA, 25 bp, Homo sapien
agagctaatgaaatacgtaactgcc

SEQ ID NO: 20189 - DNA, 25 bp, Homo sapien
agagctacgagtctctgtattctcc

SEQ ID NO: 20190 - DNA, 25 bp, Homo sapien
agagctacgcgtctctgtattctcc

SEQ ID NO: 20191 - DNA, 25 bp, Homo sapien
agagctactggcatccaataggtag

SEQ ID NO: 20192 - DNA, 25 bp, Homo sapien
agagctactggcatccgataggtag

SEQ ID NO: 20193 - DNA, 25 bp, Homo sapien
agagctagaattaggtcacaaatgg

SEQ ID NO: 20194 - DNA, 25 bp, Homo sapien
agagctagaattaggttacaaatgg

SEQ ID NO: 20195 - DNA, 25 bp, Homo sapien
agagctcagagaagcacgtgtgact

SEQ ID NO: 20196 - DNA, 25 bp, Homo sapien
agagctcagagaggcacgtgtgact

SEQ ID NO: 20197 - DNA, 25 bp, Homo sapien
agagctcagatgtttgcacctttct

SEQ ID NO: 20198 - DNA, 25 bp, Homo sapien
agagctcagatgtttgtacctttct

SEQ ID NO: 20199 - DNA, 25 bp, Homo sapien
agagctcattcctcgggatttaata

SEQ ID NO: 20200 - DNA, 25 bp, Homo sapien
agagctcattccttgggatttaata

SEQ ID NO: 20201 - DNA, 25 bp, Homo sapien
agagctcgtaagtgctcaaattcag

SEQ ID NO: 20202 - DNA, 25 bp, Homo sapien
agagctcgtaagtgttcaaattcag

SEQ ID NO: 20203 - DNA, 25 bp, Homo sapien
agagctcgtgccattcaacctgcca

SEQ ID NO: 20204 - DNA, 25 bp, Homo sapien
agagctcgtgccgttcaacctgcca

SEQ ID NO: 20205 - DNA, 25 bp, Homo sapien
agagctcgtgttatctaacctgttt

SEQ ID NO: 20206 - DNA, 25 bp, Homo sapien
agagctcgtgttgtctaacctgttt

SEQ ID NO: 20207 - DNA, 25 bp, Homo sapien
agagctctgtggattctggacatat

SEQ ID NO: 20208 - DNA, 25 bp, Homo sapien
agagctcttgttacctaaccatctt

SEQ ID NO: 20209 - DNA, 25 bp, Homo sapien
agagctcttgttatctaaccatctt

SEQ ID NO: 20210 - DNA, 25 bp, Homo sapien
agagctctttggattctggacatat

SEQ ID NO: 20211 - DNA, 25 bp, Homo sapien
agagctgccagtcagccgagcccgt

SEQ ID NO: 20212 - DNA, 25 bp, Homo sapien
agagctgccagtcagctgagcccgt

SEQ ID NO: 20213 - DNA, 25 bp, Homo sapien
agagctgggaaccaaacactcctgg

SEQ ID NO: 20214 - DNA, 25 bp, Homo sapien
agagctgggaaccaaagactcctgg

SEQ ID NO: 20215 - DNA, 25 bp, Homo sapien
agagctgtggtgaagttcaaatgag

SEQ ID NO: 20216 - DNA, 25 bp, Homo sapien
agagctgtggtgaggttcaaatgag

SEQ ID NO: 20217 - DNA, 25 bp, Homo sapien
agagcttaacgaaggaatagaaatc

SEQ ID NO: 20218 - DNA, 25 bp, Homo sapien
agagcttaatgaaggaatagaaatc

SEQ ID NO: 20219 - DNA, 25 bp, Homo sapien
agagcttacggctccaaagccaagg

SEQ ID NO: 20220 - DNA, 25 bp, Homo sapien
agagcttacggcttcaaagccaagg

SEQ ID NO: 20221 - DNA, 25 bp, Homo sapien
agagcttatctactgaatgacctca

SEQ ID NO: 20222 - DNA, 25 bp, Homo sapien
agagcttatctattgaatgacctca

SEQ ID NO: 20223 - DNA, 25 bp, Homo sapien
agagctttatcacttgatgaggtaa

SEQ ID NO: 20224 - DNA, 25 bp, Homo sapien
agagctttatcgcttgatgaggtaa

SEQ ID NO: 20225 - DNA, 25 bp, Homo sapien
agagcttttggaccccttttctgaa

SEQ ID NO: 20226 - DNA, 25 bp, Homo sapien
agagcttttggacctcttttctgaa

SEQ ID NO: 20227 - DNA, 25 bp, Homo sapien
agaggaaaaaagaacgtgaagactc

SEQ ID NO: 20228 - DNA, 25 bp, Homo sapien
agaggaaaaaagaatgtgaagactc

SEQ ID NO: 20229 - DNA, 25 bp, Homo sapien
agaggaaaagcagactactgcaaga

SEQ ID NO: 20230 - DNA, 25 bp, Homo sapien
agaggaaaagcagagtactgcaaga

SEQ ID NO: 20231 - DNA, 25 bp, Homo sapien
agaggaaacagaattaattagttag

SEQ ID NO: 20232 - DNA, 25 bp, Homo sapien
agaggaaacagtacatgcagaggcc

SEQ ID NO: 20233 - DNA, 25 bp, Homo sapien
agaggaaacagtacgtgcagaggcc

SEQ ID NO: 20234 - DNA, 25 bp, Homo sapien
agaggaaacctggcatgagctgggg

SEQ ID NO: 20235 - DNA, 25 bp, Homo sapien
agaggaaacggaattaattagttag

SEQ ID NO: 20236 - DNA, 25 bp, Homo sapien
agaggaaagctggcatgagctgggg

SEQ ID NO: 20237 - DNA, 25 bp, Homo sapien
agaggaacattgtccaactctttgg

SEQ ID NO: 20238 - DNA, 25 bp, Homo sapien
agaggaacattttccaactctttgg

SEQ ID NO: 20239 - DNA, 25 bp, Homo sapien
agaggaagagctgtcaagttaatta

SEQ ID NO: 20240 - DNA, 25 bp, Homo sapien
agaggaagagctgtcaggttaatta

SEQ ID NO: 20241 - DNA, 25 bp, Homo sapien
agaggaagccaagagaaaactcatt

SEQ ID NO: 20242 - DNA, 25 bp, Homo sapien
agaggaagccaagagacaactcatt

SEQ ID NO: 20243 - DNA, 25 bp, Homo sapien
agaggaaggatcaactgtgaatggc

SEQ ID NO: 20244 - DNA, 25 bp, Homo sapien
agaggaaggatcgactgtgaatggc

SEQ ID NO: 20245 - DNA, 25 bp, Homo sapien
agaggaatgaacaagagtttaagag

SEQ ID NO: 20246 - DNA, 25 bp, Homo sapien
agaggaatgaaccagagtttaagag

SEQ ID NO: 20247 - DNA, 25 bp, Homo sapien
agaggacaaaggtgtaaagtcagac

SEQ ID NO: 20248 - DNA, 25 bp, Homo sapien
agaggacaagggtgtaaagtcagac

SEQ ID NO: 20249 - DNA, 25 bp, Homo sapien
agaggacaataagtacaggcactgg

SEQ ID NO: 20250 - DNA, 25 bp, Homo sapien
agaggacaccatcgggaatgtgctg

SEQ ID NO: 20251 - DNA, 25 bp, Homo sapien
agaggacaccattgggaatgtgctg

SEQ ID NO: 20252 - DNA, 25 bp, Homo sapien
agaggacacttgaagcatcacacta

SEQ ID NO: 20253 - DNA, 25 bp, Homo sapien
agaggacacttgaagcgtcacacta

SEQ ID NO: 20254 - DNA, 25 bp, Homo sapien
agaggacagtaagtacaggcactgg

SEQ ID NO: 20255 - DNA, 25 bp, Homo sapien
agaggacatagtaggtacacaatat

SEQ ID NO: 20256 - DNA, 25 bp, Homo sapien
agaggacatcgctactattattaca

SEQ ID NO: 20257 - DNA, 25 bp, Homo sapien
agaggacatggtaggtacacaatat

SEQ ID NO: 20258 - DNA, 25 bp, Homo sapien
agaggacattgctactattattaca

SEQ ID NO: 20259 - DNA, 25 bp, Homo sapien
agaggaccaggaaagttgtgactta

SEQ ID NO: 20260 - DNA, 25 bp, Homo sapien
agaggaccagggaagttgtgactta

SEQ ID NO: 20261 - DNA, 25 bp, Homo sapien
agaggactgtgaatatcccatcaga

SEQ ID NO: 20262 - DNA, 25 bp, Homo sapien
agaggactgtgagtatcccatcaga

SEQ ID NO: 20263 - DNA, 25 bp, Homo sapien
agaggagacggcgcaggatcactca

SEQ ID NO: 20264 - DNA, 25 bp, Homo sapien
agaggagagacccagctgccgccgc

SEQ ID NO: 20265 - DNA, 25 bp, Homo sapien
agaggagagagaccatacaactttt

SEQ ID NO: 20266 - DNA, 25 bp, Homo sapien
agaggagagagactatacaactttt

SEQ ID NO: 20267 - DNA, 25 bp, Homo sapien
agaggagaggaaacagaattaatta

SEQ ID NO: 20268 - DNA, 25 bp, Homo sapien
agaggagaggaaacggaattaatta

SEQ ID NO: 20269 - DNA, 25 bp, Homo sapien
agaggagaggcccagctgccgccgc

SEQ ID NO: 20270 - DNA, 25 bp, Homo sapien
agaggagatggcgcaggatcactca

SEQ ID NO: 20271 - DNA, 25 bp, Homo sapien
agaggagtcctgattactgaattga

SEQ ID NO: 20272 - DNA, 25 bp, Homo sapien
agaggagtcctgattattgaattga

SEQ ID NO: 20273 - DNA, 25 bp, Homo sapien
agaggagtgagggaaagaactttga

SEQ ID NO: 20274 - DNA, 25 bp, Homo sapien
agaggagtgagggaaataactttga

SEQ ID NO: 20275 - DNA, 25 bp, Homo sapien
agaggatactgagacaactcatgaa

SEQ ID NO: 20276 - DNA, 25 bp, Homo sapien
agaggatactgagacagctcatgaa

SEQ ID NO: 20277 - DNA, 25 bp, Homo sapien
agaggatactgatacacttttttgc

SEQ ID NO: 20278 - DNA, 25 bp, Homo sapien
agaggatactgatacatttttttgc

SEQ ID NO: 20279 - DNA, 25 bp, Homo sapien
agaggatagaccacggcttcagcct

SEQ ID NO: 20280 - DNA, 25 bp, Homo sapien
agaggatagaccatggcttcagcct

SEQ ID NO: 20281 - DNA, 25 bp, Homo sapien
agaggatagagaagcaccctgaagc

SEQ ID NO: 20282 - DNA, 25 bp, Homo sapien
agaggatagagaagcatcctgaagc

SEQ ID NO: 20283 - DNA, 25 bp, Homo sapien
agaggatcacattctagttttgcat

SEQ ID NO: 20284 - DNA, 25 bp, Homo sapien
agaggatcagattctagttttgcat

SEQ ID NO: 20285 - DNA, 25 bp, Homo sapien
agaggatccagatttccctgtggcc

SEQ ID NO: 20286 - DNA, 25 bp, Homo sapien
agaggatccagctttccctgtggcc

SEQ ID NO: 20287 - DNA, 25 bp, Homo sapien
agaggatgaagacagggtacagatg

SEQ ID NO: 20288 - DNA, 25 bp, Homo sapien
agaggatgaaggtagccttgttgag

SEQ ID NO: 20289 - DNA, 25 bp, Homo sapien
agaggatgaagttagccttgttgag

SEQ ID NO: 20290 - DNA, 25 bp, Homo sapien
agaggatgacgacagggtacagatg

SEQ ID NO: 20291 - DNA, 25 bp, Homo sapien
agaggatggctcccactacaaagaa

SEQ ID NO: 20292 - DNA, 25 bp, Homo sapien
agaggatggttcccactacaaagaa

SEQ ID NO: 20293 - DNA, 25 bp, Homo sapien
agaggatttttccttgcactttatc

SEQ ID NO: 20294 - DNA, 25 bp, Homo sapien
agaggatttttctttgcactttatc

SEQ ID NO: 20295 - DNA, 25 bp, Homo sapien
agaggcaaaataacttgagatactt

SEQ ID NO: 20296 - DNA, 25 bp, Homo sapien
agaggcaaaatagcttgagatactt

SEQ ID NO: 20297 - DNA, 25 bp, Homo sapien
agaggcaaattgcagaatctaatcc

SEQ ID NO: 20298 - DNA, 25 bp, Homo sapien
agaggcaaattgtagaatctaatcc

SEQ ID NO: 20299 - DNA, 25 bp, Homo sapien
agaggcaagagacaacctgaaggaa

SEQ ID NO: 20300 - DNA, 25 bp, Homo sapien
agaggcaagagataacctgaaggaa

SEQ ID NO: 20301 - DNA, 25 bp, Homo sapien
agaggcacaactgatggcaagctat

SEQ ID NO: 20302 - DNA, 25 bp, Homo sapien
agaggcacacctgatggcaagctat

SEQ ID NO: 20303 - DNA, 25 bp, Homo sapien
agaggcaggaagacttaccttgaat

SEQ ID NO: 20304 - DNA, 25 bp, Homo sapien
agaggcaggcacagacgttagtagt

SEQ ID NO: 20305 - DNA, 25 bp, Homo sapien
agaggcagggagacttaccttgaat

SEQ ID NO: 20306 - DNA, 25 bp, Homo sapien
agaggcaggtacagacgttagtagt

SEQ ID NO: 20307 - DNA, 25 bp, Homo sapien
agaggcatggtcttggaaatctatt

SEQ ID NO: 20308 - DNA, 25 bp, Homo sapien
agaggcatggttttggaaatctatt

SEQ ID NO: 20309 - DNA, 25 bp, Homo sapien
agaggccagctaagctcaatctggg

SEQ ID NO: 20310 - DNA, 25 bp, Homo sapien
agaggccagctcagctcaatctggg

SEQ ID NO: 20311 - DNA, 25 bp, Homo sapien
agaggccatgttgaggcttccacaa

SEQ ID NO: 20312 - DNA, 25 bp, Homo sapien
agaggccatgttgaggtttccacaa

SEQ ID NO: 20313 - DNA, 25 bp, Homo sapien
agaggccattgccatgttcagcttg

SEQ ID NO: 20314 - DNA, 25 bp, Homo sapien
agaggccattgctatgttcagcttg

SEQ ID NO: 20315 - DNA, 25 bp, Homo sapien
agaggcccagtcaggtgaaggcaaa

SEQ ID NO: 20316 - DNA, 25 bp, Homo sapien
agaggcccagtcagttgaaggcaaa

SEQ ID NO: 20317 - DNA, 25 bp, Homo sapien
agaggcctacgaaaaggttccaaac

SEQ ID NO: 20318 - DNA, 25 bp, Homo sapien
agaggcctactcctcacagcacagt

SEQ ID NO: 20319 - DNA, 25 bp, Homo sapien
agaggcctatgaaaaggttccaaac

SEQ ID NO: 20320 - DNA, 25 bp, Homo sapien
agaggcctcccaagacagtctcctg

SEQ ID NO: 20321 - DNA, 25 bp, Homo sapien
agaggcctcccaggacagtctcctg

SEQ ID NO: 20322 - DNA, 25 bp, Homo sapien
agaggcctgtacattcgtttaatta

SEQ ID NO: 20323 - DNA, 25 bp, Homo sapien
agaggcctgtacgttcgtttaatta

SEQ ID NO: 20324 - DNA, 25 bp, Homo sapien
agaggccttctcctcacagcacagt

SEQ ID NO: 20325 - DNA, 25 bp, Homo sapien
agaggctagggtcctccatttaagc

SEQ ID NO: 20326 - DNA, 25 bp, Homo sapien
agaggctagtgtcctccatttaagc

SEQ ID NO: 20327 - DNA, 25 bp, Homo sapien
agaggctattacgaacagcactatc

SEQ ID NO: 20328 - DNA, 25 bp, Homo sapien
agaggctattatgaacagcactatc

SEQ ID NO: 20329 - DNA, 25 bp, Homo sapien
agaggctgatccctgtctgtacaaa

SEQ ID NO: 20330 - DNA, 25 bp, Homo sapien
agaggctgatctctgtctgtacaaa

SEQ ID NO: 20331 - DNA, 25 bp, Homo sapien
agaggctgtctctactatgtacatg

SEQ ID NO: 20332 - DNA, 25 bp, Homo sapien
agaggctgtctctactctgtacatg

SEQ ID NO: 20333 - DNA, 25 bp, Homo sapien
agaggctgtgctttcataagagcaa

SEQ ID NO: 20334 - DNA, 25 bp, Homo sapien
agaggctgtgcttttataagagcaa

SEQ ID NO: 20335 - DNA, 25 bp, Homo sapien
agaggcttatttctaaactccttat

SEQ ID NO: 20336 - DNA, 25 bp, Homo sapien
agaggcttatttttaaactccttat

SEQ ID NO: 20337 - DNA, 25 bp, Homo sapien
agaggcttcaaacgactggtttata

SEQ ID NO: 20338 - DNA, 25 bp, Homo sapien
agaggcttcaaatgactggtttata

SEQ ID NO: 20339 - DNA, 25 bp, Homo sapien
agaggcttcacagctaattgacaga

SEQ ID NO: 20340 - DNA, 25 bp, Homo sapien
agaggcttcacagttaattgacaga

SEQ ID NO: 20341 - DNA, 25 bp, Homo sapien
agaggcttcagcataagatcccaca

SEQ ID NO: 20342 - DNA, 25 bp, Homo sapien
agaggcttcagcgtaagatcccaca

SEQ ID NO: 20343 - DNA, 25 bp, Homo sapien
agagggaaaacaccaagacaaaaat

SEQ ID NO: 20344 - DNA, 25 bp, Homo sapien
agagggaaaacatcaagacaaaaat

SEQ ID NO: 20345 - DNA, 25 bp, Homo sapien
agagggaaacaaatgaccaaatagg

SEQ ID NO: 20346 - DNA, 25 bp, Homo sapien
agagggaaatgaccatagaaattag

SEQ ID NO: 20347 - DNA, 25 bp, Homo sapien
agagggaaatgaccgtagaaattag

SEQ ID NO: 20348 - DNA, 25 bp, Homo sapien
agagggaagcaaatgaccaaatagg

SEQ ID NO: 20349 - DNA, 25 bp, Homo sapien
agagggacaatgggaccacataatt

SEQ ID NO: 20350 - DNA, 25 bp, Homo sapien
agagggacaatgggactacataatt

SEQ ID NO: 20351 - DNA, 25 bp, Homo sapien
agagggacacgtactggctttggct

SEQ ID NO: 20352 - DNA, 25 bp, Homo sapien
agagggacacgtactgtctttggct

SEQ ID NO: 20353 - DNA, 25 bp, Homo sapien
agagggagatataacctgtctgcaa

SEQ ID NO: 20354 - DNA, 25 bp, Homo sapien
agagggagatataagctgtctgcaa

SEQ ID NO: 20355 - DNA, 25 bp, Homo sapien
agagggagcgtgctctcgaattgaa

SEQ ID NO: 20356 - DNA, 25 bp, Homo sapien
agagggagcgtgctctggaattgaa

SEQ ID NO: 20357 - DNA, 25 bp, Homo sapien
agagggagctgcaaccaatggtcaa

SEQ ID NO: 20358 - DNA, 25 bp, Homo sapien
agagggagctgcgaccaatggtcaa

SEQ ID NO: 20359 - DNA, 25 bp, Homo sapien
agagggatataagaggaaattttaa

SEQ ID NO: 20360 - DNA, 25 bp, Homo sapien
agagggatataagcggaaattttaa

SEQ ID NO: 20361 - DNA, 25 bp, Homo sapien
agagggcacgggctccgcagacagg

SEQ ID NO: 20362 - DNA, 25 bp, Homo sapien
agagggcatgggctccgcagacagg

SEQ ID NO: 20363 - DNA, 25 bp, Homo sapien
agagggctgccattctctctgttgt

SEQ ID NO: 20364 - DNA, 25 bp, Homo sapien
agagggctgccattgtctctgttgt

SEQ ID NO: 20365 - DNA, 25 bp, Homo sapien
agaggggaatgccataaacagaagt

SEQ ID NO: 20366 - DNA, 25 bp, Homo sapien
agaggggaatgccgtaaacagaagt

SEQ ID NO: 20367 - DNA, 25 bp, Homo sapien
agagggggaatctgttcttagccca

SEQ ID NO: 20368 - DNA, 25 bp, Homo sapien
agagggggagtctgttcttagccca

SEQ ID NO: 20369 - DNA, 25 bp, Homo sapien
agaggtaaaaacgagccactcttct

SEQ ID NO: 20370 - DNA, 25 bp, Homo sapien
agaggtaaaaatgagccactcttct

SEQ ID NO: 20371 - DNA, 25 bp, Homo sapien
agaggtaaacgattcttctcattga

SEQ ID NO: 20372 - DNA, 25 bp, Homo sapien
agaggtaaagaaatcgtaagtgttc

SEQ ID NO: 20373 - DNA, 25 bp, Homo sapien
agaggtaaagaagtcgtaagtgttc

SEQ ID NO: 20374 - DNA, 25 bp, Homo sapien
agaggtaaatgattcttctcattga

SEQ ID NO: 20375 - DNA, 25 bp, Homo sapien
agaggtaactgtggccaagattcaa

SEQ ID NO: 20376 - DNA, 25 bp, Homo sapien
agaggtaactgtgtccaagattcaa

SEQ ID NO: 20377 - DNA, 25 bp, Homo sapien
agaggtaatccttgctgctggaccc

SEQ ID NO: 20378 - DNA, 25 bp, Homo sapien
agaggtaatccttgttgctggaccc

SEQ ID NO: 20379 - DNA, 25 bp, Homo sapien
agaggtaccgagatttcctcaccaa

SEQ ID NO: 20380 - DNA, 25 bp, Homo sapien
agaggtactgagatttcctcaccaa

SEQ ID NO: 20381 - DNA, 25 bp, Homo sapien
agaggtagtttcacaaaaagtagat

SEQ ID NO: 20382 - DNA, 25 bp, Homo sapien
agaggtagtttcacaacaagtagat

SEQ ID NO: 20383 - DNA, 25 bp, Homo sapien
agaggtatctaaaatctcccactgt

SEQ ID NO: 20384 - DNA, 25 bp, Homo sapien
agaggtatgcaggcttcaggcacag

SEQ ID NO: 20385 - DNA, 25 bp, Homo sapien
agaggtatgcaggtttcaggcacag

SEQ ID NO: 20386 - DNA, 25 bp, Homo sapien
agaggtatgtaaaatctcccactgt

SEQ ID NO: 20387 - DNA, 25 bp, Homo sapien
agaggtattctgaaatcctcaaaac

SEQ ID NO: 20388 - DNA, 25 bp, Homo sapien
agaggtattctggaatcctcaaaac

SEQ ID NO: 20389 - DNA, 25 bp, Homo sapien
agaggtcactacgagtcttatggac

SEQ ID NO: 20390 - DNA, 25 bp, Homo sapien
agaggtcactatgagtcttatggac

SEQ ID NO: 20391 - DNA, 25 bp, Homo sapien
agaggtgccgtgtgtatataggcta

SEQ ID NO: 20392 - DNA, 25 bp, Homo sapien
agaggtgctgtgtgtatataggcta

SEQ ID NO: 20393 - DNA, 25 bp, Homo sapien
agaggtggacaatcataaaattgtc

SEQ ID NO: 20394 - DNA, 25 bp, Homo sapien
agaggtggagaatcataaaattgtc

SEQ ID NO: 20395 - DNA, 25 bp, Homo sapien
agaggtggcaatacagaagtagccc

SEQ ID NO: 20396 - DNA, 25 bp, Homo sapien
agaggtggcaatatagaagtagccc

SEQ ID NO: 20397 - DNA, 25 bp, Homo sapien
agaggtggcagatgtgaagtggccc

SEQ ID NO: 20398 - DNA, 25 bp, Homo sapien
agaggtggcagatttgaagtggccc

SEQ ID NO: 20399 - DNA, 25 bp, Homo sapien
agaggtggctttgcttacaggttga

SEQ ID NO: 20400 - DNA, 25 bp, Homo sapien
agaggtggtataacatctagttaga

SEQ ID NO: 20401 - DNA, 25 bp, Homo sapien
agaggtggtataatatctagttaga

SEQ ID NO: 20402 - DNA, 25 bp, Homo sapien
agaggtggtgttctataaatattca

SEQ ID NO: 20403 - DNA, 25 bp, Homo sapien
agaggtggtgttctgtaaatattca

SEQ ID NO: 20404 - DNA, 25 bp, Homo sapien
agaggtggttttgcttacaggttga

SEQ ID NO: 20405 - DNA, 25 bp, Homo sapien
agaggttacattgaccaagttagaa

SEQ ID NO: 20406 - DNA, 25 bp, Homo sapien
agaggttacattgacccagttagaa

SEQ ID NO: 20407 - DNA, 25 bp, Homo sapien
agaggttcaatcctagggctcatga

SEQ ID NO: 20408 - DNA, 25 bp, Homo sapien
agaggttcagtcctagggctcatga

SEQ ID NO: 20409 - DNA, 25 bp, Homo sapien
agaggtttcactttgtccaacactc

SEQ ID NO: 20410 - DNA, 25 bp, Homo sapien
agaggtttgactttgtccaacactc

SEQ ID NO: 20411 - DNA, 25 bp, Homo sapien
agagtaaagatactaaccagccaga

SEQ ID NO: 20412 - DNA, 25 bp, Homo sapien
agagtaaagatgctaaccagccaga

SEQ ID NO: 20413 - DNA, 25 bp, Homo sapien
agagtaaaggggaatttgtcttgcg

SEQ ID NO: 20414 - DNA, 25 bp, Homo sapien
agagtaaagggtaatttgtcttgcg

SEQ ID NO: 20415 - DNA, 25 bp, Homo sapien
agagtaacaaatgatactttaacag

SEQ ID NO: 20416 - DNA, 25 bp, Homo sapien
agagtaacaaattatactttaacag

SEQ ID NO: 20417 - DNA, 25 bp, Homo sapien
agagtaactgtgataggttccgaag

SEQ ID NO: 20418 - DNA, 25 bp, Homo sapien
agagtaactgtggtaggttccgaag

SEQ ID NO: 20419 - DNA, 25 bp, Homo sapien
agagtaagcgtacatctaaagtgct

SEQ ID NO: 20420 - DNA, 25 bp, Homo sapien
agagtaagtattgaggcttctcagg

SEQ ID NO: 20421 - DNA, 25 bp, Homo sapien
agagtaagtattgaggtttctcagg

SEQ ID NO: 20422 - DNA, 25 bp, Homo sapien
agagtaagtctaataaagcgtggac

SEQ ID NO: 20423 - DNA, 25 bp, Homo sapien
agagtaagtctagtaaagcgtggac

SEQ ID NO: 20424 - DNA, 25 bp, Homo sapien
agagtaagtgtaaacaggtcaaaaa

SEQ ID NO: 20425 - DNA, 25 bp, Homo sapien
agagtaagtgtacatctaaagtgct

SEQ ID NO: 20426 - DNA, 25 bp, Homo sapien
agagtaagtgtgaacaggtcaaaaa

SEQ ID NO: 20427 - DNA, 25 bp, Homo sapien
agagtaataaactatgatgctaaat

SEQ ID NO: 20428 - DNA, 25 bp, Homo sapien
agagtaatataacattgtttgtgac

SEQ ID NO: 20429 - DNA, 25 bp, Homo sapien
agagtaatataatattgtttgtgac

SEQ ID NO: 20430 - DNA, 25 bp, Homo sapien
agagtaatgaactatgatgctaaat

SEQ ID NO: 20431 - DNA, 25 bp, Homo sapien
agagtacaaaaagccatgttaaaaa

SEQ ID NO: 20432 - DNA, 25 bp, Homo sapien
agagtacaaaaaggcatgttaaaaa

SEQ ID NO: 20433 - DNA, 25 bp, Homo sapien
agagtacaaagcacatccttcttgg

SEQ ID NO: 20434 - DNA, 25 bp, Homo sapien
agagtacaaggcacatccttcttgg

SEQ ID NO: 20435 - DNA, 25 bp, Homo sapien
agagtacttgacagtgtcctcaata

SEQ ID NO: 20436 - DNA, 25 bp, Homo sapien
agagtacttgacggtgtcctcaata

SEQ ID NO: 20437 - DNA, 25 bp, Homo sapien
agagtagaatgtattttatgtcttt

SEQ ID NO: 20438 - DNA, 25 bp, Homo sapien
agagtagaatgtgttttatgtcttt

SEQ ID NO: 20439 - DNA, 25 bp, Homo sapien
agagtagagcaagtagcagttttac

SEQ ID NO: 20440 - DNA, 25 bp, Homo sapien
agagtagaggttagtggaattgttt

SEQ ID NO: 20441 - DNA, 25 bp, Homo sapien
agagtagaggttcgtggaattgttt

SEQ ID NO: 20442 - DNA, 25 bp, Homo sapien
agagtagagtaagtagcagttttac

SEQ ID NO: 20443 - DNA, 25 bp, Homo sapien
agagtagcaaggcaatttagtttaa

SEQ ID NO: 20444 - DNA, 25 bp, Homo sapien
agagtagcatccagagcagttttca

SEQ ID NO: 20445 - DNA, 25 bp, Homo sapien
agagtagcatccggagcagttttca

SEQ ID NO: 20446 - DNA, 25 bp, Homo sapien
agagtagcgaggcaatttagtttaa

SEQ ID NO: 20447 - DNA, 25 bp, Homo sapien
agagtagtgttttatagtggctaca

SEQ ID NO: 20448 - DNA, 25 bp, Homo sapien
agagtagtgttttgtagtggctaca

SEQ ID NO: 20449 - DNA, 25 bp, Homo sapien
agagtataaagttccttcttctccc

SEQ ID NO: 20450 - DNA, 25 bp, Homo sapien
agagtataaagtttcttcttctccc

SEQ ID NO: 20451 - DNA, 25 bp, Homo sapien
agagtataagattgccagatatgga

SEQ ID NO: 20452 - DNA, 25 bp, Homo sapien
agagtataagattgccggatatgga

SEQ ID NO: 20453 - DNA, 25 bp, Homo sapien
agagtataatgtttaaatgctgtac

SEQ ID NO: 20454 - DNA, 25 bp, Homo sapien
agagtatagtgtttaaatgctgtac

SEQ ID NO: 20455 - DNA, 25 bp, Homo sapien
agagtatatgaccagcacagttttc

SEQ ID NO: 20456 - DNA, 25 bp, Homo sapien
agagtatatgactagcacagttttc

SEQ ID NO: 20457 - DNA, 25 bp, Homo sapien
agagtattaaagagtcttgtcaatg

SEQ ID NO: 20458 - DNA, 25 bp, Homo sapien
agagtattaaagggtcttgtcaatg

SEQ ID NO: 20459 - DNA, 25 bp, Homo sapien
agagtcacaaacccacctgtgaatg

SEQ ID NO: 20460 - DNA, 25 bp, Homo sapien
agagtcaccaacccacctgtgaatg

SEQ ID NO: 20461 - DNA, 25 bp, Homo sapien
agagtcactttacaatggagaaacc

SEQ ID NO: 20462 - DNA, 25 bp, Homo sapien
agagtcactttgcaatggagaaacc

SEQ ID NO: 20463 - DNA, 25 bp, Homo sapien
agagtcagcctagtatatgagcatc

SEQ ID NO: 20464 - DNA, 25 bp, Homo sapien
agagtcagcctcgtatatgagcatc

SEQ ID NO: 20465 - DNA, 25 bp, Homo sapien
agagtcagcgagatggtgcccagtg

SEQ ID NO: 20466 - DNA, 25 bp, Homo sapien
agagtcagtgagatggtgcccagtg

SEQ ID NO: 20467 - DNA, 25 bp, Homo sapien
agagtcatcagtaacctcagaaaaa

SEQ ID NO: 20468 - DNA, 25 bp, Homo sapien
agagtcattagtaacctcagaaaaa

SEQ ID NO: 20469 - DNA, 25 bp, Homo sapien
agagtcccgatcagctagttttcag

SEQ ID NO: 20470 - DNA, 25 bp, Homo sapien
agagtcccgattagctagttttcag

SEQ ID NO: 20471 - DNA, 25 bp, Homo sapien
agagtccgagtctatagtctcatac

SEQ ID NO: 20472 - DNA, 25 bp, Homo sapien
agagtccgagtgtatagtctcatac

SEQ ID NO: 20473 - DNA, 25 bp, Homo sapien
agagtcgacatgtctattcaacatg

SEQ ID NO: 20474 - DNA, 25 bp, Homo sapien
agagtcgatatgtctattcaacatg

SEQ ID NO: 20475 - DNA, 25 bp, Homo sapien
agagtctcaccaaaggtttttgata

SEQ ID NO: 20476 - DNA, 25 bp, Homo sapien
agagtctcatcaaaggtttttgata

SEQ ID NO: 20477 - DNA, 25 bp, Homo sapien
agagtctgaactgtaaaagaaattg

SEQ ID NO: 20478 - DNA, 25 bp, Homo sapien
agagtctgaactgtgaaagaaattg

SEQ ID NO: 20479 - DNA, 25 bp, Homo sapien
agagtcttagagatagtatcccagg

SEQ ID NO: 20480 - DNA, 25 bp, Homo sapien
agagtcttagagatggtatcccagg

SEQ ID NO: 20481 - DNA, 25 bp, Homo sapien
agagtcttcaaaaggacaaaattat

SEQ ID NO: 20482 - DNA, 25 bp, Homo sapien
agagtcttcaaaaggataaaattat

SEQ ID NO: 20483 - DNA, 25 bp, Homo sapien
agagtctttgcacccaaaactccaa

SEQ ID NO: 20484 - DNA, 25 bp, Homo sapien
agagtctttgcacccacaactccaa

SEQ ID NO: 20485 - DNA, 25 bp, Homo sapien
agagtgaaaaggcaattcatagaat

SEQ ID NO: 20486 - DNA, 25 bp, Homo sapien
agagtgaaaaggcgattcatagaat

SEQ ID NO: 20487 - DNA, 25 bp, Homo sapien
agagtgaaaattgagcaaatctgca

SEQ ID NO: 20488 - DNA, 25 bp, Homo sapien
agagtgaaagttgagcaaatctgca

SEQ ID NO: 20489 - DNA, 25 bp, Homo sapien
agagtgaactagaaataaaccaaac

SEQ ID NO: 20490 - DNA, 25 bp, Homo sapien
agagtgaagatacattacctacaca

SEQ ID NO: 20491 - DNA, 25 bp, Homo sapien
agagtgaagatagattacctacaca

SEQ ID NO: 20492 - DNA, 25 bp, Homo sapien
agagtgaattagaaataaaccaaac

SEQ ID NO: 20493 - DNA, 25 bp, Homo sapien
agagtgacagcaaaaatcatagctg

SEQ ID NO: 20494 - DNA, 25 bp, Homo sapien
agagtgacatcaaaaatcatagctg

SEQ ID NO: 20495 - DNA, 25 bp, Homo sapien
agagtgagtgttgctccagctctct

SEQ ID NO: 20496 - DNA, 25 bp, Homo sapien
agagtgagtgtttctccagctctct

SEQ ID NO: 20497 - DNA, 25 bp, Homo sapien
agagtgcacaggggaaagccactcc

SEQ ID NO: 20498 - DNA, 25 bp, Homo sapien
agagtgcacaggggaaggccactcc

SEQ ID NO: 20499 - DNA, 25 bp, Homo sapien
agagtgcacagtatgttcaaaggcc

SEQ ID NO: 20500 - DNA, 25 bp, Homo sapien
agagtgcacagtgtgttcaaaggcc

SEQ ID NO: 20501 - DNA, 25 bp, Homo sapien
agagtgctgggtggtatgaaactga

SEQ ID NO: 20502 - DNA, 25 bp, Homo sapien
agagtgctgggttgtatgaaactga

SEQ ID NO: 20503 - DNA, 25 bp, Homo sapien
agagtgctttctatgtacctgctga

SEQ ID NO: 20504 - DNA, 25 bp, Homo sapien
agagtgctttctgtgtacctgctga

SEQ ID NO: 20505 - DNA, 25 bp, Homo sapien
agagtggaaattaggccagaaagaa

SEQ ID NO: 20506 - DNA, 25 bp, Homo sapien
agagtggaaattatgccagaaagaa

SEQ ID NO: 20507 - DNA, 25 bp, Homo sapien
agagtggatatgttgttagccagca

SEQ ID NO: 20508 - DNA, 25 bp, Homo sapien
agagtggatattttgttagccagca

SEQ ID NO: 20509 - DNA, 25 bp, Homo sapien
agagtggcctccatctcgattgcca

SEQ ID NO: 20510 - DNA, 25 bp, Homo sapien
agagtggcctccatcttgattgcca

SEQ ID NO: 20511 - DNA, 25 bp, Homo sapien
agagtgggaagccttgattataggc

SEQ ID NO: 20512 - DNA, 25 bp, Homo sapien
agagtgggaaggcttgattataggc

SEQ ID NO: 20513 - DNA, 25 bp, Homo sapien
agagtggggcttctcacatgcagtc

SEQ ID NO: 20514 - DNA, 25 bp, Homo sapien
agagtggggcttttcacatgcagtc

SEQ ID NO: 20515 - DNA, 25 bp, Homo sapien
agagtgtgacacttcataagcatca

SEQ ID NO: 20516 - DNA, 25 bp, Homo sapien
agagtgtgacagttcataagcatca

SEQ ID NO: 20517 - DNA, 25 bp, Homo sapien
agagtgtgctccagtaaatttcctg

SEQ ID NO: 20518 - DNA, 25 bp, Homo sapien
agagtgtgctccggtaaatttcctg

SEQ ID NO: 20519 - DNA, 25 bp, Homo sapien
agagtgttccttctcaaatcatctc

SEQ ID NO: 20520 - DNA, 25 bp, Homo sapien
agagtgtttcttctcaaatcatctc

SEQ ID NO: 20521 - DNA, 25 bp, Homo sapien
agagttaatttgatggcttgagcag

SEQ ID NO: 20522 - DNA, 25 bp, Homo sapien
agagttaatttggtggcttgagcag

SEQ ID NO: 20523 - DNA, 25 bp, Homo sapien
agagttactacacaatggggaaacc

SEQ ID NO: 20524 - DNA, 25 bp, Homo sapien
agagttacttcacaatggggaaacc

SEQ ID NO: 20525 - DNA, 25 bp, Homo sapien
agagttatcaaaatgaatgctacaa

SEQ ID NO: 20526 - DNA, 25 bp, Homo sapien
agagttatcaagatgaatgctacaa

SEQ ID NO: 20527 - DNA, 25 bp, Homo sapien
agagttatgatctctcaagtcactg

SEQ ID NO: 20528 - DNA, 25 bp, Homo sapien
agagttatgttctctcaagtcactg

SEQ ID NO: 20529 - DNA, 25 bp, Homo sapien
agagttcaagggagactaaactgga

SEQ ID NO: 20530 - DNA, 25 bp, Homo sapien
agagttcaagggaggctaaactgga

SEQ ID NO: 20531 - DNA, 25 bp, Homo sapien
agagttcacaggtaaatgaaaggaa

SEQ ID NO: 20532 - DNA, 25 bp, Homo sapien
agagttcacaggtgaatgaaaggaa

SEQ ID NO: 20533 - DNA, 25 bp, Homo sapien
agagttcacagtattcatatttagt

SEQ ID NO: 20534 - DNA, 25 bp, Homo sapien
agagttcacggtattcatatttagt

SEQ ID NO: 20535 - DNA, 25 bp, Homo sapien
agagttcattgtaagtaaatttttg

SEQ ID NO: 20536 - DNA, 25 bp, Homo sapien
agagttcattgtaggtaaatttttg

SEQ ID NO: 20537 - DNA, 25 bp, Homo sapien
agagttccagaaatgtgggttcaag

SEQ ID NO: 20538 - DNA, 25 bp, Homo sapien
agagttccagagatgtgggttcaag

SEQ ID NO: 20539 - DNA, 25 bp, Homo sapien
agagttgaagcaccaagaagcagag

SEQ ID NO: 20540 - DNA, 25 bp, Homo sapien
agagttgacttttgaccttgttcct

SEQ ID NO: 20541 - DNA, 25 bp, Homo sapien
agagttgacttttggccttgttcct

SEQ ID NO: 20542 - DNA, 25 bp, Homo sapien
agagttgaggcaccaagaagcagag

SEQ ID NO: 20543 - DNA, 25 bp, Homo sapien
agagttgctatccatatgatcttgt

SEQ ID NO: 20544 - DNA, 25 bp, Homo sapien
agagttgctatccgtatgatcttgt

SEQ ID NO: 20545 - DNA, 25 bp, Homo sapien
agagttggagcaaatgagactcaga

SEQ ID NO: 20546 - DNA, 25 bp, Homo sapien
agagttggagcaactgagactcaga

SEQ ID NO: 20547 - DNA, 25 bp, Homo sapien
agagttgtcacccaatggcagttga

SEQ ID NO: 20548 - DNA, 25 bp, Homo sapien
agagttgtcacccagtggcagttga

SEQ ID NO: 20549 - DNA, 25 bp, Homo sapien
agagttgtcatttttagggagaagt

SEQ ID NO: 20550 - DNA, 25 bp, Homo sapien
agagttgtcgtttttagggagaagt

SEQ ID NO: 20551 - DNA, 25 bp, Homo sapien
agagtttcaaattcagtgtttctgg

SEQ ID NO: 20552 - DNA, 25 bp, Homo sapien
agagtttcagattcagtgtttctgg

SEQ ID NO: 20553 - DNA, 25 bp, Homo sapien
agagtttgcagactagtgagaaagc

SEQ ID NO: 20554 - DNA, 25 bp, Homo sapien
agagtttgcagtttgctccttaccc

SEQ ID NO: 20555 - DNA, 25 bp, Homo sapien
agagtttgccgtttgctccttaccc

SEQ ID NO: 20556 - DNA, 25 bp, Homo sapien
agagtttgctttcaggctgctttga

SEQ ID NO: 20557 - DNA, 25 bp, Homo sapien
agagtttgctttcgggctgctttga

SEQ ID NO: 20558 - DNA, 25 bp, Homo sapien
agagtttggagactagtgagaaagc

SEQ ID NO: 20559 - DNA, 25 bp, Homo sapien
agagtttggatgaagcccagcaaat

SEQ ID NO: 20560 - DNA, 25 bp, Homo sapien
agagtttggatgaagcgcagcaaat

SEQ ID NO: 20561 - DNA, 25 bp, Homo sapien
agagtttgttcaacggaataataat

SEQ ID NO: 20562 - DNA, 25 bp, Homo sapien
agagtttgttcaatggaataataat

SEQ ID NO: 20563 - DNA, 25 bp, Homo sapien
agagttttaaaactgacatgcaata

SEQ ID NO: 20564 - DNA, 25 bp, Homo sapien
agagttttaaaattgacatgcaata

SEQ ID NO: 20565 - DNA, 25 bp, Homo sapien
agataaaaactccaatacagcacat

SEQ ID NO: 20566 - DNA, 25 bp, Homo sapien
agataaaaactccgatacagcacat

SEQ ID NO: 20567 - DNA, 25 bp, Homo sapien
agataaaaggtaggcatgagagcca

SEQ ID NO: 20568 - DNA, 25 bp, Homo sapien
agataaaaggtgggcatgagagcca

SEQ ID NO: 20569 - DNA, 25 bp, Homo sapien
agataaaatagcacaaaacgctgaa

SEQ ID NO: 20570 - DNA, 25 bp, Homo sapien
agataaaatagcagaaaacgctgaa

SEQ ID NO: 20571 - DNA, 25 bp, Homo sapien
agataaacaatgtctcttacttgaa

SEQ ID NO: 20572 - DNA, 25 bp, Homo sapien
agataaacaccaaataaatgcaaca

SEQ ID NO: 20573 - DNA, 25 bp, Homo sapien
agataaacagcaaataaatgcaaca

SEQ ID NO: 20574 - DNA, 25 bp, Homo sapien
agataaaccatagagaaaattaata

SEQ ID NO: 20575 - DNA, 25 bp, Homo sapien
agataaaccatggagaaaattaata

SEQ ID NO: 20576 - DNA, 25 bp, Homo sapien
agataaacccaatcaaatcagaaag

SEQ ID NO: 20577 - DNA, 25 bp, Homo sapien
agataaacccaatccaatcagaaag

SEQ ID NO: 20578 - DNA, 25 bp, Homo sapien
agataaacgatgtctcttacttgaa

SEQ ID NO: 20579 - DNA, 25 bp, Homo sapien
agataaagccaagacaatattagga

SEQ ID NO: 20580 - DNA, 25 bp, Homo sapien
agataaagccaaggcaatattagga

SEQ ID NO: 20581 - DNA, 25 bp, Homo sapien
agataaataccaagaaacacaattg

SEQ ID NO: 20582 - DNA, 25 bp, Homo sapien
agataaataccaaggaacacaattg

SEQ ID NO: 20583 - DNA, 25 bp, Homo sapien
agataaattagtaaaaaaaatagtg

SEQ ID NO: 20584 - DNA, 25 bp, Homo sapien
agataaattagtaaaacaaatagtg

SEQ ID NO: 20585 - DNA, 25 bp, Homo sapien
agataacacaaacgaagagaaacac

SEQ ID NO: 20586 - DNA, 25 bp, Homo sapien
agataacacaaatgaagagaaacac

SEQ ID NO: 20587 - DNA, 25 bp, Homo sapien
agataacagacactaactggtacag

SEQ ID NO: 20588 - DNA, 25 bp, Homo sapien
agataacagacactaagtggtacag

SEQ ID NO: 20589 - DNA, 25 bp, Homo sapien
agataacagcagagaagatattttt

SEQ ID NO: 20590 - DNA, 25 bp, Homo sapien
agataacagcagaggagatattttt

SEQ ID NO: 20591 - DNA, 25 bp, Homo sapien
agataacggagcagcaccttcgtag

SEQ ID NO: 20592 - DNA, 25 bp, Homo sapien
agataacggagcagcatcttcgtag

SEQ ID NO: 20593 - DNA, 25 bp, Homo sapien
agataactagataaacaaagtctca

SEQ ID NO: 20594 - DNA, 25 bp, Homo sapien
agataactagcagtgttcctggaag

SEQ ID NO: 20595 - DNA, 25 bp, Homo sapien
agataactctgcaattaagtggagc

SEQ ID NO: 20596 - DNA, 25 bp, Homo sapien
agataactctgtaattaagtggagc

SEQ ID NO: 20597 - DNA, 25 bp, Homo sapien
agataactggataaacaaagtctca

SEQ ID NO: 20598 - DNA, 25 bp, Homo sapien
agataactggcagtgttcctggaag

SEQ ID NO: 20599 - DNA, 25 bp, Homo sapien
agataacttagtgaaagttaagata

SEQ ID NO: 20600 - DNA, 25 bp, Homo sapien
agataacttagtgaaatttaagata

SEQ ID NO: 20601 - DNA, 25 bp, Homo sapien
agataagaccagccctactttataa

SEQ ID NO: 20602 - DNA, 25 bp, Homo sapien
agataagacgagccctactttataa

SEQ ID NO: 20603 - DNA, 25 bp, Homo sapien
agataagcctgtgctttccttaaac

SEQ ID NO: 20604 - DNA, 25 bp, Homo sapien
agataagcctgtgttttccttaaac

SEQ ID NO: 20605 - DNA, 25 bp, Homo sapien
agataagttcatcaaaatagccagg

SEQ ID NO: 20606 - DNA, 25 bp, Homo sapien
agataagttcatcaaagtagccagg

SEQ ID NO: 20607 - DNA, 25 bp, Homo sapien
agataataacttcctagtctacatt

SEQ ID NO: 20608 - DNA, 25 bp, Homo sapien
agataataatttcctagtctacatt

SEQ ID NO: 20609 - DNA, 25 bp, Homo sapien
agataataggagccgaaattccata

SEQ ID NO: 20610 - DNA, 25 bp, Homo sapien
agataataggagctgaaattccata

SEQ ID NO: 20611 - DNA, 25 bp, Homo sapien
agataatccaggatattctccttat

SEQ ID NO: 20612 - DNA, 25 bp, Homo sapien
agataatccaggttattctccttat

SEQ ID NO: 20613 - DNA, 25 bp, Homo sapien
agataattcaatgaaagaaagaata

SEQ ID NO: 20614 - DNA, 25 bp, Homo sapien
agataattcaatgagagaaagaata

SEQ ID NO: 20615 - DNA, 25 bp, Homo sapien
agatacacagtattctcggtagtcc

SEQ ID NO: 20616 - DNA, 25 bp, Homo sapien
agatacacagtattcttggtagtcc

SEQ ID NO: 20617 - DNA, 25 bp, Homo sapien
agatacagctttgatcaaaacactc

SEQ ID NO: 20618 - DNA, 25 bp, Homo sapien
agatacagctttgatcgaaacactc

SEQ ID NO: 20619 - DNA, 25 bp, Homo sapien
agatacaggtacttgtttttctgtg

SEQ ID NO: 20620 - DNA, 25 bp, Homo sapien
agatacaggtatttgtttttctgtg

SEQ ID NO: 20621 - DNA, 25 bp, Homo sapien
agatacatttgaattttataccaca

SEQ ID NO: 20622 - DNA, 25 bp, Homo sapien
agatacatttggattttataccaca

SEQ ID NO: 20623 - DNA, 25 bp, Homo sapien
agataccaaagacaaagttaacaga

SEQ ID NO: 20624 - DNA, 25 bp, Homo sapien
agataccaaagataaagttaacaga

SEQ ID NO: 20625 - DNA, 25 bp, Homo sapien
agataccacgctgcaaagtctcttg

SEQ ID NO: 20626 - DNA, 25 bp, Homo sapien
agataccatgctgcaaagtctcttg

SEQ ID NO: 20627 - DNA, 25 bp, Homo sapien
agatacccactgaaatttgagaccc

SEQ ID NO: 20628 - DNA, 25 bp, Homo sapien
agatacccactggaatttgagaccc

SEQ ID NO: 20629 - DNA, 25 bp, Homo sapien
agatacctggctcaatacattactg

SEQ ID NO: 20630 - DNA, 25 bp, Homo sapien
agatacctggctcaatccattactg

SEQ ID NO: 20631 - DNA, 25 bp, Homo sapien
agatacctgtgtccatgtaagttat

SEQ ID NO: 20632 - DNA, 25 bp, Homo sapien
agatacctgtgtccctgtaagttat

SEQ ID NO: 20633 - DNA, 25 bp, Homo sapien
agatactccgccttttgtaaaataa

SEQ ID NO: 20634 - DNA, 25 bp, Homo sapien
agatactcggtctccttaattcagg

SEQ ID NO: 20635 - DNA, 25 bp, Homo sapien
agatactcggtcttcttaattcagg

SEQ ID NO: 20636 - DNA, 25 bp, Homo sapien
agatactctcaccataggtaacttg

SEQ ID NO: 20637 - DNA, 25 bp, Homo sapien
agatactctcactataggtaacttg

SEQ ID NO: 20638 - DNA, 25 bp, Homo sapien
agatactctgccttttgtaaaataa

SEQ ID NO: 20639 - DNA, 25 bp, Homo sapien
agatactgagccttcaatcttctaa

SEQ ID NO: 20640 - DNA, 25 bp, Homo sapien
agatactgagccttcagtcttctaa

SEQ ID NO: 20641 - DNA, 25 bp, Homo sapien
agatactgcctgccattctccaggg

SEQ ID NO: 20642 - DNA, 25 bp, Homo sapien
agatactgcctgctattctccaggg

SEQ ID NO: 20643 - DNA, 25 bp, Homo sapien
agatactgggttttccgtccaacag

SEQ ID NO: 20644 - DNA, 25 bp, Homo sapien
agatactgtgttttccgtccaacag

SEQ ID NO: 20645 - DNA, 25 bp, Homo sapien
agatacttataggaaagagactttc

SEQ ID NO: 20646 - DNA, 25 bp, Homo sapien
agatacttcattcgaccattttaat

SEQ ID NO: 20647 - DNA, 25 bp, Homo sapien
agatacttcatttgaccattttaat

SEQ ID NO: 20648 - DNA, 25 bp, Homo sapien
agatacttctaggaaagagactttc

SEQ ID NO: 20649 - DNA, 25 bp, Homo sapien
agatacttctcttttattgtgcaat

SEQ ID NO: 20650 - DNA, 25 bp, Homo sapien
agatactttcttactcccttgacgg

SEQ ID NO: 20651 - DNA, 25 bp, Homo sapien
agatactttcttactctcttgacgg

SEQ ID NO: 20652 - DNA, 25 bp, Homo sapien
agatactttgacaaaagtgccacaa

SEQ ID NO: 20653 - DNA, 25 bp, Homo sapien
agatactttgacagaagtgccacaa

SEQ ID NO: 20654 - DNA, 25 bp, Homo sapien
agatacttttcttttattgtgcaat

SEQ ID NO: 20655 - DNA, 25 bp, Homo sapien
agatagaatcacagcaaccttaggt

SEQ ID NO: 20656 - DNA, 25 bp, Homo sapien
agatagaatcatagcaaccttaggt

SEQ ID NO: 20657 - DNA, 25 bp, Homo sapien
agatagacaaggagatgaagtgcgg

SEQ ID NO: 20658 - DNA, 25 bp, Homo sapien
agatagaccgaggttctggtggcaa

SEQ ID NO: 20659 - DNA, 25 bp, Homo sapien
agatagacgaggagatgaagtgcgg

SEQ ID NO: 20660 - DNA, 25 bp, Homo sapien
agatagactgaggttctggtggcaa

SEQ ID NO: 20661 - DNA, 25 bp, Homo sapien
agatagagattttcggttttatcca

SEQ ID NO: 20662 - DNA, 25 bp, Homo sapien
agatagagatttttggttttatcca

SEQ ID NO: 20663 - DNA, 25 bp, Homo sapien
agatagagcagagcgcaaggaatga

SEQ ID NO: 20664 - DNA, 25 bp, Homo sapien
agatagagcagagtgcaaggaatga

SEQ ID NO: 20665 - DNA, 25 bp, Homo sapien
agatagagcctttcaagaaatgact

SEQ ID NO: 20666 - DNA, 25 bp, Homo sapien
agatagaggctttcaagaaatgact

SEQ ID NO: 20667 - DNA, 25 bp, Homo sapien
agatagagtgcacagtatgttcaaa

SEQ ID NO: 20668 - DNA, 25 bp, Homo sapien
agatagagtgcacagtgtgttcaaa

SEQ ID NO: 20669 - DNA, 25 bp, Homo sapien
agatagagttgtcatttttagggag

SEQ ID NO: 20670 - DNA, 25 bp, Homo sapien
agatagagttgtcgtttttagggag

SEQ ID NO: 20671 - DNA, 25 bp, Homo sapien
agatagataaaaggaggaatcccta

SEQ ID NO: 20672 - DNA, 25 bp, Homo sapien
agatagataaaatgaggaatcccta

SEQ ID NO: 20673 - DNA, 25 bp, Homo sapien
agatagatacaaccatggagtccta

SEQ ID NO: 20674 - DNA, 25 bp, Homo sapien
agatagatagatacaaccatggagt

SEQ ID NO: 20675 - DNA, 25 bp, Homo sapien
agatagatagatataaccatggagt

SEQ ID NO: 20676 - DNA, 25 bp, Homo sapien
agatagatataaccatggagtccta

SEQ ID NO: 20677 - DNA, 25 bp, Homo sapien
agatagatcatagatgacagatatg

SEQ ID NO: 20678 - DNA, 25 bp, Homo sapien
agatagatcatagttgacagatatg

SEQ ID NO: 20679 - DNA, 25 bp, Homo sapien
agatagatgacagaataagaaacaa

SEQ ID NO: 20680 - DNA, 25 bp, Homo sapien
agatagatgacaggataagaaacaa

SEQ ID NO: 20681 - DNA, 25 bp, Homo sapien
agatagatgcggctaccgtgggata

SEQ ID NO: 20682 - DNA, 25 bp, Homo sapien
agatagatgcggctactgtgggata

SEQ ID NO: 20683 - DNA, 25 bp, Homo sapien
agatagatgcttatttatgaccttt

SEQ ID NO: 20684 - DNA, 25 bp, Homo sapien
agatagatgcttatttgtgaccttt

SEQ ID NO: 20685 - DNA, 25 bp, Homo sapien
agatagatggacatcgagatagagc

SEQ ID NO: 20686 - DNA, 25 bp, Homo sapien
agatagatggatatcgagatagagc

SEQ ID NO: 20687 - DNA, 25 bp, Homo sapien
agatagcctacaggacccaaaagga

SEQ ID NO: 20688 - DNA, 25 bp, Homo sapien
agatagcctacgggacccaaaagga

SEQ ID NO: 20689 - DNA, 25 bp, Homo sapien
agatagccttacgtttctttttgtt

SEQ ID NO: 20690 - DNA, 25 bp, Homo sapien
agatagccttatgtttctttttgtt

SEQ ID NO: 20691 - DNA, 25 bp, Homo sapien
agatagctcttggtctccaatgttc

SEQ ID NO: 20692 - DNA, 25 bp, Homo sapien
agatagctggcaggctaaaattgca

SEQ ID NO: 20693 - DNA, 25 bp, Homo sapien
agatagctggcatgctaaaattgca

SEQ ID NO: 20694 - DNA, 25 bp, Homo sapien
agatagctgttggtctccaatgttc

SEQ ID NO: 20695 - DNA, 25 bp, Homo sapien
agataggaacaattttcagtggatt

SEQ ID NO: 20696 - DNA, 25 bp, Homo sapien
agataggaccaattttcagtggatt

SEQ ID NO: 20697 - DNA, 25 bp, Homo sapien
agataggctctttgaaaatatgcaa

SEQ ID NO: 20698 - DNA, 25 bp, Homo sapien
agataggctgtttgaaaatatgcaa

SEQ ID NO: 20699 - DNA, 25 bp, Homo sapien
agatagggttgtagtccaattatgt

SEQ ID NO: 20700 - DNA, 25 bp, Homo sapien
agatagggttgttgtccaattatgt

SEQ ID NO: 20701 - DNA, 25 bp, Homo sapien
agataggtgaggcagatgacagtgt

SEQ ID NO: 20702 - DNA, 25 bp, Homo sapien
agataggtgaggcggatgacagtgt

SEQ ID NO: 20703 - DNA, 25 bp, Homo sapien
agatagtagacataaaacaacttcc

SEQ ID NO: 20704 - DNA, 25 bp, Homo sapien
agatagtagtcataaaacaacttcc

SEQ ID NO: 20705 - DNA, 25 bp, Homo sapien
agatagtgagattactaggtttgct

SEQ ID NO: 20706 - DNA, 25 bp, Homo sapien
agatagtgagattactgggtttgct

SEQ ID NO: 20707 - DNA, 25 bp, Homo sapien
agatagtgttagaaactgggaatct

SEQ ID NO: 20708 - DNA, 25 bp, Homo sapien
agatagtgttagagactgggaatct

SEQ ID NO: 20709 - DNA, 25 bp, Homo sapien
agatagttgcagagaggtggagata

SEQ ID NO: 20710 - DNA, 25 bp, Homo sapien
agatagttgtagagaggtggagata

SEQ ID NO: 20711 - DNA, 25 bp, Homo sapien
agatataagacgaagttcaaatgat

SEQ ID NO: 20712 - DNA, 25 bp, Homo sapien
agatataagccgaagttcaaatgat

SEQ ID NO: 20713 - DNA, 25 bp, Homo sapien
agatataatggataccggaagcttt

SEQ ID NO: 20714 - DNA, 25 bp, Homo sapien
agatataatggattccggaagcttt

SEQ ID NO: 20715 - DNA, 25 bp, Homo sapien
agatatatataagatagcatcaata

SEQ ID NO: 20716 - DNA, 25 bp, Homo sapien
agatatatatacgatagcatcaata

SEQ ID NO: 20717 - DNA, 25 bp, Homo sapien
agatatattagagaaaaaaatgtct

SEQ ID NO: 20718 - DNA, 25 bp, Homo sapien
agatatattagggaaaaaaatgtct

SEQ ID NO: 20719 - DNA, 25 bp, Homo sapien
agatatcacaatactcacaatctct

SEQ ID NO: 20720 - DNA, 25 bp, Homo sapien
agatatcagaatactcacaatctct

SEQ ID NO: 20721 - DNA, 25 bp, Homo sapien
agatatcagttaatcggtaatatct

SEQ ID NO: 20722 - DNA, 25 bp, Homo sapien
agatatcagttaattggtaatatct

SEQ ID NO: 20723 - DNA, 25 bp, Homo sapien
agatatcctcacagtactcattctc

SEQ ID NO: 20724 - DNA, 25 bp, Homo sapien
agatatcctcacggtactcattctc

SEQ ID NO: 20725 - DNA, 25 bp, Homo sapien
agatatcctctaagagaactttcag

SEQ ID NO: 20726 - DNA, 25 bp, Homo sapien
agatatcctctaagggaactttcag

SEQ ID NO: 20727 - DNA, 25 bp, Homo sapien
agatatgaacagcaaatgtttgttt

SEQ ID NO: 20728 - DNA, 25 bp, Homo sapien
agatatgaatagcaaatgtttgttt

SEQ ID NO: 20729 - DNA, 25 bp, Homo sapien
agatatgatttcagttgggccagtt

SEQ ID NO: 20730 - DNA, 25 bp, Homo sapien
agatatgatttcatttgggccagtt

SEQ ID NO: 20731 - DNA, 25 bp, Homo sapien
agatatgtaagtttgacgtgaagtg

SEQ ID NO: 20732 - DNA, 25 bp, Homo sapien
agatatgtaagtttgaggtgaagtg

SEQ ID NO: 20733 - DNA, 25 bp, Homo sapien
agatattaggctgccatatgatcca

SEQ ID NO: 20734 - DNA, 25 bp, Homo sapien
agatattaggcttccatatgatcca

SEQ ID NO: 20735 - DNA, 25 bp, Homo sapien
agatattcacattatctgtagatat

SEQ ID NO: 20736 - DNA, 25 bp, Homo sapien
agatattcgcattatctgtagatat

SEQ ID NO: 20737 - DNA, 25 bp, Homo sapien
agatattctaaaacagactgaatga

SEQ ID NO: 20738 - DNA, 25 bp, Homo sapien
agatattctaacacagactgaatga

SEQ ID NO: 20739 - DNA, 25 bp, Homo sapien
agatattctgtgacagtagcccaaa

SEQ ID NO: 20740 - DNA, 25 bp, Homo sapien
agatattctgtgatagtagcccaaa

SEQ ID NO: 20741 - DNA, 25 bp, Homo sapien
agatattgatgtattagtagacctt

SEQ ID NO: 20742 - DNA, 25 bp, Homo sapien
agatattgctaaagagaagtagctg

SEQ ID NO: 20743 - DNA, 25 bp, Homo sapien
agatattgctaaggagaagtagctg

SEQ ID NO: 20744 - DNA, 25 bp, Homo sapien
agatattgggtgcttattccctggc

SEQ ID NO: 20745 - DNA, 25 bp, Homo sapien
agatattgggtgtttattccctggc

SEQ ID NO: 20746 - DNA, 25 bp, Homo sapien
agatattggtgtattagtagacctt

SEQ ID NO: 20747 - DNA, 25 bp, Homo sapien
agatatttacagagaccaacagcaa

SEQ ID NO: 20748 - DNA, 25 bp, Homo sapien
agatatttacagaggccaacagcaa

SEQ ID NO: 20749 - DNA, 25 bp, Homo sapien
agatatttaccaaagggattcttta

SEQ ID NO: 20750 - DNA, 25 bp, Homo sapien
agatatttaccgaagggattcttta

SEQ ID NO: 20751 - DNA, 25 bp, Homo sapien
agatcaaaacacagtgtgcctttgt

SEQ ID NO: 20752 - DNA, 25 bp, Homo sapien
agatcaaaacagagtgtgcctttgt

SEQ ID NO: 20753 - DNA, 25 bp, Homo sapien
agatcaaaacctgaaatgatcaaat

SEQ ID NO: 20754 - DNA, 25 bp, Homo sapien
agatcaaagaacaactgaatggaat

SEQ ID NO: 20755 - DNA, 25 bp, Homo sapien
agatcaaagaaccactgaatggaat

SEQ ID NO: 20756 - DNA, 25 bp, Homo sapien
agatcaaagagcaagctaaacagtc

SEQ ID NO: 20757 - DNA, 25 bp, Homo sapien
agatcaaagagcgagctaaacagtc

SEQ ID NO: 20758 - DNA, 25 bp, Homo sapien
agatcaaagcctgaaatgatcaaat

SEQ ID NO: 20759 - DNA, 25 bp, Homo sapien
agatcaaccttgaagtgacatacaa

SEQ ID NO: 20760 - DNA, 25 bp, Homo sapien
agatcaacctttaagtgacatacaa

SEQ ID NO: 20761 - DNA, 25 bp, Homo sapien
agatcaagataaaacgaaaaactca

SEQ ID NO: 20762 - DNA, 25 bp, Homo sapien
agatcaaggtaaaacgaaaaactca

SEQ ID NO: 20763 - DNA, 25 bp, Homo sapien
agatcaataaccagtgtgatgtcag

SEQ ID NO: 20764 - DNA, 25 bp, Homo sapien
agatcaataccaatgtatctcatat

SEQ ID NO: 20765 - DNA, 25 bp, Homo sapien
agatcaatagccagtgtgatgtcag

SEQ ID NO: 20766 - DNA, 25 bp, Homo sapien
agatcaatatcaatgtatctcatat

SEQ ID NO: 20767 - DNA, 25 bp, Homo sapien
agatcaatatccctacatggaactc

SEQ ID NO: 20768 - DNA, 25 bp, Homo sapien
agatcaatatccctgcatggaactc

SEQ ID NO: 20769 - DNA, 25 bp, Homo sapien
agatcaatgaagaaagtttccaagg

SEQ ID NO: 20770 - DNA, 25 bp, Homo sapien
agatcaatgaaggaagtttccaagg

SEQ ID NO: 20771 - DNA, 25 bp, Homo sapien
agatcacataattactaaaaactgt

SEQ ID NO: 20772 - DNA, 25 bp, Homo sapien
agatcacataattactgaaaactgt

SEQ ID NO: 20773 - DNA, 25 bp, Homo sapien
agatcactatactcctaaagaaata

SEQ ID NO: 20774 - DNA, 25 bp, Homo sapien
agatcactatactcgtaaagaaata

SEQ ID NO: 20775 - DNA, 25 bp, Homo sapien
agatcactgaagatttgagaaacat

SEQ ID NO: 20776 - DNA, 25 bp, Homo sapien
agatcactgaaggtttgagaaacat

SEQ ID NO: 20777 - DNA, 25 bp, Homo sapien
agatcagcaaagcgctgtaactatg

SEQ ID NO: 20778 - DNA, 25 bp, Homo sapien
agatcagcaaagtgctgtaactatg

SEQ ID NO: 20779 - DNA, 25 bp, Homo sapien
agatcagcattcctacttcaccaaa

SEQ ID NO: 20780 - DNA, 25 bp, Homo sapien
agatcagcattcttacttcaccaaa

SEQ ID NO: 20781 - DNA, 25 bp, Homo sapien
agatcaggaacctaatctaaccttg

SEQ ID NO: 20782 - DNA, 25 bp, Homo sapien
agatcaggaccctaatctaaccttg

SEQ ID NO: 20783 - DNA, 25 bp, Homo sapien
agatcaggacggaagcaaggctgtc

SEQ ID NO: 20784 - DNA, 25 bp, Homo sapien
agatcaggatggaagcaaggctgtc

SEQ ID NO: 20785 - DNA, 25 bp, Homo sapien
agatcaggctggttaggcagataag

SEQ ID NO: 20786 - DNA, 25 bp, Homo sapien
agatcaggttggttaggcagataag

SEQ ID NO: 20787 - DNA, 25 bp, Homo sapien
agatcagtctctggaacgtgggatc

SEQ ID NO: 20788 - DNA, 25 bp, Homo sapien
agatcagtctctggaatgtgggatc

SEQ ID NO: 20789 - DNA, 25 bp, Homo sapien
agatcagtctgttctcagttttctt

SEQ ID NO: 20790 - DNA, 25 bp, Homo sapien
agatcagtctgttctccgttttctt

SEQ ID NO: 20791 - DNA, 25 bp, Homo sapien
agatcatataaagcctttctactcc

SEQ ID NO: 20792 - DNA, 25 bp, Homo sapien
agatcatataaaggctttctactcc

SEQ ID NO: 20793 - DNA, 25 bp, Homo sapien
agatcatcacaaaactctttattct

SEQ ID NO: 20794 - DNA, 25 bp, Homo sapien
agatcatcacaagactctttattct

SEQ ID NO: 20795 - DNA, 25 bp, Homo sapien
agatcatctccaagttctgaaatgc

SEQ ID NO: 20796 - DNA, 25 bp, Homo sapien
agatcatctccatgttctgaaatgc

SEQ ID NO: 20797 - DNA, 25 bp, Homo sapien
agatcatgatcgggtaaagagattg

SEQ ID NO: 20798 - DNA, 25 bp, Homo sapien
agatcatgatcgtgtaaagagattg

SEQ ID NO: 20799 - DNA, 25 bp, Homo sapien
agatcattaactcaggtctgactca

SEQ ID NO: 20800 - DNA, 25 bp, Homo sapien
agatcattaactcgggtctgactca

SEQ ID NO: 20801 - DNA, 25 bp, Homo sapien
agatcattgcaggaaaggaagaaac

SEQ ID NO: 20802 - DNA, 25 bp, Homo sapien
agatcattgcagggaaggaagaaac

SEQ ID NO: 20803 - DNA, 25 bp, Homo sapien
agatccaaaatgccatagaaaataa

SEQ ID NO: 20804 - DNA, 25 bp, Homo sapien
agatccaaagtgccatagaaaataa

SEQ ID NO: 20805 - DNA, 25 bp, Homo sapien
agatccaaagttttcgtgcaaaatg

SEQ ID NO: 20806 - DNA, 25 bp, Homo sapien
agatccaaagtttttgtgcaaaatg

SEQ ID NO: 20807 - DNA, 25 bp, Homo sapien
agatccccaagtgaccaatttgcac

SEQ ID NO: 20808 - DNA, 25 bp, Homo sapien
agatccccaagtgaccgatttgcac

SEQ ID NO: 20809 - DNA, 25 bp, Homo sapien
agatccctcacttggagatgtggta

SEQ ID NO: 20810 - DNA, 25 bp, Homo sapien
agatccctcgcttggagatgtggta

SEQ ID NO: 20811 - DNA, 25 bp, Homo sapien
agatcccttacaaatggcttggtgc

SEQ ID NO: 20812 - DNA, 25 bp, Homo sapien
agatcccttacgaatggcttggtgc

SEQ ID NO: 20813 - DNA, 25 bp, Homo sapien
agatcccttagaacagactagaaaa

SEQ ID NO: 20814 - DNA, 25 bp, Homo sapien
agatcccttagaacggactagaaaa

SEQ ID NO: 20815 - DNA, 25 bp, Homo sapien
agatcctcacattcattccctgata

SEQ ID NO: 20816 - DNA, 25 bp, Homo sapien
agatcctcagattcattccctgata

SEQ ID NO: 20817 - DNA, 25 bp, Homo sapien
agatcctcagggactatacaaaaga

SEQ ID NO: 20818 - DNA, 25 bp, Homo sapien
agatcctcagggtctatacaaaaga

SEQ ID NO: 20819 - DNA, 25 bp, Homo sapien
agatcctcatgattttaccaaagat

SEQ ID NO: 20820 - DNA, 25 bp, Homo sapien
agatcctcgtgattttaccaaagat

SEQ ID NO: 20821 - DNA, 25 bp, Homo sapien
agatcctgatgacacgtgcacaagg

SEQ ID NO: 20822 - DNA, 25 bp, Homo sapien
agatcctgatgacatgtgcacaagg

SEQ ID NO: 20823 - DNA, 25 bp, Homo sapien
agatcctgccagattgcaccttatt

SEQ ID NO: 20824 - DNA, 25 bp, Homo sapien
agatcctgccagtttgcaccttatt

SEQ ID NO: 20825 - DNA, 25 bp, Homo sapien
agatccttaatatcatcacatctgt

SEQ ID NO: 20826 - DNA, 25 bp, Homo sapien
agatccttaatgtcatcacatctgt

SEQ ID NO: 20827 - DNA, 25 bp, Homo sapien
agatcgctaaatgtcttagattgtc

SEQ ID NO: 20828 - DNA, 25 bp, Homo sapien
agatcgcttaatgtcttagattgtc

SEQ ID NO: 20829 - DNA, 25 bp, Homo sapien
agatctaaatgaagaaaatgatttg

SEQ ID NO: 20830 - DNA, 25 bp, Homo sapien
agatctaaatgaggaaaatgatttg

SEQ ID NO: 20831 - DNA, 25 bp, Homo sapien
agatctataccaattcccacaggtt

SEQ ID NO: 20832 - DNA, 25 bp, Homo sapien
agatctataccagttcccacaggtt

SEQ ID NO: 20833 - DNA, 25 bp, Homo sapien
agatctcacacatacgtagttcaca

SEQ ID NO: 20834 - DNA, 25 bp, Homo sapien
agatctcacacatatgtagttcaca

SEQ ID NO: 20835 - DNA, 25 bp, Homo sapien
agatctcagcgcagctcctgctgtg

SEQ ID NO: 20836 - DNA, 25 bp, Homo sapien
agatctcagtgcagctcctgctgtg

SEQ ID NO: 20837 - DNA, 25 bp, Homo sapien
agatctccaggaaaatattgccttc

SEQ ID NO: 20838 - DNA, 25 bp, Homo sapien
agatctccaggaaaatgttgccttc

SEQ ID NO: 20839 - DNA, 25 bp, Homo sapien
agatctccttgccctagcctaggaa

SEQ ID NO: 20840 - DNA, 25 bp, Homo sapien
agatctccttgcgctagcctaggaa

SEQ ID NO: 20841 - DNA, 25 bp, Homo sapien
agatctctagcaatctttccctctt

SEQ ID NO: 20842 - DNA, 25 bp, Homo sapien
agatctctagcagtctttccctctt

SEQ ID NO: 20843 - DNA, 25 bp, Homo sapien
agatctctttctactgtggatgaag

SEQ ID NO: 20844 - DNA, 25 bp, Homo sapien
agatctctttctattgtggatgaag

SEQ ID NO: 20845 - DNA, 25 bp, Homo sapien
agatctgaagagaacactggaaaag

SEQ ID NO: 20846 - DNA, 25 bp, Homo sapien
agatctgaagagaacattggaaaag

SEQ ID NO: 20847 - DNA, 25 bp, Homo sapien
agatctgaatttgagctctagttgc

SEQ ID NO: 20848 - DNA, 25 bp, Homo sapien
agatctgaatttgcgctctagttgc

SEQ ID NO: 20849 - DNA, 25 bp, Homo sapien
agatctgactgttacggagaaaaga

SEQ ID NO: 20850 - DNA, 25 bp, Homo sapien
agatctgactgttatggagaaaaga

SEQ ID NO: 20851 - DNA, 25 bp, Homo sapien
agatctgatgaaacccagcgtgttt

SEQ ID NO: 20852 - DNA, 25 bp, Homo sapien
agatctgatgaagcccagcgtgttt

SEQ ID NO: 20853 - DNA, 25 bp, Homo sapien
agatctgcaacgtctcaacagggta

SEQ ID NO: 20854 - DNA, 25 bp, Homo sapien
agatctgcagcgtctcaacagggta

SEQ ID NO: 20855 - DNA, 25 bp, Homo sapien
agatctgcatgcctctatattgtta

SEQ ID NO: 20856 - DNA, 25 bp, Homo sapien
agatctgcatgtctctatattgtta

SEQ ID NO: 20857 - DNA, 25 bp, Homo sapien
agatctgcccaagttgctgtaggta

SEQ ID NO: 20858 - DNA, 25 bp, Homo sapien
agatctgcccaagttgttgtaggta

SEQ ID NO: 20859 - DNA, 25 bp, Homo sapien
agatctggacatcatcagtgccagc

SEQ ID NO: 20860 - DNA, 25 bp, Homo sapien
agatctggacattatcagtgccagc

SEQ ID NO: 20861 - DNA, 25 bp, Homo sapien
agatctgtggaagagaactgagaaa

SEQ ID NO: 20862 - DNA, 25 bp, Homo sapien
agatctgtggaagggaactgagaaa

SEQ ID NO: 20863 - DNA, 25 bp, Homo sapien
agatcttaaccacattgccaactgg

SEQ ID NO: 20864 - DNA, 25 bp, Homo sapien
agatcttaaccatattgccaactgg

SEQ ID NO: 20865 - DNA, 25 bp, Homo sapien
agatcttacggatttatgagatcca

SEQ ID NO: 20866 - DNA, 25 bp, Homo sapien
agatcttatggatttatgagatcca

SEQ ID NO: 20867 - DNA, 25 bp, Homo sapien
agatcttattatcaggcatatatgc

SEQ ID NO: 20868 - DNA, 25 bp, Homo sapien
agatcttattatgaggcatatatgc

SEQ ID NO: 20869 - DNA, 25 bp, Homo sapien
agatcttcaccggactggcttcctc

SEQ ID NO: 20870 - DNA, 25 bp, Homo sapien
agatcttcacctgactggcttcctc

SEQ ID NO: 20871 - DNA, 25 bp, Homo sapien
agatcttgcaagcactcactcgcta

SEQ ID NO: 20872 - DNA, 25 bp, Homo sapien
agatcttgcgagcactcactcgcta

SEQ ID NO: 20873 - DNA, 25 bp, Homo sapien
agatcttgtactttaaactctggcc

SEQ ID NO: 20874 - DNA, 25 bp, Homo sapien
agatcttgtgctttaaactctggcc

SEQ ID NO: 20875 - DNA, 25 bp, Homo sapien
agatctttacaagacctgagccata

SEQ ID NO: 20876 - DNA, 25 bp, Homo sapien
agatctttacaagagctgagccata

SEQ ID NO: 20877 - DNA, 25 bp, Homo sapien
agatctttcatatatattgtgtcat

SEQ ID NO: 20878 - DNA, 25 bp, Homo sapien
agatctttcctatatattgtgtcat

SEQ ID NO: 20879 - DNA, 25 bp, Homo sapien
agatgaaaacagaattcctagtact

SEQ ID NO: 20880 - DNA, 25 bp, Homo sapien
agatgaaaagaatcactcctatttc

SEQ ID NO: 20881 - DNA, 25 bp, Homo sapien
agatgaaaagagaattcctagtact

SEQ ID NO: 20882 - DNA, 25 bp, Homo sapien
agatgaaacaagctgtgcatggcag

SEQ ID NO: 20883 - DNA, 25 bp, Homo sapien
agatgaaacaagttgtgcatggcag

SEQ ID NO: 20884 - DNA, 25 bp, Homo sapien
agatgaaacctacttctagttcgtg

SEQ ID NO: 20885 - DNA, 25 bp, Homo sapien
agatgaaacctagttctagttcgtg

SEQ ID NO: 20886 - DNA, 25 bp, Homo sapien
agatgaaacgaatcactctaactct

SEQ ID NO: 20887 - DNA, 25 bp, Homo sapien
agatgaaacgagtcactctaactct

SEQ ID NO: 20888 - DNA, 25 bp, Homo sapien
agatgaaacttccaccctacagatg

SEQ ID NO: 20889 - DNA, 25 bp, Homo sapien
agatgaaactttcaccctacagatg

SEQ ID NO: 20890 - DNA, 25 bp, Homo sapien
agatgaaaggaatcactcctatttc

SEQ ID NO: 20891 - DNA, 25 bp, Homo sapien
agatgaaatccataaaggtcagagc

SEQ ID NO: 20892 - DNA, 25 bp, Homo sapien
agatgaaatccatgaaggtcagagc

SEQ ID NO: 20893 - DNA, 25 bp, Homo sapien
agatgaactttaagtctagctgaca

SEQ ID NO: 20894 - DNA, 25 bp, Homo sapien
agatgaactttaattctagctgaca

SEQ ID NO: 20895 - DNA, 25 bp, Homo sapien
agatgaagacattcaacttgataaa

SEQ ID NO: 20896 - DNA, 25 bp, Homo sapien
agatgaagatattcaacttgataaa

SEQ ID NO: 20897 - DNA, 25 bp, Homo sapien
agatgaagattcaggcattacctgc

SEQ ID NO: 20898 - DNA, 25 bp, Homo sapien
agatgaaggttcaggcattacctgc

SEQ ID NO: 20899 - DNA, 25 bp, Homo sapien
agatgaatactcaccctgtatgtgt

SEQ ID NO: 20900 - DNA, 25 bp, Homo sapien
agatgaatatatacaaatctatgaa

SEQ ID NO: 20901 - DNA, 25 bp, Homo sapien
agatgaatattcaccctgtatgtgt

SEQ ID NO: 20902 - DNA, 25 bp, Homo sapien
agatgaatccacacaaagcaaagca

SEQ ID NO: 20903 - DNA, 25 bp, Homo sapien
agatgaatccacacaaggcaaagca

SEQ ID NO: 20904 - DNA, 25 bp, Homo sapien
agatgaatgtatacaaatctatgaa

SEQ ID NO: 20905 - DNA, 25 bp, Homo sapien
agatgacaaagatcaatcactttct

SEQ ID NO: 20906 - DNA, 25 bp, Homo sapien
agatgacaaaggtcaatcactttct

SEQ ID NO: 20907 - DNA, 25 bp, Homo sapien
agatgacaataagtaacaatgaatg

SEQ ID NO: 20908 - DNA, 25 bp, Homo sapien
agatgacacaattattttagagaag

SEQ ID NO: 20909 - DNA, 25 bp, Homo sapien
agatgacagaataagaaacaagaat

SEQ ID NO: 20910 - DNA, 25 bp, Homo sapien
agatgacagaattattttagagaag

SEQ ID NO: 20911 - DNA, 25 bp, Homo sapien
agatgacaggataagaaacaagaat

SEQ ID NO: 20912 - DNA, 25 bp, Homo sapien
agatgacagtaagtaacaatgaatg

SEQ ID NO: 20913 - DNA, 25 bp, Homo sapien
agatgacctcatcacgcatttctta

SEQ ID NO: 20914 - DNA, 25 bp, Homo sapien
agatgacctcatcatgcatttctta

SEQ ID NO: 20915 - DNA, 25 bp, Homo sapien
agatgactacagatgccataagcct

SEQ ID NO: 20916 - DNA, 25 bp, Homo sapien
agatgactatagatgccataagcct

SEQ ID NO: 20917 - DNA, 25 bp, Homo sapien
agatgacttcagatacagaaatctt

SEQ ID NO: 20918 - DNA, 25 bp, Homo sapien
agatgacttcaggtacagaaatctt

SEQ ID NO: 20919 - DNA, 25 bp, Homo sapien
agatgagacaaaaatgtttactgtg

SEQ ID NO: 20920 - DNA, 25 bp, Homo sapien
agatgagaccaaaatgtttactgtg

SEQ ID NO: 20921 - DNA, 25 bp, Homo sapien
agatgagactgtgtacattgaactt

SEQ ID NO: 20922 - DNA, 25 bp, Homo sapien
agatgagactgtgtacgttgaactt

SEQ ID NO: 20923 - DNA, 25 bp, Homo sapien
agatgagagctacaggcatcctttc

SEQ ID NO: 20924 - DNA, 25 bp, Homo sapien
agatgagagctagaggcatcctttc

SEQ ID NO: 20925 - DNA, 25 bp, Homo sapien
agatgagattagcaaacaaaagtgt

SEQ ID NO: 20926 - DNA, 25 bp, Homo sapien
agatgagattaggaaacaaaagtgt

SEQ ID NO: 20927 - DNA, 25 bp, Homo sapien
agatgaggaaaccaagttatggtct

SEQ ID NO: 20928 - DNA, 25 bp, Homo sapien
agatgaggaaaccgagttatggtct

SEQ ID NO: 20929 - DNA, 25 bp, Homo sapien
agatgaggatacaaagcagagcatg

SEQ ID NO: 20930 - DNA, 25 bp, Homo sapien
agatgaggatacgaagcagagcatg

SEQ ID NO: 20931 - DNA, 25 bp, Homo sapien
agatgaggcctttttgctctctgca

SEQ ID NO: 20932 - DNA, 25 bp, Homo sapien
agatgaggcctttttgttctctgca

SEQ ID NO: 20933 - DNA, 25 bp, Homo sapien
agatgagtacaaactatctacagca

SEQ ID NO: 20934 - DNA, 25 bp, Homo sapien
agatgagtacaaattatctacagca

SEQ ID NO: 20935 - DNA, 25 bp, Homo sapien
agatgagtcactctgaccattgaag

SEQ ID NO: 20936 - DNA, 25 bp, Homo sapien
agatgagtcactgtgaccattgaag

SEQ ID NO: 20937 - DNA, 25 bp, Homo sapien
agatgagttcctgacaggttactgg

SEQ ID NO: 20938 - DNA, 25 bp, Homo sapien
agatgagttcctgataggttactgg

SEQ ID NO: 20939 - DNA, 25 bp, Homo sapien
agatgataatgaagcattcctggcc

SEQ ID NO: 20940 - DNA, 25 bp, Homo sapien
agatgataatgaagtattcctggcc

SEQ ID NO: 20941 - DNA, 25 bp, Homo sapien
agatgatactcccaaaacttaggta

SEQ ID NO: 20942 - DNA, 25 bp, Homo sapien
agatgatactcctaaaacttaggta

SEQ ID NO: 20943 - DNA, 25 bp, Homo sapien
agatgatagcatctcatctgcagcc

SEQ ID NO: 20944 - DNA, 25 bp, Homo sapien
agatgatagcatgtcatctgcagcc

SEQ ID NO: 20945 - DNA, 25 bp, Homo sapien
agatgatagttaagatttgatgtag

SEQ ID NO: 20946 - DNA, 25 bp, Homo sapien
agatgatatcttgattttcaagtct

SEQ ID NO: 20947 - DNA, 25 bp, Homo sapien
agatgatatttaagatttgatgtag

SEQ ID NO: 20948 - DNA, 25 bp, Homo sapien
agatgatattttgattttcaagtct

SEQ ID NO: 20949 - DNA, 25 bp, Homo sapien
agatgatcagctaattccacaaata

SEQ ID NO: 20950 - DNA, 25 bp, Homo sapien
agatgatcagctagttccacaaata

SEQ ID NO: 20951 - DNA, 25 bp, Homo sapien
agatgatccgtcacaaccacacggc

SEQ ID NO: 20952 - DNA, 25 bp, Homo sapien
agatgatctgtcacaaccacacggc

SEQ ID NO: 20953 - DNA, 25 bp, Homo sapien
agatgatgtttatatttccatgtaa

SEQ ID NO: 20954 - DNA, 25 bp, Homo sapien
agatgatgtttgtatttccatgtaa

SEQ ID NO: 20955 - DNA, 25 bp, Homo sapien
agatgattcgatttgcatttgatgg

SEQ ID NO: 20956 - DNA, 25 bp, Homo sapien
agatgatttacaggcttttggcttg

SEQ ID NO: 20957 - DNA, 25 bp, Homo sapien
agatgatttacaggtttttggcttg

SEQ ID NO: 20958 - DNA, 25 bp, Homo sapien
agatgatttattgtatcactgctat

SEQ ID NO: 20959 - DNA, 25 bp, Homo sapien
agatgatttattttatcactgctat

SEQ ID NO: 20960 - DNA, 25 bp, Homo sapien
agatgatttcgggaatgattttttg

SEQ ID NO: 20961 - DNA, 25 bp, Homo sapien
agatgatttgaacagccatgccaat

SEQ ID NO: 20962 - DNA, 25 bp, Homo sapien
agatgatttgagcagccatgccaat

SEQ ID NO: 20963 - DNA, 25 bp, Homo sapien
agatgatttgatttgcatttgatgg

SEQ ID NO: 20964 - DNA, 25 bp, Homo sapien
agatgattttgcttgtccttagata

SEQ ID NO: 20965 - DNA, 25 bp, Homo sapien
agatgattttgggaatgattttttg

SEQ ID NO: 20966 - DNA, 25 bp, Homo sapien
agatgattttggttgtccttagata

SEQ ID NO: 20967 - DNA, 25 bp, Homo sapien
agatgcaatatatacctgtaatcat

SEQ ID NO: 20968 - DNA, 25 bp, Homo sapien
agatgcaatatatatctgtaatcat

SEQ ID NO: 20969 - DNA, 25 bp, Homo sapien
agatgcactcatatttttgcataaa

SEQ ID NO: 20970 - DNA, 25 bp, Homo sapien
agatgcactcatgtttttgcataaa

SEQ ID NO: 20971 - DNA, 25 bp, Homo sapien
agatgcagatgccgttaaaactaag

SEQ ID NO: 20972 - DNA, 25 bp, Homo sapien
agatgcagatgctgttaaaactaag

SEQ ID NO: 20973 - DNA, 25 bp, Homo sapien
agatgcctatccagcctttccctgt

SEQ ID NO: 20974 - DNA, 25 bp, Homo sapien
agatgcctatccggcctttccctgt

SEQ ID NO: 20975 - DNA, 25 bp, Homo sapien
agatgcctatgtacgtggtatagct

SEQ ID NO: 20976 - DNA, 25 bp, Homo sapien
agatgcctatgtgcgtggtatagct

SEQ ID NO: 20977 - DNA, 25 bp, Homo sapien
agatgcctttgagaaaaatggtaac

SEQ ID NO: 20978 - DNA, 25 bp, Homo sapien
agatgcctttgaggaaaatggtaac

SEQ ID NO: 20979 - DNA, 25 bp, Homo sapien
agatgcggctaccgtgggataagaa

SEQ ID NO: 20980 - DNA, 25 bp, Homo sapien
agatgcggctactgtgggataagaa

SEQ ID NO: 20981 - DNA, 25 bp, Homo sapien
agatgctacagccactgcacaccca

SEQ ID NO: 20982 - DNA, 25 bp, Homo sapien
agatgctacagcgactgcacaccca

SEQ ID NO: 20983 - DNA, 25 bp, Homo sapien
agatgctatcgatgttgctagttgc

SEQ ID NO: 20984 - DNA, 25 bp, Homo sapien
agatgctattgatgttgctagttgc

SEQ ID NO: 20985 - DNA, 25 bp, Homo sapien
agatgctgaagtcagagtctacata

SEQ ID NO: 20986 - DNA, 25 bp, Homo sapien
agatgctgaagtcggagtctacata

SEQ ID NO: 20987 - DNA, 25 bp, Homo sapien
agatgctggagcctggaattcaaaa

SEQ ID NO: 20988 - DNA, 25 bp, Homo sapien
agatgctggagcctggcattcaaaa

SEQ ID NO: 20989 - DNA, 25 bp, Homo sapien
agatgcttatttatgaccttttaat

SEQ ID NO: 20990 - DNA, 25 bp, Homo sapien
agatgcttatttgtgaccttttaat

SEQ ID NO: 20991 - DNA, 25 bp, Homo sapien
agatgcttgcaaaggacaggtgtat

SEQ ID NO: 20992 - DNA, 25 bp, Homo sapien
agatgcttgtaaaggacaggtgtat

SEQ ID NO: 20993 - DNA, 25 bp, Homo sapien
agatgctttaaaggaatttatggaa

SEQ ID NO: 20994 - DNA, 25 bp, Homo sapien
agatgctttaaagtaatttatggaa

SEQ ID NO: 20995 - DNA, 25 bp, Homo sapien
agatgctttattcaaacgactggtt

SEQ ID NO: 20996 - DNA, 25 bp, Homo sapien
agatgctttattcaaatgactggtt

SEQ ID NO: 20997 - DNA, 25 bp, Homo sapien
agatgctttctgctctatctttagg

SEQ ID NO: 20998 - DNA, 25 bp, Homo sapien
agatgctttctggtctatctttagg

SEQ ID NO: 20999 - DNA, 25 bp, Homo sapien
agatggaaacagtcctcaataccca

SEQ ID NO: 21000 - DNA, 25 bp, Homo sapien
agatggaaacagtcctgaataccca

SEQ ID NO: 21001 - DNA, 25 bp, Homo sapien
agatggaaattttgctgtgagaatg

SEQ ID NO: 21002 - DNA, 25 bp, Homo sapien
agatggaaattttggtgtgagaatg

SEQ ID NO: 21003 - DNA, 25 bp, Homo sapien
agatggaaggaaactttttgcaagt

SEQ ID NO: 21004 - DNA, 25 bp, Homo sapien
agatggaaggaaattttttgcaagt

SEQ ID NO: 21005 - DNA, 25 bp, Homo sapien
agatggaattccaaagccaattcag

SEQ ID NO: 21006 - DNA, 25 bp, Homo sapien
agatggaattccgaagccaattcag

SEQ ID NO: 21007 - DNA, 25 bp, Homo sapien
agatggacaattcatcaggcctgaa

SEQ ID NO: 21008 - DNA, 25 bp, Homo sapien
agatggacgattcatcaggcctgaa

SEQ ID NO: 21009 - DNA, 25 bp, Homo sapien
agatggacttttcccgagaggctta

SEQ ID NO: 21010 - DNA, 25 bp, Homo sapien
agatggacttttcctgagaggctta

SEQ ID NO: 21011 - DNA, 25 bp, Homo sapien
agatggaggccaaaagactaagcca

SEQ ID NO: 21012 - DNA, 25 bp, Homo sapien
agatggaggtcaaaagactaagcca

SEQ ID NO: 21013 - DNA, 25 bp, Homo sapien
agatggcaattttcacaaagaaagt

SEQ ID NO: 21014 - DNA, 25 bp, Homo sapien
agatggcaggaagtaatctttctgc

SEQ ID NO: 21015 - DNA, 25 bp, Homo sapien
agatggcagttttcacaaagaaagt

SEQ ID NO: 21016 - DNA, 25 bp, Homo sapien
agatggcatgaagtaatctttctgc

SEQ ID NO: 21017 - DNA, 25 bp, Homo sapien
agatggctatgcaataggttccctt

SEQ ID NO: 21018 - DNA, 25 bp, Homo sapien
agatggctatgtaataggttccctt

SEQ ID NO: 21019 - DNA, 25 bp, Homo sapien
agatgggaatttttatttgagacag

SEQ ID NO: 21020 - DNA, 25 bp, Homo sapien
agatgggaatttttgtttgagacag

SEQ ID NO: 21021 - DNA, 25 bp, Homo sapien
agatgggctgctcgaaccttgtatg

SEQ ID NO: 21022 - DNA, 25 bp, Homo sapien
agatgggctgcttgaaccttgtatg

SEQ ID NO: 21023 - DNA, 25 bp, Homo sapien
agatggtcaacaacttcatattgac

SEQ ID NO: 21024 - DNA, 25 bp, Homo sapien
agatggtcagcaacttcatattgac

SEQ ID NO: 21025 - DNA, 25 bp, Homo sapien
agatggtcttgaatatacttcaaat

SEQ ID NO: 21026 - DNA, 25 bp, Homo sapien
agatggtcttgagtatacttcaaat

SEQ ID NO: 21027 - DNA, 25 bp, Homo sapien
agatggttatatagcagggctcact

SEQ ID NO: 21028 - DNA, 25 bp, Homo sapien
agatggttatattgcagggctcact

SEQ ID NO: 21029 - DNA, 25 bp, Homo sapien
agatggtttctcaggcctaatgatt

SEQ ID NO: 21030 - DNA, 25 bp, Homo sapien
agatggtttctcaggcttaatgatt

SEQ ID NO: 21031 - DNA, 25 bp, Homo sapien
agatggttttacaatgaaactgttc

SEQ ID NO: 21032 - DNA, 25 bp, Homo sapien
agatggttttacgatgaaactgttc

SEQ ID NO: 21033 - DNA, 25 bp, Homo sapien
agatgtaaagcttcattttttttcc

SEQ ID NO: 21034 - DNA, 25 bp, Homo sapien
agatgtaaagcttcgttttttttcc

SEQ ID NO: 21035 - DNA, 25 bp, Homo sapien
agatgtaaattacggacctcgagac

SEQ ID NO: 21036 - DNA, 25 bp, Homo sapien
agatgtaaattatggacctcgagac

SEQ ID NO: 21037 - DNA, 25 bp, Homo sapien
agatgtaacgctctcccttgattgc

SEQ ID NO: 21038 - DNA, 25 bp, Homo sapien
agatgtaactctctcccttgattgc

SEQ ID NO: 21039 - DNA, 25 bp, Homo sapien
agatgtacagaaagctaattaaaag

SEQ ID NO: 21040 - DNA, 25 bp, Homo sapien
agatgtacagaatgctaattaaaag

SEQ ID NO: 21041 - DNA, 25 bp, Homo sapien
agatgtacctactgcaaatggcttc

SEQ ID NO: 21042 - DNA, 25 bp, Homo sapien
agatgtacctactgcatatggcttc

SEQ ID NO: 21043 - DNA, 25 bp, Homo sapien
agatgtatgaagaaattaatgttgt

SEQ ID NO: 21044 - DNA, 25 bp, Homo sapien
agatgtatgaagaagttaatgttgt

SEQ ID NO: 21045 - DNA, 25 bp, Homo sapien
agatgtcaaaatcccatctcttccc

SEQ ID NO: 21046 - DNA, 25 bp, Homo sapien
agatgtcagaatcccatctcttccc

SEQ ID NO: 21047 - DNA, 25 bp, Homo sapien
agatgtgaattctacaaacccttgt

SEQ ID NO: 21048 - DNA, 25 bp, Homo sapien
agatgtgaattctacagacccttgt

SEQ ID NO: 21049 - DNA, 25 bp, Homo sapien
agatgtgctgccattcagactgttg

SEQ ID NO: 21050 - DNA, 25 bp, Homo sapien
agatgtgctgccattcggactgttg

SEQ ID NO: 21051 - DNA, 25 bp, Homo sapien
agatgtgctttgtttcatgtgctgt

SEQ ID NO: 21052 - DNA, 25 bp, Homo sapien
agatgtgctttgtttcgtgtgctgt

SEQ ID NO: 21053 - DNA, 25 bp, Homo sapien
agatgtggcaacagtattcaagatt

SEQ ID NO: 21054 - DNA, 25 bp, Homo sapien
agatgtggcgacagtattcaagatt

SEQ ID NO: 21055 - DNA, 25 bp, Homo sapien
agatgtgtctgcacaaggtctttta

SEQ ID NO: 21056 - DNA, 25 bp, Homo sapien
agatgtgtctgtacaaggtctttta

SEQ ID NO: 21057 - DNA, 25 bp, Homo sapien
agatgttcaaaacttttcacttagt

SEQ ID NO: 21058 - DNA, 25 bp, Homo sapien
agatgttcaaaatttttcacttagt

SEQ ID NO: 21059 - DNA, 25 bp, Homo sapien
agatgttcactggaggatttgaaaa

SEQ ID NO: 21060 - DNA, 25 bp, Homo sapien
agatgttcattggaggatttgaaaa

SEQ ID NO: 21061 - DNA, 25 bp, Homo sapien
agatgttgagcccaggtagcttggg

SEQ ID NO: 21062 - DNA, 25 bp, Homo sapien
agatgttgagcccgggtagcttggg

SEQ ID NO: 21063 - DNA, 25 bp, Homo sapien
agatgttgtatgactaaagaagatg

SEQ ID NO: 21064 - DNA, 25 bp, Homo sapien
agatgttgtatgagtaaagaagatg

SEQ ID NO: 21065 - DNA, 25 bp, Homo sapien
agatgtttaaaaaagtgaccttcct

SEQ ID NO: 21066 - DNA, 25 bp, Homo sapien
agatgtttaaacaagtgaccttcct

SEQ ID NO: 21067 - DNA, 25 bp, Homo sapien
agatgtttaagggtcactttgtaaa

SEQ ID NO: 21068 - DNA, 25 bp, Homo sapien
agatgtttaagggtcattttgtaaa

SEQ ID NO: 21069 - DNA, 25 bp, Homo sapien
agatgtttcctgttgatagtacttc

SEQ ID NO: 21070 - DNA, 25 bp, Homo sapien
agatgtttctgaacgacacaaaaca

SEQ ID NO: 21071 - DNA, 25 bp, Homo sapien
agatgtttgcaataatcataattaa

SEQ ID NO: 21072 - DNA, 25 bp, Homo sapien
agatgtttgcagtaatcataattaa

SEQ ID NO: 21073 - DNA, 25 bp, Homo sapien
agatgtttggacgaccatgaaaatt

SEQ ID NO: 21074 - DNA, 25 bp, Homo sapien
agatgtttggatgaccatgaaaatt

SEQ ID NO: 21075 - DNA, 25 bp, Homo sapien
agatgttttctgttgatagtacttc

SEQ ID NO: 21076 - DNA, 25 bp, Homo sapien
agatgtttttgaacgacacaaaaca

SEQ ID NO: 21077 - DNA, 25 bp, Homo sapien
agattaaaaaaaaatatgtaccaca

SEQ ID NO: 21078 - DNA, 25 bp, Homo sapien
agattaaaaaaacatatgtaccaca

SEQ ID NO: 21079 - DNA, 25 bp, Homo sapien
agattaaagaggtgaggatggctga

SEQ ID NO: 21080 - DNA, 25 bp, Homo sapien
agattaaagagttgaggatggctga

SEQ ID NO: 21081 - DNA, 25 bp, Homo sapien
agattaacactgatgcaataccatt

SEQ ID NO: 21082 - DNA, 25 bp, Homo sapien
agattaacattgatgcaataccatt

SEQ ID NO: 21083 - DNA, 25 bp, Homo sapien
agattaatccacttccatgctacca

SEQ ID NO: 21084 - DNA, 25 bp, Homo sapien
agattaatctacttccatgctacca

SEQ ID NO: 21085 - DNA, 25 bp, Homo sapien
agattaatgaacgtatttgaactgg

SEQ ID NO: 21086 - DNA, 25 bp, Homo sapien
agattaatggaattgtctctcttct

SEQ ID NO: 21087 - DNA, 25 bp, Homo sapien
agattaatggacgtatttgaactgg

SEQ ID NO: 21088 - DNA, 25 bp, Homo sapien
agattaattgaattgtctctcttct

SEQ ID NO: 21089 - DNA, 25 bp, Homo sapien
agattacaaggtgctacgagaacat

SEQ ID NO: 21090 - DNA, 25 bp, Homo sapien
agattacaaggtgctatgagaacat

SEQ ID NO: 21091 - DNA, 25 bp, Homo sapien
agattacacatggtgtattgagttg

SEQ ID NO: 21092 - DNA, 25 bp, Homo sapien
agattacacgaagagttaaagaata

SEQ ID NO: 21093 - DNA, 25 bp, Homo sapien
agattacacgtggtgtattgagttg

SEQ ID NO: 21094 - DNA, 25 bp, Homo sapien
agattacactgatagattttaaacc

SEQ ID NO: 21095 - DNA, 25 bp, Homo sapien
agattacatgaagagttaaagaata

SEQ ID NO: 21096 - DNA, 25 bp, Homo sapien
agattacattgatagattttaaacc

SEQ ID NO: 21097 - DNA, 25 bp, Homo sapien
agattactagcccgggtgcccaaca

SEQ ID NO: 21098 - DNA, 25 bp, Homo sapien
agattactagcctgggtgcccaaca

SEQ ID NO: 21099 - DNA, 25 bp, Homo sapien
agattactcaggaaggcgccagaga

SEQ ID NO: 21100 - DNA, 25 bp, Homo sapien
agattactcaggaaggtgccagaga

SEQ ID NO: 21101 - DNA, 25 bp, Homo sapien
agattagctgcacggctgaggagat

SEQ ID NO: 21102 - DNA, 25 bp, Homo sapien
agattagctgcatggctgaggagat

SEQ ID NO: 21103 - DNA, 25 bp, Homo sapien
agattaggcatctgcatttggtgag

SEQ ID NO: 21104 - DNA, 25 bp, Homo sapien
agattaggcttctgcatttggtgag

SEQ ID NO: 21105 - DNA, 25 bp, Homo sapien
agattagttggttatataggttact

SEQ ID NO: 21106 - DNA, 25 bp, Homo sapien
agattagttggttgtataggttact

SEQ ID NO: 21107 - DNA, 25 bp, Homo sapien
agattatcaatgattaaaaagacta

SEQ ID NO: 21108 - DNA, 25 bp, Homo sapien
agattatcaatgattagaaagacta

SEQ ID NO: 21109 - DNA, 25 bp, Homo sapien
agattatcataaccagttccaccaa

SEQ ID NO: 21110 - DNA, 25 bp, Homo sapien
agattatcataatcagttccaccaa

SEQ ID NO: 21111 - DNA, 25 bp, Homo sapien
agattatctcctgcatagagagacg

SEQ ID NO: 21112 - DNA, 25 bp, Homo sapien
agattatctcctgcgtagagagacg

SEQ ID NO: 21113 - DNA, 25 bp, Homo sapien
agattatgtggtcagtgatccagga

SEQ ID NO: 21114 - DNA, 25 bp, Homo sapien
agattatgtggtcggtgatccagga

SEQ ID NO: 21115 - DNA, 25 bp, Homo sapien
agattcaaagggtatgttgtttttt

SEQ ID NO: 21116 - DNA, 25 bp, Homo sapien
agattcaaatccacattccacttaa

SEQ ID NO: 21117 - DNA, 25 bp, Homo sapien
agattcaaatccactttccacttaa

SEQ ID NO: 21118 - DNA, 25 bp, Homo sapien
agattcaaggggtatgttgtttttt

SEQ ID NO: 21119 - DNA, 25 bp, Homo sapien
agattcagaaatgtacagatagagg

SEQ ID NO: 21120 - DNA, 25 bp, Homo sapien
agattcagagatgtacagatagagg

SEQ ID NO: 21121 - DNA, 25 bp, Homo sapien
agattcagcagccctggaaagttat

SEQ ID NO: 21122 - DNA, 25 bp, Homo sapien
agattcagcagtcctggaaagttat

SEQ ID NO: 21123 - DNA, 25 bp, Homo sapien
agattcagcctgagcctaaaggcct

SEQ ID NO: 21124 - DNA, 25 bp, Homo sapien
agattcagcctgggcctaaaggcct

SEQ ID NO: 21125 - DNA, 25 bp, Homo sapien
agattcagttgcaggagattaacgt

SEQ ID NO: 21126 - DNA, 25 bp, Homo sapien
agattcagttgtaggagattaacgt

SEQ ID NO: 21127 - DNA, 25 bp, Homo sapien
agattcataaaaaaaaaaaaggaag

SEQ ID NO: 21128 - DNA, 25 bp, Homo sapien
agattcataaaagaaaaaaaggaag

SEQ ID NO: 21129 - DNA, 25 bp, Homo sapien
agattcatcagcaagtcttgatatt

SEQ ID NO: 21130 - DNA, 25 bp, Homo sapien
agattcatcagcaattcttgatatt

SEQ ID NO: 21131 - DNA, 25 bp, Homo sapien
agattcatggattccaataaaacaa

SEQ ID NO: 21132 - DNA, 25 bp, Homo sapien
agattcatggattccagtaaaacaa

SEQ ID NO: 21133 - DNA, 25 bp, Homo sapien
agattcatggtcactgagttccttg

SEQ ID NO: 21134 - DNA, 25 bp, Homo sapien
agattcatggtcattgagttccttg

SEQ ID NO: 21135 - DNA, 25 bp, Homo sapien
agattcattgtaccttgtcacaact

SEQ ID NO: 21136 - DNA, 25 bp, Homo sapien
agattcattgtgccttgtcacaact

SEQ ID NO: 21137 - DNA, 25 bp, Homo sapien
agattccacttacattttatatctg

SEQ ID NO: 21138 - DNA, 25 bp, Homo sapien
agattccacttgcattttatatctg

SEQ ID NO: 21139 - DNA, 25 bp, Homo sapien
agattcccgttgacataagctggaa

SEQ ID NO: 21140 - DNA, 25 bp, Homo sapien
agattcccgttgatataagctggaa

SEQ ID NO: 21141 - DNA, 25 bp, Homo sapien
agattcggctaaagtccacgagggc

SEQ ID NO: 21142 - DNA, 25 bp, Homo sapien
agattcggctaaagtctacgagggc

SEQ ID NO: 21143 - DNA, 25 bp, Homo sapien
agattctatcaattgccaagtgcct

SEQ ID NO: 21144 - DNA, 25 bp, Homo sapien
agattctatcagttgccaagtgcct

SEQ ID NO: 21145 - DNA, 25 bp, Homo sapien
agattctcaaaaatgaagtttcctg

SEQ ID NO: 21146 - DNA, 25 bp, Homo sapien
agattctcagaggtgcgtcaaccct

SEQ ID NO: 21147 - DNA, 25 bp, Homo sapien
agattctcaggctcatcaggaagcc

SEQ ID NO: 21148 - DNA, 25 bp, Homo sapien
agattctcataggtgcgtcaaccct

SEQ ID NO: 21149 - DNA, 25 bp, Homo sapien
agattctcatgctcatcaggaagcc

SEQ ID NO: 21150 - DNA, 25 bp, Homo sapien
agattctcgaaaatgaagtttcctg

SEQ ID NO: 21151 - DNA, 25 bp, Homo sapien
agattctctaattacatgctaccaa

SEQ ID NO: 21152 - DNA, 25 bp, Homo sapien
agattctctaatttcatgctaccaa

SEQ ID NO: 21153 - DNA, 25 bp, Homo sapien
agattctgattgcggttcttttgaa

SEQ ID NO: 21154 - DNA, 25 bp, Homo sapien
agattctgattgtggttcttttgaa

SEQ ID NO: 21155 - DNA, 25 bp, Homo sapien
agattctgtttacggagaacagaag

SEQ ID NO: 21156 - DNA, 25 bp, Homo sapien
agattctgtttatggagaacagaag

SEQ ID NO: 21157 - DNA, 25 bp, Homo sapien
agattcttaaccgttctaatgcgct

SEQ ID NO: 21158 - DNA, 25 bp, Homo sapien
agattcttaacctttctaatgcgct

SEQ ID NO: 21159 - DNA, 25 bp, Homo sapien
agattcttagctcggccataagccc

SEQ ID NO: 21160 - DNA, 25 bp, Homo sapien
agattcttagctgggccataagccc

SEQ ID NO: 21161 - DNA, 25 bp, Homo sapien
agattcttcagcggcgttcagttct

SEQ ID NO: 21162 - DNA, 25 bp, Homo sapien
agattcttcagcggtgttcagttct

SEQ ID NO: 21163 - DNA, 25 bp, Homo sapien
agattcttcatacgtaggcaaaaat

SEQ ID NO: 21164 - DNA, 25 bp, Homo sapien
agattcttcatatgtaggcaaaaat

SEQ ID NO: 21165 - DNA, 25 bp, Homo sapien
agattgaagaagccacttatggcca

SEQ ID NO: 21166 - DNA, 25 bp, Homo sapien
agattgaaggaagcaaaatattgtt

SEQ ID NO: 21167 - DNA, 25 bp, Homo sapien
agattgaaggaaggaaaatattgtt

SEQ ID NO: 21168 - DNA, 25 bp, Homo sapien
agattgaaggagccacttatggcca

SEQ ID NO: 21169 - DNA, 25 bp, Homo sapien
agattgaagtcccggaagaaaaaat

SEQ ID NO: 21170 - DNA, 25 bp, Homo sapien
agattgaagtcctggaagaaaaaat

SEQ ID NO: 21171 - DNA, 25 bp, Homo sapien
agattgaatgtgaatatgcaagtga

SEQ ID NO: 21172 - DNA, 25 bp, Homo sapien
agattgaatgtgactatgcaagtga

SEQ ID NO: 21173 - DNA, 25 bp, Homo sapien
agattgagacagaaagagagaatgg

SEQ ID NO: 21174 - DNA, 25 bp, Homo sapien
agattgagacagtaagagagaatgg

SEQ ID NO: 21175 - DNA, 25 bp, Homo sapien
agattgaggtaacgctcataactgt

SEQ ID NO: 21176 - DNA, 25 bp, Homo sapien
agattgaggtaatgctcataactgt

SEQ ID NO: 21177 - DNA, 25 bp, Homo sapien
agattgagtacaacagcaactaaag

SEQ ID NO: 21178 - DNA, 25 bp, Homo sapien
agattgagtacaccagcaactaaag

SEQ ID NO: 21179 - DNA, 25 bp, Homo sapien
agattgagttaatcttttgagctat

SEQ ID NO: 21180 - DNA, 25 bp, Homo sapien
agattgagttaattttttgagctat

SEQ ID NO: 21181 - DNA, 25 bp, Homo sapien
agattgatcgaggaatatgttatta

SEQ ID NO: 21182 - DNA, 25 bp, Homo sapien
agattgatcgaggattatgttatta

SEQ ID NO: 21183 - DNA, 25 bp, Homo sapien
agattgattataaacctatgtatta

SEQ ID NO: 21184 - DNA, 25 bp, Homo sapien
agattgattgtaaacctatgtatta

SEQ ID NO: 21185 - DNA, 25 bp, Homo sapien
agattgcacctctacactatagcct

SEQ ID NO: 21186 - DNA, 25 bp, Homo sapien
agattgcacctctgcactatagcct

SEQ ID NO: 21187 - DNA, 25 bp, Homo sapien
agattgcagtgattaaattgaagct

SEQ ID NO: 21188 - DNA, 25 bp, Homo sapien
agattgcagtgattgaattgaagct

SEQ ID NO: 21189 - DNA, 25 bp, Homo sapien
agattgccagatatggaacatttaa

SEQ ID NO: 21190 - DNA, 25 bp, Homo sapien
agattgccaggtgaacaccacagcc

SEQ ID NO: 21191 - DNA, 25 bp, Homo sapien
agattgccaggtgagcaccacagcc

SEQ ID NO: 21192 - DNA, 25 bp, Homo sapien
agattgccggatatggaacatttaa

SEQ ID NO: 21193 - DNA, 25 bp, Homo sapien
agattgccttagaagacttttaaag

SEQ ID NO: 21194 - DNA, 25 bp, Homo sapien
agattgccttaggagacttttaaag

SEQ ID NO: 21195 - DNA, 25 bp, Homo sapien
agattgctccttataacaaaatgac

SEQ ID NO: 21196 - DNA, 25 bp, Homo sapien
agattgctccttataataaaatgac

SEQ ID NO: 21197 - DNA, 25 bp, Homo sapien
agattggagagattcatctacaagt

SEQ ID NO: 21198 - DNA, 25 bp, Homo sapien
agattggagagattgatctacaagt

SEQ ID NO: 21199 - DNA, 25 bp, Homo sapien
agattggcttgaacagagaggttga

SEQ ID NO: 21200 - DNA, 25 bp, Homo sapien
agattggcttgagcagagaggttga

SEQ ID NO: 21201 - DNA, 25 bp, Homo sapien
agattgggcgcattcctactcctga

SEQ ID NO: 21202 - DNA, 25 bp, Homo sapien
agattgggctcattcctactcctga

SEQ ID NO: 21203 - DNA, 25 bp, Homo sapien
agattgtatcacctctttacactcc

SEQ ID NO: 21204 - DNA, 25 bp, Homo sapien
agattgtatcatctctttacactcc

SEQ ID NO: 21205 - DNA, 25 bp, Homo sapien
agattgttaacacgtgtgaggagat

SEQ ID NO: 21206 - DNA, 25 bp, Homo sapien
agattgttaacatgtgtgaggagat

SEQ ID NO: 21207 - DNA, 25 bp, Homo sapien
agattgttggtaagaggaattccaa

SEQ ID NO: 21208 - DNA, 25 bp, Homo sapien
agattgtttgtaagaggaattccaa

SEQ ID NO: 21209 - DNA, 25 bp, Homo sapien
agattgttttgatccagaatctcta

SEQ ID NO: 21210 - DNA, 25 bp, Homo sapien
agattgttttgatgcagaatctcta

SEQ ID NO: 21211 - DNA, 25 bp, Homo sapien
agatttaaactacaccatgatgctt

SEQ ID NO: 21212 - DNA, 25 bp, Homo sapien
agatttaaactataccatgatgctt

SEQ ID NO: 21213 - DNA, 25 bp, Homo sapien
agatttaatatgctgttactgtaag

SEQ ID NO: 21214 - DNA, 25 bp, Homo sapien
agatttaatatgttgttactgtaag

SEQ ID NO: 21215 - DNA, 25 bp, Homo sapien
agatttaattagagcgaccaagaaa

SEQ ID NO: 21216 - DNA, 25 bp, Homo sapien
agatttaattagtgcgaccaagaaa

SEQ ID NO: 21217 - DNA, 25 bp, Homo sapien
agatttacaacactgtattataaca

SEQ ID NO: 21218 - DNA, 25 bp, Homo sapien
agatttaccacactgtattataaca

SEQ ID NO: 21219 - DNA, 25 bp, Homo sapien
agatttagaaactgtaggattacat

SEQ ID NO: 21220 - DNA, 25 bp, Homo sapien
agatttagaaagtgtaggattacat

SEQ ID NO: 21221 - DNA, 25 bp, Homo sapien
agatttataactcgtaatgaatgtt

SEQ ID NO: 21222 - DNA, 25 bp, Homo sapien
agatttataacttgtaatgaatgtt

SEQ ID NO: 21223 - DNA, 25 bp, Homo sapien
agatttattccatcaacacagtatt

SEQ ID NO: 21224 - DNA, 25 bp, Homo sapien
agatttattccatcgacacagtatt

SEQ ID NO: 21225 - DNA, 25 bp, Homo sapien
agatttcacaaatgctacctgtgta

SEQ ID NO: 21226 - DNA, 25 bp, Homo sapien
agatttcacaaatgttacctgtgta

SEQ ID NO: 21227 - DNA, 25 bp, Homo sapien
agatttcacatccagaggttaatta

SEQ ID NO: 21228 - DNA, 25 bp, Homo sapien
agatttcacatccataggttaatta

SEQ ID NO: 21229 - DNA, 25 bp, Homo sapien
agatttcacggcaatcccttgaaac

SEQ ID NO: 21230 - DNA, 25 bp, Homo sapien
agatttcatggcaatcccttgaaac

SEQ ID NO: 21231 - DNA, 25 bp, Homo sapien
agatttccatgagaccttcagagat

SEQ ID NO: 21232 - DNA, 25 bp, Homo sapien
agatttccatgaggccttcagagat

SEQ ID NO: 21233 - DNA, 25 bp, Homo sapien
agatttctggtgccctctttacagg

SEQ ID NO: 21234 - DNA, 25 bp, Homo sapien
agatttctggtgccttctttacagg

SEQ ID NO: 21235 - DNA, 25 bp, Homo sapien
agatttcttttgacagcttacagaa

SEQ ID NO: 21236 - DNA, 25 bp, Homo sapien
agatttcttttgtcagcttacagaa

SEQ ID NO: 21237 - DNA, 25 bp, Homo sapien
agatttgcacgtccgtcttttttct

SEQ ID NO: 21238 - DNA, 25 bp, Homo sapien
agatttgcacgtctgtcttttttct

SEQ ID NO: 21239 - DNA, 25 bp, Homo sapien
agatttggaatcctgttatgttgcc

SEQ ID NO: 21240 - DNA, 25 bp, Homo sapien
agatttggagtcctgttatgttgcc

SEQ ID NO: 21241 - DNA, 25 bp, Homo sapien
agatttggcaaatactgagggcagg

SEQ ID NO: 21242 - DNA, 25 bp, Homo sapien
agatttggcaaatacttagggcagg

SEQ ID NO: 21243 - DNA, 25 bp, Homo sapien
agatttgtagaaaggttgttggttg

SEQ ID NO: 21244 - DNA, 25 bp, Homo sapien
agatttgtagaagggttgttggttg

SEQ ID NO: 21245 - DNA, 25 bp, Homo sapien
agattttactcaggaactattgcag

SEQ ID NO: 21246 - DNA, 25 bp, Homo sapien
agattttattcaggaactattgcag

SEQ ID NO: 21247 - DNA, 25 bp, Homo sapien
agattttattggaaaggaaagaaaa

SEQ ID NO: 21248 - DNA, 25 bp, Homo sapien
agattttattggagaggaaagaaaa

SEQ ID NO: 21249 - DNA, 25 bp, Homo sapien
agattttcaaaagttttcattttgc

SEQ ID NO: 21250 - DNA, 25 bp, Homo sapien
agattttcaaggcagaatgagactt

SEQ ID NO: 21251 - DNA, 25 bp, Homo sapien
agattttcagaagttttcattttgc

SEQ ID NO: 21252 - DNA, 25 bp, Homo sapien
agattttcagggcagaatgagactt

SEQ ID NO: 21253 - DNA, 25 bp, Homo sapien
agattttgaaggagcaagactggaa

SEQ ID NO: 21254 - DNA, 25 bp, Homo sapien
agattttgagggagcaagactggaa

SEQ ID NO: 21255 - DNA, 25 bp, Homo sapien
agattttgatgaccaggtagtataa

SEQ ID NO: 21256 - DNA, 25 bp, Homo sapien
agattttgcataccaattacaactc

SEQ ID NO: 21257 - DNA, 25 bp, Homo sapien
agattttgcataccgattacaactc

SEQ ID NO: 21258 - DNA, 25 bp, Homo sapien
agattttgctattcagtatttataa

SEQ ID NO: 21259 - DNA, 25 bp, Homo sapien
agattttgctatttagtatttataa

SEQ ID NO: 21260 - DNA, 25 bp, Homo sapien
agattttggctctgttctcaacttc

SEQ ID NO: 21261 - DNA, 25 bp, Homo sapien
agattttggctgtgttctcaacttc

SEQ ID NO: 21262 - DNA, 25 bp, Homo sapien
agattttggtgaccaggtagtataa

SEQ ID NO: 21263 - DNA, 25 bp, Homo sapien
agattttgtggatcataggccccca

SEQ ID NO: 21264 - DNA, 25 bp, Homo sapien
agattttgtggatcatgggccccca

SEQ ID NO: 21265 - DNA, 25 bp, Homo sapien
agattttgtggtgcatagggcgatt

SEQ ID NO: 21266 - DNA, 25 bp, Homo sapien
agattttgtggtgcgtagggcgatt

SEQ ID NO: 21267 - DNA, 25 bp, Homo sapien
agatttttaaaattgctcatgctgg

SEQ ID NO: 21268 - DNA, 25 bp, Homo sapien
agatttttaaaatttctcatgctgg

SEQ ID NO: 21269 - DNA, 25 bp, Homo sapien
agatttttagacgataaagtgctag

SEQ ID NO: 21270 - DNA, 25 bp, Homo sapien
agatttttagacggtaaagtgctag

SEQ ID NO: 21271 - DNA, 25 bp, Homo sapien
agatttttatgcgtggattcttttt

SEQ ID NO: 21272 - DNA, 25 bp, Homo sapien
agatttttatggcaattccaagaga

SEQ ID NO: 21273 - DNA, 25 bp, Homo sapien
agatttttatgtgtggattcttttt

SEQ ID NO: 21274 - DNA, 25 bp, Homo sapien
agatttttcataatgtacttaagca

SEQ ID NO: 21275 - DNA, 25 bp, Homo sapien
agatttttcgtaatgtacttaagca

SEQ ID NO: 21276 - DNA, 25 bp, Homo sapien
agatttttggaattctgtatttttg

SEQ ID NO: 21277 - DNA, 25 bp, Homo sapien
agatttttgtggcaattccaagaga

SEQ ID NO: 21278 - DNA, 25 bp, Homo sapien
agattttttgaattctgtatttttg

SEQ ID NO: 21279 - DNA, 25 bp, Homo sapien
agattttttgatgcatttgggtaag

SEQ ID NO: 21280 - DNA, 25 bp, Homo sapien
agattttttgatgcgtttgggtaag

SEQ ID NO: 21281 - DNA, 25 bp, Homo sapien
agattttttggtttacaaagtttat

SEQ ID NO: 21282 - DNA, 25 bp, Homo sapien
agatttttttgtttacaaagtttat

SEQ ID NO: 21283 - DNA, 25 bp, Homo sapien
agattttttttctccaagcctcatc

SEQ ID NO: 21284 - DNA, 25 bp, Homo sapien
agattttttttctctaagcctcatc

SEQ ID NO: 21285 - DNA, 25 bp, Homo sapien
agcaaaaaaccacgttttccagact

SEQ ID NO: 21286 - DNA, 25 bp, Homo sapien
agcaaaaaaccatgttttccagact

SEQ ID NO: 21287 - DNA, 25 bp, Homo sapien
agcaaaaagagtactgttatcaccc

SEQ ID NO: 21288 - DNA, 25 bp, Homo sapien
agcaaaaagagtgctgttatcaccc

SEQ ID NO: 21289 - DNA, 25 bp, Homo sapien
agcaaaaatacccaacagtgacaac

SEQ ID NO: 21290 - DNA, 25 bp, Homo sapien
agcaaaaatacccagcagtgacaac

SEQ ID NO: 21291 - DNA, 25 bp, Homo sapien
agcaaaaatgctgagataggaggtt

SEQ ID NO: 21292 - DNA, 25 bp, Homo sapien
agcaaaaatgctgggataggaggtt

SEQ ID NO: 21293 - DNA, 25 bp, Homo sapien
agcaaaaatgtccaggtataggaga

SEQ ID NO: 21294 - DNA, 25 bp, Homo sapien
agcaaaaatgtccgggtataggaga

SEQ ID NO: 21295 - DNA, 25 bp, Homo sapien
agcaaaaggcatgatcttgctggga

SEQ ID NO: 21296 - DNA, 25 bp, Homo sapien
agcaaaaggcatggtcttgctggga

SEQ ID NO: 21297 - DNA, 25 bp, Homo sapien
agcaaaataacattgagtagacaca

SEQ ID NO: 21298 - DNA, 25 bp, Homo sapien
agcaaaatagcattgagtagacaca

SEQ ID NO: 21299 - DNA, 25 bp, Homo sapien
agcaaacaaatcagtaactaccact

SEQ ID NO: 21300 - DNA, 25 bp, Homo sapien
agcaaacaaatctgtaactaccact

SEQ ID NO: 21301 - DNA, 25 bp, Homo sapien
agcaaacacactctcttgacccgag

SEQ ID NO: 21302 - DNA, 25 bp, Homo sapien
agcaaacacactgtcttgacccgag

SEQ ID NO: 21303 - DNA, 25 bp, Homo sapien
agcaaacagatgcaggatgatccgc

SEQ ID NO: 21304 - DNA, 25 bp, Homo sapien
agcaaacagattcaggatgatccgc

SEQ ID NO: 21305 - DNA, 25 bp, Homo sapien
agcaaactctatgaactactgtttt

SEQ ID NO: 21306 - DNA, 25 bp, Homo sapien
agcaaactctgaaggggcccattct

SEQ ID NO: 21307 - DNA, 25 bp, Homo sapien
agcaaactctgagggggcccattct

SEQ ID NO: 21308 - DNA, 25 bp, Homo sapien
agcaaactttatgaactactgtttt

SEQ ID NO: 21309 - DNA, 25 bp, Homo sapien
agcaaagaaaatactcagttaatta

SEQ ID NO: 21310 - DNA, 25 bp, Homo sapien
agcaaagaaaatattcagttaatta

SEQ ID NO: 21311 - DNA, 25 bp, Homo sapien
agcaaagaacaacgaagtagttgag

SEQ ID NO: 21312 - DNA, 25 bp, Homo sapien
agcaaagaacaatgaagtagttgag

SEQ ID NO: 21313 - DNA, 25 bp, Homo sapien
agcaaagaacaatgtctccaaagtc

SEQ ID NO: 21314 - DNA, 25 bp, Homo sapien
agcaaagagcaatgtctccaaagtc

SEQ ID NO: 21315 - DNA, 25 bp, Homo sapien
agcaaagatccctcacttggagatg

SEQ ID NO: 21316 - DNA, 25 bp, Homo sapien
agcaaagatccctcgcttggagatg

SEQ ID NO: 21317 - DNA, 25 bp, Homo sapien
agcaaagatgtggcaacagtattca

SEQ ID NO: 21318 - DNA, 25 bp, Homo sapien
agcaaagatgtggcgacagtattca

SEQ ID NO: 21319 - DNA, 25 bp, Homo sapien
agcaaagcattccctgaccacacgc

SEQ ID NO: 21320 - DNA, 25 bp, Homo sapien
agcaaagcattccttgaccacacgc

SEQ ID NO: 21321 - DNA, 25 bp, Homo sapien
agcaaagcctcaagacatttgcctt

SEQ ID NO: 21322 - DNA, 25 bp, Homo sapien
agcaaagcctcaggacatttgcctt

SEQ ID NO: 21323 - DNA, 25 bp, Homo sapien
agcaaataaaaccgatacaagcaat

SEQ ID NO: 21324 - DNA, 25 bp, Homo sapien
agcaaataaaactgatacaagcaat

SEQ ID NO: 21325 - DNA, 25 bp, Homo sapien
agcaaataaacaaacagtatgtcag

SEQ ID NO: 21326 - DNA, 25 bp, Homo sapien
agcaaataaacaaatagtatgtcag

SEQ ID NO: 21327 - DNA, 25 bp, Homo sapien
agcaaataactacaatacacggaca

SEQ ID NO: 21328 - DNA, 25 bp, Homo sapien
agcaaataactaccatacacggaca

SEQ ID NO: 21329 - DNA, 25 bp, Homo sapien
agcaaatggccaggccaggattcaa

SEQ ID NO: 21330 - DNA, 25 bp, Homo sapien
agcaaatggccgggccaggattcaa

SEQ ID NO: 21331 - DNA, 25 bp, Homo sapien
agcaaatgtaaagcaggcagaataa

SEQ ID NO: 21332 - DNA, 25 bp, Homo sapien
agcaaatgtaaaggaggcagaataa

SEQ ID NO: 21333 - DNA, 25 bp, Homo sapien
agcaaattaacataccaacaagtca

SEQ ID NO: 21334 - DNA, 25 bp, Homo sapien
agcaaattaacatgccaacaagtca

SEQ ID NO: 21335 - DNA, 25 bp, Homo sapien
agcaacaatcaaagaaagttcttgt

SEQ ID NO: 21336 - DNA, 25 bp, Homo sapien
agcaacaatcagagaaagttcttgt

SEQ ID NO: 21337 - DNA, 25 bp, Homo sapien
agcaacaatttgaaaaatctgtaaa

SEQ ID NO: 21338 - DNA, 25 bp, Homo sapien
agcaacaatttgcaaaatctgtaaa

SEQ ID NO: 21339 - DNA, 25 bp, Homo sapien
agcaacacaaatccattactttgat

SEQ ID NO: 21340 - DNA, 25 bp, Homo sapien
agcaacacacgattcttgcggcttt

SEQ ID NO: 21341 - DNA, 25 bp, Homo sapien
agcaacacaggattcttgcggcttt

SEQ ID NO: 21342 - DNA, 25 bp, Homo sapien
agcaacacatatccattactttgat

SEQ ID NO: 21343 - DNA, 25 bp, Homo sapien
agcaacacccaagtttagcagcagt

SEQ ID NO: 21344 - DNA, 25 bp, Homo sapien
agcaacacccaggtttagcagcagt

SEQ ID NO: 21345 - DNA, 25 bp, Homo sapien
agcaacagcaatcgtattcatagtc

SEQ ID NO: 21346 - DNA, 25 bp, Homo sapien
agcaacagcgatcgtattcatagtc

SEQ ID NO: 21347 - DNA, 25 bp, Homo sapien
agcaacaggattggatgagagattg

SEQ ID NO: 21348 - DNA, 25 bp, Homo sapien
agcaacagggttggatgagagattg

SEQ ID NO: 21349 - DNA, 25 bp, Homo sapien
agcaacagttcatcgtgtttcaaat

SEQ ID NO: 21350 - DNA, 25 bp, Homo sapien
agcaacagttcattgtgtttcaaat

SEQ ID NO: 21351 - DNA, 25 bp, Homo sapien
agcaacataactcctgagtgttagc

SEQ ID NO: 21352 - DNA, 25 bp, Homo sapien
agcaacatgactcctgagtgttagc

SEQ ID NO: 21353 - DNA, 25 bp, Homo sapien
agcaaccaaaaaagcttctcaaata

SEQ ID NO: 21354 - DNA, 25 bp, Homo sapien
agcaaccaactcaaatttgctaatc

SEQ ID NO: 21355 - DNA, 25 bp, Homo sapien
agcaaccaactcagatttgctaatc

SEQ ID NO: 21356 - DNA, 25 bp, Homo sapien
agcaaccacaaaagcttctcaaata

SEQ ID NO: 21357 - DNA, 25 bp, Homo sapien
agcaaccactgcattgtattttaag

SEQ ID NO: 21358 - DNA, 25 bp, Homo sapien
agcaaccattgcattgtattttaag

SEQ ID NO: 21359 - DNA, 25 bp, Homo sapien
agcaaccctcaacggacggctgcag

SEQ ID NO: 21360 - DNA, 25 bp, Homo sapien
agcaaccctcaatggacggctgcag

SEQ ID NO: 21361 - DNA, 25 bp, Homo sapien
agcaacctcattaagaaggtggaac

SEQ ID NO: 21362 - DNA, 25 bp, Homo sapien
agcaacctcattaagatggtggaac

SEQ ID NO: 21363 - DNA, 25 bp, Homo sapien
agcaactaaataactgcacaggctt

SEQ ID NO: 21364 - DNA, 25 bp, Homo sapien
agcaactaaatagctgcacaggctt

SEQ ID NO: 21365 - DNA, 25 bp, Homo sapien
agcaactctacaatcctgcccactc

SEQ ID NO: 21366 - DNA, 25 bp, Homo sapien
agcaactctacagtcctgcccactc

SEQ ID NO: 21367 - DNA, 25 bp, Homo sapien
agcaactctaccaaacaccaactta

SEQ ID NO: 21368 - DNA, 25 bp, Homo sapien
agcaactctaccaagcaccaactta

SEQ ID NO: 21369 - DNA, 25 bp, Homo sapien
agcaagaaataatcatctgtgtact

SEQ ID NO: 21370 - DNA, 25 bp, Homo sapien
agcaagaaataatcgtctgtgtact

SEQ ID NO: 21371 - DNA, 25 bp, Homo sapien
agcaagaacaattagtggcatgagc

SEQ ID NO: 21372 - DNA, 25 bp, Homo sapien
agcaagaacaattcgtggcatgagc

SEQ ID NO: 21373 - DNA, 25 bp, Homo sapien
agcaagacaaatgacctggaaatta

SEQ ID NO: 21374 - DNA, 25 bp, Homo sapien
agcaagacacgaagagatcacaact

SEQ ID NO: 21375 - DNA, 25 bp, Homo sapien
agcaagacagatgacctggaaatta

SEQ ID NO: 21376 - DNA, 25 bp, Homo sapien
agcaagacaggaaaatacagtttgg

SEQ ID NO: 21377 - DNA, 25 bp, Homo sapien
agcaagacagggaaatacagtttgg

SEQ ID NO: 21378 - DNA, 25 bp, Homo sapien
agcaagacatgaagagatcacaact

SEQ ID NO: 21379 - DNA, 25 bp, Homo sapien
agcaagagacgaagttgagggatga

SEQ ID NO: 21380 - DNA, 25 bp, Homo sapien
agcaagagatgaagttgagggatga

SEQ ID NO: 21381 - DNA, 25 bp, Homo sapien
agcaagaggtgagagctggttgttg

SEQ ID NO: 21382 - DNA, 25 bp, Homo sapien
agcaagagttgagagctggttgttg

SEQ ID NO: 21383 - DNA, 25 bp, Homo sapien
agcaagataccttttagtctatttc

SEQ ID NO: 21384 - DNA, 25 bp, Homo sapien
agcaagatatcttttagtctatttc

SEQ ID NO: 21385 - DNA, 25 bp, Homo sapien
agcaagcaaatcgtggtcctggaac

SEQ ID NO: 21386 - DNA, 25 bp, Homo sapien
agcaagcaaattgtggtcctggaac

SEQ ID NO: 21387 - DNA, 25 bp, Homo sapien
agcaagcacattatatccagagatg

SEQ ID NO: 21388 - DNA, 25 bp, Homo sapien
agcaagcacattgtatccagagatg

SEQ ID NO: 21389 - DNA, 25 bp, Homo sapien
agcaagcagtcttcctgcaatggtg

SEQ ID NO: 21390 - DNA, 25 bp, Homo sapien
agcaagcagtctttctgcaatggtg

SEQ ID NO: 21391 - DNA, 25 bp, Homo sapien
agcaagccaagacagttatctaagt

SEQ ID NO: 21392 - DNA, 25 bp, Homo sapien
agcaagccaagagagttatctaagt

SEQ ID NO: 21393 - DNA, 25 bp, Homo sapien
agcaagcccgtgggagcgcagggag

SEQ ID NO: 21394 - DNA, 25 bp, Homo sapien
agcaagcctgtgggagcgcagggag

SEQ ID NO: 21395 - DNA, 25 bp, Homo sapien
agcaagctgtaaaccctctgagaac

SEQ ID NO: 21396 - DNA, 25 bp, Homo sapien
agcaagctgtaagccctctgagaac

SEQ ID NO: 21397 - DNA, 25 bp, Homo sapien
agcaagcttcacaactttctccgac

SEQ ID NO: 21398 - DNA, 25 bp, Homo sapien
agcaagcttcacatctttctccgac

SEQ ID NO: 21399 - DNA, 25 bp, Homo sapien
agcaaggcatggctaaaatacaagc

SEQ ID NO: 21400 - DNA, 25 bp, Homo sapien
agcaaggcgtggctaaaatacaagc

SEQ ID NO: 21401 - DNA, 25 bp, Homo sapien
agcaaggctctgtgggcataggacc

SEQ ID NO: 21402 - DNA, 25 bp, Homo sapien
agcaaggctctgtgggtataggacc

SEQ ID NO: 21403 - DNA, 25 bp, Homo sapien
agcaagggaagtgttatacgctcac

SEQ ID NO: 21404 - DNA, 25 bp, Homo sapien
agcaagggagcaacatggcacccca

SEQ ID NO: 21405 - DNA, 25 bp, Homo sapien
agcaagggagcagcatggcacccca

SEQ ID NO: 21406 - DNA, 25 bp, Homo sapien
agcaagggcagtgttatacgctcac

SEQ ID NO: 21407 - DNA, 25 bp, Homo sapien
agcaagtaaataagtaaaggtcttc

SEQ ID NO: 21408 - DNA, 25 bp, Homo sapien
agcaagtaaattattctttctgtgc

SEQ ID NO: 21409 - DNA, 25 bp, Homo sapien
agcaagtaacttattctttctgtgc

SEQ ID NO: 21410 - DNA, 25 bp, Homo sapien
agcaagtaagtaagtaaaggtcttc

SEQ ID NO: 21411 - DNA, 25 bp, Homo sapien
agcaagtagatactcacatattgaa

SEQ ID NO: 21412 - DNA, 25 bp, Homo sapien
agcaagtagatactcatatattgaa

SEQ ID NO: 21413 - DNA, 25 bp, Homo sapien
agcaagtatatggtagcaccaggtt

SEQ ID NO: 21414 - DNA, 25 bp, Homo sapien
agcaagtatatggtagtaccaggtt

SEQ ID NO: 21415 - DNA, 25 bp, Homo sapien
agcaagtatgatacaatgcctttgc

SEQ ID NO: 21416 - DNA, 25 bp, Homo sapien
agcaagtatgatccaatgcctttgc

SEQ ID NO: 21417 - DNA, 25 bp, Homo sapien
agcaagtccaagttaaatacatgtt

SEQ ID NO: 21418 - DNA, 25 bp, Homo sapien
agcaagtccaagttgaatacatgtt

SEQ ID NO: 21419 - DNA, 25 bp, Homo sapien
agcaagtggcctcaccctggacgct

SEQ ID NO: 21420 - DNA, 25 bp, Homo sapien
agcaagtggcctcatcctggacgct

SEQ ID NO: 21421 - DNA, 25 bp, Homo sapien
agcaagtgtatgaaattctgaagga

SEQ ID NO: 21422 - DNA, 25 bp, Homo sapien
agcaagtgtatgaagttctgaagga

SEQ ID NO: 21423 - DNA, 25 bp, Homo sapien
agcaagttccagccttatttttata

SEQ ID NO: 21424 - DNA, 25 bp, Homo sapien
agcaagttccagcgttatttttata

SEQ ID NO: 21425 - DNA, 25 bp, Homo sapien
agcaagttgtttagttttcatatat

SEQ ID NO: 21426 - DNA, 25 bp, Homo sapien
agcaagttgtttggttttcatatat

SEQ ID NO: 21427 - DNA, 25 bp, Homo sapien
agcaataaactcatttgcaacagaa

SEQ ID NO: 21428 - DNA, 25 bp, Homo sapien
agcaataagctcatttgcaacagaa

SEQ ID NO: 21429 - DNA, 25 bp, Homo sapien
agcaatagatgaggacattttggac

SEQ ID NO: 21430 - DNA, 25 bp, Homo sapien
agcaatagatgatgacattttggac

SEQ ID NO: 21431 - DNA, 25 bp, Homo sapien
agcaatagcatctaaagacaatata

SEQ ID NO: 21432 - DNA, 25 bp, Homo sapien
agcaatagcatctgaagacaatata

SEQ ID NO: 21433 - DNA, 25 bp, Homo sapien
agcaatatcctctttcagaactagc

SEQ ID NO: 21434 - DNA, 25 bp, Homo sapien
agcaatatcctgtttcagaactagc

SEQ ID NO: 21435 - DNA, 25 bp, Homo sapien
agcaatcatgcatctttgcatcaac

SEQ ID NO: 21436 - DNA, 25 bp, Homo sapien
agcaatcatgcgtctttgcatcaac

SEQ ID NO: 21437 - DNA, 25 bp, Homo sapien
agcaatccattaaacttctcctggc

SEQ ID NO: 21438 - DNA, 25 bp, Homo sapien
agcaatccattaatcttctcctggc

SEQ ID NO: 21439 - DNA, 25 bp, Homo sapien
agcaatctgctactgatatagttag

SEQ ID NO: 21440 - DNA, 25 bp, Homo sapien
agcaatctgttactgatatagttag

SEQ ID NO: 21441 - DNA, 25 bp, Homo sapien
agcaatgaaggtacaaaaatgacct

SEQ ID NO: 21442 - DNA, 25 bp, Homo sapien
agcaatgaaggtaccaaaatgacct

SEQ ID NO: 21443 - DNA, 25 bp, Homo sapien
agcaatgactcatgatgtaaaattg

SEQ ID NO: 21444 - DNA, 25 bp, Homo sapien
agcaatgactcatgctgtaaaattg

SEQ ID NO: 21445 - DNA, 25 bp, Homo sapien
agcaatgcacattaaagttcaaatt

SEQ ID NO: 21446 - DNA, 25 bp, Homo sapien
agcaatgcatattaaagttcaaatt

SEQ ID NO: 21447 - DNA, 25 bp, Homo sapien
agcaatgctattaccggttgagtat

SEQ ID NO: 21448 - DNA, 25 bp, Homo sapien
agcaatgctattactggttgagtat

SEQ ID NO: 21449 - DNA, 25 bp, Homo sapien
agcaatggccctcgttaattttatc

SEQ ID NO: 21450 - DNA, 25 bp, Homo sapien
agcaatggccctctttaattttatc

SEQ ID NO: 21451 - DNA, 25 bp, Homo sapien
agcaatggcgtcagtcatttagtac

SEQ ID NO: 21452 - DNA, 25 bp, Homo sapien
agcaatggtgtcagtcatttagtac

SEQ ID NO: 21453 - DNA, 25 bp, Homo sapien
agcaatgtctcccaaatttataaag

SEQ ID NO: 21454 - DNA, 25 bp, Homo sapien
agcaatgtctcccagatttataaag

SEQ ID NO: 21455 - DNA, 25 bp, Homo sapien
agcaatgtgactccaagctagttcc

SEQ ID NO: 21456 - DNA, 25 bp, Homo sapien
agcaatgtgactccgagctagttcc

SEQ ID NO: 21457 - DNA, 25 bp, Homo sapien
agcaatgttctaacagttcaaatta

SEQ ID NO: 21458 - DNA, 25 bp, Homo sapien
agcaatgttctaatagttcaaatta

SEQ ID NO: 21459 - DNA, 25 bp, Homo sapien
agcaattctgttcccagagaaatga

SEQ ID NO: 21460 - DNA, 25 bp, Homo sapien
agcaattctgttcctagagaaatga

SEQ ID NO: 21461 - DNA, 25 bp, Homo sapien
agcaattgattcgaaaacctgtgta

SEQ ID NO: 21462 - DNA, 25 bp, Homo sapien
agcaattgatttgaaaacctgtgta

SEQ ID NO: 21463 - DNA, 25 bp, Homo sapien
agcaattgggcaaaataataatcct

SEQ ID NO: 21464 - DNA, 25 bp, Homo sapien
agcaattgggccaaataataatcct

SEQ ID NO: 21465 - DNA, 25 bp, Homo sapien
agcaatttaatgagtgatttctgat

SEQ ID NO: 21466 - DNA, 25 bp, Homo sapien
agcaatttaatgcgtgatttctgat

SEQ ID NO: 21467 - DNA, 25 bp, Homo sapien
agcaatttagcttccaccttttttt

SEQ ID NO: 21468 - DNA, 25 bp, Homo sapien
agcaatttagcttccatcttttttt

SEQ ID NO: 21469 - DNA, 25 bp, Homo sapien
agcaatttcactgcttagaacttaa

SEQ ID NO: 21470 - DNA, 25 bp, Homo sapien
agcaatttcacttcttagaacttaa

SEQ ID NO: 21471 - DNA, 25 bp, Homo sapien
agcaatttgacaagagggtaaggtc

SEQ ID NO: 21472 - DNA, 25 bp, Homo sapien
agcaatttgacaggagggtaaggtc

SEQ ID NO: 21473 - DNA, 25 bp, Homo sapien
agcacaaaaacaatcatcagcctgt

SEQ ID NO: 21474 - DNA, 25 bp, Homo sapien
agcacaaaagacatggaaaaacgat

SEQ ID NO: 21475 - DNA, 25 bp, Homo sapien
agcacaaaagagatggaaaaacgat

SEQ ID NO: 21476 - DNA, 25 bp, Homo sapien
agcacaaaagcaatcatcagcctgt

SEQ ID NO: 21477 - DNA, 25 bp, Homo sapien
agcacaaagaaaactattcttggct

SEQ ID NO: 21478 - DNA, 25 bp, Homo sapien
agcacaaagaaaagtattcttggct

SEQ ID NO: 21479 - DNA, 25 bp, Homo sapien
agcacaaatcacccaaacaaatttt

SEQ ID NO: 21480 - DNA, 25 bp, Homo sapien
agcacaaatcagccaaacaaatttt

SEQ ID NO: 21481 - DNA, 25 bp, Homo sapien
agcacaacacaggattagcacataa

SEQ ID NO: 21482 - DNA, 25 bp, Homo sapien
agcacaacacagtattagcacataa

SEQ ID NO: 21483 - DNA, 25 bp, Homo sapien
agcacaactgaaatattttacaact

SEQ ID NO: 21484 - DNA, 25 bp, Homo sapien
agcacaactgaagtattttacaact

SEQ ID NO: 21485 - DNA, 25 bp, Homo sapien
agcacaagaacttaagcggttcaaa

SEQ ID NO: 21486 - DNA, 25 bp, Homo sapien
agcacaagaacttaggcggttcaaa

SEQ ID NO: 21487 - DNA, 25 bp, Homo sapien
agcacaagcacaagtcactgttgta

SEQ ID NO: 21488 - DNA, 25 bp, Homo sapien
agcacaagcacaattcactgttgta

SEQ ID NO: 21489 - DNA, 25 bp, Homo sapien
agcacaagggactatttcttcaatt

SEQ ID NO: 21490 - DNA, 25 bp, Homo sapien
agcacaagggactgtttcttcaatt

SEQ ID NO: 21491 - DNA, 25 bp, Homo sapien
agcacaatattgattgcacaatagc

SEQ ID NO: 21492 - DNA, 25 bp, Homo sapien
agcacaatatttattgcacaatagc

SEQ ID NO: 21493 - DNA, 25 bp, Homo sapien
agcacaatgcctaacgcagagtaaa

SEQ ID NO: 21494 - DNA, 25 bp, Homo sapien
agcacaatgcctaatgcagagtaaa

SEQ ID NO: 21495 - DNA, 25 bp, Homo sapien
agcacaatggttagaaggttaagtt

SEQ ID NO: 21496 - DNA, 25 bp, Homo sapien
agcacaatggttaggaggttaagtt

SEQ ID NO: 21497 - DNA, 25 bp, Homo sapien
agcacacaaaaacattaagaaagct

SEQ ID NO: 21498 - DNA, 25 bp, Homo sapien
agcacacaagaacattaagaaagct

SEQ ID NO: 21499 - DNA, 25 bp, Homo sapien
agcacaccaatgtgaggtcatgttg

SEQ ID NO: 21500 - DNA, 25 bp, Homo sapien
agcacaccagtgtgaggtcatgttg

SEQ ID NO: 21501 - DNA, 25 bp, Homo sapien
agcacaccatcctaaattttttttc

SEQ ID NO: 21502 - DNA, 25 bp, Homo sapien
agcacaccatcctagattttttttc

SEQ ID NO: 21503 - DNA, 25 bp, Homo sapien
agcacacctgctaacagtacccatg

SEQ ID NO: 21504 - DNA, 25 bp, Homo sapien
agcacacctgctaacattacccatg

SEQ ID NO: 21505 - DNA, 25 bp, Homo sapien
agcacactcaaatgaggaaggtgtt

SEQ ID NO: 21506 - DNA, 25 bp, Homo sapien
agcacacttaaatgaggaaggtgtt

SEQ ID NO: 21507 - DNA, 25 bp, Homo sapien
agcacacttaagtacaccattgacg

SEQ ID NO: 21508 - DNA, 25 bp, Homo sapien
agcacacttaagtataccattgacg

SEQ ID NO: 21509 - DNA, 25 bp, Homo sapien
agcacagaaaaaactaccatttata

SEQ ID NO: 21510 - DNA, 25 bp, Homo sapien
agcacagaaaaaattaccatttata

SEQ ID NO: 21511 - DNA, 25 bp, Homo sapien
agcacagactgtgacgactacaata

SEQ ID NO: 21512 - DNA, 25 bp, Homo sapien
agcacagactgtgatgactacaata

SEQ ID NO: 21513 - DNA, 25 bp, Homo sapien
agcacagagaaataagaaccaggat

SEQ ID NO: 21514 - DNA, 25 bp, Homo sapien
agcacagagaaataggaaccaggat

SEQ ID NO: 21515 - DNA, 25 bp, Homo sapien
agcacagcatttcttcattctactg

SEQ ID NO: 21516 - DNA, 25 bp, Homo sapien
agcacagcgtttcttcattctactg

SEQ ID NO: 21517 - DNA, 25 bp, Homo sapien
agcacagtgaattaacgtaaaccta

SEQ ID NO: 21518 - DNA, 25 bp, Homo sapien
agcacagtgcattaacgtaaaccta

SEQ ID NO: 21519 - DNA, 25 bp, Homo sapien
agcacagttaattccagggctgcct

SEQ ID NO: 21520 - DNA, 25 bp, Homo sapien
agcacagttaattctagggctgcct

SEQ ID NO: 21521 - DNA, 25 bp, Homo sapien
agcacagttgtacatgattttgatc

SEQ ID NO: 21522 - DNA, 25 bp, Homo sapien
agcacagttgtacgtgattttgatc

SEQ ID NO: 21523 - DNA, 25 bp, Homo sapien
agcacatcaacctagtaagaatctt

SEQ ID NO: 21524 - DNA, 25 bp, Homo sapien
agcacatcagcctagtaagaatctt

SEQ ID NO: 21525 - DNA, 25 bp, Homo sapien
agcacatcatcaactgtgtaatagt

SEQ ID NO: 21526 - DNA, 25 bp, Homo sapien
agcacatcatcacctgtgtaatagt

SEQ ID NO: 21527 - DNA, 25 bp, Homo sapien
agcacatcctgaatgacaaggtttc

SEQ ID NO: 21528 - DNA, 25 bp, Homo sapien
agcacatcttgaatgacaaggtttc

SEQ ID NO: 21529 - DNA, 25 bp, Homo sapien
agcacatgaccaactgagatttatc

SEQ ID NO: 21530 - DNA, 25 bp, Homo sapien
agcacatgaccaactgggatttatc

SEQ ID NO: 21531 - DNA, 25 bp, Homo sapien
agcacatgagttgcctactgacatg

SEQ ID NO: 21532 - DNA, 25 bp, Homo sapien
agcacatgagttgtctactgacatg

SEQ ID NO: 21533 - DNA, 25 bp, Homo sapien
agcacatggcccaccttgcactgcc

SEQ ID NO: 21534 - DNA, 25 bp, Homo sapien
agcacatggcccagcttgcactgcc

SEQ ID NO: 21535 - DNA, 25 bp, Homo sapien
agcacatgtgagggtacaaaattat

SEQ ID NO: 21536 - DNA, 25 bp, Homo sapien
agcacatgtgagggtataaaattat

SEQ ID NO: 21537 - DNA, 25 bp, Homo sapien
agcacattcaaattaaagagaaaac

SEQ ID NO: 21538 - DNA, 25 bp, Homo sapien
agcacattcaagttaaagagaaaac

SEQ ID NO: 21539 - DNA, 25 bp, Homo sapien
agcacattcccaatggtgtcctctg

SEQ ID NO: 21540 - DNA, 25 bp, Homo sapien
agcacattcccgatggtgtcctctg

SEQ ID NO: 21541 - DNA, 25 bp, Homo sapien
agcacattgcacatgcattaaaaaa

SEQ ID NO: 21542 - DNA, 25 bp, Homo sapien
agcacattgcacatgcgttaaaaaa

SEQ ID NO: 21543 - DNA, 25 bp, Homo sapien
agcacattgtgaatcctccataaat

SEQ ID NO: 21544 - DNA, 25 bp, Homo sapien
agcacattgtgagtcctccataaat

SEQ ID NO: 21545 - DNA, 25 bp, Homo sapien
agcacatttcattgcaagactgggc

SEQ ID NO: 21546 - DNA, 25 bp, Homo sapien
agcacattttattgcaagactgggc

SEQ ID NO: 21547 - DNA, 25 bp, Homo sapien
agcaccaatcagatcatgtatgtgt

SEQ ID NO: 21548 - DNA, 25 bp, Homo sapien
agcaccaatcagattatgtatgtgt

SEQ ID NO: 21549 - DNA, 25 bp, Homo sapien
agcaccacaagaaagatcactgaag

SEQ ID NO: 21550 - DNA, 25 bp, Homo sapien
agcaccacaaggaagatcactgaag

SEQ ID NO: 21551 - DNA, 25 bp, Homo sapien
agcaccacatgagctctggcggaat

SEQ ID NO: 21552 - DNA, 25 bp, Homo sapien
agcaccacatgaggtctggcggaat

SEQ ID NO: 21553 - DNA, 25 bp, Homo sapien
agcaccagtatagaagaaaaaacgc

SEQ ID NO: 21554 - DNA, 25 bp, Homo sapien
agcaccagtatagaaggaaaaacgc

SEQ ID NO: 21555 - DNA, 25 bp, Homo sapien
agcaccatccgtgatgccatgtaga

SEQ ID NO: 21556 - DNA, 25 bp, Homo sapien
agcaccatctgtgatgccatgtaga

SEQ ID NO: 21557 - DNA, 25 bp, Homo sapien
agcaccatgcaatagaaaagatttg

SEQ ID NO: 21558 - DNA, 25 bp, Homo sapien
agcaccatgcattagaaaagatttg

SEQ ID NO: 21559 - DNA, 25 bp, Homo sapien
agcacccaaatgttatattgttcta

SEQ ID NO: 21560 - DNA, 25 bp, Homo sapien
agcacccaagtgttatattgttcta

SEQ ID NO: 21561 - DNA, 25 bp, Homo sapien
agcaccctctttgactcattaatgc

SEQ ID NO: 21562 - DNA, 25 bp, Homo sapien
agcaccctctttgacttattaatgc

SEQ ID NO: 21563 - DNA, 25 bp, Homo sapien
agcaccctggagtacttcaacattt

SEQ ID NO: 21564 - DNA, 25 bp, Homo sapien
agcaccctggagtgcttcaacattt

SEQ ID NO: 21565 - DNA, 25 bp, Homo sapien
agcacctaaaacatcaatttctctg

SEQ ID NO: 21566 - DNA, 25 bp, Homo sapien
agcacctaatacatcaatttctctg

SEQ ID NO: 21567 - DNA, 25 bp, Homo sapien
agcacctatatttcgaaggtgacac

SEQ ID NO: 21568 - DNA, 25 bp, Homo sapien
agcacctatattttgaaggtgacac

SEQ ID NO: 21569 - DNA, 25 bp, Homo sapien
agcacctgttagtcgttctggcact

SEQ ID NO: 21570 - DNA, 25 bp, Homo sapien
agcacctgttagtctttctggcact

SEQ ID NO: 21571 - DNA, 25 bp, Homo sapien
agcacctttccgtgaactctagggg

SEQ ID NO: 21572 - DNA, 25 bp, Homo sapien
agcacctttccgtggactctagggg

SEQ ID NO: 21573 - DNA, 25 bp, Homo sapien
agcacgcagggtttatcgtatcgtg

SEQ ID NO: 21574 - DNA, 25 bp, Homo sapien
agcacgcagggtttattgtatcgtg

SEQ ID NO: 21575 - DNA, 25 bp, Homo sapien
agcacgtattctcctgcaacaactg

SEQ ID NO: 21576 - DNA, 25 bp, Homo sapien
agcacgtattctcttgcaacaactg

SEQ ID NO: 21577 - DNA, 25 bp, Homo sapien
agcactaaatgcccacagaagacag

SEQ ID NO: 21578 - DNA, 25 bp, Homo sapien
agcactaaatgcccacggaagacag

SEQ ID NO: 21579 - DNA, 25 bp, Homo sapien
agcactaacaataggccaggcatta

SEQ ID NO: 21580 - DNA, 25 bp, Homo sapien
agcactaacaccacataccagccct

SEQ ID NO: 21581 - DNA, 25 bp, Homo sapien
agcactaacgataggccaggcatta

SEQ ID NO: 21582 - DNA, 25 bp, Homo sapien
agcactaacgccacataccagccct

SEQ ID NO: 21583 - DNA, 25 bp, Homo sapien
agcactagccaggcagtatttgctg

SEQ ID NO: 21584 - DNA, 25 bp, Homo sapien
agcactaggaaaagtccaagtttgt

SEQ ID NO: 21585 - DNA, 25 bp, Homo sapien
agcactaggatgcaagttgcaggac

SEQ ID NO: 21586 - DNA, 25 bp, Homo sapien
agcactaggatgtaagttgcaggac

SEQ ID NO: 21587 - DNA, 25 bp, Homo sapien
agcactaggcaaagtccaagtttgt

SEQ ID NO: 21588 - DNA, 25 bp, Homo sapien
agcactaggcaggcagtatttgctg

SEQ ID NO: 21589 - DNA, 25 bp, Homo sapien
agcactctgcagacttcactttccc

SEQ ID NO: 21590 - DNA, 25 bp, Homo sapien
agcactctgcaggcttcactttccc

SEQ ID NO: 21591 - DNA, 25 bp, Homo sapien
agcactgaaatacagatcactgaaa

SEQ ID NO: 21592 - DNA, 25 bp, Homo sapien
agcactgaagtacagatcactgaaa

SEQ ID NO: 21593 - DNA, 25 bp, Homo sapien
agcactgagttattcttgagaatcc

SEQ ID NO: 21594 - DNA, 25 bp, Homo sapien
agcactgagttatttttgagaatcc

SEQ ID NO: 21595 - DNA, 25 bp, Homo sapien
agcactgattcctaacagggttatt

SEQ ID NO: 21596 - DNA, 25 bp, Homo sapien
agcactgattcctagcagggttatt

SEQ ID NO: 21597 - DNA, 25 bp, Homo sapien
agcactgcaaatcgcatcagactga

SEQ ID NO: 21598 - DNA, 25 bp, Homo sapien
agcactgcaaatggcatcagactga

SEQ ID NO: 21599 - DNA, 25 bp, Homo sapien
agcactggcatctcattttggctct

SEQ ID NO: 21600 - DNA, 25 bp, Homo sapien
agcactggcttctcattttggctct

SEQ ID NO: 21601 - DNA, 25 bp, Homo sapien
agcactgtagatccatcaaccttgc

SEQ ID NO: 21602 - DNA, 25 bp, Homo sapien
agcactgtagattcatcaaccttgc

SEQ ID NO: 21603 - DNA, 25 bp, Homo sapien
agcactgtgcggaaggctggctgaa

SEQ ID NO: 21604 - DNA, 25 bp, Homo sapien
agcactgtgtggaaggctggctgaa

SEQ ID NO: 21605 - DNA, 25 bp, Homo sapien
agcacttctgccgtcaattacgaag

SEQ ID NO: 21606 - DNA, 25 bp, Homo sapien
agcacttctgccgtcagttacgaag

SEQ ID NO: 21607 - DNA, 25 bp, Homo sapien
agcacttgagtagtcactggtaaag

SEQ ID NO: 21608 - DNA, 25 bp, Homo sapien
agcacttgagtagtgactggtaaag

SEQ ID NO: 21609 - DNA, 25 bp, Homo sapien
agcacttgggaacagctgggccaga

SEQ ID NO: 21610 - DNA, 25 bp, Homo sapien
agcacttgtaaagaaacacaagggg

SEQ ID NO: 21611 - DNA, 25 bp, Homo sapien
agcacttgtaaggaaacacaagggg

SEQ ID NO: 21612 - DNA, 25 bp, Homo sapien
agcacttgtgaacagctgggccaga

SEQ ID NO: 21613 - DNA, 25 bp, Homo sapien
agcactttcaacacagaaacatact

SEQ ID NO: 21614 - DNA, 25 bp, Homo sapien
agcactttcacctgggttatctcat

SEQ ID NO: 21615 - DNA, 25 bp, Homo sapien
agcactttcacctgtgttatctcat

SEQ ID NO: 21616 - DNA, 25 bp, Homo sapien
agcacttttaacacagaaacatact

SEQ ID NO: 21617 - DNA, 25 bp, Homo sapien
agcagaaaacagatatcagccttgg

SEQ ID NO: 21618 - DNA, 25 bp, Homo sapien
agcagaaaacaggtatcagccttgg

SEQ ID NO: 21619 - DNA, 25 bp, Homo sapien
agcagaaaactcaaaaacaaacaat

SEQ ID NO: 21620 - DNA, 25 bp, Homo sapien
agcagaaaactcgaaaacaaacaat

SEQ ID NO: 21621 - DNA, 25 bp, Homo sapien
agcagaaaagaggatctactggtga

SEQ ID NO: 21622 - DNA, 25 bp, Homo sapien
agcagaaacagagactcctggtttg

SEQ ID NO: 21623 - DNA, 25 bp, Homo sapien
agcagaaacggagactcctggtttg

SEQ ID NO: 21624 - DNA, 25 bp, Homo sapien
agcagaaatcaattatgcctgtgtt

SEQ ID NO: 21625 - DNA, 25 bp, Homo sapien
agcagaaatcagttatgcctgtgtt

SEQ ID NO: 21626 - DNA, 25 bp, Homo sapien
agcagaaatgaggatctactggtga

SEQ ID NO: 21627 - DNA, 25 bp, Homo sapien
agcagaaccagaaagtaaaacagaa

SEQ ID NO: 21628 - DNA, 25 bp, Homo sapien
agcagaaccggaaagtaaaacagaa

SEQ ID NO: 21629 - DNA, 25 bp, Homo sapien
agcagaagaacgaatgagcgagctt

SEQ ID NO: 21630 - DNA, 25 bp, Homo sapien
agcagaagaacgcatgagcgagctt

SEQ ID NO: 21631 - DNA, 25 bp, Homo sapien
agcagaaggccacctggcaggaatc

SEQ ID NO: 21632 - DNA, 25 bp, Homo sapien
agcagaaggccacctgtcaggaatc

SEQ ID NO: 21633 - DNA, 25 bp, Homo sapien
agcagaatacagactaaaatcctta

SEQ ID NO: 21634 - DNA, 25 bp, Homo sapien
agcagaatacagattaaaatcctta

SEQ ID NO: 21635 - DNA, 25 bp, Homo sapien
agcagaatagctgcaaggagtactg

SEQ ID NO: 21636 - DNA, 25 bp, Homo sapien
agcagaatagctgcaatgagtactg

SEQ ID NO: 21637 - DNA, 25 bp, Homo sapien
agcagacactaatgcctttggatgc

SEQ ID NO: 21638 - DNA, 25 bp, Homo sapien
agcagacactaatgtctttggatgc

SEQ ID NO: 21639 - DNA, 25 bp, Homo sapien
agcagactctgtcagtgccttgccc

SEQ ID NO: 21640 - DNA, 25 bp, Homo sapien
agcagactctgtcggtgccttgccc

SEQ ID NO: 21641 - DNA, 25 bp, Homo sapien
agcagagaaaatgaagaaatttggg

SEQ ID NO: 21642 - DNA, 25 bp, Homo sapien
agcagagacgaaataccaaaacaga

SEQ ID NO: 21643 - DNA, 25 bp, Homo sapien
agcagagataatgaagaaatttggg

SEQ ID NO: 21644 - DNA, 25 bp, Homo sapien
agcagagatgaaataccaaaacaga

SEQ ID NO: 21645 - DNA, 25 bp, Homo sapien
agcagagcattccctactctatcct

SEQ ID NO: 21646 - DNA, 25 bp, Homo sapien
agcagagcattccttactctatcct

SEQ ID NO: 21647 - DNA, 25 bp, Homo sapien
agcagagccagtagaaaagaacaca

SEQ ID NO: 21648 - DNA, 25 bp, Homo sapien
agcagagcccgtagaaaagaacaca

SEQ ID NO: 21649 - DNA, 25 bp, Homo sapien
agcagataaagattgaatcacaaca

SEQ ID NO: 21650 - DNA, 25 bp, Homo sapien
agcagatacagattgaatcacaaca

SEQ ID NO: 21651 - DNA, 25 bp, Homo sapien
agcagatcaaaaacatcccgattcc

SEQ ID NO: 21652 - DNA, 25 bp, Homo sapien
agcagatcaaaagcatcccgattcc

SEQ ID NO: 21653 - DNA, 25 bp, Homo sapien
agcagatcattcagctctttcctga

SEQ ID NO: 21654 - DNA, 25 bp, Homo sapien
agcagatctttcagctctttcctga

SEQ ID NO: 21655 - DNA, 25 bp, Homo sapien
agcagattgaagaagccacttatgg

SEQ ID NO: 21656 - DNA, 25 bp, Homo sapien
agcagattgaaggagccacttatgg

SEQ ID NO: 21657 - DNA, 25 bp, Homo sapien
agcagcaacacccaagtttagcagc

SEQ ID NO: 21658 - DNA, 25 bp, Homo sapien
agcagcaacacccaggtttagcagc

SEQ ID NO: 21659 - DNA, 25 bp, Homo sapien
agcagcaagcccgtgggagcgcagg

SEQ ID NO: 21660 - DNA, 25 bp, Homo sapien
agcagcaagcctgtgggagcgcagg

SEQ ID NO: 21661 - DNA, 25 bp, Homo sapien
agcagcacaaacagatgggtgggtg

SEQ ID NO: 21662 - DNA, 25 bp, Homo sapien
agcagcacaaatagatgggtgggtg

SEQ ID NO: 21663 - DNA, 25 bp, Homo sapien
agcagcactcactataatttctgat

SEQ ID NO: 21664 - DNA, 25 bp, Homo sapien
agcagcactcactgtaatttctgat

SEQ ID NO: 21665 - DNA, 25 bp, Homo sapien
agcagcactttcaacacagaaacat

SEQ ID NO: 21666 - DNA, 25 bp, Homo sapien
agcagcacttttaacacagaaacat

SEQ ID NO: 21667 - DNA, 25 bp, Homo sapien
agcagcagacgtgagcttatatgtg

SEQ ID NO: 21668 - DNA, 25 bp, Homo sapien
agcagcagagccagtagaaaagaac

SEQ ID NO: 21669 - DNA, 25 bp, Homo sapien
agcagcagagcccgtagaaaagaac

SEQ ID NO: 21670 - DNA, 25 bp, Homo sapien
agcagcagatgtgagcttatatgtg

SEQ ID NO: 21671 - DNA, 25 bp, Homo sapien
agcagcaggaaaatgaaacttggat

SEQ ID NO: 21672 - DNA, 25 bp, Homo sapien
agcagcaggaaactgaaacttggat

SEQ ID NO: 21673 - DNA, 25 bp, Homo sapien
agcagcattcctcacttctactcac

SEQ ID NO: 21674 - DNA, 25 bp, Homo sapien
agcagcattcctcgcttctactcac

SEQ ID NO: 21675 - DNA, 25 bp, Homo sapien
agcagcatttcccacatgagcactg

SEQ ID NO: 21676 - DNA, 25 bp, Homo sapien
agcagcatttcccatatgagcactg

SEQ ID NO: 21677 - DNA, 25 bp, Homo sapien
agcagccaaacccagacagaggtga

SEQ ID NO: 21678 - DNA, 25 bp, Homo sapien
agcagccaaaccgagacagaggtga

SEQ ID NO: 21679 - DNA, 25 bp, Homo sapien
agcagccacctgctttctgtcatta

SEQ ID NO: 21680 - DNA, 25 bp, Homo sapien
agcagccacctgctttgtgtcatta

SEQ ID NO: 21681 - DNA, 25 bp, Homo sapien
agcagccactggacaggactaagct

SEQ ID NO: 21682 - DNA, 25 bp, Homo sapien
agcagccactgggcaggactaagct

SEQ ID NO: 21683 - DNA, 25 bp, Homo sapien
agcagccagactttgtgctggttac

SEQ ID NO: 21684 - DNA, 25 bp, Homo sapien
agcagccagactttttgctggttac

SEQ ID NO: 21685 - DNA, 25 bp, Homo sapien
agcagccctactagtcaggaggctt

SEQ ID NO: 21686 - DNA, 25 bp, Homo sapien
agcagccctgctagtcaggaggctt

SEQ ID NO: 21687 - DNA, 25 bp, Homo sapien
agcagctaaccctagtcactgggac

SEQ ID NO: 21688 - DNA, 25 bp, Homo sapien
agcagctatccctagtcactgggac

SEQ ID NO: 21689 - DNA, 25 bp, Homo sapien
agcagctcttacaggctcttcaagg

SEQ ID NO: 21690 - DNA, 25 bp, Homo sapien
agcagctcttacagtctcttcaagg

SEQ ID NO: 21691 - DNA, 25 bp, Homo sapien
agcagcttaccaagaccaaaagggg

SEQ ID NO: 21692 - DNA, 25 bp, Homo sapien
agcagcttaccgagaccaaaagggg

SEQ ID NO: 21693 - DNA, 25 bp, Homo sapien
agcaggaaaaggctcacgcttcagt

SEQ ID NO: 21694 - DNA, 25 bp, Homo sapien
agcaggaaaaggctcatgcttcagt

SEQ ID NO: 21695 - DNA, 25 bp, Homo sapien
agcaggaaaatgaaacttggatggg

SEQ ID NO: 21696 - DNA, 25 bp, Homo sapien
agcaggaaactgaaacttggatggg

SEQ ID NO: 21697 - DNA, 25 bp, Homo sapien
agcaggaatctcactaccctcatat

SEQ ID NO: 21698 - DNA, 25 bp, Homo sapien
agcaggaatctcattaccctcatat

SEQ ID NO: 21699 - DNA, 25 bp, Homo sapien
agcaggactaggtaccaaagccatg

SEQ ID NO: 21700 - DNA, 25 bp, Homo sapien
agcaggactgggtaccaaagccatg

SEQ ID NO: 21701 - DNA, 25 bp, Homo sapien
agcaggataatgagaacgttctctg

SEQ ID NO: 21702 - DNA, 25 bp, Homo sapien
agcaggataatgagaatgttctctg

SEQ ID NO: 21703 - DNA, 25 bp, Homo sapien
agcaggcaaaaaaaagagtcatgtt

SEQ ID NO: 21704 - DNA, 25 bp, Homo sapien
agcaggcaaaaaaaggagtcatgtt

SEQ ID NO: 21705 - DNA, 25 bp, Homo sapien
agcaggcaagaaagcgtttgcaggg

SEQ ID NO: 21706 - DNA, 25 bp, Homo sapien
agcaggcaagagagcgtttgcaggg

SEQ ID NO: 21707 - DNA, 25 bp, Homo sapien
agcaggccgacaatcataggcggcc

SEQ ID NO: 21708 - DNA, 25 bp, Homo sapien
agcaggccgacagtcataggcggcc

SEQ ID NO: 21709 - DNA, 25 bp, Homo sapien
agcagggaacctaggactgatttgt

SEQ ID NO: 21710 - DNA, 25 bp, Homo sapien
agcagggaagctaggactgatttgt

SEQ ID NO: 21711 - DNA, 25 bp, Homo sapien
agcagggacatgcctctcagcttca

SEQ ID NO: 21712 - DNA, 25 bp, Homo sapien
agcagggacatggctctcagcttca

SEQ ID NO: 21713 - DNA, 25 bp, Homo sapien
agcagggaggcccctggtcctgaaa

SEQ ID NO: 21714 - DNA, 25 bp, Homo sapien
agcagggaggcccctgttcctgaaa

SEQ ID NO: 21715 - DNA, 25 bp, Homo sapien
agcagggatgaaaacaaaattaatt

SEQ ID NO: 21716 - DNA, 25 bp, Homo sapien
agcagggatgaaagcaaaattaatt

SEQ ID NO: 21717 - DNA, 25 bp, Homo sapien
agcaggggacgaacagctctgcttg

SEQ ID NO: 21718 - DNA, 25 bp, Homo sapien
agcaggggacgaacagttctgcttg

SEQ ID NO: 21719 - DNA, 25 bp, Homo sapien
agcaggggtgtgacaatgactgcaa

SEQ ID NO: 21720 - DNA, 25 bp, Homo sapien
agcaggggtgtgagaatgactgcaa

SEQ ID NO: 21721 - DNA, 25 bp, Homo sapien
agcagggtcaacactgccaggtctc

SEQ ID NO: 21722 - DNA, 25 bp, Homo sapien
agcagggtccacactgccaggtctc

SEQ ID NO: 21723 - DNA, 25 bp, Homo sapien
agcagggtctttctgcagacaaagt

SEQ ID NO: 21724 - DNA, 25 bp, Homo sapien
agcagggtctttgtgcagacaaagt

SEQ ID NO: 21725 - DNA, 25 bp, Homo sapien
agcaggtaagattacacgaagagtt

SEQ ID NO: 21726 - DNA, 25 bp, Homo sapien
agcaggtaagattacatgaagagtt

SEQ ID NO: 21727 - DNA, 25 bp, Homo sapien
agcaggtaattctgaagcaagtaat

SEQ ID NO: 21728 - DNA, 25 bp, Homo sapien
agcaggtaattttgaagcaagtaat

SEQ ID NO: 21729 - DNA, 25 bp, Homo sapien
agcaggtagtgtactttttgtgata

SEQ ID NO: 21730 - DNA, 25 bp, Homo sapien
agcaggtagtgtgctttttgtgata

SEQ ID NO: 21731 - DNA, 25 bp, Homo sapien
agcagtaaaatgatcaaacaatttt

SEQ ID NO: 21732 - DNA, 25 bp, Homo sapien
agcagtaaaatgttcaaacaatttt

SEQ ID NO: 21733 - DNA, 25 bp, Homo sapien
agcagtaaaggtcagcagctgaggg

SEQ ID NO: 21734 - DNA, 25 bp, Homo sapien
agcagtaaaggtgagcagctgaggg

SEQ ID NO: 21735 - DNA, 25 bp, Homo sapien
agcagtaagtcattcatttggacaa

SEQ ID NO: 21736 - DNA, 25 bp, Homo sapien
agcagtaagtcatttatttggacaa

SEQ ID NO: 21737 - DNA, 25 bp, Homo sapien
agcagtaatggaaataaagatccca

SEQ ID NO: 21738 - DNA, 25 bp, Homo sapien
agcagtaattgaaataaagatccca

SEQ ID NO: 21739 - DNA, 25 bp, Homo sapien
agcagtacatgggctagaagctggt

SEQ ID NO: 21740 - DNA, 25 bp, Homo sapien
agcagtacgtgggctagaagctggt

SEQ ID NO: 21741 - DNA, 25 bp, Homo sapien
agcagtagcctgaattctggaatag

SEQ ID NO: 21742 - DNA, 25 bp, Homo sapien
agcagtagcctgatttctggaatag

SEQ ID NO: 21743 - DNA, 25 bp, Homo sapien
agcagtaggcctagcaaggagagag

SEQ ID NO: 21744 - DNA, 25 bp, Homo sapien
agcagtaggcctggcaaggagagag

SEQ ID NO: 21745 - DNA, 25 bp, Homo sapien
agcagtctaggattctgatgaatgg

SEQ ID NO: 21746 - DNA, 25 bp, Homo sapien
agcagtctagggttctgatgaatgg

SEQ ID NO: 21747 - DNA, 25 bp, Homo sapien
agcagtcttgctatcgagtcctcgg

SEQ ID NO: 21748 - DNA, 25 bp, Homo sapien
agcagtcttgctgtcgagtcctcgg

SEQ ID NO: 21749 - DNA, 25 bp, Homo sapien
agcagtgacctcaaagtgacagcct

SEQ ID NO: 21750 - DNA, 25 bp, Homo sapien
agcagtgacttcaaagtgacagcct

SEQ ID NO: 21751 - DNA, 25 bp, Homo sapien
agcagtgcagttaatttgtgtacat

SEQ ID NO: 21752 - DNA, 25 bp, Homo sapien
agcagtgctaacaggaaagtttata

SEQ ID NO: 21753 - DNA, 25 bp, Homo sapien
agcagtgctaacagtaaagtttata

SEQ ID NO: 21754 - DNA, 25 bp, Homo sapien
agcagtgctgttaatttgtgtacat

SEQ ID NO: 21755 - DNA, 25 bp, Homo sapien
agcagtggtcatctcttggttccat

SEQ ID NO: 21756 - DNA, 25 bp, Homo sapien
agcagtggtcatttcttggttccat

SEQ ID NO: 21757 - DNA, 25 bp, Homo sapien
agcagtggttgttaagttttcattt

SEQ ID NO: 21758 - DNA, 25 bp, Homo sapien
agcagtggttgttacgttttcattt

SEQ ID NO: 21759 - DNA, 25 bp, Homo sapien
agcagtgtttcataaacttatttga

SEQ ID NO: 21760 - DNA, 25 bp, Homo sapien
agcagtgtttcatgaacttatttga

SEQ ID NO: 21761 - DNA, 25 bp, Homo sapien
agcagttagagaggtccggcatgtg

SEQ ID NO: 21762 - DNA, 25 bp, Homo sapien
agcagttagagaggtctggcatgtg

SEQ ID NO: 21763 - DNA, 25 bp, Homo sapien
agcagttaggaacactggcattgga

SEQ ID NO: 21764 - DNA, 25 bp, Homo sapien
agcagttaggagcactggcattgga

SEQ ID NO: 21765 - DNA, 25 bp, Homo sapien
agcagttcaaataaaaagtgatgta

SEQ ID NO: 21766 - DNA, 25 bp, Homo sapien
agcagttcaaatacaaagtgatgta

SEQ ID NO: 21767 - DNA, 25 bp, Homo sapien
agcagttcaacagtcaaaagacagg

SEQ ID NO: 21768 - DNA, 25 bp, Homo sapien
agcagttcaacagtgaaaagacagg

SEQ ID NO: 21769 - DNA, 25 bp, Homo sapien
agcagttcagcaccatagctaagat

SEQ ID NO: 21770 - DNA, 25 bp, Homo sapien
agcagttcagcatcatagctaagat

SEQ ID NO: 21771 - DNA, 25 bp, Homo sapien
agcagttctctctgggaaggattgt

SEQ ID NO: 21772 - DNA, 25 bp, Homo sapien
agcagttctctctgggtaggattgt

SEQ ID NO: 21773 - DNA, 25 bp, Homo sapien
agcagttctttccatttttgtatat

SEQ ID NO: 21774 - DNA, 25 bp, Homo sapien
agcagttctttccctttttgtatat

SEQ ID NO: 21775 - DNA, 25 bp, Homo sapien
agcagttgagactccaagaactgtc

SEQ ID NO: 21776 - DNA, 25 bp, Homo sapien
agcagttgagactccatgaactgtc

SEQ ID NO: 21777 - DNA, 25 bp, Homo sapien
agcagttgtcggtatggttatatat

SEQ ID NO: 21778 - DNA, 25 bp, Homo sapien
agcagttgttggtatggttatatat

SEQ ID NO: 21779 - DNA, 25 bp, Homo sapien
agcagtttgaccataatgtgccctg

SEQ ID NO: 21780 - DNA, 25 bp, Homo sapien
agcagtttgaccgtaatgtgccctg

SEQ ID NO: 21781 - DNA, 25 bp, Homo sapien
agcagtttgtgggatagttagttgt

SEQ ID NO: 21782 - DNA, 25 bp, Homo sapien
agcagtttgtggggtagttagttgt

SEQ ID NO: 21783 - DNA, 25 bp, Homo sapien
agcagttttatagccgtattacttc

SEQ ID NO: 21784 - DNA, 25 bp, Homo sapien
agcagttttatagctgtattacttc

SEQ ID NO: 21785 - DNA, 25 bp, Homo sapien
agcagttttattttgacgaatctcc

SEQ ID NO: 21786 - DNA, 25 bp, Homo sapien
agcagttttattttgatgaatctcc

SEQ ID NO: 21787 - DNA, 25 bp, Homo sapien
agcataaaatccaaatctcgagttt

SEQ ID NO: 21788 - DNA, 25 bp, Homo sapien
agcataaaatccgaatctcgagttt

SEQ ID NO: 21789 - DNA, 25 bp, Homo sapien
agcataacaggtcggatgacatggg

SEQ ID NO: 21790 - DNA, 25 bp, Homo sapien
agcataacaggttggatgacatggg

SEQ ID NO: 21791 - DNA, 25 bp, Homo sapien
agcataagaacaccaacctccaagt

SEQ ID NO: 21792 - DNA, 25 bp, Homo sapien
agcataagaacacgaacctccaagt

SEQ ID NO: 21793 - DNA, 25 bp, Homo sapien
agcataagatcatttttcagtagtt

SEQ ID NO: 21794 - DNA, 25 bp, Homo sapien
agcataagatcgtttttcagtagtt

SEQ ID NO: 21795 - DNA, 25 bp, Homo sapien
agcatacaacgatagaaaactctta

SEQ ID NO: 21796 - DNA, 25 bp, Homo sapien
agcatacaagacagcatctctgtct

SEQ ID NO: 21797 - DNA, 25 bp, Homo sapien
agcatacaagatagcatctctgtct

SEQ ID NO: 21798 - DNA, 25 bp, Homo sapien
agcatacaaggatagaaaactctta

SEQ ID NO: 21799 - DNA, 25 bp, Homo sapien
agcatacaatcagaagaggctggaa

SEQ ID NO: 21800 - DNA, 25 bp, Homo sapien
agcatacaatcagaggaggctggaa

SEQ ID NO: 21801 - DNA, 25 bp, Homo sapien
agcatacacgcccattggatttcag

SEQ ID NO: 21802 - DNA, 25 bp, Homo sapien
agcatacagccacgtagggcctcaa

SEQ ID NO: 21803 - DNA, 25 bp, Homo sapien
agcatacagccatgtagggcctcaa

SEQ ID NO: 21804 - DNA, 25 bp, Homo sapien
agcatacatgcccattggatttcag

SEQ ID NO: 21805 - DNA, 25 bp, Homo sapien
agcatacctattgcacacagtagct

SEQ ID NO: 21806 - DNA, 25 bp, Homo sapien
agcatacctattgcacgcagtagct

SEQ ID NO: 21807 - DNA, 25 bp, Homo sapien
agcatacttcaaacaattcctttaa

SEQ ID NO: 21808 - DNA, 25 bp, Homo sapien
agcatacttcaaaccattcctttaa

SEQ ID NO: 21809 - DNA, 25 bp, Homo sapien
agcatagaagcatagaacgtttagg

SEQ ID NO: 21810 - DNA, 25 bp, Homo sapien
agcatagaagcgtagaacgtttagg

SEQ ID NO: 21811 - DNA, 25 bp, Homo sapien
agcatagacaaagcattaggagaca

SEQ ID NO: 21812 - DNA, 25 bp, Homo sapien
agcatagacaaggcattaggagaca

SEQ ID NO: 21813 - DNA, 25 bp, Homo sapien
agcatagacacaattgcagtgttgg

SEQ ID NO: 21814 - DNA, 25 bp, Homo sapien
agcatagacacgattgcagtgttgg

SEQ ID NO: 21815 - DNA, 25 bp, Homo sapien
agcatagagcacataagctttcaca

SEQ ID NO: 21816 - DNA, 25 bp, Homo sapien
agcatagagcacgtaagctttcaca

SEQ ID NO: 21817 - DNA, 25 bp, Homo sapien
agcataggcagtccatcattgacca

SEQ ID NO: 21818 - DNA, 25 bp, Homo sapien
agcataggcagtccgtcattgacca

SEQ ID NO: 21819 - DNA, 25 bp, Homo sapien
agcataggctgttagaagaagccat

SEQ ID NO: 21820 - DNA, 25 bp, Homo sapien
agcataggctgttataagaagccat

SEQ ID NO: 21821 - DNA, 25 bp, Homo sapien
agcataggttttattcatttccaca

SEQ ID NO: 21822 - DNA, 25 bp, Homo sapien
agcataggttttgttcatttccaca

SEQ ID NO: 21823 - DNA, 25 bp, Homo sapien
agcatagtcttctaaagtagtagga

SEQ ID NO: 21824 - DNA, 25 bp, Homo sapien
agcatagtcttctgaagtagtagga

SEQ ID NO: 21825 - DNA, 25 bp, Homo sapien
agcatagtgtagcattttaagagta

SEQ ID NO: 21826 - DNA, 25 bp, Homo sapien
agcatagtgtagctttttaagagta

SEQ ID NO: 21827 - DNA, 25 bp, Homo sapien
agcatatagaatatctgaaccgagg

SEQ ID NO: 21828 - DNA, 25 bp, Homo sapien
agcatatagaatgtctgaaccgagg

SEQ ID NO: 21829 - DNA, 25 bp, Homo sapien
agcatatgactgtctctattatatg

SEQ ID NO: 21830 - DNA, 25 bp, Homo sapien
agcatatgattgtctctattatatg

SEQ ID NO: 21831 - DNA, 25 bp, Homo sapien
agcatatggcatctcctcagcttgg

SEQ ID NO: 21832 - DNA, 25 bp, Homo sapien
agcatatggcatttcctcagcttgg

SEQ ID NO: 21833 - DNA, 25 bp, Homo sapien
agcatattaatcacagttgttttaa

SEQ ID NO: 21834 - DNA, 25 bp, Homo sapien
agcatattaatcatagttgttttaa

SEQ ID NO: 21835 - DNA, 25 bp, Homo sapien
agcatattcctagatatggtagcta

SEQ ID NO: 21836 - DNA, 25 bp, Homo sapien
agcatattcctagctatggtagcta

SEQ ID NO: 21837 - DNA, 25 bp, Homo sapien
agcatattctagcctgttaggtgaa

SEQ ID NO: 21838 - DNA, 25 bp, Homo sapien
agcatattctagtctgttaggtgaa

SEQ ID NO: 21839 - DNA, 25 bp, Homo sapien
agcatattgtcataatcacttcatt

SEQ ID NO: 21840 - DNA, 25 bp, Homo sapien
agcatattgtcatgatcacttcatt

SEQ ID NO: 21841 - DNA, 25 bp, Homo sapien
agcatcaaagtattaataagaacat

SEQ ID NO: 21842 - DNA, 25 bp, Homo sapien
agcatcaaagtgttaataagaacat

SEQ ID NO: 21843 - DNA, 25 bp, Homo sapien
agcatcaacagtagaaagatctatg

SEQ ID NO: 21844 - DNA, 25 bp, Homo sapien
agcatcaatagtagaaagatctatg

SEQ ID NO: 21845 - DNA, 25 bp, Homo sapien
agcatcacaaacatctaagtttcta

SEQ ID NO: 21846 - DNA, 25 bp, Homo sapien
agcatcacaaacatttaagtttcta

SEQ ID NO: 21847 - DNA, 25 bp, Homo sapien
agcatcacactctgcatgcagtgca

SEQ ID NO: 21848 - DNA, 25 bp, Homo sapien
agcatcacgctctgcatgcagtgca

SEQ ID NO: 21849 - DNA, 25 bp, Homo sapien
agcatcactccctttaaaggataaa

SEQ ID NO: 21850 - DNA, 25 bp, Homo sapien
agcatcactccttttaaaggataaa

SEQ ID NO: 21851 - DNA, 25 bp, Homo sapien
agcatcagggcaaagaagacaggca

SEQ ID NO: 21852 - DNA, 25 bp, Homo sapien
agcatcagggcatagaagacaggca

SEQ ID NO: 21853 - DNA, 25 bp, Homo sapien
agcatcataataatgtgggtgatga

SEQ ID NO: 21854 - DNA, 25 bp, Homo sapien
agcatcatagtaatgtgggtgatga

SEQ ID NO: 21855 - DNA, 25 bp, Homo sapien
agcatccaccacggaaatcgtattg

SEQ ID NO: 21856 - DNA, 25 bp, Homo sapien
agcatccaccatggaaatcgtattg

SEQ ID NO: 21857 - DNA, 25 bp, Homo sapien
agcatcccagagcccgaatttctga

SEQ ID NO: 21858 - DNA, 25 bp, Homo sapien
agcatcccagagcctgaatttctga

SEQ ID NO: 21859 - DNA, 25 bp, Homo sapien
agcatcccttacgttcttttagcaa

SEQ ID NO: 21860 - DNA, 25 bp, Homo sapien
agcatcccttatgttcttttagcaa

SEQ ID NO: 21861 - DNA, 25 bp, Homo sapien
agcatcctgagtaacccaccgtgta

SEQ ID NO: 21862 - DNA, 25 bp, Homo sapien
agcatcctgagtaacctaccgtgta

SEQ ID NO: 21863 - DNA, 25 bp, Homo sapien
agcatcctgcaacgcacagtccccc

SEQ ID NO: 21864 - DNA, 25 bp, Homo sapien
agcatcctgcaatgcacagtccccc

SEQ ID NO: 21865 - DNA, 25 bp, Homo sapien
agcatctaggataagacgaaaacga

SEQ ID NO: 21866 - DNA, 25 bp, Homo sapien
agcatctaggatgagacgaaaacga

SEQ ID NO: 21867 - DNA, 25 bp, Homo sapien
agcatctatactatgtcaggtgcca

SEQ ID NO: 21868 - DNA, 25 bp, Homo sapien
agcatctatactgtgtcaggtgcca

SEQ ID NO: 21869 - DNA, 25 bp, Homo sapien
agcatctctgactctcactgatatt

SEQ ID NO: 21870 - DNA, 25 bp, Homo sapien
agcatctctgactctcgctgatatt

SEQ ID NO: 21871 - DNA, 25 bp, Homo sapien
agcatctgacaattggcctaacagg

SEQ ID NO: 21872 - DNA, 25 bp, Homo sapien
agcatctgacagttggcctaacagg

SEQ ID NO: 21873 - DNA, 25 bp, Homo sapien
agcatcttcgtcgtctcctatcact

SEQ ID NO: 21874 - DNA, 25 bp, Homo sapien
agcatcttctgtacaattaactggt

SEQ ID NO: 21875 - DNA, 25 bp, Homo sapien
agcatcttcttcgtctcctatcact

SEQ ID NO: 21876 - DNA, 25 bp, Homo sapien
agcatctttataacagtgtcttatt

SEQ ID NO: 21877 - DNA, 25 bp, Homo sapien
agcatctttataatagtgtcttatt

SEQ ID NO: 21878 - DNA, 25 bp, Homo sapien
agcatcttttgtacaattaactggt

SEQ ID NO: 21879 - DNA, 25 bp, Homo sapien
agcatgaaaatgatttagtagcaag

SEQ ID NO: 21880 - DNA, 25 bp, Homo sapien
agcatgaaactgatttagtagcaag

SEQ ID NO: 21881 - DNA, 25 bp, Homo sapien
agcatgaagcagccggaaagatcta

SEQ ID NO: 21882 - DNA, 25 bp, Homo sapien
agcatgaagcagctggaaagatcta

SEQ ID NO: 21883 - DNA, 25 bp, Homo sapien
agcatgaaggagaaaaacaagataa

SEQ ID NO: 21884 - DNA, 25 bp, Homo sapien
agcatgaaggagaaaagcaagataa

SEQ ID NO: 21885 - DNA, 25 bp, Homo sapien
agcatgacaattaccacactataaa

SEQ ID NO: 21886 - DNA, 25 bp, Homo sapien
agcatgacaattactacactataaa

SEQ ID NO: 21887 - DNA, 25 bp, Homo sapien
agcatgatacaacatatgaacttgt

SEQ ID NO: 21888 - DNA, 25 bp, Homo sapien
agcatgatacaacttatgaacttgt

SEQ ID NO: 21889 - DNA, 25 bp, Homo sapien
agcatgatctgacagaggaaactct

SEQ ID NO: 21890 - DNA, 25 bp, Homo sapien
agcatgatctgatagaggaaactct

SEQ ID NO: 21891 - DNA, 25 bp, Homo sapien
agcatgatgacaaattaacacctaa

SEQ ID NO: 21892 - DNA, 25 bp, Homo sapien
agcatgatgacaagttaacacctaa

SEQ ID NO: 21893 - DNA, 25 bp, Homo sapien
agcatgcacacttgaataattagtg

SEQ ID NO: 21894 - DNA, 25 bp, Homo sapien
agcatgcacacttggataattagtg

SEQ ID NO: 21895 - DNA, 25 bp, Homo sapien
agcatgcagattaatgaacgtattt

SEQ ID NO: 21896 - DNA, 25 bp, Homo sapien
agcatgcagattaatggacgtattt

SEQ ID NO: 21897 - DNA, 25 bp, Homo sapien
agcatgcattttcaaaatcactaca

SEQ ID NO: 21898 - DNA, 25 bp, Homo sapien
agcatgcattttcaaattcactaca

SEQ ID NO: 21899 - DNA, 25 bp, Homo sapien
agcatgcctaggaacactagcacct

SEQ ID NO: 21900 - DNA, 25 bp, Homo sapien
agcatgcctagggacactagcacct

SEQ ID NO: 21901 - DNA, 25 bp, Homo sapien
agcatgccttatattccagcgaggg

SEQ ID NO: 21902 - DNA, 25 bp, Homo sapien
agcatgccttatgttccagcgaggg

SEQ ID NO: 21903 - DNA, 25 bp, Homo sapien
agcatgctgaacatggaaaccacaa

SEQ ID NO: 21904 - DNA, 25 bp, Homo sapien
agcatgctgaacttggaaaccacaa

SEQ ID NO: 21905 - DNA, 25 bp, Homo sapien
agcatggaactttggtcaaaccaaa

SEQ ID NO: 21906 - DNA, 25 bp, Homo sapien
agcatggaacttttgtcaaaccaaa

SEQ ID NO: 21907 - DNA, 25 bp, Homo sapien
agcatggaatcaagaaaagggtagg

SEQ ID NO: 21908 - DNA, 25 bp, Homo sapien
agcatggactcaagaaaagggtagg

SEQ ID NO: 21909 - DNA, 25 bp, Homo sapien
agcatggatcaatgagacaaaaaga

SEQ ID NO: 21910 - DNA, 25 bp, Homo sapien
agcatggatcaatgaggcaaaaaga

SEQ ID NO: 21911 - DNA, 25 bp, Homo sapien
agcatggcaagccaatcttacacaa

SEQ ID NO: 21912 - DNA, 25 bp, Homo sapien
agcatggcaagccagtcttacacaa

SEQ ID NO: 21913 - DNA, 25 bp, Homo sapien
agcatggccaccgtggaattcaccg

SEQ ID NO: 21914 - DNA, 25 bp, Homo sapien
agcatggccactgtggaattcaccg

SEQ ID NO: 21915 - DNA, 25 bp, Homo sapien
agcatggtcatggatcctaaggtgt

SEQ ID NO: 21916 - DNA, 25 bp, Homo sapien
agcatggtctcactaagaaccagga

SEQ ID NO: 21917 - DNA, 25 bp, Homo sapien
agcatggtctcattaagaaccagga

SEQ ID NO: 21918 - DNA, 25 bp, Homo sapien
agcatggtgggatgagaaggagttg

SEQ ID NO: 21919 - DNA, 25 bp, Homo sapien
agcatggtgggatgagtaggagttg

SEQ ID NO: 21920 - DNA, 25 bp, Homo sapien
agcatggttatggatcctaaggtgt

SEQ ID NO: 21921 - DNA, 25 bp, Homo sapien
agcatggttctatgaaggatttgat

SEQ ID NO: 21922 - DNA, 25 bp, Homo sapien
agcatggttttatgaaggatttgat

SEQ ID NO: 21923 - DNA, 25 bp, Homo sapien
agcatgtgcatgagtctgtgtaccc

SEQ ID NO: 21924 - DNA, 25 bp, Homo sapien
agcatgtgcgtgagtctgtgtaccc

SEQ ID NO: 21925 - DNA, 25 bp, Homo sapien
agcattaaagttcagaaagtttgca

SEQ ID NO: 21926 - DNA, 25 bp, Homo sapien
agcattaaagttcataaagtttgca

SEQ ID NO: 21927 - DNA, 25 bp, Homo sapien
agcattaccgagccactagtgtatt

SEQ ID NO: 21928 - DNA, 25 bp, Homo sapien
agcattactgagccactagtgtatt

SEQ ID NO: 21929 - DNA, 25 bp, Homo sapien
agcattatcacctgcgctccgcctc

SEQ ID NO: 21930 - DNA, 25 bp, Homo sapien
agcattatcacctgtgctccgcctc

SEQ ID NO: 21931 - DNA, 25 bp, Homo sapien
agcattattcacaatacccaatata

SEQ ID NO: 21932 - DNA, 25 bp, Homo sapien
agcattattcacagtacccaatata

SEQ ID NO: 21933 - DNA, 25 bp, Homo sapien
agcattcaatatcattgttcatcat

SEQ ID NO: 21934 - DNA, 25 bp, Homo sapien
agcattcaatatcgttgttcatcat

SEQ ID NO: 21935 - DNA, 25 bp, Homo sapien
agcattcagtattttgacaagaatt

SEQ ID NO: 21936 - DNA, 25 bp, Homo sapien
agcattcagtattttggcaagaatt

SEQ ID NO: 21937 - DNA, 25 bp, Homo sapien
agcattccattttacaatcagacag

SEQ ID NO: 21938 - DNA, 25 bp, Homo sapien
agcattccattttataatcagacag

SEQ ID NO: 21939 - DNA, 25 bp, Homo sapien
agcattccctgaccacacgccaggc

SEQ ID NO: 21940 - DNA, 25 bp, Homo sapien
agcattccttgaccacacgccaggc

SEQ ID NO: 21941 - DNA, 25 bp, Homo sapien
agcattctaaagaataaagtcatgt

SEQ ID NO: 21942 - DNA, 25 bp, Homo sapien
agcattctaaagagtaaagtcatgt

SEQ ID NO: 21943 - DNA, 25 bp, Homo sapien
agcattgagagctatatcttttcat

SEQ ID NO: 21944 - DNA, 25 bp, Homo sapien
agcattgagagctgtatcttttcat

SEQ ID NO: 21945 - DNA, 25 bp, Homo sapien
agcattggacacactgatcaatcat

SEQ ID NO: 21946 - DNA, 25 bp, Homo sapien
agcattggacactctgatcaatcat

SEQ ID NO: 21947 - DNA, 25 bp, Homo sapien
agcattgtctgacgtgattctaaat

SEQ ID NO: 21948 - DNA, 25 bp, Homo sapien
agcattgtctgatgtgattctaaat

SEQ ID NO: 21949 - DNA, 25 bp, Homo sapien
agcattgtgacttgttatttttctt

SEQ ID NO: 21950 - DNA, 25 bp, Homo sapien
agcattgtgacttgttctttttctt

SEQ ID NO: 21951 - DNA, 25 bp, Homo sapien
agcatttaaccccttggtgatgaat

SEQ ID NO: 21952 - DNA, 25 bp, Homo sapien
agcatttaacccgttggtgatgaat

SEQ ID NO: 21953 - DNA, 25 bp, Homo sapien
agcatttacaagctcagtgtcccta

SEQ ID NO: 21954 - DNA, 25 bp, Homo sapien
agcatttacgagctcagtgtcccta

SEQ ID NO: 21955 - DNA, 25 bp, Homo sapien
agcatttctgacacacagtaggtgc

SEQ ID NO: 21956 - DNA, 25 bp, Homo sapien
agcatttctgacccacagtaggtgc

SEQ ID NO: 21957 - DNA, 25 bp, Homo sapien
agcatttgatactgagttgggtgct

SEQ ID NO: 21958 - DNA, 25 bp, Homo sapien
agcatttgatattgagttgggtgct

SEQ ID NO: 21959 - DNA, 25 bp, Homo sapien
agcattttaatccctatcaagagac

SEQ ID NO: 21960 - DNA, 25 bp, Homo sapien
agcattttaattcctatcaagagac

SEQ ID NO: 21961 - DNA, 25 bp, Homo sapien
agcattttctgggcaacttttgtgt

SEQ ID NO: 21962 - DNA, 25 bp, Homo sapien
agcattttctgggcaatttttgtgt

SEQ ID NO: 21963 - DNA, 25 bp, Homo sapien
agcattttgcaatcatctggaatat

SEQ ID NO: 21964 - DNA, 25 bp, Homo sapien
agcattttgcaattatctggaatat

SEQ ID NO: 21965 - DNA, 25 bp, Homo sapien
agcatttttgcagtttatcaatcgt

SEQ ID NO: 21966 - DNA, 25 bp, Homo sapien
agcatttttgccgtttatcaatcgt

SEQ ID NO: 21967 - DNA, 25 bp, Homo sapien
agccaaacatacttctaggcatttt

SEQ ID NO: 21968 - DNA, 25 bp, Homo sapien
agccaaacatacttgtaggcatttt

SEQ ID NO: 21969 - DNA, 25 bp, Homo sapien
agccaaacccagacagaggtgatgt

SEQ ID NO: 21970 - DNA, 25 bp, Homo sapien
agccaaaccgagacagaggtgatgt

SEQ ID NO: 21971 - DNA, 25 bp, Homo sapien
agccaaactacaatatctgccacaa

SEQ ID NO: 21972 - DNA, 25 bp, Homo sapien
agccaaactgcaatatctgccacaa

SEQ ID NO: 21973 - DNA, 25 bp, Homo sapien
agccaaagacccgcgagctcctggc

SEQ ID NO: 21974 - DNA, 25 bp, Homo sapien
agccaaagagctagttctcctcagt

SEQ ID NO: 21975 - DNA, 25 bp, Homo sapien
agccaaagagctggttctcctcagt

SEQ ID NO: 21976 - DNA, 25 bp, Homo sapien
agccaaagccatcatgcctagcaga

SEQ ID NO: 21977 - DNA, 25 bp, Homo sapien
agccaaagccatcgtgcctagcaga

SEQ ID NO: 21978 - DNA, 25 bp, Homo sapien
agccaaaggcccgcgagctcctggc

SEQ ID NO: 21979 - DNA, 25 bp, Homo sapien
agccaaagtgtctcacatctaaatc

SEQ ID NO: 21980 - DNA, 25 bp, Homo sapien
agccaaagtgtcttacatctaaatc

SEQ ID NO: 21981 - DNA, 25 bp, Homo sapien
agccaaatagaattttttattcata

SEQ ID NO: 21982 - DNA, 25 bp, Homo sapien
agccaaatataattttttattcata

SEQ ID NO: 21983 - DNA, 25 bp, Homo sapien
agccaaatattactcctacatacat

SEQ ID NO: 21984 - DNA, 25 bp, Homo sapien
agccaaatattgctcctacatacat

SEQ ID NO: 21985 - DNA, 25 bp, Homo sapien
agccaaattttgaacataaagctca

SEQ ID NO: 21986 - DNA, 25 bp, Homo sapien
agccaaattttgcacataaagctca

SEQ ID NO: 21987 - DNA, 25 bp, Homo sapien
agccaaccaggagaagcctcagcat

SEQ ID NO: 21988 - DNA, 25 bp, Homo sapien
agccaaccaggagcagcctcagcat

SEQ ID NO: 21989 - DNA, 25 bp, Homo sapien
agccaacgaattatgtcagaagcag

SEQ ID NO: 21990 - DNA, 25 bp, Homo sapien
agccaacgaattgtgtcagaagcag

SEQ ID NO: 21991 - DNA, 25 bp, Homo sapien
agccaactatcaacatcgggtacat

SEQ ID NO: 21992 - DNA, 25 bp, Homo sapien
agccaactgtcaacatcgggtacat

SEQ ID NO: 21993 - DNA, 25 bp, Homo sapien
agccaagataacaactctatcattt

SEQ ID NO: 21994 - DNA, 25 bp, Homo sapien
agccaagataacacctctatcattt

SEQ ID NO: 21995 - DNA, 25 bp, Homo sapien
agccaagcagcttaaaacaaccctt

SEQ ID NO: 21996 - DNA, 25 bp, Homo sapien
agccaagctgatgtattggtattgt

SEQ ID NO: 21997 - DNA, 25 bp, Homo sapien
agccaagctgatgttttggtattgt

SEQ ID NO: 21998 - DNA, 25 bp, Homo sapien
agccaagctgcttaaaacaaccctt

SEQ ID NO: 21999 - DNA, 25 bp, Homo sapien
agccaagcttgaaatgatgctgaca

SEQ ID NO: 22000 - DNA, 25 bp, Homo sapien
agccaagcttgaaatggtgctgaca

SEQ ID NO: 22001 - DNA, 25 bp, Homo sapien
agccaaggtacaaactcacgtgcat

SEQ ID NO: 22002 - DNA, 25 bp, Homo sapien
agccaaggtacagactcacgtgcat

SEQ ID NO: 22003 - DNA, 25 bp, Homo sapien
agccaatagagatcaatctagctat

SEQ ID NO: 22004 - DNA, 25 bp, Homo sapien
agccaatagggatcaatctagctat

SEQ ID NO: 22005 - DNA, 25 bp, Homo sapien
agccaatcatccaagcctgtgcaaa

SEQ ID NO: 22006 - DNA, 25 bp, Homo sapien
agccaatcatcccagcctgtgcaaa

SEQ ID NO: 22007 - DNA, 25 bp, Homo sapien
agccaattcacacggcaaaacctag

SEQ ID NO: 22008 - DNA, 25 bp, Homo sapien
agccaattcacatggcaaaacctag

SEQ ID NO: 22009 - DNA, 25 bp, Homo sapien
agccaatttccaatgattaaaagat

SEQ ID NO: 22010 - DNA, 25 bp, Homo sapien
agccaatttccgatgattaaaagat

SEQ ID NO: 22011 - DNA, 25 bp, Homo sapien
agccacaaacgcctacaactaatgg

SEQ ID NO: 22012 - DNA, 25 bp, Homo sapien
agccacaaagatagaccgaggttct

SEQ ID NO: 22013 - DNA, 25 bp, Homo sapien
agccacaaagatagactgaggttct

SEQ ID NO: 22014 - DNA, 25 bp, Homo sapien
agccacaaatgcctacaactaatgg

SEQ ID NO: 22015 - DNA, 25 bp, Homo sapien
agccacaaattagtcattaatatgt

SEQ ID NO: 22016 - DNA, 25 bp, Homo sapien
agccacaatttagtcattaatatgt

SEQ ID NO: 22017 - DNA, 25 bp, Homo sapien
agccacagacactgtaaccttggtg

SEQ ID NO: 22018 - DNA, 25 bp, Homo sapien
agccacaggcactgtaaccttggtg

SEQ ID NO: 22019 - DNA, 25 bp, Homo sapien
agccacagtttacacgagcacagag

SEQ ID NO: 22020 - DNA, 25 bp, Homo sapien
agccacagtttacatgagcacagag

SEQ ID NO: 22021 - DNA, 25 bp, Homo sapien
agccacattacacctttgcattact

SEQ ID NO: 22022 - DNA, 25 bp, Homo sapien
agccacattacgcctttgcattact

SEQ ID NO: 22023 - DNA, 25 bp, Homo sapien
agccaccaagttcatgttaatctat

SEQ ID NO: 22024 - DNA, 25 bp, Homo sapien
agccaccaagttcgtgttaatctat

SEQ ID NO: 22025 - DNA, 25 bp, Homo sapien
agccaccgagttggtggtgatttgt

SEQ ID NO: 22026 - DNA, 25 bp, Homo sapien
agccaccgagtttgtggtgatttgt

SEQ ID NO: 22027 - DNA, 25 bp, Homo sapien
agccacctgctttctgtcattatag

SEQ ID NO: 22028 - DNA, 25 bp, Homo sapien
agccacctgctttgtgtcattatag

SEQ ID NO: 22029 - DNA, 25 bp, Homo sapien
agccactagaacaatggtgctggag

SEQ ID NO: 22030 - DNA, 25 bp, Homo sapien
agccactagaacgatggtgctggag

SEQ ID NO: 22031 - DNA, 25 bp, Homo sapien
agccactagcttcatgatcatttgt

SEQ ID NO: 22032 - DNA, 25 bp, Homo sapien
agccactagcttcgtgatcatttgt

SEQ ID NO: 22033 - DNA, 25 bp, Homo sapien
agccactcagtctgctgtcttgtta

SEQ ID NO: 22034 - DNA, 25 bp, Homo sapien
agccactcagtcttctgtcttgtta

SEQ ID NO: 22035 - DNA, 25 bp, Homo sapien
agccactttgggctccttctggctc

SEQ ID NO: 22036 - DNA, 25 bp, Homo sapien
agccactttgggcttcttctggctc

SEQ ID NO: 22037 - DNA, 25 bp, Homo sapien
agccagaaaattccttcagtgagac

SEQ ID NO: 22038 - DNA, 25 bp, Homo sapien
agccagaaatttccttcagtgagac

SEQ ID NO: 22039 - DNA, 25 bp, Homo sapien
agccagaacctctgccctcttgccc

SEQ ID NO: 22040 - DNA, 25 bp, Homo sapien
agccagaacctttgccctcttgccc

SEQ ID NO: 22041 - DNA, 25 bp, Homo sapien
agccagaagatttttaatgggagaa

SEQ ID NO: 22042 - DNA, 25 bp, Homo sapien
agccagaaggtttttaatgggagaa

SEQ ID NO: 22043 - DNA, 25 bp, Homo sapien
agccagacagagcctttggaagaca

SEQ ID NO: 22044 - DNA, 25 bp, Homo sapien
agccagacagaggctttggaagaca

SEQ ID NO: 22045 - DNA, 25 bp, Homo sapien
agccagacttacatttagtagaatt

SEQ ID NO: 22046 - DNA, 25 bp, Homo sapien
agccagacttatatttagtagaatt

SEQ ID NO: 22047 - DNA, 25 bp, Homo sapien
agccagagaagtctgaggaggataa

SEQ ID NO: 22048 - DNA, 25 bp, Homo sapien
agccagagaagtttgaggaggataa

SEQ ID NO: 22049 - DNA, 25 bp, Homo sapien
agccagagatcgacatgcaggatat

SEQ ID NO: 22050 - DNA, 25 bp, Homo sapien
agccagagatcggcatgcaggatat

SEQ ID NO: 22051 - DNA, 25 bp, Homo sapien
agccagagatgacgcttcacattct

SEQ ID NO: 22052 - DNA, 25 bp, Homo sapien
agccagagatgactcttcacattct

SEQ ID NO: 22053 - DNA, 25 bp, Homo sapien
agccagaggtaaagaaatcgtaagt

SEQ ID NO: 22054 - DNA, 25 bp, Homo sapien
agccagaggtaaagaagtcgtaagt

SEQ ID NO: 22055 - DNA, 25 bp, Homo sapien
agccagatgcttgcaaaggacaggt

SEQ ID NO: 22056 - DNA, 25 bp, Homo sapien
agccagatgcttgtaaaggacaggt

SEQ ID NO: 22057 - DNA, 25 bp, Homo sapien
agccagatgtttctgaacgacacaa

SEQ ID NO: 22058 - DNA, 25 bp, Homo sapien
agccagatgtttttgaacgacacaa

SEQ ID NO: 22059 - DNA, 25 bp, Homo sapien
agccagcacatatgcaacaagaagc

SEQ ID NO: 22060 - DNA, 25 bp, Homo sapien
agccagcacatatgtaacaagaagc

SEQ ID NO: 22061 - DNA, 25 bp, Homo sapien
agccagccagacagagcctttggaa

SEQ ID NO: 22062 - DNA, 25 bp, Homo sapien
agccagccagacagaggctttggaa

SEQ ID NO: 22063 - DNA, 25 bp, Homo sapien
agccagctcatagacagtatctgct

SEQ ID NO: 22064 - DNA, 25 bp, Homo sapien
agccagctccacaaccagacacacc

SEQ ID NO: 22065 - DNA, 25 bp, Homo sapien
agccagctcgtagacagtatctgct

SEQ ID NO: 22066 - DNA, 25 bp, Homo sapien
agccagcttcacaaccagacacacc

SEQ ID NO: 22067 - DNA, 25 bp, Homo sapien
agccagctttcccaactcaatcacc

SEQ ID NO: 22068 - DNA, 25 bp, Homo sapien
agccagctttcccgactcaatcacc

SEQ ID NO: 22069 - DNA, 25 bp, Homo sapien
agccaggaactactaaaaagacatg

SEQ ID NO: 22070 - DNA, 25 bp, Homo sapien
agccaggaactgctaaaaagacatg

SEQ ID NO: 22071 - DNA, 25 bp, Homo sapien
agccaggaagtacttacaggaagcc

SEQ ID NO: 22072 - DNA, 25 bp, Homo sapien
agccaggaagtagttacaggaagcc

SEQ ID NO: 22073 - DNA, 25 bp, Homo sapien
agccaggactagaaccatcactaga

SEQ ID NO: 22074 - DNA, 25 bp, Homo sapien
agccaggactagaaccgtcactaga

SEQ ID NO: 22075 - DNA, 25 bp, Homo sapien
agccaggactcagaagcaggtctgc

SEQ ID NO: 22076 - DNA, 25 bp, Homo sapien
agccaggactcagcagcaggtctgc

SEQ ID NO: 22077 - DNA, 25 bp, Homo sapien
agccaggagattaacactgatgcaa

SEQ ID NO: 22078 - DNA, 25 bp, Homo sapien
agccaggagattaacattgatgcaa

SEQ ID NO: 22079 - DNA, 25 bp, Homo sapien
agccaggattcatacgtctaggaat

SEQ ID NO: 22080 - DNA, 25 bp, Homo sapien
agccaggattcataggtctaggaat

SEQ ID NO: 22081 - DNA, 25 bp, Homo sapien
agccaggcataagcagctatgtgct

SEQ ID NO: 22082 - DNA, 25 bp, Homo sapien
agccaggcgctgttgaatctgagtc

SEQ ID NO: 22083 - DNA, 25 bp, Homo sapien
agccaggcgctgttgactctgagtc

SEQ ID NO: 22084 - DNA, 25 bp, Homo sapien
agccaggcgtaagcagctatgtgct

SEQ ID NO: 22085 - DNA, 25 bp, Homo sapien
agccaggtatcacagagtgcttaag

SEQ ID NO: 22086 - DNA, 25 bp, Homo sapien
agccaggtatcatagagtgcttaag

SEQ ID NO: 22087 - DNA, 25 bp, Homo sapien
agccaggtccttaacttcccggagg

SEQ ID NO: 22088 - DNA, 25 bp, Homo sapien
agccaggtcctttacttcccggagg

SEQ ID NO: 22089 - DNA, 25 bp, Homo sapien
agccaggtttgcagagactgccttt

SEQ ID NO: 22090 - DNA, 25 bp, Homo sapien
agccaggtttgcagaggctgccttt

SEQ ID NO: 22091 - DNA, 25 bp, Homo sapien
agccagtcatgcaagtgaataatgt

SEQ ID NO: 22092 - DNA, 25 bp, Homo sapien
agccagtcatgcaggtgaataatgt

SEQ ID NO: 22093 - DNA, 25 bp, Homo sapien
agccagtgcggtggatttcatattc

SEQ ID NO: 22094 - DNA, 25 bp, Homo sapien
agccagtgcgttacatggccagagc

SEQ ID NO: 22095 - DNA, 25 bp, Homo sapien
agccagtgcgttatatggccagagc

SEQ ID NO: 22096 - DNA, 25 bp, Homo sapien
agccagtgtggtggatttcatattc

SEQ ID NO: 22097 - DNA, 25 bp, Homo sapien
agccagtttagccagtggaataata

SEQ ID NO: 22098 - DNA, 25 bp, Homo sapien
agccagtttagctagtggaataata

SEQ ID NO: 22099 - DNA, 25 bp, Homo sapien
agccataatgcaaaataagcctaaa

SEQ ID NO: 22100 - DNA, 25 bp, Homo sapien
agccataatgcgaaataagcctaaa

SEQ ID NO: 22101 - DNA, 25 bp, Homo sapien
agccatactatcaataggagagtga

SEQ ID NO: 22102 - DNA, 25 bp, Homo sapien
agccatactgtcaataggagagtga

SEQ ID NO: 22103 - DNA, 25 bp, Homo sapien
agccatcaagaagaatgtttactgg

SEQ ID NO: 22104 - DNA, 25 bp, Homo sapien
agccatcaagaagactgtttactgg

SEQ ID NO: 22105 - DNA, 25 bp, Homo sapien
agccatcaggcacaggaaagctgag

SEQ ID NO: 22106 - DNA, 25 bp, Homo sapien
agccatcaggcgcaggaaagctgag

SEQ ID NO: 22107 - DNA, 25 bp, Homo sapien
agccatcttttcgcccctgctaatg

SEQ ID NO: 22108 - DNA, 25 bp, Homo sapien
agccatctttttgcccctgctaatg

SEQ ID NO: 22109 - DNA, 25 bp, Homo sapien
agccatgaaaatttaaaaggactag

SEQ ID NO: 22110 - DNA, 25 bp, Homo sapien
agccatgaaaattttaaaggactag

SEQ ID NO: 22111 - DNA, 25 bp, Homo sapien
agccatgaagagtccttcctcagct

SEQ ID NO: 22112 - DNA, 25 bp, Homo sapien
agccatgaagagtctttcctcagct

SEQ ID NO: 22113 - DNA, 25 bp, Homo sapien
agccatgctggagtggtgctcacag

SEQ ID NO: 22114 - DNA, 25 bp, Homo sapien
agccatgctggcgtggtgctcacag

SEQ ID NO: 22115 - DNA, 25 bp, Homo sapien
agccatggtggttacggtgaaagac

SEQ ID NO: 22116 - DNA, 25 bp, Homo sapien
agccatggtggttgcggtgaaagac

SEQ ID NO: 22117 - DNA, 25 bp, Homo sapien
agccattaaacatgaacctgggtct

SEQ ID NO: 22118 - DNA, 25 bp, Homo sapien
agccattaaatttcctctgtagctt

SEQ ID NO: 22119 - DNA, 25 bp, Homo sapien
agccattaaatttcctttgtagctt

SEQ ID NO: 22120 - DNA, 25 bp, Homo sapien
agccattacaaagttaggaaaaacc

SEQ ID NO: 22121 - DNA, 25 bp, Homo sapien
agccattacaaggttaggaaaaacc

SEQ ID NO: 22122 - DNA, 25 bp, Homo sapien
agccattagacatgaacctgggtct

SEQ ID NO: 22123 - DNA, 25 bp, Homo sapien
agccattgcaaaatttgaaaccaag

SEQ ID NO: 22124 - DNA, 25 bp, Homo sapien
agccattgctgcattttaaatgtga

SEQ ID NO: 22125 - DNA, 25 bp, Homo sapien
agccattggaaaaacagaaattaaa

SEQ ID NO: 22126 - DNA, 25 bp, Homo sapien
agccattggaaaaatagaaattaaa

SEQ ID NO: 22127 - DNA, 25 bp, Homo sapien
agccattggtgcattttaaatgtga

SEQ ID NO: 22128 - DNA, 25 bp, Homo sapien
agccattgtaaaatttgaaaccaag

SEQ ID NO: 22129 - DNA, 25 bp, Homo sapien
agccatttaaccatgtcccagaaca

SEQ ID NO: 22130 - DNA, 25 bp, Homo sapien
agccatttaacgatgtcccagaaca

SEQ ID NO: 22131 - DNA, 25 bp, Homo sapien
agccatttatttcttgcattgttat

SEQ ID NO: 22132 - DNA, 25 bp, Homo sapien
agccatttatttgttgcattgttat

SEQ ID NO: 22133 - DNA, 25 bp, Homo sapien
agccattttcaaaacacaaaagtat

SEQ ID NO: 22134 - DNA, 25 bp, Homo sapien
agccattttcaaaacataaaagtat

SEQ ID NO: 22135 - DNA, 25 bp, Homo sapien
agcccaaagctctatgatgaccctg

SEQ ID NO: 22136 - DNA, 25 bp, Homo sapien
agcccaaagctgtatgatgaccctg

SEQ ID NO: 22137 - DNA, 25 bp, Homo sapien
agcccaaatgccagatgatgaatcc

SEQ ID NO: 22138 - DNA, 25 bp, Homo sapien
agcccaaatgccaggtgatgaatcc

SEQ ID NO: 22139 - DNA, 25 bp, Homo sapien
agcccaatagagttgacaggataat

SEQ ID NO: 22140 - DNA, 25 bp, Homo sapien
agcccaatagagttgataggataat

SEQ ID NO: 22141 - DNA, 25 bp, Homo sapien
agcccaatttaactatggaagggac

SEQ ID NO: 22142 - DNA, 25 bp, Homo sapien
agcccaatttagctatggaagggac

SEQ ID NO: 22143 - DNA, 25 bp, Homo sapien
agcccacagctttcaaatttataag

SEQ ID NO: 22144 - DNA, 25 bp, Homo sapien
agcccacaggtttcaaatttataag

SEQ ID NO: 22145 - DNA, 25 bp, Homo sapien
agcccacattttcatactctcagaa

SEQ ID NO: 22146 - DNA, 25 bp, Homo sapien
agcccacattttcatattctcagaa

SEQ ID NO: 22147 - DNA, 25 bp, Homo sapien
agcccacctaaaatgatgatcacag

SEQ ID NO: 22148 - DNA, 25 bp, Homo sapien
agcccacctgaaatgatgatcacag

SEQ ID NO: 22149 - DNA, 25 bp, Homo sapien
agcccactgcattgtcaaacctgaa

SEQ ID NO: 22150 - DNA, 25 bp, Homo sapien
agcccactgcattgtcgaacctgaa

SEQ ID NO: 22151 - DNA, 25 bp, Homo sapien
agcccagaacagcagaatataacag

SEQ ID NO: 22152 - DNA, 25 bp, Homo sapien
agcccagaatagcagaatataacag

SEQ ID NO: 22153 - DNA, 25 bp, Homo sapien
agcccagacaggtcatggaaactga

SEQ ID NO: 22154 - DNA, 25 bp, Homo sapien
agcccagagaggtcatggaaactga

SEQ ID NO: 22155 - DNA, 25 bp, Homo sapien
agcccagaggatagcgacggctgtg

SEQ ID NO: 22156 - DNA, 25 bp, Homo sapien
agcccagagtatagcgacggctgtg

SEQ ID NO: 22157 - DNA, 25 bp, Homo sapien
agcccaggagagggatttttttctt

SEQ ID NO: 22158 - DNA, 25 bp, Homo sapien
agcccaggagagggctttttttctt

SEQ ID NO: 22159 - DNA, 25 bp, Homo sapien
agcccagggaaatagtaattgcagt

SEQ ID NO: 22160 - DNA, 25 bp, Homo sapien
agcccagggaactagtaattgcagt

SEQ ID NO: 22161 - DNA, 25 bp, Homo sapien
agcccatagatggatgcctgaatag

SEQ ID NO: 22162 - DNA, 25 bp, Homo sapien
agcccatagatgtatgcctgaatag

SEQ ID NO: 22163 - DNA, 25 bp, Homo sapien
agcccataggaggaagttcccacaa

SEQ ID NO: 22164 - DNA, 25 bp, Homo sapien
agcccatagtaggaagttcccacaa

SEQ ID NO: 22165 - DNA, 25 bp, Homo sapien
agcccatcatactgtaggaatgtct

SEQ ID NO: 22166 - DNA, 25 bp, Homo sapien
agcccatcatattgtaggaatgtct

SEQ ID NO: 22167 - DNA, 25 bp, Homo sapien
agcccatccatcagtactttccttg

SEQ ID NO: 22168 - DNA, 25 bp, Homo sapien
agcccatctatcagtactttccttg

SEQ ID NO: 22169 - DNA, 25 bp, Homo sapien
agcccatctctaagtagaaaaatca

SEQ ID NO: 22170 - DNA, 25 bp, Homo sapien
agcccatctctgagtagaaaaatca

SEQ ID NO: 22171 - DNA, 25 bp, Homo sapien
agcccatgcccacttcaatctgttc

SEQ ID NO: 22172 - DNA, 25 bp, Homo sapien
agcccatgccctcttcaatctgttc

SEQ ID NO: 22173 - DNA, 25 bp, Homo sapien
agccccaaatcaatttgcttctctg

SEQ ID NO: 22174 - DNA, 25 bp, Homo sapien
agccccaaatcaattttcttctctg

SEQ ID NO: 22175 - DNA, 25 bp, Homo sapien
agccccatgcaatgaccctgcctta

SEQ ID NO: 22176 - DNA, 25 bp, Homo sapien
agccccatgcaatgactctgcctta

SEQ ID NO: 22177 - DNA, 25 bp, Homo sapien
agccccttacgtggcacagctggtt

SEQ ID NO: 22178 - DNA, 25 bp, Homo sapien
agccccttatgtggcacagctggtt

SEQ ID NO: 22179 - DNA, 25 bp, Homo sapien
agcccggaacttctgatgaatttgt

SEQ ID NO: 22180 - DNA, 25 bp, Homo sapien
agcccggagcttctgatgaatttgt

SEQ ID NO: 22181 - DNA, 25 bp, Homo sapien
agcccgtcaaaagcattcttatttc

SEQ ID NO: 22182 - DNA, 25 bp, Homo sapien
agcccgtcaaaggcattcttatttc

SEQ ID NO: 22183 - DNA, 25 bp, Homo sapien
agcccgtggtgctcaccttccagca

SEQ ID NO: 22184 - DNA, 25 bp, Homo sapien
agcccgtggtgctcactttccagca

SEQ ID NO: 22185 - DNA, 25 bp, Homo sapien
agccctagtaagcgtggattcactg

SEQ ID NO: 22186 - DNA, 25 bp, Homo sapien
agccctagtaagtgtggattcactg

SEQ ID NO: 22187 - DNA, 25 bp, Homo sapien
agccctattcatatgtggcctgctt

SEQ ID NO: 22188 - DNA, 25 bp, Homo sapien
agccctattcatgtgtggcctgctt

SEQ ID NO: 22189 - DNA, 25 bp, Homo sapien
agccctctggagatctggtctttat

SEQ ID NO: 22190 - DNA, 25 bp, Homo sapien
agccctctggagatcttgtctttat

SEQ ID NO: 22191 - DNA, 25 bp, Homo sapien
agccctgaggtctgaagtcaccctc

SEQ ID NO: 22192 - DNA, 25 bp, Homo sapien
agccctgaggtctggagtcaccctc

SEQ ID NO: 22193 - DNA, 25 bp, Homo sapien
agccctgcagatctttttcctggtt

SEQ ID NO: 22194 - DNA, 25 bp, Homo sapien
agccctgcatatctttttcctggtt

SEQ ID NO: 22195 - DNA, 25 bp, Homo sapien
agccctgttggacggaactttgctt

SEQ ID NO: 22196 - DNA, 25 bp, Homo sapien
agccctgttggatggaactttgctt

SEQ ID NO: 22197 - DNA, 25 bp, Homo sapien
agcccttacgaacaaaagatggacc

SEQ ID NO: 22198 - DNA, 25 bp, Homo sapien
agcccttactaacaaaagatggacc

SEQ ID NO: 22199 - DNA, 25 bp, Homo sapien
agcccttcgaagagcaacatcagac

SEQ ID NO: 22200 - DNA, 25 bp, Homo sapien
agcccttcgaagaggaacatcagac

SEQ ID NO: 22201 - DNA, 25 bp, Homo sapien
agcccttgctttgcccagtctccgt

SEQ ID NO: 22202 - DNA, 25 bp, Homo sapien
agcccttgttttgcccagtctccgt

SEQ ID NO: 22203 - DNA, 25 bp, Homo sapien
agccctttccggtaaaaagcaagtg

SEQ ID NO: 22204 - DNA, 25 bp, Homo sapien
agccctttctggtaaaaagcaagtg

SEQ ID NO: 22205 - DNA, 25 bp, Homo sapien
agccgaagaggacaatgccacagag

SEQ ID NO: 22206 - DNA, 25 bp, Homo sapien
agccgaagaggacagtgccacagag

SEQ ID NO: 22207 - DNA, 25 bp, Homo sapien
agccgacactgcagactgtaatgtt

SEQ ID NO: 22208 - DNA, 25 bp, Homo sapien
agccgacactgcggactgtaatgtt

SEQ ID NO: 22209 - DNA, 25 bp, Homo sapien
agccgatgattaacaccaggtcagg

SEQ ID NO: 22210 - DNA, 25 bp, Homo sapien
agccgatgattaccaccaggtcagg

SEQ ID NO: 22211 - DNA, 25 bp, Homo sapien
agccgattagggcagcaataccaat

SEQ ID NO: 22212 - DNA, 25 bp, Homo sapien
agccgattagggcagcgataccaat

SEQ ID NO: 22213 - DNA, 25 bp, Homo sapien
agccgctttgccgtgctgattgctt

SEQ ID NO: 22214 - DNA, 25 bp, Homo sapien
agccgctttgctgtgctgattgctt

SEQ ID NO: 22215 - DNA, 25 bp, Homo sapien
agccggcagaatagtgagcgaaaat

SEQ ID NO: 22216 - DNA, 25 bp, Homo sapien
agccggcagaatagtgcgcgaaaat

SEQ ID NO: 22217 - DNA, 25 bp, Homo sapien
agccgtagtttcgtcatttcatatt

SEQ ID NO: 22218 - DNA, 25 bp, Homo sapien
agccgtagtttcttcatttcatatt

SEQ ID NO: 22219 - DNA, 25 bp, Homo sapien
agccgtataaaggagttgggcataa

SEQ ID NO: 22220 - DNA, 25 bp, Homo sapien
agccgtatgaaggagttgggcataa

SEQ ID NO: 22221 - DNA, 25 bp, Homo sapien
agccgtttacagcccttgttgagct

SEQ ID NO: 22222 - DNA, 25 bp, Homo sapien
agccgtttatagcccttgttgagct

SEQ ID NO: 22223 - DNA, 25 bp, Homo sapien
agccgttttcatcaatgatcttagc

SEQ ID NO: 22224 - DNA, 25 bp, Homo sapien
agccgttttcatgaatgatcttagc

SEQ ID NO: 22225 - DNA, 25 bp, Homo sapien
agcctacaacatcttgttctaccag

SEQ ID NO: 22226 - DNA, 25 bp, Homo sapien
agcctacaatatcttgttctaccag

SEQ ID NO: 22227 - DNA, 25 bp, Homo sapien
agcctacatcacacccgaacaggca

SEQ ID NO: 22228 - DNA, 25 bp, Homo sapien
agcctacatcacagccgaacaggca

SEQ ID NO: 22229 - DNA, 25 bp, Homo sapien
agcctacattagaattagtctacac

SEQ ID NO: 22230 - DNA, 25 bp, Homo sapien
agcctacattagaattggtctacac

SEQ ID NO: 22231 - DNA, 25 bp, Homo sapien
agcctactattgccaggtagctgga

SEQ ID NO: 22232 - DNA, 25 bp, Homo sapien
agcctactgttgccaggtagctgga

SEQ ID NO: 22233 - DNA, 25 bp, Homo sapien
agcctagcagttaggaacactggca

SEQ ID NO: 22234 - DNA, 25 bp, Homo sapien
agcctagcagttaggagcactggca

SEQ ID NO: 22235 - DNA, 25 bp, Homo sapien
agcctagggatgctcacagtaatgg

SEQ ID NO: 22236 - DNA, 25 bp, Homo sapien
agcctagggatgttcacagtaatgg

SEQ ID NO: 22237 - DNA, 25 bp, Homo sapien
agcctagttactcttggcccaccac

SEQ ID NO: 22238 - DNA, 25 bp, Homo sapien
agcctagttacttttggcccaccac

SEQ ID NO: 22239 - DNA, 25 bp, Homo sapien
agcctatctcagcccttatcatgcc

SEQ ID NO: 22240 - DNA, 25 bp, Homo sapien
agcctatctcagctcttatcatgcc

SEQ ID NO: 22241 - DNA, 25 bp, Homo sapien
agcctatcttttgagagcatggttt

SEQ ID NO: 22242 - DNA, 25 bp, Homo sapien
agcctatcttttgcgagcatggttt

SEQ ID NO: 22243 - DNA, 25 bp, Homo sapien
agcctcaaattttcctttgaactct

SEQ ID NO: 22244 - DNA, 25 bp, Homo sapien
agcctcaacatcctcatctgcaaac

SEQ ID NO: 22245 - DNA, 25 bp, Homo sapien
agcctcaacatcttcatctgcaaac

SEQ ID NO: 22246 - DNA, 25 bp, Homo sapien
agcctcaacttttcctttgaactct

SEQ ID NO: 22247 - DNA, 25 bp, Homo sapien
agcctcacatcctaaaaacggtact

SEQ ID NO: 22248 - DNA, 25 bp, Homo sapien
agcctcacatcctgaaaacggtact

SEQ ID NO: 22249 - DNA, 25 bp, Homo sapien
agcctcactcgcatatcttacgtag

SEQ ID NO: 22250 - DNA, 25 bp, Homo sapien
agcctcactcgcgtatcttacgtag

SEQ ID NO: 22251 - DNA, 25 bp, Homo sapien
agcctcagaataggaatagcataat

SEQ ID NO: 22252 - DNA, 25 bp, Homo sapien
agcctcagaattggaatagcataat

SEQ ID NO: 22253 - DNA, 25 bp, Homo sapien
agcctcaggaagtttacaagcatgg

SEQ ID NO: 22254 - DNA, 25 bp, Homo sapien
agcctcaggaattttacaagcatgg

SEQ ID NO: 22255 - DNA, 25 bp, Homo sapien
agcctcatccttacctcactttaca

SEQ ID NO: 22256 - DNA, 25 bp, Homo sapien
agcctcatccttatctcactttaca

SEQ ID NO: 22257 - DNA, 25 bp, Homo sapien
agcctccaacccacgttctcctcag

SEQ ID NO: 22258 - DNA, 25 bp, Homo sapien
agcctccaacccatgttctcctcag

SEQ ID NO: 22259 - DNA, 25 bp, Homo sapien
agcctccatcaatattagagaaatg

SEQ ID NO: 22260 - DNA, 25 bp, Homo sapien
agcctccatcaatgttagagaaatg

SEQ ID NO: 22261 - DNA, 25 bp, Homo sapien
agcctccattcaacacacaaggtta

SEQ ID NO: 22262 - DNA, 25 bp, Homo sapien
agcctccattcaactcacaaggtta

SEQ ID NO: 22263 - DNA, 25 bp, Homo sapien
agcctcctgatctatgagaaataaa

SEQ ID NO: 22264 - DNA, 25 bp, Homo sapien
agcctcctgatttatgagaaataaa

SEQ ID NO: 22265 - DNA, 25 bp, Homo sapien
agcctcggagacaatttgtaggtgc

SEQ ID NO: 22266 - DNA, 25 bp, Homo sapien
agcctcggagactatttgtaggtgc

SEQ ID NO: 22267 - DNA, 25 bp, Homo sapien
agcctcggtcatgaaacagcccaag

SEQ ID NO: 22268 - DNA, 25 bp, Homo sapien
agcctcggtcatgaaagagcccaag

SEQ ID NO: 22269 - DNA, 25 bp, Homo sapien
agcctctcgatgacctatgaacagg

SEQ ID NO: 22270 - DNA, 25 bp, Homo sapien
agcctctcgatgagctatgaacagg

SEQ ID NO: 22271 - DNA, 25 bp, Homo sapien
agcctctgagacttaggcgagccag

SEQ ID NO: 22272 - DNA, 25 bp, Homo sapien
agcctctgagactttggcgagccag

SEQ ID NO: 22273 - DNA, 25 bp, Homo sapien
agcctgaaagaatattttatggtct

SEQ ID NO: 22274 - DNA, 25 bp, Homo sapien
agcctgaatgaatattttatggtct

SEQ ID NO: 22275 - DNA, 25 bp, Homo sapien
agcctgacaatttaaaaaggggggc

SEQ ID NO: 22276 - DNA, 25 bp, Homo sapien
agcctgacgatttaaaaaggggggc

SEQ ID NO: 22277 - DNA, 25 bp, Homo sapien
agcctgacggtggcaaggtcaactc

SEQ ID NO: 22278 - DNA, 25 bp, Homo sapien
agcctgacggtggctaggtcaactc

SEQ ID NO: 22279 - DNA, 25 bp, Homo sapien
agcctgagcttcctaacctatactg

SEQ ID NO: 22280 - DNA, 25 bp, Homo sapien
agcctgagcttcgtaacctatactg

SEQ ID NO: 22281 - DNA, 25 bp, Homo sapien
agcctgatgacctacttaatgttca

SEQ ID NO: 22282 - DNA, 25 bp, Homo sapien
agcctgatgacttacttaatgttca

SEQ ID NO: 22283 - DNA, 25 bp, Homo sapien
agcctgcacatatacctcttcattc

SEQ ID NO: 22284 - DNA, 25 bp, Homo sapien
agcctgcacgtatacctcttcattc

SEQ ID NO: 22285 - DNA, 25 bp, Homo sapien
agcctgccatgagtacattttcagg

SEQ ID NO: 22286 - DNA, 25 bp, Homo sapien
agcctgccatgagtacgttttcagg

SEQ ID NO: 22287 - DNA, 25 bp, Homo sapien
agcctggccgagcttgccacctact

SEQ ID NO: 22288 - DNA, 25 bp, Homo sapien
agcctggctgagcttgccacctact

SEQ ID NO: 22289 - DNA, 25 bp, Homo sapien
agcctggtctttttcggctgaatgg

SEQ ID NO: 22290 - DNA, 25 bp, Homo sapien
agcctggtcttttttggctgaatgg

SEQ ID NO: 22291 - DNA, 25 bp, Homo sapien
agcctggtgacatgtttaaacccca

SEQ ID NO: 22292 - DNA, 25 bp, Homo sapien
agcctggtgacatttttaaacccca

SEQ ID NO: 22293 - DNA, 25 bp, Homo sapien
agcctgtagagaagaaataaaagct

SEQ ID NO: 22294 - DNA, 25 bp, Homo sapien
agcctgtagagacgaaataaaagct

SEQ ID NO: 22295 - DNA, 25 bp, Homo sapien
agcctgtgaacaagataaggaagat

SEQ ID NO: 22296 - DNA, 25 bp, Homo sapien
agcctgtgaacgagataaggaagat

SEQ ID NO: 22297 - DNA, 25 bp, Homo sapien
agcctgtgcattataagcaggatac

SEQ ID NO: 22298 - DNA, 25 bp, Homo sapien
agcctgtgcgttataagcaggatac

SEQ ID NO: 22299 - DNA, 25 bp, Homo sapien
agccttaacaatagattagaccaag

SEQ ID NO: 22300 - DNA, 25 bp, Homo sapien
agccttaaccatagattagaccaag

SEQ ID NO: 22301 - DNA, 25 bp, Homo sapien
agccttagctctggtccctctcgat

SEQ ID NO: 22302 - DNA, 25 bp, Homo sapien
agccttagctcttgtccctctcgat

SEQ ID NO: 22303 - DNA, 25 bp, Homo sapien
agccttagtcgcccacagtggtcac

SEQ ID NO: 22304 - DNA, 25 bp, Homo sapien
agccttagtcgcccacggtggtcac

SEQ ID NO: 22305 - DNA, 25 bp, Homo sapien
agccttatgctatgcgagccactat

SEQ ID NO: 22306 - DNA, 25 bp, Homo sapien
agccttatgctatgggagccactat

SEQ ID NO: 22307 - DNA, 25 bp, Homo sapien
agccttattctagttaaatgtaaaa

SEQ ID NO: 22308 - DNA, 25 bp, Homo sapien
agccttattctggttaaatgtaaaa

SEQ ID NO: 22309 - DNA, 25 bp, Homo sapien
agccttattctgtggcagggcggct

SEQ ID NO: 22310 - DNA, 25 bp, Homo sapien
agccttattttgtggcagggcggct

SEQ ID NO: 22311 - DNA, 25 bp, Homo sapien
agccttcactcacactcttctgtcc

SEQ ID NO: 22312 - DNA, 25 bp, Homo sapien
agccttcactcacgctcttctgtcc

SEQ ID NO: 22313 - DNA, 25 bp, Homo sapien
agccttcagttgcgacctcagcctt

SEQ ID NO: 22314 - DNA, 25 bp, Homo sapien
agccttcagttgggacctcagcctt

SEQ ID NO: 22315 - DNA, 25 bp, Homo sapien
agccttccaaggagcgcggcccctc

SEQ ID NO: 22316 - DNA, 25 bp, Homo sapien
agccttccacactacatgactggta

SEQ ID NO: 22317 - DNA, 25 bp, Homo sapien
agccttccacactatatgactggta

SEQ ID NO: 22318 - DNA, 25 bp, Homo sapien
agccttccactgagatactgacttt

SEQ ID NO: 22319 - DNA, 25 bp, Homo sapien
agccttccattgagatactgacttt

SEQ ID NO: 22320 - DNA, 25 bp, Homo sapien
agccttcccgagcaggtgaacagat

SEQ ID NO: 22321 - DNA, 25 bp, Homo sapien
agccttccgaggagcgcggcccctc

SEQ ID NO: 22322 - DNA, 25 bp, Homo sapien
agccttcctgagcaggtgaacagat

SEQ ID NO: 22323 - DNA, 25 bp, Homo sapien
agccttcgctattgtttttaacatg

SEQ ID NO: 22324 - DNA, 25 bp, Homo sapien
agccttcgctattttttttaacatg

SEQ ID NO: 22325 - DNA, 25 bp, Homo sapien
agccttcttatttaacttatttggt

SEQ ID NO: 22326 - DNA, 25 bp, Homo sapien
agccttcttatttatcttatttggt

SEQ ID NO: 22327 - DNA, 25 bp, Homo sapien
agccttgaaagtactatttcacagg

SEQ ID NO: 22328 - DNA, 25 bp, Homo sapien
agccttgaatgtactatttcacagg

SEQ ID NO: 22329 - DNA, 25 bp, Homo sapien
agccttgacgggagagccaattcgg

SEQ ID NO: 22330 - DNA, 25 bp, Homo sapien
agccttgatccagaagatttttctc

SEQ ID NO: 22331 - DNA, 25 bp, Homo sapien
agccttgatccagcagatttttctc

SEQ ID NO: 22332 - DNA, 25 bp, Homo sapien
agccttgatgggagagccaattcgg

SEQ ID NO: 22333 - DNA, 25 bp, Homo sapien
agccttggcttcgtatccccacaat

SEQ ID NO: 22334 - DNA, 25 bp, Homo sapien
agccttggctttgtatccccacaat

SEQ ID NO: 22335 - DNA, 25 bp, Homo sapien
agccttgtaagaaaaccaggtggga

SEQ ID NO: 22336 - DNA, 25 bp, Homo sapien
agccttgtaagaaagccaggtggga

SEQ ID NO: 22337 - DNA, 25 bp, Homo sapien
agccttgtagttcgaggagaggaag

SEQ ID NO: 22338 - DNA, 25 bp, Homo sapien
agccttgtagttggaggagaggaag

SEQ ID NO: 22339 - DNA, 25 bp, Homo sapien
agcctttacataacagtagtcatac

SEQ ID NO: 22340 - DNA, 25 bp, Homo sapien
agcctttacataatagtagtcatac

SEQ ID NO: 22341 - DNA, 25 bp, Homo sapien
agcctttcaatgttacactatgcaa

SEQ ID NO: 22342 - DNA, 25 bp, Homo sapien
agcctttcattgttacactatgcaa

SEQ ID NO: 22343 - DNA, 25 bp, Homo sapien
agcctttcattgttattctccagtg

SEQ ID NO: 22344 - DNA, 25 bp, Homo sapien
agcctttcattgttcttctccagtg

SEQ ID NO: 22345 - DNA, 25 bp, Homo sapien
agcctttggcacgtgaagataattc

SEQ ID NO: 22346 - DNA, 25 bp, Homo sapien
agcctttggcatgtgaagataattc

SEQ ID NO: 22347 - DNA, 25 bp, Homo sapien
agcctttgggaactaattaatgagg

SEQ ID NO: 22348 - DNA, 25 bp, Homo sapien
agcctttgggagctaattaatgagg

SEQ ID NO: 22349 - DNA, 25 bp, Homo sapien
agcctttggttaagctcctgtgttc

SEQ ID NO: 22350 - DNA, 25 bp, Homo sapien
agcctttggttaagttcctgtgttc

SEQ ID NO: 22351 - DNA, 25 bp, Homo sapien
agccttttaaaaagcaggtgcccct

SEQ ID NO: 22352 - DNA, 25 bp, Homo sapien
agccttttaaaaatcaggtgcccct

SEQ ID NO: 22353 - DNA, 25 bp, Homo sapien
agcgaaaacttctaaggatggaatt

SEQ ID NO: 22354 - DNA, 25 bp, Homo sapien
agcgaaaacttgtaaggatggaatt

SEQ ID NO: 22355 - DNA, 25 bp, Homo sapien
agcgaaatgctatgagcataaatca

SEQ ID NO: 22356 - DNA, 25 bp, Homo sapien
agcgaaatgctgtgagcataaatca

SEQ ID NO: 22357 - DNA, 25 bp, Homo sapien
agcgaactcaaaggaagaggcttcc

SEQ ID NO: 22358 - DNA, 25 bp, Homo sapien
agcgaactcaagggaagaggcttcc

SEQ ID NO: 22359 - DNA, 25 bp, Homo sapien
agcgaagtgaaaagaatgcattaag

SEQ ID NO: 22360 - DNA, 25 bp, Homo sapien
agcgaagtgaaaataatgcattaag

SEQ ID NO: 22361 - DNA, 25 bp, Homo sapien
agcgacatcaggtgttttagtacag

SEQ ID NO: 22362 - DNA, 25 bp, Homo sapien
agcgacattaggtgttttagtacag

SEQ ID NO: 22363 - DNA, 25 bp, Homo sapien
agcgacttcgaaattattatatacg

SEQ ID NO: 22364 - DNA, 25 bp, Homo sapien
agcgactttgaaattattatatacg

SEQ ID NO: 22365 - DNA, 25 bp, Homo sapien
agcgaggagataaaatgccctggtt

SEQ ID NO: 22366 - DNA, 25 bp, Homo sapien
agcgaggaggtaaaatgccctggtt

SEQ ID NO: 22367 - DNA, 25 bp, Homo sapien
agcgaggctccatgcagacaggtga

SEQ ID NO: 22368 - DNA, 25 bp, Homo sapien
agcgaggctccgtgcagacaggtga

SEQ ID NO: 22369 - DNA, 25 bp, Homo sapien
agcgataccacgctcttccacgtag

SEQ ID NO: 22370 - DNA, 25 bp, Homo sapien
agcgataccactctcttccacgtag

SEQ ID NO: 22371 - DNA, 25 bp, Homo sapien
agcgatcatgtataaaaacattaca

SEQ ID NO: 22372 - DNA, 25 bp, Homo sapien
agcgatcatgtatgaaaacattaca

SEQ ID NO: 22373 - DNA, 25 bp, Homo sapien
agcgattgtcctatgaaagactagg

SEQ ID NO: 22374 - DNA, 25 bp, Homo sapien
agcgattgtcctgtgaaagactagg

SEQ ID NO: 22375 - DNA, 25 bp, Homo sapien
agcgcacctcagtattatgtgtatg

SEQ ID NO: 22376 - DNA, 25 bp, Homo sapien
agcgcacctcagtgttatgtgtatg

SEQ ID NO: 22377 - DNA, 25 bp, Homo sapien
agcgcatagtacgacagaatcagta

SEQ ID NO: 22378 - DNA, 25 bp, Homo sapien
agcgcatagtatgacagaatcagta

SEQ ID NO: 22379 - DNA, 25 bp, Homo sapien
agcgcattctattggcaaggctgcg

SEQ ID NO: 22380 - DNA, 25 bp, Homo sapien
agcgcattctattgtcaaggctgcg

SEQ ID NO: 22381 - DNA, 25 bp, Homo sapien
agcgcatttcatataacactaattt

SEQ ID NO: 22382 - DNA, 25 bp, Homo sapien
agcgcatttcatctaacactaattt

SEQ ID NO: 22383 - DNA, 25 bp, Homo sapien
agcgcgcatgcaatagatccagggt

SEQ ID NO: 22384 - DNA, 25 bp, Homo sapien
agcgcgcatgcaatggatccagggt

SEQ ID NO: 22385 - DNA, 25 bp, Homo sapien
agcgctactcggtgaccaaacccaa

SEQ ID NO: 22386 - DNA, 25 bp, Homo sapien
agcgctacttggtgaccaaacccaa

SEQ ID NO: 22387 - DNA, 25 bp, Homo sapien
agcgctagttgacggctagcccaag

SEQ ID NO: 22388 - DNA, 25 bp, Homo sapien
agcgctagttgatggctagcccaag

SEQ ID NO: 22389 - DNA, 25 bp, Homo sapien
agcgctgtgacatgggaagggccct

SEQ ID NO: 22390 - DNA, 25 bp, Homo sapien
agcgctgtgacgtgggaagggccct

SEQ ID NO: 22391 - DNA, 25 bp, Homo sapien
agcggacaccagagcaggatgagct

SEQ ID NO: 22392 - DNA, 25 bp, Homo sapien
agcggacaccagagtaggatgagct

SEQ ID NO: 22393 - DNA, 25 bp, Homo sapien
agcggcagatgcatgatggagtagc

SEQ ID NO: 22394 - DNA, 25 bp, Homo sapien
agcggcagatgcgtgatggagtagc

SEQ ID NO: 22395 - DNA, 25 bp, Homo sapien
agcggcctctctcaacttcatacta

SEQ ID NO: 22396 - DNA, 25 bp, Homo sapien
agcggcctctctcaccttcatacta

SEQ ID NO: 22397 - DNA, 25 bp, Homo sapien
agcgggacactgagttcttccccag

SEQ ID NO: 22398 - DNA, 25 bp, Homo sapien
agcgggacagtgagttcttccccag

SEQ ID NO: 22399 - DNA, 25 bp, Homo sapien
agcggggactccagccttataaaat

SEQ ID NO: 22400 - DNA, 25 bp, Homo sapien
agcggggactccaggcttataaaat

SEQ ID NO: 22401 - DNA, 25 bp, Homo sapien
agcgtatcctgggttattcatgtgg

SEQ ID NO: 22402 - DNA, 25 bp, Homo sapien
agcgtatcgtgggttattcatgtgg

SEQ ID NO: 22403 - DNA, 25 bp, Homo sapien
agcgtatgaaacaagattcacaaac

SEQ ID NO: 22404 - DNA, 25 bp, Homo sapien
agcgtatgaaagaagattcacaaac

SEQ ID NO: 22405 - DNA, 25 bp, Homo sapien
agcgtctcactttccttttcctttc

SEQ ID NO: 22406 - DNA, 25 bp, Homo sapien
agcgtctcgctttccttttcctttc

SEQ ID NO: 22407 - DNA, 25 bp, Homo sapien
agcgtgaaagagaagacctaagatg

SEQ ID NO: 22408 - DNA, 25 bp, Homo sapien
agcgtgaaagagaagagctaagatg

SEQ ID NO: 22409 - DNA, 25 bp, Homo sapien
agcgtgggcctatgatcaagcctgg

SEQ ID NO: 22410 - DNA, 25 bp, Homo sapien
agcgtgggcctatggtcaagcctgg

SEQ ID NO: 22411 - DNA, 25 bp, Homo sapien
agcgttaatgcttgatgtatccgaa

SEQ ID NO: 22412 - DNA, 25 bp, Homo sapien
agcgttaatgcttggtgtatccgaa

SEQ ID NO: 22413 - DNA, 25 bp, Homo sapien
agcgttttgattaagtgctggattt

SEQ ID NO: 22414 - DNA, 25 bp, Homo sapien
agcgttttgatttagtgctggattt

SEQ ID NO: 22415 - DNA, 25 bp, Homo sapien
agctaaaaaatgaagcctagtgaga

SEQ ID NO: 22416 - DNA, 25 bp, Homo sapien
agctaaaaatcatgatcactaagtg

SEQ ID NO: 22417 - DNA, 25 bp, Homo sapien
agctaaaaatcctgatcactaagtg

SEQ ID NO: 22418 - DNA, 25 bp, Homo sapien
agctaaaaatcctttaaatcagtta

SEQ ID NO: 22419 - DNA, 25 bp, Homo sapien
agctaaaaatcttttaaatcagtta

SEQ ID NO: 22420 - DNA, 25 bp, Homo sapien
agctaaaacatgaagcctagtgaga

SEQ ID NO: 22421 - DNA, 25 bp, Homo sapien
agctaaaatatgtctcattccaaac

SEQ ID NO: 22422 - DNA, 25 bp, Homo sapien
agctaaaatgtgtctcattccaaac

SEQ ID NO: 22423 - DNA, 25 bp, Homo sapien
agctaaactcacattccttctagtc

SEQ ID NO: 22424 - DNA, 25 bp, Homo sapien
agctaaactcatattccttctagtc

SEQ ID NO: 22425 - DNA, 25 bp, Homo sapien
agctaaagtcactgggaacagccct

SEQ ID NO: 22426 - DNA, 25 bp, Homo sapien
agctaaagtcattgggaacagccct

SEQ ID NO: 22427 - DNA, 25 bp, Homo sapien
agctaaatacgctgagactcagagg

SEQ ID NO: 22428 - DNA, 25 bp, Homo sapien
agctaaatagagacgttgcaggaga

SEQ ID NO: 22429 - DNA, 25 bp, Homo sapien
agctaaatagaggcgttgcaggaga

SEQ ID NO: 22430 - DNA, 25 bp, Homo sapien
agctaaatatgctgagactcagagg

SEQ ID NO: 22431 - DNA, 25 bp, Homo sapien
agctaaattctactgactttttcct

SEQ ID NO: 22432 - DNA, 25 bp, Homo sapien
agctaaattctactgattttttcct

SEQ ID NO: 22433 - DNA, 25 bp, Homo sapien
agctaacacatgacattgggcctgc

SEQ ID NO: 22434 - DNA, 25 bp, Homo sapien
agctaacacatggcattgggcctgc

SEQ ID NO: 22435 - DNA, 25 bp, Homo sapien
agctaacctacttgaaccagctgga

SEQ ID NO: 22436 - DNA, 25 bp, Homo sapien
agctaacctactttaaccagctgga

SEQ ID NO: 22437 - DNA, 25 bp, Homo sapien
agctaagactagcagagactcttag

SEQ ID NO: 22438 - DNA, 25 bp, Homo sapien
agctaagagacgaagaccatccctc

SEQ ID NO: 22439 - DNA, 25 bp, Homo sapien
agctaagagactaagaccatccctc

SEQ ID NO: 22440 - DNA, 25 bp, Homo sapien
agctaagattagcagagactcttag

SEQ ID NO: 22441 - DNA, 25 bp, Homo sapien
agctaagcattgttgggctataaaa

SEQ ID NO: 22442 - DNA, 25 bp, Homo sapien
agctaagcgttgttgggctataaaa

SEQ ID NO: 22443 - DNA, 25 bp, Homo sapien
agctaagttgcacttgaattttgaa

SEQ ID NO: 22444 - DNA, 25 bp, Homo sapien
agctaagttgcatttgaattttgaa

SEQ ID NO: 22445 - DNA, 25 bp, Homo sapien
agctaatatccagaaagggtaaaag

SEQ ID NO: 22446 - DNA, 25 bp, Homo sapien
agctaatatcctgaaagggtaaaag

SEQ ID NO: 22447 - DNA, 25 bp, Homo sapien
agctaatcataaagtggacccagct

SEQ ID NO: 22448 - DNA, 25 bp, Homo sapien
agctaatcgtaaagtggacccagct

SEQ ID NO: 22449 - DNA, 25 bp, Homo sapien
agctaatgaaatacataactgcctg

SEQ ID NO: 22450 - DNA, 25 bp, Homo sapien
agctaatgaaatacgtaactgcctg

SEQ ID NO: 22451 - DNA, 25 bp, Homo sapien
agctacaaaatccagtgcaaagctg

SEQ ID NO: 22452 - DNA, 25 bp, Homo sapien
agctacaaaatccggtgcaaagctg

SEQ ID NO: 22453 - DNA, 25 bp, Homo sapien
agctacaaaattgacgaattccttc

SEQ ID NO: 22454 - DNA, 25 bp, Homo sapien
agctacaaaattgatgaattccttc

SEQ ID NO: 22455 - DNA, 25 bp, Homo sapien
agctacaacttaccatatcttcctt

SEQ ID NO: 22456 - DNA, 25 bp, Homo sapien
agctacaacttacgatatcttcctt

SEQ ID NO: 22457 - DNA, 25 bp, Homo sapien
agctacaccattattatgttttaaa

SEQ ID NO: 22458 - DNA, 25 bp, Homo sapien
agctacactattattatgttttaaa

SEQ ID NO: 22459 - DNA, 25 bp, Homo sapien
agctacaggagagtttgggtcagcc

SEQ ID NO: 22460 - DNA, 25 bp, Homo sapien
agctacaggagcgtttgggtcagcc

SEQ ID NO: 22461 - DNA, 25 bp, Homo sapien
agctacagtgcaagctaaaaacata

SEQ ID NO: 22462 - DNA, 25 bp, Homo sapien
agctacagtgcgagctaaaaacata

SEQ ID NO: 22463 - DNA, 25 bp, Homo sapien
agctacatatgaggctgtgtggtta

SEQ ID NO: 22464 - DNA, 25 bp, Homo sapien
agctacatatgaggctttgtggtta

SEQ ID NO: 22465 - DNA, 25 bp, Homo sapien
agctaccaacactgtgttctttgat

SEQ ID NO: 22466 - DNA, 25 bp, Homo sapien
agctaccaagactgtgttctttgat

SEQ ID NO: 22467 - DNA, 25 bp, Homo sapien
agctacccattatcaattaccttct

SEQ ID NO: 22468 - DNA, 25 bp, Homo sapien
agctacccattattaattaccttct

SEQ ID NO: 22469 - DNA, 25 bp, Homo sapien
agctacctataaagttcaatatcct

SEQ ID NO: 22470 - DNA, 25 bp, Homo sapien
agctacctctaaagttcaatatcct

SEQ ID NO: 22471 - DNA, 25 bp, Homo sapien
agctaccttttcacatgtgtagttt

SEQ ID NO: 22472 - DNA, 25 bp, Homo sapien
agctaccttttcatatgtgtagttt

SEQ ID NO: 22473 - DNA, 25 bp, Homo sapien
agctactacttaatactgagccaag

SEQ ID NO: 22474 - DNA, 25 bp, Homo sapien
agctactacttactactgagccaag

SEQ ID NO: 22475 - DNA, 25 bp, Homo sapien
agctactacttgcttcctggacttg

SEQ ID NO: 22476 - DNA, 25 bp, Homo sapien
agctactacttgcttcgtggacttg

SEQ ID NO: 22477 - DNA, 25 bp, Homo sapien
agctactagagacattgctggcatg

SEQ ID NO: 22478 - DNA, 25 bp, Homo sapien
agctactagagacgttgctggcatg

SEQ ID NO: 22479 - DNA, 25 bp, Homo sapien
agctactatctggtttttgtctcag

SEQ ID NO: 22480 - DNA, 25 bp, Homo sapien
agctactatctgttttttgtctcag

SEQ ID NO: 22481 - DNA, 25 bp, Homo sapien
agctactctaaccattgatccttta

SEQ ID NO: 22482 - DNA, 25 bp, Homo sapien
agctactctaatcattgatccttta

SEQ ID NO: 22483 - DNA, 25 bp, Homo sapien
agctactgaaaaactgatttctaaa

SEQ ID NO: 22484 - DNA, 25 bp, Homo sapien
agctactgaaacactgatttctaaa

SEQ ID NO: 22485 - DNA, 25 bp, Homo sapien
agctactgaggactgtttcttttat

SEQ ID NO: 22486 - DNA, 25 bp, Homo sapien
agctactgatgactgtttcttttat

SEQ ID NO: 22487 - DNA, 25 bp, Homo sapien
agctactgtatttaaaattggctta

SEQ ID NO: 22488 - DNA, 25 bp, Homo sapien
agctactgtattttaaattggctta

SEQ ID NO: 22489 - DNA, 25 bp, Homo sapien
agctactttttttcatttccttgtg

SEQ ID NO: 22490 - DNA, 25 bp, Homo sapien
agctactttttttcgtttccttgtg

SEQ ID NO: 22491 - DNA, 25 bp, Homo sapien
agctagaaagaacaataatgacctc

SEQ ID NO: 22492 - DNA, 25 bp, Homo sapien
agctagaaagaataataatgacctc

SEQ ID NO: 22493 - DNA, 25 bp, Homo sapien
agctagaaggacgatactgaacggt

SEQ ID NO: 22494 - DNA, 25 bp, Homo sapien
agctagaaggatgatactgaacggt

SEQ ID NO: 22495 - DNA, 25 bp, Homo sapien
agctagaattaggtcacaaatggat

SEQ ID NO: 22496 - DNA, 25 bp, Homo sapien
agctagaattaggttacaaatggat

SEQ ID NO: 22497 - DNA, 25 bp, Homo sapien
agctagaattctgactcgctgattt

SEQ ID NO: 22498 - DNA, 25 bp, Homo sapien
agctagaattctgacttgctgattt

SEQ ID NO: 22499 - DNA, 25 bp, Homo sapien
agctagagccaaacacaacaaaatg

SEQ ID NO: 22500 - DNA, 25 bp, Homo sapien
agctagaggatcgaaggccaaccca

SEQ ID NO: 22501 - DNA, 25 bp, Homo sapien
agctagaggattgaaggccaaccca

SEQ ID NO: 22502 - DNA, 25 bp, Homo sapien
agctagaggcaaaataacttgagat

SEQ ID NO: 22503 - DNA, 25 bp, Homo sapien
agctagaggcaaaatagcttgagat

SEQ ID NO: 22504 - DNA, 25 bp, Homo sapien
agctagaggcaaacacaacaaaatg

SEQ ID NO: 22505 - DNA, 25 bp, Homo sapien
agctagatgctaattatttggaata

SEQ ID NO: 22506 - DNA, 25 bp, Homo sapien
agctagatgttaattatttggaata

SEQ ID NO: 22507 - DNA, 25 bp, Homo sapien
agctagcacagaagaaagaactttt

SEQ ID NO: 22508 - DNA, 25 bp, Homo sapien
agctagcacagtagaaagaactttt

SEQ ID NO: 22509 - DNA, 25 bp, Homo sapien
agctagcagaggactcaatgatgca

SEQ ID NO: 22510 - DNA, 25 bp, Homo sapien
agctagcagaggattcaatgatgca

SEQ ID NO: 22511 - DNA, 25 bp, Homo sapien
agctagccagctgatgaaaaagaga

SEQ ID NO: 22512 - DNA, 25 bp, Homo sapien
agctagccagctggtgaaaaagaga

SEQ ID NO: 22513 - DNA, 25 bp, Homo sapien
agctaggaacattatttcccttgtg

SEQ ID NO: 22514 - DNA, 25 bp, Homo sapien
agctaggaacattgtttcccttgtg

SEQ ID NO: 22515 - DNA, 25 bp, Homo sapien
agctagggagcgtatcctgggttat

SEQ ID NO: 22516 - DNA, 25 bp, Homo sapien
agctagggagcgtatcgtgggttat

SEQ ID NO: 22517 - DNA, 25 bp, Homo sapien
agctaggtatgacaacagagacaaa

SEQ ID NO: 22518 - DNA, 25 bp, Homo sapien
agctaggtatgataacagagacaaa

SEQ ID NO: 22519 - DNA, 25 bp, Homo sapien
agctagtaaatagtagacccaggac

SEQ ID NO: 22520 - DNA, 25 bp, Homo sapien
agctagtaaatggtagacccaggac

SEQ ID NO: 22521 - DNA, 25 bp, Homo sapien
agctagtataactgcaagtattctg

SEQ ID NO: 22522 - DNA, 25 bp, Homo sapien
agctagtataactgcacgtattctg

SEQ ID NO: 22523 - DNA, 25 bp, Homo sapien
agctagtgaattgaccaatttataa

SEQ ID NO: 22524 - DNA, 25 bp, Homo sapien
agctagtgaattggccaatttataa

SEQ ID NO: 22525 - DNA, 25 bp, Homo sapien
agctagtgcagtagacagaccattc

SEQ ID NO: 22526 - DNA, 25 bp, Homo sapien
agctagtggagtagacagaccattc

SEQ ID NO: 22527 - DNA, 25 bp, Homo sapien
agctagtggcacgaagcaggaacat

SEQ ID NO: 22528 - DNA, 25 bp, Homo sapien
agctagtggcatgaagcaggaacat

SEQ ID NO: 22529 - DNA, 25 bp, Homo sapien
agctataaaccaaagaagcatctac

SEQ ID NO: 22530 - DNA, 25 bp, Homo sapien
agctataaaccaacgaagcatctac

SEQ ID NO: 22531 - DNA, 25 bp, Homo sapien
agctataaatatacctttcagagtg

SEQ ID NO: 22532 - DNA, 25 bp, Homo sapien
agctataaatatacttttcagagtg

SEQ ID NO: 22533 - DNA, 25 bp, Homo sapien
agctataagaacctaaccgtagaag

SEQ ID NO: 22534 - DNA, 25 bp, Homo sapien
agctataagaacctaatcgtagaag

SEQ ID NO: 22535 - DNA, 25 bp, Homo sapien
agctataatgtggtaaagattagta

SEQ ID NO: 22536 - DNA, 25 bp, Homo sapien
agctataatgtggtcaagattagta

SEQ ID NO: 22537 - DNA, 25 bp, Homo sapien
agctatacttctacaccacatggga

SEQ ID NO: 22538 - DNA, 25 bp, Homo sapien
agctatacttctgcaccacatggga

SEQ ID NO: 22539 - DNA, 25 bp, Homo sapien
agctatattcctacatttcatttct

SEQ ID NO: 22540 - DNA, 25 bp, Homo sapien
agctatatttctacatttcatttct

SEQ ID NO: 22541 - DNA, 25 bp, Homo sapien
agctatcacctttgatgagtggcca

SEQ ID NO: 22542 - DNA, 25 bp, Homo sapien
agctatcacctttgttgagtggcca

SEQ ID NO: 22543 - DNA, 25 bp, Homo sapien
agctatcattgtacaactgcactcc

SEQ ID NO: 22544 - DNA, 25 bp, Homo sapien
agctatcattgtacgactgcactcc

SEQ ID NO: 22545 - DNA, 25 bp, Homo sapien
agctatgaagaacataatataaagc

SEQ ID NO: 22546 - DNA, 25 bp, Homo sapien
agctatgaagaacatattataaagc

SEQ ID NO: 22547 - DNA, 25 bp, Homo sapien
agctatggaaaaaagtgagtgagct

SEQ ID NO: 22548 - DNA, 25 bp, Homo sapien
agctatggaaaaaagttagtgagct

SEQ ID NO: 22549 - DNA, 25 bp, Homo sapien
agctatggtcacacctggcacaacc

SEQ ID NO: 22550 - DNA, 25 bp, Homo sapien
agctatggtcacgcctggcacaacc

SEQ ID NO: 22551 - DNA, 25 bp, Homo sapien
agctattaaacaagtcacacccttc

SEQ ID NO: 22552 - DNA, 25 bp, Homo sapien
agctattaaacaagtcgcacccttc

SEQ ID NO: 22553 - DNA, 25 bp, Homo sapien
agctattaactctcaattactagac

SEQ ID NO: 22554 - DNA, 25 bp, Homo sapien
agctattaactttcaattactagac

SEQ ID NO: 22555 - DNA, 25 bp, Homo sapien
agctattacgttgtgaagaaatttc

SEQ ID NO: 22556 - DNA, 25 bp, Homo sapien
agctattaggttgtgaagaaatttc

SEQ ID NO: 22557 - DNA, 25 bp, Homo sapien
agctattgcgaatatttctgcaaag

SEQ ID NO: 22558 - DNA, 25 bp, Homo sapien
agctattgtgaatatttctgcaaag

SEQ ID NO: 22559 - DNA, 25 bp, Homo sapien
agctatttctgaacatgaggcctct

SEQ ID NO: 22560 - DNA, 25 bp, Homo sapien
agctatttgtttacattccacttgc

SEQ ID NO: 22561 - DNA, 25 bp, Homo sapien
agctatttgtttagattccacttgc

SEQ ID NO: 22562 - DNA, 25 bp, Homo sapien
agctatttttgaacatgaggcctct

SEQ ID NO: 22563 - DNA, 25 bp, Homo sapien
agctcaaaataaaccaaggaaagaa

SEQ ID NO: 22564 - DNA, 25 bp, Homo sapien
agctcaaaataaagcaaggaaagaa

SEQ ID NO: 22565 - DNA, 25 bp, Homo sapien
agctcaaggaacaagatcatggcag

SEQ ID NO: 22566 - DNA, 25 bp, Homo sapien
agctcaaggaaccagatcatggcag

SEQ ID NO: 22567 - DNA, 25 bp, Homo sapien
agctcaaggataaagaggagaattg

SEQ ID NO: 22568 - DNA, 25 bp, Homo sapien
agctcaaggatagagaggagaattg

SEQ ID NO: 22569 - DNA, 25 bp, Homo sapien
agctcaataagaacagggactgact

SEQ ID NO: 22570 - DNA, 25 bp, Homo sapien
agctcaatcaagagaacagtcaaaa

SEQ ID NO: 22571 - DNA, 25 bp, Homo sapien
agctcaatcaagataacagtcaaaa

SEQ ID NO: 22572 - DNA, 25 bp, Homo sapien
agctcaatgagaacagggactgact

SEQ ID NO: 22573 - DNA, 25 bp, Homo sapien
agctcaccaaacatactaaatgagg

SEQ ID NO: 22574 - DNA, 25 bp, Homo sapien
agctcaccaaacgtactaaatgagg

SEQ ID NO: 22575 - DNA, 25 bp, Homo sapien
agctcactgtacaatcaggacgcaa

SEQ ID NO: 22576 - DNA, 25 bp, Homo sapien
agctcactgtataatcaggacgcaa

SEQ ID NO: 22577 - DNA, 25 bp, Homo sapien
agctcagaatggaaaacgcatttgg

SEQ ID NO: 22578 - DNA, 25 bp, Homo sapien
agctcagaccaataactattctcag

SEQ ID NO: 22579 - DNA, 25 bp, Homo sapien
agctcagaccaatgactattctcag

SEQ ID NO: 22580 - DNA, 25 bp, Homo sapien
agctcagagcacccaactaagtgaa

SEQ ID NO: 22581 - DNA, 25 bp, Homo sapien
agctcagagtacccaactaagtgaa

SEQ ID NO: 22582 - DNA, 25 bp, Homo sapien
agctcagagtggaaaacgcatttgg

SEQ ID NO: 22583 - DNA, 25 bp, Homo sapien
agctcagatgtcactttctcagaaa

SEQ ID NO: 22584 - DNA, 25 bp, Homo sapien
agctcagatgtcgctttctcagaaa

SEQ ID NO: 22585 - DNA, 25 bp, Homo sapien
agctcagatgtttgcacctttcttt

SEQ ID NO: 22586 - DNA, 25 bp, Homo sapien
agctcagatgtttgtacctttcttt

SEQ ID NO: 22587 - DNA, 25 bp, Homo sapien
agctcagcttcctaccactatggtc

SEQ ID NO: 22588 - DNA, 25 bp, Homo sapien
agctcagcttcctaccgctatggtc

SEQ ID NO: 22589 - DNA, 25 bp, Homo sapien
agctcaggccactccaacaaaatac

SEQ ID NO: 22590 - DNA, 25 bp, Homo sapien
agctcaggccactgcaacaaaatac

SEQ ID NO: 22591 - DNA, 25 bp, Homo sapien
agctcaggccatttttctacttgcc

SEQ ID NO: 22592 - DNA, 25 bp, Homo sapien
agctcaggtcatttttctacttgcc

SEQ ID NO: 22593 - DNA, 25 bp, Homo sapien
agctcagtgagtcccaggatgtctc

SEQ ID NO: 22594 - DNA, 25 bp, Homo sapien
agctcagtgcgtcccaggatgtctc

SEQ ID NO: 22595 - DNA, 25 bp, Homo sapien
agctcagtggtgctcccagaggctc

SEQ ID NO: 22596 - DNA, 25 bp, Homo sapien
agctcagtggtgcttccagaggctc

SEQ ID NO: 22597 - DNA, 25 bp, Homo sapien
agctcatagaaacagaagacatgac

SEQ ID NO: 22598 - DNA, 25 bp, Homo sapien
agctcatagaagcagaagacatgac

SEQ ID NO: 22599 - DNA, 25 bp, Homo sapien
agctcatagacatgtttaaaatttc

SEQ ID NO: 22600 - DNA, 25 bp, Homo sapien
agctcataggcatgtttaaaatttc

SEQ ID NO: 22601 - DNA, 25 bp, Homo sapien
agctcatggtaccattgcaatcaaa

SEQ ID NO: 22602 - DNA, 25 bp, Homo sapien
agctcatggtactattgcaatcaaa

SEQ ID NO: 22603 - DNA, 25 bp, Homo sapien
agctcatggtcctgtgcaaattaat

SEQ ID NO: 22604 - DNA, 25 bp, Homo sapien
agctcatggtcttgtgcaaattaat

SEQ ID NO: 22605 - DNA, 25 bp, Homo sapien
agctcatgtacacattttttttggg

SEQ ID NO: 22606 - DNA, 25 bp, Homo sapien
agctcatgtacactttttttttggg

SEQ ID NO: 22607 - DNA, 25 bp, Homo sapien
agctcattcaaactgttggctgaaa

SEQ ID NO: 22608 - DNA, 25 bp, Homo sapien
agctcattcaaattgttggctgaaa

SEQ ID NO: 22609 - DNA, 25 bp, Homo sapien
agctcattcctcgggatttaataag

SEQ ID NO: 22610 - DNA, 25 bp, Homo sapien
agctcattccttgggatttaataag

SEQ ID NO: 22611 - DNA, 25 bp, Homo sapien
agctcattctttgaatcattttatt

SEQ ID NO: 22612 - DNA, 25 bp, Homo sapien
agctcattctttgattcattttatt

SEQ ID NO: 22613 - DNA, 25 bp, Homo sapien
agctcatttgtctgacggtttttga

SEQ ID NO: 22614 - DNA, 25 bp, Homo sapien
agctcatttttctgacggtttttga

SEQ ID NO: 22615 - DNA, 25 bp, Homo sapien
agctccaactcttccctttatttta

SEQ ID NO: 22616 - DNA, 25 bp, Homo sapien
agctccaatgcccagtctctgatga

SEQ ID NO: 22617 - DNA, 25 bp, Homo sapien
agctccaatgcccagtgtctgatga

SEQ ID NO: 22618 - DNA, 25 bp, Homo sapien
agctccaattcttccctttatttta

SEQ ID NO: 22619 - DNA, 25 bp, Homo sapien
agctccatttccaagccactgctac

SEQ ID NO: 22620 - DNA, 25 bp, Homo sapien
agctccatttccaggccactgctac

SEQ ID NO: 22621 - DNA, 25 bp, Homo sapien
agctcccaatctgcctgggaagggc

SEQ ID NO: 22622 - DNA, 25 bp, Homo sapien
agctcccaatctgtctgggaagggc

SEQ ID NO: 22623 - DNA, 25 bp, Homo sapien
agctcccattttgaagagagaacat

SEQ ID NO: 22624 - DNA, 25 bp, Homo sapien
agctcccatttttaagagagaacat

SEQ ID NO: 22625 - DNA, 25 bp, Homo sapien
agctccgccatcctgagttcctgtg

SEQ ID NO: 22626 - DNA, 25 bp, Homo sapien
agctccgccatcttgagttcctgtg

SEQ ID NO: 22627 - DNA, 25 bp, Homo sapien
agctcctcacagcgtagtggaagag

SEQ ID NO: 22628 - DNA, 25 bp, Homo sapien
agctcctcacagtgtagtggaagag

SEQ ID NO: 22629 - DNA, 25 bp, Homo sapien
agctccttcctgtacacaccagctt

SEQ ID NO: 22630 - DNA, 25 bp, Homo sapien
agctccttcctgtacataccagctt

SEQ ID NO: 22631 - DNA, 25 bp, Homo sapien
agctccttctgttcaaccagaagtt

SEQ ID NO: 22632 - DNA, 25 bp, Homo sapien
agctccttctgttcaagcagaagtt

SEQ ID NO: 22633 - DNA, 25 bp, Homo sapien
agctccttttactatgtccaaagtc

SEQ ID NO: 22634 - DNA, 25 bp, Homo sapien
agctccttttactctgtccaaagtc

SEQ ID NO: 22635 - DNA, 25 bp, Homo sapien
agctcgtaagtgctcaaattcagat

SEQ ID NO: 22636 - DNA, 25 bp, Homo sapien
agctcgtaagtgttcaaattcagat

SEQ ID NO: 22637 - DNA, 25 bp, Homo sapien
agctctaaacacagattatatccta

SEQ ID NO: 22638 - DNA, 25 bp, Homo sapien
agctctaaacacaggttatatccta

SEQ ID NO: 22639 - DNA, 25 bp, Homo sapien
agctctagcctcagtacccgccatg

SEQ ID NO: 22640 - DNA, 25 bp, Homo sapien
agctctagcttcagtacccgccatg

SEQ ID NO: 22641 - DNA, 25 bp, Homo sapien
agctctagtaatcaagacagtgtgc

SEQ ID NO: 22642 - DNA, 25 bp, Homo sapien
agctctagtaattaagacagtgtgc

SEQ ID NO: 22643 - DNA, 25 bp, Homo sapien
agctctatagaaagtaaaatgtaga

SEQ ID NO: 22644 - DNA, 25 bp, Homo sapien
agctctatagagagtaaaatgtaga

SEQ ID NO: 22645 - DNA, 25 bp, Homo sapien
agctctcaacatacctctgtaggtt

SEQ ID NO: 22646 - DNA, 25 bp, Homo sapien
agctctcaacatatctctgtaggtt

SEQ ID NO: 22647 - DNA, 25 bp, Homo sapien
agctctcttcatgcattctctttcc

SEQ ID NO: 22648 - DNA, 25 bp, Homo sapien
agctctcttcatgcgttctctttcc

SEQ ID NO: 22649 - DNA, 25 bp, Homo sapien
agctctgccagataatgctctaaga

SEQ ID NO: 22650 - DNA, 25 bp, Homo sapien
agctctgccagatgatgctctaaga

SEQ ID NO: 22651 - DNA, 25 bp, Homo sapien
agctctggaaacgattactagttag

SEQ ID NO: 22652 - DNA, 25 bp, Homo sapien
agctctggaaacggttactagttag

SEQ ID NO: 22653 - DNA, 25 bp, Homo sapien
agctctgtaaatggccaaacaacca

SEQ ID NO: 22654 - DNA, 25 bp, Homo sapien
agctctgtaaatggtcaaacaacca

SEQ ID NO: 22655 - DNA, 25 bp, Homo sapien
agctctgtcctgcctaggcgactca

SEQ ID NO: 22656 - DNA, 25 bp, Homo sapien
agctctgtcttgcctaggcgactca

SEQ ID NO: 22657 - DNA, 25 bp, Homo sapien
agctcttacaggctcttcaaggtaa

SEQ ID NO: 22658 - DNA, 25 bp, Homo sapien
agctcttacagtctcttcaaggtaa

SEQ ID NO: 22659 - DNA, 25 bp, Homo sapien
agctcttcaagacaggacaaactca

SEQ ID NO: 22660 - DNA, 25 bp, Homo sapien
agctcttcaagagaggacaaactca

SEQ ID NO: 22661 - DNA, 25 bp, Homo sapien
agctcttcaggaccaagcctgaacc

SEQ ID NO: 22662 - DNA, 25 bp, Homo sapien
agctcttcgggaccaagcctgaacc

SEQ ID NO: 22663 - DNA, 25 bp, Homo sapien
agctcttctctcatggtaatacaat

SEQ ID NO: 22664 - DNA, 25 bp, Homo sapien
agctcttctcttatggtaatacaat

SEQ ID NO: 22665 - DNA, 25 bp, Homo sapien
agctcttgttacctaaccatcttcc

SEQ ID NO: 22666 - DNA, 25 bp, Homo sapien
agctcttgttatctaaccatcttcc

SEQ ID NO: 22667 - DNA, 25 bp, Homo sapien
agctctttcattactgtcttttatg

SEQ ID NO: 22668 - DNA, 25 bp, Homo sapien
agctctttcgttactgtcttttatg

SEQ ID NO: 22669 - DNA, 25 bp, Homo sapien
agctgaaactaccatctagcccttt

SEQ ID NO: 22670 - DNA, 25 bp, Homo sapien
agctgaaactactatctagcccttt

SEQ ID NO: 22671 - DNA, 25 bp, Homo sapien
agctgaaactgtaaaagtgcaatcc

SEQ ID NO: 22672 - DNA, 25 bp, Homo sapien
agctgaaatgctgcaagtcaataat

SEQ ID NO: 22673 - DNA, 25 bp, Homo sapien
agctgaaatgctgcgagtcaataat

SEQ ID NO: 22674 - DNA, 25 bp, Homo sapien
agctgaaattgtaaaagtgcaatcc

SEQ ID NO: 22675 - DNA, 25 bp, Homo sapien
agctgaacatttatcacttctacat

SEQ ID NO: 22676 - DNA, 25 bp, Homo sapien
agctgaacatttatcatttctacat

SEQ ID NO: 22677 - DNA, 25 bp, Homo sapien
agctgaatgcagccctatcagtgat

SEQ ID NO: 22678 - DNA, 25 bp, Homo sapien
agctgaatgtagccctatcagtgat

SEQ ID NO: 22679 - DNA, 25 bp, Homo sapien
agctgacatttgattctcctctaag

SEQ ID NO: 22680 - DNA, 25 bp, Homo sapien
agctgacattttattctcctctaag

SEQ ID NO: 22681 - DNA, 25 bp, Homo sapien
agctgaccctgacgcaaagattcat

SEQ ID NO: 22682 - DNA, 25 bp, Homo sapien
agctgaccctgatgcaaagattcat

SEQ ID NO: 22683 - DNA, 25 bp, Homo sapien
agctgactggtgcatgggaaggatt

SEQ ID NO: 22684 - DNA, 25 bp, Homo sapien
agctgactggtgcctgggaaggatt

SEQ ID NO: 22685 - DNA, 25 bp, Homo sapien
agctgagaagcattcggctgattct

SEQ ID NO: 22686 - DNA, 25 bp, Homo sapien
agctgagaagcatttggctgattct

SEQ ID NO: 22687 - DNA, 25 bp, Homo sapien
agctgagcagaaagaggttgggtct

SEQ ID NO: 22688 - DNA, 25 bp, Homo sapien
agctgagcagaaagagtttgggtct

SEQ ID NO: 22689 - DNA, 25 bp, Homo sapien
agctgaggagaacacgctgtgctca

SEQ ID NO: 22690 - DNA, 25 bp, Homo sapien
agctgaggagaacatgctgtgctca

SEQ ID NO: 22691 - DNA, 25 bp, Homo sapien
agctgagggaactgaggtccaggga

SEQ ID NO: 22692 - DNA, 25 bp, Homo sapien
agctgagggaattgaggtccaggga

SEQ ID NO: 22693 - DNA, 25 bp, Homo sapien
agctgaggttcacaaagtttgagga

SEQ ID NO: 22694 - DNA, 25 bp, Homo sapien
agctgaggttcagaaagtttgagga

SEQ ID NO: 22695 - DNA, 25 bp, Homo sapien
agctgataagctaacaagaatcaac

SEQ ID NO: 22696 - DNA, 25 bp, Homo sapien
agctgataagctaataagaatcaac

SEQ ID NO: 22697 - DNA, 25 bp, Homo sapien
agctgatccacagtatcttccatac

SEQ ID NO: 22698 - DNA, 25 bp, Homo sapien
agctgatccgcagtatcttccatac

SEQ ID NO: 22699 - DNA, 25 bp, Homo sapien
agctgatgtattggtattgtgctta

SEQ ID NO: 22700 - DNA, 25 bp, Homo sapien
agctgatgtgacgagtggctcccta

SEQ ID NO: 22701 - DNA, 25 bp, Homo sapien
agctgatgtgatgagtggctcccta

SEQ ID NO: 22702 - DNA, 25 bp, Homo sapien
agctgatgtggaaagaaccactggc

SEQ ID NO: 22703 - DNA, 25 bp, Homo sapien
agctgatgtggatagaaccactggc

SEQ ID NO: 22704 - DNA, 25 bp, Homo sapien
agctgatgttatcaacaacgttcta

SEQ ID NO: 22705 - DNA, 25 bp, Homo sapien
agctgatgttattaacaacgttcta

SEQ ID NO: 22706 - DNA, 25 bp, Homo sapien
agctgatgttttggtattgtgctta

SEQ ID NO: 22707 - DNA, 25 bp, Homo sapien
agctgattacattgtgcccacgcag

SEQ ID NO: 22708 - DNA, 25 bp, Homo sapien
agctgattacattgtgtccacgcag

SEQ ID NO: 22709 - DNA, 25 bp, Homo sapien
agctgattcactcagttgaaacatc

SEQ ID NO: 22710 - DNA, 25 bp, Homo sapien
agctgattcacttagttgaaacatc

SEQ ID NO: 22711 - DNA, 25 bp, Homo sapien
agctgcaaaaaacaaggattttccc

SEQ ID NO: 22712 - DNA, 25 bp, Homo sapien
agctgcaaaaagcaaggattttccc

SEQ ID NO: 22713 - DNA, 25 bp, Homo sapien
agctgcacagccagaatataaaccc

SEQ ID NO: 22714 - DNA, 25 bp, Homo sapien
agctgcacggccagaatataaaccc

SEQ ID NO: 22715 - DNA, 25 bp, Homo sapien
agctgcactaaacaatggattttca

SEQ ID NO: 22716 - DNA, 25 bp, Homo sapien
agctgcactgaacaatggattttca

SEQ ID NO: 22717 - DNA, 25 bp, Homo sapien
agctgcagaaaacacatagccacct

SEQ ID NO: 22718 - DNA, 25 bp, Homo sapien
agctgcagcaaacacatagccacct

SEQ ID NO: 22719 - DNA, 25 bp, Homo sapien
agctgccaaggctacatcattttgt

SEQ ID NO: 22720 - DNA, 25 bp, Homo sapien
agctgccaaggttacatcattttgt

SEQ ID NO: 22721 - DNA, 25 bp, Homo sapien
agctgccagtcagccgagcccgtga

SEQ ID NO: 22722 - DNA, 25 bp, Homo sapien
agctgccagtcagctgagcccgtga

SEQ ID NO: 22723 - DNA, 25 bp, Homo sapien
agctgccctggcatatttaacaaca

SEQ ID NO: 22724 - DNA, 25 bp, Homo sapien
agctgccctggcgtatttaacaaca

SEQ ID NO: 22725 - DNA, 25 bp, Homo sapien
agctgcctatttcacacatacagaa

SEQ ID NO: 22726 - DNA, 25 bp, Homo sapien
agctgcctatttcgcacatacagaa

SEQ ID NO: 22727 - DNA, 25 bp, Homo sapien
agctgctctcaaacatacgctagaa

SEQ ID NO: 22728 - DNA, 25 bp, Homo sapien
agctgctctgaaacatacgctagaa

SEQ ID NO: 22729 - DNA, 25 bp, Homo sapien
agctgctgaaaaacttcagaaactg

SEQ ID NO: 22730 - DNA, 25 bp, Homo sapien
agctgctgaaaatcttcagaaactg

SEQ ID NO: 22731 - DNA, 25 bp, Homo sapien
agctgctgagctaaccaacggtgga

SEQ ID NO: 22732 - DNA, 25 bp, Homo sapien
agctgctgagctagccaacggtgga

SEQ ID NO: 22733 - DNA, 25 bp, Homo sapien
agctgctgcataagaaacgaaactg

SEQ ID NO: 22734 - DNA, 25 bp, Homo sapien
agctgctgcattagaaacgaaactg

SEQ ID NO: 22735 - DNA, 25 bp, Homo sapien
agctgctgggctctttctgtttgtc

SEQ ID NO: 22736 - DNA, 25 bp, Homo sapien
agctgctgggctctttttgtttgtc

SEQ ID NO: 22737 - DNA, 25 bp, Homo sapien
agctgcttagtgaaggtgatttcct

SEQ ID NO: 22738 - DNA, 25 bp, Homo sapien
agctgcttagtgatggtgatttcct

SEQ ID NO: 22739 - DNA, 25 bp, Homo sapien
agctgcttcagaactgtgtgtcatg

SEQ ID NO: 22740 - DNA, 25 bp, Homo sapien
agctgcttgagaactgtgtgtcatg

SEQ ID NO: 22741 - DNA, 25 bp, Homo sapien
agctggaaaataccaacggcaactc

SEQ ID NO: 22742 - DNA, 25 bp, Homo sapien
agctggaaaatactaacggcaactc

SEQ ID NO: 22743 - DNA, 25 bp, Homo sapien
agctggaaaatgcaactggcatact

SEQ ID NO: 22744 - DNA, 25 bp, Homo sapien
agctggaaaatgtaactggcatact

SEQ ID NO: 22745 - DNA, 25 bp, Homo sapien
agctggaaccacacaaaaagcttag

SEQ ID NO: 22746 - DNA, 25 bp, Homo sapien
agctggaaccacacgaaaagcttag

SEQ ID NO: 22747 - DNA, 25 bp, Homo sapien
agctggaacggtgtactaagttaac

SEQ ID NO: 22748 - DNA, 25 bp, Homo sapien
agctggaagcagtcaggaacataag

SEQ ID NO: 22749 - DNA, 25 bp, Homo sapien
agctggaagcagtgaggaacataag

SEQ ID NO: 22750 - DNA, 25 bp, Homo sapien
agctggaagctggccatttgggtgt

SEQ ID NO: 22751 - DNA, 25 bp, Homo sapien
agctggaagctggctatttgggtgt

SEQ ID NO: 22752 - DNA, 25 bp, Homo sapien
agctggaatggcatatgcaagcaac

SEQ ID NO: 22753 - DNA, 25 bp, Homo sapien
agctggaatggtatatgcaagcaac

SEQ ID NO: 22754 - DNA, 25 bp, Homo sapien
agctggaatggtgtactaagttaac

SEQ ID NO: 22755 - DNA, 25 bp, Homo sapien
agctggacaggagcgaagagtctcc

SEQ ID NO: 22756 - DNA, 25 bp, Homo sapien
agctggactggagcgaagagtctcc

SEQ ID NO: 22757 - DNA, 25 bp, Homo sapien
agctggcactgagaatgaagagaaa

SEQ ID NO: 22758 - DNA, 25 bp, Homo sapien
agctggcattgagaatgaagagaaa

SEQ ID NO: 22759 - DNA, 25 bp, Homo sapien
agctggccatgcatcaataacataa

SEQ ID NO: 22760 - DNA, 25 bp, Homo sapien
agctggccatgcgtcaataacataa

SEQ ID NO: 22761 - DNA, 25 bp, Homo sapien
agctggctgtctaaagatatgttga

SEQ ID NO: 22762 - DNA, 25 bp, Homo sapien
agctggctgtctacagatatgttga

SEQ ID NO: 22763 - DNA, 25 bp, Homo sapien
agctgggacagttgtcactattcac

SEQ ID NO: 22764 - DNA, 25 bp, Homo sapien
agctgggacggttgtcactattcac

SEQ ID NO: 22765 - DNA, 25 bp, Homo sapien
agctgggagtgccgcgaatcagtgt

SEQ ID NO: 22766 - DNA, 25 bp, Homo sapien
agctgggagtgctgcgaatcagtgt

SEQ ID NO: 22767 - DNA, 25 bp, Homo sapien
agctggggacacaagattatagatg

SEQ ID NO: 22768 - DNA, 25 bp, Homo sapien
agctggggacacaatattatagatg

SEQ ID NO: 22769 - DNA, 25 bp, Homo sapien
agctggtctcaaagccataattgat

SEQ ID NO: 22770 - DNA, 25 bp, Homo sapien
agctggtctcaaagccgtaattgat

SEQ ID NO: 22771 - DNA, 25 bp, Homo sapien
agctggtgtagagttgaccttcatt

SEQ ID NO: 22772 - DNA, 25 bp, Homo sapien
agctggtgtggagttgaccttcatt

SEQ ID NO: 22773 - DNA, 25 bp, Homo sapien
agctggtttcttacttaaatactgc

SEQ ID NO: 22774 - DNA, 25 bp, Homo sapien
agctggttttttacttaaatactgc

SEQ ID NO: 22775 - DNA, 25 bp, Homo sapien
agctgtaaaccctctgagaacagga

SEQ ID NO: 22776 - DNA, 25 bp, Homo sapien
agctgtaaatatctcagtgctattt

SEQ ID NO: 22777 - DNA, 25 bp, Homo sapien
agctgtaaatatttcagtgctattt

SEQ ID NO: 22778 - DNA, 25 bp, Homo sapien
agctgtaagccctctgagaacagga

SEQ ID NO: 22779 - DNA, 25 bp, Homo sapien
agctgtacccagtcattagggaaaa

SEQ ID NO: 22780 - DNA, 25 bp, Homo sapien
agctgtacccagtcgttagggaaaa

SEQ ID NO: 22781 - DNA, 25 bp, Homo sapien
agctgtagatagagacattcagcca

SEQ ID NO: 22782 - DNA, 25 bp, Homo sapien
agctgtagatagagacgttcagcca

SEQ ID NO: 22783 - DNA, 25 bp, Homo sapien
agctgtaggcggatctaccattctg

SEQ ID NO: 22784 - DNA, 25 bp, Homo sapien
agctgtaggtggatctaccattctg

SEQ ID NO: 22785 - DNA, 25 bp, Homo sapien
agctgtattattagggatttaggtc

SEQ ID NO: 22786 - DNA, 25 bp, Homo sapien
agctgtattattagggttttaggtc

SEQ ID NO: 22787 - DNA, 25 bp, Homo sapien
agctgtcaagttaattaatctatct

SEQ ID NO: 22788 - DNA, 25 bp, Homo sapien
agctgtcacttcggaaaccatctga

SEQ ID NO: 22789 - DNA, 25 bp, Homo sapien
agctgtcaggttaattaatctatct

SEQ ID NO: 22790 - DNA, 25 bp, Homo sapien
agctgtcatgtggcgttactgactg

SEQ ID NO: 22791 - DNA, 25 bp, Homo sapien
agctgtcatgtggtgttactgactg

SEQ ID NO: 22792 - DNA, 25 bp, Homo sapien
agctgtcatttcggaaaccatctga

SEQ ID NO: 22793 - DNA, 25 bp, Homo sapien
agctgtcccgcgtgtggtgatttgt

SEQ ID NO: 22794 - DNA, 25 bp, Homo sapien
agctgtcctgcgtgtggtgatttgt

SEQ ID NO: 22795 - DNA, 25 bp, Homo sapien
agctgtctatatccgataggctaca

SEQ ID NO: 22796 - DNA, 25 bp, Homo sapien
agctgtctatatctgataggctaca

SEQ ID NO: 22797 - DNA, 25 bp, Homo sapien
agctgtgaacagatggataaggtct

SEQ ID NO: 22798 - DNA, 25 bp, Homo sapien
agctgtgaacagcatcagcaacgag

SEQ ID NO: 22799 - DNA, 25 bp, Homo sapien
agctgtgaacagcatcggcaacgag

SEQ ID NO: 22800 - DNA, 25 bp, Homo sapien
agctgtgaacaggtggataaggtct

SEQ ID NO: 22801 - DNA, 25 bp, Homo sapien
agctgtgcaaagtcaattcaacttt

SEQ ID NO: 22802 - DNA, 25 bp, Homo sapien
agctgtgcagagtcaattcaacttt

SEQ ID NO: 22803 - DNA, 25 bp, Homo sapien
agctgtgcccagatccgagccagag

SEQ ID NO: 22804 - DNA, 25 bp, Homo sapien
agctgtgcccaggtccgagccagag

SEQ ID NO: 22805 - DNA, 25 bp, Homo sapien
agctgtggcctgataaaggcaaatg

SEQ ID NO: 22806 - DNA, 25 bp, Homo sapien
agctgtgggatctaacaatgaacag

SEQ ID NO: 22807 - DNA, 25 bp, Homo sapien
agctgtgggttctaacaatgaacag

SEQ ID NO: 22808 - DNA, 25 bp, Homo sapien
agctgtggtctgataaaggcaaatg

SEQ ID NO: 22809 - DNA, 25 bp, Homo sapien
agctgtgtaatcgattgtgaagaag

SEQ ID NO: 22810 - DNA, 25 bp, Homo sapien
agctgtgtaatctattgtgaagaag

SEQ ID NO: 22811 - DNA, 25 bp, Homo sapien
agctgtgtgctaaacctaacacatg

SEQ ID NO: 22812 - DNA, 25 bp, Homo sapien
agctgtgtgttaaacctaacacatg

SEQ ID NO: 22813 - DNA, 25 bp, Homo sapien
agctgtgtgtttcctggaaatgcca

SEQ ID NO: 22814 - DNA, 25 bp, Homo sapien
agctgtgtgttttctggaaatgcca

SEQ ID NO: 22815 - DNA, 25 bp, Homo sapien
agctgttcctatgaagccatgttgg

SEQ ID NO: 22816 - DNA, 25 bp, Homo sapien
agctgttcctattaagccatgttgg

SEQ ID NO: 22817 - DNA, 25 bp, Homo sapien
agctgttcctttgcttggctacgtc

SEQ ID NO: 22818 - DNA, 25 bp, Homo sapien
agctgttcctttgtttggctacgtc

SEQ ID NO: 22819 - DNA, 25 bp, Homo sapien
agctgtttcactgtcagacaagtaa

SEQ ID NO: 22820 - DNA, 25 bp, Homo sapien
agctgtttcgctgtcagacaagtaa

SEQ ID NO: 22821 - DNA, 25 bp, Homo sapien
agcttaaacattagctactctacct

SEQ ID NO: 22822 - DNA, 25 bp, Homo sapien
agcttaaacgttagctactctacct

SEQ ID NO: 22823 - DNA, 25 bp, Homo sapien
agcttaactgtacgccaggagaaaa

SEQ ID NO: 22824 - DNA, 25 bp, Homo sapien
agcttaactgtatgccaggagaaaa

SEQ ID NO: 22825 - DNA, 25 bp, Homo sapien
agcttaagaaagcgatctcaggaag

SEQ ID NO: 22826 - DNA, 25 bp, Homo sapien
agcttaagaaagtgatctcaggaag

SEQ ID NO: 22827 - DNA, 25 bp, Homo sapien
agcttaataaaacaattgcactttg

SEQ ID NO: 22828 - DNA, 25 bp, Homo sapien
agcttaataaaacgattgcactttg

SEQ ID NO: 22829 - DNA, 25 bp, Homo sapien
agcttaatagccaatgtgacagtat

SEQ ID NO: 22830 - DNA, 25 bp, Homo sapien
agcttaatagccagtgtgacagtat

SEQ ID NO: 22831 - DNA, 25 bp, Homo sapien
agcttaattagccaggtgtcctgca

SEQ ID NO: 22832 - DNA, 25 bp, Homo sapien
agcttaattagcgaggtgtcctgca

SEQ ID NO: 22833 - DNA, 25 bp, Homo sapien
agcttacaaccgctatgagggcaga

SEQ ID NO: 22834 - DNA, 25 bp, Homo sapien
agcttacaacctctatgagggcaga

SEQ ID NO: 22835 - DNA, 25 bp, Homo sapien
agcttaccaatgacggtcttctatg

SEQ ID NO: 22836 - DNA, 25 bp, Homo sapien
agcttaccactctgatacttttaac

SEQ ID NO: 22837 - DNA, 25 bp, Homo sapien
agcttaccaggactttaaactcttt

SEQ ID NO: 22838 - DNA, 25 bp, Homo sapien
agcttaccaggattttaaactcttt

SEQ ID NO: 22839 - DNA, 25 bp, Homo sapien
agcttaccagtgacggtcttctatg

SEQ ID NO: 22840 - DNA, 25 bp, Homo sapien
agcttaccgctctgatacttttaac

SEQ ID NO: 22841 - DNA, 25 bp, Homo sapien
agcttagaatgcagatcactccaat

SEQ ID NO: 22842 - DNA, 25 bp, Homo sapien
agcttagaatgtagatcactccaat

SEQ ID NO: 22843 - DNA, 25 bp, Homo sapien
agcttagatttccgcttcaggatga

SEQ ID NO: 22844 - DNA, 25 bp, Homo sapien
agcttagatttctgcttcaggatga

SEQ ID NO: 22845 - DNA, 25 bp, Homo sapien
agcttagcaatccaaacagaaaagg

SEQ ID NO: 22846 - DNA, 25 bp, Homo sapien
agcttagcaatccaaagagaaaagg

SEQ ID NO: 22847 - DNA, 25 bp, Homo sapien
agcttaggcggctatagagtgcttg

SEQ ID NO: 22848 - DNA, 25 bp, Homo sapien
agcttaggtggctatagagtgcttg

SEQ ID NO: 22849 - DNA, 25 bp, Homo sapien
agcttagtcccagcatataacaatt

SEQ ID NO: 22850 - DNA, 25 bp, Homo sapien
agcttagtcccagcgtataacaatt

SEQ ID NO: 22851 - DNA, 25 bp, Homo sapien
agcttataaacaacattgaaataag

SEQ ID NO: 22852 - DNA, 25 bp, Homo sapien
agcttataaactacattgaaataag

SEQ ID NO: 22853 - DNA, 25 bp, Homo sapien
agcttatatttcagtagtcaggtat

SEQ ID NO: 22854 - DNA, 25 bp, Homo sapien
agcttatatttcattagtcaggtat

SEQ ID NO: 22855 - DNA, 25 bp, Homo sapien
agcttatgatgatgcctagagatta

SEQ ID NO: 22856 - DNA, 25 bp, Homo sapien
agcttatgatggtgcctagagatta

SEQ ID NO: 22857 - DNA, 25 bp, Homo sapien
agcttattaaaacaacgttaggctc

SEQ ID NO: 22858 - DNA, 25 bp, Homo sapien
agcttattaaaacaactttaggctc

SEQ ID NO: 22859 - DNA, 25 bp, Homo sapien
agcttattaaactccatgacacagt

SEQ ID NO: 22860 - DNA, 25 bp, Homo sapien
agcttattaaattccatgacacagt

SEQ ID NO: 22861 - DNA, 25 bp, Homo sapien
agcttcaaaaccttacatgaattga

SEQ ID NO: 22862 - DNA, 25 bp, Homo sapien
agcttcaaaactttacatgaattga

SEQ ID NO: 22863 - DNA, 25 bp, Homo sapien
agcttcagttcctccacgcgtaaat

SEQ ID NO: 22864 - DNA, 25 bp, Homo sapien
agcttcagttcctccatgcgtaaat

SEQ ID NO: 22865 - DNA, 25 bp, Homo sapien
agcttcatacccattagcggtcact

SEQ ID NO: 22866 - DNA, 25 bp, Homo sapien
agcttcatacccgttagcggtcact

SEQ ID NO: 22867 - DNA, 25 bp, Homo sapien
agcttcatatgccggaaattaagag

SEQ ID NO: 22868 - DNA, 25 bp, Homo sapien
agcttcatatgctggaaattaagag

SEQ ID NO: 22869 - DNA, 25 bp, Homo sapien
agcttcatcagagcagtcagtagaa

SEQ ID NO: 22870 - DNA, 25 bp, Homo sapien
agcttcatcagggcagtcagtagaa

SEQ ID NO: 22871 - DNA, 25 bp, Homo sapien
agcttcatctatttctccagctttt

SEQ ID NO: 22872 - DNA, 25 bp, Homo sapien
agcttcatgatctaatacaaatgca

SEQ ID NO: 22873 - DNA, 25 bp, Homo sapien
agcttcatgatctcatacaaatgca

SEQ ID NO: 22874 - DNA, 25 bp, Homo sapien
agcttcatttatttctccagctttt

SEQ ID NO: 22875 - DNA, 25 bp, Homo sapien
agcttcccaaaaatgcatacaacat

SEQ ID NO: 22876 - DNA, 25 bp, Homo sapien
agcttcccaaaaattcatacaacat

SEQ ID NO: 22877 - DNA, 25 bp, Homo sapien
agcttcccatgtgatttgagtgtgc

SEQ ID NO: 22878 - DNA, 25 bp, Homo sapien
agcttcccatgttatttgagtgtgc

SEQ ID NO: 22879 - DNA, 25 bp, Homo sapien
agcttccctcagaacattgcacacg

SEQ ID NO: 22880 - DNA, 25 bp, Homo sapien
agcttccctcataacattgcacacg

SEQ ID NO: 22881 - DNA, 25 bp, Homo sapien
agcttcctaagcaagactatctact

SEQ ID NO: 22882 - DNA, 25 bp, Homo sapien
agcttcctaagcacgactatctact

SEQ ID NO: 22883 - DNA, 25 bp, Homo sapien
agcttcctaccactatggtccagat

SEQ ID NO: 22884 - DNA, 25 bp, Homo sapien
agcttcctaccgctatggtccagat

SEQ ID NO: 22885 - DNA, 25 bp, Homo sapien
agcttcctcatctcccatttcgcct

SEQ ID NO: 22886 - DNA, 25 bp, Homo sapien
agcttcctccttcactgggcactca

SEQ ID NO: 22887 - DNA, 25 bp, Homo sapien
agcttcctcgtctcccatttcgcct

SEQ ID NO: 22888 - DNA, 25 bp, Homo sapien
agcttcctctttcactgggcactca

SEQ ID NO: 22889 - DNA, 25 bp, Homo sapien
agcttccttgacgtcactggctaca

SEQ ID NO: 22890 - DNA, 25 bp, Homo sapien
agcttccttgacgtcattggctaca

SEQ ID NO: 22891 - DNA, 25 bp, Homo sapien
agcttctaccgtctgtttttgtgca

SEQ ID NO: 22892 - DNA, 25 bp, Homo sapien
agcttctactgtctgtttttgtgca

SEQ ID NO: 22893 - DNA, 25 bp, Homo sapien
agcttctaggtgtgcctgctgagta

SEQ ID NO: 22894 - DNA, 25 bp, Homo sapien
agcttctaggtgttcctgctgagta

SEQ ID NO: 22895 - DNA, 25 bp, Homo sapien
agcttctccatcaacactgctactg

SEQ ID NO: 22896 - DNA, 25 bp, Homo sapien
agcttctccatcgacactgctactg

SEQ ID NO: 22897 - DNA, 25 bp, Homo sapien
agcttctctaacttattttgttaat

SEQ ID NO: 22898 - DNA, 25 bp, Homo sapien
agcttctctaacttcttttgttaat

SEQ ID NO: 22899 - DNA, 25 bp, Homo sapien
agcttctgttttctgccagtgagta

SEQ ID NO: 22900 - DNA, 25 bp, Homo sapien
agcttctgttttctgctagtgagta

SEQ ID NO: 22901 - DNA, 25 bp, Homo sapien
agcttcttagatgtacttagggcat

SEQ ID NO: 22902 - DNA, 25 bp, Homo sapien
agcttcttagatgtccttagggcat

SEQ ID NO: 22903 - DNA, 25 bp, Homo sapien
agcttctttctttcccaaaatcacc

SEQ ID NO: 22904 - DNA, 25 bp, Homo sapien
agcttctttcttttccaaaatcacc

SEQ ID NO: 22905 - DNA, 25 bp, Homo sapien
agcttgaaccatggcaatgaaaagg

SEQ ID NO: 22906 - DNA, 25 bp, Homo sapien
agcttgaaccatggcagtgaaaagg

SEQ ID NO: 22907 - DNA, 25 bp, Homo sapien
agcttgaagcatctgtgacatctgt

SEQ ID NO: 22908 - DNA, 25 bp, Homo sapien
agcttgaagcatttgtgacatctgt

SEQ ID NO: 22909 - DNA, 25 bp, Homo sapien
agcttgcatagctctacaatggaga

SEQ ID NO: 22910 - DNA, 25 bp, Homo sapien
agcttgcatagctctataatggaga

SEQ ID NO: 22911 - DNA, 25 bp, Homo sapien
agcttgccttccaccacacagtctg

SEQ ID NO: 22912 - DNA, 25 bp, Homo sapien
agcttgccttccaccatacagtctg

SEQ ID NO: 22913 - DNA, 25 bp, Homo sapien
agcttgccttttcagtttcataaca

SEQ ID NO: 22914 - DNA, 25 bp, Homo sapien
agcttgccttttcattttcataaca

SEQ ID NO: 22915 - DNA, 25 bp, Homo sapien
agcttgctgtgggatgtcacttttt

SEQ ID NO: 22916 - DNA, 25 bp, Homo sapien
agcttgctgtgggttgtcacttttt

SEQ ID NO: 22917 - DNA, 25 bp, Homo sapien
agcttgctttgactaacagaatatc

SEQ ID NO: 22918 - DNA, 25 bp, Homo sapien
agcttgctttgactaatagaatatc

SEQ ID NO: 22919 - DNA, 25 bp, Homo sapien
agcttggcattgatcaaacacttta

SEQ ID NO: 22920 - DNA, 25 bp, Homo sapien
agcttggcattgttcaaacacttta

SEQ ID NO: 22921 - DNA, 25 bp, Homo sapien
agcttgtactacaacaagattccac

SEQ ID NO: 22922 - DNA, 25 bp, Homo sapien
agcttgtactacgacaagattccac

SEQ ID NO: 22923 - DNA, 25 bp, Homo sapien
agcttgtccacatgatctcctgctc

SEQ ID NO: 22924 - DNA, 25 bp, Homo sapien
agcttgtccgcatgatctcctgctc

SEQ ID NO: 22925 - DNA, 25 bp, Homo sapien
agcttgtgagtacaaataaaatcac

SEQ ID NO: 22926 - DNA, 25 bp, Homo sapien
agcttgtgagtataaataaaatcac

SEQ ID NO: 22927 - DNA, 25 bp, Homo sapien
agcttgtggctccaaaaaagactcc

SEQ ID NO: 22928 - DNA, 25 bp, Homo sapien
agcttgtggctcgaaaaaagactcc

SEQ ID NO: 22929 - DNA, 25 bp, Homo sapien
agcttgttatgacaggacacaaagg

SEQ ID NO: 22930 - DNA, 25 bp, Homo sapien
agcttgttatgacagggcacaaagg

SEQ ID NO: 22931 - DNA, 25 bp, Homo sapien
agcttgttcagaattattattaaaa

SEQ ID NO: 22932 - DNA, 25 bp, Homo sapien
agcttgttctgaattattattaaaa

SEQ ID NO: 22933 - DNA, 25 bp, Homo sapien
agctttaaaactcagatctaacaaa

SEQ ID NO: 22934 - DNA, 25 bp, Homo sapien
agctttaaaactcatatctaacaaa

SEQ ID NO: 22935 - DNA, 25 bp, Homo sapien
agctttacctttaacgaaacagaaa

SEQ ID NO: 22936 - DNA, 25 bp, Homo sapien
agctttacctttaatgaaacagaaa

SEQ ID NO: 22937 - DNA, 25 bp, Homo sapien
agctttatcacttgatgaggtaatt

SEQ ID NO: 22938 - DNA, 25 bp, Homo sapien
agctttatcgcttgatgaggtaatt

SEQ ID NO: 22939 - DNA, 25 bp, Homo sapien
agctttcacgacaataaaatggata

SEQ ID NO: 22940 - DNA, 25 bp, Homo sapien
agctttcatgacaataaaatggata

SEQ ID NO: 22941 - DNA, 25 bp, Homo sapien
agctttccagagcaggtaatgtcag

SEQ ID NO: 22942 - DNA, 25 bp, Homo sapien
agctttccagagtaggtaatgtcag

SEQ ID NO: 22943 - DNA, 25 bp, Homo sapien
agctttcccccagtccatgctgcaa

SEQ ID NO: 22944 - DNA, 25 bp, Homo sapien
agctttcccccagtccttgctgcaa

SEQ ID NO: 22945 - DNA, 25 bp, Homo sapien
agctttctgtgaagacatactgaag

SEQ ID NO: 22946 - DNA, 25 bp, Homo sapien
agctttctgtgaagtcatactgaag

SEQ ID NO: 22947 - DNA, 25 bp, Homo sapien
agctttgagcaatacacatgctcat

SEQ ID NO: 22948 - DNA, 25 bp, Homo sapien
agctttgagcagtacacatgctcat

SEQ ID NO: 22949 - DNA, 25 bp, Homo sapien
agctttgccaactaagacccagcag

SEQ ID NO: 22950 - DNA, 25 bp, Homo sapien
agctttgccgactaagacccagcag

SEQ ID NO: 22951 - DNA, 25 bp, Homo sapien
agctttgctctacattcttttcaat

SEQ ID NO: 22952 - DNA, 25 bp, Homo sapien
agctttgctctacgttcttttcaat

SEQ ID NO: 22953 - DNA, 25 bp, Homo sapien
agctttggtgcaatcaaaggaatgt

SEQ ID NO: 22954 - DNA, 25 bp, Homo sapien
agctttggtgcaattaaaggaatgt

SEQ ID NO: 22955 - DNA, 25 bp, Homo sapien
agctttgtaacaatttaggcgctac

SEQ ID NO: 22956 - DNA, 25 bp, Homo sapien
agctttgtaacgatttaggcgctac

SEQ ID NO: 22957 - DNA, 25 bp, Homo sapien
agctttgtgacatgcatatattgca

SEQ ID NO: 22958 - DNA, 25 bp, Homo sapien
agctttgtgacatgtatatattgca

SEQ ID NO: 22959 - DNA, 25 bp, Homo sapien
agctttgtgatccgcttggctgacc

SEQ ID NO: 22960 - DNA, 25 bp, Homo sapien
agctttgtgatctgcttggctgacc

SEQ ID NO: 22961 - DNA, 25 bp, Homo sapien
agcttttaaaacaagccatgtgtta

SEQ ID NO: 22962 - DNA, 25 bp, Homo sapien
agcttttaaaacaatccatgtgtta

SEQ ID NO: 22963 - DNA, 25 bp, Homo sapien
agcttttaggtatacggcacaggct

SEQ ID NO: 22964 - DNA, 25 bp, Homo sapien
agcttttaggtatatggcacaggct

SEQ ID NO: 22965 - DNA, 25 bp, Homo sapien
agcttttataatccttcctcaacta

SEQ ID NO: 22966 - DNA, 25 bp, Homo sapien
agcttttataatcctttctcaacta

SEQ ID NO: 22967 - DNA, 25 bp, Homo sapien
agcttttatttcgtctctacaggct

SEQ ID NO: 22968 - DNA, 25 bp, Homo sapien
agcttttatttcttctctacaggct

SEQ ID NO: 22969 - DNA, 25 bp, Homo sapien
agcttttcatcaatataatatacat

SEQ ID NO: 22970 - DNA, 25 bp, Homo sapien
agcttttcatcagccaaaaagaaag

SEQ ID NO: 22971 - DNA, 25 bp, Homo sapien
agcttttcatcagccataaagaaag

SEQ ID NO: 22972 - DNA, 25 bp, Homo sapien
agcttttcatcagtataatatacat

SEQ ID NO: 22973 - DNA, 25 bp, Homo sapien
agcttttcattgaagctactacatt

SEQ ID NO: 22974 - DNA, 25 bp, Homo sapien
agcttttcctgcagtaaagactgct

SEQ ID NO: 22975 - DNA, 25 bp, Homo sapien
agcttttcgttgaagctactacatt

SEQ ID NO: 22976 - DNA, 25 bp, Homo sapien
agcttttctctacctcttcccacca

SEQ ID NO: 22977 - DNA, 25 bp, Homo sapien
agcttttctctagctcttcccacca

SEQ ID NO: 22978 - DNA, 25 bp, Homo sapien
agcttttcttgcagtaaagactgct

SEQ ID NO: 22979 - DNA, 25 bp, Homo sapien
agcttttgaatagtatcagacactt

SEQ ID NO: 22980 - DNA, 25 bp, Homo sapien
agcttttgaatagtattagacactt

SEQ ID NO: 22981 - DNA, 25 bp, Homo sapien
agcttttgctatgaggcaataacac

SEQ ID NO: 22982 - DNA, 25 bp, Homo sapien
agcttttgctattaggcaataacac

SEQ ID NO: 22983 - DNA, 25 bp, Homo sapien
agcttttggaccccttttctgaaca

SEQ ID NO: 22984 - DNA, 25 bp, Homo sapien
agcttttggacctcttttctgaaca

SEQ ID NO: 22985 - DNA, 25 bp, Homo sapien
agctttttcgcccacagcaagaaat

SEQ ID NO: 22986 - DNA, 25 bp, Homo sapien
agctttttcgcctacagcaagaaat

SEQ ID NO: 22987 - DNA, 25 bp, Homo sapien
aggaaaaaaagaacacaataaactc

SEQ ID NO: 22988 - DNA, 25 bp, Homo sapien
aggaaaaaagaacgtgaagactcag

SEQ ID NO: 22989 - DNA, 25 bp, Homo sapien
aggaaaaaagaatgtgaagactcag

SEQ ID NO: 22990 - DNA, 25 bp, Homo sapien
aggaaaaaaggaacacaataaactc

SEQ ID NO: 22991 - DNA, 25 bp, Homo sapien
aggaaaaaattaactgtttcaaaag

SEQ ID NO: 22992 - DNA, 25 bp, Homo sapien
aggaaaaaggagaataatgtggaga

SEQ ID NO: 22993 - DNA, 25 bp, Homo sapien
aggaaaaaggagaatattgtggaga

SEQ ID NO: 22994 - DNA, 25 bp, Homo sapien
aggaaaaaggctctagctattatta

SEQ ID NO: 22995 - DNA, 25 bp, Homo sapien
aggaaaaaggctctaggtattatta

SEQ ID NO: 22996 - DNA, 25 bp, Homo sapien
aggaaaaatatagccctgaggattg

SEQ ID NO: 22997 - DNA, 25 bp, Homo sapien
aggaaaaatatggccctgaggattg

SEQ ID NO: 22998 - DNA, 25 bp, Homo sapien
aggaaaaattgccatatattctcta

SEQ ID NO: 22999 - DNA, 25 bp, Homo sapien
aggaaaaattgctatatattctcta

SEQ ID NO: 23000 - DNA, 25 bp, Homo sapien
aggaaaaatttaactgtttcaaaag

SEQ ID NO: 23001 - DNA, 25 bp, Homo sapien
aggaaaacctccaaacatcagcaaa

SEQ ID NO: 23002 - DNA, 25 bp, Homo sapien
aggaaaacctccgaacatcagcaaa

SEQ ID NO: 23003 - DNA, 25 bp, Homo sapien
aggaaaactataacttatctcccag

SEQ ID NO: 23004 - DNA, 25 bp, Homo sapien
aggaaaactataacttgtctcccag

SEQ ID NO: 23005 - DNA, 25 bp, Homo sapien
aggaaaagcaactccattacatagg

SEQ ID NO: 23006 - DNA, 25 bp, Homo sapien
aggaaaagcaagtccattacatagg

SEQ ID NO: 23007 - DNA, 25 bp, Homo sapien
aggaaaagcagactactgcaagaag

SEQ ID NO: 23008 - DNA, 25 bp, Homo sapien
aggaaaagcagagtactgcaagaag

SEQ ID NO: 23009 - DNA, 25 bp, Homo sapien
aggaaaaggctcacgcttcagtaga

SEQ ID NO: 23010 - DNA, 25 bp, Homo sapien
aggaaaaggctcatgcttcagtaga

SEQ ID NO: 23011 - DNA, 25 bp, Homo sapien
aggaaaaggcttaaatgccctaaga

SEQ ID NO: 23012 - DNA, 25 bp, Homo sapien
aggaaaagtcttaaatgccctaaga

SEQ ID NO: 23013 - DNA, 25 bp, Homo sapien
aggaaaataaaagcttataactcat

SEQ ID NO: 23014 - DNA, 25 bp, Homo sapien
aggaaaataaaagtttataactcat

SEQ ID NO: 23015 - DNA, 25 bp, Homo sapien
aggaaaatacgtttggagagtggta

SEQ ID NO: 23016 - DNA, 25 bp, Homo sapien
aggaaaataggaagaagaaatggag

SEQ ID NO: 23017 - DNA, 25 bp, Homo sapien
aggaaaataggcagcatcattttgt

SEQ ID NO: 23018 - DNA, 25 bp, Homo sapien
aggaaaataggtttggagagtggta

SEQ ID NO: 23019 - DNA, 25 bp, Homo sapien
aggaaaatatggcccataaccagga

SEQ ID NO: 23020 - DNA, 25 bp, Homo sapien
aggaaaatatggcctataaccagga

SEQ ID NO: 23021 - DNA, 25 bp, Homo sapien
aggaaaatcacctgatgaagcattt

SEQ ID NO: 23022 - DNA, 25 bp, Homo sapien
aggaaaatcacttgatgaagcattt

SEQ ID NO: 23023 - DNA, 25 bp, Homo sapien
aggaaaatgataacagagtaccctg

SEQ ID NO: 23024 - DNA, 25 bp, Homo sapien
aggaaaatgataagagagtaccctg

SEQ ID NO: 23025 - DNA, 25 bp, Homo sapien
aggaaaatgggaagaagaaatggag

SEQ ID NO: 23026 - DNA, 25 bp, Homo sapien
aggaaaatgggcagcatcattttgt

SEQ ID NO: 23027 - DNA, 25 bp, Homo sapien
aggaaaatgtcatattgaatcaagc

SEQ ID NO: 23028 - DNA, 25 bp, Homo sapien
aggaaaatgtcctattgaatcaagc

SEQ ID NO: 23029 - DNA, 25 bp, Homo sapien
aggaaacaattatcagtactactat

SEQ ID NO: 23030 - DNA, 25 bp, Homo sapien
aggaaacagggcttcctttatggac

SEQ ID NO: 23031 - DNA, 25 bp, Homo sapien
aggaaacagggctttctttatggac

SEQ ID NO: 23032 - DNA, 25 bp, Homo sapien
aggaaacagtacatgcagaggccac

SEQ ID NO: 23033 - DNA, 25 bp, Homo sapien
aggaaacagtacgtgcagaggccac

SEQ ID NO: 23034 - DNA, 25 bp, Homo sapien
aggaaacagttatcagtactactat

SEQ ID NO: 23035 - DNA, 25 bp, Homo sapien
aggaaaccaagttatggtctactaa

SEQ ID NO: 23036 - DNA, 25 bp, Homo sapien
aggaaaccaatcgtgtgatttcaag

SEQ ID NO: 23037 - DNA, 25 bp, Homo sapien
aggaaaccaattgtgtgatttcaag

SEQ ID NO: 23038 - DNA, 25 bp, Homo sapien
aggaaaccgagttatggtctactaa

SEQ ID NO: 23039 - DNA, 25 bp, Homo sapien
aggaaaccgtcatttcaaatacttc

SEQ ID NO: 23040 - DNA, 25 bp, Homo sapien
aggaaaccgtcatttcgaatacttc

SEQ ID NO: 23041 - DNA, 25 bp, Homo sapien
aggaaacctgataggactttagcct

SEQ ID NO: 23042 - DNA, 25 bp, Homo sapien
aggaaacctgataggattttagcct

SEQ ID NO: 23043 - DNA, 25 bp, Homo sapien
aggaaacgggcacgtcaatgagtgg

SEQ ID NO: 23044 - DNA, 25 bp, Homo sapien
aggaaacgggcacgtccatgagtgg

SEQ ID NO: 23045 - DNA, 25 bp, Homo sapien
aggaaactcaattcgtgctcagcat

SEQ ID NO: 23046 - DNA, 25 bp, Homo sapien
aggaaactcaatttgtgctcagcat

SEQ ID NO: 23047 - DNA, 25 bp, Homo sapien
aggaaactcatataaatgtaggagg

SEQ ID NO: 23048 - DNA, 25 bp, Homo sapien
aggaaactcatatagatgtaggagg

SEQ ID NO: 23049 - DNA, 25 bp, Homo sapien
aggaaactgaatctatcctgtggaa

SEQ ID NO: 23050 - DNA, 25 bp, Homo sapien
aggaaactggactaatgagctgtgt

SEQ ID NO: 23051 - DNA, 25 bp, Homo sapien
aggaaactggacttatgagctgtgt

SEQ ID NO: 23052 - DNA, 25 bp, Homo sapien
aggaaacttaatctatcctgtggaa

SEQ ID NO: 23053 - DNA, 25 bp, Homo sapien
aggaaagaaactggcatgttataag

SEQ ID NO: 23054 - DNA, 25 bp, Homo sapien
aggaaagaacaactctaccaactaa

SEQ ID NO: 23055 - DNA, 25 bp, Homo sapien
aggaaagaacaattctaccaactaa

SEQ ID NO: 23056 - DNA, 25 bp, Homo sapien
aggaaagacaatcccaacatgtact

SEQ ID NO: 23057 - DNA, 25 bp, Homo sapien
aggaaagagaatcccaacatgtact

SEQ ID NO: 23058 - DNA, 25 bp, Homo sapien
aggaaagagactggcatgttataag

SEQ ID NO: 23059 - DNA, 25 bp, Homo sapien
aggaaagagagtaatgacggaaatt

SEQ ID NO: 23060 - DNA, 25 bp, Homo sapien
aggaaagagccacatgttcagtgag

SEQ ID NO: 23061 - DNA, 25 bp, Homo sapien
aggaaagagccagatgttcagtgag

SEQ ID NO: 23062 - DNA, 25 bp, Homo sapien
aggaaagatagtaatgacggaaatt

SEQ ID NO: 23063 - DNA, 25 bp, Homo sapien
aggaaagcattttaatccctatcaa

SEQ ID NO: 23064 - DNA, 25 bp, Homo sapien
aggaaagcattttaattcctatcaa

SEQ ID NO: 23065 - DNA, 25 bp, Homo sapien
aggaaaggaaaggagacagggagac

SEQ ID NO: 23066 - DNA, 25 bp, Homo sapien
aggaaaggaaaggcgacagggagac

SEQ ID NO: 23067 - DNA, 25 bp, Homo sapien
aggaaaggagacagggagactttgc

SEQ ID NO: 23068 - DNA, 25 bp, Homo sapien
aggaaaggatgaatacatttttcgg

SEQ ID NO: 23069 - DNA, 25 bp, Homo sapien
aggaaaggatgattacatttttcgg

SEQ ID NO: 23070 - DNA, 25 bp, Homo sapien
aggaaaggcgacagggagactttgc

SEQ ID NO: 23071 - DNA, 25 bp, Homo sapien
aggaaagggtgtcggcagggagaat

SEQ ID NO: 23072 - DNA, 25 bp, Homo sapien
aggaaagggtgttggcagggagaat

SEQ ID NO: 23073 - DNA, 25 bp, Homo sapien
aggaaagttgccatgactccacacc

SEQ ID NO: 23074 - DNA, 25 bp, Homo sapien
aggaaagttgccgtgactccacacc

SEQ ID NO: 23075 - DNA, 25 bp, Homo sapien
aggaaagtttgaacccagtgacaat

SEQ ID NO: 23076 - DNA, 25 bp, Homo sapien
aggaaagtttgaagccagtgacaat

SEQ ID NO: 23077 - DNA, 25 bp, Homo sapien
aggaaataacatgcctaaaagaata

SEQ ID NO: 23078 - DNA, 25 bp, Homo sapien
aggaaataatatgcctaaaagaata

SEQ ID NO: 23079 - DNA, 25 bp, Homo sapien
aggaaataccaccgcttcttatgca

SEQ ID NO: 23080 - DNA, 25 bp, Homo sapien
aggaaataccactgcttcttatgca

SEQ ID NO: 23081 - DNA, 25 bp, Homo sapien
aggaaatagacatcaaccatttgag

SEQ ID NO: 23082 - DNA, 25 bp, Homo sapien
aggaaatagacatcaagcatttgag

SEQ ID NO: 23083 - DNA, 25 bp, Homo sapien
aggaaatagcacgtatggctcccag

SEQ ID NO: 23084 - DNA, 25 bp, Homo sapien
aggaaatagcacgtgtggctcccag

SEQ ID NO: 23085 - DNA, 25 bp, Homo sapien
aggaaatatcgccggccccagtctt

SEQ ID NO: 23086 - DNA, 25 bp, Homo sapien
aggaaatatcgcctgccccagtctt

SEQ ID NO: 23087 - DNA, 25 bp, Homo sapien
aggaaatccagacacagacatgtgc

SEQ ID NO: 23088 - DNA, 25 bp, Homo sapien
aggaaatccagatacagacatgtgc

SEQ ID NO: 23089 - DNA, 25 bp, Homo sapien
aggaaatgacaggtgacctcattac

SEQ ID NO: 23090 - DNA, 25 bp, Homo sapien
aggaaatggagaagaaatgagactg

SEQ ID NO: 23091 - DNA, 25 bp, Homo sapien
aggaaatggagaaggaatgagactg

SEQ ID NO: 23092 - DNA, 25 bp, Homo sapien
aggaaatggcaggtgacctcattac

SEQ ID NO: 23093 - DNA, 25 bp, Homo sapien
aggaaatgtatacgcccgcttagct

SEQ ID NO: 23094 - DNA, 25 bp, Homo sapien
aggaaatgtatatgcccgcttagct

SEQ ID NO: 23095 - DNA, 25 bp, Homo sapien
aggaaattagaatccctgtcctagt

SEQ ID NO: 23096 - DNA, 25 bp, Homo sapien
aggaaattagagtccctgtcctagt

SEQ ID NO: 23097 - DNA, 25 bp, Homo sapien
aggaaattttgcaggcatactggag

SEQ ID NO: 23098 - DNA, 25 bp, Homo sapien
aggaaattttgcagtcatactggag

SEQ ID NO: 23099 - DNA, 25 bp, Homo sapien
aggaacaccacaccggtgatcgctt

SEQ ID NO: 23100 - DNA, 25 bp, Homo sapien
aggaacaccacagcggtgatcgctt

SEQ ID NO: 23101 - DNA, 25 bp, Homo sapien
aggaacagatgcccaaaaacagtct

SEQ ID NO: 23102 - DNA, 25 bp, Homo sapien
aggaacagatgtccaaaaacagtct

SEQ ID NO: 23103 - DNA, 25 bp, Homo sapien
aggaacagggaaataatgagtccca

SEQ ID NO: 23104 - DNA, 25 bp, Homo sapien
aggaacagggaattaatgagtccca

SEQ ID NO: 23105 - DNA, 25 bp, Homo sapien
aggaacatagtgggaaaactagtca

SEQ ID NO: 23106 - DNA, 25 bp, Homo sapien
aggaacatagtggggaaactagtca

SEQ ID NO: 23107 - DNA, 25 bp, Homo sapien
aggaacattatttcccttgtgtctt

SEQ ID NO: 23108 - DNA, 25 bp, Homo sapien
aggaacattgtttcccttgtgtctt

SEQ ID NO: 23109 - DNA, 25 bp, Homo sapien
aggaaccaataatcagcacactcgg

SEQ ID NO: 23110 - DNA, 25 bp, Homo sapien
aggaaccacggcctcagcacaaact

SEQ ID NO: 23111 - DNA, 25 bp, Homo sapien
aggaaccagacagcagaagaaaagg

SEQ ID NO: 23112 - DNA, 25 bp, Homo sapien
aggaaccaggcagcagaagaaaagg

SEQ ID NO: 23113 - DNA, 25 bp, Homo sapien
aggaaccagtaatcagcacactcgg

SEQ ID NO: 23114 - DNA, 25 bp, Homo sapien
aggaaccatggcctcagcacaaact

SEQ ID NO: 23115 - DNA, 25 bp, Homo sapien
aggaaccgatctctcatccccaact

SEQ ID NO: 23116 - DNA, 25 bp, Homo sapien
aggaaccgatctgtcatccccaact

SEQ ID NO: 23117 - DNA, 25 bp, Homo sapien
aggaacctcagcaaattttttagac

SEQ ID NO: 23118 - DNA, 25 bp, Homo sapien
aggaacctcggcaaattttttagac

SEQ ID NO: 23119 - DNA, 25 bp, Homo sapien
aggaacctctgcgaatgaagcactt

SEQ ID NO: 23120 - DNA, 25 bp, Homo sapien
aggaacctctgtgaatgaagcactt

SEQ ID NO: 23121 - DNA, 25 bp, Homo sapien
aggaactacctaccccattcaaatt

SEQ ID NO: 23122 - DNA, 25 bp, Homo sapien
aggaactacctatcccattcaaatt

SEQ ID NO: 23123 - DNA, 25 bp, Homo sapien
aggaactccagctgctgctgtgtga

SEQ ID NO: 23124 - DNA, 25 bp, Homo sapien
aggaactctagctgctgctgtgtga

SEQ ID NO: 23125 - DNA, 25 bp, Homo sapien
aggaactgaatcctgagttctaact

SEQ ID NO: 23126 - DNA, 25 bp, Homo sapien
aggaactgaatcttgagttctaact

SEQ ID NO: 23127 - DNA, 25 bp, Homo sapien
aggaactgacatttactgagtgctt

SEQ ID NO: 23128 - DNA, 25 bp, Homo sapien
aggaactgataatagacttggcaaa

SEQ ID NO: 23129 - DNA, 25 bp, Homo sapien
aggaactgataatagatttggcaaa

SEQ ID NO: 23130 - DNA, 25 bp, Homo sapien
aggaactggcatttactgagtgctt

SEQ ID NO: 23131 - DNA, 25 bp, Homo sapien
aggaacttacccacggatatacacc

SEQ ID NO: 23132 - DNA, 25 bp, Homo sapien
aggaacttacccatggatatacacc

SEQ ID NO: 23133 - DNA, 25 bp, Homo sapien
aggaacttagactctagttagggaa

SEQ ID NO: 23134 - DNA, 25 bp, Homo sapien
aggaacttagagtctagttagggaa

SEQ ID NO: 23135 - DNA, 25 bp, Homo sapien
aggaacttgttaaattgttgtgatt

SEQ ID NO: 23136 - DNA, 25 bp, Homo sapien
aggaacttgttaatttgttgtgatt

SEQ ID NO: 23137 - DNA, 25 bp, Homo sapien
aggaactttaggaatatactgtgta

SEQ ID NO: 23138 - DNA, 25 bp, Homo sapien
aggaactttagggatatactgtgta

SEQ ID NO: 23139 - DNA, 25 bp, Homo sapien
aggaagaacaccatttaatctttaa

SEQ ID NO: 23140 - DNA, 25 bp, Homo sapien
aggaagaacaccatttgatctttaa

SEQ ID NO: 23141 - DNA, 25 bp, Homo sapien
aggaagaagaaactgcagagtccct

SEQ ID NO: 23142 - DNA, 25 bp, Homo sapien
aggaagaagaaattgcagagtccct

SEQ ID NO: 23143 - DNA, 25 bp, Homo sapien
aggaagacaaaaccaacaacaaatt

SEQ ID NO: 23144 - DNA, 25 bp, Homo sapien
aggaagacaaaagcaacaacaaatt

SEQ ID NO: 23145 - DNA, 25 bp, Homo sapien
aggaagactatcttcttgccttggg

SEQ ID NO: 23146 - DNA, 25 bp, Homo sapien
aggaagactattttcttgccttggg

SEQ ID NO: 23147 - DNA, 25 bp, Homo sapien
aggaagactctacaaggacatggca

SEQ ID NO: 23148 - DNA, 25 bp, Homo sapien
aggaagactctataaggacatggca

SEQ ID NO: 23149 - DNA, 25 bp, Homo sapien
aggaagagaaagcataggacaaggc

SEQ ID NO: 23150 - DNA, 25 bp, Homo sapien
aggaagagaaagcgtaggacaaggc

SEQ ID NO: 23151 - DNA, 25 bp, Homo sapien
aggaagagcctactgaggtctggat

SEQ ID NO: 23152 - DNA, 25 bp, Homo sapien
aggaagagctgtcaagttaattaat

SEQ ID NO: 23153 - DNA, 25 bp, Homo sapien
aggaagagctgtcaggttaattaat

SEQ ID NO: 23154 - DNA, 25 bp, Homo sapien
aggaagaggtggctttgcttacagg

SEQ ID NO: 23155 - DNA, 25 bp, Homo sapien
aggaagaggtggttttgcttacagg

SEQ ID NO: 23156 - DNA, 25 bp, Homo sapien
aggaagagtctactgaggtctggat

SEQ ID NO: 23157 - DNA, 25 bp, Homo sapien
aggaagataatcttttttaagcttt

SEQ ID NO: 23158 - DNA, 25 bp, Homo sapien
aggaagattatcttttttaagcttt

SEQ ID NO: 23159 - DNA, 25 bp, Homo sapien
aggaagcaaaaagagtactgttatc

SEQ ID NO: 23160 - DNA, 25 bp, Homo sapien
aggaagcaaaaagagtgctgttatc

SEQ ID NO: 23161 - DNA, 25 bp, Homo sapien
aggaagcacagagcatgtccaggga

SEQ ID NO: 23162 - DNA, 25 bp, Homo sapien
aggaagcacagagtatgtccaggga

SEQ ID NO: 23163 - DNA, 25 bp, Homo sapien
aggaagcacagcgtatcccaaacag

SEQ ID NO: 23164 - DNA, 25 bp, Homo sapien
aggaagcacagtgtatcccaaacag

SEQ ID NO: 23165 - DNA, 25 bp, Homo sapien
aggaagcagcgtgtgtgccttacaa

SEQ ID NO: 23166 - DNA, 25 bp, Homo sapien
aggaagcaggcaagaatatgtgggt

SEQ ID NO: 23167 - DNA, 25 bp, Homo sapien
aggaagcaggcgagaatatgtgggt

SEQ ID NO: 23168 - DNA, 25 bp, Homo sapien
aggaagcagggtgtgtgccttacaa

SEQ ID NO: 23169 - DNA, 25 bp, Homo sapien
aggaagccaagagaaaactcatttc

SEQ ID NO: 23170 - DNA, 25 bp, Homo sapien
aggaagccaagagacaactcatttc

SEQ ID NO: 23171 - DNA, 25 bp, Homo sapien
aggaagccaatcacagggtctcaag

SEQ ID NO: 23172 - DNA, 25 bp, Homo sapien
aggaagccattaagagattattatt

SEQ ID NO: 23173 - DNA, 25 bp, Homo sapien
aggaagccattaggagattattatt

SEQ ID NO: 23174 - DNA, 25 bp, Homo sapien
aggaagccgatcacagggtctcaag

SEQ ID NO: 23175 - DNA, 25 bp, Homo sapien
aggaagctgaacaaattgagaacat

SEQ ID NO: 23176 - DNA, 25 bp, Homo sapien
aggaagctgaacgaattgagaacat

SEQ ID NO: 23177 - DNA, 25 bp, Homo sapien
aggaagctggacaggagcgaagagt

SEQ ID NO: 23178 - DNA, 25 bp, Homo sapien
aggaagctggactggagcgaagagt

SEQ ID NO: 23179 - DNA, 25 bp, Homo sapien
aggaaggaaaacctccaaacatcag

SEQ ID NO: 23180 - DNA, 25 bp, Homo sapien
aggaaggaaaacctccgaacatcag

SEQ ID NO: 23181 - DNA, 25 bp, Homo sapien
aggaaggaaagaaactggcatgtta

SEQ ID NO: 23182 - DNA, 25 bp, Homo sapien
aggaaggaaagagactggcatgtta

SEQ ID NO: 23183 - DNA, 25 bp, Homo sapien
aggaaggctgaactggatgctcacc

SEQ ID NO: 23184 - DNA, 25 bp, Homo sapien
aggaaggctgaattggatgctcacc

SEQ ID NO: 23185 - DNA, 25 bp, Homo sapien
aggaaggctgttcctaaatggactg

SEQ ID NO: 23186 - DNA, 25 bp, Homo sapien
aggaaggctgtttctaaatggactg

SEQ ID NO: 23187 - DNA, 25 bp, Homo sapien
aggaagggccagaaacacatggaaa

SEQ ID NO: 23188 - DNA, 25 bp, Homo sapien
aggaagggccagaaactcatggaaa

SEQ ID NO: 23189 - DNA, 25 bp, Homo sapien
aggaagggtcatctacatggatact

SEQ ID NO: 23190 - DNA, 25 bp, Homo sapien
aggaagggtcatctacgtggatact

SEQ ID NO: 23191 - DNA, 25 bp, Homo sapien
aggaaggtattatgatctttacact

SEQ ID NO: 23192 - DNA, 25 bp, Homo sapien
aggaaggtattatgctctttacact

SEQ ID NO: 23193 - DNA, 25 bp, Homo sapien
aggaaggtcctgcgagctgcggctg

SEQ ID NO: 23194 - DNA, 25 bp, Homo sapien
aggaaggtcctgtgagctgcggctg

SEQ ID NO: 23195 - DNA, 25 bp, Homo sapien
aggaaggtgtggcccaaagtcccaa

SEQ ID NO: 23196 - DNA, 25 bp, Homo sapien
aggaaggtgtggcccagagtcccaa

SEQ ID NO: 23197 - DNA, 25 bp, Homo sapien
aggaaggttgtgcgtttaatcttta

SEQ ID NO: 23198 - DNA, 25 bp, Homo sapien
aggaaggttgtgtgtttaatcttta

SEQ ID NO: 23199 - DNA, 25 bp, Homo sapien
aggaagtaaagtacacttagaagag

SEQ ID NO: 23200 - DNA, 25 bp, Homo sapien
aggaagtaaagtgcacttagaagag

SEQ ID NO: 23201 - DNA, 25 bp, Homo sapien
aggaagtacttacaggaagccttga

SEQ ID NO: 23202 - DNA, 25 bp, Homo sapien
aggaagtagaaatgcttggagataa

SEQ ID NO: 23203 - DNA, 25 bp, Homo sapien
aggaagtagaaattcttggagataa

SEQ ID NO: 23204 - DNA, 25 bp, Homo sapien
aggaagtagataataagactgttgc

SEQ ID NO: 23205 - DNA, 25 bp, Homo sapien
aggaagtagataatcagactgttgc

SEQ ID NO: 23206 - DNA, 25 bp, Homo sapien
aggaagtagttacaggaagccttga

SEQ ID NO: 23207 - DNA, 25 bp, Homo sapien
aggaagtatttcatgacgtcttgag

SEQ ID NO: 23208 - DNA, 25 bp, Homo sapien
aggaagtatttcatgatgtcttgag

SEQ ID NO: 23209 - DNA, 25 bp, Homo sapien
aggaagtcatagaggacacttatgg

SEQ ID NO: 23210 - DNA, 25 bp, Homo sapien
aggaagtcatagagtacacttatgg

SEQ ID NO: 23211 - DNA, 25 bp, Homo sapien
aggaagtgaaactcagataaattaa

SEQ ID NO: 23212 - DNA, 25 bp, Homo sapien
aggaagtgaaactcggataaattaa

SEQ ID NO: 23213 - DNA, 25 bp, Homo sapien
aggaagtgtaattcgcctgcctagc

SEQ ID NO: 23214 - DNA, 25 bp, Homo sapien
aggaagtgtaatttgcctgcctagc

SEQ ID NO: 23215 - DNA, 25 bp, Homo sapien
aggaagttagaaactatgacctaga

SEQ ID NO: 23216 - DNA, 25 bp, Homo sapien
aggaagttagaatctatgacctaga

SEQ ID NO: 23217 - DNA, 25 bp, Homo sapien
aggaagttcttccaagccaccaccg

SEQ ID NO: 23218 - DNA, 25 bp, Homo sapien
aggaagttcttccaggccaccaccg

SEQ ID NO: 23219 - DNA, 25 bp, Homo sapien
aggaagttgagttttgaatatgctc

SEQ ID NO: 23220 - DNA, 25 bp, Homo sapien
aggaagttgcgttttgaatatgctc

SEQ ID NO: 23221 - DNA, 25 bp, Homo sapien
aggaataaatacctatcaaagtgag

SEQ ID NO: 23222 - DNA, 25 bp, Homo sapien
aggaataaatgaccagcaataaagt

SEQ ID NO: 23223 - DNA, 25 bp, Homo sapien
aggaataaatgaccggcaataaagt

SEQ ID NO: 23224 - DNA, 25 bp, Homo sapien
aggaataactacttgttcattttgt

SEQ ID NO: 23225 - DNA, 25 bp, Homo sapien
aggaataagaaaccacagatggaaa

SEQ ID NO: 23226 - DNA, 25 bp, Homo sapien
aggaataagaaacgacagatggaaa

SEQ ID NO: 23227 - DNA, 25 bp, Homo sapien
aggaataagtacctatcaaagtgag

SEQ ID NO: 23228 - DNA, 25 bp, Homo sapien
aggaataagttttgctggttttcct

SEQ ID NO: 23229 - DNA, 25 bp, Homo sapien
aggaataagttttgttggttttcct

SEQ ID NO: 23230 - DNA, 25 bp, Homo sapien
aggaataattacttgttcattttgt

SEQ ID NO: 23231 - DNA, 25 bp, Homo sapien
aggaataattagcacaataggcagc

SEQ ID NO: 23232 - DNA, 25 bp, Homo sapien
aggaataattagcagaataggcagc

SEQ ID NO: 23233 - DNA, 25 bp, Homo sapien
aggaataattcagacgatcttaata

SEQ ID NO: 23234 - DNA, 25 bp, Homo sapien
aggaataattcagatgatcttaata

SEQ ID NO: 23235 - DNA, 25 bp, Homo sapien
aggaatagccatattgcttcactct

SEQ ID NO: 23236 - DNA, 25 bp, Homo sapien
aggaatagccatattgtttcactct

SEQ ID NO: 23237 - DNA, 25 bp, Homo sapien
aggaatcagaagaaaaagataacag

SEQ ID NO: 23238 - DNA, 25 bp, Homo sapien
aggaatcagaagaagaagataacag

SEQ ID NO: 23239 - DNA, 25 bp, Homo sapien
aggaatctattattatcttcatgtt

SEQ ID NO: 23240 - DNA, 25 bp, Homo sapien
aggaatctatttttatcttcatgtt

SEQ ID NO: 23241 - DNA, 25 bp, Homo sapien
aggaatgaatagatagaggacaaag

SEQ ID NO: 23242 - DNA, 25 bp, Homo sapien
aggaatgaataggtagaggacaaag

SEQ ID NO: 23243 - DNA, 25 bp, Homo sapien
aggaatgacaacagggactgcagaa

SEQ ID NO: 23244 - DNA, 25 bp, Homo sapien
aggaatgacaacaggggctgcagaa

SEQ ID NO: 23245 - DNA, 25 bp, Homo sapien
aggaatgacagaatcgggtatgtga

SEQ ID NO: 23246 - DNA, 25 bp, Homo sapien
aggaatgacagaattgggtatgtga

SEQ ID NO: 23247 - DNA, 25 bp, Homo sapien
aggaatgacatgcgtgacatattcc

SEQ ID NO: 23248 - DNA, 25 bp, Homo sapien
aggaatgacatgtgtgacatattcc

SEQ ID NO: 23249 - DNA, 25 bp, Homo sapien
aggaatgacctacatagcattaaaa

SEQ ID NO: 23250 - DNA, 25 bp, Homo sapien
aggaatgacctatatagcattaaaa

SEQ ID NO: 23251 - DNA, 25 bp, Homo sapien
aggaatgacttgagtagtcaaaggg

SEQ ID NO: 23252 - DNA, 25 bp, Homo sapien
aggaatgacttgcgtagtcaaaggg

SEQ ID NO: 23253 - DNA, 25 bp, Homo sapien
aggaatgaggttccaatgcatgcta

SEQ ID NO: 23254 - DNA, 25 bp, Homo sapien
aggaatgaggttccgatgcatgcta

SEQ ID NO: 23255 - DNA, 25 bp, Homo sapien
aggaatgatttgtgccactaagaaa

SEQ ID NO: 23256 - DNA, 25 bp, Homo sapien
aggaatgatttgtgtcactaagaaa

SEQ ID NO: 23257 - DNA, 25 bp, Homo sapien
aggaatggccgatgcccagtcatta

SEQ ID NO: 23258 - DNA, 25 bp, Homo sapien
aggaatggctgatgcccagtcatta

SEQ ID NO: 23259 - DNA, 25 bp, Homo sapien
aggaatgtaaactggtacatctatt

SEQ ID NO: 23260 - DNA, 25 bp, Homo sapien
aggaatgtaaactggtgcatctatt

SEQ ID NO: 23261 - DNA, 25 bp, Homo sapien
aggaatgtaagaagaatctgctggg

SEQ ID NO: 23262 - DNA, 25 bp, Homo sapien
aggaatgtaagaggaatctgctggg

SEQ ID NO: 23263 - DNA, 25 bp, Homo sapien
aggaatgttcttacagcgatgttac

SEQ ID NO: 23264 - DNA, 25 bp, Homo sapien
aggaatgttcttacagtgatgttac

SEQ ID NO: 23265 - DNA, 25 bp, Homo sapien
aggaattgaaagaaataatgtgatt

SEQ ID NO: 23266 - DNA, 25 bp, Homo sapien
aggaattgcaagaaataatgtgatt

SEQ ID NO: 23267 - DNA, 25 bp, Homo sapien
aggaattggaacacaatctaactgt

SEQ ID NO: 23268 - DNA, 25 bp, Homo sapien
aggaattggaacacgatctaactgt

SEQ ID NO: 23269 - DNA, 25 bp, Homo sapien
aggaatttaacaggagcttcaggtt

SEQ ID NO: 23270 - DNA, 25 bp, Homo sapien
aggaatttaacaggcgcttcaggtt

SEQ ID NO: 23271 - DNA, 25 bp, Homo sapien
aggaatttgcaacacttacacattt

SEQ ID NO: 23272 - DNA, 25 bp, Homo sapien
aggaatttgcaatacttacacattt

SEQ ID NO: 23273 - DNA, 25 bp, Homo sapien
aggaatttgcccaacaaaggcactt

SEQ ID NO: 23274 - DNA, 25 bp, Homo sapien
aggaatttggaatcaagatagtttg

SEQ ID NO: 23275 - DNA, 25 bp, Homo sapien
aggaatttggaatcgagatagtttg

SEQ ID NO: 23276 - DNA, 25 bp, Homo sapien
aggaatttgtatcttattgtaagga

SEQ ID NO: 23277 - DNA, 25 bp, Homo sapien
aggaatttgtattttattgtaagga

SEQ ID NO: 23278 - DNA, 25 bp, Homo sapien
aggaatttgtcatttaaagatccta

SEQ ID NO: 23279 - DNA, 25 bp, Homo sapien
aggaatttgtcgtttaaagatccta

SEQ ID NO: 23280 - DNA, 25 bp, Homo sapien
aggaattttatcatttttctgatcc

SEQ ID NO: 23281 - DNA, 25 bp, Homo sapien
aggaattttatcgtttttctgatcc

SEQ ID NO: 23282 - DNA, 25 bp, Homo sapien
aggaattttcccaacaaaggcactt

SEQ ID NO: 23283 - DNA, 25 bp, Homo sapien
aggacaaaaagaactgtaaaggtca

SEQ ID NO: 23284 - DNA, 25 bp, Homo sapien
aggacaaaaagaattgtaaaggtca

SEQ ID NO: 23285 - DNA, 25 bp, Homo sapien
aggacaaacaccgaaaagaatagag

SEQ ID NO: 23286 - DNA, 25 bp, Homo sapien
aggacaaacactgaaaagaatagag

SEQ ID NO: 23287 - DNA, 25 bp, Homo sapien
aggacaaagcactacactggctctc

SEQ ID NO: 23288 - DNA, 25 bp, Homo sapien
aggacaaagcactatactggctctc

SEQ ID NO: 23289 - DNA, 25 bp, Homo sapien
aggacaaatatgataccgacaggct

SEQ ID NO: 23290 - DNA, 25 bp, Homo sapien
aggacaaatatgatactgacaggct

SEQ ID NO: 23291 - DNA, 25 bp, Homo sapien
aggacaagaatcgtcaagattgaga

SEQ ID NO: 23292 - DNA, 25 bp, Homo sapien
aggacaagaattgtcaagattgaga

SEQ ID NO: 23293 - DNA, 25 bp, Homo sapien
aggacaagacatgttgacaaaccca

SEQ ID NO: 23294 - DNA, 25 bp, Homo sapien
aggacaagatatgttgacaaaccca

SEQ ID NO: 23295 - DNA, 25 bp, Homo sapien
aggacaaggcacttcgtagcacaat

SEQ ID NO: 23296 - DNA, 25 bp, Homo sapien
aggacaaggcactttgtagcacaat

SEQ ID NO: 23297 - DNA, 25 bp, Homo sapien
aggacaatataagcaggcaacttgg

SEQ ID NO: 23298 - DNA, 25 bp, Homo sapien
aggacaatatatgcaggcaacttgg

SEQ ID NO: 23299 - DNA, 25 bp, Homo sapien
aggacaatcctaatctagtcattaa

SEQ ID NO: 23300 - DNA, 25 bp, Homo sapien
aggacaatcttaatctagtcattaa

SEQ ID NO: 23301 - DNA, 25 bp, Homo sapien
aggacaattagagaatgaatgccta

SEQ ID NO: 23302 - DNA, 25 bp, Homo sapien
aggacaattagaggatgaatgccta

SEQ ID NO: 23303 - DNA, 25 bp, Homo sapien
aggacacagaagctccgcaagaaac

SEQ ID NO: 23304 - DNA, 25 bp, Homo sapien
aggacacagaagcttcgcaagaaac

SEQ ID NO: 23305 - DNA, 25 bp, Homo sapien
aggacacagagagaaggcatctgtc

SEQ ID NO: 23306 - DNA, 25 bp, Homo sapien
aggacacagcgagaaggcatctgtc

SEQ ID NO: 23307 - DNA, 25 bp, Homo sapien
aggacacagggtctgacactaggct

SEQ ID NO: 23308 - DNA, 25 bp, Homo sapien
aggacacatggtctgacactaggct

SEQ ID NO: 23309 - DNA, 25 bp, Homo sapien
aggacactattaccaggcaaatata

SEQ ID NO: 23310 - DNA, 25 bp, Homo sapien
aggacactattactaggcaaatata

SEQ ID NO: 23311 - DNA, 25 bp, Homo sapien
aggacacttgaagcatcacactagg

SEQ ID NO: 23312 - DNA, 25 bp, Homo sapien
aggacacttgaagcgtcacactagg

SEQ ID NO: 23313 - DNA, 25 bp, Homo sapien
aggacagaactatcattcaatacta

SEQ ID NO: 23314 - DNA, 25 bp, Homo sapien
aggacagaagcccaagatcaagctg

SEQ ID NO: 23315 - DNA, 25 bp, Homo sapien
aggacagaagcctaagatcaagctg

SEQ ID NO: 23316 - DNA, 25 bp, Homo sapien
aggacagaagtatcattcaatacta

SEQ ID NO: 23317 - DNA, 25 bp, Homo sapien
aggacagactttctggaagaaataa

SEQ ID NO: 23318 - DNA, 25 bp, Homo sapien
aggacagactttctgggagaaataa

SEQ ID NO: 23319 - DNA, 25 bp, Homo sapien
aggacagcagtacatgggctagaag

SEQ ID NO: 23320 - DNA, 25 bp, Homo sapien
aggacagcagtacgtgggctagaag

SEQ ID NO: 23321 - DNA, 25 bp, Homo sapien
aggacagctagtgaagtaggaagag

SEQ ID NO: 23322 - DNA, 25 bp, Homo sapien
aggacagctagttaagtaggaagag

SEQ ID NO: 23323 - DNA, 25 bp, Homo sapien
aggacagctgccagtagtgccctct

SEQ ID NO: 23324 - DNA, 25 bp, Homo sapien
aggacagctgccggtagtgccctct

SEQ ID NO: 23325 - DNA, 25 bp, Homo sapien
aggacaggaaagacagtcataaatt

SEQ ID NO: 23326 - DNA, 25 bp, Homo sapien
aggacaggaaaggcagtcataaatt

SEQ ID NO: 23327 - DNA, 25 bp, Homo sapien
aggacaggtagtcacaattgctagg

SEQ ID NO: 23328 - DNA, 25 bp, Homo sapien
aggacaggtagtcacatttgctagg

SEQ ID NO: 23329 - DNA, 25 bp, Homo sapien
aggacagtcatttagataagaactt

SEQ ID NO: 23330 - DNA, 25 bp, Homo sapien
aggacagtcgtttagataagaactt

SEQ ID NO: 23331 - DNA, 25 bp, Homo sapien
aggacagtgaggccataaaatgttt

SEQ ID NO: 23332 - DNA, 25 bp, Homo sapien
aggacagtgtggccataaaatgttt

SEQ ID NO: 23333 - DNA, 25 bp, Homo sapien
aggacagttctgtgatctgcaaaat

SEQ ID NO: 23334 - DNA, 25 bp, Homo sapien
aggacagttctgtgatttgcaaaat

SEQ ID NO: 23335 - DNA, 25 bp, Homo sapien
aggacataacaggaaaaggccctca

SEQ ID NO: 23336 - DNA, 25 bp, Homo sapien
aggacataccaggaaaaggccctca

SEQ ID NO: 23337 - DNA, 25 bp, Homo sapien
aggacatccgctagcaaatctagga

SEQ ID NO: 23338 - DNA, 25 bp, Homo sapien
aggacatctgctagcaaatctagga

SEQ ID NO: 23339 - DNA, 25 bp, Homo sapien
aggacattacgctagtgaaataggc

SEQ ID NO: 23340 - DNA, 25 bp, Homo sapien
aggacattatgctagtgaaataggc

SEQ ID NO: 23341 - DNA, 25 bp, Homo sapien
aggaccaacacagataagtgcttcc

SEQ ID NO: 23342 - DNA, 25 bp, Homo sapien
aggaccaacacaggtaagtgcttcc

SEQ ID NO: 23343 - DNA, 25 bp, Homo sapien
aggaccacagagcgagcaagcagca

SEQ ID NO: 23344 - DNA, 25 bp, Homo sapien
aggaccacagagctagcaagcagca

SEQ ID NO: 23345 - DNA, 25 bp, Homo sapien
aggaccacagagtaaacattttcaa

SEQ ID NO: 23346 - DNA, 25 bp, Homo sapien
aggaccacggagtaaacattttcaa

SEQ ID NO: 23347 - DNA, 25 bp, Homo sapien
aggaccaggaaagttgtgacttagc

SEQ ID NO: 23348 - DNA, 25 bp, Homo sapien
aggaccagggaagttgtgacttagc

SEQ ID NO: 23349 - DNA, 25 bp, Homo sapien
aggacccacaggatccatcatccac

SEQ ID NO: 23350 - DNA, 25 bp, Homo sapien
aggacccacagggtccatcatccac

SEQ ID NO: 23351 - DNA, 25 bp, Homo sapien
aggacccagattatatagggaaaca

SEQ ID NO: 23352 - DNA, 25 bp, Homo sapien
aggacccagattatatggggaaaca

SEQ ID NO: 23353 - DNA, 25 bp, Homo sapien
aggacccattcccactcatcatgtg

SEQ ID NO: 23354 - DNA, 25 bp, Homo sapien
aggacccattcccgctcatcatgtg

SEQ ID NO: 23355 - DNA, 25 bp, Homo sapien
aggaccctaacgaatacacctcccc

SEQ ID NO: 23356 - DNA, 25 bp, Homo sapien
aggaccctaactaatacacctcccc

SEQ ID NO: 23357 - DNA, 25 bp, Homo sapien
aggacctaaaatggtttttctgtgt

SEQ ID NO: 23358 - DNA, 25 bp, Homo sapien
aggacctaatatggtttttctgtgt

SEQ ID NO: 23359 - DNA, 25 bp, Homo sapien
aggacctcaataacacctaatttag

SEQ ID NO: 23360 - DNA, 25 bp, Homo sapien
aggacctcattaacacctaatttag

SEQ ID NO: 23361 - DNA, 25 bp, Homo sapien
aggacctggcctcgatactaaattc

SEQ ID NO: 23362 - DNA, 25 bp, Homo sapien
aggacctggccttgatactaaattc

SEQ ID NO: 23363 - DNA, 25 bp, Homo sapien
aggacgcctacaaataaatgaataa

SEQ ID NO: 23364 - DNA, 25 bp, Homo sapien
aggacgcctacaaatagatgaataa

SEQ ID NO: 23365 - DNA, 25 bp, Homo sapien
aggactactgccacagtacagccag

SEQ ID NO: 23366 - DNA, 25 bp, Homo sapien
aggactactgccacggtacagccag

SEQ ID NO: 23367 - DNA, 25 bp, Homo sapien
aggactactttacctgctctttcac

SEQ ID NO: 23368 - DNA, 25 bp, Homo sapien
aggactactttacctgttctttcac

SEQ ID NO: 23369 - DNA, 25 bp, Homo sapien
aggactagaaccatcactagaaaca

SEQ ID NO: 23370 - DNA, 25 bp, Homo sapien
aggactagaaccgtcactagaaaca

SEQ ID NO: 23371 - DNA, 25 bp, Homo sapien
aggactcacgtagtaaggtgtgcca

SEQ ID NO: 23372 - DNA, 25 bp, Homo sapien
aggactcagaagcaggtctgcctga

SEQ ID NO: 23373 - DNA, 25 bp, Homo sapien
aggactcagcagcaggtctgcctga

SEQ ID NO: 23374 - DNA, 25 bp, Homo sapien
aggactcatgtagtaaggtgtgcca

SEQ ID NO: 23375 - DNA, 25 bp, Homo sapien
aggactcatttatctatttatatat

SEQ ID NO: 23376 - DNA, 25 bp, Homo sapien
aggactcatttgtctatttatatat

SEQ ID NO: 23377 - DNA, 25 bp, Homo sapien
aggactcggcaacttcttggatgtg

SEQ ID NO: 23378 - DNA, 25 bp, Homo sapien
aggactcggtaacttcttggatgtg

SEQ ID NO: 23379 - DNA, 25 bp, Homo sapien
aggactctggctgcctttgaaatat

SEQ ID NO: 23380 - DNA, 25 bp, Homo sapien
aggactctggctgtctttgaaatat

SEQ ID NO: 23381 - DNA, 25 bp, Homo sapien
aggactctgggtcagcagctgtgaa

SEQ ID NO: 23382 - DNA, 25 bp, Homo sapien
aggactctgtgtcagcagctgtgaa

SEQ ID NO: 23383 - DNA, 25 bp, Homo sapien
aggactcttacactatactgtctcc

SEQ ID NO: 23384 - DNA, 25 bp, Homo sapien
aggactcttacactatgctgtctcc

SEQ ID NO: 23385 - DNA, 25 bp, Homo sapien
aggactgagctgcgactcaggctgt

SEQ ID NO: 23386 - DNA, 25 bp, Homo sapien
aggactgagctgtgactcaggctgt

SEQ ID NO: 23387 - DNA, 25 bp, Homo sapien
aggactgctttagctacttctcata

SEQ ID NO: 23388 - DNA, 25 bp, Homo sapien
aggactgctttcgctacttctcata

SEQ ID NO: 23389 - DNA, 25 bp, Homo sapien
aggacttaatcatccagcagtgtcc

SEQ ID NO: 23390 - DNA, 25 bp, Homo sapien
aggacttaatcgtccagcagtgtcc

SEQ ID NO: 23391 - DNA, 25 bp, Homo sapien
aggactttgctcgcattactattac

SEQ ID NO: 23392 - DNA, 25 bp, Homo sapien
aggactttgctctcattactattac

SEQ ID NO: 23393 - DNA, 25 bp, Homo sapien
aggagaaaaaaaactgaagattcat

SEQ ID NO: 23394 - DNA, 25 bp, Homo sapien
aggagaaaaaaacctgaagattcat

SEQ ID NO: 23395 - DNA, 25 bp, Homo sapien
aggagaaaaggcaaatttattgctc

SEQ ID NO: 23396 - DNA, 25 bp, Homo sapien
aggagaaaggccatgctgcaccctc

SEQ ID NO: 23397 - DNA, 25 bp, Homo sapien
aggagaaaggccattctgcaccctc

SEQ ID NO: 23398 - DNA, 25 bp, Homo sapien
aggagaaagggcaaatttattgctc

SEQ ID NO: 23399 - DNA, 25 bp, Homo sapien
aggagaacacgctgtgctcagaaat

SEQ ID NO: 23400 - DNA, 25 bp, Homo sapien
aggagaacatgctgtgctcagaaat

SEQ ID NO: 23401 - DNA, 25 bp, Homo sapien
aggagaacttagtccgagtaaaggt

SEQ ID NO: 23402 - DNA, 25 bp, Homo sapien
aggagaacttagtctgagtaaaggt

SEQ ID NO: 23403 - DNA, 25 bp, Homo sapien
aggagaagaacaagtgatgattaga

SEQ ID NO: 23404 - DNA, 25 bp, Homo sapien
aggagaagaacaggtgatgattaga

SEQ ID NO: 23405 - DNA, 25 bp, Homo sapien
aggagaagcaaacctgccatcttag

SEQ ID NO: 23406 - DNA, 25 bp, Homo sapien
aggagaagcaaacgtgccatcttag

SEQ ID NO: 23407 - DNA, 25 bp, Homo sapien
aggagaagctagaaaaataaaacca

SEQ ID NO: 23408 - DNA, 25 bp, Homo sapien
aggagaagctagaaaagtaaaacca

SEQ ID NO: 23409 - DNA, 25 bp, Homo sapien
aggagaataatgtggagaaaaaaag

SEQ ID NO: 23410 - DNA, 25 bp, Homo sapien
aggagaatattgtggagaaaaaaag

SEQ ID NO: 23411 - DNA, 25 bp, Homo sapien
aggagaatttggagaggtataaaat

SEQ ID NO: 23412 - DNA, 25 bp, Homo sapien
aggagaatttggagagttataaaat

SEQ ID NO: 23413 - DNA, 25 bp, Homo sapien
aggagaatttgtcacaaacaaacag

SEQ ID NO: 23414 - DNA, 25 bp, Homo sapien
aggagaatttgtcagaaacaaacag

SEQ ID NO: 23415 - DNA, 25 bp, Homo sapien
aggagacaaaaatagagctgttggg

SEQ ID NO: 23416 - DNA, 25 bp, Homo sapien
aggagacaacaatagagctgttggg

SEQ ID NO: 23417 - DNA, 25 bp, Homo sapien
aggagacaagggttagagactattg

SEQ ID NO: 23418 - DNA, 25 bp, Homo sapien
aggagacaaggtttagagactattg

SEQ ID NO: 23419 - DNA, 25 bp, Homo sapien
aggagacacaggtgatccagcacct

SEQ ID NO: 23420 - DNA, 25 bp, Homo sapien
aggagacacgggtgatccagcacct

SEQ ID NO: 23421 - DNA, 25 bp, Homo sapien
aggagacaggaaacaatacagtcca

SEQ ID NO: 23422 - DNA, 25 bp, Homo sapien
aggagacaggagacaatacagtcca

SEQ ID NO: 23423 - DNA, 25 bp, Homo sapien
aggagacagttaacaaatccactat

SEQ ID NO: 23424 - DNA, 25 bp, Homo sapien
aggagacagttgacaaatccactat

SEQ ID NO: 23425 - DNA, 25 bp, Homo sapien
aggagacgacatctgagcatctgaa

SEQ ID NO: 23426 - DNA, 25 bp, Homo sapien
aggagacgatatctgagcatctgaa

SEQ ID NO: 23427 - DNA, 25 bp, Homo sapien
aggagactggaagtaccataaaaat

SEQ ID NO: 23428 - DNA, 25 bp, Homo sapien
aggagactggaagtacgataaaaat

SEQ ID NO: 23429 - DNA, 25 bp, Homo sapien
aggagagaaacaacgaagatataag

SEQ ID NO: 23430 - DNA, 25 bp, Homo sapien
aggagagaagcaacgaagatataag

SEQ ID NO: 23431 - DNA, 25 bp, Homo sapien
aggagagcttacggctccaaagcca

SEQ ID NO: 23432 - DNA, 25 bp, Homo sapien
aggagagcttacggcttcaaagcca

SEQ ID NO: 23433 - DNA, 25 bp, Homo sapien
aggagaggaaacagaattaattagt

SEQ ID NO: 23434 - DNA, 25 bp, Homo sapien
aggagaggaaacggaattaattagt

SEQ ID NO: 23435 - DNA, 25 bp, Homo sapien
aggagaggagacggcgcaggatcac

SEQ ID NO: 23436 - DNA, 25 bp, Homo sapien
aggagaggagatggcgcaggatcac

SEQ ID NO: 23437 - DNA, 25 bp, Homo sapien
aggagagggaaacaaatgaccaaat

SEQ ID NO: 23438 - DNA, 25 bp, Homo sapien
aggagagggaagcaaatgaccaaat

SEQ ID NO: 23439 - DNA, 25 bp, Homo sapien
aggagagggatttttttcttggtca

SEQ ID NO: 23440 - DNA, 25 bp, Homo sapien
aggagagggctttttttcttggtca

SEQ ID NO: 23441 - DNA, 25 bp, Homo sapien
aggagagggggaatctgttcttagc

SEQ ID NO: 23442 - DNA, 25 bp, Homo sapien
aggagagggggagtctgttcttagc

SEQ ID NO: 23443 - DNA, 25 bp, Homo sapien
aggagagtggaaattaggccagaaa

SEQ ID NO: 23444 - DNA, 25 bp, Homo sapien
aggagagtggaaattatgccagaaa

SEQ ID NO: 23445 - DNA, 25 bp, Homo sapien
aggagataaggactggggtgtggtg

SEQ ID NO: 23446 - DNA, 25 bp, Homo sapien
aggagataatgactggggtgtggtg

SEQ ID NO: 23447 - DNA, 25 bp, Homo sapien
aggagatagacaaggagatgaagtg

SEQ ID NO: 23448 - DNA, 25 bp, Homo sapien
aggagatagacgaggagatgaagtg

SEQ ID NO: 23449 - DNA, 25 bp, Homo sapien
aggagatagagttctcctttgattt

SEQ ID NO: 23450 - DNA, 25 bp, Homo sapien
aggagatagagttttcctttgattt

SEQ ID NO: 23451 - DNA, 25 bp, Homo sapien
aggagataggaacaattttcagtgg

SEQ ID NO: 23452 - DNA, 25 bp, Homo sapien
aggagataggaccaattttcagtgg

SEQ ID NO: 23453 - DNA, 25 bp, Homo sapien
aggagatgactgacttctcagcttc

SEQ ID NO: 23454 - DNA, 25 bp, Homo sapien
aggagatgattgacttctcagcttc

SEQ ID NO: 23455 - DNA, 25 bp, Homo sapien
aggagatgcactacattcaaaaaga

SEQ ID NO: 23456 - DNA, 25 bp, Homo sapien
aggagatgcgctacattcaaaaaga

SEQ ID NO: 23457 - DNA, 25 bp, Homo sapien
aggagattaacactgatgcaatacc

SEQ ID NO: 23458 - DNA, 25 bp, Homo sapien
aggagattaacattgatgcaatacc

SEQ ID NO: 23459 - DNA, 25 bp, Homo sapien
aggagattatggcacaacatatgga

SEQ ID NO: 23460 - DNA, 25 bp, Homo sapien
aggagattatggcacagcatatgga

SEQ ID NO: 23461 - DNA, 25 bp, Homo sapien
aggagcaagccagggaagaaagcgc

SEQ ID NO: 23462 - DNA, 25 bp, Homo sapien
aggagcaagtcagggaagaaagcgc

SEQ ID NO: 23463 - DNA, 25 bp, Homo sapien
aggagcaattttccaatcttcttca

SEQ ID NO: 23464 - DNA, 25 bp, Homo sapien
aggagcaattttccgatcttcttca

SEQ ID NO: 23465 - DNA, 25 bp, Homo sapien
aggagcagaactgtccaggccttgt

SEQ ID NO: 23466 - DNA, 25 bp, Homo sapien
aggagcagaactttccaggccttgt

SEQ ID NO: 23467 - DNA, 25 bp, Homo sapien
aggagcagacggcttcttgttttga

SEQ ID NO: 23468 - DNA, 25 bp, Homo sapien
aggagcagatggcttcttgttttga

SEQ ID NO: 23469 - DNA, 25 bp, Homo sapien
aggagcatctaacacatgcttgaaa

SEQ ID NO: 23470 - DNA, 25 bp, Homo sapien
aggagcatctaacccatgcttgaaa

SEQ ID NO: 23471 - DNA, 25 bp, Homo sapien
aggagccagcaatcagtcctccaag

SEQ ID NO: 23472 - DNA, 25 bp, Homo sapien
aggagccagcaatcggtcctccaag

SEQ ID NO: 23473 - DNA, 25 bp, Homo sapien
aggagcctgctgggtgattcacatt

SEQ ID NO: 23474 - DNA, 25 bp, Homo sapien
aggagcctgggtacagaagtttctc

SEQ ID NO: 23475 - DNA, 25 bp, Homo sapien
aggagcctgtgtacagaagtttctc

SEQ ID NO: 23476 - DNA, 25 bp, Homo sapien
aggagcctgttgggtgattcacatt

SEQ ID NO: 23477 - DNA, 25 bp, Homo sapien
aggagccttttcgcagagtctttag

SEQ ID NO: 23478 - DNA, 25 bp, Homo sapien
aggagcctttttgcagagtctttag

SEQ ID NO: 23479 - DNA, 25 bp, Homo sapien
aggagctcagggcttggcagcatgt

SEQ ID NO: 23480 - DNA, 25 bp, Homo sapien
aggagctcatggcttggcagcatgt

SEQ ID NO: 23481 - DNA, 25 bp, Homo sapien
aggagcttagggacttagaatgctt

SEQ ID NO: 23482 - DNA, 25 bp, Homo sapien
aggagcttagggatttagaatgctt

SEQ ID NO: 23483 - DNA, 25 bp, Homo sapien
aggagcttcctccttcactgggcac

SEQ ID NO: 23484 - DNA, 25 bp, Homo sapien
aggagcttcctctttcactgggcac

SEQ ID NO: 23485 - DNA, 25 bp, Homo sapien
aggagcttgatacagggccagggct

SEQ ID NO: 23486 - DNA, 25 bp, Homo sapien
aggagcttgatacggggccagggct

SEQ ID NO: 23487 - DNA, 25 bp, Homo sapien
aggaggaaaacaagaatgatcttac

SEQ ID NO: 23488 - DNA, 25 bp, Homo sapien
aggaggaaaacatgaatgatcttac

SEQ ID NO: 23489 - DNA, 25 bp, Homo sapien
aggaggaacgagctggaaataaatg

SEQ ID NO: 23490 - DNA, 25 bp, Homo sapien
aggaggaagactgaggaaataaaag

SEQ ID NO: 23491 - DNA, 25 bp, Homo sapien
aggaggaagtctgaggaaataaaag

SEQ ID NO: 23492 - DNA, 25 bp, Homo sapien
aggaggaatgagctggaaataaatg

SEQ ID NO: 23493 - DNA, 25 bp, Homo sapien
aggaggactccacggtgcaggcaga

SEQ ID NO: 23494 - DNA, 25 bp, Homo sapien
aggaggactccatggtgcaggcaga

SEQ ID NO: 23495 - DNA, 25 bp, Homo sapien
aggaggagactttggtagtcaacag

SEQ ID NO: 23496 - DNA, 25 bp, Homo sapien
aggaggaggctttggtagtcaacag

SEQ ID NO: 23497 - DNA, 25 bp, Homo sapien
aggaggatcaggtagaataatactc

SEQ ID NO: 23498 - DNA, 25 bp, Homo sapien
aggaggatccaacaggaaggcaact

SEQ ID NO: 23499 - DNA, 25 bp, Homo sapien
aggaggatccaacgggaaggcaact

SEQ ID NO: 23500 - DNA, 25 bp, Homo sapien
aggaggatcgggtagaataatactc

SEQ ID NO: 23501 - DNA, 25 bp, Homo sapien
aggaggattaggtcaaaaccaacag

SEQ ID NO: 23502 - DNA, 25 bp, Homo sapien
aggaggattaggttaaaaccaacag

SEQ ID NO: 23503 - DNA, 25 bp, Homo sapien
aggaggcaagactctacttcagtct

SEQ ID NO: 23504 - DNA, 25 bp, Homo sapien
aggaggcaagactctatttcagtct

SEQ ID NO: 23505 - DNA, 25 bp, Homo sapien
aggaggcacattgtactcactggta

SEQ ID NO: 23506 - DNA, 25 bp, Homo sapien
aggaggcagaactcagacactagtg

SEQ ID NO: 23507 - DNA, 25 bp, Homo sapien
aggaggcagaactcaggcactagtg

SEQ ID NO: 23508 - DNA, 25 bp, Homo sapien
aggaggcatattgtactcactggta

SEQ ID NO: 23509 - DNA, 25 bp, Homo sapien
aggaggccgttttcttctggtaggt

SEQ ID NO: 23510 - DNA, 25 bp, Homo sapien
aggaggccgttttcttttggtaggt

SEQ ID NO: 23511 - DNA, 25 bp, Homo sapien
aggagggaagatcatttgagctcag

SEQ ID NO: 23512 - DNA, 25 bp, Homo sapien
aggagggaagatcgtttgagctcag

SEQ ID NO: 23513 - DNA, 25 bp, Homo sapien
aggagggatcgcagaaagaaggtgg

SEQ ID NO: 23514 - DNA, 25 bp, Homo sapien
aggagggatcgcggaaagaaggtgg

SEQ ID NO: 23515 - DNA, 25 bp, Homo sapien
aggagggatgaagagtggctagagt

SEQ ID NO: 23516 - DNA, 25 bp, Homo sapien
aggagggatgaagagttgctagagt

SEQ ID NO: 23517 - DNA, 25 bp, Homo sapien
aggagggtcatctcagccccaggat

SEQ ID NO: 23518 - DNA, 25 bp, Homo sapien
aggagggtcatgtcagccccaggat

SEQ ID NO: 23519 - DNA, 25 bp, Homo sapien
aggagggtggcacatgctcatcacc

SEQ ID NO: 23520 - DNA, 25 bp, Homo sapien
aggagggtggcgcatgctcatcacc

SEQ ID NO: 23521 - DNA, 25 bp, Homo sapien
aggaggtaaaaagatgacaaacagc

SEQ ID NO: 23522 - DNA, 25 bp, Homo sapien
aggaggtaaaaagctgacaaacagc

SEQ ID NO: 23523 - DNA, 25 bp, Homo sapien
aggaggtccaacatccaaataaaat

SEQ ID NO: 23524 - DNA, 25 bp, Homo sapien
aggaggtccgacatccaaataaaat

SEQ ID NO: 23525 - DNA, 25 bp, Homo sapien
aggaggtgctcttaagcaaacgaag

SEQ ID NO: 23526 - DNA, 25 bp, Homo sapien
aggaggtgctcttaaggaaacgaag

SEQ ID NO: 23527 - DNA, 25 bp, Homo sapien
aggaggtggacataatttaccctca

SEQ ID NO: 23528 - DNA, 25 bp, Homo sapien
aggaggtggacgtaatttaccctca

SEQ ID NO: 23529 - DNA, 25 bp, Homo sapien
aggagtaaacggtcctttcacaggt

SEQ ID NO: 23530 - DNA, 25 bp, Homo sapien
aggagtaagcggtcctttcacaggt

SEQ ID NO: 23531 - DNA, 25 bp, Homo sapien
aggagtagaattaacagaagacaga

SEQ ID NO: 23532 - DNA, 25 bp, Homo sapien
aggagtagagttaacagaagacaga

SEQ ID NO: 23533 - DNA, 25 bp, Homo sapien
aggagtagggctacatccagacctg

SEQ ID NO: 23534 - DNA, 25 bp, Homo sapien
aggagtagggctacattcagacctg

SEQ ID NO: 23535 - DNA, 25 bp, Homo sapien
aggagtagtgactgaagatttttgc

SEQ ID NO: 23536 - DNA, 25 bp, Homo sapien
aggagtagtgagtgaagatttttgc

SEQ ID NO: 23537 - DNA, 25 bp, Homo sapien
aggagtatattccggtaacaaagag

SEQ ID NO: 23538 - DNA, 25 bp, Homo sapien
aggagtatattctggtaacaaagag

SEQ ID NO: 23539 - DNA, 25 bp, Homo sapien
aggagtatcagacgcatttatttcg

SEQ ID NO: 23540 - DNA, 25 bp, Homo sapien
aggagtatcagatgcatttatttcg

SEQ ID NO: 23541 - DNA, 25 bp, Homo sapien
aggagtattcctaccggtttggata

SEQ ID NO: 23542 - DNA, 25 bp, Homo sapien
aggagtattcctactggtttggata

SEQ ID NO: 23543 - DNA, 25 bp, Homo sapien
aggagtcctgattactgaattgaag

SEQ ID NO: 23544 - DNA, 25 bp, Homo sapien
aggagtcctgattattgaattgaag

SEQ ID NO: 23545 - DNA, 25 bp, Homo sapien
aggagtgcatagaccacaatagatt

SEQ ID NO: 23546 - DNA, 25 bp, Homo sapien
aggagtgcatagactacaatagatt

SEQ ID NO: 23547 - DNA, 25 bp, Homo sapien
aggagtgcattttgatcatgttaaa

SEQ ID NO: 23548 - DNA, 25 bp, Homo sapien
aggagtgcattttggtcatgttaaa

SEQ ID NO: 23549 - DNA, 25 bp, Homo sapien
aggagtgccctgtatataagtccta

SEQ ID NO: 23550 - DNA, 25 bp, Homo sapien
aggagtgctctgtatataagtccta

SEQ ID NO: 23551 - DNA, 25 bp, Homo sapien
aggagtggacttacagcgcaatcga

SEQ ID NO: 23552 - DNA, 25 bp, Homo sapien
aggagtggacttatagcgcaatcga

SEQ ID NO: 23553 - DNA, 25 bp, Homo sapien
aggagtggccagaccatagaggcag

SEQ ID NO: 23554 - DNA, 25 bp, Homo sapien
aggagtggccaggccatagaggcag

SEQ ID NO: 23555 - DNA, 25 bp, Homo sapien
aggagtgtgctagctagattgtatg

SEQ ID NO: 23556 - DNA, 25 bp, Homo sapien
aggagtgtgcttgctagattgtatg

SEQ ID NO: 23557 - DNA, 25 bp, Homo sapien
aggagtgttgaacctgcattccaga

SEQ ID NO: 23558 - DNA, 25 bp, Homo sapien
aggagtgttgagcctgcattccaga

SEQ ID NO: 23559 - DNA, 25 bp, Homo sapien
aggagttcagttttggtcatgttca

SEQ ID NO: 23560 - DNA, 25 bp, Homo sapien
aggagttcagtttttgtcatgttca

SEQ ID NO: 23561 - DNA, 25 bp, Homo sapien
aggagttccgagagacacccaggct

SEQ ID NO: 23562 - DNA, 25 bp, Homo sapien
aggagttcggagagacacccaggct

SEQ ID NO: 23563 - DNA, 25 bp, Homo sapien
aggagttgaaaaacacattaagagc

SEQ ID NO: 23564 - DNA, 25 bp, Homo sapien
aggagttgaaaaacccattaagagc

SEQ ID NO: 23565 - DNA, 25 bp, Homo sapien
aggagttgctaacaccactggctca

SEQ ID NO: 23566 - DNA, 25 bp, Homo sapien
aggagttgctaacaccgctggctca

SEQ ID NO: 23567 - DNA, 25 bp, Homo sapien
aggagttgctgggtatcgagaacca

SEQ ID NO: 23568 - DNA, 25 bp, Homo sapien
aggagttgctgggtattgagaacca

SEQ ID NO: 23569 - DNA, 25 bp, Homo sapien
aggagttggcttacatgattgtgag

SEQ ID NO: 23570 - DNA, 25 bp, Homo sapien
aggagttggcttacgtgattgtgag

SEQ ID NO: 23571 - DNA, 25 bp, Homo sapien
aggagttgggacgaaggtatcaata

SEQ ID NO: 23572 - DNA, 25 bp, Homo sapien
aggagttgggatgaaggtatcaata

SEQ ID NO: 23573 - DNA, 25 bp, Homo sapien
aggagttgtcagggctctgctgtaa

SEQ ID NO: 23574 - DNA, 25 bp, Homo sapien
aggagttgtcagggctttgctgtaa

SEQ ID NO: 23575 - DNA, 25 bp, Homo sapien
aggagtttcaactacagggaaacct

SEQ ID NO: 23576 - DNA, 25 bp, Homo sapien
aggagtttcaactacatggaaacct

SEQ ID NO: 23577 - DNA, 25 bp, Homo sapien
aggagtttcatgagatacaatatag

SEQ ID NO: 23578 - DNA, 25 bp, Homo sapien
aggagtttccctcaaacagcagtta

SEQ ID NO: 23579 - DNA, 25 bp, Homo sapien
aggagtttctctcaaacagcagtta

SEQ ID NO: 23580 - DNA, 25 bp, Homo sapien
aggagtttcttgagatacaatatag

SEQ ID NO: 23581 - DNA, 25 bp, Homo sapien
aggagtttgagaccagattgagcaa

SEQ ID NO: 23582 - DNA, 25 bp, Homo sapien
aggagtttgagacctgattgagcaa

SEQ ID NO: 23583 - DNA, 25 bp, Homo sapien
aggataaaaatacacacatgaagaa

SEQ ID NO: 23584 - DNA, 25 bp, Homo sapien
aggataaaaatatacacatgaagaa

SEQ ID NO: 23585 - DNA, 25 bp, Homo sapien
aggataaaagacgcatttgtgataa

SEQ ID NO: 23586 - DNA, 25 bp, Homo sapien
aggataaaagatgcatttgtgataa

SEQ ID NO: 23587 - DNA, 25 bp, Homo sapien
aggataaacaggacagtgataaata

SEQ ID NO: 23588 - DNA, 25 bp, Homo sapien
aggataaagacagcagttggttaga

SEQ ID NO: 23589 - DNA, 25 bp, Homo sapien
aggataaagacaggagttggttaga

SEQ ID NO: 23590 - DNA, 25 bp, Homo sapien
aggataaataggacagtgataaata

SEQ ID NO: 23591 - DNA, 25 bp, Homo sapien
aggataaatcgtgaattggaaggag

SEQ ID NO: 23592 - DNA, 25 bp, Homo sapien
aggataaatcgtgagttggaaggag

SEQ ID NO: 23593 - DNA, 25 bp, Homo sapien
aggataagaaaacaaaaagtactta

SEQ ID NO: 23594 - DNA, 25 bp, Homo sapien
aggataaggaaacaaaaagtactta

SEQ ID NO: 23595 - DNA, 25 bp, Homo sapien
aggataatctgagattcacgcaaag

SEQ ID NO: 23596 - DNA, 25 bp, Homo sapien
aggataatctgaggttcacgcaaag

SEQ ID NO: 23597 - DNA, 25 bp, Homo sapien
aggataatgagaacgttctctggca

SEQ ID NO: 23598 - DNA, 25 bp, Homo sapien
aggataatgagaatgttctctggca

SEQ ID NO: 23599 - DNA, 25 bp, Homo sapien
aggataatgctagaggatccagctg

SEQ ID NO: 23600 - DNA, 25 bp, Homo sapien
aggataatgctagaggctccagctg

SEQ ID NO: 23601 - DNA, 25 bp, Homo sapien
aggataatgtgaaatatggcctaat

SEQ ID NO: 23602 - DNA, 25 bp, Homo sapien
aggataatgtgaactatggcctaat

SEQ ID NO: 23603 - DNA, 25 bp, Homo sapien
aggatacacttacaacgaactgtaa

SEQ ID NO: 23604 - DNA, 25 bp, Homo sapien
aggatacactttcaacgaactgtaa

SEQ ID NO: 23605 - DNA, 25 bp, Homo sapien
aggatacagtatcatggctagtgct

SEQ ID NO: 23606 - DNA, 25 bp, Homo sapien
aggatacagtatcgtggctagtgct

SEQ ID NO: 23607 - DNA, 25 bp, Homo sapien
aggataccatataacttggcactca

SEQ ID NO: 23608 - DNA, 25 bp, Homo sapien
aggataccatatgacttggcactca

SEQ ID NO: 23609 - DNA, 25 bp, Homo sapien
aggatagaaaatggaatcctggcaa

SEQ ID NO: 23610 - DNA, 25 bp, Homo sapien
aggatagaccacggcttcagcctgc

SEQ ID NO: 23611 - DNA, 25 bp, Homo sapien
aggatagaccatggcttcagcctgc

SEQ ID NO: 23612 - DNA, 25 bp, Homo sapien
aggatagagaagcaccctgaagcct

SEQ ID NO: 23613 - DNA, 25 bp, Homo sapien
aggatagagaagcatcctgaagcct

SEQ ID NO: 23614 - DNA, 25 bp, Homo sapien
aggatagagaatggaatcctggcaa

SEQ ID NO: 23615 - DNA, 25 bp, Homo sapien
aggataggaagagaaaactgcacat

SEQ ID NO: 23616 - DNA, 25 bp, Homo sapien
aggataggaagggaaaactgcacat

SEQ ID NO: 23617 - DNA, 25 bp, Homo sapien
aggatatagggttcagtctagcatg

SEQ ID NO: 23618 - DNA, 25 bp, Homo sapien
aggatatatatcattctcagctgga

SEQ ID NO: 23619 - DNA, 25 bp, Homo sapien
aggatatatatcgttctcagctgga

SEQ ID NO: 23620 - DNA, 25 bp, Homo sapien
aggatatatggttcagtctagcatg

SEQ ID NO: 23621 - DNA, 25 bp, Homo sapien
aggatatgaacggagtattcaaggc

SEQ ID NO: 23622 - DNA, 25 bp, Homo sapien
aggatatgaactgagtattcaaggc

SEQ ID NO: 23623 - DNA, 25 bp, Homo sapien
aggatatgacacagaaatggtaagc

SEQ ID NO: 23624 - DNA, 25 bp, Homo sapien
aggatatgacacagcaatggtaagc

SEQ ID NO: 23625 - DNA, 25 bp, Homo sapien
aggatcacaaccagtgaaactatcc

SEQ ID NO: 23626 - DNA, 25 bp, Homo sapien
aggatcacaactagtgaaactatcc

SEQ ID NO: 23627 - DNA, 25 bp, Homo sapien
aggatcataagattgggagattacc

SEQ ID NO: 23628 - DNA, 25 bp, Homo sapien
aggatcatgagattgggagattacc

SEQ ID NO: 23629 - DNA, 25 bp, Homo sapien
aggatcattaactgtccagaaatct

SEQ ID NO: 23630 - DNA, 25 bp, Homo sapien
aggatcattcactgtccagaaatct

SEQ ID NO: 23631 - DNA, 25 bp, Homo sapien
aggatccagatttccctgtggcctc

SEQ ID NO: 23632 - DNA, 25 bp, Homo sapien
aggatccagcaggactaggtaccaa

SEQ ID NO: 23633 - DNA, 25 bp, Homo sapien
aggatccagcaggactgggtaccaa

SEQ ID NO: 23634 - DNA, 25 bp, Homo sapien
aggatccagctttccctgtggcctc

SEQ ID NO: 23635 - DNA, 25 bp, Homo sapien
aggatctaacctcttcctacaaggc

SEQ ID NO: 23636 - DNA, 25 bp, Homo sapien
aggatctagcaggacttcaatgtac

SEQ ID NO: 23637 - DNA, 25 bp, Homo sapien
aggatctagcaggagttcaatgtac

SEQ ID NO: 23638 - DNA, 25 bp, Homo sapien
aggatctagcctcttcctacaaggc

SEQ ID NO: 23639 - DNA, 25 bp, Homo sapien
aggatctgacttacctaggtgattt

SEQ ID NO: 23640 - DNA, 25 bp, Homo sapien
aggatctgacttacttaggtgattt

SEQ ID NO: 23641 - DNA, 25 bp, Homo sapien
aggatctgcttgaatatttgaggca

SEQ ID NO: 23642 - DNA, 25 bp, Homo sapien
aggatctgcttggatatttgaggca

SEQ ID NO: 23643 - DNA, 25 bp, Homo sapien
aggatctggccacgccaaattggaa

SEQ ID NO: 23644 - DNA, 25 bp, Homo sapien
aggatctggccatgccaaattggaa

SEQ ID NO: 23645 - DNA, 25 bp, Homo sapien
aggatcttggccatattctgagcca

SEQ ID NO: 23646 - DNA, 25 bp, Homo sapien
aggatcttggccgtattctgagcca

SEQ ID NO: 23647 - DNA, 25 bp, Homo sapien
aggatgaaggtagccttgttgagct

SEQ ID NO: 23648 - DNA, 25 bp, Homo sapien
aggatgaagttagccttgttgagct

SEQ ID NO: 23649 - DNA, 25 bp, Homo sapien
aggatgactggtctgagattttctt

SEQ ID NO: 23650 - DNA, 25 bp, Homo sapien
aggatgactggtgtgagattttctt

SEQ ID NO: 23651 - DNA, 25 bp, Homo sapien
aggatgagatgcatacacctacttc

SEQ ID NO: 23652 - DNA, 25 bp, Homo sapien
aggatgagatgcatactcctacttc

SEQ ID NO: 23653 - DNA, 25 bp, Homo sapien
aggatgatttattaagatgtaagga

SEQ ID NO: 23654 - DNA, 25 bp, Homo sapien
aggatgatttattaagttgtaagga

SEQ ID NO: 23655 - DNA, 25 bp, Homo sapien
aggatgcaccattccatagaacaat

SEQ ID NO: 23656 - DNA, 25 bp, Homo sapien
aggatgcaccattcgatagaacaat

SEQ ID NO: 23657 - DNA, 25 bp, Homo sapien
aggatgcagagtacaaagcacatcc

SEQ ID NO: 23658 - DNA, 25 bp, Homo sapien
aggatgcagagtacaaggcacatcc

SEQ ID NO: 23659 - DNA, 25 bp, Homo sapien
aggatgctattggctttccctcgct

SEQ ID NO: 23660 - DNA, 25 bp, Homo sapien
aggatgctattgtctttccctcgct

SEQ ID NO: 23661 - DNA, 25 bp, Homo sapien
aggatggaaatagcaaacaaacaac

SEQ ID NO: 23662 - DNA, 25 bp, Homo sapien
aggatggaaatatcaaacaaacaac

SEQ ID NO: 23663 - DNA, 25 bp, Homo sapien
aggatggagaaaacagatctgattt

SEQ ID NO: 23664 - DNA, 25 bp, Homo sapien
aggatggagcatccaaatggcaccc

SEQ ID NO: 23665 - DNA, 25 bp, Homo sapien
aggatggagtatccaaatggcaccc

SEQ ID NO: 23666 - DNA, 25 bp, Homo sapien
aggatggataaaacagatctgattt

SEQ ID NO: 23667 - DNA, 25 bp, Homo sapien
aggatggccaaacgcagcagacagg

SEQ ID NO: 23668 - DNA, 25 bp, Homo sapien
aggatggccaaactcagcagacagg

SEQ ID NO: 23669 - DNA, 25 bp, Homo sapien
aggatggctgcaacctcaaaaaaag

SEQ ID NO: 23670 - DNA, 25 bp, Homo sapien
aggatggctgcatcctcaaaaaaag

SEQ ID NO: 23671 - DNA, 25 bp, Homo sapien
aggatggcttaaagtatgcaaatca

SEQ ID NO: 23672 - DNA, 25 bp, Homo sapien
aggatggcttaacgtatgcaaatca

SEQ ID NO: 23673 - DNA, 25 bp, Homo sapien
aggatgggtacaatgaagcagagtg

SEQ ID NO: 23674 - DNA, 25 bp, Homo sapien
aggatgggtgcaatgaagcagagtg

SEQ ID NO: 23675 - DNA, 25 bp, Homo sapien
aggatggtaatgttaagacacaaat

SEQ ID NO: 23676 - DNA, 25 bp, Homo sapien
aggatggtaatgttgagacacaaat

SEQ ID NO: 23677 - DNA, 25 bp, Homo sapien
aggatggtcttgcttgccaagtttt

SEQ ID NO: 23678 - DNA, 25 bp, Homo sapien
aggatggttttgcttgccaagtttt

SEQ ID NO: 23679 - DNA, 25 bp, Homo sapien
aggatgtagtcttgaagtcagttgg

SEQ ID NO: 23680 - DNA, 25 bp, Homo sapien
aggatgtagtcttgaattcagttgg

SEQ ID NO: 23681 - DNA, 25 bp, Homo sapien
aggatgtcatgacacttggtctgta

SEQ ID NO: 23682 - DNA, 25 bp, Homo sapien
aggatgtcatgacccttggtctgta

SEQ ID NO: 23683 - DNA, 25 bp, Homo sapien
aggatgtcttcatttaattcactgc

SEQ ID NO: 23684 - DNA, 25 bp, Homo sapien
aggatgtcttcgtttaattcactgc

SEQ ID NO: 23685 - DNA, 25 bp, Homo sapien
aggatgttatggaactcataatttt

SEQ ID NO: 23686 - DNA, 25 bp, Homo sapien
aggatgttatggaagtcataatttt

SEQ ID NO: 23687 - DNA, 25 bp, Homo sapien
aggattaagcataacgataaatgaa

SEQ ID NO: 23688 - DNA, 25 bp, Homo sapien
aggattaagcataatgataaatgaa

SEQ ID NO: 23689 - DNA, 25 bp, Homo sapien
aggattagtctccatggctgattca

SEQ ID NO: 23690 - DNA, 25 bp, Homo sapien
aggattagtctccgtggctgattca

SEQ ID NO: 23691 - DNA, 25 bp, Homo sapien
aggattatctcatgattaaattatt

SEQ ID NO: 23692 - DNA, 25 bp, Homo sapien
aggattatctcgtgattaaattatt

SEQ ID NO: 23693 - DNA, 25 bp, Homo sapien
aggattatgctgagtcagaccgatg

SEQ ID NO: 23694 - DNA, 25 bp, Homo sapien
aggattatgctgggtcagaccgatg

SEQ ID NO: 23695 - DNA, 25 bp, Homo sapien
aggattcaaaaccaaaatgctattc

SEQ ID NO: 23696 - DNA, 25 bp, Homo sapien
aggattcaaaactaaaatgctattc

SEQ ID NO: 23697 - DNA, 25 bp, Homo sapien
aggattcaaatgacacattcattga

SEQ ID NO: 23698 - DNA, 25 bp, Homo sapien
aggattcaaatgacccattcattga

SEQ ID NO: 23699 - DNA, 25 bp, Homo sapien
aggattcacagttcagctaattggg

SEQ ID NO: 23700 - DNA, 25 bp, Homo sapien
aggattcagaggaggtatcaaaaag

SEQ ID NO: 23701 - DNA, 25 bp, Homo sapien
aggattcagaggatgtatcaaaaag

SEQ ID NO: 23702 - DNA, 25 bp, Homo sapien
aggattcagcaccaagagctctcaa

SEQ ID NO: 23703 - DNA, 25 bp, Homo sapien
aggattcagttaagtttgttcatct

SEQ ID NO: 23704 - DNA, 25 bp, Homo sapien
aggattcagttacgtttgttcatct

SEQ ID NO: 23705 - DNA, 25 bp, Homo sapien
aggattcatagttcagctaattggg

SEQ ID NO: 23706 - DNA, 25 bp, Homo sapien
aggattcatcaccaagagctctcaa

SEQ ID NO: 23707 - DNA, 25 bp, Homo sapien
aggattcatcatcattaggtgtcac

SEQ ID NO: 23708 - DNA, 25 bp, Homo sapien
aggattcatcatcgttaggtgtcac

SEQ ID NO: 23709 - DNA, 25 bp, Homo sapien
aggattcgggcataacagattaaat

SEQ ID NO: 23710 - DNA, 25 bp, Homo sapien
aggattcgggcataccagattaaat

SEQ ID NO: 23711 - DNA, 25 bp, Homo sapien
aggattgagacagatgctttagttt

SEQ ID NO: 23712 - DNA, 25 bp, Homo sapien
aggattgagacagatgttttagttt

SEQ ID NO: 23713 - DNA, 25 bp, Homo sapien
aggattgcaaaacaccagtcacagc

SEQ ID NO: 23714 - DNA, 25 bp, Homo sapien
aggattgcaaaacacctgtcacagc

SEQ ID NO: 23715 - DNA, 25 bp, Homo sapien
aggattgctaagcttgatgaattag

SEQ ID NO: 23716 - DNA, 25 bp, Homo sapien
aggattgctgagcttgatgaattag

SEQ ID NO: 23717 - DNA, 25 bp, Homo sapien
aggattggtggaaacgttcttaggg

SEQ ID NO: 23718 - DNA, 25 bp, Homo sapien
aggattggtggaaatgttcttaggg

SEQ ID NO: 23719 - DNA, 25 bp, Homo sapien
aggatttacaggtaaaggataaaga

SEQ ID NO: 23720 - DNA, 25 bp, Homo sapien
aggatttacatctacatatgcagaa

SEQ ID NO: 23721 - DNA, 25 bp, Homo sapien
aggatttacgtctacatatgcagaa

SEQ ID NO: 23722 - DNA, 25 bp, Homo sapien
aggatttactcacccacaaaagtgt

SEQ ID NO: 23723 - DNA, 25 bp, Homo sapien
aggatttactcagccacaaaagtgt

SEQ ID NO: 23724 - DNA, 25 bp, Homo sapien
aggatttactgccccaacagaaagt

SEQ ID NO: 23725 - DNA, 25 bp, Homo sapien
aggatttactgccgcaacagaaagt

SEQ ID NO: 23726 - DNA, 25 bp, Homo sapien
aggatttagaggtaaaggataaaga

SEQ ID NO: 23727 - DNA, 25 bp, Homo sapien
aggatttcaaggccaacctgggcaa

SEQ ID NO: 23728 - DNA, 25 bp, Homo sapien
aggatttcaaggtcaacctgggcaa

SEQ ID NO: 23729 - DNA, 25 bp, Homo sapien
aggatttcaatgtatgaattttgtg

SEQ ID NO: 23730 - DNA, 25 bp, Homo sapien
aggatttcagtgtatgaattttgtg

SEQ ID NO: 23731 - DNA, 25 bp, Homo sapien
aggatttgaatgtaagcattaataa

SEQ ID NO: 23732 - DNA, 25 bp, Homo sapien
aggatttgagtgtaagcattaataa

SEQ ID NO: 23733 - DNA, 25 bp, Homo sapien
aggattttattaaacgtattcacag

SEQ ID NO: 23734 - DNA, 25 bp, Homo sapien
aggattttcatacatccctctgcag

SEQ ID NO: 23735 - DNA, 25 bp, Homo sapien
aggattttctcattgcctggctggt

SEQ ID NO: 23736 - DNA, 25 bp, Homo sapien
aggattttctcgttgcctggctggt

SEQ ID NO: 23737 - DNA, 25 bp, Homo sapien
aggattttgttaaacgtattcacag

SEQ ID NO: 23738 - DNA, 25 bp, Homo sapien
aggatttttactctagtctctagtt

SEQ ID NO: 23739 - DNA, 25 bp, Homo sapien
aggatttttactttagtctctagtt

SEQ ID NO: 23740 - DNA, 25 bp, Homo sapien
aggatttttatacatccctctgcag

SEQ ID NO: 23741 - DNA, 25 bp, Homo sapien
aggcaaaaaaaagagtcatgttctt

SEQ ID NO: 23742 - DNA, 25 bp, Homo sapien
aggcaaaaaaaggagtcatgttctt

SEQ ID NO: 23743 - DNA, 25 bp, Homo sapien
aggcaaaaatttaaaaaaacattct

SEQ ID NO: 23744 - DNA, 25 bp, Homo sapien
aggcaaaaatttaagaaaacattct

SEQ ID NO: 23745 - DNA, 25 bp, Homo sapien
aggcaaaacagatgagagcaaaatg

SEQ ID NO: 23746 - DNA, 25 bp, Homo sapien
aggcaaaacttgcaatcccgattga

SEQ ID NO: 23747 - DNA, 25 bp, Homo sapien
aggcaaaactttcaatcccgattga

SEQ ID NO: 23748 - DNA, 25 bp, Homo sapien
aggcaaaagagatgagagcaaaatg

SEQ ID NO: 23749 - DNA, 25 bp, Homo sapien
aggcaaactgacttgaatacttctg

SEQ ID NO: 23750 - DNA, 25 bp, Homo sapien
aggcaaactgacttgagtacttctg

SEQ ID NO: 23751 - DNA, 25 bp, Homo sapien
aggcaaagaacacacagctacaggg

SEQ ID NO: 23752 - DNA, 25 bp, Homo sapien
aggcaaagaacacgcagctacaggg

SEQ ID NO: 23753 - DNA, 25 bp, Homo sapien
aggcaaagatcttttacttgtggtt

SEQ ID NO: 23754 - DNA, 25 bp, Homo sapien
aggcaaagatcttttatttgtggtt

SEQ ID NO: 23755 - DNA, 25 bp, Homo sapien
aggcaacaacgattactcaccagca

SEQ ID NO: 23756 - DNA, 25 bp, Homo sapien
aggcaacaatgattactcaccagca

SEQ ID NO: 23757 - DNA, 25 bp, Homo sapien
aggcaacagagccaccttgaagcac

SEQ ID NO: 23758 - DNA, 25 bp, Homo sapien
aggcaacagagccatcttgaagcac

SEQ ID NO: 23759 - DNA, 25 bp, Homo sapien
aggcaacatatcacataattgtgcc

SEQ ID NO: 23760 - DNA, 25 bp, Homo sapien
aggcaacatatcccataattgtgcc

SEQ ID NO: 23761 - DNA, 25 bp, Homo sapien
aggcaaccaaagcaacaattgacaa

SEQ ID NO: 23762 - DNA, 25 bp, Homo sapien
aggcaacccaagcaacaattgacaa

SEQ ID NO: 23763 - DNA, 25 bp, Homo sapien
aggcaactatactattatgccaaat

SEQ ID NO: 23764 - DNA, 25 bp, Homo sapien
aggcaactatattattatgccaaat

SEQ ID NO: 23765 - DNA, 25 bp, Homo sapien
aggcaactgacaatcatggcagaag

SEQ ID NO: 23766 - DNA, 25 bp, Homo sapien
aggcaactgacagtcatggcagaag

SEQ ID NO: 23767 - DNA, 25 bp, Homo sapien
aggcaagaaagcgtttgcaggggaa

SEQ ID NO: 23768 - DNA, 25 bp, Homo sapien
aggcaagaaatctgagctcaaggtg

SEQ ID NO: 23769 - DNA, 25 bp, Homo sapien
aggcaagaactgatatgatttcctc

SEQ ID NO: 23770 - DNA, 25 bp, Homo sapien
aggcaagaagtctgagctcaaggtg

SEQ ID NO: 23771 - DNA, 25 bp, Homo sapien
aggcaagaatagacccattgcttca

SEQ ID NO: 23772 - DNA, 25 bp, Homo sapien
aggcaagaatagacccgttgcttca

SEQ ID NO: 23773 - DNA, 25 bp, Homo sapien
aggcaagacctcaactgcttcattc

SEQ ID NO: 23774 - DNA, 25 bp, Homo sapien
aggcaagaccttaactgcttcattc

SEQ ID NO: 23775 - DNA, 25 bp, Homo sapien
aggcaagagagcgtttgcaggggaa

SEQ ID NO: 23776 - DNA, 25 bp, Homo sapien
aggcaagatctgatatgatttcctc

SEQ ID NO: 23777 - DNA, 25 bp, Homo sapien
aggcaagcacattacatgagtttca

SEQ ID NO: 23778 - DNA, 25 bp, Homo sapien
aggcaagcatattacatgagtttca

SEQ ID NO: 23779 - DNA, 25 bp, Homo sapien
aggcaaggaatgccactcatacatg

SEQ ID NO: 23780 - DNA, 25 bp, Homo sapien
aggcaaggaatgtcactcatacatg

SEQ ID NO: 23781 - DNA, 25 bp, Homo sapien
aggcaaggtttacggccctgaggat

SEQ ID NO: 23782 - DNA, 25 bp, Homo sapien
aggcaaggtttatggccctgaggat

SEQ ID NO: 23783 - DNA, 25 bp, Homo sapien
aggcaagtctgatatttggttatga

SEQ ID NO: 23784 - DNA, 25 bp, Homo sapien
aggcaagtctgatctttggttatga

SEQ ID NO: 23785 - DNA, 25 bp, Homo sapien
aggcaagtcttaataaattcgaaaa

SEQ ID NO: 23786 - DNA, 25 bp, Homo sapien
aggcaagtcttaatgaattcgaaaa

SEQ ID NO: 23787 - DNA, 25 bp, Homo sapien
aggcaataacactacttgctaatca

SEQ ID NO: 23788 - DNA, 25 bp, Homo sapien
aggcaataatactacttgctaatca

SEQ ID NO: 23789 - DNA, 25 bp, Homo sapien
aggcaatcattatgaagcttcagcc

SEQ ID NO: 23790 - DNA, 25 bp, Homo sapien
aggcaatcattgtgaagcttcagcc

SEQ ID NO: 23791 - DNA, 25 bp, Homo sapien
aggcaatgacaatcttcctggcctc

SEQ ID NO: 23792 - DNA, 25 bp, Homo sapien
aggcaatgacaatgttcctggcctc

SEQ ID NO: 23793 - DNA, 25 bp, Homo sapien
aggcaatggagtaaagaggagtgag

SEQ ID NO: 23794 - DNA, 25 bp, Homo sapien
aggcaatggagtgaagaggagtgag

SEQ ID NO: 23795 - DNA, 25 bp, Homo sapien
aggcaatttactatcgcatgataga

SEQ ID NO: 23796 - DNA, 25 bp, Homo sapien
aggcaatttactattgcatgataga

SEQ ID NO: 23797 - DNA, 25 bp, Homo sapien
aggcaatttagatgatgaaatttaa

SEQ ID NO: 23798 - DNA, 25 bp, Homo sapien
aggcaatttggatgatgaaatttaa

SEQ ID NO: 23799 - DNA, 25 bp, Homo sapien
aggcacaaacatcccgaggggtgtc

SEQ ID NO: 23800 - DNA, 25 bp, Homo sapien
aggcacaaacatcgcgaggggtgtc

SEQ ID NO: 23801 - DNA, 25 bp, Homo sapien
aggcacacccattccacattgccaa

SEQ ID NO: 23802 - DNA, 25 bp, Homo sapien
aggcacactcattccacattgccaa

SEQ ID NO: 23803 - DNA, 25 bp, Homo sapien
aggcacaggagtatgtagaattgaa

SEQ ID NO: 23804 - DNA, 25 bp, Homo sapien
aggcacaggagtatgtggaattgaa

SEQ ID NO: 23805 - DNA, 25 bp, Homo sapien
aggcacatagcacgaagcatcaccc

SEQ ID NO: 23806 - DNA, 25 bp, Homo sapien
aggcacatagcaggaagcatcaccc

SEQ ID NO: 23807 - DNA, 25 bp, Homo sapien
aggcacatagtatcctcagctttca

SEQ ID NO: 23808 - DNA, 25 bp, Homo sapien
aggcacatggtatcctcagctttca

SEQ ID NO: 23809 - DNA, 25 bp, Homo sapien
aggcaccatctcggttagctgtggg

SEQ ID NO: 23810 - DNA, 25 bp, Homo sapien
aggcaccatcttggttagctgtggg

SEQ ID NO: 23811 - DNA, 25 bp, Homo sapien
aggcacccaagagaaaatcttgcac

SEQ ID NO: 23812 - DNA, 25 bp, Homo sapien
aggcacccaggagaaaatcttgcac

SEQ ID NO: 23813 - DNA, 25 bp, Homo sapien
aggcacctggcaatccaaattgtcc

SEQ ID NO: 23814 - DNA, 25 bp, Homo sapien
aggcacctggcagtccaaattgtcc

SEQ ID NO: 23815 - DNA, 25 bp, Homo sapien
aggcacgctggcaaatacttggatg

SEQ ID NO: 23816 - DNA, 25 bp, Homo sapien
aggcacgctggcatatacttggatg

SEQ ID NO: 23817 - DNA, 25 bp, Homo sapien
aggcactaatagcctcaacagtttg

SEQ ID NO: 23818 - DNA, 25 bp, Homo sapien
aggcactagtagcctcaacagtttg

SEQ ID NO: 23819 - DNA, 25 bp, Homo sapien
aggcactatcgtagatccagatttt

SEQ ID NO: 23820 - DNA, 25 bp, Homo sapien
aggcactattgtagatccagatttt

SEQ ID NO: 23821 - DNA, 25 bp, Homo sapien
aggcactgaaaaaatatatatttgg

SEQ ID NO: 23822 - DNA, 25 bp, Homo sapien
aggcactgagaaaatatatatttgg

SEQ ID NO: 23823 - DNA, 25 bp, Homo sapien
aggcactgcactagacatttttttc

SEQ ID NO: 23824 - DNA, 25 bp, Homo sapien
aggcactgcactatacatttttttc

SEQ ID NO: 23825 - DNA, 25 bp, Homo sapien
aggcacttcgtagcacaatgatatt

SEQ ID NO: 23826 - DNA, 25 bp, Homo sapien
aggcacttgcaggatctcagccatt

SEQ ID NO: 23827 - DNA, 25 bp, Homo sapien
aggcactttcaggatctcagccatt

SEQ ID NO: 23828 - DNA, 25 bp, Homo sapien
aggcactttgtagcacaatgatatt

SEQ ID NO: 23829 - DNA, 25 bp, Homo sapien
aggcactttttctcaacgtatcaat

SEQ ID NO: 23830 - DNA, 25 bp, Homo sapien
aggcactttttctcaatgtatcaat

SEQ ID NO: 23831 - DNA, 25 bp, Homo sapien
aggcagaaaaaacaaagctggaaaa

SEQ ID NO: 23832 - DNA, 25 bp, Homo sapien
aggcagaaaaagcaaagctggaaaa

SEQ ID NO: 23833 - DNA, 25 bp, Homo sapien
aggcagaaaattcgcatttccaaaa

SEQ ID NO: 23834 - DNA, 25 bp, Homo sapien
aggcagaaaatttgcatttccaaaa

SEQ ID NO: 23835 - DNA, 25 bp, Homo sapien
aggcagaactcagacactagtgcaa

SEQ ID NO: 23836 - DNA, 25 bp, Homo sapien
aggcagaactcaggcactagtgcaa

SEQ ID NO: 23837 - DNA, 25 bp, Homo sapien
aggcagagcagtgagtgaatgtctt

SEQ ID NO: 23838 - DNA, 25 bp, Homo sapien
aggcagagctgtgagtgaatgtctt

SEQ ID NO: 23839 - DNA, 25 bp, Homo sapien
aggcagaggcttcagcataagatcc

SEQ ID NO: 23840 - DNA, 25 bp, Homo sapien
aggcagaggcttcagcgtaagatcc

SEQ ID NO: 23841 - DNA, 25 bp, Homo sapien
aggcagagggcatcagattgtgaga

SEQ ID NO: 23842 - DNA, 25 bp, Homo sapien
aggcagagggcgtcagattgtgaga

SEQ ID NO: 23843 - DNA, 25 bp, Homo sapien
aggcagcacaagcttgggtgcatgg

SEQ ID NO: 23844 - DNA, 25 bp, Homo sapien
aggcagcagaagcttgggtgcatgg

SEQ ID NO: 23845 - DNA, 25 bp, Homo sapien
aggcagctgtggcctgataaaggca

SEQ ID NO: 23846 - DNA, 25 bp, Homo sapien
aggcagctgtggtctgataaaggca

SEQ ID NO: 23847 - DNA, 25 bp, Homo sapien
aggcagcttaattagccaggtgtcc

SEQ ID NO: 23848 - DNA, 25 bp, Homo sapien
aggcagcttaattagcgaggtgtcc

SEQ ID NO: 23849 - DNA, 25 bp, Homo sapien
aggcaggaaaatagataacattaca

SEQ ID NO: 23850 - DNA, 25 bp, Homo sapien
aggcaggaaaatcgataacattaca

SEQ ID NO: 23851 - DNA, 25 bp, Homo sapien
aggcagtcacacggaaagctcttgg

SEQ ID NO: 23852 - DNA, 25 bp, Homo sapien
aggcagtcacatggaaagctcttgg

SEQ ID NO: 23853 - DNA, 25 bp, Homo sapien
aggcagtgtcacagcacaaagaaac

SEQ ID NO: 23854 - DNA, 25 bp, Homo sapien
aggcagtgtcacggcacaaagaaac

SEQ ID NO: 23855 - DNA, 25 bp, Homo sapien
aggcagttaagaagatgaagcaaaa

SEQ ID NO: 23856 - DNA, 25 bp, Homo sapien
aggcagttatgaagatgaagcaaaa

SEQ ID NO: 23857 - DNA, 25 bp, Homo sapien
aggcagttgatttaaaaaaaaactt

SEQ ID NO: 23858 - DNA, 25 bp, Homo sapien
aggcagttgattttaaaaaaaactt

SEQ ID NO: 23859 - DNA, 25 bp, Homo sapien
aggcatacctagcgtcagattcttt

SEQ ID NO: 23860 - DNA, 25 bp, Homo sapien
aggcatacctagcttcagattcttt

SEQ ID NO: 23861 - DNA, 25 bp, Homo sapien
aggcatacctcaatttatttcactt

SEQ ID NO: 23862 - DNA, 25 bp, Homo sapien
aggcatacctcattttatttcactt

SEQ ID NO: 23863 - DNA, 25 bp, Homo sapien
aggcatagaataagaggcttgaatt

SEQ ID NO: 23864 - DNA, 25 bp, Homo sapien
aggcatagactaagaggcttgaatt

SEQ ID NO: 23865 - DNA, 25 bp, Homo sapien
aggcatagggctcactaactgattg

SEQ ID NO: 23866 - DNA, 25 bp, Homo sapien
aggcatagggctcactgactgattg

SEQ ID NO: 23867 - DNA, 25 bp, Homo sapien
aggcatcagtgctattgtagagttg

SEQ ID NO: 23868 - DNA, 25 bp, Homo sapien
aggcatcagtgctgttgtagagttg

SEQ ID NO: 23869 - DNA, 25 bp, Homo sapien
aggcatcataacttattaacagtga

SEQ ID NO: 23870 - DNA, 25 bp, Homo sapien
aggcatcataagttattaacagtga

SEQ ID NO: 23871 - DNA, 25 bp, Homo sapien
aggcatcccaaatatcgtctagtgt

SEQ ID NO: 23872 - DNA, 25 bp, Homo sapien
aggcatcccaaatatcttctagtgt

SEQ ID NO: 23873 - DNA, 25 bp, Homo sapien
aggcatcctacaagcattgtgacgc

SEQ ID NO: 23874 - DNA, 25 bp, Homo sapien
aggcatcctactagcattgtgacgc

SEQ ID NO: 23875 - DNA, 25 bp, Homo sapien
aggcatgaaagaaaaggcctggaaa

SEQ ID NO: 23876 - DNA, 25 bp, Homo sapien
aggcatgaaagcaaaggcctggaaa

SEQ ID NO: 23877 - DNA, 25 bp, Homo sapien
aggcatgaggttaaagaaaaactgt

SEQ ID NO: 23878 - DNA, 25 bp, Homo sapien
aggcatgaggttaaagcaaaactgt

SEQ ID NO: 23879 - DNA, 25 bp, Homo sapien
aggcatgatatatctgtctactcct

SEQ ID NO: 23880 - DNA, 25 bp, Homo sapien
aggcatgatatatttgtctactcct

SEQ ID NO: 23881 - DNA, 25 bp, Homo sapien
aggcatgatccccaaattgaagttc

SEQ ID NO: 23882 - DNA, 25 bp, Homo sapien
aggcatgatcttgtggtctgaacca

SEQ ID NO: 23883 - DNA, 25 bp, Homo sapien
aggcatgatgttgtggtctgaacca

SEQ ID NO: 23884 - DNA, 25 bp, Homo sapien
aggcatgattcccaaattgaagttc

SEQ ID NO: 23885 - DNA, 25 bp, Homo sapien
aggcatgtgaatatgtccctgaatt

SEQ ID NO: 23886 - DNA, 25 bp, Homo sapien
aggcatgtgaatgtgtccctgaatt

SEQ ID NO: 23887 - DNA, 25 bp, Homo sapien
aggcattacaggagggagcaatgca

SEQ ID NO: 23888 - DNA, 25 bp, Homo sapien
aggcattagaggagggagcaatgca

SEQ ID NO: 23889 - DNA, 25 bp, Homo sapien
aggcattcctggaaaactcagtgta

SEQ ID NO: 23890 - DNA, 25 bp, Homo sapien
aggcattcctggaaaattcagtgta

SEQ ID NO: 23891 - DNA, 25 bp, Homo sapien
aggcattcttaaatcacaaacaata

SEQ ID NO: 23892 - DNA, 25 bp, Homo sapien
aggcattcttacatcacaaacaata

SEQ ID NO: 23893 - DNA, 25 bp, Homo sapien
aggcattgctttcgcttcattacac

SEQ ID NO: 23894 - DNA, 25 bp, Homo sapien
aggcattgcttttgcttcattacac

SEQ ID NO: 23895 - DNA, 25 bp, Homo sapien
aggcattgtcctctatggagttgtg

SEQ ID NO: 23896 - DNA, 25 bp, Homo sapien
aggcattgtcctctgtggagttgtg

SEQ ID NO: 23897 - DNA, 25 bp, Homo sapien
aggcatttatatcaggtctcttcac

SEQ ID NO: 23898 - DNA, 25 bp, Homo sapien
aggcatttatatctggtctcttcac

SEQ ID NO: 23899 - DNA, 25 bp, Homo sapien
aggcatttatttctcaaagttctgg

SEQ ID NO: 23900 - DNA, 25 bp, Homo sapien
aggcatttatttctgaaagttctgg

SEQ ID NO: 23901 - DNA, 25 bp, Homo sapien
aggcatttccagctgactcacagtg

SEQ ID NO: 23902 - DNA, 25 bp, Homo sapien
aggcatttccagttgactcacagtg

SEQ ID NO: 23903 - DNA, 25 bp, Homo sapien
aggccaaagaacacctcatttatta

SEQ ID NO: 23904 - DNA, 25 bp, Homo sapien
aggccaaagaacatctcatttatta

SEQ ID NO: 23905 - DNA, 25 bp, Homo sapien
aggccaacatgagtgcactgatgcc

SEQ ID NO: 23906 - DNA, 25 bp, Homo sapien
aggccaacatgcgtgcactgatgcc

SEQ ID NO: 23907 - DNA, 25 bp, Homo sapien
aggccaataacaagcatggagctag

SEQ ID NO: 23908 - DNA, 25 bp, Homo sapien
aggccaataacaggcatggagctag

SEQ ID NO: 23909 - DNA, 25 bp, Homo sapien
aggccacaatgctaggaggaagcca

SEQ ID NO: 23910 - DNA, 25 bp, Homo sapien
aggccacacagaatggtctccctgg

SEQ ID NO: 23911 - DNA, 25 bp, Homo sapien
aggccacagagaatggtctccctgg

SEQ ID NO: 23912 - DNA, 25 bp, Homo sapien
aggccacagtgctaggaggaagcca

SEQ ID NO: 23913 - DNA, 25 bp, Homo sapien
aggccactccaacaaaataccttgg

SEQ ID NO: 23914 - DNA, 25 bp, Homo sapien
aggccactgcaacaaaataccttgg

SEQ ID NO: 23915 - DNA, 25 bp, Homo sapien
aggccagacaagccagcataatttg

SEQ ID NO: 23916 - DNA, 25 bp, Homo sapien
aggccagacacttacattttacact

SEQ ID NO: 23917 - DNA, 25 bp, Homo sapien
aggccagacacttatattttacact

SEQ ID NO: 23918 - DNA, 25 bp, Homo sapien
aggccagagaagccagcataatttg

SEQ ID NO: 23919 - DNA, 25 bp, Homo sapien
aggccagagacagctatcctttgaa

SEQ ID NO: 23920 - DNA, 25 bp, Homo sapien
aggccagagactgctatcctttgaa

SEQ ID NO: 23921 - DNA, 25 bp, Homo sapien
aggccagcagctaaccctagtcact

SEQ ID NO: 23922 - DNA, 25 bp, Homo sapien
aggccagcagctatccctagtcact

SEQ ID NO: 23923 - DNA, 25 bp, Homo sapien
aggccagctaagctcaatctgggca

SEQ ID NO: 23924 - DNA, 25 bp, Homo sapien
aggccagctcagctcaatctgggca

SEQ ID NO: 23925 - DNA, 25 bp, Homo sapien
aggccagggcgatccaagctgatat

SEQ ID NO: 23926 - DNA, 25 bp, Homo sapien
aggccagggtgatccaagctgatat

SEQ ID NO: 23927 - DNA, 25 bp, Homo sapien
aggccatctatccgcagagcttttt

SEQ ID NO: 23928 - DNA, 25 bp, Homo sapien
aggccatctatcggcagagcttttt

SEQ ID NO: 23929 - DNA, 25 bp, Homo sapien
aggccatcttgtaccgcaaacaaaa

SEQ ID NO: 23930 - DNA, 25 bp, Homo sapien
aggccatcttgtactgcaaacaaaa

SEQ ID NO: 23931 - DNA, 25 bp, Homo sapien
aggccatgaataacctcttgcctgt

SEQ ID NO: 23932 - DNA, 25 bp, Homo sapien
aggccatgaatagcctcttgcctgt

SEQ ID NO: 23933 - DNA, 25 bp, Homo sapien
aggccatgacaggctcatttcaaaa

SEQ ID NO: 23934 - DNA, 25 bp, Homo sapien
aggccatgataggctcatttcaaaa

SEQ ID NO: 23935 - DNA, 25 bp, Homo sapien
aggcccacgtgttcttcagtcagct

SEQ ID NO: 23936 - DNA, 25 bp, Homo sapien
aggcccacgtgttctttagtcagct

SEQ ID NO: 23937 - DNA, 25 bp, Homo sapien
aggcccagtcaggtgaaggcaaaca

SEQ ID NO: 23938 - DNA, 25 bp, Homo sapien
aggcccagtcagttgaaggcaaaca

SEQ ID NO: 23939 - DNA, 25 bp, Homo sapien
aggccccagtggacactgaattcca

SEQ ID NO: 23940 - DNA, 25 bp, Homo sapien
aggccccagtggacgctgaattcca

SEQ ID NO: 23941 - DNA, 25 bp, Homo sapien
aggcccctggtcctgaaagtgctga

SEQ ID NO: 23942 - DNA, 25 bp, Homo sapien
aggcccctgttcctgaaagtgctga

SEQ ID NO: 23943 - DNA, 25 bp, Homo sapien
aggccctatctgaaacattctaatg

SEQ ID NO: 23944 - DNA, 25 bp, Homo sapien
aggccctatctgaatcattctaatg

SEQ ID NO: 23945 - DNA, 25 bp, Homo sapien
aggccctgaagaggcaaagacacct

SEQ ID NO: 23946 - DNA, 25 bp, Homo sapien
aggccctgagtgagaaatgtcaaat

SEQ ID NO: 23947 - DNA, 25 bp, Homo sapien
aggccctgagtgagaactgtcaaat

SEQ ID NO: 23948 - DNA, 25 bp, Homo sapien
aggccctggagaggcaaagacacct

SEQ ID NO: 23949 - DNA, 25 bp, Homo sapien
aggccctgttgatggctgtggaaga

SEQ ID NO: 23950 - DNA, 25 bp, Homo sapien
aggccctgttgattgctgtggaaga

SEQ ID NO: 23951 - DNA, 25 bp, Homo sapien
aggccgacaatcataggcggcctgt

SEQ ID NO: 23952 - DNA, 25 bp, Homo sapien
aggccgacagtcataggcggcctgt

SEQ ID NO: 23953 - DNA, 25 bp, Homo sapien
aggccgagatgggtctatcaatgga

SEQ ID NO: 23954 - DNA, 25 bp, Homo sapien
aggccgagatggttctatcaatgga

SEQ ID NO: 23955 - DNA, 25 bp, Homo sapien
aggccgttttcttctggtaggttgg

SEQ ID NO: 23956 - DNA, 25 bp, Homo sapien
aggccgttttcttttggtaggttgg

SEQ ID NO: 23957 - DNA, 25 bp, Homo sapien
aggcctaaaagagtcaagttgcttc

SEQ ID NO: 23958 - DNA, 25 bp, Homo sapien
aggcctaaaagagtcatgttgcttc

SEQ ID NO: 23959 - DNA, 25 bp, Homo sapien
aggcctccaaatcttcaactggagg

SEQ ID NO: 23960 - DNA, 25 bp, Homo sapien
aggcctccacatcttcaactggagg

SEQ ID NO: 23961 - DNA, 25 bp, Homo sapien
aggcctcgatttacctgtggtttcc

SEQ ID NO: 23962 - DNA, 25 bp, Homo sapien
aggcctcgatttacttgtggtttcc

SEQ ID NO: 23963 - DNA, 25 bp, Homo sapien
aggcctctagcaattgccaacaaat

SEQ ID NO: 23964 - DNA, 25 bp, Homo sapien
aggcctctagcagttgccaacaaat

SEQ ID NO: 23965 - DNA, 25 bp, Homo sapien
aggcctggtaacgttcaccacaagt

SEQ ID NO: 23966 - DNA, 25 bp, Homo sapien
aggcctggtaatgttcaccacaagt

SEQ ID NO: 23967 - DNA, 25 bp, Homo sapien
aggcctgtactgacactggcccagg

SEQ ID NO: 23968 - DNA, 25 bp, Homo sapien
aggcctgtactgacgctggcccagg

SEQ ID NO: 23969 - DNA, 25 bp, Homo sapien
aggccttcttccttagaaaacaaaa

SEQ ID NO: 23970 - DNA, 25 bp, Homo sapien
aggccttcttccttggaaaacaaaa

SEQ ID NO: 23971 - DNA, 25 bp, Homo sapien
aggccttgcagagaagactgttccc

SEQ ID NO: 23972 - DNA, 25 bp, Homo sapien
aggccttgcagagaagcctgttccc

SEQ ID NO: 23973 - DNA, 25 bp, Homo sapien
aggcctttccagcggtagagttcaa

SEQ ID NO: 23974 - DNA, 25 bp, Homo sapien
aggcctttccagtggtagagttcaa

SEQ ID NO: 23975 - DNA, 25 bp, Homo sapien
aggcctttttgctctctgcatccca

SEQ ID NO: 23976 - DNA, 25 bp, Homo sapien
aggcctttttgttctctgcatccca

SEQ ID NO: 23977 - DNA, 25 bp, Homo sapien
aggcgaaataccacctggtccctgc

SEQ ID NO: 23978 - DNA, 25 bp, Homo sapien
aggcgaaataccgcctggtccctgc

SEQ ID NO: 23979 - DNA, 25 bp, Homo sapien
aggcgaacgcaaacataataagttg

SEQ ID NO: 23980 - DNA, 25 bp, Homo sapien
aggcgaacgcaagcataataagttg

SEQ ID NO: 23981 - DNA, 25 bp, Homo sapien
aggcgaatccgatcatgtggttcct

SEQ ID NO: 23982 - DNA, 25 bp, Homo sapien
aggcgaatctgatcatgtggttcct

SEQ ID NO: 23983 - DNA, 25 bp, Homo sapien
aggcgagattgggcgcattcctact

SEQ ID NO: 23984 - DNA, 25 bp, Homo sapien
aggcgagattgggctcattcctact

SEQ ID NO: 23985 - DNA, 25 bp, Homo sapien
aggcgagcaaacgccagcaaggtgg

SEQ ID NO: 23986 - DNA, 25 bp, Homo sapien
aggcgagcaaacgctagcaaggtgg

SEQ ID NO: 23987 - DNA, 25 bp, Homo sapien
aggcgccattacaccatatttgaat

SEQ ID NO: 23988 - DNA, 25 bp, Homo sapien
aggcgccattacgccatatttgaat

SEQ ID NO: 23989 - DNA, 25 bp, Homo sapien
aggcgctgttgaatctgagtcccca

SEQ ID NO: 23990 - DNA, 25 bp, Homo sapien
aggcgctgttgactctgagtcccca

SEQ ID NO: 23991 - DNA, 25 bp, Homo sapien
aggcggatccctgaatgccacactt

SEQ ID NO: 23992 - DNA, 25 bp, Homo sapien
aggcggatccctgagtgccacactt

SEQ ID NO: 23993 - DNA, 25 bp, Homo sapien
aggcgtaaaattacctgcaatttgt

SEQ ID NO: 23994 - DNA, 25 bp, Homo sapien
aggcgtaaaattatctgcaatttgt

SEQ ID NO: 23995 - DNA, 25 bp, Homo sapien
aggcgtaaagaggtgagaaagtgag

SEQ ID NO: 23996 - DNA, 25 bp, Homo sapien
aggcgtaaggaggtgagaaagtgag

SEQ ID NO: 23997 - DNA, 25 bp, Homo sapien
aggctaaaccgatacagggaagctc

SEQ ID NO: 23998 - DNA, 25 bp, Homo sapien
aggctaaaccgatatagggaagctc

SEQ ID NO: 23999 - DNA, 25 bp, Homo sapien
aggctaagcctctgtttggtattcc

SEQ ID NO: 24000 - DNA, 25 bp, Homo sapien
aggctaagctggctaagctggtgag

SEQ ID NO: 24001 - DNA, 25 bp, Homo sapien
aggctaagctggctaatctggtgag

SEQ ID NO: 24002 - DNA, 25 bp, Homo sapien
aggctaagctgttaattgatgtgaa

SEQ ID NO: 24003 - DNA, 25 bp, Homo sapien
aggctaagctgttatttgatgtgaa

SEQ ID NO: 24004 - DNA, 25 bp, Homo sapien
aggctaagcttctgtttggtattcc

SEQ ID NO: 24005 - DNA, 25 bp, Homo sapien
aggctaatctaagtcagccatctga

SEQ ID NO: 24006 - DNA, 25 bp, Homo sapien
aggctaatctatgtcagccatctga

SEQ ID NO: 24007 - DNA, 25 bp, Homo sapien
aggctaatgcttacttgtggtattt

SEQ ID NO: 24008 - DNA, 25 bp, Homo sapien
aggctaattcttacttgtggtattt

SEQ ID NO: 24009 - DNA, 25 bp, Homo sapien
aggctaattggaaacaggaaggagc

SEQ ID NO: 24010 - DNA, 25 bp, Homo sapien
aggctaattggaaagaggaaggagc

SEQ ID NO: 24011 - DNA, 25 bp, Homo sapien
aggctacaccaactacataagcagc

SEQ ID NO: 24012 - DNA, 25 bp, Homo sapien
aggctacaccacaccccttgctgaa

SEQ ID NO: 24013 - DNA, 25 bp, Homo sapien
aggctacaccacaccctttgctgaa

SEQ ID NO: 24014 - DNA, 25 bp, Homo sapien
aggctacaccacctacataagcagc

SEQ ID NO: 24015 - DNA, 25 bp, Homo sapien
aggctacatatcatctaattctgtt

SEQ ID NO: 24016 - DNA, 25 bp, Homo sapien
aggctacatatcgtctaattctgtt

SEQ ID NO: 24017 - DNA, 25 bp, Homo sapien
aggctacatggaagatggaattaag

SEQ ID NO: 24018 - DNA, 25 bp, Homo sapien
aggctacatggcagatggaattaag

SEQ ID NO: 24019 - DNA, 25 bp, Homo sapien
aggctaccacaacgattaagtaatg

SEQ ID NO: 24020 - DNA, 25 bp, Homo sapien
aggctaccacaaggattaagtaatg

SEQ ID NO: 24021 - DNA, 25 bp, Homo sapien
aggctactcccagccaatgactgag

SEQ ID NO: 24022 - DNA, 25 bp, Homo sapien
aggctactcccggccaatgactgag

SEQ ID NO: 24023 - DNA, 25 bp, Homo sapien
aggctactggcttcacataattttc

SEQ ID NO: 24024 - DNA, 25 bp, Homo sapien
aggctactggcttcgcataattttc

SEQ ID NO: 24025 - DNA, 25 bp, Homo sapien
aggctactgtttccatccactagtg

SEQ ID NO: 24026 - DNA, 25 bp, Homo sapien
aggctactttttccatccactagtg

SEQ ID NO: 24027 - DNA, 25 bp, Homo sapien
aggctagcattgcgtctgacatgta

SEQ ID NO: 24028 - DNA, 25 bp, Homo sapien
aggctagcattgtgtctgacatgta

SEQ ID NO: 24029 - DNA, 25 bp, Homo sapien
aggctagcccaaattgctgacccat

SEQ ID NO: 24030 - DNA, 25 bp, Homo sapien
aggctagcccaaattgttgacccat

SEQ ID NO: 24031 - DNA, 25 bp, Homo sapien
aggctaggaactatagtagatactg

SEQ ID NO: 24032 - DNA, 25 bp, Homo sapien
aggctaggaactgtagtagatactg

SEQ ID NO: 24033 - DNA, 25 bp, Homo sapien
aggctagtgaaaataataggtctaa

SEQ ID NO: 24034 - DNA, 25 bp, Homo sapien
aggctagtgaaaatgataggtctaa

SEQ ID NO: 24035 - DNA, 25 bp, Homo sapien
aggctatatggagagtttatttgaa

SEQ ID NO: 24036 - DNA, 25 bp, Homo sapien
aggctatattgagagtttatttgaa

SEQ ID NO: 24037 - DNA, 25 bp, Homo sapien
aggctatgtatcacacagtgcaaac

SEQ ID NO: 24038 - DNA, 25 bp, Homo sapien
aggctatgtatcagacagtgcaaac

SEQ ID NO: 24039 - DNA, 25 bp, Homo sapien
aggctatttacataaaactttagta

SEQ ID NO: 24040 - DNA, 25 bp, Homo sapien
aggctatttacgtaaaactttagta

SEQ ID NO: 24041 - DNA, 25 bp, Homo sapien
aggctattttaacagtccaggtgaa

SEQ ID NO: 24042 - DNA, 25 bp, Homo sapien
aggctattttaatagtccaggtgaa

SEQ ID NO: 24043 - DNA, 25 bp, Homo sapien
aggctcaaaaaaacaccgagtcttc

SEQ ID NO: 24044 - DNA, 25 bp, Homo sapien
aggctcaaaaacacaccgagtcttc

SEQ ID NO: 24045 - DNA, 25 bp, Homo sapien
aggctcacatacactattttaattt

SEQ ID NO: 24046 - DNA, 25 bp, Homo sapien
aggctcacatacattattttaattt

SEQ ID NO: 24047 - DNA, 25 bp, Homo sapien
aggctcacatcaagtggaagtcttc

SEQ ID NO: 24048 - DNA, 25 bp, Homo sapien
aggctcacatgacctctgcacttgc

SEQ ID NO: 24049 - DNA, 25 bp, Homo sapien
aggctcaccatgtcaactaacacaa

SEQ ID NO: 24050 - DNA, 25 bp, Homo sapien
aggctcaccgtgtcaactaacacaa

SEQ ID NO: 24051 - DNA, 25 bp, Homo sapien
aggctcacgtcaagtggaagtcttc

SEQ ID NO: 24052 - DNA, 25 bp, Homo sapien
aggctcacgtgacctctgcacttgc

SEQ ID NO: 24053 - DNA, 25 bp, Homo sapien
aggctcactatcatttacatagctt

SEQ ID NO: 24054 - DNA, 25 bp, Homo sapien
aggctcactatcatttgcatagctt

SEQ ID NO: 24055 - DNA, 25 bp, Homo sapien
aggctcaggatgaaatcgagtctcc

SEQ ID NO: 24056 - DNA, 25 bp, Homo sapien
aggctcaggttgaaatcgagtctcc

SEQ ID NO: 24057 - DNA, 25 bp, Homo sapien
aggctcataggtaaaagactttgta

SEQ ID NO: 24058 - DNA, 25 bp, Homo sapien
aggctcataggtaaaatactttgta

SEQ ID NO: 24059 - DNA, 25 bp, Homo sapien
aggctcatatgtaaaagttgggata

SEQ ID NO: 24060 - DNA, 25 bp, Homo sapien
aggctcatgtgtaaaagttgggata

SEQ ID NO: 24061 - DNA, 25 bp, Homo sapien
aggctccgctacataggcatgcttg

SEQ ID NO: 24062 - DNA, 25 bp, Homo sapien
aggctccgctacgtaggcatgcttg

SEQ ID NO: 24063 - DNA, 25 bp, Homo sapien
aggctcctgagaaaaaattccacaa

SEQ ID NO: 24064 - DNA, 25 bp, Homo sapien
aggctcctgagaataaattccacaa

SEQ ID NO: 24065 - DNA, 25 bp, Homo sapien
aggctcctttacaatgtggccatct

SEQ ID NO: 24066 - DNA, 25 bp, Homo sapien
aggctcctttaccatgtggccatct

SEQ ID NO: 24067 - DNA, 25 bp, Homo sapien
aggctcggcatcctttaacctgtca

SEQ ID NO: 24068 - DNA, 25 bp, Homo sapien
aggctcggcgtcctttaacctgtca

SEQ ID NO: 24069 - DNA, 25 bp, Homo sapien
aggctctgctgcatataacaagcct

SEQ ID NO: 24070 - DNA, 25 bp, Homo sapien
aggctctgctgcatgtaacaagcct

SEQ ID NO: 24071 - DNA, 25 bp, Homo sapien
aggctctgtgggcataggacccgcc

SEQ ID NO: 24072 - DNA, 25 bp, Homo sapien
aggctctgtgggtataggacccgcc

SEQ ID NO: 24073 - DNA, 25 bp, Homo sapien
aggctctgttacaactctcctgggg

SEQ ID NO: 24074 - DNA, 25 bp, Homo sapien
aggctctgttacgactctcctgggg

SEQ ID NO: 24075 - DNA, 25 bp, Homo sapien
aggctcttttcaacaactagttctc

SEQ ID NO: 24076 - DNA, 25 bp, Homo sapien
aggctcttttcagcaactagttctc

SEQ ID NO: 24077 - DNA, 25 bp, Homo sapien
aggctgaaaatacaagatcagggtg

SEQ ID NO: 24078 - DNA, 25 bp, Homo sapien
aggctgaaagtaagagtggcctcag

SEQ ID NO: 24079 - DNA, 25 bp, Homo sapien
aggctgaaagtacaagatcagggtg

SEQ ID NO: 24080 - DNA, 25 bp, Homo sapien
aggctgaaagtaggagtggcctcag

SEQ ID NO: 24081 - DNA, 25 bp, Homo sapien
aggctgaacaactaacttgccaagg

SEQ ID NO: 24082 - DNA, 25 bp, Homo sapien
aggctgaactggatgctcaccaaga

SEQ ID NO: 24083 - DNA, 25 bp, Homo sapien
aggctgaataactaacttgccaagg

SEQ ID NO: 24084 - DNA, 25 bp, Homo sapien
aggctgaattggatgctcaccaaga

SEQ ID NO: 24085 - DNA, 25 bp, Homo sapien
aggctgacttggatggactacatca

SEQ ID NO: 24086 - DNA, 25 bp, Homo sapien
aggctgacttggatggcctacatca

SEQ ID NO: 24087 - DNA, 25 bp, Homo sapien
aggctgagaaatagcaacaaagatt

SEQ ID NO: 24088 - DNA, 25 bp, Homo sapien
aggctgagaaatagcagcaaagatt

SEQ ID NO: 24089 - DNA, 25 bp, Homo sapien
aggctgagccacagaggaatgtgtt

SEQ ID NO: 24090 - DNA, 25 bp, Homo sapien
aggctgagtcacagaggaatgtgtt

SEQ ID NO: 24091 - DNA, 25 bp, Homo sapien
aggctgatgaggggttagcacggaa

SEQ ID NO: 24092 - DNA, 25 bp, Homo sapien
aggctgatgaggggtttgcacggaa

SEQ ID NO: 24093 - DNA, 25 bp, Homo sapien
aggctgcatccctttttggaggctc

SEQ ID NO: 24094 - DNA, 25 bp, Homo sapien
aggctgcatcgtcagcttccctact

SEQ ID NO: 24095 - DNA, 25 bp, Homo sapien
aggctgcattcctttttggaggctc

SEQ ID NO: 24096 - DNA, 25 bp, Homo sapien
aggctgcattgtcagcttccctact

SEQ ID NO: 24097 - DNA, 25 bp, Homo sapien
aggctgccacctctctagttctctc

SEQ ID NO: 24098 - DNA, 25 bp, Homo sapien
aggctgccacctctcttgttctctc

SEQ ID NO: 24099 - DNA, 25 bp, Homo sapien
aggctgccataaaaaatcaccacaa

SEQ ID NO: 24100 - DNA, 25 bp, Homo sapien
aggctgccctgcttgtgccttagtg

SEQ ID NO: 24101 - DNA, 25 bp, Homo sapien
aggctgccctgtttgtgccttagtg

SEQ ID NO: 24102 - DNA, 25 bp, Homo sapien
aggctgccgtaaaaaatcaccacaa

SEQ ID NO: 24103 - DNA, 25 bp, Homo sapien
aggctgcctactttagacaactaca

SEQ ID NO: 24104 - DNA, 25 bp, Homo sapien
aggctgcctacttttgacaactaca

SEQ ID NO: 24105 - DNA, 25 bp, Homo sapien
aggctgcctctcacttgttgttacc

SEQ ID NO: 24106 - DNA, 25 bp, Homo sapien
aggctgcctctcgcttgttgttacc

SEQ ID NO: 24107 - DNA, 25 bp, Homo sapien
aggctgctccttcctcgggctgcct

SEQ ID NO: 24108 - DNA, 25 bp, Homo sapien
aggctgctcctttctcgggctgcct

SEQ ID NO: 24109 - DNA, 25 bp, Homo sapien
aggctgctgtaatatcacacactgg

SEQ ID NO: 24110 - DNA, 25 bp, Homo sapien
aggctgctgtaatgtcacacactgg

SEQ ID NO: 24111 - DNA, 25 bp, Homo sapien
aggctggagaagacacagggaggat

SEQ ID NO: 24112 - DNA, 25 bp, Homo sapien
aggctggagaagatacagggaggat

SEQ ID NO: 24113 - DNA, 25 bp, Homo sapien
aggctggtcacccaggaaggatgga

SEQ ID NO: 24114 - DNA, 25 bp, Homo sapien
aggctggtcacccgggaaggatgga

SEQ ID NO: 24115 - DNA, 25 bp, Homo sapien
aggctggtggcaactctggctcccc

SEQ ID NO: 24116 - DNA, 25 bp, Homo sapien
aggctggtggcaattctggctcccc

SEQ ID NO: 24117 - DNA, 25 bp, Homo sapien
aggctgtgctttcataagagcaaaa

SEQ ID NO: 24118 - DNA, 25 bp, Homo sapien
aggctgtgcttttataagagcaaaa

SEQ ID NO: 24119 - DNA, 25 bp, Homo sapien
aggctgttcctaaatggactggatt

SEQ ID NO: 24120 - DNA, 25 bp, Homo sapien
aggctgtttctaaatggactggatt

SEQ ID NO: 24121 - DNA, 25 bp, Homo sapien
aggcttaaaaacaaattacacgcct

SEQ ID NO: 24122 - DNA, 25 bp, Homo sapien
aggcttaaaaataaattacacgcct

SEQ ID NO: 24123 - DNA, 25 bp, Homo sapien
aggcttaaaataaccagtccctatt

SEQ ID NO: 24124 - DNA, 25 bp, Homo sapien
aggcttaaaatagccagtccctatt

SEQ ID NO: 24125 - DNA, 25 bp, Homo sapien
aggcttaggctcaaaatactacctt

SEQ ID NO: 24126 - DNA, 25 bp, Homo sapien
aggcttaggttcaaaatactacctt

SEQ ID NO: 24127 - DNA, 25 bp, Homo sapien
aggcttatagtatgcaaccttatat

SEQ ID NO: 24128 - DNA, 25 bp, Homo sapien
aggcttatagtatgcagccttatat

SEQ ID NO: 24129 - DNA, 25 bp, Homo sapien
aggcttatcaagctccttctatgag

SEQ ID NO: 24130 - DNA, 25 bp, Homo sapien
aggcttatcaagttccttctatgag

SEQ ID NO: 24131 - DNA, 25 bp, Homo sapien
aggcttattcagcggcagcccaggt

SEQ ID NO: 24132 - DNA, 25 bp, Homo sapien
aggcttattcagtggcagcccaggt

SEQ ID NO: 24133 - DNA, 25 bp, Homo sapien
aggcttcacagctaattgacagaat

SEQ ID NO: 24134 - DNA, 25 bp, Homo sapien
aggcttcacagttaattgacagaat

SEQ ID NO: 24135 - DNA, 25 bp, Homo sapien
aggcttcaccggttttggtcacaat

SEQ ID NO: 24136 - DNA, 25 bp, Homo sapien
aggcttcatcggttttggtcacaat

SEQ ID NO: 24137 - DNA, 25 bp, Homo sapien
aggcttctctatgtgctcaaatgaa

SEQ ID NO: 24138 - DNA, 25 bp, Homo sapien
aggcttctctatgttctcaaatgaa

SEQ ID NO: 24139 - DNA, 25 bp, Homo sapien
aggcttctctctgtgtcctgaggaa

SEQ ID NO: 24140 - DNA, 25 bp, Homo sapien
aggcttctctctgtgtgctgaggaa

SEQ ID NO: 24141 - DNA, 25 bp, Homo sapien
aggcttctgagtaccttagcctttc

SEQ ID NO: 24142 - DNA, 25 bp, Homo sapien
aggcttctgagtgccttagcctttc

SEQ ID NO: 24143 - DNA, 25 bp, Homo sapien
aggcttgaagtgagtttcagtgata

SEQ ID NO: 24144 - DNA, 25 bp, Homo sapien
aggcttgaagtgattttcagtgata

SEQ ID NO: 24145 - DNA, 25 bp, Homo sapien
aggcttgataaggtcacccaaaaat

SEQ ID NO: 24146 - DNA, 25 bp, Homo sapien
aggcttgataaggtcatccaaaaat

SEQ ID NO: 24147 - DNA, 25 bp, Homo sapien
aggcttgctcgctcgctctctctca

SEQ ID NO: 24148 - DNA, 25 bp, Homo sapien
aggcttgctcgctggctctctctca

SEQ ID NO: 24149 - DNA, 25 bp, Homo sapien
aggcttgcttgcagcttcccaggtg

SEQ ID NO: 24150 - DNA, 25 bp, Homo sapien
aggcttgcttgtagcttcccaggtg

SEQ ID NO: 24151 - DNA, 25 bp, Homo sapien
aggcttgtagaagtagcttccagct

SEQ ID NO: 24152 - DNA, 25 bp, Homo sapien
aggcttgtagaattagcttccagct

SEQ ID NO: 24153 - DNA, 25 bp, Homo sapien
aggcttgtagacaggataactcatt

SEQ ID NO: 24154 - DNA, 25 bp, Homo sapien
aggcttgtagataggataactcatt

SEQ ID NO: 24155 - DNA, 25 bp, Homo sapien
aggcttgttagcataagccactgag

SEQ ID NO: 24156 - DNA, 25 bp, Homo sapien
aggcttgttagcgtaagccactgag

SEQ ID NO: 24157 - DNA, 25 bp, Homo sapien
aggctttacctgtatcactcgtatt

SEQ ID NO: 24158 - DNA, 25 bp, Homo sapien
aggctttagcaatgaacttttaaga

SEQ ID NO: 24159 - DNA, 25 bp, Homo sapien
aggctttagcagtgaacttttaaga

SEQ ID NO: 24160 - DNA, 25 bp, Homo sapien
aggctttatccaggagatgtaaggt

SEQ ID NO: 24161 - DNA, 25 bp, Homo sapien
aggctttatccatgagatgtaaggt

SEQ ID NO: 24162 - DNA, 25 bp, Homo sapien
aggctttatctgtatcactcgtatt

SEQ ID NO: 24163 - DNA, 25 bp, Homo sapien
aggctttcagcactcaatcagctct

SEQ ID NO: 24164 - DNA, 25 bp, Homo sapien
aggctttcagcactgaatcagctct

SEQ ID NO: 24165 - DNA, 25 bp, Homo sapien
aggctttccacattttctaccattt

SEQ ID NO: 24166 - DNA, 25 bp, Homo sapien
aggctttccgcattttctaccattt

SEQ ID NO: 24167 - DNA, 25 bp, Homo sapien
aggcttttagtatccatgaaggtcc

SEQ ID NO: 24168 - DNA, 25 bp, Homo sapien
aggctttttgtatccatgaaggtcc

SEQ ID NO: 24169 - DNA, 25 bp, Homo sapien
aggcttttttccaagttagtttctg

SEQ ID NO: 24170 - DNA, 25 bp, Homo sapien
aggcttttttccacgttagtttctg

SEQ ID NO: 24171 - DNA, 25 bp, Homo sapien
agggaaaaactgtgtgctcaggaga

SEQ ID NO: 24172 - DNA, 25 bp, Homo sapien
agggaaaaattaaagcataactcag

SEQ ID NO: 24173 - DNA, 25 bp, Homo sapien
agggaaaaattgtgtgctcaggaga

SEQ ID NO: 24174 - DNA, 25 bp, Homo sapien
agggaaaatactataacacaatgat

SEQ ID NO: 24175 - DNA, 25 bp, Homo sapien
agggaaaatactgtaacacaatgat

SEQ ID NO: 24176 - DNA, 25 bp, Homo sapien
agggaaaatatttcaagaccatggt

SEQ ID NO: 24177 - DNA, 25 bp, Homo sapien
agggaaaatatttccagaccatggt

SEQ ID NO: 24178 - DNA, 25 bp, Homo sapien
agggaaaatcagccatgaaaaattc

SEQ ID NO: 24179 - DNA, 25 bp, Homo sapien
agggaaaattagccatgaaaaattc

SEQ ID NO: 24180 - DNA, 25 bp, Homo sapien
agggaaaattatagatgtccataat

SEQ ID NO: 24181 - DNA, 25 bp, Homo sapien
agggaaaattatggatgtccataat

SEQ ID NO: 24182 - DNA, 25 bp, Homo sapien
agggaaaatttaaagcataactcag

SEQ ID NO: 24183 - DNA, 25 bp, Homo sapien
agggaaacctatgcacgtcatgctt

SEQ ID NO: 24184 - DNA, 25 bp, Homo sapien
agggaaacctatgcccgtcatgctt

SEQ ID NO: 24185 - DNA, 25 bp, Homo sapien
agggaaagcacatggaaaattaggg

SEQ ID NO: 24186 - DNA, 25 bp, Homo sapien
agggaaagcacatggagaattaggg

SEQ ID NO: 24187 - DNA, 25 bp, Homo sapien
agggaaatgaccatagaaattagcc

SEQ ID NO: 24188 - DNA, 25 bp, Homo sapien
agggaaatgaccgtagaaattagcc

SEQ ID NO: 24189 - DNA, 25 bp, Homo sapien
agggaaattcaacaggtgaaattag

SEQ ID NO: 24190 - DNA, 25 bp, Homo sapien
agggaaattcaagaggtgaaattag

SEQ ID NO: 24191 - DNA, 25 bp, Homo sapien
agggaaattcacaaagggtacaata

SEQ ID NO: 24192 - DNA, 25 bp, Homo sapien
agggaaattcacaaggggtacaata

SEQ ID NO: 24193 - DNA, 25 bp, Homo sapien
agggaacacataaactgaggataaa

SEQ ID NO: 24194 - DNA, 25 bp, Homo sapien
agggaacatataaactgaggataaa

SEQ ID NO: 24195 - DNA, 25 bp, Homo sapien
agggaacatgtacagagtggaactt

SEQ ID NO: 24196 - DNA, 25 bp, Homo sapien
agggaacatgtatagagtggaactt

SEQ ID NO: 24197 - DNA, 25 bp, Homo sapien
agggaaccatcctgaattacctagg

SEQ ID NO: 24198 - DNA, 25 bp, Homo sapien
agggaacccagaaggacagatggga

SEQ ID NO: 24199 - DNA, 25 bp, Homo sapien
agggaacccagcaggacagatggga

SEQ ID NO: 24200 - DNA, 25 bp, Homo sapien
agggaaccgtcctgaattacctagg

SEQ ID NO: 24201 - DNA, 25 bp, Homo sapien
agggaagaagagtgattaagacaga

SEQ ID NO: 24202 - DNA, 25 bp, Homo sapien
agggaagaagagtggttaagacaga

SEQ ID NO: 24203 - DNA, 25 bp, Homo sapien
agggaagaatttagactcatagggg

SEQ ID NO: 24204 - DNA, 25 bp, Homo sapien
agggaagaatttatactcatagggg

SEQ ID NO: 24205 - DNA, 25 bp, Homo sapien
agggaagagagcagtaccatgggag

SEQ ID NO: 24206 - DNA, 25 bp, Homo sapien
agggaagatagcagtaccatgggag

SEQ ID NO: 24207 - DNA, 25 bp, Homo sapien
agggaagatatacaacagaatgcat

SEQ ID NO: 24208 - DNA, 25 bp, Homo sapien
agggaagatatagaacagaatgcat

SEQ ID NO: 24209 - DNA, 25 bp, Homo sapien
agggaagcaaataccttcaaggttg

SEQ ID NO: 24210 - DNA, 25 bp, Homo sapien
agggaagcaaatcccttcaaggttg

SEQ ID NO: 24211 - DNA, 25 bp, Homo sapien
agggaagcaggtaattctgaagcaa

SEQ ID NO: 24212 - DNA, 25 bp, Homo sapien
agggaagcaggtaattttgaagcaa

SEQ ID NO: 24213 - DNA, 25 bp, Homo sapien
agggaagccaacttccgatgattaa

SEQ ID NO: 24214 - DNA, 25 bp, Homo sapien
agggaagccaatttccgatgattaa

SEQ ID NO: 24215 - DNA, 25 bp, Homo sapien
agggaaggacatgataggatccata

SEQ ID NO: 24216 - DNA, 25 bp, Homo sapien
agggaaggccatgataggatccata

SEQ ID NO: 24217 - DNA, 25 bp, Homo sapien
agggaagtcattatccactcctctc

SEQ ID NO: 24218 - DNA, 25 bp, Homo sapien
agggaagtgccttaaagttggacta

SEQ ID NO: 24219 - DNA, 25 bp, Homo sapien
agggaagtgccttgaagttggacta

SEQ ID NO: 24220 - DNA, 25 bp, Homo sapien
agggaagttattatccactcctctc

SEQ ID NO: 24221 - DNA, 25 bp, Homo sapien
agggaataaacgtagccggtaagcc

SEQ ID NO: 24222 - DNA, 25 bp, Homo sapien
agggaataaacgtagctggtaagcc

SEQ ID NO: 24223 - DNA, 25 bp, Homo sapien
agggaatatgaaaaagccacttggg

SEQ ID NO: 24224 - DNA, 25 bp, Homo sapien
agggaatatgaaaaggccacttggg

SEQ ID NO: 24225 - DNA, 25 bp, Homo sapien
agggaatgaaccagtgttttccatt

SEQ ID NO: 24226 - DNA, 25 bp, Homo sapien
agggaatgaaccggtgttttccatt

SEQ ID NO: 24227 - DNA, 25 bp, Homo sapien
agggaatgcttgctcatatggaaag

SEQ ID NO: 24228 - DNA, 25 bp, Homo sapien
agggaatgcttgttcatatggaaag

SEQ ID NO: 24229 - DNA, 25 bp, Homo sapien
agggaatggagatccaggtttctga

SEQ ID NO: 24230 - DNA, 25 bp, Homo sapien
agggaatggaggtccaggtttctga

SEQ ID NO: 24231 - DNA, 25 bp, Homo sapien
agggaatggtatcaataaagagatg

SEQ ID NO: 24232 - DNA, 25 bp, Homo sapien
agggaatggtatcagtaaagagatg

SEQ ID NO: 24233 - DNA, 25 bp, Homo sapien
agggacacgtactggctttggcttt

SEQ ID NO: 24234 - DNA, 25 bp, Homo sapien
agggacacgtactgtctttggcttt

SEQ ID NO: 24235 - DNA, 25 bp, Homo sapien
agggacatgcctctcagcttcattt

SEQ ID NO: 24236 - DNA, 25 bp, Homo sapien
agggacatggctctcagcttcattt

SEQ ID NO: 24237 - DNA, 25 bp, Homo sapien
agggaccacattagacaaataacgc

SEQ ID NO: 24238 - DNA, 25 bp, Homo sapien
agggaccacattagacgaataacgc

SEQ ID NO: 24239 - DNA, 25 bp, Homo sapien
agggacctgagttgaaatcccagtt

SEQ ID NO: 24240 - DNA, 25 bp, Homo sapien
agggacctgagttggaatcccagtt

SEQ ID NO: 24241 - DNA, 25 bp, Homo sapien
agggacctgttgcgccactgcagtt

SEQ ID NO: 24242 - DNA, 25 bp, Homo sapien
agggacctgttgtgccactgcagtt

SEQ ID NO: 24243 - DNA, 25 bp, Homo sapien
agggactgtagaccactgcatacat

SEQ ID NO: 24244 - DNA, 25 bp, Homo sapien
agggactgtagagcactgcatacat

SEQ ID NO: 24245 - DNA, 25 bp, Homo sapien
agggacttctcagtctccatagtta

SEQ ID NO: 24246 - DNA, 25 bp, Homo sapien
agggacttctcagtctgcatagtta

SEQ ID NO: 24247 - DNA, 25 bp, Homo sapien
agggactttgaatgtcccaggatgg

SEQ ID NO: 24248 - DNA, 25 bp, Homo sapien
agggactttgagtgtcccaggatgg

SEQ ID NO: 24249 - DNA, 25 bp, Homo sapien
agggactttgtttggctttgtgtgg

SEQ ID NO: 24250 - DNA, 25 bp, Homo sapien
agggactttttttggctttgtgtgg

SEQ ID NO: 24251 - DNA, 25 bp, Homo sapien
agggagaaaggccatatacacactt

SEQ ID NO: 24252 - DNA, 25 bp, Homo sapien
agggagaaaggtcatatacacactt

SEQ ID NO: 24253 - DNA, 25 bp, Homo sapien
agggagaatattgtcacacactcat

SEQ ID NO: 24254 - DNA, 25 bp, Homo sapien
agggagaatattttcacacactcat

SEQ ID NO: 24255 - DNA, 25 bp, Homo sapien
agggagaatctgttcgatgcctctc

SEQ ID NO: 24256 - DNA, 25 bp, Homo sapien
agggagaatctgtttgatgcctctc

SEQ ID NO: 24257 - DNA, 25 bp, Homo sapien
agggagaatgtcgtggatctggcat

SEQ ID NO: 24258 - DNA, 25 bp, Homo sapien
agggagaatgttgtggatctggcat

SEQ ID NO: 24259 - DNA, 25 bp, Homo sapien
agggagatataacctgtctgcaaag

SEQ ID NO: 24260 - DNA, 25 bp, Homo sapien
agggagatataagctgtctgcaaag

SEQ ID NO: 24261 - DNA, 25 bp, Homo sapien
agggagatcaacatgaaatgaacag

SEQ ID NO: 24262 - DNA, 25 bp, Homo sapien
agggagatcaatatgaaatgaacag

SEQ ID NO: 24263 - DNA, 25 bp, Homo sapien
agggagatcatcacaaaactcttta

SEQ ID NO: 24264 - DNA, 25 bp, Homo sapien
agggagatcatcacaagactcttta

SEQ ID NO: 24265 - DNA, 25 bp, Homo sapien
agggagatggacaattcatcaggcc

SEQ ID NO: 24266 - DNA, 25 bp, Homo sapien
agggagatggacgattcatcaggcc

SEQ ID NO: 24267 - DNA, 25 bp, Homo sapien
agggagccaccagcagcatccaccc

SEQ ID NO: 24268 - DNA, 25 bp, Homo sapien
agggagccgccagcagcatccaccc

SEQ ID NO: 24269 - DNA, 25 bp, Homo sapien
agggagcctcattcttcctaaatct

SEQ ID NO: 24270 - DNA, 25 bp, Homo sapien
agggagcctcatttttcctaaatct

SEQ ID NO: 24271 - DNA, 25 bp, Homo sapien
agggagcgtatcctgggttattcat

SEQ ID NO: 24272 - DNA, 25 bp, Homo sapien
agggagcgtatcgtgggttattcat

SEQ ID NO: 24273 - DNA, 25 bp, Homo sapien
agggagctcattaactcacaaggta

SEQ ID NO: 24274 - DNA, 25 bp, Homo sapien
agggagctcattaattcacaaggta

SEQ ID NO: 24275 - DNA, 25 bp, Homo sapien
agggaggaacagtcacttctggtcc

SEQ ID NO: 24276 - DNA, 25 bp, Homo sapien
agggaggaacagtgacttctggtcc

SEQ ID NO: 24277 - DNA, 25 bp, Homo sapien
agggaggaatgacatgcgtgacata

SEQ ID NO: 24278 - DNA, 25 bp, Homo sapien
agggaggaatgacatgtgtgacata

SEQ ID NO: 24279 - DNA, 25 bp, Homo sapien
agggaggatggaaatagcaaacaaa

SEQ ID NO: 24280 - DNA, 25 bp, Homo sapien
agggaggatggaaatatcaaacaaa

SEQ ID NO: 24281 - DNA, 25 bp, Homo sapien
agggaggattaaaaagcactggtct

SEQ ID NO: 24282 - DNA, 25 bp, Homo sapien
agggaggattaacaagcactggtct

SEQ ID NO: 24283 - DNA, 25 bp, Homo sapien
agggaggcacacccattccacattg

SEQ ID NO: 24284 - DNA, 25 bp, Homo sapien
agggaggcacactcattccacattg

SEQ ID NO: 24285 - DNA, 25 bp, Homo sapien
agggaggttgacgaaatattatgca

SEQ ID NO: 24286 - DNA, 25 bp, Homo sapien
agggaggttgatgaaatattatgca

SEQ ID NO: 24287 - DNA, 25 bp, Homo sapien
agggaggttggttataagcaatgca

SEQ ID NO: 24288 - DNA, 25 bp, Homo sapien
agggaggttggttataggcaatgca

SEQ ID NO: 24289 - DNA, 25 bp, Homo sapien
agggagtacagccttgctgacagct

SEQ ID NO: 24290 - DNA, 25 bp, Homo sapien
agggagtacagccttgttgacagct

SEQ ID NO: 24291 - DNA, 25 bp, Homo sapien
agggagtagagcagcttctgcagaa

SEQ ID NO: 24292 - DNA, 25 bp, Homo sapien
agggagtatagcagcttctgcagaa

SEQ ID NO: 24293 - DNA, 25 bp, Homo sapien
agggagtcccgggtgcgagaacttc

SEQ ID NO: 24294 - DNA, 25 bp, Homo sapien
agggagtccggggtgcgagaacttc

SEQ ID NO: 24295 - DNA, 25 bp, Homo sapien
agggagtgaggatgcaaaaatagaa

SEQ ID NO: 24296 - DNA, 25 bp, Homo sapien
agggagtgaggatggaaaaatagaa

SEQ ID NO: 24297 - DNA, 25 bp, Homo sapien
agggatataagaggaaattttaaaa

SEQ ID NO: 24298 - DNA, 25 bp, Homo sapien
agggatataagcggaaattttaaaa

SEQ ID NO: 24299 - DNA, 25 bp, Homo sapien
agggatattaaccaagacccagcac

SEQ ID NO: 24300 - DNA, 25 bp, Homo sapien
agggatattaatcaagacccagcac

SEQ ID NO: 24301 - DNA, 25 bp, Homo sapien
agggatccacgtagaagttgcatca

SEQ ID NO: 24302 - DNA, 25 bp, Homo sapien
agggatccacttccacgatccaaat

SEQ ID NO: 24303 - DNA, 25 bp, Homo sapien
agggatccacttccactatccaaat

SEQ ID NO: 24304 - DNA, 25 bp, Homo sapien
agggatccatgtagaagttgcatca

SEQ ID NO: 24305 - DNA, 25 bp, Homo sapien
agggatcgcagaaagaaggtggctt

SEQ ID NO: 24306 - DNA, 25 bp, Homo sapien
agggatcgcggaaagaaggtggctt

SEQ ID NO: 24307 - DNA, 25 bp, Homo sapien
agggatctttagccttgaaaactga

SEQ ID NO: 24308 - DNA, 25 bp, Homo sapien
agggatctttagctttgaaaactga

SEQ ID NO: 24309 - DNA, 25 bp, Homo sapien
agggatgaaaagaactaaaggacat

SEQ ID NO: 24310 - DNA, 25 bp, Homo sapien
agggatgaaaagaattaaaggacat

SEQ ID NO: 24311 - DNA, 25 bp, Homo sapien
agggatgaaagaatgaatgagttta

SEQ ID NO: 24312 - DNA, 25 bp, Homo sapien
agggatgaaggaatgaatgagttta

SEQ ID NO: 24313 - DNA, 25 bp, Homo sapien
agggatgaggaagacggatgcatga

SEQ ID NO: 24314 - DNA, 25 bp, Homo sapien
agggatgaggaagatggatgcatga

SEQ ID NO: 24315 - DNA, 25 bp, Homo sapien
agggatgatgttacccagagcccag

SEQ ID NO: 24316 - DNA, 25 bp, Homo sapien
agggatgatgttatccagagcccag

SEQ ID NO: 24317 - DNA, 25 bp, Homo sapien
agggatgcagcatccaataccagtg

SEQ ID NO: 24318 - DNA, 25 bp, Homo sapien
agggatgcataataattttccgtga

SEQ ID NO: 24319 - DNA, 25 bp, Homo sapien
agggatgcataatgattttccgtga

SEQ ID NO: 24320 - DNA, 25 bp, Homo sapien
agggatgcggcatccaataccagtg

SEQ ID NO: 24321 - DNA, 25 bp, Homo sapien
agggattagtacaagtgcaaagcca

SEQ ID NO: 24322 - DNA, 25 bp, Homo sapien
agggattagtacaagttcaaagcca

SEQ ID NO: 24323 - DNA, 25 bp, Homo sapien
agggattgttaaataatttctgagc

SEQ ID NO: 24324 - DNA, 25 bp, Homo sapien
agggattgttaaatgatttctgagc

SEQ ID NO: 24325 - DNA, 25 bp, Homo sapien
agggatttttgaactgcatatttta

SEQ ID NO: 24326 - DNA, 25 bp, Homo sapien
agggatttttgaattgcatatttta

SEQ ID NO: 24327 - DNA, 25 bp, Homo sapien
agggcaaacgattatgagattgatt

SEQ ID NO: 24328 - DNA, 25 bp, Homo sapien
agggcaaacgattttgagattgatt

SEQ ID NO: 24329 - DNA, 25 bp, Homo sapien
agggcaaacgtcaactccactgtac

SEQ ID NO: 24330 - DNA, 25 bp, Homo sapien
agggcaaatgtcaactccactgtac

SEQ ID NO: 24331 - DNA, 25 bp, Homo sapien
agggcaactttgcttcccctagagt

SEQ ID NO: 24332 - DNA, 25 bp, Homo sapien
agggcaactttggttcccctagagt

SEQ ID NO: 24333 - DNA, 25 bp, Homo sapien
agggcaaggaataaatgaactcaag

SEQ ID NO: 24334 - DNA, 25 bp, Homo sapien
agggcaaggaataaattaactcaag

SEQ ID NO: 24335 - DNA, 25 bp, Homo sapien
agggcacactggtttctggaaaggt

SEQ ID NO: 24336 - DNA, 25 bp, Homo sapien
agggcacattggtttctggaaaggt

SEQ ID NO: 24337 - DNA, 25 bp, Homo sapien
agggcaccagagttggctttcaggc

SEQ ID NO: 24338 - DNA, 25 bp, Homo sapien
agggcaccagagtttgctttcaggc

SEQ ID NO: 24339 - DNA, 25 bp, Homo sapien
agggcacgacgagaagcccataatg

SEQ ID NO: 24340 - DNA, 25 bp, Homo sapien
agggcacgatgagaagcccataatg

SEQ ID NO: 24341 - DNA, 25 bp, Homo sapien
agggcactaaccatcttgacttgag

SEQ ID NO: 24342 - DNA, 25 bp, Homo sapien
agggcactaaccgtcttgacttgag

SEQ ID NO: 24343 - DNA, 25 bp, Homo sapien
agggcagccctgtgcatttttggac

SEQ ID NO: 24344 - DNA, 25 bp, Homo sapien
agggcagccttgtgcatttttggac

SEQ ID NO: 24345 - DNA, 25 bp, Homo sapien
agggcagttctatagtcttcaccac

SEQ ID NO: 24346 - DNA, 25 bp, Homo sapien
agggcagttctgtagtcttcaccac

SEQ ID NO: 24347 - DNA, 25 bp, Homo sapien
agggcataagcaaatgtcaaataat

SEQ ID NO: 24348 - DNA, 25 bp, Homo sapien
agggcataagcacatgtcaaataat

SEQ ID NO: 24349 - DNA, 25 bp, Homo sapien
agggcatcacaaacacagcctatca

SEQ ID NO: 24350 - DNA, 25 bp, Homo sapien
agggcatcacaaacgcagcctatca

SEQ ID NO: 24351 - DNA, 25 bp, Homo sapien
agggcatcaggccagctgcaaatcg

SEQ ID NO: 24352 - DNA, 25 bp, Homo sapien
agggcatcaggctagctgcaaatcg

SEQ ID NO: 24353 - DNA, 25 bp, Homo sapien
agggcatctgggaaagattttctca

SEQ ID NO: 24354 - DNA, 25 bp, Homo sapien
agggcatctgggagagattttctca

SEQ ID NO: 24355 - DNA, 25 bp, Homo sapien
agggcattagacagattacccacaa

SEQ ID NO: 24356 - DNA, 25 bp, Homo sapien
agggcattagatagattacccacaa

SEQ ID NO: 24357 - DNA, 25 bp, Homo sapien
agggcatttcaataaaggaaggtct

SEQ ID NO: 24358 - DNA, 25 bp, Homo sapien
agggcatttcaatgaaggaaggtct

SEQ ID NO: 24359 - DNA, 25 bp, Homo sapien
agggcattttccaaggcaccactgt

SEQ ID NO: 24360 - DNA, 25 bp, Homo sapien
agggcattttccaaggtaccactgt

SEQ ID NO: 24361 - DNA, 25 bp, Homo sapien
agggcattttgataaataaaggaaa

SEQ ID NO: 24362 - DNA, 25 bp, Homo sapien
agggcattttggtaaataaaggaaa

SEQ ID NO: 24363 - DNA, 25 bp, Homo sapien
agggccacaagatcagataagtgag

SEQ ID NO: 24364 - DNA, 25 bp, Homo sapien
agggccacaaggtcagataagtgag

SEQ ID NO: 24365 - DNA, 25 bp, Homo sapien
agggccactaccttctgagaaacag

SEQ ID NO: 24366 - DNA, 25 bp, Homo sapien
agggccactactttctgagaaacag

SEQ ID NO: 24367 - DNA, 25 bp, Homo sapien
agggccagaaacacatggaaagctc

SEQ ID NO: 24368 - DNA, 25 bp, Homo sapien
agggccagaaactcatggaaagctc

SEQ ID NO: 24369 - DNA, 25 bp, Homo sapien
agggccaggcgaggagcttgcagct

SEQ ID NO: 24370 - DNA, 25 bp, Homo sapien
agggccaggcgtggagcttgcagct

SEQ ID NO: 24371 - DNA, 25 bp, Homo sapien
agggccagttagcccacttactcca

SEQ ID NO: 24372 - DNA, 25 bp, Homo sapien
agggccagttagtccacttactcca

SEQ ID NO: 24373 - DNA, 25 bp, Homo sapien
agggcctctagggtgacacagtcaa

SEQ ID NO: 24374 - DNA, 25 bp, Homo sapien
agggcctctaggttgacacagtcaa

SEQ ID NO: 24375 - DNA, 25 bp, Homo sapien
agggcctgacttggcatccaaccag

SEQ ID NO: 24376 - DNA, 25 bp, Homo sapien
agggcctggtatacctattttgaaa

SEQ ID NO: 24377 - DNA, 25 bp, Homo sapien
agggcctggtatccctattttgaaa

SEQ ID NO: 24378 - DNA, 25 bp, Homo sapien
agggcctgtcttggcatccaaccag

SEQ ID NO: 24379 - DNA, 25 bp, Homo sapien
agggccttgtacgcctgagctcttt

SEQ ID NO: 24380 - DNA, 25 bp, Homo sapien
agggccttgtatgcctgagctcttt

SEQ ID NO: 24381 - DNA, 25 bp, Homo sapien
agggcgggtgatatctgagtgtggc

SEQ ID NO: 24382 - DNA, 25 bp, Homo sapien
agggcgggtgatatttgagtgtggc

SEQ ID NO: 24383 - DNA, 25 bp, Homo sapien
agggcgtgcctcttaatgcagtcca

SEQ ID NO: 24384 - DNA, 25 bp, Homo sapien
agggcgtgcctcttgatgcagtcca

SEQ ID NO: 24385 - DNA, 25 bp, Homo sapien
agggctaacagtcaaaccatggtat

SEQ ID NO: 24386 - DNA, 25 bp, Homo sapien
agggctaagagtcaaaccatggtat

SEQ ID NO: 24387 - DNA, 25 bp, Homo sapien
agggctcatcctcatattttctgtt

SEQ ID NO: 24388 - DNA, 25 bp, Homo sapien
agggctcatcctcgtattttctgtt

SEQ ID NO: 24389 - DNA, 25 bp, Homo sapien
agggctccatttacctctcgtatat

SEQ ID NO: 24390 - DNA, 25 bp, Homo sapien
agggctccatttacttctcgtatat

SEQ ID NO: 24391 - DNA, 25 bp, Homo sapien
agggctgccattctctctgttgtgc

SEQ ID NO: 24392 - DNA, 25 bp, Homo sapien
agggctgccattgtctctgttgtgc

SEQ ID NO: 24393 - DNA, 25 bp, Homo sapien
agggctgcgctaattagattgcttc

SEQ ID NO: 24394 - DNA, 25 bp, Homo sapien
agggctgctctaattagattgcttc

SEQ ID NO: 24395 - DNA, 25 bp, Homo sapien
agggctggcagtcccaggagtctct

SEQ ID NO: 24396 - DNA, 25 bp, Homo sapien
agggctggtagtcccaggagtctct

SEQ ID NO: 24397 - DNA, 25 bp, Homo sapien
agggcttacctgcttaggcacctgc

SEQ ID NO: 24398 - DNA, 25 bp, Homo sapien
agggcttacctggttaggcacctgc

SEQ ID NO: 24399 - DNA, 25 bp, Homo sapien
agggcttaccttggtacctgagtaa

SEQ ID NO: 24400 - DNA, 25 bp, Homo sapien
agggcttagcttggtacctgagtaa

SEQ ID NO: 24401 - DNA, 25 bp, Homo sapien
agggcttcttcctcaaatatgttat

SEQ ID NO: 24402 - DNA, 25 bp, Homo sapien
agggcttcttcttcaaatatgttat

SEQ ID NO: 24403 - DNA, 25 bp, Homo sapien
agggcttgaaatagatctttctata

SEQ ID NO: 24404 - DNA, 25 bp, Homo sapien
agggcttgagatagatctttctata

SEQ ID NO: 24405 - DNA, 25 bp, Homo sapien
agggcttggctagatcacagctctg

SEQ ID NO: 24406 - DNA, 25 bp, Homo sapien
agggcttggctaggtcacagctctg

SEQ ID NO: 24407 - DNA, 25 bp, Homo sapien
aggggaaaaaataagcttcagagtg

SEQ ID NO: 24408 - DNA, 25 bp, Homo sapien
aggggaaaaaatgagcttcagagtg

SEQ ID NO: 24409 - DNA, 25 bp, Homo sapien
aggggaaacctcactgcaggaagaa

SEQ ID NO: 24410 - DNA, 25 bp, Homo sapien
aggggaaacctcactgtaggaagaa

SEQ ID NO: 24411 - DNA, 25 bp, Homo sapien
aggggaaagcttaaacattagctac

SEQ ID NO: 24412 - DNA, 25 bp, Homo sapien
aggggaaagcttaaacgttagctac

SEQ ID NO: 24413 - DNA, 25 bp, Homo sapien
aggggaaagtctatgggatcaaagc

SEQ ID NO: 24414 - DNA, 25 bp, Homo sapien
aggggaaagtctgtgggatcaaagc

SEQ ID NO: 24415 - DNA, 25 bp, Homo sapien
aggggaaatgcaacctattttctgg

SEQ ID NO: 24416 - DNA, 25 bp, Homo sapien
aggggaaatgcaacctcttttctgg

SEQ ID NO: 24417 - DNA, 25 bp, Homo sapien
aggggaactgttatggacttcattc

SEQ ID NO: 24418 - DNA, 25 bp, Homo sapien
aggggaactgttatggccttcattc

SEQ ID NO: 24419 - DNA, 25 bp, Homo sapien
aggggaatgccataaacagaagtat

SEQ ID NO: 24420 - DNA, 25 bp, Homo sapien
aggggaatgccgtaaacagaagtat

SEQ ID NO: 24421 - DNA, 25 bp, Homo sapien
aggggaatgttaaacacctcttgat

SEQ ID NO: 24422 - DNA, 25 bp, Homo sapien
aggggaatgttaaagacctcttgat

SEQ ID NO: 24423 - DNA, 25 bp, Homo sapien
aggggacattctacgactctctaag

SEQ ID NO: 24424 - DNA, 25 bp, Homo sapien
aggggacattctatgactctctaag

SEQ ID NO: 24425 - DNA, 25 bp, Homo sapien
aggggacgaacagctctgcttggct

SEQ ID NO: 24426 - DNA, 25 bp, Homo sapien
aggggacgaacagttctgcttggct

SEQ ID NO: 24427 - DNA, 25 bp, Homo sapien
aggggagatttctccacctttagct

SEQ ID NO: 24428 - DNA, 25 bp, Homo sapien
aggggagatttctctacctttagct

SEQ ID NO: 24429 - DNA, 25 bp, Homo sapien
aggggagttgccattttattggtgc

SEQ ID NO: 24430 - DNA, 25 bp, Homo sapien
aggggagttgccgttttattggtgc

SEQ ID NO: 24431 - DNA, 25 bp, Homo sapien
aggggatataggagtaagttctgag

SEQ ID NO: 24432 - DNA, 25 bp, Homo sapien
aggggatataggagtaggttctgag

SEQ ID NO: 24433 - DNA, 25 bp, Homo sapien
aggggatatggctctaagtcagagt

SEQ ID NO: 24434 - DNA, 25 bp, Homo sapien
aggggatatggctttaagtcagagt

SEQ ID NO: 24435 - DNA, 25 bp, Homo sapien
aggggatgcagataaaagttgctgt

SEQ ID NO: 24436 - DNA, 25 bp, Homo sapien
aggggatgcaggtaaaagttgctgt

SEQ ID NO: 24437 - DNA, 25 bp, Homo sapien
aggggattctactgtacagcaagtt

SEQ ID NO: 24438 - DNA, 25 bp, Homo sapien
aggggattctactgtagagcaagtt

SEQ ID NO: 24439 - DNA, 25 bp, Homo sapien
aggggattttgacctgctgttgctg

SEQ ID NO: 24440 - DNA, 25 bp, Homo sapien
aggggattttgacctgttgttgctg

SEQ ID NO: 24441 - DNA, 25 bp, Homo sapien
aggggcaaactgattgcatccgatc

SEQ ID NO: 24442 - DNA, 25 bp, Homo sapien
aggggcaaattgattgcatccgatc

SEQ ID NO: 24443 - DNA, 25 bp, Homo sapien
aggggcagaagcaatgatcttccac

SEQ ID NO: 24444 - DNA, 25 bp, Homo sapien
aggggcagaaggaatgatcttccac

SEQ ID NO: 24445 - DNA, 25 bp, Homo sapien
aggggcaggccacacagaatggtct

SEQ ID NO: 24446 - DNA, 25 bp, Homo sapien
aggggcaggccacagagaatggtct

SEQ ID NO: 24447 - DNA, 25 bp, Homo sapien
aggggcatcagataccagtaaaaga

SEQ ID NO: 24448 - DNA, 25 bp, Homo sapien
aggggcatcaggtaccagtaaaaga

SEQ ID NO: 24449 - DNA, 25 bp, Homo sapien
aggggcctaaaacctagactctgct

SEQ ID NO: 24450 - DNA, 25 bp, Homo sapien
aggggcctaaaagctagactctgct

SEQ ID NO: 24451 - DNA, 25 bp, Homo sapien
aggggcctgtctaggccgcccaaat

SEQ ID NO: 24452 - DNA, 25 bp, Homo sapien
aggggcctgtctaggctgcccaaat

SEQ ID NO: 24453 - DNA, 25 bp, Homo sapien
aggggcggaagaagatatggacaca

SEQ ID NO: 24454 - DNA, 25 bp, Homo sapien
aggggcggaagaagatgtggacaca

SEQ ID NO: 24455 - DNA, 25 bp, Homo sapien
aggggctgaaagttatcgccaatag

SEQ ID NO: 24456 - DNA, 25 bp, Homo sapien
aggggctgaaagttattgccaatag

SEQ ID NO: 24457 - DNA, 25 bp, Homo sapien
aggggctgtttcaggaaagttctca

SEQ ID NO: 24458 - DNA, 25 bp, Homo sapien
aggggctgtttcagtaaagttctca

SEQ ID NO: 24459 - DNA, 25 bp, Homo sapien
agggggatgtgcggctgagtggcca

SEQ ID NO: 24460 - DNA, 25 bp, Homo sapien
agggggatgtgtggctgagtggcca

SEQ ID NO: 24461 - DNA, 25 bp, Homo sapien
agggggcctgcctgataagtcacaa

SEQ ID NO: 24462 - DNA, 25 bp, Homo sapien
agggggcctgcctggtaagtcacaa

SEQ ID NO: 24463 - DNA, 25 bp, Homo sapien
agggggtaaggatgtctcatatcag

SEQ ID NO: 24464 - DNA, 25 bp, Homo sapien
agggggtaaggttgtctcatatcag

SEQ ID NO: 24465 - DNA, 25 bp, Homo sapien
aggggtagacacaatagcctcaggc

SEQ ID NO: 24466 - DNA, 25 bp, Homo sapien
aggggtagacacgatagcctcaggc

SEQ ID NO: 24467 - DNA, 25 bp, Homo sapien
aggggtcaagtgtgagactcaaagt

SEQ ID NO: 24468 - DNA, 25 bp, Homo sapien
aggggtcaagtgtgagcctcaaagt

SEQ ID NO: 24469 - DNA, 25 bp, Homo sapien
aggggtgccagtgaacaagtcccca

SEQ ID NO: 24470 - DNA, 25 bp, Homo sapien
aggggtgccggtgaacaagtcccca

SEQ ID NO: 24471 - DNA, 25 bp, Homo sapien
agggtaaagacacaactatggctca

SEQ ID NO: 24472 - DNA, 25 bp, Homo sapien
agggtaaagacacagctatggctca

SEQ ID NO: 24473 - DNA, 25 bp, Homo sapien
agggtaaatgctacttaactggtag

SEQ ID NO: 24474 - DNA, 25 bp, Homo sapien
agggtaaatgcttcttaactggtag

SEQ ID NO: 24475 - DNA, 25 bp, Homo sapien
agggtaagccacaaggcattgtcat

SEQ ID NO: 24476 - DNA, 25 bp, Homo sapien
agggtaagccacgaggcattgtcat

SEQ ID NO: 24477 - DNA, 25 bp, Homo sapien
agggtaccaatgatcctatatttgt

SEQ ID NO: 24478 - DNA, 25 bp, Homo sapien
agggtaccaatgattctatatttgt

SEQ ID NO: 24479 - DNA, 25 bp, Homo sapien
agggtaccagtcagagtcatgaggc

SEQ ID NO: 24480 - DNA, 25 bp, Homo sapien
agggtaccagtccgagtcatgaggc

SEQ ID NO: 24481 - DNA, 25 bp, Homo sapien
agggtatacacagtagcattgcttt

SEQ ID NO: 24482 - DNA, 25 bp, Homo sapien
agggtatatacagtagcattgcttt

SEQ ID NO: 24483 - DNA, 25 bp, Homo sapien
agggtatctaatagaagcatcttag

SEQ ID NO: 24484 - DNA, 25 bp, Homo sapien
agggtatctgatagaagcatcttag

SEQ ID NO: 24485 - DNA, 25 bp, Homo sapien
agggtatgcttaaattattgctata

SEQ ID NO: 24486 - DNA, 25 bp, Homo sapien
agggtatgcttcaattattgctata

SEQ ID NO: 24487 - DNA, 25 bp, Homo sapien
agggtcaacatgaaagcgttagtat

SEQ ID NO: 24488 - DNA, 25 bp, Homo sapien
agggtcaacatgaaagtgttagtat

SEQ ID NO: 24489 - DNA, 25 bp, Homo sapien
agggtcatcacacactagtcattct

SEQ ID NO: 24490 - DNA, 25 bp, Homo sapien
agggtcatcacatactagtcattct

SEQ ID NO: 24491 - DNA, 25 bp, Homo sapien
agggtcatctacatggatactgaaa

SEQ ID NO: 24492 - DNA, 25 bp, Homo sapien
agggtcatctacgtggatactgaaa

SEQ ID NO: 24493 - DNA, 25 bp, Homo sapien
agggtccagccatgtcatcgaatcg

SEQ ID NO: 24494 - DNA, 25 bp, Homo sapien
agggtccagccatttcatcgaatcg

SEQ ID NO: 24495 - DNA, 25 bp, Homo sapien
agggtctaaggtccagaaggtagtg

SEQ ID NO: 24496 - DNA, 25 bp, Homo sapien
agggtctaaggtccggaaggtagtg

SEQ ID NO: 24497 - DNA, 25 bp, Homo sapien
agggtctacacttttagaaacaaat

SEQ ID NO: 24498 - DNA, 25 bp, Homo sapien
agggtctacgcttttagaaacaaat

SEQ ID NO: 24499 - DNA, 25 bp, Homo sapien
agggtgaatagaaatgaagaactgg

SEQ ID NO: 24500 - DNA, 25 bp, Homo sapien
agggtgaatggaaatgaagaactgg

SEQ ID NO: 24501 - DNA, 25 bp, Homo sapien
agggtgattgagagaaggctggata

SEQ ID NO: 24502 - DNA, 25 bp, Homo sapien
agggtgattgagagaatgctggata

SEQ ID NO: 24503 - DNA, 25 bp, Homo sapien
agggtgattggtacaactttctatt

SEQ ID NO: 24504 - DNA, 25 bp, Homo sapien
agggtgattggtagaactttctatt

SEQ ID NO: 24505 - DNA, 25 bp, Homo sapien
agggtgcaggacctaaaatggtttt

SEQ ID NO: 24506 - DNA, 25 bp, Homo sapien
agggtgcaggacctaatatggtttt

SEQ ID NO: 24507 - DNA, 25 bp, Homo sapien
agggtggaaagagagaaccctgctc

SEQ ID NO: 24508 - DNA, 25 bp, Homo sapien
agggtggaagaggaaacgatgctga

SEQ ID NO: 24509 - DNA, 25 bp, Homo sapien
agggtggaagaggaaatgatgctga

SEQ ID NO: 24510 - DNA, 25 bp, Homo sapien
agggtggaaggagagaaccctgctc

SEQ ID NO: 24511 - DNA, 25 bp, Homo sapien
agggtggagaatgtggatatcatgc

SEQ ID NO: 24512 - DNA, 25 bp, Homo sapien
agggtggataatgtggatatcatgc

SEQ ID NO: 24513 - DNA, 25 bp, Homo sapien
agggtggcacatgctcatcaccttt

SEQ ID NO: 24514 - DNA, 25 bp, Homo sapien
agggtggccaacttgtcccagtttt

SEQ ID NO: 24515 - DNA, 25 bp, Homo sapien
agggtggccaatttgtcccagtttt

SEQ ID NO: 24516 - DNA, 25 bp, Homo sapien
agggtggccgagaggaagaaaagat

SEQ ID NO: 24517 - DNA, 25 bp, Homo sapien
agggtggcgcatgctcatcaccttt

SEQ ID NO: 24518 - DNA, 25 bp, Homo sapien
agggtggcggagaggaagaaaagat

SEQ ID NO: 24519 - DNA, 25 bp, Homo sapien
agggtgggtgtccaaactggtggtg

SEQ ID NO: 24520 - DNA, 25 bp, Homo sapien
agggtgggtgtccgaactggtggtg

SEQ ID NO: 24521 - DNA, 25 bp, Homo sapien
agggtggtatggccgtagactagag

SEQ ID NO: 24522 - DNA, 25 bp, Homo sapien
agggtggtatggctgtagactagag

SEQ ID NO: 24523 - DNA, 25 bp, Homo sapien
agggtgtaaaaagaaaaaagcatca

SEQ ID NO: 24524 - DNA, 25 bp, Homo sapien
agggtgtaaaaagataaaagcatca

SEQ ID NO: 24525 - DNA, 25 bp, Homo sapien
agggtgtaattgtcacatcactgag

SEQ ID NO: 24526 - DNA, 25 bp, Homo sapien
agggtgtacttgtcacatcactgag

SEQ ID NO: 24527 - DNA, 25 bp, Homo sapien
agggttaaacgtagtggtaagaaac

SEQ ID NO: 24528 - DNA, 25 bp, Homo sapien
agggttaaatgtagtggtaagaaac

SEQ ID NO: 24529 - DNA, 25 bp, Homo sapien
agggttagaacaaagataataatct

SEQ ID NO: 24530 - DNA, 25 bp, Homo sapien
agggttagaacagagataataatct

SEQ ID NO: 24531 - DNA, 25 bp, Homo sapien
agggttcaaggaagacaatgacaga

SEQ ID NO: 24532 - DNA, 25 bp, Homo sapien
agggttcaaggaagccaatgacaga

SEQ ID NO: 24533 - DNA, 25 bp, Homo sapien
agggttcacaagcatcagaggcagg

SEQ ID NO: 24534 - DNA, 25 bp, Homo sapien
agggttcacaagcgtcagaggcagg

SEQ ID NO: 24535 - DNA, 25 bp, Homo sapien
agggttcatacaataagctcaagaa

SEQ ID NO: 24536 - DNA, 25 bp, Homo sapien
agggttcatacaatgagctcaagaa

SEQ ID NO: 24537 - DNA, 25 bp, Homo sapien
agggttctagtccaattcactaatg

SEQ ID NO: 24538 - DNA, 25 bp, Homo sapien
agggttctggtccaattcactaatg

SEQ ID NO: 24539 - DNA, 25 bp, Homo sapien
agggttgcattgcatgtcagtatgt

SEQ ID NO: 24540 - DNA, 25 bp, Homo sapien
agggttgcgttgcatgtcagtatgt

SEQ ID NO: 24541 - DNA, 25 bp, Homo sapien
agggttgctttgaagtattctttta

SEQ ID NO: 24542 - DNA, 25 bp, Homo sapien
agggttgctttgcagtattctttta

SEQ ID NO: 24543 - DNA, 25 bp, Homo sapien
agggttgtagtccaattatgtaact

SEQ ID NO: 24544 - DNA, 25 bp, Homo sapien
agggttgttgtccaattatgtaact

SEQ ID NO: 24545 - DNA, 25 bp, Homo sapien
agggttgtttccaagccctttagat

SEQ ID NO: 24546 - DNA, 25 bp, Homo sapien
agggttgtttccatgccctttagat

SEQ ID NO: 24547 - DNA, 25 bp, Homo sapien
agggtttagggacgctcagcaggcc

SEQ ID NO: 24548 - DNA, 25 bp, Homo sapien
agggtttagggatgctcagcaggcc

SEQ ID NO: 24549 - DNA, 25 bp, Homo sapien
agggtttatcgtatcgtgaacatct

SEQ ID NO: 24550 - DNA, 25 bp, Homo sapien
agggtttattgtatcgtgaacatct

SEQ ID NO: 24551 - DNA, 25 bp, Homo sapien
agggtttctaggctatcatgcagtg

SEQ ID NO: 24552 - DNA, 25 bp, Homo sapien
agggtttctaggctatgatgcagtg

SEQ ID NO: 24553 - DNA, 25 bp, Homo sapien
agggtttgcaggcagagaaaaggag

SEQ ID NO: 24554 - DNA, 25 bp, Homo sapien
agggtttgcaggtagagaaaaggag

SEQ ID NO: 24555 - DNA, 25 bp, Homo sapien
aggtaaaaacgagccactcttctcc

SEQ ID NO: 24556 - DNA, 25 bp, Homo sapien
aggtaaaaatgagccactcttctcc

SEQ ID NO: 24557 - DNA, 25 bp, Homo sapien
aggtaaaacatagcatggaagacag

SEQ ID NO: 24558 - DNA, 25 bp, Homo sapien
aggtaaaacatagtatggaagacag

SEQ ID NO: 24559 - DNA, 25 bp, Homo sapien
aggtaaaagaacagagctccagaac

SEQ ID NO: 24560 - DNA, 25 bp, Homo sapien
aggtaaaagaagagagctccagaac

SEQ ID NO: 24561 - DNA, 25 bp, Homo sapien
aggtaaaagactttgtactgtggac

SEQ ID NO: 24562 - DNA, 25 bp, Homo sapien
aggtaaaatactttgtactgtggac

SEQ ID NO: 24563 - DNA, 25 bp, Homo sapien
aggtaaaatgaggacagaaactgtg

SEQ ID NO: 24564 - DNA, 25 bp, Homo sapien
aggtaaaatgagggcagaaactgtg

SEQ ID NO: 24565 - DNA, 25 bp, Homo sapien
aggtaaacaaagggagcatgacatg

SEQ ID NO: 24566 - DNA, 25 bp, Homo sapien
aggtaaacaaagtgagcatgacatg

SEQ ID NO: 24567 - DNA, 25 bp, Homo sapien
aggtaaatagagtttgcatgtggaa

SEQ ID NO: 24568 - DNA, 25 bp, Homo sapien
aggtaaatatagtttgcatgtggaa

SEQ ID NO: 24569 - DNA, 25 bp, Homo sapien
aggtaacagtgtctcgttttccctt

SEQ ID NO: 24570 - DNA, 25 bp, Homo sapien
aggtaacagtgtcttgttttccctt

SEQ ID NO: 24571 - DNA, 25 bp, Homo sapien
aggtaaccaactatccgaactgtgt

SEQ ID NO: 24572 - DNA, 25 bp, Homo sapien
aggtaaccagctatccgaactgtgt

SEQ ID NO: 24573 - DNA, 25 bp, Homo sapien
aggtaactgtggccaagattcaaga

SEQ ID NO: 24574 - DNA, 25 bp, Homo sapien
aggtaactgtgtccaagattcaaga

SEQ ID NO: 24575 - DNA, 25 bp, Homo sapien
aggtaaggcccaaagtattgattgt

SEQ ID NO: 24576 - DNA, 25 bp, Homo sapien
aggtaaggcccgaagtattgattgt

SEQ ID NO: 24577 - DNA, 25 bp, Homo sapien
aggtaagtcatttcaaattttcact

SEQ ID NO: 24578 - DNA, 25 bp, Homo sapien
aggtaagtcattttaaattttcact

SEQ ID NO: 24579 - DNA, 25 bp, Homo sapien
aggtaagtgaactgaaagctcagtc

SEQ ID NO: 24580 - DNA, 25 bp, Homo sapien
aggtaagtgaactgaatgctcagtc

SEQ ID NO: 24581 - DNA, 25 bp, Homo sapien
aggtaagtttgaaaaatgtcttaac

SEQ ID NO: 24582 - DNA, 25 bp, Homo sapien
aggtaagtttgagaaatgtcttaac

SEQ ID NO: 24583 - DNA, 25 bp, Homo sapien
aggtaatatagtaacaagttctggg

SEQ ID NO: 24584 - DNA, 25 bp, Homo sapien
aggtaatatagtaacaggttctggg

SEQ ID NO: 24585 - DNA, 25 bp, Homo sapien
aggtaatccttgctgctggacccaa

SEQ ID NO: 24586 - DNA, 25 bp, Homo sapien
aggtaatccttgttgctggacccaa

SEQ ID NO: 24587 - DNA, 25 bp, Homo sapien
aggtaattacacatgttgttttaaa

SEQ ID NO: 24588 - DNA, 25 bp, Homo sapien
aggtaattatacatgttgttttaaa

SEQ ID NO: 24589 - DNA, 25 bp, Homo sapien
aggtaattcaccaggtgttattctt

SEQ ID NO: 24590 - DNA, 25 bp, Homo sapien
aggtaattcaccgggtgttattctt

SEQ ID NO: 24591 - DNA, 25 bp, Homo sapien
aggtaattctgaagcaagtaatact

SEQ ID NO: 24592 - DNA, 25 bp, Homo sapien
aggtaattttgaagcaagtaatact

SEQ ID NO: 24593 - DNA, 25 bp, Homo sapien
aggtacaattacacccatctgtgga

SEQ ID NO: 24594 - DNA, 25 bp, Homo sapien
aggtacaattacacccgtctgtgga

SEQ ID NO: 24595 - DNA, 25 bp, Homo sapien
aggtaccaaaatgattcactagttt

SEQ ID NO: 24596 - DNA, 25 bp, Homo sapien
aggtaccagaatgattcactagttt

SEQ ID NO: 24597 - DNA, 25 bp, Homo sapien
aggtacctgggcagatgcaaagagc

SEQ ID NO: 24598 - DNA, 25 bp, Homo sapien
aggtacctgggcaggtgcaaagagc

SEQ ID NO: 24599 - DNA, 25 bp, Homo sapien
aggtacggatgagtaaagcacatgg

SEQ ID NO: 24600 - DNA, 25 bp, Homo sapien
aggtacggatgtgtaaagcacatgg

SEQ ID NO: 24601 - DNA, 25 bp, Homo sapien
aggtacgttaggctctaatgaaacc

SEQ ID NO: 24602 - DNA, 25 bp, Homo sapien
aggtacgttaggctctgatgaaacc

SEQ ID NO: 24603 - DNA, 25 bp, Homo sapien
aggtactaacatgaaccaggaaaag

SEQ ID NO: 24604 - DNA, 25 bp, Homo sapien
aggtactaacatgaactaggaaaag

SEQ ID NO: 24605 - DNA, 25 bp, Homo sapien
aggtactacggaggagacaacaaat

SEQ ID NO: 24606 - DNA, 25 bp, Homo sapien
aggtactatgctatatcttatatga

SEQ ID NO: 24607 - DNA, 25 bp, Homo sapien
aggtactatgctgtatcttatatga

SEQ ID NO: 24608 - DNA, 25 bp, Homo sapien
aggtactatggaggagacaacaaat

SEQ ID NO: 24609 - DNA, 25 bp, Homo sapien
aggtactattaattatccactttat

SEQ ID NO: 24610 - DNA, 25 bp, Homo sapien
aggtactattatttatccactttat

SEQ ID NO: 24611 - DNA, 25 bp, Homo sapien
aggtacttctcattaacatgcaatc

SEQ ID NO: 24612 - DNA, 25 bp, Homo sapien
aggtacttctcattaatatgcaatc

SEQ ID NO: 24613 - DNA, 25 bp, Homo sapien
aggtagaacatacacatttctcatg

SEQ ID NO: 24614 - DNA, 25 bp, Homo sapien
aggtagaacatacccatttctcatg

SEQ ID NO: 24615 - DNA, 25 bp, Homo sapien
aggtagacatttactctcccctcat

SEQ ID NO: 24616 - DNA, 25 bp, Homo sapien
aggtagacgtttactctcccctcat

SEQ ID NO: 24617 - DNA, 25 bp, Homo sapien
aggtagactcagaaatgtctccgca

SEQ ID NO: 24618 - DNA, 25 bp, Homo sapien
aggtagactcagaattgtctccgca

SEQ ID NO: 24619 - DNA, 25 bp, Homo sapien
aggtagagagaatgaaaattaaaat

SEQ ID NO: 24620 - DNA, 25 bp, Homo sapien
aggtagagagaatggaaattaaaat

SEQ ID NO: 24621 - DNA, 25 bp, Homo sapien
aggtagagattcagttgctgggtgt

SEQ ID NO: 24622 - DNA, 25 bp, Homo sapien
aggtagaggttcagttgctgggtgt

SEQ ID NO: 24623 - DNA, 25 bp, Homo sapien
aggtagaggttggaaggattggaag

SEQ ID NO: 24624 - DNA, 25 bp, Homo sapien
aggtagagtttggaaggattggaag

SEQ ID NO: 24625 - DNA, 25 bp, Homo sapien
aggtagattcttagctcggccataa

SEQ ID NO: 24626 - DNA, 25 bp, Homo sapien
aggtagattcttagctgggccataa

SEQ ID NO: 24627 - DNA, 25 bp, Homo sapien
aggtagccagtgagcaccctaggag

SEQ ID NO: 24628 - DNA, 25 bp, Homo sapien
aggtagccagtgaggaccctaggag

SEQ ID NO: 24629 - DNA, 25 bp, Homo sapien
aggtagccgtttacagcccttgttg

SEQ ID NO: 24630 - DNA, 25 bp, Homo sapien
aggtagccgtttatagcccttgttg

SEQ ID NO: 24631 - DNA, 25 bp, Homo sapien
aggtagctaaaattaagcacatttt

SEQ ID NO: 24632 - DNA, 25 bp, Homo sapien
aggtagctataattaagcacatttt

SEQ ID NO: 24633 - DNA, 25 bp, Homo sapien
aggtagctgccctggcatatttaac

SEQ ID NO: 24634 - DNA, 25 bp, Homo sapien
aggtagctgccctggcgtatttaac

SEQ ID NO: 24635 - DNA, 25 bp, Homo sapien
aggtagctggaatacattggtccaa

SEQ ID NO: 24636 - DNA, 25 bp, Homo sapien
aggtagctggaatccattggtccaa

SEQ ID NO: 24637 - DNA, 25 bp, Homo sapien
aggtaggaaaaattgccatatattc

SEQ ID NO: 24638 - DNA, 25 bp, Homo sapien
aggtaggaaaaattgctatatattc

SEQ ID NO: 24639 - DNA, 25 bp, Homo sapien
aggtagggcactacagaacaagtca

SEQ ID NO: 24640 - DNA, 25 bp, Homo sapien
aggtagggcgctacagaacaagtca

SEQ ID NO: 24641 - DNA, 25 bp, Homo sapien
aggtagtgagaacactaggaaaata

SEQ ID NO: 24642 - DNA, 25 bp, Homo sapien
aggtagtgagaatactaggaaaata

SEQ ID NO: 24643 - DNA, 25 bp, Homo sapien
aggtagtgcagctacggaaggcaat

SEQ ID NO: 24644 - DNA, 25 bp, Homo sapien
aggtagtgcagctatggaaggcaat

SEQ ID NO: 24645 - DNA, 25 bp, Homo sapien
aggtagtgtactttttgtgatatta

SEQ ID NO: 24646 - DNA, 25 bp, Homo sapien
aggtagtgtgctttttgtgatatta

SEQ ID NO: 24647 - DNA, 25 bp, Homo sapien
aggtagtgtttgccttcgttacata

SEQ ID NO: 24648 - DNA, 25 bp, Homo sapien
aggtagtgtttgctttcgttacata

SEQ ID NO: 24649 - DNA, 25 bp, Homo sapien
aggtagttaagagaaagtcaggcac

SEQ ID NO: 24650 - DNA, 25 bp, Homo sapien
aggtagttaagggaaagtcaggcac

SEQ ID NO: 24651 - DNA, 25 bp, Homo sapien
aggtataaaacacctagagaatagt

SEQ ID NO: 24652 - DNA, 25 bp, Homo sapien
aggtataaaacgcctagagaatagt

SEQ ID NO: 24653 - DNA, 25 bp, Homo sapien
aggtataaagaatctccgtgacatt

SEQ ID NO: 24654 - DNA, 25 bp, Homo sapien
aggtataaagaatctctgtgacatt

SEQ ID NO: 24655 - DNA, 25 bp, Homo sapien
aggtataactactgctaaataccct

SEQ ID NO: 24656 - DNA, 25 bp, Homo sapien
aggtataattactgctaaataccct

SEQ ID NO: 24657 - DNA, 25 bp, Homo sapien
aggtatagaagtctgatgctggaag

SEQ ID NO: 24658 - DNA, 25 bp, Homo sapien
aggtatagagatgttaaccacttgg

SEQ ID NO: 24659 - DNA, 25 bp, Homo sapien
aggtatagagattttaaccacttgg

SEQ ID NO: 24660 - DNA, 25 bp, Homo sapien
aggtataggagtctgatgctggaag

SEQ ID NO: 24661 - DNA, 25 bp, Homo sapien
aggtatatgtatacgttaatctgga

SEQ ID NO: 24662 - DNA, 25 bp, Homo sapien
aggtatatgtatatgttaatctgga

SEQ ID NO: 24663 - DNA, 25 bp, Homo sapien
aggtatcgtatctctgaatgccgcc

SEQ ID NO: 24664 - DNA, 25 bp, Homo sapien
aggtatcgtatctgtgaatgccgcc

SEQ ID NO: 24665 - DNA, 25 bp, Homo sapien
aggtatctatttcaactaagcaatg

SEQ ID NO: 24666 - DNA, 25 bp, Homo sapien
aggtatctatttccactaagcaatg

SEQ ID NO: 24667 - DNA, 25 bp, Homo sapien
aggtatctcacagcaggcattgcca

SEQ ID NO: 24668 - DNA, 25 bp, Homo sapien
aggtatctcgcagcaggcattgcca

SEQ ID NO: 24669 - DNA, 25 bp, Homo sapien
aggtatcttaagtaagtgaagcagg

SEQ ID NO: 24670 - DNA, 25 bp, Homo sapien
aggtatcttaagtgagtgaagcagg

SEQ ID NO: 24671 - DNA, 25 bp, Homo sapien
aggtatgaaactatcacacgcaggc

SEQ ID NO: 24672 - DNA, 25 bp, Homo sapien
aggtatgaaactgtcacacgcaggc

SEQ ID NO: 24673 - DNA, 25 bp, Homo sapien
aggtatgacaacagagacaaagggt

SEQ ID NO: 24674 - DNA, 25 bp, Homo sapien
aggtatgataacagagacaaagggt

SEQ ID NO: 24675 - DNA, 25 bp, Homo sapien
aggtatggaaaatacgtataaggtc

SEQ ID NO: 24676 - DNA, 25 bp, Homo sapien
aggtatggaaaatatgtataaggtc

SEQ ID NO: 24677 - DNA, 25 bp, Homo sapien
aggtatgtattataagacctacagt

SEQ ID NO: 24678 - DNA, 25 bp, Homo sapien
aggtatgtattgtaagacctacagt

SEQ ID NO: 24679 - DNA, 25 bp, Homo sapien
aggtattcactgcagtctcctcagt

SEQ ID NO: 24680 - DNA, 25 bp, Homo sapien
aggtattcattgcagtctcctcagt

SEQ ID NO: 24681 - DNA, 25 bp, Homo sapien
aggtattccgctgtttactgaaaac

SEQ ID NO: 24682 - DNA, 25 bp, Homo sapien
aggtattctgctgtttactgaaaac

SEQ ID NO: 24683 - DNA, 25 bp, Homo sapien
aggtatttcatgctgccggccactg

SEQ ID NO: 24684 - DNA, 25 bp, Homo sapien
aggtatttcatgctgctggccactg

SEQ ID NO: 24685 - DNA, 25 bp, Homo sapien
aggtatttgtccctcggaacagagc

SEQ ID NO: 24686 - DNA, 25 bp, Homo sapien
aggtatttgtcccttggaacagagc

SEQ ID NO: 24687 - DNA, 25 bp, Homo sapien
aggtcaaaacattgctatgaacata

SEQ ID NO: 24688 - DNA, 25 bp, Homo sapien
aggtcaaaacattgctgtgaacata

SEQ ID NO: 24689 - DNA, 25 bp, Homo sapien
aggtcaaaagttgattataaggatc

SEQ ID NO: 24690 - DNA, 25 bp, Homo sapien
aggtcaaagcaccgtaacttggggt

SEQ ID NO: 24691 - DNA, 25 bp, Homo sapien
aggtcaaagcaccgtatcttggggt

SEQ ID NO: 24692 - DNA, 25 bp, Homo sapien
aggtcaaatgttgattataaggatc

SEQ ID NO: 24693 - DNA, 25 bp, Homo sapien
aggtcaagcaatattatcctctttt

SEQ ID NO: 24694 - DNA, 25 bp, Homo sapien
aggtcaagcaatgttatcctctttt

SEQ ID NO: 24695 - DNA, 25 bp, Homo sapien
aggtcacaaggagtacacacattgg

SEQ ID NO: 24696 - DNA, 25 bp, Homo sapien
aggtcacaaggattacacacattgg

SEQ ID NO: 24697 - DNA, 25 bp, Homo sapien
aggtcacaggataaaaggtcaatat

SEQ ID NO: 24698 - DNA, 25 bp, Homo sapien
aggtcacaggatacaaggtcaatat

SEQ ID NO: 24699 - DNA, 25 bp, Homo sapien
aggtcacgtgataccaacaaggtgc

SEQ ID NO: 24700 - DNA, 25 bp, Homo sapien
aggtcacgtgatatcaacaaggtgc

SEQ ID NO: 24701 - DNA, 25 bp, Homo sapien
aggtcactacgagtcttatggacat

SEQ ID NO: 24702 - DNA, 25 bp, Homo sapien
aggtcactagaaggatgctcaccaa

SEQ ID NO: 24703 - DNA, 25 bp, Homo sapien
aggtcactagaagtatgctcaccaa

SEQ ID NO: 24704 - DNA, 25 bp, Homo sapien
aggtcactatgagtcttatggacat

SEQ ID NO: 24705 - DNA, 25 bp, Homo sapien
aggtcacttcataagcttcatcagg

SEQ ID NO: 24706 - DNA, 25 bp, Homo sapien
aggtcacttcatgagcttcatcagg

SEQ ID NO: 24707 - DNA, 25 bp, Homo sapien
aggtcagaacccaaggctcaatttt

SEQ ID NO: 24708 - DNA, 25 bp, Homo sapien
aggtcagaacccgaggctcaatttt

SEQ ID NO: 24709 - DNA, 25 bp, Homo sapien
aggtcagaactagatgtagagattc

SEQ ID NO: 24710 - DNA, 25 bp, Homo sapien
aggtcagaagtagatgtagagattc

SEQ ID NO: 24711 - DNA, 25 bp, Homo sapien
aggtcagcaccatccgtgatgccat

SEQ ID NO: 24712 - DNA, 25 bp, Homo sapien
aggtcagcaccatctgtgatgccat

SEQ ID NO: 24713 - DNA, 25 bp, Homo sapien
aggtcagccacaaattagtcattaa

SEQ ID NO: 24714 - DNA, 25 bp, Homo sapien
aggtcagccacaatttagtcattaa

SEQ ID NO: 24715 - DNA, 25 bp, Homo sapien
aggtcagccgaagaagtagaagaaa

SEQ ID NO: 24716 - DNA, 25 bp, Homo sapien
aggtcagctgaagaagtagaagaaa

SEQ ID NO: 24717 - DNA, 25 bp, Homo sapien
aggtcagggaacggggtcacaatgt

SEQ ID NO: 24718 - DNA, 25 bp, Homo sapien
aggtcagggaatggggtcacaatgt

SEQ ID NO: 24719 - DNA, 25 bp, Homo sapien
aggtcaggtcctcaaacttggtcac

SEQ ID NO: 24720 - DNA, 25 bp, Homo sapien
aggtcaggtccttaaacttggtcac

SEQ ID NO: 24721 - DNA, 25 bp, Homo sapien
aggtcagtgagatgcgaactaaaag

SEQ ID NO: 24722 - DNA, 25 bp, Homo sapien
aggtcagtgagatgcggactaaaag

SEQ ID NO: 24723 - DNA, 25 bp, Homo sapien
aggtcagtttatggcatactggagt

SEQ ID NO: 24724 - DNA, 25 bp, Homo sapien
aggtcagtttatgtcatactggagt

SEQ ID NO: 24725 - DNA, 25 bp, Homo sapien
aggtcatttaactaccaggactaat

SEQ ID NO: 24726 - DNA, 25 bp, Homo sapien
aggtcatttaacttccaggactaat

SEQ ID NO: 24727 - DNA, 25 bp, Homo sapien
aggtcatttatttctcagcctgatg

SEQ ID NO: 24728 - DNA, 25 bp, Homo sapien
aggtcatttatttgtcagcctgatg

SEQ ID NO: 24729 - DNA, 25 bp, Homo sapien
aggtccagcagacagttgtgcaaac

SEQ ID NO: 24730 - DNA, 25 bp, Homo sapien
aggtccagcagctatcttgggccat

SEQ ID NO: 24731 - DNA, 25 bp, Homo sapien
aggtccagcagttatcttgggccat

SEQ ID NO: 24732 - DNA, 25 bp, Homo sapien
aggtccagcggacagttgtgcaaac

SEQ ID NO: 24733 - DNA, 25 bp, Homo sapien
aggtccataatatactcaacaagtg

SEQ ID NO: 24734 - DNA, 25 bp, Homo sapien
aggtccataatatattcaacaagtg

SEQ ID NO: 24735 - DNA, 25 bp, Homo sapien
aggtcccgaaatggcgactcatgcc

SEQ ID NO: 24736 - DNA, 25 bp, Homo sapien
aggtcccgaaatggtgactcatgcc

SEQ ID NO: 24737 - DNA, 25 bp, Homo sapien
aggtccctctgacaaactggtaaga

SEQ ID NO: 24738 - DNA, 25 bp, Homo sapien
aggtccctttgacaaactggtaaga

SEQ ID NO: 24739 - DNA, 25 bp, Homo sapien
aggtccgtaagtaaccctaaagaaa

SEQ ID NO: 24740 - DNA, 25 bp, Homo sapien
aggtccgtaagtaaccttaaagaaa

SEQ ID NO: 24741 - DNA, 25 bp, Homo sapien
aggtcctagtagaaggcgcttacca

SEQ ID NO: 24742 - DNA, 25 bp, Homo sapien
aggtcctagtagaaggtgcttacca

SEQ ID NO: 24743 - DNA, 25 bp, Homo sapien
aggtcctgcgagctgcggctgtttg

SEQ ID NO: 24744 - DNA, 25 bp, Homo sapien
aggtcctgtgagctgcggctgtttg

SEQ ID NO: 24745 - DNA, 25 bp, Homo sapien
aggtccttaacttcccggaggatct

SEQ ID NO: 24746 - DNA, 25 bp, Homo sapien
aggtccttaattcagagactcccca

SEQ ID NO: 24747 - DNA, 25 bp, Homo sapien
aggtccttagttcagagactcccca

SEQ ID NO: 24748 - DNA, 25 bp, Homo sapien
aggtcctttacttcccggaggatct

SEQ ID NO: 24749 - DNA, 25 bp, Homo sapien
aggtcgcagccttctctgtcttttc

SEQ ID NO: 24750 - DNA, 25 bp, Homo sapien
aggtcgcaggcttctctgtcttttc

SEQ ID NO: 24751 - DNA, 25 bp, Homo sapien
aggtctaaagggttctagtccaatt

SEQ ID NO: 24752 - DNA, 25 bp, Homo sapien
aggtctaaagggttctggtccaatt

SEQ ID NO: 24753 - DNA, 25 bp, Homo sapien
aggtctagctctctaaaaaaaaaga

SEQ ID NO: 24754 - DNA, 25 bp, Homo sapien
aggtctagctctctcaaaaaaaaga

SEQ ID NO: 24755 - DNA, 25 bp, Homo sapien
aggtctattttcataactagaagac

SEQ ID NO: 24756 - DNA, 25 bp, Homo sapien
aggtctattttcgtaactagaagac

SEQ ID NO: 24757 - DNA, 25 bp, Homo sapien
aggtctcacaaaatgtcagattttc

SEQ ID NO: 24758 - DNA, 25 bp, Homo sapien
aggtctcacgaaatgtcagattttc

SEQ ID NO: 24759 - DNA, 25 bp, Homo sapien
aggtctcatgaacccagccattcgt

SEQ ID NO: 24760 - DNA, 25 bp, Homo sapien
aggtctcatgaccccagccattcgt

SEQ ID NO: 24761 - DNA, 25 bp, Homo sapien
aggtctccttaccggcaagtgtttg

SEQ ID NO: 24762 - DNA, 25 bp, Homo sapien
aggtctccttactggcaagtgtttg

SEQ ID NO: 24763 - DNA, 25 bp, Homo sapien
aggtctctttttccatgaaatgcct

SEQ ID NO: 24764 - DNA, 25 bp, Homo sapien
aggtctctttttccgtgaaatgcct

SEQ ID NO: 24765 - DNA, 25 bp, Homo sapien
aggtctgataaaaagtttgttggat

SEQ ID NO: 24766 - DNA, 25 bp, Homo sapien
aggtctgataaaacgtttgttggat

SEQ ID NO: 24767 - DNA, 25 bp, Homo sapien
aggtctgatcccactattgaaataa

SEQ ID NO: 24768 - DNA, 25 bp, Homo sapien
aggtctgatcccgctattgaaataa

SEQ ID NO: 24769 - DNA, 25 bp, Homo sapien
aggtctgatttaactcacctttctc

SEQ ID NO: 24770 - DNA, 25 bp, Homo sapien
aggtctgatttgactcacctttctc

SEQ ID NO: 24771 - DNA, 25 bp, Homo sapien
aggtctgcagtagaggctgtgcatt

SEQ ID NO: 24772 - DNA, 25 bp, Homo sapien
aggtctgcggtagaggctgtgcatt

SEQ ID NO: 24773 - DNA, 25 bp, Homo sapien
aggtcttcaacattttaacctgcca

SEQ ID NO: 24774 - DNA, 25 bp, Homo sapien
aggtcttcagcattttaacctgcca

SEQ ID NO: 24775 - DNA, 25 bp, Homo sapien
aggtcttctctggaattatatcaaa

SEQ ID NO: 24776 - DNA, 25 bp, Homo sapien
aggtcttctttggaattatatcaaa

SEQ ID NO: 24777 - DNA, 25 bp, Homo sapien
aggtcttgaggatatctagaaaact

SEQ ID NO: 24778 - DNA, 25 bp, Homo sapien
aggtcttgcatctgccaccggccaa

SEQ ID NO: 24779 - DNA, 25 bp, Homo sapien
aggtcttgcattgctccctccaaaa

SEQ ID NO: 24780 - DNA, 25 bp, Homo sapien
aggtcttgcatttctccctccaaaa

SEQ ID NO: 24781 - DNA, 25 bp, Homo sapien
aggtcttgcctctaaagcccgctat

SEQ ID NO: 24782 - DNA, 25 bp, Homo sapien
aggtcttgcggatatctagaaaact

SEQ ID NO: 24783 - DNA, 25 bp, Homo sapien
aggtcttgtatctgccaccggccaa

SEQ ID NO: 24784 - DNA, 25 bp, Homo sapien
aggtcttgtctctaaagcccgctat

SEQ ID NO: 24785 - DNA, 25 bp, Homo sapien
aggtctttatgctactcattcctac

SEQ ID NO: 24786 - DNA, 25 bp, Homo sapien
aggtctttatgcttctcattcctac

SEQ ID NO: 24787 - DNA, 25 bp, Homo sapien
aggtctttcgtaccaaacattctat

SEQ ID NO: 24788 - DNA, 25 bp, Homo sapien
aggtctttggtaccaaacattctat

SEQ ID NO: 24789 - DNA, 25 bp, Homo sapien
aggtcttttagccatgaaagagaat

SEQ ID NO: 24790 - DNA, 25 bp, Homo sapien
aggtcttttagccatgtaagagaat

SEQ ID NO: 24791 - DNA, 25 bp, Homo sapien
aggtgaaaacttgtctaggtttcat

SEQ ID NO: 24792 - DNA, 25 bp, Homo sapien
aggtgaaaacttttctaggtttcat

SEQ ID NO: 24793 - DNA, 25 bp, Homo sapien
aggtgaaacagaaacagatcatcct

SEQ ID NO: 24794 - DNA, 25 bp, Homo sapien
aggtgaaaggtcagcaacctagaaa

SEQ ID NO: 24795 - DNA, 25 bp, Homo sapien
aggtgaaagtgacttgactttgccc

SEQ ID NO: 24796 - DNA, 25 bp, Homo sapien
aggtgaaatagaaacagatcatcct

SEQ ID NO: 24797 - DNA, 25 bp, Homo sapien
aggtgaaatgtcagcaacctagaaa

SEQ ID NO: 24798 - DNA, 25 bp, Homo sapien
aggtgaaattgacttgactttgccc

SEQ ID NO: 24799 - DNA, 25 bp, Homo sapien
aggtgaacgaaccctagctctgtct

SEQ ID NO: 24800 - DNA, 25 bp, Homo sapien
aggtgaactaaccctagctctgtct

SEQ ID NO: 24801 - DNA, 25 bp, Homo sapien
aggtgaagttgattccagatgttca

SEQ ID NO: 24802 - DNA, 25 bp, Homo sapien
aggtgaagttgatttcagatgttca

SEQ ID NO: 24803 - DNA, 25 bp, Homo sapien
aggtgacactgatcaccaaatcttg

SEQ ID NO: 24804 - DNA, 25 bp, Homo sapien
aggtgacactgattaccaaatcttg

SEQ ID NO: 24805 - DNA, 25 bp, Homo sapien
aggtgacatattcacagattcttgg

SEQ ID NO: 24806 - DNA, 25 bp, Homo sapien
aggtgacatattcgcagattcttgg

SEQ ID NO: 24807 - DNA, 25 bp, Homo sapien
aggtgaccactcctcgggaatagag

SEQ ID NO: 24808 - DNA, 25 bp, Homo sapien
aggtgaccagtcctcgggaatagag

SEQ ID NO: 24809 - DNA, 25 bp, Homo sapien
aggtgactgagtgtgcaagaatctg

SEQ ID NO: 24810 - DNA, 25 bp, Homo sapien
aggtgactgtgtgtgcaagaatctg

SEQ ID NO: 24811 - DNA, 25 bp, Homo sapien
aggtgacttttcggagaagattagg

SEQ ID NO: 24812 - DNA, 25 bp, Homo sapien
aggtgactttttggagaagattagg

SEQ ID NO: 24813 - DNA, 25 bp, Homo sapien
aggtgagaggtgccgtgtgtatata

SEQ ID NO: 24814 - DNA, 25 bp, Homo sapien
aggtgagaggtgctgtgtgtatata

SEQ ID NO: 24815 - DNA, 25 bp, Homo sapien
aggtgagcccttgctttgcccagtc

SEQ ID NO: 24816 - DNA, 25 bp, Homo sapien
aggtgagcccttgttttgcccagtc

SEQ ID NO: 24817 - DNA, 25 bp, Homo sapien
aggtgaggaagactatcttcttgcc

SEQ ID NO: 24818 - DNA, 25 bp, Homo sapien
aggtgaggaagactattttcttgcc

SEQ ID NO: 24819 - DNA, 25 bp, Homo sapien
aggtgaggcagatgacagtgtcctt

SEQ ID NO: 24820 - DNA, 25 bp, Homo sapien
aggtgaggcggatgacagtgtcctt

SEQ ID NO: 24821 - DNA, 25 bp, Homo sapien
aggtgagtagacacagagaaaatct

SEQ ID NO: 24822 - DNA, 25 bp, Homo sapien
aggtgagtagacgcagagaaaatct

SEQ ID NO: 24823 - DNA, 25 bp, Homo sapien
aggtgagtgaaatgataggctgccc

SEQ ID NO: 24824 - DNA, 25 bp, Homo sapien
aggtgagtggaatgataggctgccc

SEQ ID NO: 24825 - DNA, 25 bp, Homo sapien
aggtgatagaagaaaaagacatatg

SEQ ID NO: 24826 - DNA, 25 bp, Homo sapien
aggtgatagaaggaaaagacatatg

SEQ ID NO: 24827 - DNA, 25 bp, Homo sapien
aggtgatgctcaacaagccacttat

SEQ ID NO: 24828 - DNA, 25 bp, Homo sapien
aggtgatgctcaacaatccacttat

SEQ ID NO: 24829 - DNA, 25 bp, Homo sapien
aggtgattgacaaataaacttaatc

SEQ ID NO: 24830 - DNA, 25 bp, Homo sapien
aggtgattgacaagtaaacttaatc

SEQ ID NO: 24831 - DNA, 25 bp, Homo sapien
aggtgattgcttggcttcctcagaa

SEQ ID NO: 24832 - DNA, 25 bp, Homo sapien
aggtgattgggacgagcttttcaac

SEQ ID NO: 24833 - DNA, 25 bp, Homo sapien
aggtgattgggatgagcttttcaac

SEQ ID NO: 24834 - DNA, 25 bp, Homo sapien
aggtgatttcttggcttcctcagaa

SEQ ID NO: 24835 - DNA, 25 bp, Homo sapien
aggtgattttaaggcaggaggtcct

SEQ ID NO: 24836 - DNA, 25 bp, Homo sapien
aggtgattttaatgcaggaggtcct

SEQ ID NO: 24837 - DNA, 25 bp, Homo sapien
aggtgcaaaggacgatatttgggag

SEQ ID NO: 24838 - DNA, 25 bp, Homo sapien
aggtgcaaaggacgatgtttgggag

SEQ ID NO: 24839 - DNA, 25 bp, Homo sapien
aggtgcaactgaagatcatcgtgga

SEQ ID NO: 24840 - DNA, 25 bp, Homo sapien
aggtgcaatgataagttaacatcta

SEQ ID NO: 24841 - DNA, 25 bp, Homo sapien
aggtgcaattataagttaacatcta

SEQ ID NO: 24842 - DNA, 25 bp, Homo sapien
aggtgcaattgaagatcatcgtgga

SEQ ID NO: 24843 - DNA, 25 bp, Homo sapien
aggtgcattccattaaattcctcag

SEQ ID NO: 24844 - DNA, 25 bp, Homo sapien
aggtgcattccatttaattcctcag

SEQ ID NO: 24845 - DNA, 25 bp, Homo sapien
aggtgctccatcaatggtcactgtg

SEQ ID NO: 24846 - DNA, 25 bp, Homo sapien
aggtgctccatcagtggtcactgtg

SEQ ID NO: 24847 - DNA, 25 bp, Homo sapien
aggtgctcgtgaagattaaatgcat

SEQ ID NO: 24848 - DNA, 25 bp, Homo sapien
aggtgctcgtgaggattaaatgcat

SEQ ID NO: 24849 - DNA, 25 bp, Homo sapien
aggtgctgaccaagaacaggttaaa

SEQ ID NO: 24850 - DNA, 25 bp, Homo sapien
aggtgctgaccaaggacaggttaaa

SEQ ID NO: 24851 - DNA, 25 bp, Homo sapien
aggtgcttaatccgtttgggctact

SEQ ID NO: 24852 - DNA, 25 bp, Homo sapien
aggtgcttaatctgtttgggctact

SEQ ID NO: 24853 - DNA, 25 bp, Homo sapien
aggtgcttccgaaaggattcttact

SEQ ID NO: 24854 - DNA, 25 bp, Homo sapien
aggtgcttccgcaaggattcttact

SEQ ID NO: 24855 - DNA, 25 bp, Homo sapien
aggtgctttaggcattccctggttg

SEQ ID NO: 24856 - DNA, 25 bp, Homo sapien
aggtgctttaggccttccctggttg

SEQ ID NO: 24857 - DNA, 25 bp, Homo sapien
aggtggaagacattgagacgccttt

SEQ ID NO: 24858 - DNA, 25 bp, Homo sapien
aggtggaaggcattgagacgccttt

SEQ ID NO: 24859 - DNA, 25 bp, Homo sapien
aggtggacataatttaccctcagcc

SEQ ID NO: 24860 - DNA, 25 bp, Homo sapien
aggtggaccatcatgcatacccact

SEQ ID NO: 24861 - DNA, 25 bp, Homo sapien
aggtggacgtaatttaccctcagcc

SEQ ID NO: 24862 - DNA, 25 bp, Homo sapien
aggtggactatcatgcatacccact

SEQ ID NO: 24863 - DNA, 25 bp, Homo sapien
aggtggagctcaccgaatgttggat

SEQ ID NO: 24864 - DNA, 25 bp, Homo sapien
aggtggagctcagcgaatgttggat

SEQ ID NO: 24865 - DNA, 25 bp, Homo sapien
aggtggagtacagcctgggtatccc

SEQ ID NO: 24866 - DNA, 25 bp, Homo sapien
aggtggagtacggcctgggtatccc

SEQ ID NO: 24867 - DNA, 25 bp, Homo sapien
aggtggattgtctgtcactgaacac

SEQ ID NO: 24868 - DNA, 25 bp, Homo sapien
aggtggattttctgtcactgaacac

SEQ ID NO: 24869 - DNA, 25 bp, Homo sapien
aggtggcaatacagaagtagcccaa

SEQ ID NO: 24870 - DNA, 25 bp, Homo sapien
aggtggcaatatagaagtagcccaa

SEQ ID NO: 24871 - DNA, 25 bp, Homo sapien
aggtggcagatgtgaagtggccctt

SEQ ID NO: 24872 - DNA, 25 bp, Homo sapien
aggtggcagatttgaagtggccctt

SEQ ID NO: 24873 - DNA, 25 bp, Homo sapien
aggtgggcatagctaccgtgaaggg

SEQ ID NO: 24874 - DNA, 25 bp, Homo sapien
aggtgggcatagctactgtgaaggg

SEQ ID NO: 24875 - DNA, 25 bp, Homo sapien
aggtggtacaatataacaagaacca

SEQ ID NO: 24876 - DNA, 25 bp, Homo sapien
aggtggtacaatgtaacaagaacca

SEQ ID NO: 24877 - DNA, 25 bp, Homo sapien
aggtggtataacatctagttagagg

SEQ ID NO: 24878 - DNA, 25 bp, Homo sapien
aggtggtataatatctagttagagg

SEQ ID NO: 24879 - DNA, 25 bp, Homo sapien
aggtggtcattatcctgatttctaa

SEQ ID NO: 24880 - DNA, 25 bp, Homo sapien
aggtggtctttatcctgatttctaa

SEQ ID NO: 24881 - DNA, 25 bp, Homo sapien
aggtggtgcgtgcagtacatttttt

SEQ ID NO: 24882 - DNA, 25 bp, Homo sapien
aggtggtgcgtggagtacatttttt

SEQ ID NO: 24883 - DNA, 25 bp, Homo sapien
aggtggtgttctataaatattcatt

SEQ ID NO: 24884 - DNA, 25 bp, Homo sapien
aggtggtgttctgtaaatattcatt

SEQ ID NO: 24885 - DNA, 25 bp, Homo sapien
aggtggttcagcacagaaagaaaga

SEQ ID NO: 24886 - DNA, 25 bp, Homo sapien
aggtggttcagcacagcaagaaaga

SEQ ID NO: 24887 - DNA, 25 bp, Homo sapien
aggtggttgtccgagtgcccaaagg

SEQ ID NO: 24888 - DNA, 25 bp, Homo sapien
aggtggttgtctgagtgcccaaagg

SEQ ID NO: 24889 - DNA, 25 bp, Homo sapien
aggtgtacaaaacaatagaaaagtg

SEQ ID NO: 24890 - DNA, 25 bp, Homo sapien
aggtgtacaaaagaatagaaaagtg

SEQ ID NO: 24891 - DNA, 25 bp, Homo sapien
aggtgtagattaaaactgtgcagca

SEQ ID NO: 24892 - DNA, 25 bp, Homo sapien
aggtgtaggttaaaactgtgcagca

SEQ ID NO: 24893 - DNA, 25 bp, Homo sapien
aggtgtattagacaaacgagactta

SEQ ID NO: 24894 - DNA, 25 bp, Homo sapien
aggtgtattagaccaacgagactta

SEQ ID NO: 24895 - DNA, 25 bp, Homo sapien
aggtgtcagacatacattgcagcat

SEQ ID NO: 24896 - DNA, 25 bp, Homo sapien
aggtgtcagacatgcattgcagcat

SEQ ID NO: 24897 - DNA, 25 bp, Homo sapien
aggtgtgaactttgaaaatttgaca

SEQ ID NO: 24898 - DNA, 25 bp, Homo sapien
aggtgtgatctttgaaaatttgaca

SEQ ID NO: 24899 - DNA, 25 bp, Homo sapien
aggtgtggcccaaagtcccaatcta

SEQ ID NO: 24900 - DNA, 25 bp, Homo sapien
aggtgtggcccagagtcccaatcta

SEQ ID NO: 24901 - DNA, 25 bp, Homo sapien
aggtgtggctgaccatccaaaggaa

SEQ ID NO: 24902 - DNA, 25 bp, Homo sapien
aggtgtggctgagcatccaaaggaa

SEQ ID NO: 24903 - DNA, 25 bp, Homo sapien
aggtgtgtctcagtcgaatggccaa

SEQ ID NO: 24904 - DNA, 25 bp, Homo sapien
aggtgtgtctcagttgaatggccaa

SEQ ID NO: 24905 - DNA, 25 bp, Homo sapien
aggtgttcacgcctcactgccccac

SEQ ID NO: 24906 - DNA, 25 bp, Homo sapien
aggtgttcacgcctcattgccccac

SEQ ID NO: 24907 - DNA, 25 bp, Homo sapien
aggtgttcactagttcctatcctcc

SEQ ID NO: 24908 - DNA, 25 bp, Homo sapien
aggtgttcgctagttcctatcctcc

SEQ ID NO: 24909 - DNA, 25 bp, Homo sapien
aggtgttgaatacttgaagggaaca

SEQ ID NO: 24910 - DNA, 25 bp, Homo sapien
aggtgttgaatagttgaagggaaca

SEQ ID NO: 24911 - DNA, 25 bp, Homo sapien
aggtgtttttgcatagcttgtccca

SEQ ID NO: 24912 - DNA, 25 bp, Homo sapien
aggtgtttttgcgtagcttgtccca

SEQ ID NO: 24913 - DNA, 25 bp, Homo sapien
aggttaaactctgttaatatgttta

SEQ ID NO: 24914 - DNA, 25 bp, Homo sapien
aggttaaactcttttaatatgttta

SEQ ID NO: 24915 - DNA, 25 bp, Homo sapien
aggttaacaacaatactggaagctg

SEQ ID NO: 24916 - DNA, 25 bp, Homo sapien
aggttaacaacaatcctggaagctg

SEQ ID NO: 24917 - DNA, 25 bp, Homo sapien
aggttaagcaaacacaaataggttt

SEQ ID NO: 24918 - DNA, 25 bp, Homo sapien
aggttaagcaaacacagataggttt

SEQ ID NO: 24919 - DNA, 25 bp, Homo sapien
aggttacagataccaggtaccaggc

SEQ ID NO: 24920 - DNA, 25 bp, Homo sapien
aggttacagatatcaggtaccaggc

SEQ ID NO: 24921 - DNA, 25 bp, Homo sapien
aggttacattgaccaagttagaaag

SEQ ID NO: 24922 - DNA, 25 bp, Homo sapien
aggttacattgacccagttagaaag

SEQ ID NO: 24923 - DNA, 25 bp, Homo sapien
aggttacctaacaacataccattgc

SEQ ID NO: 24924 - DNA, 25 bp, Homo sapien
aggttacctaacatcataccattgc

SEQ ID NO: 24925 - DNA, 25 bp, Homo sapien
aggttactgagactatgtgagcttt

SEQ ID NO: 24926 - DNA, 25 bp, Homo sapien
aggttactgggactatgtgagcttt

SEQ ID NO: 24927 - DNA, 25 bp, Homo sapien
aggttacttcatggtctcaaatagc

SEQ ID NO: 24928 - DNA, 25 bp, Homo sapien
aggttacttcattgtctcaaatagc

SEQ ID NO: 24929 - DNA, 25 bp, Homo sapien
aggttagacaacagtgatgcaacac

SEQ ID NO: 24930 - DNA, 25 bp, Homo sapien
aggttagagaacagtgatgcaacac

SEQ ID NO: 24931 - DNA, 25 bp, Homo sapien
aggttagtgcatgagtaacaattcg

SEQ ID NO: 24932 - DNA, 25 bp, Homo sapien
aggttagtgtatgagtaacaattcg

SEQ ID NO: 24933 - DNA, 25 bp, Homo sapien
aggttatggcttcccttacataaga

SEQ ID NO: 24934 - DNA, 25 bp, Homo sapien
aggttatggctttccttacataaga

SEQ ID NO: 24935 - DNA, 25 bp, Homo sapien
aggttatgtcagtttatttggaagc

SEQ ID NO: 24936 - DNA, 25 bp, Homo sapien
aggttatgtgagtttatttggaagc

SEQ ID NO: 24937 - DNA, 25 bp, Homo sapien
aggttatttcccatggagcaaaatt

SEQ ID NO: 24938 - DNA, 25 bp, Homo sapien
aggttatttgaagaccaatctggca

SEQ ID NO: 24939 - DNA, 25 bp, Homo sapien
aggttatttgaaggccaatctggca

SEQ ID NO: 24940 - DNA, 25 bp, Homo sapien
aggttattttcaccctcctgtcaga

SEQ ID NO: 24941 - DNA, 25 bp, Homo sapien
aggttattttcactctcctgtcaga

SEQ ID NO: 24942 - DNA, 25 bp, Homo sapien
aggttattttccatggagcaaaatt

SEQ ID NO: 24943 - DNA, 25 bp, Homo sapien
aggttcacaggacgtcaaggctatt

SEQ ID NO: 24944 - DNA, 25 bp, Homo sapien
aggttcacaggatgtcaaggctatt

SEQ ID NO: 24945 - DNA, 25 bp, Homo sapien
aggttcacattgctttccactcatc

SEQ ID NO: 24946 - DNA, 25 bp, Homo sapien
aggttcacattgttttccactcatc

SEQ ID NO: 24947 - DNA, 25 bp, Homo sapien
aggttcagttgcgtttctgtgattt

SEQ ID NO: 24948 - DNA, 25 bp, Homo sapien
aggttcagttgcgtttttgtgattt

SEQ ID NO: 24949 - DNA, 25 bp, Homo sapien
aggttccaattctgcacaaatatga

SEQ ID NO: 24950 - DNA, 25 bp, Homo sapien
aggttccaattcttcacaaatatga

SEQ ID NO: 24951 - DNA, 25 bp, Homo sapien
aggttccagcccatgctgaggttcg

SEQ ID NO: 24952 - DNA, 25 bp, Homo sapien
aggttccagcccgtgctgaggttcg

SEQ ID NO: 24953 - DNA, 25 bp, Homo sapien
aggttcctcgtgccatcttcaggag

SEQ ID NO: 24954 - DNA, 25 bp, Homo sapien
aggttcctcgtgtcatcttcaggag

SEQ ID NO: 24955 - DNA, 25 bp, Homo sapien
aggttcctggtctttccggaggtac

SEQ ID NO: 24956 - DNA, 25 bp, Homo sapien
aggttcctggtctttctggaggtac

SEQ ID NO: 24957 - DNA, 25 bp, Homo sapien
aggttcgctgttattaatgtactcc

SEQ ID NO: 24958 - DNA, 25 bp, Homo sapien
aggttcgctgttattagtgtactcc

SEQ ID NO: 24959 - DNA, 25 bp, Homo sapien
aggttctaaagtacgaaaagatgta

SEQ ID NO: 24960 - DNA, 25 bp, Homo sapien
aggttctaaggtacgaaaagatgta

SEQ ID NO: 24961 - DNA, 25 bp, Homo sapien
aggttctcagtcacacctggcagac

SEQ ID NO: 24962 - DNA, 25 bp, Homo sapien
aggttctcagtcccacctggcagac

SEQ ID NO: 24963 - DNA, 25 bp, Homo sapien
aggttctccacagctgcctgcgacc

SEQ ID NO: 24964 - DNA, 25 bp, Homo sapien
aggttctccacggctgcctgcgacc

SEQ ID NO: 24965 - DNA, 25 bp, Homo sapien
aggttctgtagactctgcgtgtgtg

SEQ ID NO: 24966 - DNA, 25 bp, Homo sapien
aggttctgtagactgtgcgtgtgtg

SEQ ID NO: 24967 - DNA, 25 bp, Homo sapien
aggttcttactttattgcactgaag

SEQ ID NO: 24968 - DNA, 25 bp, Homo sapien
aggttcttattttattgcactgaag

SEQ ID NO: 24969 - DNA, 25 bp, Homo sapien
aggttcttctggacactagattaat

SEQ ID NO: 24970 - DNA, 25 bp, Homo sapien
aggttcttctgggcactagattaat

SEQ ID NO: 24971 - DNA, 25 bp, Homo sapien
aggttcttgccctatatgtgtgact

SEQ ID NO: 24972 - DNA, 25 bp, Homo sapien
aggttcttgccctgtatgtgtgact

SEQ ID NO: 24973 - DNA, 25 bp, Homo sapien
aggttctttctatcttcctgacaat

SEQ ID NO: 24974 - DNA, 25 bp, Homo sapien
aggttctttctgtcttcctgacaat

SEQ ID NO: 24975 - DNA, 25 bp, Homo sapien
aggttgaaactgcaatgagcgttga

SEQ ID NO: 24976 - DNA, 25 bp, Homo sapien
aggttgaaactgcagtgagcgttga

SEQ ID NO: 24977 - DNA, 25 bp, Homo sapien
aggttgaactgatgatgtggtttct

SEQ ID NO: 24978 - DNA, 25 bp, Homo sapien
aggttgaactgatgctgtggtttct

SEQ ID NO: 24979 - DNA, 25 bp, Homo sapien
aggttgactcttccacattctatgg

SEQ ID NO: 24980 - DNA, 25 bp, Homo sapien
aggttgactcttctacattctatgg

SEQ ID NO: 24981 - DNA, 25 bp, Homo sapien
aggttgagtaccgatactgggggtg

SEQ ID NO: 24982 - DNA, 25 bp, Homo sapien
aggttgagtacggatactgggggtg

SEQ ID NO: 24983 - DNA, 25 bp, Homo sapien
aggttgagtcagagattgcttctaa

SEQ ID NO: 24984 - DNA, 25 bp, Homo sapien
aggttgagtcagggattgcttctaa

SEQ ID NO: 24985 - DNA, 25 bp, Homo sapien
aggttgattgacagaaataagagtt

SEQ ID NO: 24986 - DNA, 25 bp, Homo sapien
aggttgattgatagaaataagagtt

SEQ ID NO: 24987 - DNA, 25 bp, Homo sapien
aggttgcaacagaagattgaaaaag

SEQ ID NO: 24988 - DNA, 25 bp, Homo sapien
aggttgcaatagaagattgaaaaag

SEQ ID NO: 24989 - DNA, 25 bp, Homo sapien
aggttgcaatagtacctagtcttgg

SEQ ID NO: 24990 - DNA, 25 bp, Homo sapien
aggttgcactgtcctccttggaagc

SEQ ID NO: 24991 - DNA, 25 bp, Homo sapien
aggttgcagtagtacctagtcttgg

SEQ ID NO: 24992 - DNA, 25 bp, Homo sapien
aggttgcagtgtcctccttggaagc

SEQ ID NO: 24993 - DNA, 25 bp, Homo sapien
aggttgccaagcgccacccttccat

SEQ ID NO: 24994 - DNA, 25 bp, Homo sapien
aggttgccaagtgccacccttccat

SEQ ID NO: 24995 - DNA, 25 bp, Homo sapien
aggttgccatctagccttcctcact

SEQ ID NO: 24996 - DNA, 25 bp, Homo sapien
aggttgccgtctagccttcctcact

SEQ ID NO: 24997 - DNA, 25 bp, Homo sapien
aggttggaagttgctatcttattgc

SEQ ID NO: 24998 - DNA, 25 bp, Homo sapien
aggttggaagttggtatcttattgc

SEQ ID NO: 24999 - DNA, 25 bp, Homo sapien
aggttgggcacatggcatcagcata

SEQ ID NO: 25000 - DNA, 25 bp, Homo sapien
aggttgggcacgtggcatcagcata

SEQ ID NO: 25001 - DNA, 25 bp, Homo sapien
aggttggggattagctctctcagga

SEQ ID NO: 25002 - DNA, 25 bp, Homo sapien
aggttggggattatctctctcagga

SEQ ID NO: 25003 - DNA, 25 bp, Homo sapien
aggttggttataagcaatgcatgaa

SEQ ID NO: 25004 - DNA, 25 bp, Homo sapien
aggttggttataggcaatgcatgaa

SEQ ID NO: 25005 - DNA, 25 bp, Homo sapien
aggttgtaattcgtatcactgcatt

SEQ ID NO: 25006 - DNA, 25 bp, Homo sapien
aggttgtaatttgtatcactgcatt

SEQ ID NO: 25007 - DNA, 25 bp, Homo sapien
aggttgtctcatcactgctaatgtc

SEQ ID NO: 25008 - DNA, 25 bp, Homo sapien
aggttgtctcatgactgctaatgtc

SEQ ID NO: 25009 - DNA, 25 bp, Homo sapien
aggttgtctcttcaatctgttggtt

SEQ ID NO: 25010 - DNA, 25 bp, Homo sapien
aggttgtctcttgaatctgttggtt

SEQ ID NO: 25011 - DNA, 25 bp, Homo sapien
aggttgtgcgtttaagaagactcat

SEQ ID NO: 25012 - DNA, 25 bp, Homo sapien
aggttgtgcgtttaatctttagcat

SEQ ID NO: 25013 - DNA, 25 bp, Homo sapien
aggttgtgtgtttaagaagactcat

SEQ ID NO: 25014 - DNA, 25 bp, Homo sapien
aggttgtgtgtttaatctttagcat

SEQ ID NO: 25015 - DNA, 25 bp, Homo sapien
aggttgttttgatacttaagtgtga

SEQ ID NO: 25016 - DNA, 25 bp, Homo sapien
aggttgttttggtacttaagtgtga

SEQ ID NO: 25017 - DNA, 25 bp, Homo sapien
aggtttaggaaagaaccatctgaga

SEQ ID NO: 25018 - DNA, 25 bp, Homo sapien
aggtttagggaagaaccatctgaga

SEQ ID NO: 25019 - DNA, 25 bp, Homo sapien
aggtttagttgttcaacatcatctc

SEQ ID NO: 25020 - DNA, 25 bp, Homo sapien
aggtttagttgttgaacatcatctc

SEQ ID NO: 25021 - DNA, 25 bp, Homo sapien
aggtttcctaattacttcaccaaaa

SEQ ID NO: 25022 - DNA, 25 bp, Homo sapien
aggtttcctaattatttcaccaaaa

SEQ ID NO: 25023 - DNA, 25 bp, Homo sapien
aggtttctgaatccataatggcatg

SEQ ID NO: 25024 - DNA, 25 bp, Homo sapien
aggtttctgaattcataatggcatg

SEQ ID NO: 25025 - DNA, 25 bp, Homo sapien
aggtttgaaagctgtagaaaagttt

SEQ ID NO: 25026 - DNA, 25 bp, Homo sapien
aggtttgaaagctgtataaaagttt

SEQ ID NO: 25027 - DNA, 25 bp, Homo sapien
aggtttgattccaaatgctctggaa

SEQ ID NO: 25028 - DNA, 25 bp, Homo sapien
aggtttgattccaagtgctctggaa

SEQ ID NO: 25029 - DNA, 25 bp, Homo sapien
aggtttgattttacgcaagaaacca

SEQ ID NO: 25030 - DNA, 25 bp, Homo sapien
aggtttgattttatgcaagaaacca

SEQ ID NO: 25031 - DNA, 25 bp, Homo sapien
aggtttgcagagactgcctttccat

SEQ ID NO: 25032 - DNA, 25 bp, Homo sapien
aggtttgcagaggctgcctttccat

SEQ ID NO: 25033 - DNA, 25 bp, Homo sapien
aggtttgccatactggagcaagtag

SEQ ID NO: 25034 - DNA, 25 bp, Homo sapien
aggtttgccatagtggagcaagtag

SEQ ID NO: 25035 - DNA, 25 bp, Homo sapien
aggtttgccctagagtaggtatcat

SEQ ID NO: 25036 - DNA, 25 bp, Homo sapien
aggtttgccctagcgtaggtatcat

SEQ ID NO: 25037 - DNA, 25 bp, Homo sapien
aggtttgctctaaatacacccaata

SEQ ID NO: 25038 - DNA, 25 bp, Homo sapien
aggtttgctgtaaatacacccaata

SEQ ID NO: 25039 - DNA, 25 bp, Homo sapien
aggtttggctacacagatgatggag

SEQ ID NO: 25040 - DNA, 25 bp, Homo sapien
aggtttgggtcattctgtcaggtaa

SEQ ID NO: 25041 - DNA, 25 bp, Homo sapien
aggtttgggtcgttctgtcaggtaa

SEQ ID NO: 25042 - DNA, 25 bp, Homo sapien
aggtttggttacacagatgatggag

SEQ ID NO: 25043 - DNA, 25 bp, Homo sapien
aggtttggtttacatgcagatgttt

SEQ ID NO: 25044 - DNA, 25 bp, Homo sapien
aggtttggtttacgtgcagatgttt

SEQ ID NO: 25045 - DNA, 25 bp, Homo sapien
aggttttcaggattccctggtattt

SEQ ID NO: 25046 - DNA, 25 bp, Homo sapien
aggttttcaggattccttggtattt

SEQ ID NO: 25047 - DNA, 25 bp, Homo sapien
aggttttcccagccatttccttggt

SEQ ID NO: 25048 - DNA, 25 bp, Homo sapien
aggttttcccagcgatttccttggt

SEQ ID NO: 25049 - DNA, 25 bp, Homo sapien
aggttttggcttctgagttcaggaa

SEQ ID NO: 25050 - DNA, 25 bp, Homo sapien
aggttttgggttctgagttcaggaa

SEQ ID NO: 25051 - DNA, 25 bp, Homo sapien
aggtttttgttacagcagtgcccca

SEQ ID NO: 25052 - DNA, 25 bp, Homo sapien
aggtttttgttagagcagtgcccca

SEQ ID NO: 25053 - DNA, 25 bp, Homo sapien
agtaaaaagagacaggtaaatcgaa

SEQ ID NO: 25054 - DNA, 25 bp, Homo sapien
agtaaaaagagacgggtaaatcgaa

SEQ ID NO: 25055 - DNA, 25 bp, Homo sapien
agtaaaacagttgtgcattaaatag

SEQ ID NO: 25056 - DNA, 25 bp, Homo sapien
agtaaaacagttgtgcgttaaatag

SEQ ID NO: 25057 - DNA, 25 bp, Homo sapien
agtaaaacattagagcaataaggtg

SEQ ID NO: 25058 - DNA, 25 bp, Homo sapien
agtaaaacattagggcaataaggtg

SEQ ID NO: 25059 - DNA, 25 bp, Homo sapien
agtaaacaacccattcaagacaatc

SEQ ID NO: 25060 - DNA, 25 bp, Homo sapien
agtaaacaacccgttcaagacaatc

SEQ ID NO: 25061 - DNA, 25 bp, Homo sapien
agtaaacacatgagtataaggcatg

SEQ ID NO: 25062 - DNA, 25 bp, Homo sapien
agtaaacagatgagtataaggcatg

SEQ ID NO: 25063 - DNA, 25 bp, Homo sapien
agtaaactctggccccagaacaacc

SEQ ID NO: 25064 - DNA, 25 bp, Homo sapien
agtaaactctgggcccagaacaacc

SEQ ID NO: 25065 - DNA, 25 bp, Homo sapien
agtaaagaatacgagtaaacataaa

SEQ ID NO: 25066 - DNA, 25 bp, Homo sapien
agtaaagaatatgagtaaacataaa

SEQ ID NO: 25067 - DNA, 25 bp, Homo sapien
agtaaagacacttttcgtaaggaat

SEQ ID NO: 25068 - DNA, 25 bp, Homo sapien
agtaaagacacttttcttaaggaat

SEQ ID NO: 25069 - DNA, 25 bp, Homo sapien
agtaaagatactaaccagccagaga

SEQ ID NO: 25070 - DNA, 25 bp, Homo sapien
agtaaagatgctaaccagccagaga

SEQ ID NO: 25071 - DNA, 25 bp, Homo sapien
agtaaagatgtaaaacagggaagcc

SEQ ID NO: 25072 - DNA, 25 bp, Homo sapien
agtaaagatgtcaaacagggaagcc

SEQ ID NO: 25073 - DNA, 25 bp, Homo sapien
agtaaagcacatttcacggaccgtg

SEQ ID NO: 25074 - DNA, 25 bp, Homo sapien
agtaaagcacatttcatggaccgtg

SEQ ID NO: 25075 - DNA, 25 bp, Homo sapien
agtaaaggtcagcagctgaggggga

SEQ ID NO: 25076 - DNA, 25 bp, Homo sapien
agtaaaggtgagcagctgaggggga

SEQ ID NO: 25077 - DNA, 25 bp, Homo sapien
agtaaagtatatttagctcatttcc

SEQ ID NO: 25078 - DNA, 25 bp, Homo sapien
agtaaagtatatttagttcatttcc

SEQ ID NO: 25079 - DNA, 25 bp, Homo sapien
agtaaagttagaggaaatttcagct

SEQ ID NO: 25080 - DNA, 25 bp, Homo sapien
agtaaagttagaggcaatttcagct

SEQ ID NO: 25081 - DNA, 25 bp, Homo sapien
agtaaataagtatcttgttgagtaa

SEQ ID NO: 25082 - DNA, 25 bp, Homo sapien
agtaaatacaaataccctaagccaa

SEQ ID NO: 25083 - DNA, 25 bp, Homo sapien
agtaaataccaataccctaagccaa

SEQ ID NO: 25084 - DNA, 25 bp, Homo sapien
agtaaataccgagcgtaaaaaatga

SEQ ID NO: 25085 - DNA, 25 bp, Homo sapien
agtaaataccgagtgtaaaaaatga

SEQ ID NO: 25086 - DNA, 25 bp, Homo sapien
agtaaatatgtatcttgttgagtaa

SEQ ID NO: 25087 - DNA, 25 bp, Homo sapien
agtaaatgcagcgagaagaatgagt

SEQ ID NO: 25088 - DNA, 25 bp, Homo sapien
agtaaatgcagtgagaagaatgagt

SEQ ID NO: 25089 - DNA, 25 bp, Homo sapien
agtaaatgtcatcttgagtgttaat

SEQ ID NO: 25090 - DNA, 25 bp, Homo sapien
agtaaatgtcattttgagtgttaat

SEQ ID NO: 25091 - DNA, 25 bp, Homo sapien
agtaaatgtgcaaaagagacaggtg

SEQ ID NO: 25092 - DNA, 25 bp, Homo sapien
agtaaatgtgcgaaagagacaggtg

SEQ ID NO: 25093 - DNA, 25 bp, Homo sapien
agtaaattcacctgttcttagaagg

SEQ ID NO: 25094 - DNA, 25 bp, Homo sapien
agtaaattcacttgttcttagaagg

SEQ ID NO: 25095 - DNA, 25 bp, Homo sapien
agtaacaaacctcaaattttcaaag

SEQ ID NO: 25096 - DNA, 25 bp, Homo sapien
agtaacaaacctcatattttcaaag

SEQ ID NO: 25097 - DNA, 25 bp, Homo sapien
agtaacacaaagatcaatggatgtt

SEQ ID NO: 25098 - DNA, 25 bp, Homo sapien
agtaacacaaagttcaatggatgtt

SEQ ID NO: 25099 - DNA, 25 bp, Homo sapien
agtaacactcctaacacggcaagaa

SEQ ID NO: 25100 - DNA, 25 bp, Homo sapien
agtaacactcctaacatggcaagaa

SEQ ID NO: 25101 - DNA, 25 bp, Homo sapien
agtaacactgcataattgacctgat

SEQ ID NO: 25102 - DNA, 25 bp, Homo sapien
agtaacactgcatagttgacctgat

SEQ ID NO: 25103 - DNA, 25 bp, Homo sapien
agtaacacttatagtaaacattttc

SEQ ID NO: 25104 - DNA, 25 bp, Homo sapien
agtaacacttatattaaacattttc

SEQ ID NO: 25105 - DNA, 25 bp, Homo sapien
agtaacagcctgaaagaacacagaa

SEQ ID NO: 25106 - DNA, 25 bp, Homo sapien
agtaacaggctgaaagaacacagaa

SEQ ID NO: 25107 - DNA, 25 bp, Homo sapien
agtaacagtcacaacagcattttac

SEQ ID NO: 25108 - DNA, 25 bp, Homo sapien
agtaacagttacaacagcattttac

SEQ ID NO: 25109 - DNA, 25 bp, Homo sapien
agtaaccaaaaacaggtatgaacac

SEQ ID NO: 25110 - DNA, 25 bp, Homo sapien
agtaaccaaaaccaggtatgaacac

SEQ ID NO: 25111 - DNA, 25 bp, Homo sapien
agtaacctaccactgaagccaaaat

SEQ ID NO: 25112 - DNA, 25 bp, Homo sapien
agtaacctaccattgaagccaaaat

SEQ ID NO: 25113 - DNA, 25 bp, Homo sapien
agtaacgtttgcatggaacagtctc

SEQ ID NO: 25114 - DNA, 25 bp, Homo sapien
agtaacgtttgcatgggacagtctc

SEQ ID NO: 25115 - DNA, 25 bp, Homo sapien
agtaactacaaatataatgcttatt

SEQ ID NO: 25116 - DNA, 25 bp, Homo sapien
agtaactacaagtataatgcttatt

SEQ ID NO: 25117 - DNA, 25 bp, Homo sapien
agtaactctctaaagtctctggaga

SEQ ID NO: 25118 - DNA, 25 bp, Homo sapien
agtaactctctgaagtctctggaga

SEQ ID NO: 25119 - DNA, 25 bp, Homo sapien
agtaactgcgtgtgactaatggctc

SEQ ID NO: 25120 - DNA, 25 bp, Homo sapien
agtaactgtgtgtgactaatggctc

SEQ ID NO: 25121 - DNA, 25 bp, Homo sapien
agtaactgttgagactaaggtttag

SEQ ID NO: 25122 - DNA, 25 bp, Homo sapien
agtaactgttgggactaaggtttag

SEQ ID NO: 25123 - DNA, 25 bp, Homo sapien
agtaacttcctataagctgaaagta

SEQ ID NO: 25124 - DNA, 25 bp, Homo sapien
agtaacttcctgtaagctgaaagta

SEQ ID NO: 25125 - DNA, 25 bp, Homo sapien
agtaagaaaaaagtaggaattttaa

SEQ ID NO: 25126 - DNA, 25 bp, Homo sapien
agtaagaaacaacataatgaagact

SEQ ID NO: 25127 - DNA, 25 bp, Homo sapien
agtaagaaataacataatgaagact

SEQ ID NO: 25128 - DNA, 25 bp, Homo sapien
agtaagaagaaagtaggaattttaa

SEQ ID NO: 25129 - DNA, 25 bp, Homo sapien
agtaagactgtaccattcatcatta

SEQ ID NO: 25130 - DNA, 25 bp, Homo sapien
agtaagactttaccattcatcatta

SEQ ID NO: 25131 - DNA, 25 bp, Homo sapien
agtaagaggatgccaaaaatgactc

SEQ ID NO: 25132 - DNA, 25 bp, Homo sapien
agtaagagggtgccaaaaatgactc

SEQ ID NO: 25133 - DNA, 25 bp, Homo sapien
agtaagattttcaaggcagaatgag

SEQ ID NO: 25134 - DNA, 25 bp, Homo sapien
agtaagattttcagggcagaatgag

SEQ ID NO: 25135 - DNA, 25 bp, Homo sapien
agtaagcataacgcaaatcgatgca

SEQ ID NO: 25136 - DNA, 25 bp, Homo sapien
agtaagcataatgcaaatcgatgca

SEQ ID NO: 25137 - DNA, 25 bp, Homo sapien
agtaaggtcacaggaaaagatgtca

SEQ ID NO: 25138 - DNA, 25 bp, Homo sapien
agtaaggtcaccggaaaagatgtca

SEQ ID NO: 25139 - DNA, 25 bp, Homo sapien
agtaaggtcactccagaaagttaaa

SEQ ID NO: 25140 - DNA, 25 bp, Homo sapien
agtaaggtgactccagaaagttaaa

SEQ ID NO: 25141 - DNA, 25 bp, Homo sapien
agtaagtaaaaaataatctgggcat

SEQ ID NO: 25142 - DNA, 25 bp, Homo sapien
agtaagtaaaatataatctgggcat

SEQ ID NO: 25143 - DNA, 25 bp, Homo sapien
agtaagtcattcatttggacaatag

SEQ ID NO: 25144 - DNA, 25 bp, Homo sapien
agtaagtcatttatttggacaatag

SEQ ID NO: 25145 - DNA, 25 bp, Homo sapien
agtaagtgaacacaataatagccaa

SEQ ID NO: 25146 - DNA, 25 bp, Homo sapien
agtaagtgaacagaataatagccaa

SEQ ID NO: 25147 - DNA, 25 bp, Homo sapien
agtaagtgctcaaagatatttcctg

SEQ ID NO: 25148 - DNA, 25 bp, Homo sapien
agtaagtgctcagagatatttcctg

SEQ ID NO: 25149 - DNA, 25 bp, Homo sapien
agtaagttcaaatcccagtggcatc

SEQ ID NO: 25150 - DNA, 25 bp, Homo sapien
agtaagttcaaatcccggtggcatc

SEQ ID NO: 25151 - DNA, 25 bp, Homo sapien
agtaagttgaaccacttttgcatca

SEQ ID NO: 25152 - DNA, 25 bp, Homo sapien
agtaagttgaaccatttttgcatca

SEQ ID NO: 25153 - DNA, 25 bp, Homo sapien
agtaataaaaccaagacttgaaccc

SEQ ID NO: 25154 - DNA, 25 bp, Homo sapien
agtaataaaaccgagacttgaaccc

SEQ ID NO: 25155 - DNA, 25 bp, Homo sapien
agtaataaatttggcggacataggc

SEQ ID NO: 25156 - DNA, 25 bp, Homo sapien
agtaataaatttggtggacataggc

SEQ ID NO: 25157 - DNA, 25 bp, Homo sapien
agtaataactaacacaccggaacgc

SEQ ID NO: 25158 - DNA, 25 bp, Homo sapien
agtaataactaacataccggaacgc

SEQ ID NO: 25159 - DNA, 25 bp, Homo sapien
agtaataagagtcacaaccactatt

SEQ ID NO: 25160 - DNA, 25 bp, Homo sapien
agtaataagagtgacaaccactatt

SEQ ID NO: 25161 - DNA, 25 bp, Homo sapien
agtaataatagcccttgagatcaga

SEQ ID NO: 25162 - DNA, 25 bp, Homo sapien
agtaataattgcccttgagatcaga

SEQ ID NO: 25163 - DNA, 25 bp, Homo sapien
agtaataccaacgatggggagtggc

SEQ ID NO: 25164 - DNA, 25 bp, Homo sapien
agtaataccaatgatggggagtggc

SEQ ID NO: 25165 - DNA, 25 bp, Homo sapien
agtaatattaagaggctttatacac

SEQ ID NO: 25166 - DNA, 25 bp, Homo sapien
agtaatattaagatgctttatacac

SEQ ID NO: 25167 - DNA, 25 bp, Homo sapien
agtaatattgcccttgctccaaaat

SEQ ID NO: 25168 - DNA, 25 bp, Homo sapien
agtaatattgcctttgctccaaaat

SEQ ID NO: 25169 - DNA, 25 bp, Homo sapien
agtaatcaaacagttgataaaagaa

SEQ ID NO: 25170 - DNA, 25 bp, Homo sapien
agtaatcaattttatgtatatgtta

SEQ ID NO: 25171 - DNA, 25 bp, Homo sapien
agtaatcagacagttgataaaagaa

SEQ ID NO: 25172 - DNA, 25 bp, Homo sapien
agtaatcatttttatgtatatgtta

SEQ ID NO: 25173 - DNA, 25 bp, Homo sapien
agtaatctgttacgctctgtatgta

SEQ ID NO: 25174 - DNA, 25 bp, Homo sapien
agtaatcttttacgctctgtatgta

SEQ ID NO: 25175 - DNA, 25 bp, Homo sapien
agtaatgaccacaatgcagtctgtt

SEQ ID NO: 25176 - DNA, 25 bp, Homo sapien
agtaatgaccacagtgcagtctgtt

SEQ ID NO: 25177 - DNA, 25 bp, Homo sapien
agtaatgactgcgctttggccccca

SEQ ID NO: 25178 - DNA, 25 bp, Homo sapien
agtaatgactgtgctttggccccca

SEQ ID NO: 25179 - DNA, 25 bp, Homo sapien
agtaatgcaaaggcgtaatgtggct

SEQ ID NO: 25180 - DNA, 25 bp, Homo sapien
agtaatgcaaaggtgtaatgtggct

SEQ ID NO: 25181 - DNA, 25 bp, Homo sapien
agtaatgccaacgttctgttagcaa

SEQ ID NO: 25182 - DNA, 25 bp, Homo sapien
agtaatgccaaggttctgttagcaa

SEQ ID NO: 25183 - DNA, 25 bp, Homo sapien
agtaatggtaaaatagctcctttgc

SEQ ID NO: 25184 - DNA, 25 bp, Homo sapien
agtaatggtaaagtagctcctttgc

SEQ ID NO: 25185 - DNA, 25 bp, Homo sapien
agtaatgtccaagtaatcaacatga

SEQ ID NO: 25186 - DNA, 25 bp, Homo sapien
agtaatgtccacgtaatcaacatga

SEQ ID NO: 25187 - DNA, 25 bp, Homo sapien
agtaatgtccttcatagtgaaaaga

SEQ ID NO: 25188 - DNA, 25 bp, Homo sapien
agtaatgtcctttatagtgaaaaga

SEQ ID NO: 25189 - DNA, 25 bp, Homo sapien
agtaattaatcactcccgccactgt

SEQ ID NO: 25190 - DNA, 25 bp, Homo sapien
agtaattaatcattcccgccactgt

SEQ ID NO: 25191 - DNA, 25 bp, Homo sapien
agtaattattatctccaaaccaata

SEQ ID NO: 25192 - DNA, 25 bp, Homo sapien
agtaattattatttccaaaccaata

SEQ ID NO: 25193 - DNA, 25 bp, Homo sapien
agtaattatttataggaatccaaaa

SEQ ID NO: 25194 - DNA, 25 bp, Homo sapien
agtaattatttgtaggaatccaaaa

SEQ ID NO: 25195 - DNA, 25 bp, Homo sapien
agtaattcaatggaaacataccttc

SEQ ID NO: 25196 - DNA, 25 bp, Homo sapien
agtaattcagtggaaacataccttc

SEQ ID NO: 25197 - DNA, 25 bp, Homo sapien
agtaattcatcattaccaaattcca

SEQ ID NO: 25198 - DNA, 25 bp, Homo sapien
agtaattcatcattgccaaattcca

SEQ ID NO: 25199 - DNA, 25 bp, Homo sapien
agtaatttacccaacatcacatagc

SEQ ID NO: 25200 - DNA, 25 bp, Homo sapien
agtaatttacccatcatcacatagc

SEQ ID NO: 25201 - DNA, 25 bp, Homo sapien
agtacaaaaagccatgttaaaaaat

SEQ ID NO: 25202 - DNA, 25 bp, Homo sapien
agtacaaaaaggcatgttaaaaaat

SEQ ID NO: 25203 - DNA, 25 bp, Homo sapien
agtacaaaatagtctctgaaactaa

SEQ ID NO: 25204 - DNA, 25 bp, Homo sapien
agtacaaactagtctctgaaactaa

SEQ ID NO: 25205 - DNA, 25 bp, Homo sapien
agtacaaactatctacagcagtttt

SEQ ID NO: 25206 - DNA, 25 bp, Homo sapien
agtacaaattatctacagcagtttt

SEQ ID NO: 25207 - DNA, 25 bp, Homo sapien
agtacaaattgtggttcttgaattg

SEQ ID NO: 25208 - DNA, 25 bp, Homo sapien
agtacaaattgtggttgttgaattg

SEQ ID NO: 25209 - DNA, 25 bp, Homo sapien
agtacaataatgtcggagtctaaaa

SEQ ID NO: 25210 - DNA, 25 bp, Homo sapien
agtacaattatgtcggagtctaaaa

SEQ ID NO: 25211 - DNA, 25 bp, Homo sapien
agtacacacgaaaggaaaaatgtaa

SEQ ID NO: 25212 - DNA, 25 bp, Homo sapien
agtacacacgaaaggataaatgtaa

SEQ ID NO: 25213 - DNA, 25 bp, Homo sapien
agtacacacggtaaagtttgagaag

SEQ ID NO: 25214 - DNA, 25 bp, Homo sapien
agtacacacggtcaagtttgagaag

SEQ ID NO: 25215 - DNA, 25 bp, Homo sapien
agtacagaactctttaattatacca

SEQ ID NO: 25216 - DNA, 25 bp, Homo sapien
agtacagaattctttaattatacca

SEQ ID NO: 25217 - DNA, 25 bp, Homo sapien
agtacagacctaccaagtgcttaag

SEQ ID NO: 25218 - DNA, 25 bp, Homo sapien
agtacagagaagcagaagataaaaa

SEQ ID NO: 25219 - DNA, 25 bp, Homo sapien
agtacagagaagcggaagataaaaa

SEQ ID NO: 25220 - DNA, 25 bp, Homo sapien
agtacagatctaccaagtgcttaag

SEQ ID NO: 25221 - DNA, 25 bp, Homo sapien
agtacagcacattcccaatggtgtc

SEQ ID NO: 25222 - DNA, 25 bp, Homo sapien
agtacagcacattcccgatggtgtc

SEQ ID NO: 25223 - DNA, 25 bp, Homo sapien
agtacagccttgctgacagcttgat

SEQ ID NO: 25224 - DNA, 25 bp, Homo sapien
agtacagccttgttgacagcttgat

SEQ ID NO: 25225 - DNA, 25 bp, Homo sapien
agtacagtctaggagagaactatgc

SEQ ID NO: 25226 - DNA, 25 bp, Homo sapien
agtacagtgcttacaggcagtttct

SEQ ID NO: 25227 - DNA, 25 bp, Homo sapien
agtacagtgcttataggcagtttct

SEQ ID NO: 25228 - DNA, 25 bp, Homo sapien
agtacagtgtaggagagaactatgc

SEQ ID NO: 25229 - DNA, 25 bp, Homo sapien
agtacataggttaatgacaagtgga

SEQ ID NO: 25230 - DNA, 25 bp, Homo sapien
agtacatagtttaatgacaagtgga

SEQ ID NO: 25231 - DNA, 25 bp, Homo sapien
agtacatgataacgcgatttcaaaa

SEQ ID NO: 25232 - DNA, 25 bp, Homo sapien
agtacatgatatcgcgatttcaaaa

SEQ ID NO: 25233 - DNA, 25 bp, Homo sapien
agtaccattttcacataaagcatgc

SEQ ID NO: 25234 - DNA, 25 bp, Homo sapien
agtaccattttcatataaagcatgc

SEQ ID NO: 25235 - DNA, 25 bp, Homo sapien
agtacccaattcactacccatcttc

SEQ ID NO: 25236 - DNA, 25 bp, Homo sapien
agtacccagttcactacccatcttc

SEQ ID NO: 25237 - DNA, 25 bp, Homo sapien
agtacctcacgcattatgactgtcc

SEQ ID NO: 25238 - DNA, 25 bp, Homo sapien
agtacctcgcgcattatgactgtcc

SEQ ID NO: 25239 - DNA, 25 bp, Homo sapien
agtacctgaatcatacaattacaac

SEQ ID NO: 25240 - DNA, 25 bp, Homo sapien
agtacctgatgtaccagcagccaga

SEQ ID NO: 25241 - DNA, 25 bp, Homo sapien
agtacctgcatcatacaattacaac

SEQ ID NO: 25242 - DNA, 25 bp, Homo sapien
agtacctgttgtaccagcagccaga

SEQ ID NO: 25243 - DNA, 25 bp, Homo sapien
agtaccttctcaataacacatgcca

SEQ ID NO: 25244 - DNA, 25 bp, Homo sapien
agtaccttgtcaataacacatgcca

SEQ ID NO: 25245 - DNA, 25 bp, Homo sapien
agtactacctcagccacagtacaat

SEQ ID NO: 25246 - DNA, 25 bp, Homo sapien
agtactacttcagccacagtacaat

SEQ ID NO: 25247 - DNA, 25 bp, Homo sapien
agtactaggtacctgtcctgagcat

SEQ ID NO: 25248 - DNA, 25 bp, Homo sapien
agtactaggtacgtgtcctgagcat

SEQ ID NO: 25249 - DNA, 25 bp, Homo sapien
agtactatggtgtaatactagatcc

SEQ ID NO: 25250 - DNA, 25 bp, Homo sapien
agtactatggtgtgatactagatcc

SEQ ID NO: 25251 - DNA, 25 bp, Homo sapien
agtactattccggtattctagctac

SEQ ID NO: 25252 - DNA, 25 bp, Homo sapien
agtactattcctgtattctagctac

SEQ ID NO: 25253 - DNA, 25 bp, Homo sapien
agtactatttgcttaaaaaggaatg

SEQ ID NO: 25254 - DNA, 25 bp, Homo sapien
agtactatttgcttgaaaaggaatg

SEQ ID NO: 25255 - DNA, 25 bp, Homo sapien
agtactggtctccttgcgtaattga

SEQ ID NO: 25256 - DNA, 25 bp, Homo sapien
agtactggtctccttgtgtaattga

SEQ ID NO: 25257 - DNA, 25 bp, Homo sapien
agtacttacagcagttacacagtag

SEQ ID NO: 25258 - DNA, 25 bp, Homo sapien
agtacttacagcggttacacagtag

SEQ ID NO: 25259 - DNA, 25 bp, Homo sapien
agtacttgtcactcaagtaatgcct

SEQ ID NO: 25260 - DNA, 25 bp, Homo sapien
agtacttgtcacttaagtaatgcct

SEQ ID NO: 25261 - DNA, 25 bp, Homo sapien
agtactttacagccttcctacagca

SEQ ID NO: 25262 - DNA, 25 bp, Homo sapien
agtacttttcagccttcctacagca

SEQ ID NO: 25263 - DNA, 25 bp, Homo sapien
agtagaaaatactgcaattactgat

SEQ ID NO: 25264 - DNA, 25 bp, Homo sapien
agtagaaaatactgcagttactgat

SEQ ID NO: 25265 - DNA, 25 bp, Homo sapien
agtagaaatttcagaaagagaacca

SEQ ID NO: 25266 - DNA, 25 bp, Homo sapien
agtagaaatttcagaaggagaacca

SEQ ID NO: 25267 - DNA, 25 bp, Homo sapien
agtagaagctgcagaaaacacatag

SEQ ID NO: 25268 - DNA, 25 bp, Homo sapien
agtagaagctgcagcaaacacatag

SEQ ID NO: 25269 - DNA, 25 bp, Homo sapien
agtagaatgagagatggcattgcac

SEQ ID NO: 25270 - DNA, 25 bp, Homo sapien
agtagaattagagatggcattgcac

SEQ ID NO: 25271 - DNA, 25 bp, Homo sapien
agtagacactaagaaaatggagtcg

SEQ ID NO: 25272 - DNA, 25 bp, Homo sapien
agtagacagtaagaaaatggagtcg

SEQ ID NO: 25273 - DNA, 25 bp, Homo sapien
agtagacatgaccgtgacagttaaa

SEQ ID NO: 25274 - DNA, 25 bp, Homo sapien
agtagacatgactgtgacagttaaa

SEQ ID NO: 25275 - DNA, 25 bp, Homo sapien
agtagactgagcatgtggaaataag

SEQ ID NO: 25276 - DNA, 25 bp, Homo sapien
agtagactgagcgtgtggaaataag

SEQ ID NO: 25277 - DNA, 25 bp, Homo sapien
agtagagacgaaaaagtagtaagct

SEQ ID NO: 25278 - DNA, 25 bp, Homo sapien
agtagagagagaactccagcaaggt

SEQ ID NO: 25279 - DNA, 25 bp, Homo sapien
agtagagagagaactctagcaaggt

SEQ ID NO: 25280 - DNA, 25 bp, Homo sapien
agtagagagtcatcagtaacctcag

SEQ ID NO: 25281 - DNA, 25 bp, Homo sapien
agtagagagtcattagtaacctcag

SEQ ID NO: 25282 - DNA, 25 bp, Homo sapien
agtagagatgaaaaagtagtaagct

SEQ ID NO: 25283 - DNA, 25 bp, Homo sapien
agtagaggacagctgaaccaaggcc

SEQ ID NO: 25284 - DNA, 25 bp, Homo sapien
agtagaggagtagtgactgaagatt

SEQ ID NO: 25285 - DNA, 25 bp, Homo sapien
agtagaggagtagtgagtgaagatt

SEQ ID NO: 25286 - DNA, 25 bp, Homo sapien
agtagaggctagggtcctccattta

SEQ ID NO: 25287 - DNA, 25 bp, Homo sapien
agtagaggctagtgtcctccattta

SEQ ID NO: 25288 - DNA, 25 bp, Homo sapien
agtagagggcagctgaaccaaggcc

SEQ ID NO: 25289 - DNA, 25 bp, Homo sapien
agtagagtccatcaggctcattctt

SEQ ID NO: 25290 - DNA, 25 bp, Homo sapien
agtagagtccatccggctcattctt

SEQ ID NO: 25291 - DNA, 25 bp, Homo sapien
agtagatactcacatattgaataga

SEQ ID NO: 25292 - DNA, 25 bp, Homo sapien
agtagatactcatatattgaataga

SEQ ID NO: 25293 - DNA, 25 bp, Homo sapien
agtagatgactcccctttcttctta

SEQ ID NO: 25294 - DNA, 25 bp, Homo sapien
agtagatgactctcctttcttctta

SEQ ID NO: 25295 - DNA, 25 bp, Homo sapien
agtagattcccagatccagggctgc

SEQ ID NO: 25296 - DNA, 25 bp, Homo sapien
agtagattcccaggtccagggctgc

SEQ ID NO: 25297 - DNA, 25 bp, Homo sapien
agtagattgctgaaaaatattccac

SEQ ID NO: 25298 - DNA, 25 bp, Homo sapien
agtagattgtgccaccagctgcacc

SEQ ID NO: 25299 - DNA, 25 bp, Homo sapien
agtagattgtgccgccagctgcacc

SEQ ID NO: 25300 - DNA, 25 bp, Homo sapien
agtagattgttgaaaaatattccac

SEQ ID NO: 25301 - DNA, 25 bp, Homo sapien
agtagcaaccactgcattgtatttt

SEQ ID NO: 25302 - DNA, 25 bp, Homo sapien
agtagcaaccattgcattgtatttt

SEQ ID NO: 25303 - DNA, 25 bp, Homo sapien
agtagcaaggactccataggaatta

SEQ ID NO: 25304 - DNA, 25 bp, Homo sapien
agtagcaaggactctataggaatta

SEQ ID NO: 25305 - DNA, 25 bp, Homo sapien
agtagcacactcaaatgaggaaggt

SEQ ID NO: 25306 - DNA, 25 bp, Homo sapien
agtagcacacttaaatgaggaaggt

SEQ ID NO: 25307 - DNA, 25 bp, Homo sapien
agtagcacatgactttgaaaggaca

SEQ ID NO: 25308 - DNA, 25 bp, Homo sapien
agtagcacgtgactttgaaaggaca

SEQ ID NO: 25309 - DNA, 25 bp, Homo sapien
agtagcagagagtggtatgtgaatc

SEQ ID NO: 25310 - DNA, 25 bp, Homo sapien
agtagcagagagtggtgtgtgaatc

SEQ ID NO: 25311 - DNA, 25 bp, Homo sapien
agtagcagtttatatacaggcttat

SEQ ID NO: 25312 - DNA, 25 bp, Homo sapien
agtagcagtttatatataggcttat

SEQ ID NO: 25313 - DNA, 25 bp, Homo sapien
agtagcatatgattctaataatgaa

SEQ ID NO: 25314 - DNA, 25 bp, Homo sapien
agtagcatgtgattctaataatgaa

SEQ ID NO: 25315 - DNA, 25 bp, Homo sapien
agtagcattcccagagtgacagaag

SEQ ID NO: 25316 - DNA, 25 bp, Homo sapien
agtagcattctaaagaataaagtca

SEQ ID NO: 25317 - DNA, 25 bp, Homo sapien
agtagcattctaaagagtaaagtca

SEQ ID NO: 25318 - DNA, 25 bp, Homo sapien
agtagcatttccagagtgacagaag

SEQ ID NO: 25319 - DNA, 25 bp, Homo sapien
agtagccactagatatcagccctcc

SEQ ID NO: 25320 - DNA, 25 bp, Homo sapien
agtagccagggacatttgtctttct

SEQ ID NO: 25321 - DNA, 25 bp, Homo sapien
agtagccagggatatttgtctttct

SEQ ID NO: 25322 - DNA, 25 bp, Homo sapien
agtagccattagatatcagccctcc

SEQ ID NO: 25323 - DNA, 25 bp, Homo sapien
agtagcctatttcctctaaataaca

SEQ ID NO: 25324 - DNA, 25 bp, Homo sapien
agtagcctcatccacagggtgttgt

SEQ ID NO: 25325 - DNA, 25 bp, Homo sapien
agtagcctgtttcctctaaataaca

SEQ ID NO: 25326 - DNA, 25 bp, Homo sapien
agtagccttatccacagggtgttgt

SEQ ID NO: 25327 - DNA, 25 bp, Homo sapien
agtagctacggtgaacagtgctaca

SEQ ID NO: 25328 - DNA, 25 bp, Homo sapien
agtagctatggtgaacagtgctaca

SEQ ID NO: 25329 - DNA, 25 bp, Homo sapien
agtagctgtgggatctaacaatgaa

SEQ ID NO: 25330 - DNA, 25 bp, Homo sapien
agtagctgtgggttctaacaatgaa

SEQ ID NO: 25331 - DNA, 25 bp, Homo sapien
agtaggaaaggttacagaggctaat

SEQ ID NO: 25332 - DNA, 25 bp, Homo sapien
agtaggaaatgttacagaggctaat

SEQ ID NO: 25333 - DNA, 25 bp, Homo sapien
agtaggaataaaaccaaaaaagatc

SEQ ID NO: 25334 - DNA, 25 bp, Homo sapien
agtaggaataaagccaaaaaagatc

SEQ ID NO: 25335 - DNA, 25 bp, Homo sapien
agtaggaatgtaaacactatatgcc

SEQ ID NO: 25336 - DNA, 25 bp, Homo sapien
agtaggaatgtaaacagtatatgcc

SEQ ID NO: 25337 - DNA, 25 bp, Homo sapien
agtaggacccagagacagagtttac

SEQ ID NO: 25338 - DNA, 25 bp, Homo sapien
agtaggacctagagacagagtttac

SEQ ID NO: 25339 - DNA, 25 bp, Homo sapien
agtaggagactggaaggaaggagaa

SEQ ID NO: 25340 - DNA, 25 bp, Homo sapien
agtaggagattggaaggaaggagaa

SEQ ID NO: 25341 - DNA, 25 bp, Homo sapien
agtaggcagacacattaggtggaaa

SEQ ID NO: 25342 - DNA, 25 bp, Homo sapien
agtaggcagacatattaggtggaaa

SEQ ID NO: 25343 - DNA, 25 bp, Homo sapien
agtaggcagttgatttaaaaaaaaa

SEQ ID NO: 25344 - DNA, 25 bp, Homo sapien
agtaggcagttgattttaaaaaaaa

SEQ ID NO: 25345 - DNA, 25 bp, Homo sapien
agtaggcctagcaaggagagagagg

SEQ ID NO: 25346 - DNA, 25 bp, Homo sapien
agtaggcctgctactagttccaatt

SEQ ID NO: 25347 - DNA, 25 bp, Homo sapien
agtaggcctgctattagttccaatt

SEQ ID NO: 25348 - DNA, 25 bp, Homo sapien
agtaggcctggcaaggagagagagg

SEQ ID NO: 25349 - DNA, 25 bp, Homo sapien
agtagggctacatccagacctggct

SEQ ID NO: 25350 - DNA, 25 bp, Homo sapien
agtagggctacattcagacctggct

SEQ ID NO: 25351 - DNA, 25 bp, Homo sapien
agtaggtagagcacagatagaggag

SEQ ID NO: 25352 - DNA, 25 bp, Homo sapien
agtaggtagagcacagttagaggag

SEQ ID NO: 25353 - DNA, 25 bp, Homo sapien
agtaggttaatactcagaatgtttg

SEQ ID NO: 25354 - DNA, 25 bp, Homo sapien
agtaggttagtactcagaatgtttg

SEQ ID NO: 25355 - DNA, 25 bp, Homo sapien
agtaggttatacaatggaaaacaac

SEQ ID NO: 25356 - DNA, 25 bp, Homo sapien
agtaggttatacagtggaaaacaac

SEQ ID NO: 25357 - DNA, 25 bp, Homo sapien
agtagtaaaaggaaatctgtgggat

SEQ ID NO: 25358 - DNA, 25 bp, Homo sapien
agtagtaaaaggagatctgtgggat

SEQ ID NO: 25359 - DNA, 25 bp, Homo sapien
agtagtataaagttcccaggccagg

SEQ ID NO: 25360 - DNA, 25 bp, Homo sapien
agtagtatgaagttcccaggccagg

SEQ ID NO: 25361 - DNA, 25 bp, Homo sapien
agtagtcagaccggaaatgtactat

SEQ ID NO: 25362 - DNA, 25 bp, Homo sapien
agtagtcagactggaaatgtactat

SEQ ID NO: 25363 - DNA, 25 bp, Homo sapien
agtagtctctacaaacacagggtag

SEQ ID NO: 25364 - DNA, 25 bp, Homo sapien
agtagtctctataaacacagggtag

SEQ ID NO: 25365 - DNA, 25 bp, Homo sapien
agtagtgacgccattaggtcttggg

SEQ ID NO: 25366 - DNA, 25 bp, Homo sapien
agtagtgactgaagatttttgcaaa

SEQ ID NO: 25367 - DNA, 25 bp, Homo sapien
agtagtgagtgaagatttttgcaaa

SEQ ID NO: 25368 - DNA, 25 bp, Homo sapien
agtagtgatgccattaggtcttggg

SEQ ID NO: 25369 - DNA, 25 bp, Homo sapien
agtagtggcactctctaaccattag

SEQ ID NO: 25370 - DNA, 25 bp, Homo sapien
agtagtggcactttctaaccattag

SEQ ID NO: 25371 - DNA, 25 bp, Homo sapien
agtagtgggaattatgatagagatt

SEQ ID NO: 25372 - DNA, 25 bp, Homo sapien
agtagtgggaattgtgatagagatt

SEQ ID NO: 25373 - DNA, 25 bp, Homo sapien
agtagtggtgctgagaggttcctca

SEQ ID NO: 25374 - DNA, 25 bp, Homo sapien
agtagtggtgcttagaggttcctca

SEQ ID NO: 25375 - DNA, 25 bp, Homo sapien
agtagtgttttatagtggctacaaa

SEQ ID NO: 25376 - DNA, 25 bp, Homo sapien
agtagtgttttgtagtggctacaaa

SEQ ID NO: 25377 - DNA, 25 bp, Homo sapien
agtataactgcaagtattctgagtt

SEQ ID NO: 25378 - DNA, 25 bp, Homo sapien
agtataactgcacgtattctgagtt

SEQ ID NO: 25379 - DNA, 25 bp, Homo sapien
agtataagagtgaactagaaataaa

SEQ ID NO: 25380 - DNA, 25 bp, Homo sapien
agtataagagtgaattagaaataaa

SEQ ID NO: 25381 - DNA, 25 bp, Homo sapien
agtataataaatatgtcatggagaa

SEQ ID NO: 25382 - DNA, 25 bp, Homo sapien
agtataataaatatgtgatggagaa

SEQ ID NO: 25383 - DNA, 25 bp, Homo sapien
agtatacaacaaagctcatcattca

SEQ ID NO: 25384 - DNA, 25 bp, Homo sapien
agtatacaacacagctcatcattca

SEQ ID NO: 25385 - DNA, 25 bp, Homo sapien
agtatacaatgggaaatcatgcctt

SEQ ID NO: 25386 - DNA, 25 bp, Homo sapien
agtatacactggagaccgaaaccat

SEQ ID NO: 25387 - DNA, 25 bp, Homo sapien
agtatacactggagactgaaaccat

SEQ ID NO: 25388 - DNA, 25 bp, Homo sapien
agtatacagtgggaaatcatgcctt

SEQ ID NO: 25389 - DNA, 25 bp, Homo sapien
agtatacattgcacttgatgtctat

SEQ ID NO: 25390 - DNA, 25 bp, Homo sapien
agtatacattggacttgatgtctat

SEQ ID NO: 25391 - DNA, 25 bp, Homo sapien
agtatagatccacgtctctgttctc

SEQ ID NO: 25392 - DNA, 25 bp, Homo sapien
agtatagatccatgtctctgttctc

SEQ ID NO: 25393 - DNA, 25 bp, Homo sapien
agtatagggccattgaaaaacacac

SEQ ID NO: 25394 - DNA, 25 bp, Homo sapien
agtatagggccgttgaaaaacacac

SEQ ID NO: 25395 - DNA, 25 bp, Homo sapien
agtatagtaatctgttacgctctgt

SEQ ID NO: 25396 - DNA, 25 bp, Homo sapien
agtatagtaatcttttacgctctgt

SEQ ID NO: 25397 - DNA, 25 bp, Homo sapien
agtatagtcgtcctttaaatgtttg

SEQ ID NO: 25398 - DNA, 25 bp, Homo sapien
agtatagttgacataaccttggcag

SEQ ID NO: 25399 - DNA, 25 bp, Homo sapien
agtatagttgacgtaaccttggcag

SEQ ID NO: 25400 - DNA, 25 bp, Homo sapien
agtatagttgtcctttaaatgtttg

SEQ ID NO: 25401 - DNA, 25 bp, Homo sapien
agtatatgacaaccgcgacagcaac

SEQ ID NO: 25402 - DNA, 25 bp, Homo sapien
agtatatgacaactgcgacagcaac

SEQ ID NO: 25403 - DNA, 25 bp, Homo sapien
agtatatggtagcaccaggttttga

SEQ ID NO: 25404 - DNA, 25 bp, Homo sapien
agtatatggtagtaccaggttttga

SEQ ID NO: 25405 - DNA, 25 bp, Homo sapien
agtatattatctcaaatggcacaag

SEQ ID NO: 25406 - DNA, 25 bp, Homo sapien
agtatattatctcacatggcacaag

SEQ ID NO: 25407 - DNA, 25 bp, Homo sapien
agtatattccggtaacaaagagcta

SEQ ID NO: 25408 - DNA, 25 bp, Homo sapien
agtatattctggtaacaaagagcta

SEQ ID NO: 25409 - DNA, 25 bp, Homo sapien
agtatatttagctcatttccaaatg

SEQ ID NO: 25410 - DNA, 25 bp, Homo sapien
agtatatttagttcatttccaaatg

SEQ ID NO: 25411 - DNA, 25 bp, Homo sapien
agtatcaaaacatgttcaactggaa

SEQ ID NO: 25412 - DNA, 25 bp, Homo sapien
agtatcaaagcatgttcaactggaa

SEQ ID NO: 25413 - DNA, 25 bp, Homo sapien
agtatcacgatttatcttccttttt

SEQ ID NO: 25414 - DNA, 25 bp, Homo sapien
agtatcacgatttctcttccttttt

SEQ ID NO: 25415 - DNA, 25 bp, Homo sapien
agtatcatttatcatgagaagtgct

SEQ ID NO: 25416 - DNA, 25 bp, Homo sapien
agtatcatttatcctgagaagtgct

SEQ ID NO: 25417 - DNA, 25 bp, Homo sapien
agtatccagcacagtgaattaacgt

SEQ ID NO: 25418 - DNA, 25 bp, Homo sapien
agtatccagcacagtgcattaacgt

SEQ ID NO: 25419 - DNA, 25 bp, Homo sapien
agtatcccgtgccttctggaggtaa

SEQ ID NO: 25420 - DNA, 25 bp, Homo sapien
agtatcccgtgctttctggaggtaa

SEQ ID NO: 25421 - DNA, 25 bp, Homo sapien
agtatctattcaagccttttttatt

SEQ ID NO: 25422 - DNA, 25 bp, Homo sapien
agtatctattcaaggcttttttatt

SEQ ID NO: 25423 - DNA, 25 bp, Homo sapien
agtatctctgcttcctccctagcag

SEQ ID NO: 25424 - DNA, 25 bp, Homo sapien
agtatctctgcttcttccctagcag

SEQ ID NO: 25425 - DNA, 25 bp, Homo sapien
agtatctggaaacattttttggttg

SEQ ID NO: 25426 - DNA, 25 bp, Homo sapien
agtatctggaaacgttttttggttg

SEQ ID NO: 25427 - DNA, 25 bp, Homo sapien
agtatgaagatagaaagcagcagta

SEQ ID NO: 25428 - DNA, 25 bp, Homo sapien
agtatgaagcttcccaaagttttaa

SEQ ID NO: 25429 - DNA, 25 bp, Homo sapien
agtatgaagcttctcaaagttttaa

SEQ ID NO: 25430 - DNA, 25 bp, Homo sapien
agtatgaaggtagaaagcagcagta

SEQ ID NO: 25431 - DNA, 25 bp, Homo sapien
agtatgacacttgttccggctctaa

SEQ ID NO: 25432 - DNA, 25 bp, Homo sapien
agtatgacacttgttctggctctaa

SEQ ID NO: 25433 - DNA, 25 bp, Homo sapien
agtatgaggctactgtttccatcca

SEQ ID NO: 25434 - DNA, 25 bp, Homo sapien
agtatgaggctactttttccatcca

SEQ ID NO: 25435 - DNA, 25 bp, Homo sapien
agtatgatacaatgcctttgcagag

SEQ ID NO: 25436 - DNA, 25 bp, Homo sapien
agtatgatattaatagtgggctggc

SEQ ID NO: 25437 - DNA, 25 bp, Homo sapien
agtatgatattgatagtgggctggc

SEQ ID NO: 25438 - DNA, 25 bp, Homo sapien
agtatgatccaatgcctttgcagag

SEQ ID NO: 25439 - DNA, 25 bp, Homo sapien
agtatgcaaaaaagcctaaaacaaa

SEQ ID NO: 25440 - DNA, 25 bp, Homo sapien
agtatgcaaaaaaggctaaaacaaa

SEQ ID NO: 25441 - DNA, 25 bp, Homo sapien
agtatgcacaaagggcaataaagca

SEQ ID NO: 25442 - DNA, 25 bp, Homo sapien
agtatgcacgaagggcaataaagca

SEQ ID NO: 25443 - DNA, 25 bp, Homo sapien
agtatgcagtgctttgatgaataat

SEQ ID NO: 25444 - DNA, 25 bp, Homo sapien
agtatgcagtgctttggtgaataat

SEQ ID NO: 25445 - DNA, 25 bp, Homo sapien
agtatgccctaaaattgtgtgtatt

SEQ ID NO: 25446 - DNA, 25 bp, Homo sapien
agtatgccttaaaattgtgtgtatt

SEQ ID NO: 25447 - DNA, 25 bp, Homo sapien
agtatgctactttccgaggcaatgg

SEQ ID NO: 25448 - DNA, 25 bp, Homo sapien
agtatgcttctttccgaggcaatgg

SEQ ID NO: 25449 - DNA, 25 bp, Homo sapien
agtatggaaaacgcatgtcaaagac

SEQ ID NO: 25450 - DNA, 25 bp, Homo sapien
agtatggaaaatgcatgtcaaagac

SEQ ID NO: 25451 - DNA, 25 bp, Homo sapien
agtatggacactaaccaactctaca

SEQ ID NO: 25452 - DNA, 25 bp, Homo sapien
agtatggacactacccaactctaca

SEQ ID NO: 25453 - DNA, 25 bp, Homo sapien
agtatggagtcacaattacctatta

SEQ ID NO: 25454 - DNA, 25 bp, Homo sapien
agtatggagtcgcaattacctatta

SEQ ID NO: 25455 - DNA, 25 bp, Homo sapien
agtatgggaacaatagacactggac

SEQ ID NO: 25456 - DNA, 25 bp, Homo sapien
agtatggggacaatagacactggac

SEQ ID NO: 25457 - DNA, 25 bp, Homo sapien
agtatgtattctctgaagtatgaat

SEQ ID NO: 25458 - DNA, 25 bp, Homo sapien
agtatgtattctctgaggtatgaat

SEQ ID NO: 25459 - DNA, 25 bp, Homo sapien
agtatgtgaatttctcctttaatct

SEQ ID NO: 25460 - DNA, 25 bp, Homo sapien
agtatgtgagtttctcctttaatct

SEQ ID NO: 25461 - DNA, 25 bp, Homo sapien
agtatgtgtctcagaatgtaattgt

SEQ ID NO: 25462 - DNA, 25 bp, Homo sapien
agtatgtgtcttagaatgtaattgt

SEQ ID NO: 25463 - DNA, 25 bp, Homo sapien
agtatgttacgggcttcatcagaga

SEQ ID NO: 25464 - DNA, 25 bp, Homo sapien
agtatgttagaaccaaagtgctaag

SEQ ID NO: 25465 - DNA, 25 bp, Homo sapien
agtatgttagaaccgaagtgctaag

SEQ ID NO: 25466 - DNA, 25 bp, Homo sapien
agtatgttatgggcttcatcagaga

SEQ ID NO: 25467 - DNA, 25 bp, Homo sapien
agtatgttctgggaatcgctccata

SEQ ID NO: 25468 - DNA, 25 bp, Homo sapien
agtatgttctgggaattgctccata

SEQ ID NO: 25469 - DNA, 25 bp, Homo sapien
agtattaaaataggctggaaattaa

SEQ ID NO: 25470 - DNA, 25 bp, Homo sapien
agtattaacataggctggaaattaa

SEQ ID NO: 25471 - DNA, 25 bp, Homo sapien
agtattaatattacataacatgagg

SEQ ID NO: 25472 - DNA, 25 bp, Homo sapien
agtattaatattacgtaacatgagg

SEQ ID NO: 25473 - DNA, 25 bp, Homo sapien
agtattacctcacttgccgcttatt

SEQ ID NO: 25474 - DNA, 25 bp, Homo sapien
agtattacctcagttgccgcttatt

SEQ ID NO: 25475 - DNA, 25 bp, Homo sapien
agtattagtctccaaagattagaaa

SEQ ID NO: 25476 - DNA, 25 bp, Homo sapien
agtattagtctccgaagattagaaa

SEQ ID NO: 25477 - DNA, 25 bp, Homo sapien
agtattcacctgtaagatagtgaca

SEQ ID NO: 25478 - DNA, 25 bp, Homo sapien
agtattcatctgtaagatagtgaca

SEQ ID NO: 25479 - DNA, 25 bp, Homo sapien
agtattcctaccggtttggatattg

SEQ ID NO: 25480 - DNA, 25 bp, Homo sapien
agtattcctactggtttggatattg

SEQ ID NO: 25481 - DNA, 25 bp, Homo sapien
agtattctcggtagtcctgtagagt

SEQ ID NO: 25482 - DNA, 25 bp, Homo sapien
agtattcttggtagtcctgtagagt

SEQ ID NO: 25483 - DNA, 25 bp, Homo sapien
agtattcttttcaatatgtcagtct

SEQ ID NO: 25484 - DNA, 25 bp, Homo sapien
agtattcttttcagtatgtcagtct

SEQ ID NO: 25485 - DNA, 25 bp, Homo sapien
agtattggagttatagcatgagagg

SEQ ID NO: 25486 - DNA, 25 bp, Homo sapien
agtattggagttctagcatgagagg

SEQ ID NO: 25487 - DNA, 25 bp, Homo sapien
agtattgtattagtttcctcttgct

SEQ ID NO: 25488 - DNA, 25 bp, Homo sapien
agtattgtattcgtttcctcttgct

SEQ ID NO: 25489 - DNA, 25 bp, Homo sapien
agtattgtcttctagcacatggggc

SEQ ID NO: 25490 - DNA, 25 bp, Homo sapien
agtattgtcttctagcgcatggggc

SEQ ID NO: 25491 - DNA, 25 bp, Homo sapien
agtatttaatagcaattacgtgttt

SEQ ID NO: 25492 - DNA, 25 bp, Homo sapien
agtatttagtagcaattacgtgttt

SEQ ID NO: 25493 - DNA, 25 bp, Homo sapien
agtatttcaacataggttctatttt

SEQ ID NO: 25494 - DNA, 25 bp, Homo sapien
agtatttcaacgtaggttctatttt

SEQ ID NO: 25495 - DNA, 25 bp, Homo sapien
agtatttcatgacgtcttgaggcag

SEQ ID NO: 25496 - DNA, 25 bp, Homo sapien
agtatttcatgatgtcttgaggcag

SEQ ID NO: 25497 - DNA, 25 bp, Homo sapien
agtatttctatagagaggatccagc

SEQ ID NO: 25498 - DNA, 25 bp, Homo sapien
agtatttctttagagaggatccagc

SEQ ID NO: 25499 - DNA, 25 bp, Homo sapien
agtatttgactgcctaacttttcag

SEQ ID NO: 25500 - DNA, 25 bp, Homo sapien
agtatttgactgcttaacttttcag

SEQ ID NO: 25501 - DNA, 25 bp, Homo sapien
agtatttgcttttgtaataaaggct

SEQ ID NO: 25502 - DNA, 25 bp, Homo sapien
agtatttgtaagtggtgtaagatat

SEQ ID NO: 25503 - DNA, 25 bp, Homo sapien
agtatttgtgagtggtgtaagatat

SEQ ID NO: 25504 - DNA, 25 bp, Homo sapien
agtatttgtttttgtaataaaggct

SEQ ID NO: 25505 - DNA, 25 bp, Homo sapien
agtattttactttactcaccattgt

SEQ ID NO: 25506 - DNA, 25 bp, Homo sapien
agtattttactttattcaccattgt

SEQ ID NO: 25507 - DNA, 25 bp, Homo sapien
agtattttccaaacttattgtacta

SEQ ID NO: 25508 - DNA, 25 bp, Homo sapien
agtattttccaaatttattgtacta

SEQ ID NO: 25509 - DNA, 25 bp, Homo sapien
agtattttctgaacttctgaatgaa

SEQ ID NO: 25510 - DNA, 25 bp, Homo sapien
agtattttctgaacttttgaatgaa

SEQ ID NO: 25511 - DNA, 25 bp, Homo sapien
agtcaaaaatttaccatcctggcta

SEQ ID NO: 25512 - DNA, 25 bp, Homo sapien
agtcaaaagatggcaactcagcatt

SEQ ID NO: 25513 - DNA, 25 bp, Homo sapien
agtcaaaagatgggaactcagcatt

SEQ ID NO: 25514 - DNA, 25 bp, Homo sapien
agtcaaaagtttaccatcctggcta

SEQ ID NO: 25515 - DNA, 25 bp, Homo sapien
agtcaaaatgtgaacagaccagtca

SEQ ID NO: 25516 - DNA, 25 bp, Homo sapien
agtcaaaatgtgaatagaccagtca

SEQ ID NO: 25517 - DNA, 25 bp, Homo sapien
agtcaaagtagttgggatggtgctg

SEQ ID NO: 25518 - DNA, 25 bp, Homo sapien
agtcaaagtccacatgcaagttgag

SEQ ID NO: 25519 - DNA, 25 bp, Homo sapien
agtcaaagtccacatgtaagttgag

SEQ ID NO: 25520 - DNA, 25 bp, Homo sapien
agtcaaagtggttgggatggtgctg

SEQ ID NO: 25521 - DNA, 25 bp, Homo sapien
agtcaaatacctcaaatgtctatca

SEQ ID NO: 25522 - DNA, 25 bp, Homo sapien
agtcaaataccttaaatgtctatca

SEQ ID NO: 25523 - DNA, 25 bp, Homo sapien
agtcaacagtttatgtgcaactcaa

SEQ ID NO: 25524 - DNA, 25 bp, Homo sapien
agtcaacagtttgtgtgcaactcaa

SEQ ID NO: 25525 - DNA, 25 bp, Homo sapien
agtcaacatgaaaaaaaataatgca

SEQ ID NO: 25526 - DNA, 25 bp, Homo sapien
agtcaacatgagaaaaaataatgca

SEQ ID NO: 25527 - DNA, 25 bp, Homo sapien
agtcaactgtgcacaacgtgctgaa

SEQ ID NO: 25528 - DNA, 25 bp, Homo sapien
agtcaactgtgcgcaacgtgctgaa

SEQ ID NO: 25529 - DNA, 25 bp, Homo sapien
agtcaagcacttccccttggtgtca

SEQ ID NO: 25530 - DNA, 25 bp, Homo sapien
agtcaagcactttcccttggtgtca

SEQ ID NO: 25531 - DNA, 25 bp, Homo sapien
agtcaaggaagaatcagcattctgt

SEQ ID NO: 25532 - DNA, 25 bp, Homo sapien
agtcaaggaggaatcagcattctgt

SEQ ID NO: 25533 - DNA, 25 bp, Homo sapien
agtcaatactgaaccactgctcctg

SEQ ID NO: 25534 - DNA, 25 bp, Homo sapien
agtcaatactgaatcactgctcctg

SEQ ID NO: 25535 - DNA, 25 bp, Homo sapien
agtcaatcctctctcaaaaaaaatc

SEQ ID NO: 25536 - DNA, 25 bp, Homo sapien
agtcaatcctctcttaaaaaaaatc

SEQ ID NO: 25537 - DNA, 25 bp, Homo sapien
agtcaatctttgcactcagggttga

SEQ ID NO: 25538 - DNA, 25 bp, Homo sapien
agtcaatctttgcgctcagggttga

SEQ ID NO: 25539 - DNA, 25 bp, Homo sapien
agtcaattacatttttcaaagtgca

SEQ ID NO: 25540 - DNA, 25 bp, Homo sapien
agtcaattacatttttgaaagtgca

SEQ ID NO: 25541 - DNA, 25 bp, Homo sapien
agtcaattgaatgaaggctttgtgg

SEQ ID NO: 25542 - DNA, 25 bp, Homo sapien
agtcaattgaatgatggctttgtgg

SEQ ID NO: 25543 - DNA, 25 bp, Homo sapien
agtcacaagttgaaattgaataacc

SEQ ID NO: 25544 - DNA, 25 bp, Homo sapien
agtcacaagttgaagttgaataacc

SEQ ID NO: 25545 - DNA, 25 bp, Homo sapien
agtcacaataggacactcagctaat

SEQ ID NO: 25546 - DNA, 25 bp, Homo sapien
agtcacaataggacgctcagctaat

SEQ ID NO: 25547 - DNA, 25 bp, Homo sapien
agtcacacttgtcacgtcacaatgt

SEQ ID NO: 25548 - DNA, 25 bp, Homo sapien
agtcacacttgtcatgtcacaatgt

SEQ ID NO: 25549 - DNA, 25 bp, Homo sapien
agtcacatgaactaaaaagcattac

SEQ ID NO: 25550 - DNA, 25 bp, Homo sapien
agtcacatgaactgaaaagcattac

SEQ ID NO: 25551 - DNA, 25 bp, Homo sapien
agtcacatttcatcggcaggcactc

SEQ ID NO: 25552 - DNA, 25 bp, Homo sapien
agtcacatttcatctgcaggcactc

SEQ ID NO: 25553 - DNA, 25 bp, Homo sapien
agtcaccagttaccagagctgcaaa

SEQ ID NO: 25554 - DNA, 25 bp, Homo sapien
agtcaccagttgccagagctgcaaa

SEQ ID NO: 25555 - DNA, 25 bp, Homo sapien
agtcactaatggggcttcatcccaa

SEQ ID NO: 25556 - DNA, 25 bp, Homo sapien
agtcactacggcacacaggaaacta

SEQ ID NO: 25557 - DNA, 25 bp, Homo sapien
agtcactactggggcttcatcccaa

SEQ ID NO: 25558 - DNA, 25 bp, Homo sapien
agtcactatggcacacaggaaacta

SEQ ID NO: 25559 - DNA, 25 bp, Homo sapien
agtcactcattcagggttagaatca

SEQ ID NO: 25560 - DNA, 25 bp, Homo sapien
agtcactcattccgggttagaatca

SEQ ID NO: 25561 - DNA, 25 bp, Homo sapien
agtcactgaaacgtgggtcagatgt

SEQ ID NO: 25562 - DNA, 25 bp, Homo sapien
agtcactgaaatgtgggtcagatgt

SEQ ID NO: 25563 - DNA, 25 bp, Homo sapien
agtcactgtcaagaccggagtttca

SEQ ID NO: 25564 - DNA, 25 bp, Homo sapien
agtcactgtcaagacctgagtttca

SEQ ID NO: 25565 - DNA, 25 bp, Homo sapien
agtcacttatgtcacatttctctca

SEQ ID NO: 25566 - DNA, 25 bp, Homo sapien
agtcacttatgtcagatttctctca

SEQ ID NO: 25567 - DNA, 25 bp, Homo sapien
agtcacttctcagcaacatctcagg

SEQ ID NO: 25568 - DNA, 25 bp, Homo sapien
agtcactttacaatggagaaacctg

SEQ ID NO: 25569 - DNA, 25 bp, Homo sapien
agtcactttgcaatggagaaacctg

SEQ ID NO: 25570 - DNA, 25 bp, Homo sapien
agtcacttttcagcaacatctcagg

SEQ ID NO: 25571 - DNA, 25 bp, Homo sapien
agtcagaaactggttccccgccttg

SEQ ID NO: 25572 - DNA, 25 bp, Homo sapien
agtcagaagctggttccccgccttg

SEQ ID NO: 25573 - DNA, 25 bp, Homo sapien
agtcagaccaaggctggcccatggg

SEQ ID NO: 25574 - DNA, 25 bp, Homo sapien
agtcagaccgaggctggcccatggg

SEQ ID NO: 25575 - DNA, 25 bp, Homo sapien
agtcagaggttcatccaaggcgctc

SEQ ID NO: 25576 - DNA, 25 bp, Homo sapien
agtcagaggttcgtccaaggcgctc

SEQ ID NO: 25577 - DNA, 25 bp, Homo sapien
agtcagagtcttgttctgttgccca

SEQ ID NO: 25578 - DNA, 25 bp, Homo sapien
agtcagagtctttttctgttgccca

SEQ ID NO: 25579 - DNA, 25 bp, Homo sapien
agtcagagtggagccgataatcgga

SEQ ID NO: 25580 - DNA, 25 bp, Homo sapien
agtcagagtggagctgataatcgga

SEQ ID NO: 25581 - DNA, 25 bp, Homo sapien
agtcagagttgaagcaccaagaagc

SEQ ID NO: 25582 - DNA, 25 bp, Homo sapien
agtcagagttgaggcaccaagaagc

SEQ ID NO: 25583 - DNA, 25 bp, Homo sapien
agtcagagtttgccgcccaaaaaag

SEQ ID NO: 25584 - DNA, 25 bp, Homo sapien
agtcagagtttgctgcccaaaaaag

SEQ ID NO: 25585 - DNA, 25 bp, Homo sapien
agtcagatactaggcaagaaccagg

SEQ ID NO: 25586 - DNA, 25 bp, Homo sapien
agtcagatactcggcaagaaccagg

SEQ ID NO: 25587 - DNA, 25 bp, Homo sapien
agtcagcaagagaacacatatacga

SEQ ID NO: 25588 - DNA, 25 bp, Homo sapien
agtcagcaagagaccacatatacga

SEQ ID NO: 25589 - DNA, 25 bp, Homo sapien
agtcagcatacccaacctgaaagaa

SEQ ID NO: 25590 - DNA, 25 bp, Homo sapien
agtcagcatacccatcctgaaagaa

SEQ ID NO: 25591 - DNA, 25 bp, Homo sapien
agtcagcctagtatatgagcatcag

SEQ ID NO: 25592 - DNA, 25 bp, Homo sapien
agtcagcctcgtatatgagcatcag

SEQ ID NO: 25593 - DNA, 25 bp, Homo sapien
agtcagctacaattcagagtttacc

SEQ ID NO: 25594 - DNA, 25 bp, Homo sapien
agtcagctgcaattcagagtttacc

SEQ ID NO: 25595 - DNA, 25 bp, Homo sapien
agtcagctgtcacttcggaaaccat

SEQ ID NO: 25596 - DNA, 25 bp, Homo sapien
agtcagctgtcatttcggaaaccat

SEQ ID NO: 25597 - DNA, 25 bp, Homo sapien
agtcaggaaagggtgtcggcaggga

SEQ ID NO: 25598 - DNA, 25 bp, Homo sapien
agtcaggaaagggtgttggcaggga

SEQ ID NO: 25599 - DNA, 25 bp, Homo sapien
agtcaggccagcagtctgaaaatag

SEQ ID NO: 25600 - DNA, 25 bp, Homo sapien
agtcaggccggcagtctgaaaatag

SEQ ID NO: 25601 - DNA, 25 bp, Homo sapien
agtcagggactcatatctcattctc

SEQ ID NO: 25602 - DNA, 25 bp, Homo sapien
agtcagggattcatatctcattctc

SEQ ID NO: 25603 - DNA, 25 bp, Homo sapien
agtcaggggaaaaaataagcttcag

SEQ ID NO: 25604 - DNA, 25 bp, Homo sapien
agtcaggggaaaaaatgagcttcag

SEQ ID NO: 25605 - DNA, 25 bp, Homo sapien
agtcagtaaactcaccaatgtcttc

SEQ ID NO: 25606 - DNA, 25 bp, Homo sapien
agtcagtaagctcaccaatgtcttc

SEQ ID NO: 25607 - DNA, 25 bp, Homo sapien
agtcagtctcatactttcaggttgt

SEQ ID NO: 25608 - DNA, 25 bp, Homo sapien
agtcagtctcatcctttcaggttgt

SEQ ID NO: 25609 - DNA, 25 bp, Homo sapien
agtcagtctcctagaacatacatct

SEQ ID NO: 25610 - DNA, 25 bp, Homo sapien
agtcagtctcctggaacatacatct

SEQ ID NO: 25611 - DNA, 25 bp, Homo sapien
agtcagtgtatccattttatgtcat

SEQ ID NO: 25612 - DNA, 25 bp, Homo sapien
agtcagtgtatctattttatgtcat

SEQ ID NO: 25613 - DNA, 25 bp, Homo sapien
agtcagttacaaatcaaacatttaa

SEQ ID NO: 25614 - DNA, 25 bp, Homo sapien
agtcagttacaattcaaacatttaa

SEQ ID NO: 25615 - DNA, 25 bp, Homo sapien
agtcagttgttgcgataagatctag

SEQ ID NO: 25616 - DNA, 25 bp, Homo sapien
agtcagttgttgggataagatctag

SEQ ID NO: 25617 - DNA, 25 bp, Homo sapien
agtcataccttgattttcaatactt

SEQ ID NO: 25618 - DNA, 25 bp, Homo sapien
agtcatactttgattttcaatactt

SEQ ID NO: 25619 - DNA, 25 bp, Homo sapien
agtcatagagaagaaagatttggag

SEQ ID NO: 25620 - DNA, 25 bp, Homo sapien
agtcatagataagaaagatttggag

SEQ ID NO: 25621 - DNA, 25 bp, Homo sapien
agtcatagatattcacattatctgt

SEQ ID NO: 25622 - DNA, 25 bp, Homo sapien
agtcatagatattcgcattatctgt

SEQ ID NO: 25623 - DNA, 25 bp, Homo sapien
agtcatatcaagaaaggagaagccc

SEQ ID NO: 25624 - DNA, 25 bp, Homo sapien
agtcatatcaagaagggagaagccc

SEQ ID NO: 25625 - DNA, 25 bp, Homo sapien
agtcatatggttgtttcctttctat

SEQ ID NO: 25626 - DNA, 25 bp, Homo sapien
agtcatatggttgttttctttctat

SEQ ID NO: 25627 - DNA, 25 bp, Homo sapien
agtcatattagtgatgattcaatgc

SEQ ID NO: 25628 - DNA, 25 bp, Homo sapien
agtcatattagtgatggttcaatgc

SEQ ID NO: 25629 - DNA, 25 bp, Homo sapien
agtcatcaagaacaactagaaatta

SEQ ID NO: 25630 - DNA, 25 bp, Homo sapien
agtcatcacttcacaccgggatggc

SEQ ID NO: 25631 - DNA, 25 bp, Homo sapien
agtcatcacttcacactgggatggc

SEQ ID NO: 25632 - DNA, 25 bp, Homo sapien
agtcatcaggaacaactagaaatta

SEQ ID NO: 25633 - DNA, 25 bp, Homo sapien
agtcatcataaggaagaaagtttgg

SEQ ID NO: 25634 - DNA, 25 bp, Homo sapien
agtcatcataaggaagcaagtttgg

SEQ ID NO: 25635 - DNA, 25 bp, Homo sapien
agtcatcccatcttaccatctctaa

SEQ ID NO: 25636 - DNA, 25 bp, Homo sapien
agtcatcccatcttactatctctaa

SEQ ID NO: 25637 - DNA, 25 bp, Homo sapien
agtcatcgcaaaccaccatgaatga

SEQ ID NO: 25638 - DNA, 25 bp, Homo sapien
agtcatcgccaaccaccatgaatga

SEQ ID NO: 25639 - DNA, 25 bp, Homo sapien
agtcatctggtaaccgtgtgtttaa

SEQ ID NO: 25640 - DNA, 25 bp, Homo sapien
agtcatctggtaactgtgtgtttaa

SEQ ID NO: 25641 - DNA, 25 bp, Homo sapien
agtcatgatatagggaattgaaaag

SEQ ID NO: 25642 - DNA, 25 bp, Homo sapien
agtcatgatatatggaattgaaaag

SEQ ID NO: 25643 - DNA, 25 bp, Homo sapien
agtcatggctagcagcatttccctt

SEQ ID NO: 25644 - DNA, 25 bp, Homo sapien
agtcatggctagcggcatttccctt

SEQ ID NO: 25645 - DNA, 25 bp, Homo sapien
agtcatgggtcaacgtccttctcca

SEQ ID NO: 25646 - DNA, 25 bp, Homo sapien
agtcatgggtcaatgtccttctcca

SEQ ID NO: 25647 - DNA, 25 bp, Homo sapien
agtcatgtacagtataaaggattat

SEQ ID NO: 25648 - DNA, 25 bp, Homo sapien
agtcatgtatagtataaaggattat

SEQ ID NO: 25649 - DNA, 25 bp, Homo sapien
agtcatgtatttccacagatgggga

SEQ ID NO: 25650 - DNA, 25 bp, Homo sapien
agtcatgtctttccacagatgggga

SEQ ID NO: 25651 - DNA, 25 bp, Homo sapien
agtcatgtgggagacaggagaagaa

SEQ ID NO: 25652 - DNA, 25 bp, Homo sapien
agtcatgtgggagataggagaagaa

SEQ ID NO: 25653 - DNA, 25 bp, Homo sapien
agtcattgattcaacaatagctaga

SEQ ID NO: 25654 - DNA, 25 bp, Homo sapien
agtcattgattcaagaatagctaga

SEQ ID NO: 25655 - DNA, 25 bp, Homo sapien
agtcattggctggaaagagacaagg

SEQ ID NO: 25656 - DNA, 25 bp, Homo sapien
agtcattggctggagagagacaagg

SEQ ID NO: 25657 - DNA, 25 bp, Homo sapien
agtcattgttggagagcaggaagca

SEQ ID NO: 25658 - DNA, 25 bp, Homo sapien
agtcattgttgtagagcaggaagca

SEQ ID NO: 25659 - DNA, 25 bp, Homo sapien
agtcatttccacttaaaaaaatgag

SEQ ID NO: 25660 - DNA, 25 bp, Homo sapien
agtcatttccagttaaaaaaatgag

SEQ ID NO: 25661 - DNA, 25 bp, Homo sapien
agtcatttgctattctcattgcaca

SEQ ID NO: 25662 - DNA, 25 bp, Homo sapien
agtcatttgctgttctcattgcaca

SEQ ID NO: 25663 - DNA, 25 bp, Homo sapien
agtcattttagatgtcttgcttaat

SEQ ID NO: 25664 - DNA, 25 bp, Homo sapien
agtcattttagttgtcttgcttaat

SEQ ID NO: 25665 - DNA, 25 bp, Homo sapien
agtcattttcttcctgctgtttttc

SEQ ID NO: 25666 - DNA, 25 bp, Homo sapien
agtcattttgaaaaacgacacagca

SEQ ID NO: 25667 - DNA, 25 bp, Homo sapien
agtcattttgaaaagcgacacagca

SEQ ID NO: 25668 - DNA, 25 bp, Homo sapien
agtcattttgttcctgctgtttttc

SEQ ID NO: 25669 - DNA, 25 bp, Homo sapien
agtccaaaagcggtctctcaaaagg

SEQ ID NO: 25670 - DNA, 25 bp, Homo sapien
agtccaaaagctgtctctcaaaagg

SEQ ID NO: 25671 - DNA, 25 bp, Homo sapien
agtccaaagtggtggccattaccta

SEQ ID NO: 25672 - DNA, 25 bp, Homo sapien
agtccaaagtgttggccattaccta

SEQ ID NO: 25673 - DNA, 25 bp, Homo sapien
agtccaacagggaaaaactctgaag

SEQ ID NO: 25674 - DNA, 25 bp, Homo sapien
agtccaacagggaacaactctgaag

SEQ ID NO: 25675 - DNA, 25 bp, Homo sapien
agtccaagaactgttgatctcaagc

SEQ ID NO: 25676 - DNA, 25 bp, Homo sapien
agtccaagtactgttgatctcaagc

SEQ ID NO: 25677 - DNA, 25 bp, Homo sapien
agtccaatcacaccatattgtttct

SEQ ID NO: 25678 - DNA, 25 bp, Homo sapien
agtccaatcacaccgtattgtttct

SEQ ID NO: 25679 - DNA, 25 bp, Homo sapien
agtccaatgttactttgctaatttt

SEQ ID NO: 25680 - DNA, 25 bp, Homo sapien
agtccaatgttagtttgctaatttt

SEQ ID NO: 25681 - DNA, 25 bp, Homo sapien
agtccacacgctcaggtttgcctaa

SEQ ID NO: 25682 - DNA, 25 bp, Homo sapien
agtccacatgctcaggtttgcctaa

SEQ ID NO: 25683 - DNA, 25 bp, Homo sapien
agtccaccgtcctgatcccagatgt

SEQ ID NO: 25684 - DNA, 25 bp, Homo sapien
agtccaccgtcttgatcccagatgt

SEQ ID NO: 25685 - DNA, 25 bp, Homo sapien
agtccagacataaattcatgcctat

SEQ ID NO: 25686 - DNA, 25 bp, Homo sapien
agtccagatataaattcatgcctat

SEQ ID NO: 25687 - DNA, 25 bp, Homo sapien
agtccagcactctctaacagaccct

SEQ ID NO: 25688 - DNA, 25 bp, Homo sapien
agtccagcattctctaacagaccct

SEQ ID NO: 25689 - DNA, 25 bp, Homo sapien
agtccaggaggaagactgaggaaat

SEQ ID NO: 25690 - DNA, 25 bp, Homo sapien
agtccaggaggaagtctgaggaaat

SEQ ID NO: 25691 - DNA, 25 bp, Homo sapien
agtccagttccaagttagaggtcca

SEQ ID NO: 25692 - DNA, 25 bp, Homo sapien
agtccagttccaagttggaggtcca

SEQ ID NO: 25693 - DNA, 25 bp, Homo sapien
agtccatcaggctcattcttttgtc

SEQ ID NO: 25694 - DNA, 25 bp, Homo sapien
agtccatccggctcattcttttgtc

SEQ ID NO: 25695 - DNA, 25 bp, Homo sapien
agtccatcgaatgctaagcaggata

SEQ ID NO: 25696 - DNA, 25 bp, Homo sapien
agtccatctaatgctaagcaggata

SEQ ID NO: 25697 - DNA, 25 bp, Homo sapien
agtccatcttttcgaggccattcat

SEQ ID NO: 25698 - DNA, 25 bp, Homo sapien
agtccatctttttgaggccattcat

SEQ ID NO: 25699 - DNA, 25 bp, Homo sapien
agtccatgactttcccttgcttgga

SEQ ID NO: 25700 - DNA, 25 bp, Homo sapien
agtccatgattttcccttgcttgga

SEQ ID NO: 25701 - DNA, 25 bp, Homo sapien
agtccattatgcttccaaatgcagc

SEQ ID NO: 25702 - DNA, 25 bp, Homo sapien
agtccattatgctttcaaatgcagc

SEQ ID NO: 25703 - DNA, 25 bp, Homo sapien
agtccatttctcaggtgaggaaaat

SEQ ID NO: 25704 - DNA, 25 bp, Homo sapien
agtccatttctcgggtgaggaaaat

SEQ ID NO: 25705 - DNA, 25 bp, Homo sapien
agtccatttggtcaactcctcattt

SEQ ID NO: 25706 - DNA, 25 bp, Homo sapien
agtccatttggttaactcctcattt

SEQ ID NO: 25707 - DNA, 25 bp, Homo sapien
agtcccaacaagataagagagaaaa

SEQ ID NO: 25708 - DNA, 25 bp, Homo sapien
agtcccaacaaggtaagagagaaaa

SEQ ID NO: 25709 - DNA, 25 bp, Homo sapien
agtccctggagggtcgtgaatagca

SEQ ID NO: 25710 - DNA, 25 bp, Homo sapien
agtccctggagggttgtgaatagca

SEQ ID NO: 25711 - DNA, 25 bp, Homo sapien
agtcccttctgccatacatgtgaag

SEQ ID NO: 25712 - DNA, 25 bp, Homo sapien
agtcccttctgtcatacatgtgaag

SEQ ID NO: 25713 - DNA, 25 bp, Homo sapien
agtccctttatgcttctatataggc

SEQ ID NO: 25714 - DNA, 25 bp, Homo sapien
agtccctttgtgcttctatataggc

SEQ ID NO: 25715 - DNA, 25 bp, Homo sapien
agtccgagtctatagtctcatactt

SEQ ID NO: 25716 - DNA, 25 bp, Homo sapien
agtccgagtgtatagtctcatactt

SEQ ID NO: 25717 - DNA, 25 bp, Homo sapien
agtccgtacttgccattttctctta

SEQ ID NO: 25718 - DNA, 25 bp, Homo sapien
agtccgtacttggcattttctctta

SEQ ID NO: 25719 - DNA, 25 bp, Homo sapien
agtcctacaataacacatgacagag

SEQ ID NO: 25720 - DNA, 25 bp, Homo sapien
agtcctacaattacacatgacagag

SEQ ID NO: 25721 - DNA, 25 bp, Homo sapien
agtcctatataacatcttccaatat

SEQ ID NO: 25722 - DNA, 25 bp, Homo sapien
agtcctatataacgtcttccaatat

SEQ ID NO: 25723 - DNA, 25 bp, Homo sapien
agtcctatcctcacacttcctgtac

SEQ ID NO: 25724 - DNA, 25 bp, Homo sapien
agtcctatcctcatacttcctgtac

SEQ ID NO: 25725 - DNA, 25 bp, Homo sapien
agtcctattattgaattatccccca

SEQ ID NO: 25726 - DNA, 25 bp, Homo sapien
agtcctattcttgaattatccccca

SEQ ID NO: 25727 - DNA, 25 bp, Homo sapien
agtcctcagcaaccacagggaggat

SEQ ID NO: 25728 - DNA, 25 bp, Homo sapien
agtcctcagcaactacagggaggat

SEQ ID NO: 25729 - DNA, 25 bp, Homo sapien
agtcctccaggggccaatgtcagaa

SEQ ID NO: 25730 - DNA, 25 bp, Homo sapien
agtcctccaggggccagtgtcagaa

SEQ ID NO: 25731 - DNA, 25 bp, Homo sapien
agtcctccctgggctaccatttttc

SEQ ID NO: 25732 - DNA, 25 bp, Homo sapien
agtcctccctgggctatcatttttc

SEQ ID NO: 25733 - DNA, 25 bp, Homo sapien
agtcctctctcattgtccttgaagc

SEQ ID NO: 25734 - DNA, 25 bp, Homo sapien
agtcctctgtcattgtccttgaagc

SEQ ID NO: 25735 - DNA, 25 bp, Homo sapien
agtcctgcaaagttctgttccaaaa

SEQ ID NO: 25736 - DNA, 25 bp, Homo sapien
agtcctgcgaagttctgttccaaaa

SEQ ID NO: 25737 - DNA, 25 bp, Homo sapien
agtcctggaaatagattcttggaga

SEQ ID NO: 25738 - DNA, 25 bp, Homo sapien
agtcctggaaataggttcttggaga

SEQ ID NO: 25739 - DNA, 25 bp, Homo sapien
agtcctggcactctctatgaacatt

SEQ ID NO: 25740 - DNA, 25 bp, Homo sapien
agtcctggcactctctgtgaacatt

SEQ ID NO: 25741 - DNA, 25 bp, Homo sapien
agtcctgttgagcatagcagagatg

SEQ ID NO: 25742 - DNA, 25 bp, Homo sapien
agtcctgttgagcgtagcagagatg

SEQ ID NO: 25743 - DNA, 25 bp, Homo sapien
agtccttatttataagccatataat

SEQ ID NO: 25744 - DNA, 25 bp, Homo sapien
agtccttatttataagtcatataat

SEQ ID NO: 25745 - DNA, 25 bp, Homo sapien
agtccttgtacacggtatagctcaa

SEQ ID NO: 25746 - DNA, 25 bp, Homo sapien
agtccttgtacatggtatagctcaa

SEQ ID NO: 25747 - DNA, 25 bp, Homo sapien
agtcctttcgaaaccactgtccatg

SEQ ID NO: 25748 - DNA, 25 bp, Homo sapien
agtccttttgaaaccactgtccatg

SEQ ID NO: 25749 - DNA, 25 bp, Homo sapien
agtcgaactgttacctttccagaaa

SEQ ID NO: 25750 - DNA, 25 bp, Homo sapien
agtcgaactgtttcctttccagaaa

SEQ ID NO: 25751 - DNA, 25 bp, Homo sapien
agtcgacagttttacacaacattct

SEQ ID NO: 25752 - DNA, 25 bp, Homo sapien
agtcgacagttttacagaacattct

SEQ ID NO: 25753 - DNA, 25 bp, Homo sapien
agtcgatacatctcttcgtgtgact

SEQ ID NO: 25754 - DNA, 25 bp, Homo sapien
agtcgatatatctcttcgtgtgact

SEQ ID NO: 25755 - DNA, 25 bp, Homo sapien
agtcgcttaattcaggaggcagagg

SEQ ID NO: 25756 - DNA, 25 bp, Homo sapien
agtcgcttaattcgggaggcagagg

SEQ ID NO: 25757 - DNA, 25 bp, Homo sapien
agtcgtcaaagctgaaagcctgttt

SEQ ID NO: 25758 - DNA, 25 bp, Homo sapien
agtcgtcaaagctgaatgcctgttt

SEQ ID NO: 25759 - DNA, 25 bp, Homo sapien
agtcgtgatggagccgctgcacccc

SEQ ID NO: 25760 - DNA, 25 bp, Homo sapien
agtcgtgattgagccgctgcacccc

SEQ ID NO: 25761 - DNA, 25 bp, Homo sapien
agtcgtttgtgcccacagtaactcc

SEQ ID NO: 25762 - DNA, 25 bp, Homo sapien
agtcgtttgtgcccaccgtaactcc

SEQ ID NO: 25763 - DNA, 25 bp, Homo sapien
agtctaaaaaaaccctgaaatctga

SEQ ID NO: 25764 - DNA, 25 bp, Homo sapien
agtctaaaaaacccctgaaatctga

SEQ ID NO: 25765 - DNA, 25 bp, Homo sapien
agtctaaactgaggatcattcacct

SEQ ID NO: 25766 - DNA, 25 bp, Homo sapien
agtctaaactgaggattattcacct

SEQ ID NO: 25767 - DNA, 25 bp, Homo sapien
agtctaagctgaatctagttatttt

SEQ ID NO: 25768 - DNA, 25 bp, Homo sapien
agtctaaggtgaatctagttatttt

SEQ ID NO: 25769 - DNA, 25 bp, Homo sapien
agtctaatactcaaaatttcccatg

SEQ ID NO: 25770 - DNA, 25 bp, Homo sapien
agtctaatactttcaggaagaaaca

SEQ ID NO: 25771 - DNA, 25 bp, Homo sapien
agtctaatactttgaggaagaaaca

SEQ ID NO: 25772 - DNA, 25 bp, Homo sapien
agtctaatagtgcaattctttccct

SEQ ID NO: 25773 - DNA, 25 bp, Homo sapien
agtctaatagttcctactgccagaa

SEQ ID NO: 25774 - DNA, 25 bp, Homo sapien
agtctaatattcaaaatttcccatg

SEQ ID NO: 25775 - DNA, 25 bp, Homo sapien
agtctaatattgcaattctttccct

SEQ ID NO: 25776 - DNA, 25 bp, Homo sapien
agtctaatggttcctactgccagaa

SEQ ID NO: 25777 - DNA, 25 bp, Homo sapien
agtctacaggcctttaagcctctgg

SEQ ID NO: 25778 - DNA, 25 bp, Homo sapien
agtctacaggcgtttaagcctctgg

SEQ ID NO: 25779 - DNA, 25 bp, Homo sapien
agtctactcgtggtccctgaaatat

SEQ ID NO: 25780 - DNA, 25 bp, Homo sapien
agtctactcgttgtccctgaaatat

SEQ ID NO: 25781 - DNA, 25 bp, Homo sapien
agtctaggtgttcaaaccaactcct

SEQ ID NO: 25782 - DNA, 25 bp, Homo sapien
agtctaggtgttcgaaccaactcct

SEQ ID NO: 25783 - DNA, 25 bp, Homo sapien
agtctagtcgggttagatagaaata

SEQ ID NO: 25784 - DNA, 25 bp, Homo sapien
agtctagttgggttagatagaaata

SEQ ID NO: 25785 - DNA, 25 bp, Homo sapien
agtctatcaagctatttactgagtg

SEQ ID NO: 25786 - DNA, 25 bp, Homo sapien
agtctatcaggctatttactgagtg

SEQ ID NO: 25787 - DNA, 25 bp, Homo sapien
agtctattcaggtatctaaacaagg

SEQ ID NO: 25788 - DNA, 25 bp, Homo sapien
agtctattcagttatctaaacaagg

SEQ ID NO: 25789 - DNA, 25 bp, Homo sapien
agtctattttctcatgcctaagtga

SEQ ID NO: 25790 - DNA, 25 bp, Homo sapien
agtctattttctcatggctaagtga

SEQ ID NO: 25791 - DNA, 25 bp, Homo sapien
agtctcaaaattaatgttccagtcc

SEQ ID NO: 25792 - DNA, 25 bp, Homo sapien
agtctcaaaatttatgttccagtcc

SEQ ID NO: 25793 - DNA, 25 bp, Homo sapien
agtctcaaagtggagtgttctttct

SEQ ID NO: 25794 - DNA, 25 bp, Homo sapien
agtctcaaagtggagttttctttct

SEQ ID NO: 25795 - DNA, 25 bp, Homo sapien
agtctcaaatccatttccttgaccc

SEQ ID NO: 25796 - DNA, 25 bp, Homo sapien
agtctcaaatccttttccttgaccc

SEQ ID NO: 25797 - DNA, 25 bp, Homo sapien
agtctcaatagtttgctagatggca

SEQ ID NO: 25798 - DNA, 25 bp, Homo sapien
agtctcaatggtttgctagatggca

SEQ ID NO: 25799 - DNA, 25 bp, Homo sapien
agtctcactttcgctgttcttcctg

SEQ ID NO: 25800 - DNA, 25 bp, Homo sapien
agtctcacttttgctgttcttcctg

SEQ ID NO: 25801 - DNA, 25 bp, Homo sapien
agtctcagaaaccatggagccatat

SEQ ID NO: 25802 - DNA, 25 bp, Homo sapien
agtctcagaaatcatggagccatat

SEQ ID NO: 25803 - DNA, 25 bp, Homo sapien
agtctcagaagaatttaccaatatg

SEQ ID NO: 25804 - DNA, 25 bp, Homo sapien
agtctcagcagaatttaccaatatg

SEQ ID NO: 25805 - DNA, 25 bp, Homo sapien
agtctcagctacatactgtttcatt

SEQ ID NO: 25806 - DNA, 25 bp, Homo sapien
agtctcagctacgtactgtttcatt

SEQ ID NO: 25807 - DNA, 25 bp, Homo sapien
agtctcagcttgccgcaatcttggt

SEQ ID NO: 25808 - DNA, 25 bp, Homo sapien
agtctcagcttgctgcaatcttggt

SEQ ID NO: 25809 - DNA, 25 bp, Homo sapien
agtctcaggccagtcactttctttt

SEQ ID NO: 25810 - DNA, 25 bp, Homo sapien
agtctcaggccggtcactttctttt

SEQ ID NO: 25811 - DNA, 25 bp, Homo sapien
agtctcatacacgcaattgtgtgaa

SEQ ID NO: 25812 - DNA, 25 bp, Homo sapien
agtctcatacatgcaattgtgtgaa

SEQ ID NO: 25813 - DNA, 25 bp, Homo sapien
agtctcatcacaaattctgttttag

SEQ ID NO: 25814 - DNA, 25 bp, Homo sapien
agtctcatcacaatttctgttttag

SEQ ID NO: 25815 - DNA, 25 bp, Homo sapien
agtctcatccatatcattgtcactg

SEQ ID NO: 25816 - DNA, 25 bp, Homo sapien
agtctcatccatattattgtcactg

SEQ ID NO: 25817 - DNA, 25 bp, Homo sapien
agtctcatttgtctgtgatccctga

SEQ ID NO: 25818 - DNA, 25 bp, Homo sapien
agtctcatttgtctttgatccctga

SEQ ID NO: 25819 - DNA, 25 bp, Homo sapien
agtctccaaaaagcaaagtcataac

SEQ ID NO: 25820 - DNA, 25 bp, Homo sapien
agtctccagaaagcaaagtcataac

SEQ ID NO: 25821 - DNA, 25 bp, Homo sapien
agtctcccatgcatgcaggccctga

SEQ ID NO: 25822 - DNA, 25 bp, Homo sapien
agtctcccgtgcatgcaggccctga

SEQ ID NO: 25823 - DNA, 25 bp, Homo sapien
agtctcctagaacatacatctgagg

SEQ ID NO: 25824 - DNA, 25 bp, Homo sapien
agtctcctggaacatacatctgagg

SEQ ID NO: 25825 - DNA, 25 bp, Homo sapien
agtctcctgtttctgattgtagctg

SEQ ID NO: 25826 - DNA, 25 bp, Homo sapien
agtctcctgtttttgattgtagctg

SEQ ID NO: 25827 - DNA, 25 bp, Homo sapien
agtctctaaataacttcaccagaac

SEQ ID NO: 25828 - DNA, 25 bp, Homo sapien
agtctctaaatagcttcaccagaac

SEQ ID NO: 25829 - DNA, 25 bp, Homo sapien
agtctctaacccagtcattttgtag

SEQ ID NO: 25830 - DNA, 25 bp, Homo sapien
agtctctaacccagtcgttttgtag

SEQ ID NO: 25831 - DNA, 25 bp, Homo sapien
agtctctacaaacacagggtaggct

SEQ ID NO: 25832 - DNA, 25 bp, Homo sapien
agtctctataaacacagggtaggct

SEQ ID NO: 25833 - DNA, 25 bp, Homo sapien
agtctctccctatgtgtcagcctcc

SEQ ID NO: 25834 - DNA, 25 bp, Homo sapien
agtctctccctgtgtgtcagcctcc

SEQ ID NO: 25835 - DNA, 25 bp, Homo sapien
agtctctggaacgtgggatctaatt

SEQ ID NO: 25836 - DNA, 25 bp, Homo sapien
agtctctggaatgtgggatctaatt

SEQ ID NO: 25837 - DNA, 25 bp, Homo sapien
agtctctgtctaatgatgcttcaaa

SEQ ID NO: 25838 - DNA, 25 bp, Homo sapien
agtctctgtctgatgatgcttcaaa

SEQ ID NO: 25839 - DNA, 25 bp, Homo sapien
agtctctttcgtcaattggaggtat

SEQ ID NO: 25840 - DNA, 25 bp, Homo sapien
agtctctttcgtcagttggaggtat

SEQ ID NO: 25841 - DNA, 25 bp, Homo sapien
agtctgaaatcaaggtgtaaagagg

SEQ ID NO: 25842 - DNA, 25 bp, Homo sapien
agtctgaaatcaatgtgtaaagagg

SEQ ID NO: 25843 - DNA, 25 bp, Homo sapien
agtctgaactgtaaaagaaattgtg

SEQ ID NO: 25844 - DNA, 25 bp, Homo sapien
agtctgaactgtaaggtatgcaaaa

SEQ ID NO: 25845 - DNA, 25 bp, Homo sapien
agtctgaactgtgaaagaaattgtg

SEQ ID NO: 25846 - DNA, 25 bp, Homo sapien
agtctgaactgtgaggtatgcaaaa

SEQ ID NO: 25847 - DNA, 25 bp, Homo sapien
agtctgaaggggaattatgttagag

SEQ ID NO: 25848 - DNA, 25 bp, Homo sapien
agtctgaatgggaattatgttagag

SEQ ID NO: 25849 - DNA, 25 bp, Homo sapien
agtctgattatcctgagcaggttcc

SEQ ID NO: 25850 - DNA, 25 bp, Homo sapien
agtctgattctcacaaatggcctag

SEQ ID NO: 25851 - DNA, 25 bp, Homo sapien
agtctgattctcataaatggcctag

SEQ ID NO: 25852 - DNA, 25 bp, Homo sapien
agtctgattgtcctgagcaggttcc

SEQ ID NO: 25853 - DNA, 25 bp, Homo sapien
agtctgatttaaaactatttatgca

SEQ ID NO: 25854 - DNA, 25 bp, Homo sapien
agtctgatttaaaagtatttatgca

SEQ ID NO: 25855 - DNA, 25 bp, Homo sapien
agtctgcaagagccaagcattactg

SEQ ID NO: 25856 - DNA, 25 bp, Homo sapien
agtctgcaagatccaagcattactg

SEQ ID NO: 25857 - DNA, 25 bp, Homo sapien
agtctgcataaatgtgggatgcctc

SEQ ID NO: 25858 - DNA, 25 bp, Homo sapien
agtctgcataactgtgggatgcctc

SEQ ID NO: 25859 - DNA, 25 bp, Homo sapien
agtctgcatcataaacccaaattcc

SEQ ID NO: 25860 - DNA, 25 bp, Homo sapien
agtctgcatcatgaacccaaattcc

SEQ ID NO: 25861 - DNA, 25 bp, Homo sapien
agtctgctatttgggcgcctcaatc

SEQ ID NO: 25862 - DNA, 25 bp, Homo sapien
agtctgctatttgggctcctcaatc

SEQ ID NO: 25863 - DNA, 25 bp, Homo sapien
agtctgctcttaaagctttctgcct

SEQ ID NO: 25864 - DNA, 25 bp, Homo sapien
agtctgctcttaaggctttctgcct

SEQ ID NO: 25865 - DNA, 25 bp, Homo sapien
agtctgctgagctcatgttgtcaca

SEQ ID NO: 25866 - DNA, 25 bp, Homo sapien
agtctgctgagctcttgttgtcaca

SEQ ID NO: 25867 - DNA, 25 bp, Homo sapien
agtctggacgtaggagttggcatta

SEQ ID NO: 25868 - DNA, 25 bp, Homo sapien
agtctggatgtaggagttggcatta

SEQ ID NO: 25869 - DNA, 25 bp, Homo sapien
agtctggttatctctatttaaatgg

SEQ ID NO: 25870 - DNA, 25 bp, Homo sapien
agtctggttatttctatttaaatgg

SEQ ID NO: 25871 - DNA, 25 bp, Homo sapien
agtctgtcagaattccatgtgggcc

SEQ ID NO: 25872 - DNA, 25 bp, Homo sapien
agtctgtcagaattccctgtgggcc

SEQ ID NO: 25873 - DNA, 25 bp, Homo sapien
agtctgtgacctctgtgctttgttt

SEQ ID NO: 25874 - DNA, 25 bp, Homo sapien
agtctgtgatctctgtgctttgttt

SEQ ID NO: 25875 - DNA, 25 bp, Homo sapien
agtctgtgctttcataggccactct

SEQ ID NO: 25876 - DNA, 25 bp, Homo sapien
agtctgtgctttgataggccactct

SEQ ID NO: 25877 - DNA, 25 bp, Homo sapien
agtctgttaataaggaatttttgga

SEQ ID NO: 25878 - DNA, 25 bp, Homo sapien
agtctgttaatgaggaatttttgga

SEQ ID NO: 25879 - DNA, 25 bp, Homo sapien
agtctgttctcagttttcttttgca

SEQ ID NO: 25880 - DNA, 25 bp, Homo sapien
agtctgttctccgttttcttttgca

SEQ ID NO: 25881 - DNA, 25 bp, Homo sapien
agtctgtttcctgcttctataacag

SEQ ID NO: 25882 - DNA, 25 bp, Homo sapien
agtctgttttctgcttctataacag

SEQ ID NO: 25883 - DNA, 25 bp, Homo sapien
agtcttaataaattcgaaaattgaa

SEQ ID NO: 25884 - DNA, 25 bp, Homo sapien
agtcttaatgaattcgaaaattgaa

SEQ ID NO: 25885 - DNA, 25 bp, Homo sapien
agtcttacatgccttcttaaaacac

SEQ ID NO: 25886 - DNA, 25 bp, Homo sapien
agtcttacatgctttcttaaaacac

SEQ ID NO: 25887 - DNA, 25 bp, Homo sapien
agtcttactgcaaagcattcaagag

SEQ ID NO: 25888 - DNA, 25 bp, Homo sapien
agtcttactgcaaagcgttcaagag

SEQ ID NO: 25889 - DNA, 25 bp, Homo sapien
agtcttagagatagtatcccaggtg

SEQ ID NO: 25890 - DNA, 25 bp, Homo sapien
agtcttagagatggtatcccaggtg

SEQ ID NO: 25891 - DNA, 25 bp, Homo sapien
agtcttagtatttatctggttccct

SEQ ID NO: 25892 - DNA, 25 bp, Homo sapien
agtcttagtatttctctggttccct

SEQ ID NO: 25893 - DNA, 25 bp, Homo sapien
agtcttcaaaaggacaaaattataa

SEQ ID NO: 25894 - DNA, 25 bp, Homo sapien
agtcttcaaaaggataaaattataa

SEQ ID NO: 25895 - DNA, 25 bp, Homo sapien
agtcttcactgtccttcttgtgata

SEQ ID NO: 25896 - DNA, 25 bp, Homo sapien
agtcttcatacaaggcattgaacac

SEQ ID NO: 25897 - DNA, 25 bp, Homo sapien
agtcttcatacaaggccttgaacac

SEQ ID NO: 25898 - DNA, 25 bp, Homo sapien
agtcttcattgtccttcttgtgata

SEQ ID NO: 25899 - DNA, 25 bp, Homo sapien
agtcttctaacttactattcacaca

SEQ ID NO: 25900 - DNA, 25 bp, Homo sapien
agtcttctaacttattattcacaca

SEQ ID NO: 25901 - DNA, 25 bp, Homo sapien
agtcttctctccagcagaaatgatc

SEQ ID NO: 25902 - DNA, 25 bp, Homo sapien
agtcttctctccggcagaaatgatc

SEQ ID NO: 25903 - DNA, 25 bp, Homo sapien
agtcttctgggaagctcgtcccatt

SEQ ID NO: 25904 - DNA, 25 bp, Homo sapien
agtcttctgggaagcttgtcccatt

SEQ ID NO: 25905 - DNA, 25 bp, Homo sapien
agtcttgaaggaagagtgagaaaag

SEQ ID NO: 25906 - DNA, 25 bp, Homo sapien
agtcttgagggaagagtgagaaaag

SEQ ID NO: 25907 - DNA, 25 bp, Homo sapien
agtcttgcactctcaaaatgagtgt

SEQ ID NO: 25908 - DNA, 25 bp, Homo sapien
agtcttgcactctcgaaatgagtgt

SEQ ID NO: 25909 - DNA, 25 bp, Homo sapien
agtcttgctaagtgtattttctgag

SEQ ID NO: 25910 - DNA, 25 bp, Homo sapien
agtcttgctaattgtattttctgag

SEQ ID NO: 25911 - DNA, 25 bp, Homo sapien
agtcttgctatcgagtcctcggacc

SEQ ID NO: 25912 - DNA, 25 bp, Homo sapien
agtcttgctgtcgagtcctcggacc

SEQ ID NO: 25913 - DNA, 25 bp, Homo sapien
agtctttaccaactcagtcaatgtc

SEQ ID NO: 25914 - DNA, 25 bp, Homo sapien
agtctttaccaattcagtcaatgtc

SEQ ID NO: 25915 - DNA, 25 bp, Homo sapien
agtctttatatcaccaaagcaccaa

SEQ ID NO: 25916 - DNA, 25 bp, Homo sapien
agtctttatatcgccaaagcaccaa

SEQ ID NO: 25917 - DNA, 25 bp, Homo sapien
agtctttcaaaattttcaagatggc

SEQ ID NO: 25918 - DNA, 25 bp, Homo sapien
agtctttcaaaattttgaagatggc

SEQ ID NO: 25919 - DNA, 25 bp, Homo sapien
agtctttctcattacagggttagct

SEQ ID NO: 25920 - DNA, 25 bp, Homo sapien
agtctttctcattagagggttagct

SEQ ID NO: 25921 - DNA, 25 bp, Homo sapien
agtctttcttactaccattcctctc

SEQ ID NO: 25922 - DNA, 25 bp, Homo sapien
agtctttcttactatcattcctctc

SEQ ID NO: 25923 - DNA, 25 bp, Homo sapien
agtctttttcacagaacagttgctt

SEQ ID NO: 25924 - DNA, 25 bp, Homo sapien
agtctttttcacagcacagttgctt

SEQ ID NO: 25925 - DNA, 25 bp, Homo sapien
agtgaaaaacacaatggttgcatga

SEQ ID NO: 25926 - DNA, 25 bp, Homo sapien
agtgaaaaacacagtggttgcatga

SEQ ID NO: 25927 - DNA, 25 bp, Homo sapien
agtgaaaaaccgaatattccaagac

SEQ ID NO: 25928 - DNA, 25 bp, Homo sapien
agtgaaaactaccgaaaacacaaat

SEQ ID NO: 25929 - DNA, 25 bp, Homo sapien
agtgaaaactacggaaaacacaaat

SEQ ID NO: 25930 - DNA, 25 bp, Homo sapien
agtgaaaaggcaattcatagaatgg

SEQ ID NO: 25931 - DNA, 25 bp, Homo sapien
agtgaaaaggcgattcatagaatgg

SEQ ID NO: 25932 - DNA, 25 bp, Homo sapien
agtgaaaatccgaatattccaagac

SEQ ID NO: 25933 - DNA, 25 bp, Homo sapien
agtgaaagaaaaaatactgaatttg

SEQ ID NO: 25934 - DNA, 25 bp, Homo sapien
agtgaaagaaaaaatattgaatttg

SEQ ID NO: 25935 - DNA, 25 bp, Homo sapien
agtgaaagaccagaggattaaatgg

SEQ ID NO: 25936 - DNA, 25 bp, Homo sapien
agtgaaagaccggaggattaaatgg

SEQ ID NO: 25937 - DNA, 25 bp, Homo sapien
agtgaaatatctcttcatgactctt

SEQ ID NO: 25938 - DNA, 25 bp, Homo sapien
agtgaaatcacatctgatacagaag

SEQ ID NO: 25939 - DNA, 25 bp, Homo sapien
agtgaaatcacatctggtacagaag

SEQ ID NO: 25940 - DNA, 25 bp, Homo sapien
agtgaaatgatgggtagagtctaaa

SEQ ID NO: 25941 - DNA, 25 bp, Homo sapien
agtgaaatgatggttagagtctaaa

SEQ ID NO: 25942 - DNA, 25 bp, Homo sapien
agtgaaatgtctcttcatgactctt

SEQ ID NO: 25943 - DNA, 25 bp, Homo sapien
agtgaacaaataagagaagcaggat

SEQ ID NO: 25944 - DNA, 25 bp, Homo sapien
agtgaacaagtaagagaagcaggat

SEQ ID NO: 25945 - DNA, 25 bp, Homo sapien
agtgaacacaataatagccaaatat

SEQ ID NO: 25946 - DNA, 25 bp, Homo sapien
agtgaacacccttttttgccaagga

SEQ ID NO: 25947 - DNA, 25 bp, Homo sapien
agtgaacactcagctcaaagtccat

SEQ ID NO: 25948 - DNA, 25 bp, Homo sapien
agtgaacactcggctcaaagtccat

SEQ ID NO: 25949 - DNA, 25 bp, Homo sapien
agtgaacagaataatagccaaatat

SEQ ID NO: 25950 - DNA, 25 bp, Homo sapien
agtgaacagccttttttgccaagga

SEQ ID NO: 25951 - DNA, 25 bp, Homo sapien
agtgaaccaaaatagggccactgca

SEQ ID NO: 25952 - DNA, 25 bp, Homo sapien
agtgaaccctcaaacacaaaacaca

SEQ ID NO: 25953 - DNA, 25 bp, Homo sapien
agtgaaccctcaagcacaaaacaca

SEQ ID NO: 25954 - DNA, 25 bp, Homo sapien
agtgaaccgaaatagggccactgca

SEQ ID NO: 25955 - DNA, 25 bp, Homo sapien
agtgaacgagccaccttttccatga

SEQ ID NO: 25956 - DNA, 25 bp, Homo sapien
agtgaacgagccactttttccatga

SEQ ID NO: 25957 - DNA, 25 bp, Homo sapien
agtgaagacagtaacacagcaggat

SEQ ID NO: 25958 - DNA, 25 bp, Homo sapien
agtgaagacagttacacagcaggat

SEQ ID NO: 25959 - DNA, 25 bp, Homo sapien
agtgaagcagaatggtaaaccagct

SEQ ID NO: 25960 - DNA, 25 bp, Homo sapien
agtgaagcagagtggtaaaccagct

SEQ ID NO: 25961 - DNA, 25 bp, Homo sapien
agtgaagcgatactgaccataaaaa

SEQ ID NO: 25962 - DNA, 25 bp, Homo sapien
agtgaagctatactgaccataaaaa

SEQ ID NO: 25963 - DNA, 25 bp, Homo sapien
agtgaaggaatgagggaacaatgaa

SEQ ID NO: 25964 - DNA, 25 bp, Homo sapien
agtgaaggaatgcgggaacaatgaa

SEQ ID NO: 25965 - DNA, 25 bp, Homo sapien
agtgaaggagggtggcacatgctca

SEQ ID NO: 25966 - DNA, 25 bp, Homo sapien
agtgaaggagggtggcgcatgctca

SEQ ID NO: 25967 - DNA, 25 bp, Homo sapien
agtgaaggtatgtattataagacct

SEQ ID NO: 25968 - DNA, 25 bp, Homo sapien
agtgaaggtatgtattgtaagacct

SEQ ID NO: 25969 - DNA, 25 bp, Homo sapien
agtgaaggttgatatcattttctga

SEQ ID NO: 25970 - DNA, 25 bp, Homo sapien
agtgaaggttggtatcattttctga

SEQ ID NO: 25971 - DNA, 25 bp, Homo sapien
agtgaagtatatcaagcagaaggaa

SEQ ID NO: 25972 - DNA, 25 bp, Homo sapien
agtgaagtatatcgagcagaaggaa

SEQ ID NO: 25973 - DNA, 25 bp, Homo sapien
agtgaagtggaccttgatgtgactc

SEQ ID NO: 25974 - DNA, 25 bp, Homo sapien
agtgaagtggaccttggtgtgactc

SEQ ID NO: 25975 - DNA, 25 bp, Homo sapien
agtgaagtggctcttcccatggaca

SEQ ID NO: 25976 - DNA, 25 bp, Homo sapien
agtgaagtggctcttcgcatggaca

SEQ ID NO: 25977 - DNA, 25 bp, Homo sapien
agtgaagttaatcgtgccccaaaac

SEQ ID NO: 25978 - DNA, 25 bp, Homo sapien
agtgaagttcatcgtgccccaaaac

SEQ ID NO: 25979 - DNA, 25 bp, Homo sapien
agtgaataaaaaagataatgcaggt

SEQ ID NO: 25980 - DNA, 25 bp, Homo sapien
agtgaataaaaaaggtaatgcaggt

SEQ ID NO: 25981 - DNA, 25 bp, Homo sapien
agtgaataagttacatatacatggc

SEQ ID NO: 25982 - DNA, 25 bp, Homo sapien
agtgaataagttacgtatacatggc

SEQ ID NO: 25983 - DNA, 25 bp, Homo sapien
agtgaatacaaactcattctcagaa

SEQ ID NO: 25984 - DNA, 25 bp, Homo sapien
agtgaatataaactcattctcagaa

SEQ ID NO: 25985 - DNA, 25 bp, Homo sapien
agtgaatatgtgacctggagtctgc

SEQ ID NO: 25986 - DNA, 25 bp, Homo sapien
agtgaatatgtgacttggagtctgc

SEQ ID NO: 25987 - DNA, 25 bp, Homo sapien
agtgaatcttatgactcttaacctc

SEQ ID NO: 25988 - DNA, 25 bp, Homo sapien
agtgaatcttatgagtcttaacctc

SEQ ID NO: 25989 - DNA, 25 bp, Homo sapien
agtgaatgacgctaaagggtaattt

SEQ ID NO: 25990 - DNA, 25 bp, Homo sapien
agtgaatgagaaagaatttttttgc

SEQ ID NO: 25991 - DNA, 25 bp, Homo sapien
agtgaatgagaaataatttttttgc

SEQ ID NO: 25992 - DNA, 25 bp, Homo sapien
agtgaatgagctgagaggtgagtga

SEQ ID NO: 25993 - DNA, 25 bp, Homo sapien
agtgaatgatgctaaagggtaattt

SEQ ID NO: 25994 - DNA, 25 bp, Homo sapien
agtgaatggagtccacggatgttgc

SEQ ID NO: 25995 - DNA, 25 bp, Homo sapien
agtgaatggagtccgcggatgttgc

SEQ ID NO: 25996 - DNA, 25 bp, Homo sapien
agtgaatgggctgagaggtgagtga

SEQ ID NO: 25997 - DNA, 25 bp, Homo sapien
agtgaattaaacagagaagactaga

SEQ ID NO: 25998 - DNA, 25 bp, Homo sapien
agtgaattaaacggagaagactaga

SEQ ID NO: 25999 - DNA, 25 bp, Homo sapien
agtgaattattacaggaaaaaaata

SEQ ID NO: 26000 - DNA, 25 bp, Homo sapien
agtgaattattacgggaaaaaaata

SEQ ID NO: 26001 - DNA, 25 bp, Homo sapien
agtgaattcattacccaatcctgga

SEQ ID NO: 26002 - DNA, 25 bp, Homo sapien
agtgaattctagccacttattactg

SEQ ID NO: 26003 - DNA, 25 bp, Homo sapien
agtgaattgattacccaatcctgga

SEQ ID NO: 26004 - DNA, 25 bp, Homo sapien
agtgaattttagccacttattactg

SEQ ID NO: 26005 - DNA, 25 bp, Homo sapien
agtgacaaatgtcctcatgcctacc

SEQ ID NO: 26006 - DNA, 25 bp, Homo sapien
agtgacaaatgtcctcgtgcctacc

SEQ ID NO: 26007 - DNA, 25 bp, Homo sapien
agtgacaatttatcatatccatcat

SEQ ID NO: 26008 - DNA, 25 bp, Homo sapien
agtgacaatttattatatccatcat

SEQ ID NO: 26009 - DNA, 25 bp, Homo sapien
agtgacactcgtgcctggcatgctc

SEQ ID NO: 26010 - DNA, 25 bp, Homo sapien
agtgacacttgtgcctggcatgctc

SEQ ID NO: 26011 - DNA, 25 bp, Homo sapien
agtgacagaaaaacgccaggaccca

SEQ ID NO: 26012 - DNA, 25 bp, Homo sapien
agtgacagaaaaatgccaggaccca

SEQ ID NO: 26013 - DNA, 25 bp, Homo sapien
agtgacagttggcacagtggaaaca

SEQ ID NO: 26014 - DNA, 25 bp, Homo sapien
agtgacagttggctcagtggaaaca

SEQ ID NO: 26015 - DNA, 25 bp, Homo sapien
agtgacataaaacggaaatataagt

SEQ ID NO: 26016 - DNA, 25 bp, Homo sapien
agtgacataaaatggaaatataagt

SEQ ID NO: 26017 - DNA, 25 bp, Homo sapien
agtgacatattcggtgttcacattg

SEQ ID NO: 26018 - DNA, 25 bp, Homo sapien
agtgacatatttggtgttcacattg

SEQ ID NO: 26019 - DNA, 25 bp, Homo sapien
agtgacctacactggagtcctgaat

SEQ ID NO: 26020 - DNA, 25 bp, Homo sapien
agtgacctacattggagtcctgaat

SEQ ID NO: 26021 - DNA, 25 bp, Homo sapien
agtgacctagtaacatccaaaagga

SEQ ID NO: 26022 - DNA, 25 bp, Homo sapien
agtgacctggtaacatccaaaagga

SEQ ID NO: 26023 - DNA, 25 bp, Homo sapien
agtgacgtgtttctcctggtaacaa

SEQ ID NO: 26024 - DNA, 25 bp, Homo sapien
agtgacgtgtttttcctggtaacaa

SEQ ID NO: 26025 - DNA, 25 bp, Homo sapien
agtgactaaaatgatggcaaataag

SEQ ID NO: 26026 - DNA, 25 bp, Homo sapien
agtgactaaaatgatgtcaaataag

SEQ ID NO: 26027 - DNA, 25 bp, Homo sapien
agtgactacgtcaggcagcaagcaa

SEQ ID NO: 26028 - DNA, 25 bp, Homo sapien
agtgactatgtcaggcagcaagcaa

SEQ ID NO: 26029 - DNA, 25 bp, Homo sapien
agtgactcatagtagatcatttgta

SEQ ID NO: 26030 - DNA, 25 bp, Homo sapien
agtgactcatattagatcatttgta

SEQ ID NO: 26031 - DNA, 25 bp, Homo sapien
agtgacttggacaaggtggtcaggg

SEQ ID NO: 26032 - DNA, 25 bp, Homo sapien
agtgacttggataaggtggtcaggg

SEQ ID NO: 26033 - DNA, 25 bp, Homo sapien
agtgactttactcggatagagtgtt

SEQ ID NO: 26034 - DNA, 25 bp, Homo sapien
agtgactttacttggatagagtgtt

SEQ ID NO: 26035 - DNA, 25 bp, Homo sapien
agtgactttcgttttcttctttgtg

SEQ ID NO: 26036 - DNA, 25 bp, Homo sapien
agtgacttttgttttcttctttgtg

SEQ ID NO: 26037 - DNA, 25 bp, Homo sapien
agtgagaaaatgtaggccttttaat

SEQ ID NO: 26038 - DNA, 25 bp, Homo sapien
agtgagaaaatgtagggcttttaat

SEQ ID NO: 26039 - DNA, 25 bp, Homo sapien
agtgagaaatctacgctgccgctta

SEQ ID NO: 26040 - DNA, 25 bp, Homo sapien
agtgagaaatctactctgccgctta

SEQ ID NO: 26041 - DNA, 25 bp, Homo sapien
agtgagaaatgtcaaattgaactat

SEQ ID NO: 26042 - DNA, 25 bp, Homo sapien
agtgagaacatgtggtatttagcgt

SEQ ID NO: 26043 - DNA, 25 bp, Homo sapien
agtgagaacatgtgttatttagcgt

SEQ ID NO: 26044 - DNA, 25 bp, Homo sapien
agtgagaactccaagtagaagcagg

SEQ ID NO: 26045 - DNA, 25 bp, Homo sapien
agtgagaactccaggtagaagcagg

SEQ ID NO: 26046 - DNA, 25 bp, Homo sapien
agtgagaactgtcaaattgaactat

SEQ ID NO: 26047 - DNA, 25 bp, Homo sapien
agtgagaagttctgcctgtggagga

SEQ ID NO: 26048 - DNA, 25 bp, Homo sapien
agtgagaagttttgcctgtggagga

SEQ ID NO: 26049 - DNA, 25 bp, Homo sapien
agtgagaatctttaatcacatccaa

SEQ ID NO: 26050 - DNA, 25 bp, Homo sapien
agtgagaatttttaatcacatccaa

SEQ ID NO: 26051 - DNA, 25 bp, Homo sapien
agtgagagaagacgcacctcaggga

SEQ ID NO: 26052 - DNA, 25 bp, Homo sapien
agtgagagaagatgcacctcaggga

SEQ ID NO: 26053 - DNA, 25 bp, Homo sapien
agtgagatgcgaactaaaagggctc

SEQ ID NO: 26054 - DNA, 25 bp, Homo sapien
agtgagatgcggactaaaagggctc

SEQ ID NO: 26055 - DNA, 25 bp, Homo sapien
agtgagatgctatcgatgttgctag

SEQ ID NO: 26056 - DNA, 25 bp, Homo sapien
agtgagatgctattgatgttgctag

SEQ ID NO: 26057 - DNA, 25 bp, Homo sapien
agtgagatggatatacctaacagtt

SEQ ID NO: 26058 - DNA, 25 bp, Homo sapien
agtgagatggatatgcctaacagtt

SEQ ID NO: 26059 - DNA, 25 bp, Homo sapien
agtgagattactaggtttgctttta

SEQ ID NO: 26060 - DNA, 25 bp, Homo sapien
agtgagattactgggtttgctttta

SEQ ID NO: 26061 - DNA, 25 bp, Homo sapien
agtgagctataataggccttaaaag

SEQ ID NO: 26062 - DNA, 25 bp, Homo sapien
agtgagctatactaggccttaaaag

SEQ ID NO: 26063 - DNA, 25 bp, Homo sapien
agtgagctatgtatcttctgctaat

SEQ ID NO: 26064 - DNA, 25 bp, Homo sapien
agtgagctatgtattttctgctaat

SEQ ID NO: 26065 - DNA, 25 bp, Homo sapien
agtgaggacagaagtaagggaatga

SEQ ID NO: 26066 - DNA, 25 bp, Homo sapien
agtgaggacaggagtaagggaatga

SEQ ID NO: 26067 - DNA, 25 bp, Homo sapien
agtgaggctgaacaactaacttgcc

SEQ ID NO: 26068 - DNA, 25 bp, Homo sapien
agtgaggctgaataactaacttgcc

SEQ ID NO: 26069 - DNA, 25 bp, Homo sapien
agtgagggaacaatgaaccctacga

SEQ ID NO: 26070 - DNA, 25 bp, Homo sapien
agtgagggaaccatgaaccctacga

SEQ ID NO: 26071 - DNA, 25 bp, Homo sapien
agtgagggcaagaacagaaaccata

SEQ ID NO: 26072 - DNA, 25 bp, Homo sapien
agtgagggcgagaacagaaaccata

SEQ ID NO: 26073 - DNA, 25 bp, Homo sapien
agtgagtacaaaatagtctctgaaa

SEQ ID NO: 26074 - DNA, 25 bp, Homo sapien
agtgagtacaaactagtctctgaaa

SEQ ID NO: 26075 - DNA, 25 bp, Homo sapien
agtgagtagcttagtatcaggtatc

SEQ ID NO: 26076 - DNA, 25 bp, Homo sapien
agtgagtagcttggtatcaggtatc

SEQ ID NO: 26077 - DNA, 25 bp, Homo sapien
agtgagtcgtgatggagccgctgca

SEQ ID NO: 26078 - DNA, 25 bp, Homo sapien
agtgagtcgtgattgagccgctgca

SEQ ID NO: 26079 - DNA, 25 bp, Homo sapien
agtgagtggcaagctcaaatttaaa

SEQ ID NO: 26080 - DNA, 25 bp, Homo sapien
agtgagtggcaagctctaatttaaa

SEQ ID NO: 26081 - DNA, 25 bp, Homo sapien
agtgagttacatgacctggtagaag

SEQ ID NO: 26082 - DNA, 25 bp, Homo sapien
agtgagttatatgacctggtagaag

SEQ ID NO: 26083 - DNA, 25 bp, Homo sapien
agtgataaaaactcaaacgagtagt

SEQ ID NO: 26084 - DNA, 25 bp, Homo sapien
agtgataaaaactcaagcgagtagt

SEQ ID NO: 26085 - DNA, 25 bp, Homo sapien
agtgataacattgaaagttgacaag

SEQ ID NO: 26086 - DNA, 25 bp, Homo sapien
agtgataacgttgaaagttgacaag

SEQ ID NO: 26087 - DNA, 25 bp, Homo sapien
agtgatacaagaatcttagagttag

SEQ ID NO: 26088 - DNA, 25 bp, Homo sapien
agtgatacgagaatcttagagttag

SEQ ID NO: 26089 - DNA, 25 bp, Homo sapien
agtgatataaagctagcattaattt

SEQ ID NO: 26090 - DNA, 25 bp, Homo sapien
agtgatataaagctaggattaattt

SEQ ID NO: 26091 - DNA, 25 bp, Homo sapien
agtgatataacacaatttgttcaac

SEQ ID NO: 26092 - DNA, 25 bp, Homo sapien
agtgatataccacaatttgttcaac

SEQ ID NO: 26093 - DNA, 25 bp, Homo sapien
agtgatatcttacgaggttttgcta

SEQ ID NO: 26094 - DNA, 25 bp, Homo sapien
agtgatatcttatgaggttttgcta

SEQ ID NO: 26095 - DNA, 25 bp, Homo sapien
agtgatatgacctcggtgtttattg

SEQ ID NO: 26096 - DNA, 25 bp, Homo sapien
agtgatatgacttcggtgtttattg

SEQ ID NO: 26097 - DNA, 25 bp, Homo sapien
agtgatcacactatttcacctccta

SEQ ID NO: 26098 - DNA, 25 bp, Homo sapien
agtgatcatactatttcacctccta

SEQ ID NO: 26099 - DNA, 25 bp, Homo sapien
agtgatcatcaatttaaatcagcct

SEQ ID NO: 26100 - DNA, 25 bp, Homo sapien
agtgatcatcattttaaatcagcct

SEQ ID NO: 26101 - DNA, 25 bp, Homo sapien
agtgatccctgcagtattgtttcta

SEQ ID NO: 26102 - DNA, 25 bp, Homo sapien
agtgatccctgcggtattgtttcta

SEQ ID NO: 26103 - DNA, 25 bp, Homo sapien
agtgatgaggacctagatttgaccc

SEQ ID NO: 26104 - DNA, 25 bp, Homo sapien
agtgatgaggacttagatttgaccc

SEQ ID NO: 26105 - DNA, 25 bp, Homo sapien
agtgatgcaatcattgaccttgaaa

SEQ ID NO: 26106 - DNA, 25 bp, Homo sapien
agtgatgcaatcgttgaccttgaaa

SEQ ID NO: 26107 - DNA, 25 bp, Homo sapien
agtgatgccaccattgacttcagtt

SEQ ID NO: 26108 - DNA, 25 bp, Homo sapien
agtgatgccaccgttgacttcagtt

SEQ ID NO: 26109 - DNA, 25 bp, Homo sapien
agtgatggagtcggctctttcctgg

SEQ ID NO: 26110 - DNA, 25 bp, Homo sapien
agtgatggagttggctctttcctgg

SEQ ID NO: 26111 - DNA, 25 bp, Homo sapien
agtgatggtagatatgactcttttt

SEQ ID NO: 26112 - DNA, 25 bp, Homo sapien
agtgatggtagatatggctcttttt

SEQ ID NO: 26113 - DNA, 25 bp, Homo sapien
agtgatgtaaaattaacaatgatat

SEQ ID NO: 26114 - DNA, 25 bp, Homo sapien
agtgatgtaaaattgacaatgatat

SEQ ID NO: 26115 - DNA, 25 bp, Homo sapien
agtgatgttttatatactgtcagca

SEQ ID NO: 26116 - DNA, 25 bp, Homo sapien
agtgatgttttctatactgtcagca

SEQ ID NO: 26117 - DNA, 25 bp, Homo sapien
agtgattcaagcacacatgtggcca

SEQ ID NO: 26118 - DNA, 25 bp, Homo sapien
agtgattcaaggacacatgtggcca

SEQ ID NO: 26119 - DNA, 25 bp, Homo sapien
agtgattccaattctttcccattat

SEQ ID NO: 26120 - DNA, 25 bp, Homo sapien
agtgattctaattctttcccattat

SEQ ID NO: 26121 - DNA, 25 bp, Homo sapien
agtgattgaaggagaatgagaacga

SEQ ID NO: 26122 - DNA, 25 bp, Homo sapien
agtgattgaaggagcatgagaacga

SEQ ID NO: 26123 - DNA, 25 bp, Homo sapien
agtgatttctttcggtgacaaagtc

SEQ ID NO: 26124 - DNA, 25 bp, Homo sapien
agtgatttcttttggtgacaaagtc

SEQ ID NO: 26125 - DNA, 25 bp, Homo sapien
agtgatttgttccatatagcagagc

SEQ ID NO: 26126 - DNA, 25 bp, Homo sapien
agtgatttgttccgtatagcagagc

SEQ ID NO: 26127 - DNA, 25 bp, Homo sapien
agtgattttaatcgtatgtccatga

SEQ ID NO: 26128 - DNA, 25 bp, Homo sapien
agtgattttaatggtatgtccatga

SEQ ID NO: 26129 - DNA, 25 bp, Homo sapien
agtgatttttgcctcctacttagct

SEQ ID NO: 26130 - DNA, 25 bp, Homo sapien
agtgatttttgcttcctacttagct

SEQ ID NO: 26131 - DNA, 25 bp, Homo sapien
agtgcaaccaacaatgtttttgtaa

SEQ ID NO: 26132 - DNA, 25 bp, Homo sapien
agtgcaaccaataatgtttttgtaa

SEQ ID NO: 26133 - DNA, 25 bp, Homo sapien
agtgcaaccatggaatacttgagtg

SEQ ID NO: 26134 - DNA, 25 bp, Homo sapien
agtgcaaccatggagtacttgagtg

SEQ ID NO: 26135 - DNA, 25 bp, Homo sapien
agtgcacacaagacattcaaatact

SEQ ID NO: 26136 - DNA, 25 bp, Homo sapien
agtgcacacgagacattcaaatact

SEQ ID NO: 26137 - DNA, 25 bp, Homo sapien
agtgcacaggaaagtccctaccccc

SEQ ID NO: 26138 - DNA, 25 bp, Homo sapien
agtgcacaggacagtccctaccccc

SEQ ID NO: 26139 - DNA, 25 bp, Homo sapien
agtgcacaggggaaagccactccag

SEQ ID NO: 26140 - DNA, 25 bp, Homo sapien
agtgcacaggggaaggccactccag

SEQ ID NO: 26141 - DNA, 25 bp, Homo sapien
agtgcagatactgggttttccgtcc

SEQ ID NO: 26142 - DNA, 25 bp, Homo sapien
agtgcagatactgtgttttccgtcc

SEQ ID NO: 26143 - DNA, 25 bp, Homo sapien
agtgcagtccacaaacacctttttg

SEQ ID NO: 26144 - DNA, 25 bp, Homo sapien
agtgcagtccacaatcacctttttg

SEQ ID NO: 26145 - DNA, 25 bp, Homo sapien
agtgcagttgtgatcatagctccct

SEQ ID NO: 26146 - DNA, 25 bp, Homo sapien
agtgcagttgtgattatagctccct

SEQ ID NO: 26147 - DNA, 25 bp, Homo sapien
agtgcataacattttttacttgcaa

SEQ ID NO: 26148 - DNA, 25 bp, Homo sapien
agtgcatagaaacagaatagatttt

SEQ ID NO: 26149 - DNA, 25 bp, Homo sapien
agtgcatagaaatagaatagatttt

SEQ ID NO: 26150 - DNA, 25 bp, Homo sapien
agtgcatagaccacaatagatttta

SEQ ID NO: 26151 - DNA, 25 bp, Homo sapien
agtgcatagactacaatagatttta

SEQ ID NO: 26152 - DNA, 25 bp, Homo sapien
agtgcatagcaaacaacaacataaa

SEQ ID NO: 26153 - DNA, 25 bp, Homo sapien
agtgcatagcagacaacaacataaa

SEQ ID NO: 26154 - DNA, 25 bp, Homo sapien
agtgcatagcattttttacttgcaa

SEQ ID NO: 26155 - DNA, 25 bp, Homo sapien
agtgcatagtgtatcggtattgtgt

SEQ ID NO: 26156 - DNA, 25 bp, Homo sapien
agtgcatagtgtattggtattgtgt

SEQ ID NO: 26157 - DNA, 25 bp, Homo sapien
agtgcatcagtataaaacaaataaa

SEQ ID NO: 26158 - DNA, 25 bp, Homo sapien
agtgcatcattataaaacaaataaa

SEQ ID NO: 26159 - DNA, 25 bp, Homo sapien
agtgcatcttacttcatgagaaatg

SEQ ID NO: 26160 - DNA, 25 bp, Homo sapien
agtgcatcttactttatgagaaatg

SEQ ID NO: 26161 - DNA, 25 bp, Homo sapien
agtgcatttgcaaatccttggttca

SEQ ID NO: 26162 - DNA, 25 bp, Homo sapien
agtgcatttgcaaatcgttggttca

SEQ ID NO: 26163 - DNA, 25 bp, Homo sapien
agtgcattttgatcatgttaaattt

SEQ ID NO: 26164 - DNA, 25 bp, Homo sapien
agtgcattttggtcatgttaaattt

SEQ ID NO: 26165 - DNA, 25 bp, Homo sapien
agtgccacatttcacaggtcaaaga

SEQ ID NO: 26166 - DNA, 25 bp, Homo sapien
agtgccacgtttcacaggtcaaaga

SEQ ID NO: 26167 - DNA, 25 bp, Homo sapien
agtgccagacaggactgaatggcaa

SEQ ID NO: 26168 - DNA, 25 bp, Homo sapien
agtgccagacaggacttaatggcaa

SEQ ID NO: 26169 - DNA, 25 bp, Homo sapien
agtgccaggacatggagaaacaata

SEQ ID NO: 26170 - DNA, 25 bp, Homo sapien
agtgccaggacctggagaaacaata

SEQ ID NO: 26171 - DNA, 25 bp, Homo sapien
agtgccctcaacttgaggcagtcag

SEQ ID NO: 26172 - DNA, 25 bp, Homo sapien
agtgccctcaatttgaggcagtcag

SEQ ID NO: 26173 - DNA, 25 bp, Homo sapien
agtgcctacacacgccttttgagaa

SEQ ID NO: 26174 - DNA, 25 bp, Homo sapien
agtgcctacacatgccttttgagaa

SEQ ID NO: 26175 - DNA, 25 bp, Homo sapien
agtgcctacatgataccatctcctc

SEQ ID NO: 26176 - DNA, 25 bp, Homo sapien
agtgcctacatgatactatctcctc

SEQ ID NO: 26177 - DNA, 25 bp, Homo sapien
agtgcctgtcgtcttcatcatcgtc

SEQ ID NO: 26178 - DNA, 25 bp, Homo sapien
agtgcctgtcgtcttcgtcatcgtc

SEQ ID NO: 26179 - DNA, 25 bp, Homo sapien
agtgccttaaagttggactagagta

SEQ ID NO: 26180 - DNA, 25 bp, Homo sapien
agtgccttacacgttcacgcagtcc

SEQ ID NO: 26181 - DNA, 25 bp, Homo sapien
agtgccttacatgttcacgcagtcc

SEQ ID NO: 26182 - DNA, 25 bp, Homo sapien
agtgccttgaagttggactagagta

SEQ ID NO: 26183 - DNA, 25 bp, Homo sapien
agtgccttgctagtctcaccctggg

SEQ ID NO: 26184 - DNA, 25 bp, Homo sapien
agtgccttgctagtgtcaccctggg

SEQ ID NO: 26185 - DNA, 25 bp, Homo sapien
agtgcctttaaagatttccggcttc

SEQ ID NO: 26186 - DNA, 25 bp, Homo sapien
agtgcctttgaagatttccggcttc

SEQ ID NO: 26187 - DNA, 25 bp, Homo sapien
agtgcgtttaatgtagaggtgactt

SEQ ID NO: 26188 - DNA, 25 bp, Homo sapien
agtgcgtttaatttagaggtgactt

SEQ ID NO: 26189 - DNA, 25 bp, Homo sapien
agtgctaaaatagaagcgtaaggga

SEQ ID NO: 26190 - DNA, 25 bp, Homo sapien
agtgctaaaatagaagtgtaaggga

SEQ ID NO: 26191 - DNA, 25 bp, Homo sapien
agtgctaacaggaaagtttatagtg

SEQ ID NO: 26192 - DNA, 25 bp, Homo sapien
agtgctaacagtaaagtttatagtg

SEQ ID NO: 26193 - DNA, 25 bp, Homo sapien
agtgctaatcgtgtcattacagaaa

SEQ ID NO: 26194 - DNA, 25 bp, Homo sapien
agtgctaattgtgtcattacagaaa

SEQ ID NO: 26195 - DNA, 25 bp, Homo sapien
agtgctacatataagtcaatctgaa

SEQ ID NO: 26196 - DNA, 25 bp, Homo sapien
agtgctacatataggtcaatctgaa

SEQ ID NO: 26197 - DNA, 25 bp, Homo sapien
agtgctactttctcaccttgtgttt

SEQ ID NO: 26198 - DNA, 25 bp, Homo sapien
agtgctactttcttaccttgtgttt

SEQ ID NO: 26199 - DNA, 25 bp, Homo sapien
agtgctattagattacaacacgtgg

SEQ ID NO: 26200 - DNA, 25 bp, Homo sapien
agtgctattagattccaacacgtgg

SEQ ID NO: 26201 - DNA, 25 bp, Homo sapien
agtgctattgctatcacctggtaag

SEQ ID NO: 26202 - DNA, 25 bp, Homo sapien
agtgctattgctgtcacctggtaag

SEQ ID NO: 26203 - DNA, 25 bp, Homo sapien
agtgctcaaagatatttcctgtaat

SEQ ID NO: 26204 - DNA, 25 bp, Homo sapien
agtgctcaatggaatcccgtgattg

SEQ ID NO: 26205 - DNA, 25 bp, Homo sapien
agtgctcagagatatttcctgtaat

SEQ ID NO: 26206 - DNA, 25 bp, Homo sapien
agtgctcagctgaacagcagtgagt

SEQ ID NO: 26207 - DNA, 25 bp, Homo sapien
agtgctcagctgaccagcagtgagt

SEQ ID NO: 26208 - DNA, 25 bp, Homo sapien
agtgctcagtggaatcccgtgattg

SEQ ID NO: 26209 - DNA, 25 bp, Homo sapien
agtgctctaggacataaccaataag

SEQ ID NO: 26210 - DNA, 25 bp, Homo sapien
agtgctctagggcataaccaataag

SEQ ID NO: 26211 - DNA, 25 bp, Homo sapien
agtgctgcaaaaacactggacatta

SEQ ID NO: 26212 - DNA, 25 bp, Homo sapien
agtgctgcgaaaacactggacatta

SEQ ID NO: 26213 - DNA, 25 bp, Homo sapien
agtgcttagggatttacgaggatta

SEQ ID NO: 26214 - DNA, 25 bp, Homo sapien
agtgcttagggatttatgaggatta

SEQ ID NO: 26215 - DNA, 25 bp, Homo sapien
agtgcttcttcatagcatggtaaga

SEQ ID NO: 26216 - DNA, 25 bp, Homo sapien
agtgcttcttcatatcatggtaaga

SEQ ID NO: 26217 - DNA, 25 bp, Homo sapien
agtgcttgctacaattcaacaccat

SEQ ID NO: 26218 - DNA, 25 bp, Homo sapien
agtgcttgctacagttcaacaccat

SEQ ID NO: 26219 - DNA, 25 bp, Homo sapien
agtgcttgctgttacgtccaaggca

SEQ ID NO: 26220 - DNA, 25 bp, Homo sapien
agtgcttgctgttatgtccaaggca

SEQ ID NO: 26221 - DNA, 25 bp, Homo sapien
agtgctttgtctcctatagtagatt

SEQ ID NO: 26222 - DNA, 25 bp, Homo sapien
agtgctttgtcttctatagtagatt

SEQ ID NO: 26223 - DNA, 25 bp, Homo sapien
agtgctttttaaactttggaaaata

SEQ ID NO: 26224 - DNA, 25 bp, Homo sapien
agtgctttttaaagtttggaaaata

SEQ ID NO: 26225 - DNA, 25 bp, Homo sapien
agtggaaattaggccagaaagaaaa

SEQ ID NO: 26226 - DNA, 25 bp, Homo sapien
agtggaaattatgccagaaagaaaa

SEQ ID NO: 26227 - DNA, 25 bp, Homo sapien
agtggaaccattatatcagttgaat

SEQ ID NO: 26228 - DNA, 25 bp, Homo sapien
agtggaactattatatcagttgaat

SEQ ID NO: 26229 - DNA, 25 bp, Homo sapien
agtggacagcctcattctcaagaca

SEQ ID NO: 26230 - DNA, 25 bp, Homo sapien
agtggacagcctccttctcaagaca

SEQ ID NO: 26231 - DNA, 25 bp, Homo sapien
agtggaccatcaacttatgatacct

SEQ ID NO: 26232 - DNA, 25 bp, Homo sapien
agtggaccgtcaacttatgatacct

SEQ ID NO: 26233 - DNA, 25 bp, Homo sapien
agtggactttttaccttaatgtatg

SEQ ID NO: 26234 - DNA, 25 bp, Homo sapien
agtggactttttagcttaatgtatg

SEQ ID NO: 26235 - DNA, 25 bp, Homo sapien
agtggagaaattgaagatccctgat

SEQ ID NO: 26236 - DNA, 25 bp, Homo sapien
agtggagaaatttaagatccctgat

SEQ ID NO: 26237 - DNA, 25 bp, Homo sapien
agtggagaagtagttaccttttacc

SEQ ID NO: 26238 - DNA, 25 bp, Homo sapien
agtggagaagtcgttaccttttacc

SEQ ID NO: 26239 - DNA, 25 bp, Homo sapien
agtggagactttaatagaaaacccc

SEQ ID NO: 26240 - DNA, 25 bp, Homo sapien
agtggagattttaatagaaaacccc

SEQ ID NO: 26241 - DNA, 25 bp, Homo sapien
agtggagccctgtcatccttaaaga

SEQ ID NO: 26242 - DNA, 25 bp, Homo sapien
agtggagccctgtcgtccttaaaga

SEQ ID NO: 26243 - DNA, 25 bp, Homo sapien
agtggagccgataatcggaatgagt

SEQ ID NO: 26244 - DNA, 25 bp, Homo sapien
agtggagctgataatcggaatgagt

SEQ ID NO: 26245 - DNA, 25 bp, Homo sapien
agtggaggtttgccactaggatttc

SEQ ID NO: 26246 - DNA, 25 bp, Homo sapien
agtggaggtttgtcactaggatttc

SEQ ID NO: 26247 - DNA, 25 bp, Homo sapien
agtggagtagacagcaggaaccaag

SEQ ID NO: 26248 - DNA, 25 bp, Homo sapien
agtggagtagatagcaggaaccaag

SEQ ID NO: 26249 - DNA, 25 bp, Homo sapien
agtggatactcccgatgttcaaaaa

SEQ ID NO: 26250 - DNA, 25 bp, Homo sapien
agtggatactctcgatgttcaaaaa

SEQ ID NO: 26251 - DNA, 25 bp, Homo sapien
agtggatatgttgttagccagcatg

SEQ ID NO: 26252 - DNA, 25 bp, Homo sapien
agtggatattttgttagccagcatg

SEQ ID NO: 26253 - DNA, 25 bp, Homo sapien
agtggatcataactggatgtcgtga

SEQ ID NO: 26254 - DNA, 25 bp, Homo sapien
agtggatcgtaactggatgtcgtga

SEQ ID NO: 26255 - DNA, 25 bp, Homo sapien
agtggatgagcagtaaaatgacttt

SEQ ID NO: 26256 - DNA, 25 bp, Homo sapien
agtggatgcttaccaaatgctgaca

SEQ ID NO: 26257 - DNA, 25 bp, Homo sapien
agtggatgcttactaaatgctgaca

SEQ ID NO: 26258 - DNA, 25 bp, Homo sapien
agtggatgtgcagtaaaatgacttt

SEQ ID NO: 26259 - DNA, 25 bp, Homo sapien
agtggattgactgtggtcagagcct

SEQ ID NO: 26260 - DNA, 25 bp, Homo sapien
agtggattgactgttgtcagagcct

SEQ ID NO: 26261 - DNA, 25 bp, Homo sapien
agtggattttaaatatactacacct

SEQ ID NO: 26262 - DNA, 25 bp, Homo sapien
agtggattttaaatatgctacacct

SEQ ID NO: 26263 - DNA, 25 bp, Homo sapien
agtggcaagctcaaatttaaactct

SEQ ID NO: 26264 - DNA, 25 bp, Homo sapien
agtggcaagctctaatttaaactct

SEQ ID NO: 26265 - DNA, 25 bp, Homo sapien
agtggcactctctaaccattaggga

SEQ ID NO: 26266 - DNA, 25 bp, Homo sapien
agtggcactttctaaccattaggga

SEQ ID NO: 26267 - DNA, 25 bp, Homo sapien
agtggcagcctccatcgtactgtaa

SEQ ID NO: 26268 - DNA, 25 bp, Homo sapien
agtggcaggctccatcgtactgtaa

SEQ ID NO: 26269 - DNA, 25 bp, Homo sapien
agtggcaggtcacttgcaaattttc

SEQ ID NO: 26270 - DNA, 25 bp, Homo sapien
agtggcaggtcatttgcaaattttc

SEQ ID NO: 26271 - DNA, 25 bp, Homo sapien
agtggcatcctgacagctttccccc

SEQ ID NO: 26272 - DNA, 25 bp, Homo sapien
agtggcatcttgacagctttccccc

SEQ ID NO: 26273 - DNA, 25 bp, Homo sapien
agtggccagaccatagaggcagagg

SEQ ID NO: 26274 - DNA, 25 bp, Homo sapien
agtggccaggccatagaggcagagg

SEQ ID NO: 26275 - DNA, 25 bp, Homo sapien
agtggccagttacatttctcatcaa

SEQ ID NO: 26276 - DNA, 25 bp, Homo sapien
agtggccagttgcatttctcatcaa

SEQ ID NO: 26277 - DNA, 25 bp, Homo sapien
agtggccatagtaagaagaaggaaa

SEQ ID NO: 26278 - DNA, 25 bp, Homo sapien
agtggccatggtaagaagaaggaaa

SEQ ID NO: 26279 - DNA, 25 bp, Homo sapien
agtggcctgctcccaacgtacctgt

SEQ ID NO: 26280 - DNA, 25 bp, Homo sapien
agtggcctgctcccaatgtacctgt

SEQ ID NO: 26281 - DNA, 25 bp, Homo sapien
agtggctaataattgagaatccaag

SEQ ID NO: 26282 - DNA, 25 bp, Homo sapien
agtggctaatacatgaggtgcattg

SEQ ID NO: 26283 - DNA, 25 bp, Homo sapien
agtggctaatatatgaggtgcattg

SEQ ID NO: 26284 - DNA, 25 bp, Homo sapien
agtggctagtaattgagaatccaag

SEQ ID NO: 26285 - DNA, 25 bp, Homo sapien
agtggctatcggccaggaatctgac

SEQ ID NO: 26286 - DNA, 25 bp, Homo sapien
agtggctattggccaggaatctgac

SEQ ID NO: 26287 - DNA, 25 bp, Homo sapien
agtggctcttcccatggacagtcca

SEQ ID NO: 26288 - DNA, 25 bp, Homo sapien
agtggctcttcgcatggacagtcca

SEQ ID NO: 26289 - DNA, 25 bp, Homo sapien
agtggctgatcacactcaatttgtc

SEQ ID NO: 26290 - DNA, 25 bp, Homo sapien
agtggctgatcatactcaatttgtc

SEQ ID NO: 26291 - DNA, 25 bp, Homo sapien
agtggctgcaataagctattaaaga

SEQ ID NO: 26292 - DNA, 25 bp, Homo sapien
agtggctgcaatatgctattaaaga

SEQ ID NO: 26293 - DNA, 25 bp, Homo sapien
agtggctgcacgttgtagttctact

SEQ ID NO: 26294 - DNA, 25 bp, Homo sapien
agtggctggcctcacttaggattgc

SEQ ID NO: 26295 - DNA, 25 bp, Homo sapien
agtggctggcctcagttaggattgc

SEQ ID NO: 26296 - DNA, 25 bp, Homo sapien
agtggctgtacgttgtagttctact

SEQ ID NO: 26297 - DNA, 25 bp, Homo sapien
agtggcttatttcctcatctgtttt

SEQ ID NO: 26298 - DNA, 25 bp, Homo sapien
agtggcttatttcctcttctgtttt

SEQ ID NO: 26299 - DNA, 25 bp, Homo sapien
agtggcttctttactgggcttcgca

SEQ ID NO: 26300 - DNA, 25 bp, Homo sapien
agtggcttctttactgtgcttcgca

SEQ ID NO: 26301 - DNA, 25 bp, Homo sapien
agtggcttgaattagatggtgatat

SEQ ID NO: 26302 - DNA, 25 bp, Homo sapien
agtggcttgaattggatggtgatat

SEQ ID NO: 26303 - DNA, 25 bp, Homo sapien
agtgggaaatggagaagtgttaatc

SEQ ID NO: 26304 - DNA, 25 bp, Homo sapien
agtgggaaatggagtagtgttaatc

SEQ ID NO: 26305 - DNA, 25 bp, Homo sapien
agtgggaagcacgtgagccaatgtt

SEQ ID NO: 26306 - DNA, 25 bp, Homo sapien
agtgggaagcatgtgagccaatgtt

SEQ ID NO: 26307 - DNA, 25 bp, Homo sapien
agtgggaagccttgattataggcag

SEQ ID NO: 26308 - DNA, 25 bp, Homo sapien
agtgggaaggcttgattataggcag

SEQ ID NO: 26309 - DNA, 25 bp, Homo sapien
agtgggaatgtaacaatgttggact

SEQ ID NO: 26310 - DNA, 25 bp, Homo sapien
agtgggaatgtaaccatgttggact

SEQ ID NO: 26311 - DNA, 25 bp, Homo sapien
agtgggacgattctgacttgcgtcc

SEQ ID NO: 26312 - DNA, 25 bp, Homo sapien
agtgggacgattctgatttgcgtcc

SEQ ID NO: 26313 - DNA, 25 bp, Homo sapien
agtgggcaaaaacctaccaacacag

SEQ ID NO: 26314 - DNA, 25 bp, Homo sapien
agtgggcaaaaagctaccaacacag

SEQ ID NO: 26315 - DNA, 25 bp, Homo sapien
agtgggctacaggatttctgtgtca

SEQ ID NO: 26316 - DNA, 25 bp, Homo sapien
agtgggctacagtatttctgtgtca

SEQ ID NO: 26317 - DNA, 25 bp, Homo sapien
agtggggatcagaaaaatatttgaa

SEQ ID NO: 26318 - DNA, 25 bp, Homo sapien
agtggggatcagaaaagtatttgaa

SEQ ID NO: 26319 - DNA, 25 bp, Homo sapien
agtgggggtacaggcagccatcaat

SEQ ID NO: 26320 - DNA, 25 bp, Homo sapien
agtgggggtacaggtagccatcaat

SEQ ID NO: 26321 - DNA, 25 bp, Homo sapien
agtgggtcacgatgtttatccatgc

SEQ ID NO: 26322 - DNA, 25 bp, Homo sapien
agtgggtcaggatgtttatccatgc

SEQ ID NO: 26323 - DNA, 25 bp, Homo sapien
agtgggtctctcactcactgccttg

SEQ ID NO: 26324 - DNA, 25 bp, Homo sapien
agtgggtctctcattcactgccttg

SEQ ID NO: 26325 - DNA, 25 bp, Homo sapien
agtgggtctggagcatccatgtggc

SEQ ID NO: 26326 - DNA, 25 bp, Homo sapien
agtgggtctggagcgtccatgtggc

SEQ ID NO: 26327 - DNA, 25 bp, Homo sapien
agtggtaataggaggtgcatctgag

SEQ ID NO: 26328 - DNA, 25 bp, Homo sapien
agtggtaataggcggtgcatctgag

SEQ ID NO: 26329 - DNA, 25 bp, Homo sapien
agtggtaatatgcataattttggaa

SEQ ID NO: 26330 - DNA, 25 bp, Homo sapien
agtggtaatatgcgtaattttggaa

SEQ ID NO: 26331 - DNA, 25 bp, Homo sapien
agtggtcaaaagcagaatttaaaag

SEQ ID NO: 26332 - DNA, 25 bp, Homo sapien
agtggtcaaaagtagaatttaaaag

SEQ ID NO: 26333 - DNA, 25 bp, Homo sapien
agtggtcatctcttggttccatata

SEQ ID NO: 26334 - DNA, 25 bp, Homo sapien
agtggtcatttcttggttccatata

SEQ ID NO: 26335 - DNA, 25 bp, Homo sapien
agtggtccacgtgctacaactgaga

SEQ ID NO: 26336 - DNA, 25 bp, Homo sapien
agtggtccatgtgctacaactgaga

SEQ ID NO: 26337 - DNA, 25 bp, Homo sapien
agtggtctgacagcttccgtggtcc

SEQ ID NO: 26338 - DNA, 25 bp, Homo sapien
agtggtctgacaggttccgtggtcc

SEQ ID NO: 26339 - DNA, 25 bp, Homo sapien
agtggtgccgcggctctccctgcca

SEQ ID NO: 26340 - DNA, 25 bp, Homo sapien
agtggtgctcccagaggctcgggct

SEQ ID NO: 26341 - DNA, 25 bp, Homo sapien
agtggtgctgagaggttcctcaggc

SEQ ID NO: 26342 - DNA, 25 bp, Homo sapien
agtggtgctgcggctctccctgcca

SEQ ID NO: 26343 - DNA, 25 bp, Homo sapien
agtggtgcttagaggttcctcaggc

SEQ ID NO: 26344 - DNA, 25 bp, Homo sapien
agtggtgcttccagaggctcgggct

SEQ ID NO: 26345 - DNA, 25 bp, Homo sapien
agtggtgttcagtctcacccattag

SEQ ID NO: 26346 - DNA, 25 bp, Homo sapien
agtggtgttcagtttcacccattag

SEQ ID NO: 26347 - DNA, 25 bp, Homo sapien
agtggtgttctctctctactgcact

SEQ ID NO: 26348 - DNA, 25 bp, Homo sapien
agtggtgttctgtctctactgcact

SEQ ID NO: 26349 - DNA, 25 bp, Homo sapien
agtggttatttaagtcacccgtgaa

SEQ ID NO: 26350 - DNA, 25 bp, Homo sapien
agtggttatttaggtcacccgtgaa

SEQ ID NO: 26351 - DNA, 25 bp, Homo sapien
agtggttctcgcactcccaaagcca

SEQ ID NO: 26352 - DNA, 25 bp, Homo sapien
agtggttcttgcactcccaaagcca

SEQ ID NO: 26353 - DNA, 25 bp, Homo sapien
agtggttgcacatggttcttttttt

SEQ ID NO: 26354 - DNA, 25 bp, Homo sapien
agtggttggttcaaggtcacaccat

SEQ ID NO: 26355 - DNA, 25 bp, Homo sapien
agtggttggttccaggtcacaccat

SEQ ID NO: 26356 - DNA, 25 bp, Homo sapien
agtggttgtacatggttcttttttt

SEQ ID NO: 26357 - DNA, 25 bp, Homo sapien
agtggttgttaagttttcatttatg

SEQ ID NO: 26358 - DNA, 25 bp, Homo sapien
agtggttgttacgttttcatttatg

SEQ ID NO: 26359 - DNA, 25 bp, Homo sapien
agtgtaaaatcaactgtctcaccat

SEQ ID NO: 26360 - DNA, 25 bp, Homo sapien
agtgtaaaatcgactgtctcaccat

SEQ ID NO: 26361 - DNA, 25 bp, Homo sapien
agtgtaaacccatgtagactggagg

SEQ ID NO: 26362 - DNA, 25 bp, Homo sapien
agtgtaaacccctgtagactggagg

SEQ ID NO: 26363 - DNA, 25 bp, Homo sapien
agtgtaacaagtagtgtgctgataa

SEQ ID NO: 26364 - DNA, 25 bp, Homo sapien
agtgtaacaggtagtgtgctgataa

SEQ ID NO: 26365 - DNA, 25 bp, Homo sapien
agtgtaagccaacgattttataccc

SEQ ID NO: 26366 - DNA, 25 bp, Homo sapien
agtgtaagccaatgattttataccc

SEQ ID NO: 26367 - DNA, 25 bp, Homo sapien
agtgtaaggaccaatgacacagagt

SEQ ID NO: 26368 - DNA, 25 bp, Homo sapien
agtgtaaggaccgatgacacagagt

SEQ ID NO: 26369 - DNA, 25 bp, Homo sapien
agtgtaatgaaaacaattctggtac

SEQ ID NO: 26370 - DNA, 25 bp, Homo sapien
agtgtaatgaaaataattctggtac

SEQ ID NO: 26371 - DNA, 25 bp, Homo sapien
agtgtacaagtcaacggaatataat

SEQ ID NO: 26372 - DNA, 25 bp, Homo sapien
agtgtacaagtcaatggaatataat

SEQ ID NO: 26373 - DNA, 25 bp, Homo sapien
agtgtacactgcagcattgttgact

SEQ ID NO: 26374 - DNA, 25 bp, Homo sapien
agtgtacactgtagcattgttgact

SEQ ID NO: 26375 - DNA, 25 bp, Homo sapien
agtgtaccagctagaagtaactaca

SEQ ID NO: 26376 - DNA, 25 bp, Homo sapien
agtgtaccagctggaagtaactaca

SEQ ID NO: 26377 - DNA, 25 bp, Homo sapien
agtgtacgacaaagactactccaat

SEQ ID NO: 26378 - DNA, 25 bp, Homo sapien
agtgtacgacaaaggctactccaat

SEQ ID NO: 26379 - DNA, 25 bp, Homo sapien
agtgtactgaacgatgcaggctatc

SEQ ID NO: 26380 - DNA, 25 bp, Homo sapien
agtgtactgaatgatgcaggctatc

SEQ ID NO: 26381 - DNA, 25 bp, Homo sapien
agtgtagatcgaacagccttctgct

SEQ ID NO: 26382 - DNA, 25 bp, Homo sapien
agtgtagatcgaccagccttctgct

SEQ ID NO: 26383 - DNA, 25 bp, Homo sapien
agtgtagcattttaagagtatgagt

SEQ ID NO: 26384 - DNA, 25 bp, Homo sapien
agtgtagctttttaagagtatgagt

SEQ ID NO: 26385 - DNA, 25 bp, Homo sapien
agtgtatagaatgagaagggaaggg

SEQ ID NO: 26386 - DNA, 25 bp, Homo sapien
agtgtatagaatgagaggggaaggg

SEQ ID NO: 26387 - DNA, 25 bp, Homo sapien
agtgtatttcgcagtgtcacagaca

SEQ ID NO: 26388 - DNA, 25 bp, Homo sapien
agtgtattttgcagtgtcacagaca

SEQ ID NO: 26389 - DNA, 25 bp, Homo sapien
agtgtcacagcacaaagaaactagc

SEQ ID NO: 26390 - DNA, 25 bp, Homo sapien
agtgtcacggcacaaagaaactagc

SEQ ID NO: 26391 - DNA, 25 bp, Homo sapien
agtgtcatataccaatgtcattctt

SEQ ID NO: 26392 - DNA, 25 bp, Homo sapien
agtgtcatataccagtgtcattctt

SEQ ID NO: 26393 - DNA, 25 bp, Homo sapien
agtgtcatgaccttagcttctttaa

SEQ ID NO: 26394 - DNA, 25 bp, Homo sapien
agtgtcatgcccttagcttctttaa

SEQ ID NO: 26395 - DNA, 25 bp, Homo sapien
agtgtcattgcaacagtaaattcaa

SEQ ID NO: 26396 - DNA, 25 bp, Homo sapien
agtgtcattgcaatagtaaattcaa

SEQ ID NO: 26397 - DNA, 25 bp, Homo sapien
agtgtccagcaatggataaggatgt

SEQ ID NO: 26398 - DNA, 25 bp, Homo sapien
agtgtccaggaatggataaggatgt

SEQ ID NO: 26399 - DNA, 25 bp, Homo sapien
agtgtccttgaaggttggtactctg

SEQ ID NO: 26400 - DNA, 25 bp, Homo sapien
agtgtccttgagggttggtactctg

SEQ ID NO: 26401 - DNA, 25 bp, Homo sapien
agtgtctcagaatatactgatgaat

SEQ ID NO: 26402 - DNA, 25 bp, Homo sapien
agtgtctcagaatatattgatgaat

SEQ ID NO: 26403 - DNA, 25 bp, Homo sapien
agtgtctgaacacagcctacacagg

SEQ ID NO: 26404 - DNA, 25 bp, Homo sapien
agtgtctgaacatagcctacacagg

SEQ ID NO: 26405 - DNA, 25 bp, Homo sapien
agtgtctggcacagaacaagcactc

SEQ ID NO: 26406 - DNA, 25 bp, Homo sapien
agtgtctggcacagcacaagcactc

SEQ ID NO: 26407 - DNA, 25 bp, Homo sapien
agtgtcttaattatcgtagctatat

SEQ ID NO: 26408 - DNA, 25 bp, Homo sapien
agtgtcttaattattgtagctatat

SEQ ID NO: 26409 - DNA, 25 bp, Homo sapien
agtgtcttttgctggttaatgagat

SEQ ID NO: 26410 - DNA, 25 bp, Homo sapien
agtgtcttttgcttgttaatgagat

SEQ ID NO: 26411 - DNA, 25 bp, Homo sapien
agtgtgaaaaattgtgcgaaattaa

SEQ ID NO: 26412 - DNA, 25 bp, Homo sapien
agtgtgaaaaattgtgtgaaattaa

SEQ ID NO: 26413 - DNA, 25 bp, Homo sapien
agtgtgaatgacaatagcacagaga

SEQ ID NO: 26414 - DNA, 25 bp, Homo sapien
agtgtgaatgagaatagcacagaga

SEQ ID NO: 26415 - DNA, 25 bp, Homo sapien
agtgtgacacttcataagcatcaaa

SEQ ID NO: 26416 - DNA, 25 bp, Homo sapien
agtgtgacagttcataagcatcaaa

SEQ ID NO: 26417 - DNA, 25 bp, Homo sapien
agtgtgactgaacggtactgtgaaa

SEQ ID NO: 26418 - DNA, 25 bp, Homo sapien
agtgtgactgaatggtactgtgaaa

SEQ ID NO: 26419 - DNA, 25 bp, Homo sapien
agtgtgagactcaaagttagacaac

SEQ ID NO: 26420 - DNA, 25 bp, Homo sapien
agtgtgagcctcaaagttagacaac

SEQ ID NO: 26421 - DNA, 25 bp, Homo sapien
agtgtgagtttacgaggtattttat

SEQ ID NO: 26422 - DNA, 25 bp, Homo sapien
agtgtgagtttatgaggtattttat

SEQ ID NO: 26423 - DNA, 25 bp, Homo sapien
agtgtgattagctgtaattagctga

SEQ ID NO: 26424 - DNA, 25 bp, Homo sapien
agtgtgattagttgtaattagctga

SEQ ID NO: 26425 - DNA, 25 bp, Homo sapien
agtgtgcaccttatcccactccacc

SEQ ID NO: 26426 - DNA, 25 bp, Homo sapien
agtgtgcactttatcccactccacc

SEQ ID NO: 26427 - DNA, 25 bp, Homo sapien
agtgtgggatatttttcctcttcac

SEQ ID NO: 26428 - DNA, 25 bp, Homo sapien
agtgtgggatattttttctcttcac

SEQ ID NO: 26429 - DNA, 25 bp, Homo sapien
agtgtggtcatctagcttttgactg

SEQ ID NO: 26430 - DNA, 25 bp, Homo sapien
agtgtggttatctagcttttgactg

SEQ ID NO: 26431 - DNA, 25 bp, Homo sapien
agtgtggttcaactatgtgagatga

SEQ ID NO: 26432 - DNA, 25 bp, Homo sapien
agtgtggttcacctatgtgagatga

SEQ ID NO: 26433 - DNA, 25 bp, Homo sapien
agtgtgtaaaataccaggctgctct

SEQ ID NO: 26434 - DNA, 25 bp, Homo sapien
agtgtgtaaaatgccaggctgctct

SEQ ID NO: 26435 - DNA, 25 bp, Homo sapien
agtgtgtcagcatgtgaccttattt

SEQ ID NO: 26436 - DNA, 25 bp, Homo sapien
agtgtgtcagcgtgtgaccttattt

SEQ ID NO: 26437 - DNA, 25 bp, Homo sapien
agtgtgtcatacgctgccaagtttg

SEQ ID NO: 26438 - DNA, 25 bp, Homo sapien
agtgtgtcataggctgccaagtttg

SEQ ID NO: 26439 - DNA, 25 bp, Homo sapien
agtgtgttctttcagctcacatttc

SEQ ID NO: 26440 - DNA, 25 bp, Homo sapien
agtgtgtttataccatcttttcctg

SEQ ID NO: 26441 - DNA, 25 bp, Homo sapien
agtgtgtttatacgatcttttcctg

SEQ ID NO: 26442 - DNA, 25 bp, Homo sapien
agtgtgttttttcagctcacatttc

SEQ ID NO: 26443 - DNA, 25 bp, Homo sapien
agtgttaaaatatacctacaaatgc

SEQ ID NO: 26444 - DNA, 25 bp, Homo sapien
agtgttaaaatgtacctacaaatgc

SEQ ID NO: 26445 - DNA, 25 bp, Homo sapien
agtgttacaaagttagccagatctc

SEQ ID NO: 26446 - DNA, 25 bp, Homo sapien
agtgttacaaagttagtcagatctc

SEQ ID NO: 26447 - DNA, 25 bp, Homo sapien
agtgttactattcggccttttacag

SEQ ID NO: 26448 - DNA, 25 bp, Homo sapien
agtgttactatttggccttttacag

SEQ ID NO: 26449 - DNA, 25 bp, Homo sapien
agtgttagaaactgggaatctgtct

SEQ ID NO: 26450 - DNA, 25 bp, Homo sapien
agtgttagagactgggaatctgtct

SEQ ID NO: 26451 - DNA, 25 bp, Homo sapien
agtgttagagtccagagatcatggg

SEQ ID NO: 26452 - DNA, 25 bp, Homo sapien
agtgttagagtcgagagatcatggg

SEQ ID NO: 26453 - DNA, 25 bp, Homo sapien
agtgttagtgcattctatgtatggc

SEQ ID NO: 26454 - DNA, 25 bp, Homo sapien
agtgttagtgcattctgtgtatggc

SEQ ID NO: 26455 - DNA, 25 bp, Homo sapien
agtgttccaaacagaagattatttg

SEQ ID NO: 26456 - DNA, 25 bp, Homo sapien
agtgttccaaacagaatattatttg

SEQ ID NO: 26457 - DNA, 25 bp, Homo sapien
agtgttcgacgagaccaaaatggaa

SEQ ID NO: 26458 - DNA, 25 bp, Homo sapien
agtgttcgatgagaccaaaatggaa

SEQ ID NO: 26459 - DNA, 25 bp, Homo sapien
agtgttctcaacatatttaaaaaac

SEQ ID NO: 26460 - DNA, 25 bp, Homo sapien
agtgttctcccatagaaataaaata

SEQ ID NO: 26461 - DNA, 25 bp, Homo sapien
agtgttctcccgtagaaataaaata

SEQ ID NO: 26462 - DNA, 25 bp, Homo sapien
agtgttctctacatatttaaaaaac

SEQ ID NO: 26463 - DNA, 25 bp, Homo sapien
agtgttgaaaggaagacgagacaca

SEQ ID NO: 26464 - DNA, 25 bp, Homo sapien
agtgttgaaaggaagatgagacaca

SEQ ID NO: 26465 - DNA, 25 bp, Homo sapien
agtgttgaactcagtatgtttaatt

SEQ ID NO: 26466 - DNA, 25 bp, Homo sapien
agtgttgaactcggtatgtttaatt

SEQ ID NO: 26467 - DNA, 25 bp, Homo sapien
agtgttgatctgagaacataactct

SEQ ID NO: 26468 - DNA, 25 bp, Homo sapien
agtgttgatctgataacataactct

SEQ ID NO: 26469 - DNA, 25 bp, Homo sapien
agtgttgcctctcagctcctcaaac

SEQ ID NO: 26470 - DNA, 25 bp, Homo sapien
agtgttgcttctcagctcctcaaac

SEQ ID NO: 26471 - DNA, 25 bp, Homo sapien
agtgttggattcagacacgcatgct

SEQ ID NO: 26472 - DNA, 25 bp, Homo sapien
agtgttggatttagacacgcatgct

SEQ ID NO: 26473 - DNA, 25 bp, Homo sapien
agtgtttaggagatcactataggca

SEQ ID NO: 26474 - DNA, 25 bp, Homo sapien
agtgtttaggagatgactataggca

SEQ ID NO: 26475 - DNA, 25 bp, Homo sapien
agtgtttcaataaacataggatgca

SEQ ID NO: 26476 - DNA, 25 bp, Homo sapien
agtgtttcaggaaaaatcaatagca

SEQ ID NO: 26477 - DNA, 25 bp, Homo sapien
agtgtttcgataaacataggatgca

SEQ ID NO: 26478 - DNA, 25 bp, Homo sapien
agtgtttcgggaaaaatcaatagca

SEQ ID NO: 26479 - DNA, 25 bp, Homo sapien
agtgtttgaagggtcagtcacgtct

SEQ ID NO: 26480 - DNA, 25 bp, Homo sapien
agtgtttgaaggttcagtcacgtct

SEQ ID NO: 26481 - DNA, 25 bp, Homo sapien
agtgtttgagtacctgatgtaccag

SEQ ID NO: 26482 - DNA, 25 bp, Homo sapien
agtgtttgagtacctgttgtaccag

SEQ ID NO: 26483 - DNA, 25 bp, Homo sapien
agtgtttgcctctaacatacgtgca

SEQ ID NO: 26484 - DNA, 25 bp, Homo sapien
agtgtttgcctctaacgtacgtgca

SEQ ID NO: 26485 - DNA, 25 bp, Homo sapien
agtgtttgctctataactggatcat

SEQ ID NO: 26486 - DNA, 25 bp, Homo sapien
agtgtttgctctttaactggatcat

SEQ ID NO: 26487 - DNA, 25 bp, Homo sapien
agtgtttgtgttgtacgctgttatt

SEQ ID NO: 26488 - DNA, 25 bp, Homo sapien
agtgtttgtgtttaggctgtagctg

SEQ ID NO: 26489 - DNA, 25 bp, Homo sapien
agtgtttgtgtttaggttgtagctg

SEQ ID NO: 26490 - DNA, 25 bp, Homo sapien
agtgtttgtgttttacgctgttatt

SEQ ID NO: 26491 - DNA, 25 bp, Homo sapien
agtgtttgttcctcacctaacattc

SEQ ID NO: 26492 - DNA, 25 bp, Homo sapien
agtgtttgttcgtcacctaacattc

SEQ ID NO: 26493 - DNA, 25 bp, Homo sapien
agtgttttacacatcctgaggttgt

SEQ ID NO: 26494 - DNA, 25 bp, Homo sapien
agtgttttacatatcctgaggttgt

SEQ ID NO: 26495 - DNA, 25 bp, Homo sapien
agtgttttatccccagatcctaaaa

SEQ ID NO: 26496 - DNA, 25 bp, Homo sapien
agtgttttcccattcgtattgctta

SEQ ID NO: 26497 - DNA, 25 bp, Homo sapien
agtgttttcccatttgtattgctta

SEQ ID NO: 26498 - DNA, 25 bp, Homo sapien
agtgttttctacaactcccgagtcc

SEQ ID NO: 26499 - DNA, 25 bp, Homo sapien
agtgttttctacacctcccgagtcc

SEQ ID NO: 26500 - DNA, 25 bp, Homo sapien
agtgttttcttcaggtgtaagtagt

SEQ ID NO: 26501 - DNA, 25 bp, Homo sapien
agtgttttctttaggtgtaagtagt

SEQ ID NO: 26502 - DNA, 25 bp, Homo sapien
agtgttttgtccccagatcctaaaa

SEQ ID NO: 26503 - DNA, 25 bp, Homo sapien
agttaaaagttgcgatgatacaaaa

SEQ ID NO: 26504 - DNA, 25 bp, Homo sapien
agttaaaagttgtgatgatacaaaa

SEQ ID NO: 26505 - DNA, 25 bp, Homo sapien
agttaaaataaggcaagtgttcaaa

SEQ ID NO: 26506 - DNA, 25 bp, Homo sapien
agttaaaataaggtaagtgttcaaa

SEQ ID NO: 26507 - DNA, 25 bp, Homo sapien
agttaaagctgaagctatttgccag

SEQ ID NO: 26508 - DNA, 25 bp, Homo sapien
agttaaagctgaggctatttgccag

SEQ ID NO: 26509 - DNA, 25 bp, Homo sapien
agttaaatataacgttgaatttcag

SEQ ID NO: 26510 - DNA, 25 bp, Homo sapien
agttaaatataatgttgaatttcag

SEQ ID NO: 26511 - DNA, 25 bp, Homo sapien
agttaaattatctgtttatatcatc

SEQ ID NO: 26512 - DNA, 25 bp, Homo sapien
agttaaattatttgtttatatcatc

SEQ ID NO: 26513 - DNA, 25 bp, Homo sapien
agttaactcgaggattttctattct

SEQ ID NO: 26514 - DNA, 25 bp, Homo sapien
agttaactcgatgattttctattct

SEQ ID NO: 26515 - DNA, 25 bp, Homo sapien
agttaactttttccttgcatactat

SEQ ID NO: 26516 - DNA, 25 bp, Homo sapien
agttaacttttttcttgcatactat

SEQ ID NO: 26517 - DNA, 25 bp, Homo sapien
agttaagccagaggacgacccaccc

SEQ ID NO: 26518 - DNA, 25 bp, Homo sapien
agttaagccagtggacgacccaccc

SEQ ID NO: 26519 - DNA, 25 bp, Homo sapien
agttaataaattgcattcccttttc

SEQ ID NO: 26520 - DNA, 25 bp, Homo sapien
agttaatacattgcattcccttttc

SEQ ID NO: 26521 - DNA, 25 bp, Homo sapien
agttaatacggacatgttctgaaat

SEQ ID NO: 26522 - DNA, 25 bp, Homo sapien
agttaatacggatatgttctgaaat

SEQ ID NO: 26523 - DNA, 25 bp, Homo sapien
agttaatcaatgtctttactttctt

SEQ ID NO: 26524 - DNA, 25 bp, Homo sapien
agttaatcagtgtctttactttctt

SEQ ID NO: 26525 - DNA, 25 bp, Homo sapien
agttaatgtgacttttgtttttagt

SEQ ID NO: 26526 - DNA, 25 bp, Homo sapien
agttaatgtgatttttgtttttagt

SEQ ID NO: 26527 - DNA, 25 bp, Homo sapien
agttaatgttgaaaaagatgaacct

SEQ ID NO: 26528 - DNA, 25 bp, Homo sapien
agttaatgttggaaaagatgaacct

SEQ ID NO: 26529 - DNA, 25 bp, Homo sapien
agttaatgttgttggttctatttat

SEQ ID NO: 26530 - DNA, 25 bp, Homo sapien
agttaatgttgtttgttctatttat

SEQ ID NO: 26531 - DNA, 25 bp, Homo sapien
agttaattccagggctgcctgcaga

SEQ ID NO: 26532 - DNA, 25 bp, Homo sapien
agttaattctagggctgcctgcaga

SEQ ID NO: 26533 - DNA, 25 bp, Homo sapien
agttaattggtgacaggccaaatac

SEQ ID NO: 26534 - DNA, 25 bp, Homo sapien
agttaattggtgagaggccaaatac

SEQ ID NO: 26535 - DNA, 25 bp, Homo sapien
agttaatttgccgcagttataagtt

SEQ ID NO: 26536 - DNA, 25 bp, Homo sapien
agttaatttgctgcagttataagtt

SEQ ID NO: 26537 - DNA, 25 bp, Homo sapien
agttacacccaacgtgcaggtggtc

SEQ ID NO: 26538 - DNA, 25 bp, Homo sapien
agttacacccaatgtgcaggtggtc

SEQ ID NO: 26539 - DNA, 25 bp, Homo sapien
agttacaccctacgcacatgaagac

SEQ ID NO: 26540 - DNA, 25 bp, Homo sapien
agttacaccctatgcacatgaagac

SEQ ID NO: 26541 - DNA, 25 bp, Homo sapien
agttacagccattggagcaaatgaa

SEQ ID NO: 26542 - DNA, 25 bp, Homo sapien
agttacagccatttgagcaaatgaa

SEQ ID NO: 26543 - DNA, 25 bp, Homo sapien
agttacattaacggctcaaagtttg

SEQ ID NO: 26544 - DNA, 25 bp, Homo sapien
agttacattcaatgaatattttctc

SEQ ID NO: 26545 - DNA, 25 bp, Homo sapien
agttacattcagtgaatattttctc

SEQ ID NO: 26546 - DNA, 25 bp, Homo sapien
agttacattgacggctcaaagtttg

SEQ ID NO: 26547 - DNA, 25 bp, Homo sapien
agttaccaaaaatgttatggcttaa

SEQ ID NO: 26548 - DNA, 25 bp, Homo sapien
agttaccaattctgctgaacgggat

SEQ ID NO: 26549 - DNA, 25 bp, Homo sapien
agttaccaattctgttgaacgggat

SEQ ID NO: 26550 - DNA, 25 bp, Homo sapien
agttaccacaaatgttatggcttaa

SEQ ID NO: 26551 - DNA, 25 bp, Homo sapien
agttaccagctcatcttcccaggca

SEQ ID NO: 26552 - DNA, 25 bp, Homo sapien
agttaccagcttatcttcccaggca

SEQ ID NO: 26553 - DNA, 25 bp, Homo sapien
agttaccctgtcttcttccatgtac

SEQ ID NO: 26554 - DNA, 25 bp, Homo sapien
agttaccctttcttcttccatgtac

SEQ ID NO: 26555 - DNA, 25 bp, Homo sapien
agttacctctcagacatcaggcaga

SEQ ID NO: 26556 - DNA, 25 bp, Homo sapien
agttacctctcagatatcaggcaga

SEQ ID NO: 26557 - DNA, 25 bp, Homo sapien
agttactttcggacagtctatgcca

SEQ ID NO: 26558 - DNA, 25 bp, Homo sapien
agttactttgggacagtctatgcca

SEQ ID NO: 26559 - DNA, 25 bp, Homo sapien
agttagaaactatgacctagagcag

SEQ ID NO: 26560 - DNA, 25 bp, Homo sapien
agttagaaatgcctgacgaaggagt

SEQ ID NO: 26561 - DNA, 25 bp, Homo sapien
agttagaaatgcctgatgaaggagt

SEQ ID NO: 26562 - DNA, 25 bp, Homo sapien
agttagaacaactgtacaatagaga

SEQ ID NO: 26563 - DNA, 25 bp, Homo sapien
agttagaataactgtacaatagaga

SEQ ID NO: 26564 - DNA, 25 bp, Homo sapien
agttagaatctatgacctagagcag

SEQ ID NO: 26565 - DNA, 25 bp, Homo sapien
agttagagaggtccggcatgtgagg

SEQ ID NO: 26566 - DNA, 25 bp, Homo sapien
agttagagaggtctggcatgtgagg

SEQ ID NO: 26567 - DNA, 25 bp, Homo sapien
agttagccgttttcatcaatgatct

SEQ ID NO: 26568 - DNA, 25 bp, Homo sapien
agttagccgttttcatgaatgatct

SEQ ID NO: 26569 - DNA, 25 bp, Homo sapien
agttagctgcacagccagaatataa

SEQ ID NO: 26570 - DNA, 25 bp, Homo sapien
agttagctgcacggccagaatataa

SEQ ID NO: 26571 - DNA, 25 bp, Homo sapien
agttagcttaccactctgatacttt

SEQ ID NO: 26572 - DNA, 25 bp, Homo sapien
agttagcttaccgctctgatacttt

SEQ ID NO: 26573 - DNA, 25 bp, Homo sapien
agttagcttatgtccttggaaatgg

SEQ ID NO: 26574 - DNA, 25 bp, Homo sapien
agttagcttatgtctttggaaatgg

SEQ ID NO: 26575 - DNA, 25 bp, Homo sapien
agttaggaacactggcattggagtc

SEQ ID NO: 26576 - DNA, 25 bp, Homo sapien
agttaggagcactggcattggagtc

SEQ ID NO: 26577 - DNA, 25 bp, Homo sapien
agttaggatctaacctcttcctaca

SEQ ID NO: 26578 - DNA, 25 bp, Homo sapien
agttaggatctagcctcttcctaca

SEQ ID NO: 26579 - DNA, 25 bp, Homo sapien
agttaggcaatgagtccactaaatg

SEQ ID NO: 26580 - DNA, 25 bp, Homo sapien
agttaggcgatgagtccactaaatg

SEQ ID NO: 26581 - DNA, 25 bp, Homo sapien
agttagggacgaattcagattactg

SEQ ID NO: 26582 - DNA, 25 bp, Homo sapien
agttagggatgaattcagattactg

SEQ ID NO: 26583 - DNA, 25 bp, Homo sapien
agttaggtattcactgcagtctcct

SEQ ID NO: 26584 - DNA, 25 bp, Homo sapien
agttaggtattcattgcagtctcct

SEQ ID NO: 26585 - DNA, 25 bp, Homo sapien
agttagtatttgtaagtggtgtaag

SEQ ID NO: 26586 - DNA, 25 bp, Homo sapien
agttagtatttgtgagtggtgtaag

SEQ ID NO: 26587 - DNA, 25 bp, Homo sapien
agttagtgctttgtctcctatagta

SEQ ID NO: 26588 - DNA, 25 bp, Homo sapien
agttagtgctttgtcttctatagta

SEQ ID NO: 26589 - DNA, 25 bp, Homo sapien
agttagttataccgatcttcatttt

SEQ ID NO: 26590 - DNA, 25 bp, Homo sapien
agttagttatactgatcttcatttt

SEQ ID NO: 26591 - DNA, 25 bp, Homo sapien
agttagttgccttggcagctgaaac

SEQ ID NO: 26592 - DNA, 25 bp, Homo sapien
agttagttgccttggcggctgaaac

SEQ ID NO: 26593 - DNA, 25 bp, Homo sapien
agttatcaaaatgaatgctacaata

SEQ ID NO: 26594 - DNA, 25 bp, Homo sapien
agttatcaagatgaatgctacaata

SEQ ID NO: 26595 - DNA, 25 bp, Homo sapien
agttatctatatgtacatacacatg

SEQ ID NO: 26596 - DNA, 25 bp, Homo sapien
agttatctatatgtacctacacatg

SEQ ID NO: 26597 - DNA, 25 bp, Homo sapien
agttatctttacgcaacagcatcat

SEQ ID NO: 26598 - DNA, 25 bp, Homo sapien
agttatctttactcaacagcatcat

SEQ ID NO: 26599 - DNA, 25 bp, Homo sapien
agttatgaaagagcaactagttatg

SEQ ID NO: 26600 - DNA, 25 bp, Homo sapien
agttatgaaagagcaattagttatg

SEQ ID NO: 26601 - DNA, 25 bp, Homo sapien
agttatggccttcagaaaaattgca

SEQ ID NO: 26602 - DNA, 25 bp, Homo sapien
agttatggccttcagacaaattgca

SEQ ID NO: 26603 - DNA, 25 bp, Homo sapien
agttatgtttctcggaagcagttta

SEQ ID NO: 26604 - DNA, 25 bp, Homo sapien
agttatgtttcttggaagcagttta

SEQ ID NO: 26605 - DNA, 25 bp, Homo sapien
agttattacagagctgtgaacttct

SEQ ID NO: 26606 - DNA, 25 bp, Homo sapien
agttattacggagctgtgaacttct

SEQ ID NO: 26607 - DNA, 25 bp, Homo sapien
agttattccaaaattgtataagatt

SEQ ID NO: 26608 - DNA, 25 bp, Homo sapien
agttattccgaaattgtataagatt

SEQ ID NO: 26609 - DNA, 25 bp, Homo sapien
agttattctcgtgttctccatttcc

SEQ ID NO: 26610 - DNA, 25 bp, Homo sapien
agttattctcgttttctccatttcc

SEQ ID NO: 26611 - DNA, 25 bp, Homo sapien
agttattgatacagggcaaagaatc

SEQ ID NO: 26612 - DNA, 25 bp, Homo sapien
agttattgatagagggcaaagaatc

SEQ ID NO: 26613 - DNA, 25 bp, Homo sapien
agttattgcacatgagataaagatg

SEQ ID NO: 26614 - DNA, 25 bp, Homo sapien
agttattgcacgtgagataaagatg

SEQ ID NO: 26615 - DNA, 25 bp, Homo sapien
agttatttgacaaaatttctcatgt

SEQ ID NO: 26616 - DNA, 25 bp, Homo sapien
agttatttgacataatttctcatgt

SEQ ID NO: 26617 - DNA, 25 bp, Homo sapien
agttcaaaaaaatcaagatagctta

SEQ ID NO: 26618 - DNA, 25 bp, Homo sapien
agttcaaacaatattccacttttac

SEQ ID NO: 26619 - DNA, 25 bp, Homo sapien
agttcaaacaatattcgacttttac

SEQ ID NO: 26620 - DNA, 25 bp, Homo sapien
agttcaaacaccaacaagaaaacaa

SEQ ID NO: 26621 - DNA, 25 bp, Homo sapien
agttcaaacgccaacaagaaaacaa

SEQ ID NO: 26622 - DNA, 25 bp, Homo sapien
agttcaaagaaatcaagatagctta

SEQ ID NO: 26623 - DNA, 25 bp, Homo sapien
agttcaaatcccagtggcatctact

SEQ ID NO: 26624 - DNA, 25 bp, Homo sapien
agttcaaatcccggtggcatctact

SEQ ID NO: 26625 - DNA, 25 bp, Homo sapien
agttcaacagtcaaaagacaggttt

SEQ ID NO: 26626 - DNA, 25 bp, Homo sapien
agttcaacagtgaaaagacaggttt

SEQ ID NO: 26627 - DNA, 25 bp, Homo sapien
agttcaacggagtttgagacaaaag

SEQ ID NO: 26628 - DNA, 25 bp, Homo sapien
agttcaacggagtttgggacaaaag

SEQ ID NO: 26629 - DNA, 25 bp, Homo sapien
agttcaagcaagaggtgagagctgg

SEQ ID NO: 26630 - DNA, 25 bp, Homo sapien
agttcaagcaagagttgagagctgg

SEQ ID NO: 26631 - DNA, 25 bp, Homo sapien
agttcaagcctatcatcattaaact

SEQ ID NO: 26632 - DNA, 25 bp, Homo sapien
agttcaaggaaggccaagagagatc

SEQ ID NO: 26633 - DNA, 25 bp, Homo sapien
agttcaagggagactaaactggatg

SEQ ID NO: 26634 - DNA, 25 bp, Homo sapien
agttcaagggaggctaaactggatg

SEQ ID NO: 26635 - DNA, 25 bp, Homo sapien
agttcaaggttaatttgatatgtga

SEQ ID NO: 26636 - DNA, 25 bp, Homo sapien
agttcaaggttattttgatatgtga

SEQ ID NO: 26637 - DNA, 25 bp, Homo sapien
agttcaagtaaggccaagagagatc

SEQ ID NO: 26638 - DNA, 25 bp, Homo sapien
agttcaagtctatcatcattaaact

SEQ ID NO: 26639 - DNA, 25 bp, Homo sapien
agttcaatacaggactgaaggacaa

SEQ ID NO: 26640 - DNA, 25 bp, Homo sapien
agttcaatacagggctgaaggacaa

SEQ ID NO: 26641 - DNA, 25 bp, Homo sapien
agttcaatcccaatagtttcttgat

SEQ ID NO: 26642 - DNA, 25 bp, Homo sapien
agttcaatcccagtagtttcttgat

SEQ ID NO: 26643 - DNA, 25 bp, Homo sapien
agttcagaaaaaaacctgaggagag

SEQ ID NO: 26644 - DNA, 25 bp, Homo sapien
agttcagaaaaaaatctgaggagag

SEQ ID NO: 26645 - DNA, 25 bp, Homo sapien
agttcagatagatcttaccaaactg

SEQ ID NO: 26646 - DNA, 25 bp, Homo sapien
agttcagattgatcttaccaaactg

SEQ ID NO: 26647 - DNA, 25 bp, Homo sapien
agttcagcaccatagctaagataat

SEQ ID NO: 26648 - DNA, 25 bp, Homo sapien
agttcagcatcatagctaagataat

SEQ ID NO: 26649 - DNA, 25 bp, Homo sapien
agttcagctgacattcaaactatca

SEQ ID NO: 26650 - DNA, 25 bp, Homo sapien
agttcagctgagattcaaactatca

SEQ ID NO: 26651 - DNA, 25 bp, Homo sapien
agttcaggaaaatttagtcgttacc

SEQ ID NO: 26652 - DNA, 25 bp, Homo sapien
agttcaggaaagtttagtcgttacc

SEQ ID NO: 26653 - DNA, 25 bp, Homo sapien
agttcagttttggtcatgttcaatt

SEQ ID NO: 26654 - DNA, 25 bp, Homo sapien
agttcagtttttgtcatgttcaatt

SEQ ID NO: 26655 - DNA, 25 bp, Homo sapien
agttcatcaaaatagccagggaaaa

SEQ ID NO: 26656 - DNA, 25 bp, Homo sapien
agttcatcaaagtagccagggaaaa

SEQ ID NO: 26657 - DNA, 25 bp, Homo sapien
agttcatcaattgaattttacagct

SEQ ID NO: 26658 - DNA, 25 bp, Homo sapien
agttcatcatttgaattttacagct

SEQ ID NO: 26659 - DNA, 25 bp, Homo sapien
agttcatgtcccgagccaataataa

SEQ ID NO: 26660 - DNA, 25 bp, Homo sapien
agttcatgtcctgagccaataataa

SEQ ID NO: 26661 - DNA, 25 bp, Homo sapien
agttcattaaaaaatatatacccct

SEQ ID NO: 26662 - DNA, 25 bp, Homo sapien
agttcattcaaaaatatatacccct

SEQ ID NO: 26663 - DNA, 25 bp, Homo sapien
agttcattctccagtttacatctcc

SEQ ID NO: 26664 - DNA, 25 bp, Homo sapien
agttcattctccattttacatctcc

SEQ ID NO: 26665 - DNA, 25 bp, Homo sapien
agttcattgtaagtaaatttttgga

SEQ ID NO: 26666 - DNA, 25 bp, Homo sapien
agttcattgtaggtaaatttttgga

SEQ ID NO: 26667 - DNA, 25 bp, Homo sapien
agttcatttttttccctcaaagctg

SEQ ID NO: 26668 - DNA, 25 bp, Homo sapien
agttcattttttttcctcaaagctg

SEQ ID NO: 26669 - DNA, 25 bp, Homo sapien
agttccaaaccaaagcaaggattaa

SEQ ID NO: 26670 - DNA, 25 bp, Homo sapien
agttccaaaccaaggcaaggattaa

SEQ ID NO: 26671 - DNA, 25 bp, Homo sapien
agttccaccaaatcaagaggtaaac

SEQ ID NO: 26672 - DNA, 25 bp, Homo sapien
agttccaccaaatcgagaggtaaac

SEQ ID NO: 26673 - DNA, 25 bp, Homo sapien
agttccagaaatgtgggttcaagtt

SEQ ID NO: 26674 - DNA, 25 bp, Homo sapien
agttccagaagcattgccagtgcta

SEQ ID NO: 26675 - DNA, 25 bp, Homo sapien
agttccagaagcattgtcagtgcta

SEQ ID NO: 26676 - DNA, 25 bp, Homo sapien
agttccagagatgtgggttcaagtt

SEQ ID NO: 26677 - DNA, 25 bp, Homo sapien
agttccagccttatttttatagccc

SEQ ID NO: 26678 - DNA, 25 bp, Homo sapien
agttccagcgttatttttatagccc

SEQ ID NO: 26679 - DNA, 25 bp, Homo sapien
agttccaggaccacaatttgcttgc

SEQ ID NO: 26680 - DNA, 25 bp, Homo sapien
agttccaggaccacgatttgcttgc

SEQ ID NO: 26681 - DNA, 25 bp, Homo sapien
agttccaggccgcctgtttttactc

SEQ ID NO: 26682 - DNA, 25 bp, Homo sapien
agttccaggcctcctgtttttactc

SEQ ID NO: 26683 - DNA, 25 bp, Homo sapien
agttccatatcttattcaattcctg

SEQ ID NO: 26684 - DNA, 25 bp, Homo sapien
agttccatatcttatttaattcctg

SEQ ID NO: 26685 - DNA, 25 bp, Homo sapien
agttcctagcataataaagatacgt

SEQ ID NO: 26686 - DNA, 25 bp, Homo sapien
agttcctagcataatacagatacgt

SEQ ID NO: 26687 - DNA, 25 bp, Homo sapien
agttcctatgaaacagagaatttca

SEQ ID NO: 26688 - DNA, 25 bp, Homo sapien
agttcctatgaagcagagaatttca

SEQ ID NO: 26689 - DNA, 25 bp, Homo sapien
agttcctctctgacattcaaccaca

SEQ ID NO: 26690 - DNA, 25 bp, Homo sapien
agttcctctctgacgttcaaccaca

SEQ ID NO: 26691 - DNA, 25 bp, Homo sapien
agttcctcttggtcctccagacacg

SEQ ID NO: 26692 - DNA, 25 bp, Homo sapien
agttcctcttggttctccagacacg

SEQ ID NO: 26693 - DNA, 25 bp, Homo sapien
agttcctgctgagacccttgcaata

SEQ ID NO: 26694 - DNA, 25 bp, Homo sapien
agttcctgctgcgacccttgcaata

SEQ ID NO: 26695 - DNA, 25 bp, Homo sapien
agttccttaatagttttttacatgc

SEQ ID NO: 26696 - DNA, 25 bp, Homo sapien
agttccttaatatttttttacatgc

SEQ ID NO: 26697 - DNA, 25 bp, Homo sapien
agttccttcttggaaatctttcaga

SEQ ID NO: 26698 - DNA, 25 bp, Homo sapien
agttcctttttggaaatctttcaga

SEQ ID NO: 26699 - DNA, 25 bp, Homo sapien
agttctaacggcttccatttgcctt

SEQ ID NO: 26700 - DNA, 25 bp, Homo sapien
agttctaagagaaaaatgattgtgc

SEQ ID NO: 26701 - DNA, 25 bp, Homo sapien
agttctaagagaaacatgattgtgc

SEQ ID NO: 26702 - DNA, 25 bp, Homo sapien
agttctaatggcttccatttgcctt

SEQ ID NO: 26703 - DNA, 25 bp, Homo sapien
agttctacatgtgcatgttggatgt

SEQ ID NO: 26704 - DNA, 25 bp, Homo sapien
agttctacatgtgtatgttggatgt

SEQ ID NO: 26705 - DNA, 25 bp, Homo sapien
agttctactagttcatcttctataa

SEQ ID NO: 26706 - DNA, 25 bp, Homo sapien
agttctactagttcgtcttctataa

SEQ ID NO: 26707 - DNA, 25 bp, Homo sapien
agttctaggcgcacttccttggact

SEQ ID NO: 26708 - DNA, 25 bp, Homo sapien
agttctaggcgcatttccttggact

SEQ ID NO: 26709 - DNA, 25 bp, Homo sapien
agttctcattgcctattgtttctat

SEQ ID NO: 26710 - DNA, 25 bp, Homo sapien
agttctcattgtctattgtttctat

SEQ ID NO: 26711 - DNA, 25 bp, Homo sapien
agttctccatacgtagcttcaagaa

SEQ ID NO: 26712 - DNA, 25 bp, Homo sapien
agttctccatatgtagcttcaagaa

SEQ ID NO: 26713 - DNA, 25 bp, Homo sapien
agttctccatctcatcccttggtct

SEQ ID NO: 26714 - DNA, 25 bp, Homo sapien
agttctccatctcgtcccttggtct

SEQ ID NO: 26715 - DNA, 25 bp, Homo sapien
agttctctagccacctctcatacct

SEQ ID NO: 26716 - DNA, 25 bp, Homo sapien
agttctctagcctcctctcatacct

SEQ ID NO: 26717 - DNA, 25 bp, Homo sapien
agttctctcagttggacatgaatgt

SEQ ID NO: 26718 - DNA, 25 bp, Homo sapien
agttctctcagttggatatgaatgt

SEQ ID NO: 26719 - DNA, 25 bp, Homo sapien
agttctctctgggaaggattgtggt

SEQ ID NO: 26720 - DNA, 25 bp, Homo sapien
agttctctctgggtaggattgtggt

SEQ ID NO: 26721 - DNA, 25 bp, Homo sapien
agttctctgtacccctgaaaataag

SEQ ID NO: 26722 - DNA, 25 bp, Homo sapien
agttctctgtactcctgaaaataag

SEQ ID NO: 26723 - DNA, 25 bp, Homo sapien
agttctctgtggagatgatagcaat

SEQ ID NO: 26724 - DNA, 25 bp, Homo sapien
agttctctgtggagattatagcaat

SEQ ID NO: 26725 - DNA, 25 bp, Homo sapien
agttctctttgcgtggcatttctct

SEQ ID NO: 26726 - DNA, 25 bp, Homo sapien
agttctctttgtgtggcatttctct

SEQ ID NO: 26727 - DNA, 25 bp, Homo sapien
agttctgaattcaaaggtcagaaac

SEQ ID NO: 26728 - DNA, 25 bp, Homo sapien
agttctgaattcgaaggtcagaaac

SEQ ID NO: 26729 - DNA, 25 bp, Homo sapien
agttctgaattggaagagcatcaca

SEQ ID NO: 26730 - DNA, 25 bp, Homo sapien
agttctgaatttgaagagcatcaca

SEQ ID NO: 26731 - DNA, 25 bp, Homo sapien
agttctgagatatcaatgcaattaa

SEQ ID NO: 26732 - DNA, 25 bp, Homo sapien
agttctgagatgtcaatgcaattaa

SEQ ID NO: 26733 - DNA, 25 bp, Homo sapien
agttctgatcacagtgatatatgag

SEQ ID NO: 26734 - DNA, 25 bp, Homo sapien
agttctgatcacagtggtatatgag

SEQ ID NO: 26735 - DNA, 25 bp, Homo sapien
agttctgatgaggacatcaagctgc

SEQ ID NO: 26736 - DNA, 25 bp, Homo sapien
agttctgatgagggcatcaagctgc

SEQ ID NO: 26737 - DNA, 25 bp, Homo sapien
agttctgccatcctgaggctaattt

SEQ ID NO: 26738 - DNA, 25 bp, Homo sapien
agttctgccatcttgaggctaattt

SEQ ID NO: 26739 - DNA, 25 bp, Homo sapien
agttctggagctaaaaaatgaagcc

SEQ ID NO: 26740 - DNA, 25 bp, Homo sapien
agttctggagctaaaacatgaagcc

SEQ ID NO: 26741 - DNA, 25 bp, Homo sapien
agttctggagtacctgaatcataca

SEQ ID NO: 26742 - DNA, 25 bp, Homo sapien
agttctggagtacctgcatcataca

SEQ ID NO: 26743 - DNA, 25 bp, Homo sapien
agttctgtgatctgcaaaatttctt

SEQ ID NO: 26744 - DNA, 25 bp, Homo sapien
agttctgtgatttgcaaaatttctt

SEQ ID NO: 26745 - DNA, 25 bp, Homo sapien
agttctgttttcctccgtgttctct

SEQ ID NO: 26746 - DNA, 25 bp, Homo sapien
agttctgttttcctccttgttctct

SEQ ID NO: 26747 - DNA, 25 bp, Homo sapien
agttcttaatgtactccaatgaaag

SEQ ID NO: 26748 - DNA, 25 bp, Homo sapien
agttcttaatgtgctccaatgaaag

SEQ ID NO: 26749 - DNA, 25 bp, Homo sapien
agttcttacagagtacatgtgtctg

SEQ ID NO: 26750 - DNA, 25 bp, Homo sapien
agttcttacagggtacatgtgtctg

SEQ ID NO: 26751 - DNA, 25 bp, Homo sapien
agttcttcaccagccagacatcgtc

SEQ ID NO: 26752 - DNA, 25 bp, Homo sapien
agttcttcaccagctagacatcgtc

SEQ ID NO: 26753 - DNA, 25 bp, Homo sapien
agttcttgcatttaagcctgtttca

SEQ ID NO: 26754 - DNA, 25 bp, Homo sapien
agttcttgcgtttaagcctgtttca

SEQ ID NO: 26755 - DNA, 25 bp, Homo sapien
agttcttggatataacacatttgta

SEQ ID NO: 26756 - DNA, 25 bp, Homo sapien
agttcttggatataacgcatttgta

SEQ ID NO: 26757 - DNA, 25 bp, Homo sapien
agttcttgtctgcattcgttaaagg

SEQ ID NO: 26758 - DNA, 25 bp, Homo sapien
agttcttgtctgcatttgttaaagg

SEQ ID NO: 26759 - DNA, 25 bp, Homo sapien
agttcttttccctgcctgacatact

SEQ ID NO: 26760 - DNA, 25 bp, Homo sapien
agttcttttcccttcctgacatact

SEQ ID NO: 26761 - DNA, 25 bp, Homo sapien
agttgaaaaacacattaagagctcc

SEQ ID NO: 26762 - DNA, 25 bp, Homo sapien
agttgaaaaacccattaagagctcc

SEQ ID NO: 26763 - DNA, 25 bp, Homo sapien
agttgaaaaatgactcaacaatggc

SEQ ID NO: 26764 - DNA, 25 bp, Homo sapien
agttgaaaaatgagtcaacaatggc

SEQ ID NO: 26765 - DNA, 25 bp, Homo sapien
agttgaaaatatgatcaatccaaga

SEQ ID NO: 26766 - DNA, 25 bp, Homo sapien
agttgaaaatatggtcaatccaaga

SEQ ID NO: 26767 - DNA, 25 bp, Homo sapien
agttgaaattactccttactccatg

SEQ ID NO: 26768 - DNA, 25 bp, Homo sapien
agttgaaattagtccttactccatg

SEQ ID NO: 26769 - DNA, 25 bp, Homo sapien
agttgaacaaataacccaagtttac

SEQ ID NO: 26770 - DNA, 25 bp, Homo sapien
agttgaacaaattacccaagtttac

SEQ ID NO: 26771 - DNA, 25 bp, Homo sapien
agttgaacctgtcaaattgagttct

SEQ ID NO: 26772 - DNA, 25 bp, Homo sapien
agttgaacctgttaaattgagttct

SEQ ID NO: 26773 - DNA, 25 bp, Homo sapien
agttgaaccttattaacttattttg

SEQ ID NO: 26774 - DNA, 25 bp, Homo sapien
agttgaacctttttaacttattttg

SEQ ID NO: 26775 - DNA, 25 bp, Homo sapien
agttgaagaaagggagtttcccacc

SEQ ID NO: 26776 - DNA, 25 bp, Homo sapien
agttgaagaggatgggacttttcag

SEQ ID NO: 26777 - DNA, 25 bp, Homo sapien
agttgaagaggatgggccttttcag

SEQ ID NO: 26778 - DNA, 25 bp, Homo sapien
agttgaagatagggagtttcccacc

SEQ ID NO: 26779 - DNA, 25 bp, Homo sapien
agttgaatttttctcccgtaatgca

SEQ ID NO: 26780 - DNA, 25 bp, Homo sapien
agttgaatttttctcctgtaatgca

SEQ ID NO: 26781 - DNA, 25 bp, Homo sapien
agttgacaaggataaacctatcata

SEQ ID NO: 26782 - DNA, 25 bp, Homo sapien
agttgacaaggctaaacctatcata

SEQ ID NO: 26783 - DNA, 25 bp, Homo sapien
agttgacttttgaccttgttccttg

SEQ ID NO: 26784 - DNA, 25 bp, Homo sapien
agttgacttttggccttgttccttg

SEQ ID NO: 26785 - DNA, 25 bp, Homo sapien
agttgagactccaagaactgtcatc

SEQ ID NO: 26786 - DNA, 25 bp, Homo sapien
agttgagactccatgaactgtcatc

SEQ ID NO: 26787 - DNA, 25 bp, Homo sapien
agttgaggtgtccagccatcaaaac

SEQ ID NO: 26788 - DNA, 25 bp, Homo sapien
agttgaggtgttcagccatcaaaac

SEQ ID NO: 26789 - DNA, 25 bp, Homo sapien
agttgagtacaaaaggatttatctt

SEQ ID NO: 26790 - DNA, 25 bp, Homo sapien
agttgagtccaaaaggatttatctt

SEQ ID NO: 26791 - DNA, 25 bp, Homo sapien
agttgagtcctccgaatgaaaaggc

SEQ ID NO: 26792 - DNA, 25 bp, Homo sapien
agttgagtcctctgaatgaaaaggc

SEQ ID NO: 26793 - DNA, 25 bp, Homo sapien
agttgatataagacggtcaactaaa

SEQ ID NO: 26794 - DNA, 25 bp, Homo sapien
agttgatataagatggtcaactaaa

SEQ ID NO: 26795 - DNA, 25 bp, Homo sapien
agttgatatttcagttaaggttctc

SEQ ID NO: 26796 - DNA, 25 bp, Homo sapien
agttgatatttcagttgaggttctc

SEQ ID NO: 26797 - DNA, 25 bp, Homo sapien
agttgatcattttaaacaccttaca

SEQ ID NO: 26798 - DNA, 25 bp, Homo sapien
agttgatcgttttaaacaccttaca

SEQ ID NO: 26799 - DNA, 25 bp, Homo sapien
agttgatgccaatcgatactctgac

SEQ ID NO: 26800 - DNA, 25 bp, Homo sapien
agttgatgccaattgatactctgac

SEQ ID NO: 26801 - DNA, 25 bp, Homo sapien
agttgattccagatgttcagcttta

SEQ ID NO: 26802 - DNA, 25 bp, Homo sapien
agttgatttaaaaaaaaacttgatg

SEQ ID NO: 26803 - DNA, 25 bp, Homo sapien
agttgatttcaaccggactaagcca

SEQ ID NO: 26804 - DNA, 25 bp, Homo sapien
agttgatttcaactggactaagcca

SEQ ID NO: 26805 - DNA, 25 bp, Homo sapien
agttgatttcagatgttcagcttta

SEQ ID NO: 26806 - DNA, 25 bp, Homo sapien
agttgattttaaaaaaaacttgatg

SEQ ID NO: 26807 - DNA, 25 bp, Homo sapien
agttgcaatgacggtgtaattttca

SEQ ID NO: 26808 - DNA, 25 bp, Homo sapien
agttgcaatgactgtgtaattttca

SEQ ID NO: 26809 - DNA, 25 bp, Homo sapien
agttgcacacaaaggcccaggaatc

SEQ ID NO: 26810 - DNA, 25 bp, Homo sapien
agttgcacacaaagtcccaggaatc

SEQ ID NO: 26811 - DNA, 25 bp, Homo sapien
agttgcacactagctacagcagaga

SEQ ID NO: 26812 - DNA, 25 bp, Homo sapien
agttgcacactaggtacagcagaga

SEQ ID NO: 26813 - DNA, 25 bp, Homo sapien
agttgcacatgctattcattataaa

SEQ ID NO: 26814 - DNA, 25 bp, Homo sapien
agttgcacctgctattcattataaa

SEQ ID NO: 26815 - DNA, 25 bp, Homo sapien
agttgcagcttctaggagctcagca

SEQ ID NO: 26816 - DNA, 25 bp, Homo sapien
agttgcagcttctgggagctcagca

SEQ ID NO: 26817 - DNA, 25 bp, Homo sapien
agttgcagtttaatcaaaaatttac

SEQ ID NO: 26818 - DNA, 25 bp, Homo sapien
agttgcagtttaatcagaaatttac

SEQ ID NO: 26819 - DNA, 25 bp, Homo sapien
agttgcataatttgataactaattc

SEQ ID NO: 26820 - DNA, 25 bp, Homo sapien
agttgcataatttgctaactaattc

SEQ ID NO: 26821 - DNA, 25 bp, Homo sapien
agttgcatcgaacctgaaatgtaga

SEQ ID NO: 26822 - DNA, 25 bp, Homo sapien
agttgcattgaacctgaaatgtaga

SEQ ID NO: 26823 - DNA, 25 bp, Homo sapien
agttgccaaccaacaccaccagctc

SEQ ID NO: 26824 - DNA, 25 bp, Homo sapien
agttgccatatccatttctgtgatg

SEQ ID NO: 26825 - DNA, 25 bp, Homo sapien
agttgccatatctatttctgtgatg

SEQ ID NO: 26826 - DNA, 25 bp, Homo sapien
agttgccatccaacaccaccagctc

SEQ ID NO: 26827 - DNA, 25 bp, Homo sapien
agttgcccaaaatttgcatgtgcag

SEQ ID NO: 26828 - DNA, 25 bp, Homo sapien
agttgcccagaatttgcatgtgcag

SEQ ID NO: 26829 - DNA, 25 bp, Homo sapien
agttgcctagactataaactttagt

SEQ ID NO: 26830 - DNA, 25 bp, Homo sapien
agttgcctagactgtaaactttagt

SEQ ID NO: 26831 - DNA, 25 bp, Homo sapien
agttgcctatctgtctaaaagcatt

SEQ ID NO: 26832 - DNA, 25 bp, Homo sapien
agttgcctatctgtctgaaagcatt

SEQ ID NO: 26833 - DNA, 25 bp, Homo sapien
agttgccttggcagctgaaacatgg

SEQ ID NO: 26834 - DNA, 25 bp, Homo sapien
agttgccttggcggctgaaacatgg

SEQ ID NO: 26835 - DNA, 25 bp, Homo sapien
agttgcggcgtatcggagacgagtt

SEQ ID NO: 26836 - DNA, 25 bp, Homo sapien
agttgcggcgtattggagacgagtt

SEQ ID NO: 26837 - DNA, 25 bp, Homo sapien
agttgctaacaccactggctcatct

SEQ ID NO: 26838 - DNA, 25 bp, Homo sapien
agttgctaacaccgctggctcatct

SEQ ID NO: 26839 - DNA, 25 bp, Homo sapien
agttgctatattatttttcttctga

SEQ ID NO: 26840 - DNA, 25 bp, Homo sapien
agttgctatattctttttcttctga

SEQ ID NO: 26841 - DNA, 25 bp, Homo sapien
agttgctatccatatgatcttgtaa

SEQ ID NO: 26842 - DNA, 25 bp, Homo sapien
agttgctatccgtatgatcttgtaa

SEQ ID NO: 26843 - DNA, 25 bp, Homo sapien
agttgctattgaaacctccaattct

SEQ ID NO: 26844 - DNA, 25 bp, Homo sapien
agttgctattgatacctccaattct

SEQ ID NO: 26845 - DNA, 25 bp, Homo sapien
agttgctcagcttctacgtaccacg

SEQ ID NO: 26846 - DNA, 25 bp, Homo sapien
agttgctcagcttctatgtaccacg

SEQ ID NO: 26847 - DNA, 25 bp, Homo sapien
agttgctctcctccctctttgtagg

SEQ ID NO: 26848 - DNA, 25 bp, Homo sapien
agttgctctgctccctctttgtagg

SEQ ID NO: 26849 - DNA, 25 bp, Homo sapien
agttgctcttccactgatctctcaa

SEQ ID NO: 26850 - DNA, 25 bp, Homo sapien
agttgctcttcctctgatctctcaa

SEQ ID NO: 26851 - DNA, 25 bp, Homo sapien
agttgctgggtatcgagaaccaaac

SEQ ID NO: 26852 - DNA, 25 bp, Homo sapien
agttgctgggtattgagaaccaaac

SEQ ID NO: 26853 - DNA, 25 bp, Homo sapien
agttgctgtgaactgccatctcttc

SEQ ID NO: 26854 - DNA, 25 bp, Homo sapien
agttgctgtgagctgccatctcttc

SEQ ID NO: 26855 - DNA, 25 bp, Homo sapien
agttgcttgacctatgttttttgca

SEQ ID NO: 26856 - DNA, 25 bp, Homo sapien
agttgcttgacttatgttttttgca

SEQ ID NO: 26857 - DNA, 25 bp, Homo sapien
agttggacatttccactcagacacc

SEQ ID NO: 26858 - DNA, 25 bp, Homo sapien
agttggacctttccactcagacacc

SEQ ID NO: 26859 - DNA, 25 bp, Homo sapien
agttggagaatacaaggtggatggt

SEQ ID NO: 26860 - DNA, 25 bp, Homo sapien
agttggagaatgcaaggtggatggt

SEQ ID NO: 26861 - DNA, 25 bp, Homo sapien
agttggagacattaacagcaaaaat

SEQ ID NO: 26862 - DNA, 25 bp, Homo sapien
agttggagcaaatgagactcagatt

SEQ ID NO: 26863 - DNA, 25 bp, Homo sapien
agttggagcaactgagactcagatt

SEQ ID NO: 26864 - DNA, 25 bp, Homo sapien
agttggaggcattaacagcaaaaat

SEQ ID NO: 26865 - DNA, 25 bp, Homo sapien
agttggaggtatgtacacattttcc

SEQ ID NO: 26866 - DNA, 25 bp, Homo sapien
agttggaggtatgtactcattttcc

SEQ ID NO: 26867 - DNA, 25 bp, Homo sapien
agttggataccaatacagcaggatc

SEQ ID NO: 26868 - DNA, 25 bp, Homo sapien
agttggatgccaatacagcaggatc

SEQ ID NO: 26869 - DNA, 25 bp, Homo sapien
agttggattttgcttccattaatgt

SEQ ID NO: 26870 - DNA, 25 bp, Homo sapien
agttggattttgtttccattaatgt

SEQ ID NO: 26871 - DNA, 25 bp, Homo sapien
agttggctcagcatgccttaacaga

SEQ ID NO: 26872 - DNA, 25 bp, Homo sapien
agttggctcagcgtgccttaacaga

SEQ ID NO: 26873 - DNA, 25 bp, Homo sapien
agttggcttacatgattgtgaggtc

SEQ ID NO: 26874 - DNA, 25 bp, Homo sapien
agttggcttacgtgattgtgaggtc

SEQ ID NO: 26875 - DNA, 25 bp, Homo sapien
agttggcttcacctttgggctggct

SEQ ID NO: 26876 - DNA, 25 bp, Homo sapien
agttggcttcacgtttgggctggct

SEQ ID NO: 26877 - DNA, 25 bp, Homo sapien
agttgggaacacatgatgagctctg

SEQ ID NO: 26878 - DNA, 25 bp, Homo sapien
agttgggaacacgtgatgagctctg

SEQ ID NO: 26879 - DNA, 25 bp, Homo sapien
agttgggacgaaggtatcaataaag

SEQ ID NO: 26880 - DNA, 25 bp, Homo sapien
agttgggatgaaggtatcaataaag

SEQ ID NO: 26881 - DNA, 25 bp, Homo sapien
agttggtagtagactggaattcctt

SEQ ID NO: 26882 - DNA, 25 bp, Homo sapien
agttggtagtagcctggaattcctt

SEQ ID NO: 26883 - DNA, 25 bp, Homo sapien
agttggtagtcaaatctcaccatca

SEQ ID NO: 26884 - DNA, 25 bp, Homo sapien
agttggtagtcacatctcaccatca

SEQ ID NO: 26885 - DNA, 25 bp, Homo sapien
agttggtcaacatgcagatgactag

SEQ ID NO: 26886 - DNA, 25 bp, Homo sapien
agttggtcaacgtgcagatgactag

SEQ ID NO: 26887 - DNA, 25 bp, Homo sapien
agttggtccttaaaagtgggcttta

SEQ ID NO: 26888 - DNA, 25 bp, Homo sapien
agttggtccttagaagtgggcttta

SEQ ID NO: 26889 - DNA, 25 bp, Homo sapien
agttggtgcttggtagagttgctga

SEQ ID NO: 26890 - DNA, 25 bp, Homo sapien
agttggtgtttggtagagttgctga

SEQ ID NO: 26891 - DNA, 25 bp, Homo sapien
agttggttatataggttactacaat

SEQ ID NO: 26892 - DNA, 25 bp, Homo sapien
agttggttcacccaaaattgaactg

SEQ ID NO: 26893 - DNA, 25 bp, Homo sapien
agttggttcacgcaaaattgaactg

SEQ ID NO: 26894 - DNA, 25 bp, Homo sapien
agttggttgtataggttactacaat

SEQ ID NO: 26895 - DNA, 25 bp, Homo sapien
agttgtaacaaatgacataaaggag

SEQ ID NO: 26896 - DNA, 25 bp, Homo sapien
agttgtaacgaatgacataaaggag

SEQ ID NO: 26897 - DNA, 25 bp, Homo sapien
agttgtaaggaatatacattggact

SEQ ID NO: 26898 - DNA, 25 bp, Homo sapien
agttgtaaggagtatacattggact

SEQ ID NO: 26899 - DNA, 25 bp, Homo sapien
agttgtaggctcatatgtaaaagtt

SEQ ID NO: 26900 - DNA, 25 bp, Homo sapien
agttgtaggctcatgtgtaaaagtt

SEQ ID NO: 26901 - DNA, 25 bp, Homo sapien
agttgtaggtcaccgggtgcagaac

SEQ ID NO: 26902 - DNA, 25 bp, Homo sapien
agttgtaggtcactgggtgcagaac

SEQ ID NO: 26903 - DNA, 25 bp, Homo sapien
agttgtagttagaggcatcccagaa

SEQ ID NO: 26904 - DNA, 25 bp, Homo sapien
agttgtagttataggcatcccagaa

SEQ ID NO: 26905 - DNA, 25 bp, Homo sapien
agttgtatcattaaaaaaatgtcac

SEQ ID NO: 26906 - DNA, 25 bp, Homo sapien
agttgtatcattgaaaaaatgtcac

SEQ ID NO: 26907 - DNA, 25 bp, Homo sapien
agttgtcaaaaattaacagtaatgg

SEQ ID NO: 26908 - DNA, 25 bp, Homo sapien
agttgtcacccaatggcagttgaaa

SEQ ID NO: 26909 - DNA, 25 bp, Homo sapien
agttgtcacccagtggcagttgaaa

SEQ ID NO: 26910 - DNA, 25 bp, Homo sapien
agttgtcagaaattaacagtaatgg

SEQ ID NO: 26911 - DNA, 25 bp, Homo sapien
agttgtctcattatgatttctcacc

SEQ ID NO: 26912 - DNA, 25 bp, Homo sapien
agttgtctcgttatgatttctcacc

SEQ ID NO: 26913 - DNA, 25 bp, Homo sapien
agttgtctggtcactttagtgaggg

SEQ ID NO: 26914 - DNA, 25 bp, Homo sapien
agttgtctgtaatgatttagtttta

SEQ ID NO: 26915 - DNA, 25 bp, Homo sapien
agttgtctgtaattatttagtttta

SEQ ID NO: 26916 - DNA, 25 bp, Homo sapien
agttgtctgttcactttagtgaggg

SEQ ID NO: 26917 - DNA, 25 bp, Homo sapien
agttgtgatcatagctccctgtaac

SEQ ID NO: 26918 - DNA, 25 bp, Homo sapien
agttgtgattatagctccctgtaac

SEQ ID NO: 26919 - DNA, 25 bp, Homo sapien
agttgtgcacatgcccatctgtggc

SEQ ID NO: 26920 - DNA, 25 bp, Homo sapien
agttgtgcacatgctcatctgtggc

SEQ ID NO: 26921 - DNA, 25 bp, Homo sapien
agttgtgcattaaatagttacttgc

SEQ ID NO: 26922 - DNA, 25 bp, Homo sapien
agttgtgcgttaaatagttacttgc

SEQ ID NO: 26923 - DNA, 25 bp, Homo sapien
agttgtggacaagttttattcatgt

SEQ ID NO: 26924 - DNA, 25 bp, Homo sapien
agttgtggagaagttttattcatgt

SEQ ID NO: 26925 - DNA, 25 bp, Homo sapien
agttgtgtaatcattgtgtttcttt

SEQ ID NO: 26926 - DNA, 25 bp, Homo sapien
agttgtgtcatcattgtgtttcttt

SEQ ID NO: 26927 - DNA, 25 bp, Homo sapien
agttgtgtgggcactaatcccttta

SEQ ID NO: 26928 - DNA, 25 bp, Homo sapien
agttgtgtgggcactactcccttta

SEQ ID NO: 26929 - DNA, 25 bp, Homo sapien
agttgttactcatttgtgagaaaac

SEQ ID NO: 26930 - DNA, 25 bp, Homo sapien
agttgttattcatttgtgagaaaac

SEQ ID NO: 26931 - DNA, 25 bp, Homo sapien
agttgtttccatattttagctattg

SEQ ID NO: 26932 - DNA, 25 bp, Homo sapien
agttgtttctgtctttttgtaatct

SEQ ID NO: 26933 - DNA, 25 bp, Homo sapien
agttgtttctgtttttttgtaatct

SEQ ID NO: 26934 - DNA, 25 bp, Homo sapien
agttgttttcatattttagctattg

SEQ ID NO: 26935 - DNA, 25 bp, Homo sapien
agtttaaccatgtatctgactggcc

SEQ ID NO: 26936 - DNA, 25 bp, Homo sapien
agtttaaccgtgtatctgactggcc

SEQ ID NO: 26937 - DNA, 25 bp, Homo sapien
agtttaactccaattactttatggg

SEQ ID NO: 26938 - DNA, 25 bp, Homo sapien
agtttaactccaattattttatggg

SEQ ID NO: 26939 - DNA, 25 bp, Homo sapien
agtttaagctgaatatgttggaaaa

SEQ ID NO: 26940 - DNA, 25 bp, Homo sapien
agtttaagctggatatgttggaaaa

SEQ ID NO: 26941 - DNA, 25 bp, Homo sapien
agtttaatatgacagacggtaagaa

SEQ ID NO: 26942 - DNA, 25 bp, Homo sapien
agtttaatatgacagagggtaagaa

SEQ ID NO: 26943 - DNA, 25 bp, Homo sapien
agtttaatcaaaccaacaagcattt

SEQ ID NO: 26944 - DNA, 25 bp, Homo sapien
agtttaatcaaatcaacaagcattt

SEQ ID NO: 26945 - DNA, 25 bp, Homo sapien
agtttacacgagcacagagttcaaa

SEQ ID NO: 26946 - DNA, 25 bp, Homo sapien
agtttacagttggctaaatatggca

SEQ ID NO: 26947 - DNA, 25 bp, Homo sapien
agtttacagttggttaaatatggca

SEQ ID NO: 26948 - DNA, 25 bp, Homo sapien
agtttacatgagcacagagttcaaa

SEQ ID NO: 26949 - DNA, 25 bp, Homo sapien
agtttaccgttgaattgctttattt

SEQ ID NO: 26950 - DNA, 25 bp, Homo sapien
agtttaccgttggattgctttattt

SEQ ID NO: 26951 - DNA, 25 bp, Homo sapien
agtttactctcaattttgtctcccg

SEQ ID NO: 26952 - DNA, 25 bp, Homo sapien
agtttactctcacttttgtctcccg

SEQ ID NO: 26953 - DNA, 25 bp, Homo sapien
agtttagatgaaaagaatcactcct

SEQ ID NO: 26954 - DNA, 25 bp, Homo sapien
agtttagatgaaaggaatcactcct

SEQ ID NO: 26955 - DNA, 25 bp, Homo sapien
agtttagccagtggaataatatttg

SEQ ID NO: 26956 - DNA, 25 bp, Homo sapien
agtttagctagtggaataatatttg

SEQ ID NO: 26957 - DNA, 25 bp, Homo sapien
agtttatacagcttgggtatggcta

SEQ ID NO: 26958 - DNA, 25 bp, Homo sapien
agtttatacagcttggttatggcta

SEQ ID NO: 26959 - DNA, 25 bp, Homo sapien
agtttatagaagaactttccatcta

SEQ ID NO: 26960 - DNA, 25 bp, Homo sapien
agtttatagaaggactttccatcta

SEQ ID NO: 26961 - DNA, 25 bp, Homo sapien
agtttatcatgctcccattgtgaac

SEQ ID NO: 26962 - DNA, 25 bp, Homo sapien
agtttatcatgctcccgttgtgaac

SEQ ID NO: 26963 - DNA, 25 bp, Homo sapien
agtttatgactgggatatcatgagg

SEQ ID NO: 26964 - DNA, 25 bp, Homo sapien
agtttatgactgggatgtcatgagg

SEQ ID NO: 26965 - DNA, 25 bp, Homo sapien
agtttatggcaataataggtagaac

SEQ ID NO: 26966 - DNA, 25 bp, Homo sapien
agtttatggccaatttgctacagca

SEQ ID NO: 26967 - DNA, 25 bp, Homo sapien
agtttatggcctatttgctacagca

SEQ ID NO: 26968 - DNA, 25 bp, Homo sapien
agtttatgggaataataggtagaac

SEQ ID NO: 26969 - DNA, 25 bp, Homo sapien
agtttatttcaagtataagagagat

SEQ ID NO: 26970 - DNA, 25 bp, Homo sapien
agtttatttcaagtatgagagagat

SEQ ID NO: 26971 - DNA, 25 bp, Homo sapien
agtttatttgtaatcaagagtggcc

SEQ ID NO: 26972 - DNA, 25 bp, Homo sapien
agtttatttgtagtcaagagtggcc

SEQ ID NO: 26973 - DNA, 25 bp, Homo sapien
agtttcaactacagggaaacctatt

SEQ ID NO: 26974 - DNA, 25 bp, Homo sapien
agtttcaactacatggaaacctatt

SEQ ID NO: 26975 - DNA, 25 bp, Homo sapien
agtttcagcctttagaattaggtct

SEQ ID NO: 26976 - DNA, 25 bp, Homo sapien
agtttcaggctttagaattaggtct

SEQ ID NO: 26977 - DNA, 25 bp, Homo sapien
agtttcagttccgactctaacttgt

SEQ ID NO: 26978 - DNA, 25 bp, Homo sapien
agtttcagttccgcctctaacttgt

SEQ ID NO: 26979 - DNA, 25 bp, Homo sapien
agtttcatgtgaaatcttttggaga

SEQ ID NO: 26980 - DNA, 25 bp, Homo sapien
agtttcatgtgaattcttttggaga

SEQ ID NO: 26981 - DNA, 25 bp, Homo sapien
agtttccagggcttagaatgtggat

SEQ ID NO: 26982 - DNA, 25 bp, Homo sapien
agtttccagggtttagaatgtggat

SEQ ID NO: 26983 - DNA, 25 bp, Homo sapien
agtttccattacagaggtctttcac

SEQ ID NO: 26984 - DNA, 25 bp, Homo sapien
agtttccattatagaggtctttcac

SEQ ID NO: 26985 - DNA, 25 bp, Homo sapien
agtttcccaaattattcgtcattgg

SEQ ID NO: 26986 - DNA, 25 bp, Homo sapien
agtttcccaaattatttgtcattgg

SEQ ID NO: 26987 - DNA, 25 bp, Homo sapien
agtttccgacattccgtattagaca

SEQ ID NO: 26988 - DNA, 25 bp, Homo sapien
agtttccgacattctgtattagaca

SEQ ID NO: 26989 - DNA, 25 bp, Homo sapien
agtttcctcacacggcaccatggct

SEQ ID NO: 26990 - DNA, 25 bp, Homo sapien
agtttcctcacagggcaccatggct

SEQ ID NO: 26991 - DNA, 25 bp, Homo sapien
agtttcctgtaacgccagccaggag

SEQ ID NO: 26992 - DNA, 25 bp, Homo sapien
agtttcctgtaatgccagccaggag

SEQ ID NO: 26993 - DNA, 25 bp, Homo sapien
agtttctcagagagtactcagatca

SEQ ID NO: 26994 - DNA, 25 bp, Homo sapien
agtttctcagatagtactcagatca

SEQ ID NO: 26995 - DNA, 25 bp, Homo sapien
agtttctcattcctctggctctgtc

SEQ ID NO: 26996 - DNA, 25 bp, Homo sapien
agtttctcatttacagtccttttgc

SEQ ID NO: 26997 - DNA, 25 bp, Homo sapien
agtttctcatttacggtccttttgc

SEQ ID NO: 26998 - DNA, 25 bp, Homo sapien
agtttctcatttctctggctctgtc

SEQ ID NO: 26999 - DNA, 25 bp, Homo sapien
agtttctccatgtcacctttcacca

SEQ ID NO: 27000 - DNA, 25 bp, Homo sapien
agtttctccatgtcacgtttcacca

SEQ ID NO: 27001 - DNA, 25 bp, Homo sapien
agtttctgataaaacgaggagactg

SEQ ID NO: 27002 - DNA, 25 bp, Homo sapien
agtttctgataaaaggaggagactg

SEQ ID NO: 27003 - DNA, 25 bp, Homo sapien
agtttctgcaaagccattaaaaatg

SEQ ID NO: 27004 - DNA, 25 bp, Homo sapien
agtttctgcaatgccattaaaaatg

SEQ ID NO: 27005 - DNA, 25 bp, Homo sapien
agtttctggtttcaagcggtgagcc

SEQ ID NO: 27006 - DNA, 25 bp, Homo sapien
agtttctggtttcaagtggtgagcc

SEQ ID NO: 27007 - DNA, 25 bp, Homo sapien
agtttctgttaataaaagtctcatc

SEQ ID NO: 27008 - DNA, 25 bp, Homo sapien
agtttctgttaataaaggtctcatc

SEQ ID NO: 27009 - DNA, 25 bp, Homo sapien
agtttcttaaaatctcattgaatct

SEQ ID NO: 27010 - DNA, 25 bp, Homo sapien
agtttcttaaaatttcattgaatct

SEQ ID NO: 27011 - DNA, 25 bp, Homo sapien
agtttcttaaataggtaggtattga

SEQ ID NO: 27012 - DNA, 25 bp, Homo sapien
agtttcttaaattggtaggtattga

SEQ ID NO: 27013 - DNA, 25 bp, Homo sapien
agtttctttgtgtccatccacagat

SEQ ID NO: 27014 - DNA, 25 bp, Homo sapien
agtttctttgtgtctatccacagat

SEQ ID NO: 27015 - DNA, 25 bp, Homo sapien
agtttgaaatcgggaatacaatgat

SEQ ID NO: 27016 - DNA, 25 bp, Homo sapien
agtttgaaatcggggatacaatgat

SEQ ID NO: 27017 - DNA, 25 bp, Homo sapien
agtttgacacacaataggcacttaa

SEQ ID NO: 27018 - DNA, 25 bp, Homo sapien
agtttgacatacaataggcacttaa

SEQ ID NO: 27019 - DNA, 25 bp, Homo sapien
agtttgaccataatgtgccctggta

SEQ ID NO: 27020 - DNA, 25 bp, Homo sapien
agtttgaccgtaatgtgccctggta

SEQ ID NO: 27021 - DNA, 25 bp, Homo sapien
agtttgagaccagattgagcaacat

SEQ ID NO: 27022 - DNA, 25 bp, Homo sapien
agtttgagacctgattgagcaacat

SEQ ID NO: 27023 - DNA, 25 bp, Homo sapien
agtttgcaaaaccttcaatcatcta

SEQ ID NO: 27024 - DNA, 25 bp, Homo sapien
agtttgcaaaagcttcaatcatcta

SEQ ID NO: 27025 - DNA, 25 bp, Homo sapien
agtttgcaatgaatggactggccac

SEQ ID NO: 27026 - DNA, 25 bp, Homo sapien
agtttgcaatgaatgggctggccac

SEQ ID NO: 27027 - DNA, 25 bp, Homo sapien
agtttgcactgtgcctggcacatag

SEQ ID NO: 27028 - DNA, 25 bp, Homo sapien
agtttgcagaaaaagttctgaagtc

SEQ ID NO: 27029 - DNA, 25 bp, Homo sapien
agtttgcagaaagagttctgaagtc

SEQ ID NO: 27030 - DNA, 25 bp, Homo sapien
agtttgcagattcctgatctaaaag

SEQ ID NO: 27031 - DNA, 25 bp, Homo sapien
agtttgcatattcctgatctaaaag

SEQ ID NO: 27032 - DNA, 25 bp, Homo sapien
agtttgcattgtgcctggcacatag

SEQ ID NO: 27033 - DNA, 25 bp, Homo sapien
agtttgcccatgatgtggtggtgga

SEQ ID NO: 27034 - DNA, 25 bp, Homo sapien
agtttgcccatggtgtggtggtgga

SEQ ID NO: 27035 - DNA, 25 bp, Homo sapien
agtttgctgctatttcagaatttct

SEQ ID NO: 27036 - DNA, 25 bp, Homo sapien
agtttgctgctatttcggaatttct

SEQ ID NO: 27037 - DNA, 25 bp, Homo sapien
agtttggacacaacagaagaaataa

SEQ ID NO: 27038 - DNA, 25 bp, Homo sapien
agtttggacacaatagaagaaataa

SEQ ID NO: 27039 - DNA, 25 bp, Homo sapien
agtttggatgaagcccagcaaattc

SEQ ID NO: 27040 - DNA, 25 bp, Homo sapien
agtttggatgaagcgcagcaaattc

SEQ ID NO: 27041 - DNA, 25 bp, Homo sapien
agtttgggcaggacttgtttattgt

SEQ ID NO: 27042 - DNA, 25 bp, Homo sapien
agtttgggcagtacttgtttattgt

SEQ ID NO: 27043 - DNA, 25 bp, Homo sapien
agtttgtacacgtagctattttcag

SEQ ID NO: 27044 - DNA, 25 bp, Homo sapien
agtttgtacacttagctattttcag

SEQ ID NO: 27045 - DNA, 25 bp, Homo sapien
agtttgtagaaacacctagatttgc

SEQ ID NO: 27046 - DNA, 25 bp, Homo sapien
agtttgtagaaatacctagatttgc

SEQ ID NO: 27047 - DNA, 25 bp, Homo sapien
agtttgtatgaaatagaactccaag

SEQ ID NO: 27048 - DNA, 25 bp, Homo sapien
agtttgtatgaaatagcactccaag

SEQ ID NO: 27049 - DNA, 25 bp, Homo sapien
agtttgtcattattgtggtgactgg

SEQ ID NO: 27050 - DNA, 25 bp, Homo sapien
agtttgtcgttattgtggtgactgg

SEQ ID NO: 27051 - DNA, 25 bp, Homo sapien
agtttgttcaacggaataataatac

SEQ ID NO: 27052 - DNA, 25 bp, Homo sapien
agtttgttcaatggaataataatac

SEQ ID NO: 27053 - DNA, 25 bp, Homo sapien
agtttgttcacactccactgtatcc

SEQ ID NO: 27054 - DNA, 25 bp, Homo sapien
agtttgttcacacttcactgtatcc

SEQ ID NO: 27055 - DNA, 25 bp, Homo sapien
agtttgtttaaataagttagcagag

SEQ ID NO: 27056 - DNA, 25 bp, Homo sapien
agtttgtttcaataagttagcagag

SEQ ID NO: 27057 - DNA, 25 bp, Homo sapien
agtttgtttggtgcacccatatttg

SEQ ID NO: 27058 - DNA, 25 bp, Homo sapien
agtttgtttggtgcactcatatttg

SEQ ID NO: 27059 - DNA, 25 bp, Homo sapien
agtttgttttttagtcacttgttaa

SEQ ID NO: 27060 - DNA, 25 bp, Homo sapien
agtttgttttttagtcgcttgttaa

SEQ ID NO: 27061 - DNA, 25 bp, Homo sapien
agttttaaataaggaacacaatgac

SEQ ID NO: 27062 - DNA, 25 bp, Homo sapien
agttttaaatacggaacacaatgac

SEQ ID NO: 27063 - DNA, 25 bp, Homo sapien
agttttaatcccgactctactcttt

SEQ ID NO: 27064 - DNA, 25 bp, Homo sapien
agttttaatcccgactgtactcttt

SEQ ID NO: 27065 - DNA, 25 bp, Homo sapien
agttttaatgtttaatgagcttagc

SEQ ID NO: 27066 - DNA, 25 bp, Homo sapien
agttttaatttttaatgagcttagc

SEQ ID NO: 27067 - DNA, 25 bp, Homo sapien
agttttatacaggaaaggatttgta

SEQ ID NO: 27068 - DNA, 25 bp, Homo sapien
agttttatccacgctttactgcaca

SEQ ID NO: 27069 - DNA, 25 bp, Homo sapien
agttttatccatgctttactgcaca

SEQ ID NO: 27070 - DNA, 25 bp, Homo sapien
agttttatgcaggaaaggatttgta

SEQ ID NO: 27071 - DNA, 25 bp, Homo sapien
agttttatggtaccagagaatttgt

SEQ ID NO: 27072 - DNA, 25 bp, Homo sapien
agttttatggtatcagagaatttgt

SEQ ID NO: 27073 - DNA, 25 bp, Homo sapien
agttttatggttcgatacatttcag

SEQ ID NO: 27074 - DNA, 25 bp, Homo sapien
agttttatggtttgatacatttcag

SEQ ID NO: 27075 - DNA, 25 bp, Homo sapien
agttttattcgctgcttcatctccc

SEQ ID NO: 27076 - DNA, 25 bp, Homo sapien
agttttattcgctgtttcatctccc

SEQ ID NO: 27077 - DNA, 25 bp, Homo sapien
agttttattggaacacactatgtaa

SEQ ID NO: 27078 - DNA, 25 bp, Homo sapien
agttttattggaagacactatgtaa

SEQ ID NO: 27079 - DNA, 25 bp, Homo sapien
agttttatttgtaacttttatgagt

SEQ ID NO: 27080 - DNA, 25 bp, Homo sapien
agttttatttgtaatttttatgagt

SEQ ID NO: 27081 - DNA, 25 bp, Homo sapien
agttttcaacagagtagtgaaatga

SEQ ID NO: 27082 - DNA, 25 bp, Homo sapien
agttttcacagccttagaaatgaga

SEQ ID NO: 27083 - DNA, 25 bp, Homo sapien
agttttcacagctttagaaatgaga

SEQ ID NO: 27084 - DNA, 25 bp, Homo sapien
agttttcacgctaaaactgagattc

SEQ ID NO: 27085 - DNA, 25 bp, Homo sapien
agttttcacgctaaaattgagattc

SEQ ID NO: 27086 - DNA, 25 bp, Homo sapien
agttttcatcagagtagtgaaatga

SEQ ID NO: 27087 - DNA, 25 bp, Homo sapien
agttttccactgaacgatcttttta

SEQ ID NO: 27088 - DNA, 25 bp, Homo sapien
agttttccactgaatgatcttttta

SEQ ID NO: 27089 - DNA, 25 bp, Homo sapien
agttttccgtaatgtgaatttctga

SEQ ID NO: 27090 - DNA, 25 bp, Homo sapien
agttttcctggcagctgtccattcc

SEQ ID NO: 27091 - DNA, 25 bp, Homo sapien
agttttcctggcagttgtccattcc

SEQ ID NO: 27092 - DNA, 25 bp, Homo sapien
agttttccttaatgtgaatttctga

SEQ ID NO: 27093 - DNA, 25 bp, Homo sapien
agttttctcctctgtcctcacttgg

SEQ ID NO: 27094 - DNA, 25 bp, Homo sapien
agttttctcctgtgtcctcacttgg

SEQ ID NO: 27095 - DNA, 25 bp, Homo sapien
agttttctgtcaaagtaggatgaga

SEQ ID NO: 27096 - DNA, 25 bp, Homo sapien
agttttctgtcaaagtgggatgaga

SEQ ID NO: 27097 - DNA, 25 bp, Homo sapien
agttttgaacagaatctaagtgttg

SEQ ID NO: 27098 - DNA, 25 bp, Homo sapien
agttttgaatagaatctaagtgttg

SEQ ID NO: 27099 - DNA, 25 bp, Homo sapien
agttttgactgaatttcttagtagt

SEQ ID NO: 27100 - DNA, 25 bp, Homo sapien
agttttgagcatcaaggaatacatt

SEQ ID NO: 27101 - DNA, 25 bp, Homo sapien
agttttgagcatcagggaatacatt

SEQ ID NO: 27102 - DNA, 25 bp, Homo sapien
agttttgagttaggcgagaacagtg

SEQ ID NO: 27103 - DNA, 25 bp, Homo sapien
agttttgagttaggtgagaacagtg

SEQ ID NO: 27104 - DNA, 25 bp, Homo sapien
agttttgattgaatttcttagtagt

SEQ ID NO: 27105 - DNA, 25 bp, Homo sapien
agttttgcaatttcctgttcaattt

SEQ ID NO: 27106 - DNA, 25 bp, Homo sapien
agttttgcatgttgcgttccatttt

SEQ ID NO: 27107 - DNA, 25 bp, Homo sapien
agttttgcattttcctgttcaattt

SEQ ID NO: 27108 - DNA, 25 bp, Homo sapien
agttttgcctgagctataggaggaa

SEQ ID NO: 27109 - DNA, 25 bp, Homo sapien
agttttgcgtgttgcgttccatttt

SEQ ID NO: 27110 - DNA, 25 bp, Homo sapien
agttttgcttgagctataggaggaa

SEQ ID NO: 27111 - DNA, 25 bp, Homo sapien
agttttgtaaaaataggtcattctt

SEQ ID NO: 27112 - DNA, 25 bp, Homo sapien
agttttgtaaaagtaggtcattctt

SEQ ID NO: 27113 - DNA, 25 bp, Homo sapien
agttttgtagcataactagaagtca

SEQ ID NO: 27114 - DNA, 25 bp, Homo sapien
agttttgtagcgtaactagaagtca

SEQ ID NO: 27115 - DNA, 25 bp, Homo sapien
agttttgtgttgaatgtgttcaaga

SEQ ID NO: 27116 - DNA, 25 bp, Homo sapien
agttttgtgttgagtgtgttcaaga

SEQ ID NO: 27117 - DNA, 25 bp, Homo sapien
agtttttaaaacctgatggaccttt

SEQ ID NO: 27118 - DNA, 25 bp, Homo sapien
agtttttaaaacttgatggaccttt

SEQ ID NO: 27119 - DNA, 25 bp, Homo sapien
agtttttacgtcacttaaatgtgaa

SEQ ID NO: 27120 - DNA, 25 bp, Homo sapien
agtttttagcagtgtcaaaaatgga

SEQ ID NO: 27121 - DNA, 25 bp, Homo sapien
agtttttagtagtgtcaaaaatgga

SEQ ID NO: 27122 - DNA, 25 bp, Homo sapien
agtttttagtgcgacctggcactat

SEQ ID NO: 27123 - DNA, 25 bp, Homo sapien
agtttttagtgtgacctggcactat

SEQ ID NO: 27124 - DNA, 25 bp, Homo sapien
agtttttatgtcacttaaatgtgaa

SEQ ID NO: 27125 - DNA, 25 bp, Homo sapien
agtttttcttacaccatctcagtct

SEQ ID NO: 27126 - DNA, 25 bp, Homo sapien
agtttttcttataccatctcagtct

SEQ ID NO: 27127 - DNA, 25 bp, Homo sapien
agtttttgctgctgcttagagaatt

SEQ ID NO: 27128 - DNA, 25 bp, Homo sapien
agtttttgcttcagttttgtgttag

SEQ ID NO: 27129 - DNA, 25 bp, Homo sapien
agtttttgcttgagttttgtgttag

SEQ ID NO: 27130 - DNA, 25 bp, Homo sapien
agtttttggcccaaggatggaggat

SEQ ID NO: 27131 - DNA, 25 bp, Homo sapien
agtttttggcccgaggatggaggat

SEQ ID NO: 27132 - DNA, 25 bp, Homo sapien
agtttttggtgctgcttagagaatt

SEQ ID NO: 27133 - DNA, 25 bp, Homo sapien
agtttttgtgtaagataaatttcca

SEQ ID NO: 27134 - DNA, 25 bp, Homo sapien
agtttttgtgtaagttaaatttcca

SEQ ID NO: 27135 - DNA, 25 bp, Homo sapien
agttttttatcatgtgatattctgt

SEQ ID NO: 27136 - DNA, 25 bp, Homo sapien
agttttttatcgtgtgatattctgt

SEQ ID NO: 27137 - DNA, 25 bp, Homo sapien
agttttttcattttctacagctttc

SEQ ID NO: 27138 - DNA, 25 bp, Homo sapien
agttttttcgttttctacagctttc

SEQ ID NO: 27139 - DNA, 25 bp, Homo sapien
agttttttgctgtttgatttatatg

SEQ ID NO: 27140 - DNA, 25 bp, Homo sapien
agttttttgctgtttgttttatatg

SEQ ID NO: 27141 - DNA, 25 bp, Homo sapien
ataaaaaaatggtgttctccatgtg

SEQ ID NO: 27142 - DNA, 25 bp, Homo sapien
ataaaaaacagaaaggcgttgctta

SEQ ID NO: 27143 - DNA, 25 bp, Homo sapien
ataaaaaacagaaaggtgttgctta

SEQ ID NO: 27144 - DNA, 25 bp, Homo sapien
ataaaaaacagatgaacaatgtaaa

SEQ ID NO: 27145 - DNA, 25 bp, Homo sapien
ataaaaaacaggtgaacaatgtaaa

SEQ ID NO: 27146 - DNA, 25 bp, Homo sapien
ataaaaaagataatgcaggtactgt

SEQ ID NO: 27147 - DNA, 25 bp, Homo sapien
ataaaaaaggtaatgcaggtactgt

SEQ ID NO: 27148 - DNA, 25 bp, Homo sapien
ataaaaaatctaccagttagtggat

SEQ ID NO: 27149 - DNA, 25 bp, Homo sapien
ataaaaaattggtgttctccatgtg

SEQ ID NO: 27150 - DNA, 25 bp, Homo sapien
ataaaaaatttaccagttagtggat

SEQ ID NO: 27151 - DNA, 25 bp, Homo sapien
ataaaaacagtcatagaatggataa

SEQ ID NO: 27152 - DNA, 25 bp, Homo sapien
ataaaaacagtcgtagaatggataa

SEQ ID NO: 27153 - DNA, 25 bp, Homo sapien
ataaaaactcaaacgagtagtaaca

SEQ ID NO: 27154 - DNA, 25 bp, Homo sapien
ataaaaactcaagcgagtagtaaca

SEQ ID NO: 27155 - DNA, 25 bp, Homo sapien
ataaaaactccaatacagcacattt

SEQ ID NO: 27156 - DNA, 25 bp, Homo sapien
ataaaaactccgatacagcacattt

SEQ ID NO: 27157 - DNA, 25 bp, Homo sapien
ataaaaacttacagagctagcatga

SEQ ID NO: 27158 - DNA, 25 bp, Homo sapien
ataaaaacttatagagctagcatga

SEQ ID NO: 27159 - DNA, 25 bp, Homo sapien
ataaaaagaacattcataataaggc

SEQ ID NO: 27160 - DNA, 25 bp, Homo sapien
ataaaaagagcattcataataaggc

SEQ ID NO: 27161 - DNA, 25 bp, Homo sapien
ataaaaataacttacaaaaattgag

SEQ ID NO: 27162 - DNA, 25 bp, Homo sapien
ataaaaataacttacagaaattgag

SEQ ID NO: 27163 - DNA, 25 bp, Homo sapien
ataaaaataagaggtacagtctctg

SEQ ID NO: 27164 - DNA, 25 bp, Homo sapien
ataaaaataagagttacagtctctg

SEQ ID NO: 27165 - DNA, 25 bp, Homo sapien
ataaaaatacacacatgaagaaaag

SEQ ID NO: 27166 - DNA, 25 bp, Homo sapien
ataaaaatacggtcatagtccttaa

SEQ ID NO: 27167 - DNA, 25 bp, Homo sapien
ataaaaatataaaacgtgatatgta

SEQ ID NO: 27168 - DNA, 25 bp, Homo sapien
ataaaaatataaaatgtgatatgta

SEQ ID NO: 27169 - DNA, 25 bp, Homo sapien
ataaaaatatacacatgaagaaaag

SEQ ID NO: 27170 - DNA, 25 bp, Homo sapien
ataaaaatcagtcgtacttagttgg

SEQ ID NO: 27171 - DNA, 25 bp, Homo sapien
ataaaaatcagtcttacttagttgg

SEQ ID NO: 27172 - DNA, 25 bp, Homo sapien
ataaaaatgcggtcatagtccttaa

SEQ ID NO: 27173 - DNA, 25 bp, Homo sapien
ataaaaatgtcaacaatattatctc

SEQ ID NO: 27174 - DNA, 25 bp, Homo sapien
ataaaaatgtcaagaatattatctc

SEQ ID NO: 27175 - DNA, 25 bp, Homo sapien
ataaaaatgtcaagagtatgttgtg

SEQ ID NO: 27176 - DNA, 25 bp, Homo sapien
ataaaaatgtcgagagtatgttgtg

SEQ ID NO: 27177 - DNA, 25 bp, Homo sapien
ataaaaatgttcacgaattaagtga

SEQ ID NO: 27178 - DNA, 25 bp, Homo sapien
ataaaaatgttcgcgaattaagtga

SEQ ID NO: 27179 - DNA, 25 bp, Homo sapien
ataaaacaatctgatttccttacca

SEQ ID NO: 27180 - DNA, 25 bp, Homo sapien
ataaaacaatctgctttccttacca

SEQ ID NO: 27181 - DNA, 25 bp, Homo sapien
ataaaacactccaaatacccagaac

SEQ ID NO: 27182 - DNA, 25 bp, Homo sapien
ataaaacactccgaatacccagaac

SEQ ID NO: 27183 - DNA, 25 bp, Homo sapien
ataaaacagaaactgttggagagca

SEQ ID NO: 27184 - DNA, 25 bp, Homo sapien
ataaaacagaagatatggaggtgaa

SEQ ID NO: 27185 - DNA, 25 bp, Homo sapien
ataaaacagaaggtatggaggtgaa

SEQ ID NO: 27186 - DNA, 25 bp, Homo sapien
ataaaacagagggaccgaaagactc

SEQ ID NO: 27187 - DNA, 25 bp, Homo sapien
ataaaacagagggtccgaaagactc

SEQ ID NO: 27188 - DNA, 25 bp, Homo sapien
ataaaacaggaactgttggagagca

SEQ ID NO: 27189 - DNA, 25 bp, Homo sapien
ataaaacatttggaaagtgacagtt

SEQ ID NO: 27190 - DNA, 25 bp, Homo sapien
ataaaacattttgaaagtgacagtt

SEQ ID NO: 27191 - DNA, 25 bp, Homo sapien
ataaaaccaagacttgaacccagcc

SEQ ID NO: 27192 - DNA, 25 bp, Homo sapien
ataaaaccgagacttgaacccagcc

SEQ ID NO: 27193 - DNA, 25 bp, Homo sapien
ataaaacgaaagtgagatgtgaaat

SEQ ID NO: 27194 - DNA, 25 bp, Homo sapien
ataaaacgaaagtgtgatgtgaaat

SEQ ID NO: 27195 - DNA, 25 bp, Homo sapien
ataaaacgggtagcagctctaaggt

SEQ ID NO: 27196 - DNA, 25 bp, Homo sapien
ataaaacggttagcagctctaaggt

SEQ ID NO: 27197 - DNA, 25 bp, Homo sapien
ataaaactcctagatcataacatag

SEQ ID NO: 27198 - DNA, 25 bp, Homo sapien
ataaaactcttagatcataacatag

SEQ ID NO: 27199 - DNA, 25 bp, Homo sapien
ataaaactgattgcccttattcaat

SEQ ID NO: 27200 - DNA, 25 bp, Homo sapien
ataaaactgatttcccttattcaat

SEQ ID NO: 27201 - DNA, 25 bp, Homo sapien
ataaaagaagtgaaacaggataaaa

SEQ ID NO: 27202 - DNA, 25 bp, Homo sapien
ataaaagaagtgaaacgggataaaa

SEQ ID NO: 27203 - DNA, 25 bp, Homo sapien
ataaaagaataatttaaaacacctc

SEQ ID NO: 27204 - DNA, 25 bp, Homo sapien
ataaaagaatattttaaaacacctc

SEQ ID NO: 27205 - DNA, 25 bp, Homo sapien
ataaaagacatagatcacctagaac

SEQ ID NO: 27206 - DNA, 25 bp, Homo sapien
ataaaagacgcatttgtgataatta

SEQ ID NO: 27207 - DNA, 25 bp, Homo sapien
ataaaagacgtagatcacctagaac

SEQ ID NO: 27208 - DNA, 25 bp, Homo sapien
ataaaagatgcatttgtgataatta

SEQ ID NO: 27209 - DNA, 25 bp, Homo sapien
ataaaagctacctataaagttcaat

SEQ ID NO: 27210 - DNA, 25 bp, Homo sapien
ataaaagctacctctaaagttcaat

SEQ ID NO: 27211 - DNA, 25 bp, Homo sapien
ataaaaggaactgacatttactgag

SEQ ID NO: 27212 - DNA, 25 bp, Homo sapien
ataaaaggaactggcatttactgag

SEQ ID NO: 27213 - DNA, 25 bp, Homo sapien
ataaaaggtaggcatgagagccaat

SEQ ID NO: 27214 - DNA, 25 bp, Homo sapien
ataaaaggtcaaaaagctaaataca

SEQ ID NO: 27215 - DNA, 25 bp, Homo sapien
ataaaaggtcacaaagctaaataca

SEQ ID NO: 27216 - DNA, 25 bp, Homo sapien
ataaaaggtgggcatgagagccaat

SEQ ID NO: 27217 - DNA, 25 bp, Homo sapien
ataaaagtcgggtcgaaaaagataa

SEQ ID NO: 27218 - DNA, 25 bp, Homo sapien
ataaaagttaccaaaaatgttatgg

SEQ ID NO: 27219 - DNA, 25 bp, Homo sapien
ataaaagttaccacaaatgttatgg

SEQ ID NO: 27220 - DNA, 25 bp, Homo sapien
ataaaagttctgattacattgtaga

SEQ ID NO: 27221 - DNA, 25 bp, Homo sapien
ataaaagttctgattatattgtaga

SEQ ID NO: 27222 - DNA, 25 bp, Homo sapien
ataaaagttgccaaccaacaccacc

SEQ ID NO: 27223 - DNA, 25 bp, Homo sapien
ataaaagttgccatccaacaccacc

SEQ ID NO: 27224 - DNA, 25 bp, Homo sapien
ataaaagttgggtcgaaaaagataa

SEQ ID NO: 27225 - DNA, 25 bp, Homo sapien
ataaaagtttaagctgaatatgttg

SEQ ID NO: 27226 - DNA, 25 bp, Homo sapien
ataaaagtttaagctggatatgttg

SEQ ID NO: 27227 - DNA, 25 bp, Homo sapien
ataaaataatatagatggacgaagg

SEQ ID NO: 27228 - DNA, 25 bp, Homo sapien
ataaaataatatagattgacgaagg

SEQ ID NO: 27229 - DNA, 25 bp, Homo sapien
ataaaataattgttctcatagagtt

SEQ ID NO: 27230 - DNA, 25 bp, Homo sapien
ataaaataattgttgtcatagagtt

SEQ ID NO: 27231 - DNA, 25 bp, Homo sapien
ataaaatacactgcaacgatttaag

SEQ ID NO: 27232 - DNA, 25 bp, Homo sapien
ataaaatacactgcaatgatttaag

SEQ ID NO: 27233 - DNA, 25 bp, Homo sapien
ataaaatagaacgatgaatgctaaa

SEQ ID NO: 27234 - DNA, 25 bp, Homo sapien
ataaaatagaatgatgaatgctaaa

SEQ ID NO: 27235 - DNA, 25 bp, Homo sapien
ataaaatagcacaaaacgctgaaaa

SEQ ID NO: 27236 - DNA, 25 bp, Homo sapien
ataaaatagcagaaaacgctgaaaa

SEQ ID NO: 27237 - DNA, 25 bp, Homo sapien
ataaaatataatctgtgtatgaata

SEQ ID NO: 27238 - DNA, 25 bp, Homo sapien
ataaaatatacctgattacattttt

SEQ ID NO: 27239 - DNA, 25 bp, Homo sapien
ataaaatatacctgtttacattttt

SEQ ID NO: 27240 - DNA, 25 bp, Homo sapien
ataaaatatgatctgtgtatgaata

SEQ ID NO: 27241 - DNA, 25 bp, Homo sapien
ataaaatatttgaaaggaaagccag

SEQ ID NO: 27242 - DNA, 25 bp, Homo sapien
ataaaatatttgaatggaaagccag

SEQ ID NO: 27243 - DNA, 25 bp, Homo sapien
ataaaatcaaaggattcttgtcttc

SEQ ID NO: 27244 - DNA, 25 bp, Homo sapien
ataaaatcaaaggattgttgtcttc

SEQ ID NO: 27245 - DNA, 25 bp, Homo sapien
ataaaatcaatacacagtggatcag

SEQ ID NO: 27246 - DNA, 25 bp, Homo sapien
ataaaatcagtacacagtggatcag

SEQ ID NO: 27247 - DNA, 25 bp, Homo sapien
ataaaatccatgacaacacctggga

SEQ ID NO: 27248 - DNA, 25 bp, Homo sapien
ataaaatccatggcaacacctggga

SEQ ID NO: 27249 - DNA, 25 bp, Homo sapien
ataaaatctagcatcgctttatgat

SEQ ID NO: 27250 - DNA, 25 bp, Homo sapien
ataaaatctagcatggctttatgat

SEQ ID NO: 27251 - DNA, 25 bp, Homo sapien
ataaaatctccatagggaaatagac

SEQ ID NO: 27252 - DNA, 25 bp, Homo sapien
ataaaatctccgtagggaaatagac

SEQ ID NO: 27253 - DNA, 25 bp, Homo sapien
ataaaatctccttgctgaatcctcg

SEQ ID NO: 27254 - DNA, 25 bp, Homo sapien
ataaaatctccttgttgaatcctcg

SEQ ID NO: 27255 - DNA, 25 bp, Homo sapien
ataaaatgacactcgggtgattaca

SEQ ID NO: 27256 - DNA, 25 bp, Homo sapien
ataaaatgacactctggtgattaca

SEQ ID NO: 27257 - DNA, 25 bp, Homo sapien
ataaaatgacgacatattcaatgct

SEQ ID NO: 27258 - DNA, 25 bp, Homo sapien
ataaaatgatgacatattcaatgct

SEQ ID NO: 27259 - DNA, 25 bp, Homo sapien
ataaaatgcagctactgagagagat

SEQ ID NO: 27260 - DNA, 25 bp, Homo sapien
ataaaatgcagctattgagagagat

SEQ ID NO: 27261 - DNA, 25 bp, Homo sapien
ataaaatggaacattacataccctc

SEQ ID NO: 27262 - DNA, 25 bp, Homo sapien
ataaaatggaatattacataccctc

SEQ ID NO: 27263 - DNA, 25 bp, Homo sapien
ataaaatgtagtagaaacatagtca

SEQ ID NO: 27264 - DNA, 25 bp, Homo sapien
ataaaatgtagtggaaacatagtca

SEQ ID NO: 27265 - DNA, 25 bp, Homo sapien
ataaaatgttagcctatcaatattt

SEQ ID NO: 27266 - DNA, 25 bp, Homo sapien
ataaaatgttagcgtatcaatattt

SEQ ID NO: 27267 - DNA, 25 bp, Homo sapien
ataaaattgactatggtaggagaat

SEQ ID NO: 27268 - DNA, 25 bp, Homo sapien
ataaaattgactctggtaggagaat

SEQ ID NO: 27269 - DNA, 25 bp, Homo sapien
ataaaattgccatggttatctctgt

SEQ ID NO: 27270 - DNA, 25 bp, Homo sapien
ataaaattgccttggttatctctgt

SEQ ID NO: 27271 - DNA, 25 bp, Homo sapien
ataaaatttctctcctaaacgctgg

SEQ ID NO: 27272 - DNA, 25 bp, Homo sapien
ataaaatttctctcttaaacgctgg

SEQ ID NO: 27273 - DNA, 25 bp, Homo sapien
ataaacaaacagtatgtcaggtgat

SEQ ID NO: 27274 - DNA, 25 bp, Homo sapien
ataaacaaaggaagctaggatgttt

SEQ ID NO: 27275 - DNA, 25 bp, Homo sapien
ataaacaaatacaagacataggaaa

SEQ ID NO: 27276 - DNA, 25 bp, Homo sapien
ataaacaaatacgaaatcttaacaa

SEQ ID NO: 27277 - DNA, 25 bp, Homo sapien
ataaacaaatactaaatcttaacaa

SEQ ID NO: 27278 - DNA, 25 bp, Homo sapien
ataaacaaatagtatgtcaggtgat

SEQ ID NO: 27279 - DNA, 25 bp, Homo sapien
ataaacaacctcacagaataccaac

SEQ ID NO: 27280 - DNA, 25 bp, Homo sapien
ataaacaactacaagacataggaaa

SEQ ID NO: 27281 - DNA, 25 bp, Homo sapien
ataaacaaggattcctaaatctcaa

SEQ ID NO: 27282 - DNA, 25 bp, Homo sapien
ataaacaaggattcttaaatctcaa

SEQ ID NO: 27283 - DNA, 25 bp, Homo sapien
ataaacaagggaagctaggatgttt

SEQ ID NO: 27284 - DNA, 25 bp, Homo sapien
ataaacaatctcacagaataccaac

SEQ ID NO: 27285 - DNA, 25 bp, Homo sapien
ataaacactcttcatgtaatttgtg

SEQ ID NO: 27286 - DNA, 25 bp, Homo sapien
ataaacactcttcgtgtaatttgtg

SEQ ID NO: 27287 - DNA, 25 bp, Homo sapien
ataaacagcggtcagtttttgttaa

SEQ ID NO: 27288 - DNA, 25 bp, Homo sapien
ataaacaggcaagacagggagatta

SEQ ID NO: 27289 - DNA, 25 bp, Homo sapien
ataaacaggcaaggcagggagatta

SEQ ID NO: 27290 - DNA, 25 bp, Homo sapien
ataaacaggctgcgaatctgtgtct

SEQ ID NO: 27291 - DNA, 25 bp, Homo sapien
ataaacaggctgtgaatctgtgtct

SEQ ID NO: 27292 - DNA, 25 bp, Homo sapien
ataaacagtggtcagtttttgttaa

SEQ ID NO: 27293 - DNA, 25 bp, Homo sapien
ataaacataagcagcagtcaggcag

SEQ ID NO: 27294 - DNA, 25 bp, Homo sapien
ataaacatatttaggagaccctgac

SEQ ID NO: 27295 - DNA, 25 bp, Homo sapien
ataaacatcagcagcagtcaggcag

SEQ ID NO: 27296 - DNA, 25 bp, Homo sapien
ataaacatggtagattggagtaagt

SEQ ID NO: 27297 - DNA, 25 bp, Homo sapien
ataaacatggtaggttggagtaagt

SEQ ID NO: 27298 - DNA, 25 bp, Homo sapien
ataaacatgtttaggagaccctgac

SEQ ID NO: 27299 - DNA, 25 bp, Homo sapien
ataaaccaacatttgtatttccaaa

SEQ ID NO: 27300 - DNA, 25 bp, Homo sapien
ataaaccactgactgcttcccgact

SEQ ID NO: 27301 - DNA, 25 bp, Homo sapien
ataaaccacttatccgagtctgctc

SEQ ID NO: 27302 - DNA, 25 bp, Homo sapien
ataaaccacttatctgagtctgctc

SEQ ID NO: 27303 - DNA, 25 bp, Homo sapien
ataaaccagcatttgtatttccaaa

SEQ ID NO: 27304 - DNA, 25 bp, Homo sapien
ataaaccattgactgcttcccgact

SEQ ID NO: 27305 - DNA, 25 bp, Homo sapien
ataaacccaagaggaaggggcctac

SEQ ID NO: 27306 - DNA, 25 bp, Homo sapien
ataaacccaatcaaatcagaaagaa

SEQ ID NO: 27307 - DNA, 25 bp, Homo sapien
ataaacccaatccaatcagaaagaa

SEQ ID NO: 27308 - DNA, 25 bp, Homo sapien
ataaacccctggtacataataagtc

SEQ ID NO: 27309 - DNA, 25 bp, Homo sapien
ataaacccgagaggaaggggcctac

SEQ ID NO: 27310 - DNA, 25 bp, Homo sapien
ataaacccttggtacataataagtc

SEQ ID NO: 27311 - DNA, 25 bp, Homo sapien
ataaacctgtacagcatcatactgt

SEQ ID NO: 27312 - DNA, 25 bp, Homo sapien
ataaacctgtacagtatcatactgt

SEQ ID NO: 27313 - DNA, 25 bp, Homo sapien
ataaacgtagccggtaagcctgagt

SEQ ID NO: 27314 - DNA, 25 bp, Homo sapien
ataaacgtagctggtaagcctgagt

SEQ ID NO: 27315 - DNA, 25 bp, Homo sapien
ataaactaagagacgatacaatttt

SEQ ID NO: 27316 - DNA, 25 bp, Homo sapien
ataaactaagagaggatacaatttt

SEQ ID NO: 27317 - DNA, 25 bp, Homo sapien
ataaactaccaaggaccaatactgg

SEQ ID NO: 27318 - DNA, 25 bp, Homo sapien
ataaactaccagggaccaatactgg

SEQ ID NO: 27319 - DNA, 25 bp, Homo sapien
ataaactcagaaaagaatcaaagat

SEQ ID NO: 27320 - DNA, 25 bp, Homo sapien
ataaactcagaagagaatcaaagat

SEQ ID NO: 27321 - DNA, 25 bp, Homo sapien
ataaactcatcatcgcatttgcttt

SEQ ID NO: 27322 - DNA, 25 bp, Homo sapien
ataaactcatcattgcatttgcttt

SEQ ID NO: 27323 - DNA, 25 bp, Homo sapien
ataaactccacatgttgttttctcc

SEQ ID NO: 27324 - DNA, 25 bp, Homo sapien
ataaactccacgtgttgttttctcc

SEQ ID NO: 27325 - DNA, 25 bp, Homo sapien
ataaactccactatccttcagacct

SEQ ID NO: 27326 - DNA, 25 bp, Homo sapien
ataaactccactctccttcagacct

SEQ ID NO: 27327 - DNA, 25 bp, Homo sapien
ataaactggtaaccgtaagtaaatg

SEQ ID NO: 27328 - DNA, 25 bp, Homo sapien
ataaactggtaactgtaagtaaatg

SEQ ID NO: 27329 - DNA, 25 bp, Homo sapien
ataaacttaaagaaaacatacaagg

SEQ ID NO: 27330 - DNA, 25 bp, Homo sapien
ataaacttaaagaacacatacaagg

SEQ ID NO: 27331 - DNA, 25 bp, Homo sapien
ataaagaaaaagtagcacattggat

SEQ ID NO: 27332 - DNA, 25 bp, Homo sapien
ataaagaaacaacgtaaaacaagag

SEQ ID NO: 27333 - DNA, 25 bp, Homo sapien
ataaagaacaagtagcacattggat

SEQ ID NO: 27334 - DNA, 25 bp, Homo sapien
ataaagaaccaacgtaaaacaagag

SEQ ID NO: 27335 - DNA, 25 bp, Homo sapien
ataaagaacgaacatctgcatctgt

SEQ ID NO: 27336 - DNA, 25 bp, Homo sapien
ataaagaacttaccaacttaactga

SEQ ID NO: 27337 - DNA, 25 bp, Homo sapien
ataaagaacttatcaacttaactga

SEQ ID NO: 27338 - DNA, 25 bp, Homo sapien
ataaagaagataatagagaagctcc

SEQ ID NO: 27339 - DNA, 25 bp, Homo sapien
ataaagaaggtaatagagaagctcc

SEQ ID NO: 27340 - DNA, 25 bp, Homo sapien
ataaagaatctccgtgacattggct

SEQ ID NO: 27341 - DNA, 25 bp, Homo sapien
ataaagaatctctgtgacattggct

SEQ ID NO: 27342 - DNA, 25 bp, Homo sapien
ataaagaatgaacatctgcatctgt

SEQ ID NO: 27343 - DNA, 25 bp, Homo sapien
ataaagaattacacaaacaaactga

SEQ ID NO: 27344 - DNA, 25 bp, Homo sapien
ataaagaattacgcaaacaaactga

SEQ ID NO: 27345 - DNA, 25 bp, Homo sapien
ataaagactaaataagtagtgtctg

SEQ ID NO: 27346 - DNA, 25 bp, Homo sapien
ataaagactaagtaagtagtgtctg

SEQ ID NO: 27347 - DNA, 25 bp, Homo sapien
ataaagagctgatttctgaaacata

SEQ ID NO: 27348 - DNA, 25 bp, Homo sapien
ataaagagctgctttctgaaacata

SEQ ID NO: 27349 - DNA, 25 bp, Homo sapien
ataaagagttatgatctctcaagtc

SEQ ID NO: 27350 - DNA, 25 bp, Homo sapien
ataaagagttatgttctctcaagtc

SEQ ID NO: 27351 - DNA, 25 bp, Homo sapien
ataaagatcagtaacgtaggataaa

SEQ ID NO: 27352 - DNA, 25 bp, Homo sapien
ataaagatcagtaatgtaggataaa

SEQ ID NO: 27353 - DNA, 25 bp, Homo sapien
ataaagatggtgctaccttcaatgg

SEQ ID NO: 27354 - DNA, 25 bp, Homo sapien
ataaagattgtgctaccttcaatgg

SEQ ID NO: 27355 - DNA, 25 bp, Homo sapien
ataaagattttcagccttctggaag

SEQ ID NO: 27356 - DNA, 25 bp, Homo sapien
ataaagattttgagccttctggaag

SEQ ID NO: 27357 - DNA, 25 bp, Homo sapien
ataaagcactaacaataggccaggc

SEQ ID NO: 27358 - DNA, 25 bp, Homo sapien
ataaagcactaacgataggccaggc

SEQ ID NO: 27359 - DNA, 25 bp, Homo sapien
ataaagcatagcgaaggatggggaa

SEQ ID NO: 27360 - DNA, 25 bp, Homo sapien
ataaagcatagtgaaggatggggaa

SEQ ID NO: 27361 - DNA, 25 bp, Homo sapien
ataaagcatgcactgtaataccagt

SEQ ID NO: 27362 - DNA, 25 bp, Homo sapien
ataaagcatgcactttaataccagt

SEQ ID NO: 27363 - DNA, 25 bp, Homo sapien
ataaagccaagacaatattaggatt

SEQ ID NO: 27364 - DNA, 25 bp, Homo sapien
ataaagccaaggcaatattaggatt

SEQ ID NO: 27365 - DNA, 25 bp, Homo sapien
ataaagctatgcactgtgtttgtca

SEQ ID NO: 27366 - DNA, 25 bp, Homo sapien
ataaagctatgtactgtgtttgtca

SEQ ID NO: 27367 - DNA, 25 bp, Homo sapien
ataaaggaacagggaaataatgagt

SEQ ID NO: 27368 - DNA, 25 bp, Homo sapien
ataaaggaacagggaattaatgagt

SEQ ID NO: 27369 - DNA, 25 bp, Homo sapien
ataaaggacaagttaggcatagagg

SEQ ID NO: 27370 - DNA, 25 bp, Homo sapien
ataaaggataagttaggcatagagg

SEQ ID NO: 27371 - DNA, 25 bp, Homo sapien
ataaaggcattctcaggtagcagca

SEQ ID NO: 27372 - DNA, 25 bp, Homo sapien
ataaaggcattctcgggtagcagca

SEQ ID NO: 27373 - DNA, 25 bp, Homo sapien
ataaaggccttcgatgcgttgagga

SEQ ID NO: 27374 - DNA, 25 bp, Homo sapien
ataaaggccttcgctgcgttgagga

SEQ ID NO: 27375 - DNA, 25 bp, Homo sapien
ataaagggttaaagcagatagagat

SEQ ID NO: 27376 - DNA, 25 bp, Homo sapien
ataaagggttagagcagatagagat

SEQ ID NO: 27377 - DNA, 25 bp, Homo sapien
ataaaggtactgagcataagcatgg

SEQ ID NO: 27378 - DNA, 25 bp, Homo sapien
ataaaggttctgagcataagcatgg

SEQ ID NO: 27379 - DNA, 25 bp, Homo sapien
ataaagtagataaatgttcctaaat

SEQ ID NO: 27380 - DNA, 25 bp, Homo sapien
ataaagtaggtaaatgttcctaaat

SEQ ID NO: 27381 - DNA, 25 bp, Homo sapien
ataaagtcacacactcttggattga

SEQ ID NO: 27382 - DNA, 25 bp, Homo sapien
ataaagtcagacactcttggattga

SEQ ID NO: 27383 - DNA, 25 bp, Homo sapien
ataaagtgcatcagtataaaacaaa

SEQ ID NO: 27384 - DNA, 25 bp, Homo sapien
ataaagtgcatcattataaaacaaa

SEQ ID NO: 27385 - DNA, 25 bp, Homo sapien
ataaagtgtctatcaagtgcatgag

SEQ ID NO: 27386 - DNA, 25 bp, Homo sapien
ataaagtgtctctcaagtgcatgag

SEQ ID NO: 27387 - DNA, 25 bp, Homo sapien
ataaagttactaagaagaggcaaat

SEQ ID NO: 27388 - DNA, 25 bp, Homo sapien
ataaagttactcagaagaggcaaat

SEQ ID NO: 27389 - DNA, 25 bp, Homo sapien
ataaagttccttcttctcccttctg

SEQ ID NO: 27390 - DNA, 25 bp, Homo sapien
ataaagtttcttcttctcccttctg

SEQ ID NO: 27391 - DNA, 25 bp, Homo sapien
ataaataccaagaaacacaattgct

SEQ ID NO: 27392 - DNA, 25 bp, Homo sapien
ataaataccaaggaacacaattgct

SEQ ID NO: 27393 - DNA, 25 bp, Homo sapien
ataaatacccagcataaggcattgt

SEQ ID NO: 27394 - DNA, 25 bp, Homo sapien
ataaataccgagcataaggcattgt

SEQ ID NO: 27395 - DNA, 25 bp, Homo sapien
ataaataccttatatcattctccag

SEQ ID NO: 27396 - DNA, 25 bp, Homo sapien
ataaataccttgtatcattctccag

SEQ ID NO: 27397 - DNA, 25 bp, Homo sapien
ataaatatactgacttctctaatgt

SEQ ID NO: 27398 - DNA, 25 bp, Homo sapien
ataaatatattgacttctctaatgt

SEQ ID NO: 27399 - DNA, 25 bp, Homo sapien
ataaatatttatcaatgtgcaaaac

SEQ ID NO: 27400 - DNA, 25 bp, Homo sapien
ataaatatttatcgatgtgcaaaac

SEQ ID NO: 27401 - DNA, 25 bp, Homo sapien
ataaatcaaatccattgaaggccaa

SEQ ID NO: 27402 - DNA, 25 bp, Homo sapien
ataaatcaaatccatttaaggccaa

SEQ ID NO: 27403 - DNA, 25 bp, Homo sapien
ataaatcaccaatgaatacaaagat

SEQ ID NO: 27404 - DNA, 25 bp, Homo sapien
ataaatcaccagtgaatacaaagat

SEQ ID NO: 27405 - DNA, 25 bp, Homo sapien
ataaatcagttcagatctaatattt

SEQ ID NO: 27406 - DNA, 25 bp, Homo sapien
ataaatcagtttagatctaatattt

SEQ ID NO: 27407 - DNA, 25 bp, Homo sapien
ataaatcataccctatagttaaaaa

SEQ ID NO: 27408 - DNA, 25 bp, Homo sapien
ataaatcataccctatggttaaaaa

SEQ ID NO: 27409 - DNA, 25 bp, Homo sapien
ataaatcatagcatcacattgtact

SEQ ID NO: 27410 - DNA, 25 bp, Homo sapien
ataaatcattgcatcacattgtact

SEQ ID NO: 27411 - DNA, 25 bp, Homo sapien
ataaatcccactaggttctgatgaa

SEQ ID NO: 27412 - DNA, 25 bp, Homo sapien
ataaatcccacttggttctgatgaa

SEQ ID NO: 27413 - DNA, 25 bp, Homo sapien
ataaatcctagaaataaaggaagca

SEQ ID NO: 27414 - DNA, 25 bp, Homo sapien
ataaatcctagatataaaggaagca

SEQ ID NO: 27415 - DNA, 25 bp, Homo sapien
ataaatcctggactctaaaaaaacg

SEQ ID NO: 27416 - DNA, 25 bp, Homo sapien
ataaatcctggactctgaaaaaacg

SEQ ID NO: 27417 - DNA, 25 bp, Homo sapien
ataaatcgaaccctgtgttctgttc

SEQ ID NO: 27418 - DNA, 25 bp, Homo sapien
ataaatcgaaccttgtgttctgttc

SEQ ID NO: 27419 - DNA, 25 bp, Homo sapien
ataaatcttgacgaaaactttctaa

SEQ ID NO: 27420 - DNA, 25 bp, Homo sapien
ataaatcttgatgaaaactttctaa

SEQ ID NO: 27421 - DNA, 25 bp, Homo sapien
ataaatgatcaataacagtgtcaat

SEQ ID NO: 27422 - DNA, 25 bp, Homo sapien
ataaatgatccctaaggagaacaga

SEQ ID NO: 27423 - DNA, 25 bp, Homo sapien
ataaatgatctgcgagcgtctaact

SEQ ID NO: 27424 - DNA, 25 bp, Homo sapien
ataaatgatctgcgagtgtctaact

SEQ ID NO: 27425 - DNA, 25 bp, Homo sapien
ataaatgattaataacagtgtcaat

SEQ ID NO: 27426 - DNA, 25 bp, Homo sapien
ataaatgattcctaaggagaacaga

SEQ ID NO: 27427 - DNA, 25 bp, Homo sapien
ataaatgcagccagagagaatagcc

SEQ ID NO: 27428 - DNA, 25 bp, Homo sapien
ataaatgcagcccgagagaatagcc

SEQ ID NO: 27429 - DNA, 25 bp, Homo sapien
ataaatggaaagatatatatgcatc

SEQ ID NO: 27430 - DNA, 25 bp, Homo sapien
ataaatggaaagatatgtatgcatc

SEQ ID NO: 27431 - DNA, 25 bp, Homo sapien
ataaatggacgcatgcagttgaaac

SEQ ID NO: 27432 - DNA, 25 bp, Homo sapien
ataaatggatgcatgcagttgaaac

SEQ ID NO: 27433 - DNA, 25 bp, Homo sapien
ataaatggtatgggtcctagcactg

SEQ ID NO: 27434 - DNA, 25 bp, Homo sapien
ataaatggtatgggtcttagcactg

SEQ ID NO: 27435 - DNA, 25 bp, Homo sapien
ataaatggtgtcacctgctctcaag

SEQ ID NO: 27436 - DNA, 25 bp, Homo sapien
ataaatggtgtcacttgctctcaag

SEQ ID NO: 27437 - DNA, 25 bp, Homo sapien
ataaatgtcagttactatcattaac

SEQ ID NO: 27438 - DNA, 25 bp, Homo sapien
ataaatgtcagttattatcattaac

SEQ ID NO: 27439 - DNA, 25 bp, Homo sapien
ataaatgtgacactcaagttttagc

SEQ ID NO: 27440 - DNA, 25 bp, Homo sapien
ataaatgtgacactcaggttttagc

SEQ ID NO: 27441 - DNA, 25 bp, Homo sapien
ataaatgtgcaaagaagtaactgcg

SEQ ID NO: 27442 - DNA, 25 bp, Homo sapien
ataaatgtgcaaaggagtaactgcg

SEQ ID NO: 27443 - DNA, 25 bp, Homo sapien
ataaatgtgctacttggaatttgct

SEQ ID NO: 27444 - DNA, 25 bp, Homo sapien
ataaatgtgttacttggaatttgct

SEQ ID NO: 27445 - DNA, 25 bp, Homo sapien
ataaatgttgaatccagaagtagca

SEQ ID NO: 27446 - DNA, 25 bp, Homo sapien
ataaatgttgaattcagaagtagca

SEQ ID NO: 27447 - DNA, 25 bp, Homo sapien
ataaattaaaagaatacacagctat

SEQ ID NO: 27448 - DNA, 25 bp, Homo sapien
ataaattaaaagaatatacagctat

SEQ ID NO: 27449 - DNA, 25 bp, Homo sapien
ataaattaataaacccctggtacat

SEQ ID NO: 27450 - DNA, 25 bp, Homo sapien
ataaattaataaacccttggtacat

SEQ ID NO: 27451 - DNA, 25 bp, Homo sapien
ataaattattgatgagtaaagagaa

SEQ ID NO: 27452 - DNA, 25 bp, Homo sapien
ataaattattggtgagtaaagagaa

SEQ ID NO: 27453 - DNA, 25 bp, Homo sapien
ataaattcaaaactgtgcaaaatct

SEQ ID NO: 27454 - DNA, 25 bp, Homo sapien
ataaattcaaaagtgtgcaaaatct

SEQ ID NO: 27455 - DNA, 25 bp, Homo sapien
ataaattcctgcataacaagtacca

SEQ ID NO: 27456 - DNA, 25 bp, Homo sapien
ataaattcctgcgtaacaagtacca

SEQ ID NO: 27457 - DNA, 25 bp, Homo sapien
ataaattctcaactccataaaagta

SEQ ID NO: 27458 - DNA, 25 bp, Homo sapien
ataaattctcaactccgtaaaagta

SEQ ID NO: 27459 - DNA, 25 bp, Homo sapien
ataaattgctattcctcttcaaaat

SEQ ID NO: 27460 - DNA, 25 bp, Homo sapien
ataaattgttattcctcttcaaaat

SEQ ID NO: 27461 - DNA, 25 bp, Homo sapien
ataaatttcctatcatttacaccta

SEQ ID NO: 27462 - DNA, 25 bp, Homo sapien
ataaatttcttatcatttacaccta

SEQ ID NO: 27463 - DNA, 25 bp, Homo sapien
ataaatttgcttcgcgtttggagag

SEQ ID NO: 27464 - DNA, 25 bp, Homo sapien
ataaatttgctttgcgtttggagag

SEQ ID NO: 27465 - DNA, 25 bp, Homo sapien
ataaatttggccatcactcgggaaa

SEQ ID NO: 27466 - DNA, 25 bp, Homo sapien
ataaatttggccatcattcgggaaa

SEQ ID NO: 27467 - DNA, 25 bp, Homo sapien
ataaatttgttcagtcgtctaataa

SEQ ID NO: 27468 - DNA, 25 bp, Homo sapien
ataaatttgttcagtcttctaataa

SEQ ID NO: 27469 - DNA, 25 bp, Homo sapien
ataacaaaacaaatgtaggattaga

SEQ ID NO: 27470 - DNA, 25 bp, Homo sapien
ataacaaaacacacatgactttagg

SEQ ID NO: 27471 - DNA, 25 bp, Homo sapien
ataacaaaataaatgtaggattaga

SEQ ID NO: 27472 - DNA, 25 bp, Homo sapien
ataacaaaatacacatgactttagg

SEQ ID NO: 27473 - DNA, 25 bp, Homo sapien
ataacaagacattgcatttgatcct

SEQ ID NO: 27474 - DNA, 25 bp, Homo sapien
ataacaagagttaagtgtctctgac

SEQ ID NO: 27475 - DNA, 25 bp, Homo sapien
ataacaagagttatgtgtctctgac

SEQ ID NO: 27476 - DNA, 25 bp, Homo sapien
ataacaagccattgcatttgatcct

SEQ ID NO: 27477 - DNA, 25 bp, Homo sapien
ataacaataccctttcagaggagac

SEQ ID NO: 27478 - DNA, 25 bp, Homo sapien
ataacaataccctttcggaggagac

SEQ ID NO: 27479 - DNA, 25 bp, Homo sapien
ataacaatacctaacagcttatctg

SEQ ID NO: 27480 - DNA, 25 bp, Homo sapien
ataacaatacctaatagcttatctg

SEQ ID NO: 27481 - DNA, 25 bp, Homo sapien
ataacaatgcagaaacgacacaaag

SEQ ID NO: 27482 - DNA, 25 bp, Homo sapien
ataacaatgcagaaactacacaaag

SEQ ID NO: 27483 - DNA, 25 bp, Homo sapien
ataacacaaagcaagatgtgataag

SEQ ID NO: 27484 - DNA, 25 bp, Homo sapien
ataacacaaagcaggatgtgataag

SEQ ID NO: 27485 - DNA, 25 bp, Homo sapien
ataacacaaatagacctcaggagga

SEQ ID NO: 27486 - DNA, 25 bp, Homo sapien
ataacacaaatagccctcaggagga

SEQ ID NO: 27487 - DNA, 25 bp, Homo sapien
ataacacaactgtagggtctgaaga

SEQ ID NO: 27488 - DNA, 25 bp, Homo sapien
ataacacaactgtggggtctgaaga

SEQ ID NO: 27489 - DNA, 25 bp, Homo sapien
ataacacaggtcattaaaggtctgc

SEQ ID NO: 27490 - DNA, 25 bp, Homo sapien
ataacacaggtcgttaaaggtctgc

SEQ ID NO: 27491 - DNA, 25 bp, Homo sapien
ataacacctcctctttgtaatgctt

SEQ ID NO: 27492 - DNA, 25 bp, Homo sapien
ataacacctcctttttgtaatgctt

SEQ ID NO: 27493 - DNA, 25 bp, Homo sapien
ataacaccttgacaccaggatgtgg

SEQ ID NO: 27494 - DNA, 25 bp, Homo sapien
ataacaccttgtcaccaggatgtgg

SEQ ID NO: 27495 - DNA, 25 bp, Homo sapien
ataacacgacagaagacaagtatga

SEQ ID NO: 27496 - DNA, 25 bp, Homo sapien
ataacacgacagaggacaagtatga

SEQ ID NO: 27497 - DNA, 25 bp, Homo sapien
ataacactactgctattcacttttt

SEQ ID NO: 27498 - DNA, 25 bp, Homo sapien
ataacactacttctattcacttttt

SEQ ID NO: 27499 - DNA, 25 bp, Homo sapien
ataacactcttgtgcagtaagcgtt

SEQ ID NO: 27500 - DNA, 25 bp, Homo sapien
ataacactcttgttcagtaagcgtt

SEQ ID NO: 27501 - DNA, 25 bp, Homo sapien
ataacacttaccatttatcattttt

SEQ ID NO: 27502 - DNA, 25 bp, Homo sapien
ataacacttaccgtttatcattttt

SEQ ID NO: 27503 - DNA, 25 bp, Homo sapien
ataacagaaaagctcttgtgaggga

SEQ ID NO: 27504 - DNA, 25 bp, Homo sapien
ataacagaaaatctcttgtgaggga

SEQ ID NO: 27505 - DNA, 25 bp, Homo sapien
ataacagcaacggcggctgctacta

SEQ ID NO: 27506 - DNA, 25 bp, Homo sapien
ataacagcaactgcggctgctacta

SEQ ID NO: 27507 - DNA, 25 bp, Homo sapien
ataacagcagagaagatatttttgt

SEQ ID NO: 27508 - DNA, 25 bp, Homo sapien
ataacagcagaggagatatttttgt

SEQ ID NO: 27509 - DNA, 25 bp, Homo sapien
ataacaggtcggatgacatgggata

SEQ ID NO: 27510 - DNA, 25 bp, Homo sapien
ataacaggttggatgacatgggata

SEQ ID NO: 27511 - DNA, 25 bp, Homo sapien
ataacagttgtaaggaatatacatt

SEQ ID NO: 27512 - DNA, 25 bp, Homo sapien
ataacagttgtaaggagtatacatt

SEQ ID NO: 27513 - DNA, 25 bp, Homo sapien
ataacataatcaatttagatgcaga

SEQ ID NO: 27514 - DNA, 25 bp, Homo sapien
ataacataatcagtttagatgcaga

SEQ ID NO: 27515 - DNA, 25 bp, Homo sapien
ataacatatttgaagaagaagccct

SEQ ID NO: 27516 - DNA, 25 bp, Homo sapien
ataacatatttgaggaagaagccct

SEQ ID NO: 27517 - DNA, 25 bp, Homo sapien
ataacatcaaacactaggagaatca

SEQ ID NO: 27518 - DNA, 25 bp, Homo sapien
ataacatcaaacgctaggagaatca

SEQ ID NO: 27519 - DNA, 25 bp, Homo sapien
ataacatcaattgactttccactgt

SEQ ID NO: 27520 - DNA, 25 bp, Homo sapien
ataacatcacagagaattttaaaac

SEQ ID NO: 27521 - DNA, 25 bp, Homo sapien
ataacatcacagataattttaaaac

SEQ ID NO: 27522 - DNA, 25 bp, Homo sapien
ataacatcagatactgggaaggcac

SEQ ID NO: 27523 - DNA, 25 bp, Homo sapien
ataacatcagatactgtgaaggcac

SEQ ID NO: 27524 - DNA, 25 bp, Homo sapien
ataacatcagttgactttccactgt

SEQ ID NO: 27525 - DNA, 25 bp, Homo sapien
ataacatccaacagtgtgaaaatac

SEQ ID NO: 27526 - DNA, 25 bp, Homo sapien
ataacatccaactgtgtgaaaatac

SEQ ID NO: 27527 - DNA, 25 bp, Homo sapien
ataacatgacaccagttttcagatg

SEQ ID NO: 27528 - DNA, 25 bp, Homo sapien
ataacatgacactagttttcagatg

SEQ ID NO: 27529 - DNA, 25 bp, Homo sapien
ataaccaaataaaatttgaggattg

SEQ ID NO: 27530 - DNA, 25 bp, Homo sapien
ataaccaaatacaatttgaggattg

SEQ ID NO: 27531 - DNA, 25 bp, Homo sapien
ataaccaaatacatctccagacact

SEQ ID NO: 27532 - DNA, 25 bp, Homo sapien
ataaccaaatacgtctccagacact

SEQ ID NO: 27533 - DNA, 25 bp, Homo sapien
ataaccacaaacagaagtcccagaa

SEQ ID NO: 27534 - DNA, 25 bp, Homo sapien
ataaccacaaagagaagtcccagaa

SEQ ID NO: 27535 - DNA, 25 bp, Homo sapien
ataaccaccatcatgcaaacatgca

SEQ ID NO: 27536 - DNA, 25 bp, Homo sapien
ataaccaccatcgtgcaaacatgca

SEQ ID NO: 27537 - DNA, 25 bp, Homo sapien
ataaccagtttataaaaggaggatg

SEQ ID NO: 27538 - DNA, 25 bp, Homo sapien
ataaccagtttctaaaaggaggatg

SEQ ID NO: 27539 - DNA, 25 bp, Homo sapien
ataacccgcttgaatctgcactacc

SEQ ID NO: 27540 - DNA, 25 bp, Homo sapien
ataacccgcttgtatctgcactacc

SEQ ID NO: 27541 - DNA, 25 bp, Homo sapien
ataacctaaaaatacttctcccatg

SEQ ID NO: 27542 - DNA, 25 bp, Homo sapien
ataacctaaaaatgcttctcccatg

SEQ ID NO: 27543 - DNA, 25 bp, Homo sapien
ataacgcaactacaaaccaaggaat

SEQ ID NO: 27544 - DNA, 25 bp, Homo sapien
ataacgcatctacaaaccaaggaat

SEQ ID NO: 27545 - DNA, 25 bp, Homo sapien
ataacgtggtgtatctgttcttact

SEQ ID NO: 27546 - DNA, 25 bp, Homo sapien
ataacgtggtgtgtctgttcttact

SEQ ID NO: 27547 - DNA, 25 bp, Homo sapien
ataactaaattcagagaagagctga

SEQ ID NO: 27548 - DNA, 25 bp, Homo sapien
ataactaaatttagagaagagctga

SEQ ID NO: 27549 - DNA, 25 bp, Homo sapien
ataactaatcccattctagctacat

SEQ ID NO: 27550 - DNA, 25 bp, Homo sapien
ataactaatccctttctagctacat

SEQ ID NO: 27551 - DNA, 25 bp, Homo sapien
ataactacaatacacggacacatcc

SEQ ID NO: 27552 - DNA, 25 bp, Homo sapien
ataactaccatacacggacacatcc

SEQ ID NO: 27553 - DNA, 25 bp, Homo sapien
ataactcaaatctttgatcttcacc

SEQ ID NO: 27554 - DNA, 25 bp, Homo sapien
ataactcaagtctttgatcttcacc

SEQ ID NO: 27555 - DNA, 25 bp, Homo sapien
ataactcatatattctttggtctgc

SEQ ID NO: 27556 - DNA, 25 bp, Homo sapien
ataactcatatattttttggtctgc

SEQ ID NO: 27557 - DNA, 25 bp, Homo sapien
ataactcatgaacaattttaagaat

SEQ ID NO: 27558 - DNA, 25 bp, Homo sapien
ataactcatgaacacttttaagaat

SEQ ID NO: 27559 - DNA, 25 bp, Homo sapien
ataactccagagcgtagcatcaaag

SEQ ID NO: 27560 - DNA, 25 bp, Homo sapien
ataactccagagtgtagcatcaaag

SEQ ID NO: 27561 - DNA, 25 bp, Homo sapien
ataactctgcaattaagtggagcat

SEQ ID NO: 27562 - DNA, 25 bp, Homo sapien
ataactctgtaattaagtggagcat

SEQ ID NO: 27563 - DNA, 25 bp, Homo sapien
ataactgagaaccacaaactgagtg

SEQ ID NO: 27564 - DNA, 25 bp, Homo sapien
ataactgagaaccataaactgagtg

SEQ ID NO: 27565 - DNA, 25 bp, Homo sapien
ataactgcaagtattctgagtttga

SEQ ID NO: 27566 - DNA, 25 bp, Homo sapien
ataactgcacgtattctgagtttga

SEQ ID NO: 27567 - DNA, 25 bp, Homo sapien
ataactgcattcgagtcaacacatt

SEQ ID NO: 27568 - DNA, 25 bp, Homo sapien
ataactgcattcgattcaacacatt

SEQ ID NO: 27569 - DNA, 25 bp, Homo sapien
ataactggagcccaatagcttcatt

SEQ ID NO: 27570 - DNA, 25 bp, Homo sapien
ataactggagcctaatagcttcatt

SEQ ID NO: 27571 - DNA, 25 bp, Homo sapien
ataactggcactatttctgagaaat

SEQ ID NO: 27572 - DNA, 25 bp, Homo sapien
ataactggcactgtttctgagaaat

SEQ ID NO: 27573 - DNA, 25 bp, Homo sapien
ataactgggatcgtgcatcacgtca

SEQ ID NO: 27574 - DNA, 25 bp, Homo sapien
ataactgggattgtgcatcacgtca

SEQ ID NO: 27575 - DNA, 25 bp, Homo sapien
ataactggtcaacatatccatcact

SEQ ID NO: 27576 - DNA, 25 bp, Homo sapien
ataactggtcaacgtatccatcact

SEQ ID NO: 27577 - DNA, 25 bp, Homo sapien
ataacttacgaattatatattgcaa

SEQ ID NO: 27578 - DNA, 25 bp, Homo sapien
ataacttacgaattgtatattgcaa

SEQ ID NO: 27579 - DNA, 25 bp, Homo sapien
ataacttagctctgtcctgcctagg

SEQ ID NO: 27580 - DNA, 25 bp, Homo sapien
ataacttagctctgtcttgcctagg

SEQ ID NO: 27581 - DNA, 25 bp, Homo sapien
ataacttagtcatatttctcttgca

SEQ ID NO: 27582 - DNA, 25 bp, Homo sapien
ataacttagtcgtatttctcttgca

SEQ ID NO: 27583 - DNA, 25 bp, Homo sapien
ataacttccagggcttgcatttttt

SEQ ID NO: 27584 - DNA, 25 bp, Homo sapien
ataacttccagggtttgcatttttt

SEQ ID NO: 27585 - DNA, 25 bp, Homo sapien
ataacttcgcctcaaaattcagtag

SEQ ID NO: 27586 - DNA, 25 bp, Homo sapien
ataacttctatatctaaaaatgctg

SEQ ID NO: 27587 - DNA, 25 bp, Homo sapien
ataacttctcctcaaaattcagtag

SEQ ID NO: 27588 - DNA, 25 bp, Homo sapien
ataacttctgtatctaaaaatgctg

SEQ ID NO: 27589 - DNA, 25 bp, Homo sapien
ataacttggcacctatttatatatt

SEQ ID NO: 27590 - DNA, 25 bp, Homo sapien
ataacttggcacgtatttatatatt

SEQ ID NO: 27591 - DNA, 25 bp, Homo sapien
ataactttggaaagaactgagccag

SEQ ID NO: 27592 - DNA, 25 bp, Homo sapien
ataactttggaaagaattgagccag

SEQ ID NO: 27593 - DNA, 25 bp, Homo sapien
ataactttgtgcacttaacccatct

SEQ ID NO: 27594 - DNA, 25 bp, Homo sapien
ataactttgtgcacttgacccatct

SEQ ID NO: 27595 - DNA, 25 bp, Homo sapien
ataactttttaaaaaatcaagcaga

SEQ ID NO: 27596 - DNA, 25 bp, Homo sapien
ataactttttaaaatatcaagcaga

SEQ ID NO: 27597 - DNA, 25 bp, Homo sapien
ataagaaaccacagatggaaaagta

SEQ ID NO: 27598 - DNA, 25 bp, Homo sapien
ataagaaacgacagatggaaaagta

SEQ ID NO: 27599 - DNA, 25 bp, Homo sapien
ataagaaagaactttgagatggtga

SEQ ID NO: 27600 - DNA, 25 bp, Homo sapien
ataagaaagaccatatgcaagctaa

SEQ ID NO: 27601 - DNA, 25 bp, Homo sapien
ataagaaagaccgtatgcaagctaa

SEQ ID NO: 27602 - DNA, 25 bp, Homo sapien
ataagaaagcccgggtgtttccttc

SEQ ID NO: 27603 - DNA, 25 bp, Homo sapien
ataagaaagcctgggtgtttccttc

SEQ ID NO: 27604 - DNA, 25 bp, Homo sapien
ataagaaaggactttgagatggtga

SEQ ID NO: 27605 - DNA, 25 bp, Homo sapien
ataagaaagtgagggcaagaacaga

SEQ ID NO: 27606 - DNA, 25 bp, Homo sapien
ataagaaagtgagggcgagaacaga

SEQ ID NO: 27607 - DNA, 25 bp, Homo sapien
ataagaaatgatcgactagagtact

SEQ ID NO: 27608 - DNA, 25 bp, Homo sapien
ataagaaatgattgactagagtact

SEQ ID NO: 27609 - DNA, 25 bp, Homo sapien
ataagaaatgcatactgattgcctg

SEQ ID NO: 27610 - DNA, 25 bp, Homo sapien
ataagaaatgcttactgattgcctg

SEQ ID NO: 27611 - DNA, 25 bp, Homo sapien
ataagaacctaaccgtagaagatca

SEQ ID NO: 27612 - DNA, 25 bp, Homo sapien
ataagaacctaatcgtagaagatca

SEQ ID NO: 27613 - DNA, 25 bp, Homo sapien
ataagaacctagatgcaaaagtgtc

SEQ ID NO: 27614 - DNA, 25 bp, Homo sapien
ataagaacctagatgcgaaagtgtc

SEQ ID NO: 27615 - DNA, 25 bp, Homo sapien
ataagaacctcaaaaatatatctgt

SEQ ID NO: 27616 - DNA, 25 bp, Homo sapien
ataagaacctcagaaatatatctgt

SEQ ID NO: 27617 - DNA, 25 bp, Homo sapien
ataagaagagaaaatccatagacac

SEQ ID NO: 27618 - DNA, 25 bp, Homo sapien
ataagaagagaagatccatagacac

SEQ ID NO: 27619 - DNA, 25 bp, Homo sapien
ataagaagtctcccatcaaagaaaa

SEQ ID NO: 27620 - DNA, 25 bp, Homo sapien
ataagaagtctcccgtcaaagaaaa

SEQ ID NO: 27621 - DNA, 25 bp, Homo sapien
ataagaatgccaattaaatgcacac

SEQ ID NO: 27622 - DNA, 25 bp, Homo sapien
ataagaatgccgattaaatgcacac

SEQ ID NO: 27623 - DNA, 25 bp, Homo sapien
ataagacaatgtcaccatagtgacc

SEQ ID NO: 27624 - DNA, 25 bp, Homo sapien
ataagacactcaccgtaaagatcag

SEQ ID NO: 27625 - DNA, 25 bp, Homo sapien
ataagacactcatcgtaaagatcag

SEQ ID NO: 27626 - DNA, 25 bp, Homo sapien
ataagacagtgtcaccatagtgacc

SEQ ID NO: 27627 - DNA, 25 bp, Homo sapien
ataagacagttagtcatcaagatcc

SEQ ID NO: 27628 - DNA, 25 bp, Homo sapien
ataagacagttattcatcaagatcc

SEQ ID NO: 27629 - DNA, 25 bp, Homo sapien
ataagactctctctacgtaatttta

SEQ ID NO: 27630 - DNA, 25 bp, Homo sapien
ataagactctctttacgtaatttta

SEQ ID NO: 27631 - DNA, 25 bp, Homo sapien
ataagacttagcgtggcaacaaagg

SEQ ID NO: 27632 - DNA, 25 bp, Homo sapien
ataagacttagtgtggcaacaaagg

SEQ ID NO: 27633 - DNA, 25 bp, Homo sapien
ataagagaaactataaaagcagtgt

SEQ ID NO: 27634 - DNA, 25 bp, Homo sapien
ataagagaaactctaaaagcagtgt

SEQ ID NO: 27635 - DNA, 25 bp, Homo sapien
ataagagcacagtatttcgtagccc

SEQ ID NO: 27636 - DNA, 25 bp, Homo sapien
ataagagcatagtatttcgtagccc

SEQ ID NO: 27637 - DNA, 25 bp, Homo sapien
ataagagccaataatgtagttccag

SEQ ID NO: 27638 - DNA, 25 bp, Homo sapien
ataagagcgaataatgtagttccag

SEQ ID NO: 27639 - DNA, 25 bp, Homo sapien
ataagagtcacaaccactattcttc

SEQ ID NO: 27640 - DNA, 25 bp, Homo sapien
ataagagtctcagtctggatattgg

SEQ ID NO: 27641 - DNA, 25 bp, Homo sapien
ataagagtgacaaccactattcttc

SEQ ID NO: 27642 - DNA, 25 bp, Homo sapien
ataagagtgttccttctcaaatcat

SEQ ID NO: 27643 - DNA, 25 bp, Homo sapien
ataagagtgtttcttctcaaatcat

SEQ ID NO: 27644 - DNA, 25 bp, Homo sapien
ataagagtttcagtctggatattgg

SEQ ID NO: 27645 - DNA, 25 bp, Homo sapien
ataagatatgaacagcaaatgtttg

SEQ ID NO: 27646 - DNA, 25 bp, Homo sapien
ataagatatgaatagcaaatgtttg

SEQ ID NO: 27647 - DNA, 25 bp, Homo sapien
ataagatcaataccaatgtatctca

SEQ ID NO: 27648 - DNA, 25 bp, Homo sapien
ataagatcaatatcaatgtatctca

SEQ ID NO: 27649 - DNA, 25 bp, Homo sapien
ataagattaattacaactcctggcc

SEQ ID NO: 27650 - DNA, 25 bp, Homo sapien
ataagattaattacgactcctggcc

SEQ ID NO: 27651 - DNA, 25 bp, Homo sapien
ataagattcagcagccctggaaagt

SEQ ID NO: 27652 - DNA, 25 bp, Homo sapien
ataagattcagcagtcctggaaagt

SEQ ID NO: 27653 - DNA, 25 bp, Homo sapien
ataagattgccagatatggaacatt

SEQ ID NO: 27654 - DNA, 25 bp, Homo sapien
ataagattgccggatatggaacatt

SEQ ID NO: 27655 - DNA, 25 bp, Homo sapien
ataagcaacggaaccagaattcaaa

SEQ ID NO: 27656 - DNA, 25 bp, Homo sapien
ataagcaatggaaccagaattcaaa

SEQ ID NO: 27657 - DNA, 25 bp, Homo sapien
ataagcacctaaaacatcaatttct

SEQ ID NO: 27658 - DNA, 25 bp, Homo sapien
ataagcacctaatacatcaatttct

SEQ ID NO: 27659 - DNA, 25 bp, Homo sapien
ataagcagaaaaagtgaccagagat

SEQ ID NO: 27660 - DNA, 25 bp, Homo sapien
ataagcagagaaagtgaccagagat

SEQ ID NO: 27661 - DNA, 25 bp, Homo sapien
ataagcagtgacctcaaagtgacag

SEQ ID NO: 27662 - DNA, 25 bp, Homo sapien
ataagcagtgacttcaaagtgacag

SEQ ID NO: 27663 - DNA, 25 bp, Homo sapien
ataagcataagaacaccaacctcca

SEQ ID NO: 27664 - DNA, 25 bp, Homo sapien
ataagcataagaacacgaacctcca

SEQ ID NO: 27665 - DNA, 25 bp, Homo sapien
ataagcatttaaataaagtgcagat

SEQ ID NO: 27666 - DNA, 25 bp, Homo sapien
ataagcatttaaatgaagtgcagat

SEQ ID NO: 27667 - DNA, 25 bp, Homo sapien
ataagccaaactacaatatctgcca

SEQ ID NO: 27668 - DNA, 25 bp, Homo sapien
ataagccaaactgcaatatctgcca

SEQ ID NO: 27669 - DNA, 25 bp, Homo sapien
ataagcctgtgctttccttaaacaa

SEQ ID NO: 27670 - DNA, 25 bp, Homo sapien
ataagcctgtgttttccttaaacaa

SEQ ID NO: 27671 - DNA, 25 bp, Homo sapien
ataagcggcctttggagtattaatt

SEQ ID NO: 27672 - DNA, 25 bp, Homo sapien
ataagcgggctttggagtattaatt

SEQ ID NO: 27673 - DNA, 25 bp, Homo sapien
ataagctaaatacgctgagactcag

SEQ ID NO: 27674 - DNA, 25 bp, Homo sapien
ataagctaaatatgctgagactcag

SEQ ID NO: 27675 - DNA, 25 bp, Homo sapien
ataagctgtagaacgaacattactc

SEQ ID NO: 27676 - DNA, 25 bp, Homo sapien
ataagctgtggaacgaacattactc

SEQ ID NO: 27677 - DNA, 25 bp, Homo sapien
ataagcttgttcagaattattatta

SEQ ID NO: 27678 - DNA, 25 bp, Homo sapien
ataagcttgttctgaattattatta

SEQ ID NO: 27679 - DNA, 25 bp, Homo sapien
ataaggaaaccaatcgtgtgatttc

SEQ ID NO: 27680 - DNA, 25 bp, Homo sapien
ataaggaaaccaattgtgtgatttc

SEQ ID NO: 27681 - DNA, 25 bp, Homo sapien
ataaggaaacttgtaattgctttga

SEQ ID NO: 27682 - DNA, 25 bp, Homo sapien
ataaggaaattgaacatctgaggat

SEQ ID NO: 27683 - DNA, 25 bp, Homo sapien
ataaggaaccttgtaattgctttga

SEQ ID NO: 27684 - DNA, 25 bp, Homo sapien
ataaggaacttgaacatctgaggat

SEQ ID NO: 27685 - DNA, 25 bp, Homo sapien
ataaggaatccagtaacttgaaggc

SEQ ID NO: 27686 - DNA, 25 bp, Homo sapien
ataaggaatccggtaacttgaaggc

SEQ ID NO: 27687 - DNA, 25 bp, Homo sapien
ataaggacagaaagtatttgttgtt

SEQ ID NO: 27688 - DNA, 25 bp, Homo sapien
ataaggacagaaggtatttgttgtt

SEQ ID NO: 27689 - DNA, 25 bp, Homo sapien
ataaggacatgtaaaggaagttgga

SEQ ID NO: 27690 - DNA, 25 bp, Homo sapien
ataaggacatgtgaaggaagttgga

SEQ ID NO: 27691 - DNA, 25 bp, Homo sapien
ataaggagatggtagtcattttcat

SEQ ID NO: 27692 - DNA, 25 bp, Homo sapien
ataaggagttggtagtcattttcat

SEQ ID NO: 27693 - DNA, 25 bp, Homo sapien
ataaggcacatctatgtttaatctt

SEQ ID NO: 27694 - DNA, 25 bp, Homo sapien
ataaggcacctctatgtttaatctt

SEQ ID NO: 27695 - DNA, 25 bp, Homo sapien
ataagggaaacataacttgcaacta

SEQ ID NO: 27696 - DNA, 25 bp, Homo sapien
ataagggaaccataacttgcaacta

SEQ ID NO: 27697 - DNA, 25 bp, Homo sapien
ataagggacaaatattgcatgcctc

SEQ ID NO: 27698 - DNA, 25 bp, Homo sapien
ataagggagaaatattgcatgcctc

SEQ ID NO: 27699 - DNA, 25 bp, Homo sapien
ataaggtagtgtttgccttcgttac

SEQ ID NO: 27700 - DNA, 25 bp, Homo sapien
ataaggtagtgtttgctttcgttac

SEQ ID NO: 27701 - DNA, 25 bp, Homo sapien
ataaggtcacccaaaaatgtccata

SEQ ID NO: 27702 - DNA, 25 bp, Homo sapien
ataaggtcatccaaaaatgtccata

SEQ ID NO: 27703 - DNA, 25 bp, Homo sapien
ataaggtccaaaatcacacttttga

SEQ ID NO: 27704 - DNA, 25 bp, Homo sapien
ataaggtcccaaatcacacttttga

SEQ ID NO: 27705 - DNA, 25 bp, Homo sapien
ataaggtgaaacagaaacagatcat

SEQ ID NO: 27706 - DNA, 25 bp, Homo sapien
ataaggtgaaatagaaacagatcat

SEQ ID NO: 27707 - DNA, 25 bp, Homo sapien
ataaggttactaagaggattgagtt

SEQ ID NO: 27708 - DNA, 25 bp, Homo sapien
ataaggttactatgaggattgagtt

SEQ ID NO: 27709 - DNA, 25 bp, Homo sapien
ataagtaagcataacgcaaatcgat

SEQ ID NO: 27710 - DNA, 25 bp, Homo sapien
ataagtaagcataatgcaaatcgat

SEQ ID NO: 27711 - DNA, 25 bp, Homo sapien
ataagtaataatagcccttgagatc

SEQ ID NO: 27712 - DNA, 25 bp, Homo sapien
ataagtaataattgcccttgagatc

SEQ ID NO: 27713 - DNA, 25 bp, Homo sapien
ataagtagaggacagctgaaccaag

SEQ ID NO: 27714 - DNA, 25 bp, Homo sapien
ataagtagagggcagctgaaccaag

SEQ ID NO: 27715 - DNA, 25 bp, Homo sapien
ataagtatgattacagagtgaagac

SEQ ID NO: 27716 - DNA, 25 bp, Homo sapien
ataagtatgattacggagtgaagac

SEQ ID NO: 27717 - DNA, 25 bp, Homo sapien
ataagtatggtaccaagaagaaata

SEQ ID NO: 27718 - DNA, 25 bp, Homo sapien
ataagtatggtacccagaagaaata

SEQ ID NO: 27719 - DNA, 25 bp, Homo sapien
ataagtccaaattccccatcagttc

SEQ ID NO: 27720 - DNA, 25 bp, Homo sapien
ataagtccaattgctttttcatatg

SEQ ID NO: 27721 - DNA, 25 bp, Homo sapien
ataagtccagattccccatcagttc

SEQ ID NO: 27722 - DNA, 25 bp, Homo sapien
ataagtccagttgctttttcatatg

SEQ ID NO: 27723 - DNA, 25 bp, Homo sapien
ataagtgaattagaagttttagagc

SEQ ID NO: 27724 - DNA, 25 bp, Homo sapien
ataagtgaattagcagttttagagc

SEQ ID NO: 27725 - DNA, 25 bp, Homo sapien
ataagtgatacctttttctgtcctt

SEQ ID NO: 27726 - DNA, 25 bp, Homo sapien
ataagtgatacgtttttctgtcctt

SEQ ID NO: 27727 - DNA, 25 bp, Homo sapien
ataagtgcaatattctcctttatct

SEQ ID NO: 27728 - DNA, 25 bp, Homo sapien
ataagtgcacacaagacattcaaat

SEQ ID NO: 27729 - DNA, 25 bp, Homo sapien
ataagtgcacacgagacattcaaat

SEQ ID NO: 27730 - DNA, 25 bp, Homo sapien
ataagtgcgatattctcctttatct

SEQ ID NO: 27731 - DNA, 25 bp, Homo sapien
ataagtgctctaggacataaccaat

SEQ ID NO: 27732 - DNA, 25 bp, Homo sapien
ataagtgctctagggcataaccaat

SEQ ID NO: 27733 - DNA, 25 bp, Homo sapien
ataagtgctgtaatgaaaagaaaga

SEQ ID NO: 27734 - DNA, 25 bp, Homo sapien
ataagtgctgtattgaaaagaaaga

SEQ ID NO: 27735 - DNA, 25 bp, Homo sapien
ataagtggatgtcctcatttatcca

SEQ ID NO: 27736 - DNA, 25 bp, Homo sapien
ataagtgggtgtcctcatttatcca

SEQ ID NO: 27737 - DNA, 25 bp, Homo sapien
ataagtgtccaggagctggctgagt

SEQ ID NO: 27738 - DNA, 25 bp, Homo sapien
ataagtgtccaggcgctggctgagt

SEQ ID NO: 27739 - DNA, 25 bp, Homo sapien
ataagttacatatacatggcgatta

SEQ ID NO: 27740 - DNA, 25 bp, Homo sapien
ataagttacgtatacatggcgatta

SEQ ID NO: 27741 - DNA, 25 bp, Homo sapien
ataagttagctacccaatgacaagg

SEQ ID NO: 27742 - DNA, 25 bp, Homo sapien
ataagttagctactcaatgacaagg

SEQ ID NO: 27743 - DNA, 25 bp, Homo sapien
ataagttcagaatagtcacaatttc

SEQ ID NO: 27744 - DNA, 25 bp, Homo sapien
ataagttcatcaaaatagccaggga

SEQ ID NO: 27745 - DNA, 25 bp, Homo sapien
ataagttcatcaaagtagccaggga

SEQ ID NO: 27746 - DNA, 25 bp, Homo sapien
ataagttccaggccgcctgttttta

SEQ ID NO: 27747 - DNA, 25 bp, Homo sapien
ataagttccaggcctcctgttttta

SEQ ID NO: 27748 - DNA, 25 bp, Homo sapien
ataagttccgaatagtcacaatttc

SEQ ID NO: 27749 - DNA, 25 bp, Homo sapien
ataagttttttaaaatgatcaggaa

SEQ ID NO: 27750 - DNA, 25 bp, Homo sapien
ataagtttttttaaatgatcaggaa

SEQ ID NO: 27751 - DNA, 25 bp, Homo sapien
ataataaacagcggtcagtttttgt

SEQ ID NO: 27752 - DNA, 25 bp, Homo sapien
ataataaacagtggtcagtttttgt

SEQ ID NO: 27753 - DNA, 25 bp, Homo sapien
ataataaaccaacatttgtatttcc

SEQ ID NO: 27754 - DNA, 25 bp, Homo sapien
ataataaaccagcatttgtatttcc

SEQ ID NO: 27755 - DNA, 25 bp, Homo sapien
ataataaaccataaatatgtgatat

SEQ ID NO: 27756 - DNA, 25 bp, Homo sapien
ataataaactggtaaccgtaagtaa

SEQ ID NO: 27757 - DNA, 25 bp, Homo sapien
ataataaactggtaactgtaagtaa

SEQ ID NO: 27758 - DNA, 25 bp, Homo sapien
ataataaagaacgaacatctgcatc

SEQ ID NO: 27759 - DNA, 25 bp, Homo sapien
ataataaagaatgaacatctgcatc

SEQ ID NO: 27760 - DNA, 25 bp, Homo sapien
ataataaatcataaatatgtgatat

SEQ ID NO: 27761 - DNA, 25 bp, Homo sapien
ataataagtcacagccatgagcaca

SEQ ID NO: 27762 - DNA, 25 bp, Homo sapien
ataataagtcatagccatgagcaca

SEQ ID NO: 27763 - DNA, 25 bp, Homo sapien
ataataataatgcgtatgaagcgat

SEQ ID NO: 27764 - DNA, 25 bp, Homo sapien
ataataataatgtgtatgaagcgat

SEQ ID NO: 27765 - DNA, 25 bp, Homo sapien
ataataatcagctgatagcacagga

SEQ ID NO: 27766 - DNA, 25 bp, Homo sapien
ataataatcagcttatagcacagga

SEQ ID NO: 27767 - DNA, 25 bp, Homo sapien
ataataatgcgtatgaagcgatttc

SEQ ID NO: 27768 - DNA, 25 bp, Homo sapien
ataataatgtgtatgaagcgatttc

SEQ ID NO: 27769 - DNA, 25 bp, Homo sapien
ataatacactacaattgagcacatt

SEQ ID NO: 27770 - DNA, 25 bp, Homo sapien
ataatacactacagttgagcacatt

SEQ ID NO: 27771 - DNA, 25 bp, Homo sapien
ataatacatttcatctttcataatc

SEQ ID NO: 27772 - DNA, 25 bp, Homo sapien
ataatacatttcctgttgtggaagc

SEQ ID NO: 27773 - DNA, 25 bp, Homo sapien
ataatacatttccttttgtggaagc

SEQ ID NO: 27774 - DNA, 25 bp, Homo sapien
ataatacatttcgtctttcataatc

SEQ ID NO: 27775 - DNA, 25 bp, Homo sapien
ataatactttcaggcccaacaatac

SEQ ID NO: 27776 - DNA, 25 bp, Homo sapien
ataatactttcaggtccaacaatac

SEQ ID NO: 27777 - DNA, 25 bp, Homo sapien
ataatagcaggatatagggttcagt

SEQ ID NO: 27778 - DNA, 25 bp, Homo sapien
ataatagcaggatatatggttcagt

SEQ ID NO: 27779 - DNA, 25 bp, Homo sapien
ataataggagccgaaattccatagg

SEQ ID NO: 27780 - DNA, 25 bp, Homo sapien
ataataggagctgaaattccatagg

SEQ ID NO: 27781 - DNA, 25 bp, Homo sapien
ataataggcaatccttttgtgtgtg

SEQ ID NO: 27782 - DNA, 25 bp, Homo sapien
ataataggcaattcttttgtgtgtg

SEQ ID NO: 27783 - DNA, 25 bp, Homo sapien
ataatagtacagctccaaaggtaga

SEQ ID NO: 27784 - DNA, 25 bp, Homo sapien
ataatagtacagctccgaaggtaga

SEQ ID NO: 27785 - DNA, 25 bp, Homo sapien
ataatatactcaacaagtggcagat

SEQ ID NO: 27786 - DNA, 25 bp, Homo sapien
ataatatattcaacaagtggcagat

SEQ ID NO: 27787 - DNA, 25 bp, Homo sapien
ataatattacgcaccatttgtgagc

SEQ ID NO: 27788 - DNA, 25 bp, Homo sapien
ataatattatgcaccatttgtgagc

SEQ ID NO: 27789 - DNA, 25 bp, Homo sapien
ataatattctatccgaaagaccttg

SEQ ID NO: 27790 - DNA, 25 bp, Homo sapien
ataatattctatctgaaagaccttg

SEQ ID NO: 27791 - DNA, 25 bp, Homo sapien
ataatattctgcctattgctctcca

SEQ ID NO: 27792 - DNA, 25 bp, Homo sapien
ataatattctgcgtattgctctcca

SEQ ID NO: 27793 - DNA, 25 bp, Homo sapien
ataatatttccaacgtgactctacc

SEQ ID NO: 27794 - DNA, 25 bp, Homo sapien
ataatatttccaatgtgactctacc

SEQ ID NO: 27795 - DNA, 25 bp, Homo sapien
ataatatttcctgacatgtgaacat

SEQ ID NO: 27796 - DNA, 25 bp, Homo sapien
ataatattttctgacatgtgaacat

SEQ ID NO: 27797 - DNA, 25 bp, Homo sapien
ataatcaaagggcaagcttcaggat

SEQ ID NO: 27798 - DNA, 25 bp, Homo sapien
ataatcaaagggcacgcttcaggat

SEQ ID NO: 27799 - DNA, 25 bp, Homo sapien
ataatcaaagttatgtcctccaatc

SEQ ID NO: 27800 - DNA, 25 bp, Homo sapien
ataatcaaagttatgttctccaatc

SEQ ID NO: 27801 - DNA, 25 bp, Homo sapien
ataatcaatactttggctgcttgct

SEQ ID NO: 27802 - DNA, 25 bp, Homo sapien
ataatcaatcctttggctgcttgct

SEQ ID NO: 27803 - DNA, 25 bp, Homo sapien
ataatcagatggtttttgcttttaa

SEQ ID NO: 27804 - DNA, 25 bp, Homo sapien
ataatcagatgttttttgcttttaa

SEQ ID NO: 27805 - DNA, 25 bp, Homo sapien
ataatcagcacctactgtcaatgta

SEQ ID NO: 27806 - DNA, 25 bp, Homo sapien
ataatcagcacctgctgtcaatgta

SEQ ID NO: 27807 - DNA, 25 bp, Homo sapien
ataatcataacaagacattgcattt

SEQ ID NO: 27808 - DNA, 25 bp, Homo sapien
ataatcataacaagccattgcattt

SEQ ID NO: 27809 - DNA, 25 bp, Homo sapien
ataatccactctcattctccgagat

SEQ ID NO: 27810 - DNA, 25 bp, Homo sapien
ataatccactcttattctccgagat

SEQ ID NO: 27811 - DNA, 25 bp, Homo sapien
ataatcccaatatccttaatttcaa

SEQ ID NO: 27812 - DNA, 25 bp, Homo sapien
ataatcccaatatcgttaatttcaa

SEQ ID NO: 27813 - DNA, 25 bp, Homo sapien
ataatcctcataaatccctaagcac

SEQ ID NO: 27814 - DNA, 25 bp, Homo sapien
ataatcctcgtaaatccctaagcac

SEQ ID NO: 27815 - DNA, 25 bp, Homo sapien
ataatccttcctcaactagttctgg

SEQ ID NO: 27816 - DNA, 25 bp, Homo sapien
ataatcctttctcaactagttctgg

SEQ ID NO: 27817 - DNA, 25 bp, Homo sapien
ataatctatttctgccttttatttt

SEQ ID NO: 27818 - DNA, 25 bp, Homo sapien
ataatctatttctggcttttatttt

SEQ ID NO: 27819 - DNA, 25 bp, Homo sapien
ataatctcattgcaatattgttgag

SEQ ID NO: 27820 - DNA, 25 bp, Homo sapien
ataatctcatttacaatctctgaga

SEQ ID NO: 27821 - DNA, 25 bp, Homo sapien
ataatctcatttgcaatctctgaga

SEQ ID NO: 27822 - DNA, 25 bp, Homo sapien
ataatctccttgcaatattgttgag

SEQ ID NO: 27823 - DNA, 25 bp, Homo sapien
ataatctgccacataattaaaagta

SEQ ID NO: 27824 - DNA, 25 bp, Homo sapien
ataatctgccacgtaattaaaagta

SEQ ID NO: 27825 - DNA, 25 bp, Homo sapien
ataatctgtgaaaagtgtgttcagc

SEQ ID NO: 27826 - DNA, 25 bp, Homo sapien
ataatctgtgaagagtgtgttcagc

SEQ ID NO: 27827 - DNA, 25 bp, Homo sapien
ataatcttcagtccttatccacatt

SEQ ID NO: 27828 - DNA, 25 bp, Homo sapien
ataatcttcagtccttgtccacatt

SEQ ID NO: 27829 - DNA, 25 bp, Homo sapien
ataatgaaaatctcagtaagaaaaa

SEQ ID NO: 27830 - DNA, 25 bp, Homo sapien
ataatgaaaatctcggtaagaaaaa

SEQ ID NO: 27831 - DNA, 25 bp, Homo sapien
ataatgaacggcagacttaaaaatt

SEQ ID NO: 27832 - DNA, 25 bp, Homo sapien
ataatgaagcattcctggccatttt

SEQ ID NO: 27833 - DNA, 25 bp, Homo sapien
ataatgaagtattcctggccatttt

SEQ ID NO: 27834 - DNA, 25 bp, Homo sapien
ataatgaatctaggcaatgatcatc

SEQ ID NO: 27835 - DNA, 25 bp, Homo sapien
ataatgaatctaggcattgatcatc

SEQ ID NO: 27836 - DNA, 25 bp, Homo sapien
ataatgaatggcagacttaaaaatt

SEQ ID NO: 27837 - DNA, 25 bp, Homo sapien
ataatgacattaatccattcatgaa

SEQ ID NO: 27838 - DNA, 25 bp, Homo sapien
ataatgacattagtccattcatgaa

SEQ ID NO: 27839 - DNA, 25 bp, Homo sapien
ataatgaccatttctggaaattcat

SEQ ID NO: 27840 - DNA, 25 bp, Homo sapien
ataatgaccatttctgtaaattcat

SEQ ID NO: 27841 - DNA, 25 bp, Homo sapien
ataatgagaaacaacgaagcaagcc

SEQ ID NO: 27842 - DNA, 25 bp, Homo sapien
ataatgagaaacaatgaagcaagcc

SEQ ID NO: 27843 - DNA, 25 bp, Homo sapien
ataatgagataaacaatgtctctta

SEQ ID NO: 27844 - DNA, 25 bp, Homo sapien
ataatgagataaacgatgtctctta

SEQ ID NO: 27845 - DNA, 25 bp, Homo sapien
ataatgaggttctgctatgtaagta

SEQ ID NO: 27846 - DNA, 25 bp, Homo sapien
ataatgaggttttgctatgtaagta

SEQ ID NO: 27847 - DNA, 25 bp, Homo sapien
ataatgagtatgccctaaaattgtg

SEQ ID NO: 27848 - DNA, 25 bp, Homo sapien
ataatgagtatgccttaaaattgtg

SEQ ID NO: 27849 - DNA, 25 bp, Homo sapien
ataatgatcccaaattcacacaggt

SEQ ID NO: 27850 - DNA, 25 bp, Homo sapien
ataatgatcccaagttcacacaggt

SEQ ID NO: 27851 - DNA, 25 bp, Homo sapien
ataatgatgctcatcaaactgttat

SEQ ID NO: 27852 - DNA, 25 bp, Homo sapien
ataatgatgctcatcagactgttat

SEQ ID NO: 27853 - DNA, 25 bp, Homo sapien
ataatgcaacactgagttttcctca

SEQ ID NO: 27854 - DNA, 25 bp, Homo sapien
ataatgcaacactgtgttttcctca

SEQ ID NO: 27855 - DNA, 25 bp, Homo sapien
ataatgcaagaggtagtatggtaac

SEQ ID NO: 27856 - DNA, 25 bp, Homo sapien
ataatgcaggaggtagtatggtaac

SEQ ID NO: 27857 - DNA, 25 bp, Homo sapien
ataatgcatgaatgtaaggtatgaa

SEQ ID NO: 27858 - DNA, 25 bp, Homo sapien
ataatgcatgacaaatggcctgtaa

SEQ ID NO: 27859 - DNA, 25 bp, Homo sapien
ataatgcatgataaatggcctgtaa

SEQ ID NO: 27860 - DNA, 25 bp, Homo sapien
ataatgcatgattgtaaggtatgaa

SEQ ID NO: 27861 - DNA, 25 bp, Homo sapien
ataatgccttcttcggttgacaagt

SEQ ID NO: 27862 - DNA, 25 bp, Homo sapien
ataatgccttctttggttgacaagt

SEQ ID NO: 27863 - DNA, 25 bp, Homo sapien
ataatgctagaggatccagctgggc

SEQ ID NO: 27864 - DNA, 25 bp, Homo sapien
ataatgctagaggctccagctgggc

SEQ ID NO: 27865 - DNA, 25 bp, Homo sapien
ataatggataccggaagctttaaaa

SEQ ID NO: 27866 - DNA, 25 bp, Homo sapien
ataatggattccggaagctttaaaa

SEQ ID NO: 27867 - DNA, 25 bp, Homo sapien
ataatggctcgcgtccacggttctg

SEQ ID NO: 27868 - DNA, 25 bp, Homo sapien
ataatggctcgtgtccacggttctg

SEQ ID NO: 27869 - DNA, 25 bp, Homo sapien
ataatgggtaaatggtatggtaagt

SEQ ID NO: 27870 - DNA, 25 bp, Homo sapien
ataatgggtaaggatgagaaagctg

SEQ ID NO: 27871 - DNA, 25 bp, Homo sapien
ataatgggtaaggctgagaaagctg

SEQ ID NO: 27872 - DNA, 25 bp, Homo sapien
ataatgggtcaatggtatggtaagt

SEQ ID NO: 27873 - DNA, 25 bp, Homo sapien
ataatggtagctgtagtttattgag

SEQ ID NO: 27874 - DNA, 25 bp, Homo sapien
ataatggtagctgtggtttattgag

SEQ ID NO: 27875 - DNA, 25 bp, Homo sapien
ataatgtaaaacatctccataattt

SEQ ID NO: 27876 - DNA, 25 bp, Homo sapien
ataatgtaaaacgtctccataattt

SEQ ID NO: 27877 - DNA, 25 bp, Homo sapien
ataatgtatcaccctgaattgctat

SEQ ID NO: 27878 - DNA, 25 bp, Homo sapien
ataatgtatcactctgaattgctat

SEQ ID NO: 27879 - DNA, 25 bp, Homo sapien
ataatgtcttcatcagtttatttct

SEQ ID NO: 27880 - DNA, 25 bp, Homo sapien
ataatgtcttcatcggtttatttct

SEQ ID NO: 27881 - DNA, 25 bp, Homo sapien
ataatgtgatagacaagaaacagga

SEQ ID NO: 27882 - DNA, 25 bp, Homo sapien
ataatgtgatagccaagaaacagga

SEQ ID NO: 27883 - DNA, 25 bp, Homo sapien
ataatgtgcaaccagattaagctat

SEQ ID NO: 27884 - DNA, 25 bp, Homo sapien
ataatgtgcgaccagattaagctat

SEQ ID NO: 27885 - DNA, 25 bp, Homo sapien
ataatgtgctaaaggcagatcctct

SEQ ID NO: 27886 - DNA, 25 bp, Homo sapien
ataatgtgcttcctgaactccctgc

SEQ ID NO: 27887 - DNA, 25 bp, Homo sapien
ataatgtgcttcttgaactccctgc

SEQ ID NO: 27888 - DNA, 25 bp, Homo sapien
ataatgtggtaaaggcagatcctct

SEQ ID NO: 27889 - DNA, 25 bp, Homo sapien
ataatgttcagacatccagttatag

SEQ ID NO: 27890 - DNA, 25 bp, Homo sapien
ataatgttcagatatccagttatag

SEQ ID NO: 27891 - DNA, 25 bp, Homo sapien
ataatgtttacagccatctccatgc

SEQ ID NO: 27892 - DNA, 25 bp, Homo sapien
ataatgtttacggccatctccatgc

SEQ ID NO: 27893 - DNA, 25 bp, Homo sapien
ataattaaccagaagtccagtagag

SEQ ID NO: 27894 - DNA, 25 bp, Homo sapien
ataattaactagaagtccagtagag

SEQ ID NO: 27895 - DNA, 25 bp, Homo sapien
ataattaagaacaccagcaacaaca

SEQ ID NO: 27896 - DNA, 25 bp, Homo sapien
ataattaaggacaccagcaacaaca

SEQ ID NO: 27897 - DNA, 25 bp, Homo sapien
ataattactaaaaactgtggcactg

SEQ ID NO: 27898 - DNA, 25 bp, Homo sapien
ataattactgaaaactgtggcactg

SEQ ID NO: 27899 - DNA, 25 bp, Homo sapien
ataattatcacaaaaatgccttgac

SEQ ID NO: 27900 - DNA, 25 bp, Homo sapien
ataattatgacaaaaatgccttgac

SEQ ID NO: 27901 - DNA, 25 bp, Homo sapien
ataattattaagccatgttagcaat

SEQ ID NO: 27902 - DNA, 25 bp, Homo sapien
ataattattaagtcatgttagcaat

SEQ ID NO: 27903 - DNA, 25 bp, Homo sapien
ataattcaatgaaagaaagaataat

SEQ ID NO: 27904 - DNA, 25 bp, Homo sapien
ataattcaatgagagaaagaataat

SEQ ID NO: 27905 - DNA, 25 bp, Homo sapien
ataattcaattacttattgtgcaca

SEQ ID NO: 27906 - DNA, 25 bp, Homo sapien
ataattcaattatttattgtgcaca

SEQ ID NO: 27907 - DNA, 25 bp, Homo sapien
ataattcacggtagctttaaattcc

SEQ ID NO: 27908 - DNA, 25 bp, Homo sapien
ataattcatggtagctttaaattcc

SEQ ID NO: 27909 - DNA, 25 bp, Homo sapien
ataattccatatgttgtatcttctg

SEQ ID NO: 27910 - DNA, 25 bp, Homo sapien
ataattccgtatgttgtatcttctg

SEQ ID NO: 27911 - DNA, 25 bp, Homo sapien
ataattcctctcatgccctgcctag

SEQ ID NO: 27912 - DNA, 25 bp, Homo sapien
ataattcctctcgtgccctgcctag

SEQ ID NO: 27913 - DNA, 25 bp, Homo sapien
ataattctaattctcacagctaaac

SEQ ID NO: 27914 - DNA, 25 bp, Homo sapien
ataattctaattttcacagctaaac

SEQ ID NO: 27915 - DNA, 25 bp, Homo sapien
ataattctatcattttgtcaaagca

SEQ ID NO: 27916 - DNA, 25 bp, Homo sapien
ataattctatccttttgtcaaagca

SEQ ID NO: 27917 - DNA, 25 bp, Homo sapien
ataattctcagagaccaaagagcaa

SEQ ID NO: 27918 - DNA, 25 bp, Homo sapien
ataattctcagagatcaaagagcaa

SEQ ID NO: 27919 - DNA, 25 bp, Homo sapien
ataattctggatgatcccacaatca

SEQ ID NO: 27920 - DNA, 25 bp, Homo sapien
ataattctggatgctcccacaatca

SEQ ID NO: 27921 - DNA, 25 bp, Homo sapien
ataattcttcaactaaggtgtttat

SEQ ID NO: 27922 - DNA, 25 bp, Homo sapien
ataattcttcagctaaggtgtttat

SEQ ID NO: 27923 - DNA, 25 bp, Homo sapien
ataattgcaaccatttatctaataa

SEQ ID NO: 27924 - DNA, 25 bp, Homo sapien
ataattgcaaccgtttatctaataa

SEQ ID NO: 27925 - DNA, 25 bp, Homo sapien
ataattgctttactttatacaaaca

SEQ ID NO: 27926 - DNA, 25 bp, Homo sapien
ataattgctttgctttatacaaaca

SEQ ID NO: 27927 - DNA, 25 bp, Homo sapien
ataattgtactgaggaatcattgca

SEQ ID NO: 27928 - DNA, 25 bp, Homo sapien
ataattgtagtgaggaatcattgca

SEQ ID NO: 27929 - DNA, 25 bp, Homo sapien
ataattgttctcatagagttcctaa

SEQ ID NO: 27930 - DNA, 25 bp, Homo sapien
ataattgttgtcatagagttcctaa

SEQ ID NO: 27931 - DNA, 25 bp, Homo sapien
ataatttaaatcatatagcatgcca

SEQ ID NO: 27932 - DNA, 25 bp, Homo sapien
ataatttaaatcgtatagcatgcca

SEQ ID NO: 27933 - DNA, 25 bp, Homo sapien
ataatttaccaactcaacattgact

SEQ ID NO: 27934 - DNA, 25 bp, Homo sapien
ataatttacgctaacaatatgattc

SEQ ID NO: 27935 - DNA, 25 bp, Homo sapien
ataatttagataactgaccaaaggc

SEQ ID NO: 27936 - DNA, 25 bp, Homo sapien
ataatttagatatctgaccaaaggc

SEQ ID NO: 27937 - DNA, 25 bp, Homo sapien
ataatttatcaactcaacattgact

SEQ ID NO: 27938 - DNA, 25 bp, Homo sapien
ataatttatgctaacaatatgattc

SEQ ID NO: 27939 - DNA, 25 bp, Homo sapien
ataatttcaaactgtagcattaata

SEQ ID NO: 27940 - DNA, 25 bp, Homo sapien
ataatttcaaattgtagcattaata

SEQ ID NO: 27941 - DNA, 25 bp, Homo sapien
ataatttccggtatggtttaagccc

SEQ ID NO: 27942 - DNA, 25 bp, Homo sapien
ataatttcctgtatggtttaagccc

SEQ ID NO: 27943 - DNA, 25 bp, Homo sapien
ataatttgataactaattctacttc

SEQ ID NO: 27944 - DNA, 25 bp, Homo sapien
ataatttgctaactaattctacttc

SEQ ID NO: 27945 - DNA, 25 bp, Homo sapien
ataatttttttcatggaagataagt

SEQ ID NO: 27946 - DNA, 25 bp, Homo sapien
ataatttttttcatgggagataagt

SEQ ID NO: 27947 - DNA, 25 bp, Homo sapien
atacaaaaacaatgacccatggaac

SEQ ID NO: 27948 - DNA, 25 bp, Homo sapien
atacaaaaacattgacccatggaac

SEQ ID NO: 27949 - DNA, 25 bp, Homo sapien
atacaaaaacgaaactgctatggta

SEQ ID NO: 27950 - DNA, 25 bp, Homo sapien
atacaaaaccgaaactgctatggta

SEQ ID NO: 27951 - DNA, 25 bp, Homo sapien
atacaaaactcaatacccttcaatg

SEQ ID NO: 27952 - DNA, 25 bp, Homo sapien
atacaaaactccatacccttcaatg

SEQ ID NO: 27953 - DNA, 25 bp, Homo sapien
atacaaaatccatcttttcagtcag

SEQ ID NO: 27954 - DNA, 25 bp, Homo sapien
atacaaaatgcatcttttcagtcag

SEQ ID NO: 27955 - DNA, 25 bp, Homo sapien
atacaaagtgaagagtaaatcagtg

SEQ ID NO: 27956 - DNA, 25 bp, Homo sapien
atacaaagtgaatagtaaatcagtg

SEQ ID NO: 27957 - DNA, 25 bp, Homo sapien
atacaaatacagaacaatctcaact

SEQ ID NO: 27958 - DNA, 25 bp, Homo sapien
atacaaatacagatcaatctcaact

SEQ ID NO: 27959 - DNA, 25 bp, Homo sapien
atacaaatcgacaatccagagccta

SEQ ID NO: 27960 - DNA, 25 bp, Homo sapien
atacaaatctagcttccgaaagctc

SEQ ID NO: 27961 - DNA, 25 bp, Homo sapien
atacaaatctagtttccgaaagctc

SEQ ID NO: 27962 - DNA, 25 bp, Homo sapien
atacaaattgacaatccagagccta

SEQ ID NO: 27963 - DNA, 25 bp, Homo sapien
atacaacaaaaagaaatggcagtac

SEQ ID NO: 27964 - DNA, 25 bp, Homo sapien
atacaacaaaaagagatggcagtac

SEQ ID NO: 27965 - DNA, 25 bp, Homo sapien
atacaacaaagctcatcattcaatt

SEQ ID NO: 27966 - DNA, 25 bp, Homo sapien
atacaacaagcaatctatcctacaa

SEQ ID NO: 27967 - DNA, 25 bp, Homo sapien
atacaacaagcagtctatcctacaa

SEQ ID NO: 27968 - DNA, 25 bp, Homo sapien
atacaacacagctcatcattcaatt

SEQ ID NO: 27969 - DNA, 25 bp, Homo sapien
atacaacacccagcttcatttttag

SEQ ID NO: 27970 - DNA, 25 bp, Homo sapien
atacaacagagatgagaaataaata

SEQ ID NO: 27971 - DNA, 25 bp, Homo sapien
atacaacagagatgagtaataaata

SEQ ID NO: 27972 - DNA, 25 bp, Homo sapien
atacaacataggacaagagtagaga

SEQ ID NO: 27973 - DNA, 25 bp, Homo sapien
atacaacatagggcaagagtagaga

SEQ ID NO: 27974 - DNA, 25 bp, Homo sapien
atacaacatccagcttcatttttag

SEQ ID NO: 27975 - DNA, 25 bp, Homo sapien
atacaacatgatgatatggaacaca

SEQ ID NO: 27976 - DNA, 25 bp, Homo sapien
atacaacatgatgttatggaacaca

SEQ ID NO: 27977 - DNA, 25 bp, Homo sapien
atacaaccacagcagtcctaaaaca

SEQ ID NO: 27978 - DNA, 25 bp, Homo sapien
atacaaccagagcagtcctaaaaca

SEQ ID NO: 27979 - DNA, 25 bp, Homo sapien
atacaacgggaaggataacagtcat

SEQ ID NO: 27980 - DNA, 25 bp, Homo sapien
atacaacgggaatgataacagtcat

SEQ ID NO: 27981 - DNA, 25 bp, Homo sapien
atacaagaacatgcggttccacagc

SEQ ID NO: 27982 - DNA, 25 bp, Homo sapien
atacaagaacatgtggttccacagc

SEQ ID NO: 27983 - DNA, 25 bp, Homo sapien
atacaagatgatgtttatatttcca

SEQ ID NO: 27984 - DNA, 25 bp, Homo sapien
atacaagatgatgtttgtatttcca

SEQ ID NO: 27985 - DNA, 25 bp, Homo sapien
atacaagcgtatgaaacaagattca

SEQ ID NO: 27986 - DNA, 25 bp, Homo sapien
atacaagcgtatgaaagaagattca

SEQ ID NO: 27987 - DNA, 25 bp, Homo sapien
atacaaggacttgaaagtgattcac

SEQ ID NO: 27988 - DNA, 25 bp, Homo sapien
atacaaggcattgaacacagaatga

SEQ ID NO: 27989 - DNA, 25 bp, Homo sapien
atacaaggccttgaacacagaatga

SEQ ID NO: 27990 - DNA, 25 bp, Homo sapien
atacaagggccacatgccttcaatt

SEQ ID NO: 27991 - DNA, 25 bp, Homo sapien
atacaagggccacatgtcttcaatt

SEQ ID NO: 27992 - DNA, 25 bp, Homo sapien
atacaaggtcttgaaagtgattcac

SEQ ID NO: 27993 - DNA, 25 bp, Homo sapien
atacaagtgtgttctttcagctcac

SEQ ID NO: 27994 - DNA, 25 bp, Homo sapien
atacaagtgtgttttttcagctcac

SEQ ID NO: 27995 - DNA, 25 bp, Homo sapien
atacaataaaatgcttgcacttgag

SEQ ID NO: 27996 - DNA, 25 bp, Homo sapien
atacaatagaatgcttgcacttgag

SEQ ID NO: 27997 - DNA, 25 bp, Homo sapien
atacaatagagaccatcaacaaagg

SEQ ID NO: 27998 - DNA, 25 bp, Homo sapien
atacaatagagactatcaacaaagg

SEQ ID NO: 27999 - DNA, 25 bp, Homo sapien
atacaatatctgccctgcaatgttg

SEQ ID NO: 28000 - DNA, 25 bp, Homo sapien
atacaatatctgccttgcaatgttg

SEQ ID NO: 28001 - DNA, 25 bp, Homo sapien
atacaatcagaagaggctggaaaac

SEQ ID NO: 28002 - DNA, 25 bp, Homo sapien
atacaatcagaggaggctggaaaac

SEQ ID NO: 28003 - DNA, 25 bp, Homo sapien
atacaatcagcctctctctttttat

SEQ ID NO: 28004 - DNA, 25 bp, Homo sapien
atacaatcagcctttctctttttat

SEQ ID NO: 28005 - DNA, 25 bp, Homo sapien
atacaatcagtagattttaaacaac

SEQ ID NO: 28006 - DNA, 25 bp, Homo sapien
atacaatcggtagattttaaacaac

SEQ ID NO: 28007 - DNA, 25 bp, Homo sapien
atacaatgcaaggccatgcatggaa

SEQ ID NO: 28008 - DNA, 25 bp, Homo sapien
atacaatgcaaggtcatgcatggaa

SEQ ID NO: 28009 - DNA, 25 bp, Homo sapien
atacaatgggagtagtgatcaggac

SEQ ID NO: 28010 - DNA, 25 bp, Homo sapien
atacaatgggagtggtgatcaggac

SEQ ID NO: 28011 - DNA, 25 bp, Homo sapien
atacaatttaaaaagccttcagaaa

SEQ ID NO: 28012 - DNA, 25 bp, Homo sapien
atacaatttcaacggcagcttcctc

SEQ ID NO: 28013 - DNA, 25 bp, Homo sapien
atacaatttcaagggcagcttcctc

SEQ ID NO: 28014 - DNA, 25 bp, Homo sapien
atacaattttaaaagccttcagaaa

SEQ ID NO: 28015 - DNA, 25 bp, Homo sapien
atacacaacgcactagaagtgttta

SEQ ID NO: 28016 - DNA, 25 bp, Homo sapien
atacacaacgcactagcagtgttta

SEQ ID NO: 28017 - DNA, 25 bp, Homo sapien
atacacacatttgtgcataaataca

SEQ ID NO: 28018 - DNA, 25 bp, Homo sapien
atacacacatttgtgcgtaaataca

SEQ ID NO: 28019 - DNA, 25 bp, Homo sapien
atacacaccttaaaacctgctgatg

SEQ ID NO: 28020 - DNA, 25 bp, Homo sapien
atacacaccttaacacctgctgatg

SEQ ID NO: 28021 - DNA, 25 bp, Homo sapien
atacacactatcttcctcattttcc

SEQ ID NO: 28022 - DNA, 25 bp, Homo sapien
atacacactatctttctcattttcc

SEQ ID NO: 28023 - DNA, 25 bp, Homo sapien
atacacagtattctcggtagtcctg

SEQ ID NO: 28024 - DNA, 25 bp, Homo sapien
atacacagtattcttggtagtcctg

SEQ ID NO: 28025 - DNA, 25 bp, Homo sapien
atacacatccgggcagcttcaagat

SEQ ID NO: 28026 - DNA, 25 bp, Homo sapien
atacacatctgggcagcttcaagat

SEQ ID NO: 28027 - DNA, 25 bp, Homo sapien
atacacatgtgaacctgggtagtcc

SEQ ID NO: 28028 - DNA, 25 bp, Homo sapien
atacacatgtgaatctgggtagtcc

SEQ ID NO: 28029 - DNA, 25 bp, Homo sapien
atacaccagaatattatttagcaat

SEQ ID NO: 28030 - DNA, 25 bp, Homo sapien
atacaccagaatgttatttagcaat

SEQ ID NO: 28031 - DNA, 25 bp, Homo sapien
atacacgtaaatctcaatctggaag

SEQ ID NO: 28032 - DNA, 25 bp, Homo sapien
atacacgtaaatcttaatctggaag

SEQ ID NO: 28033 - DNA, 25 bp, Homo sapien
atacactgcaacgatttaaggtatc

SEQ ID NO: 28034 - DNA, 25 bp, Homo sapien
atacactgcaatgatttaaggtatc

SEQ ID NO: 28035 - DNA, 25 bp, Homo sapien
atacactgcccaaactcagcaaatc

SEQ ID NO: 28036 - DNA, 25 bp, Homo sapien
atacactggagaccgaaaccatgat

SEQ ID NO: 28037 - DNA, 25 bp, Homo sapien
atacactggagactgaaaccatgat

SEQ ID NO: 28038 - DNA, 25 bp, Homo sapien
atacactggattaaaacaaattgtg

SEQ ID NO: 28039 - DNA, 25 bp, Homo sapien
atacactggattacaacaaattgtg

SEQ ID NO: 28040 - DNA, 25 bp, Homo sapien
atacactgtccaaactcagcaaatc

SEQ ID NO: 28041 - DNA, 25 bp, Homo sapien
atacactgtgtaagtccccatgtct

SEQ ID NO: 28042 - DNA, 25 bp, Homo sapien
atacactgtttaagtccccatgtct

SEQ ID NO: 28043 - DNA, 25 bp, Homo sapien
atacacttgaccgggccaggtcctg

SEQ ID NO: 28044 - DNA, 25 bp, Homo sapien
atacacttgactgggccaggtcctg

SEQ ID NO: 28045 - DNA, 25 bp, Homo sapien
atacactttacccataatttccagg

SEQ ID NO: 28046 - DNA, 25 bp, Homo sapien
atacactttacccgtaatttccagg

SEQ ID NO: 28047 - DNA, 25 bp, Homo sapien
atacagaaaccaatccaaaaaggat

SEQ ID NO: 28048 - DNA, 25 bp, Homo sapien
atacagaaagagctttcaataaaat

SEQ ID NO: 28049 - DNA, 25 bp, Homo sapien
atacagaaagagttttcaataaaat

SEQ ID NO: 28050 - DNA, 25 bp, Homo sapien
atacagaaatcaatccaaaaaggat

SEQ ID NO: 28051 - DNA, 25 bp, Homo sapien
atacagaagcggaagcctgagcaaa

SEQ ID NO: 28052 - DNA, 25 bp, Homo sapien
atacagaagtggaagcctgagcaaa

SEQ ID NO: 28053 - DNA, 25 bp, Homo sapien
atacagaccactatctacacggaag

SEQ ID NO: 28054 - DNA, 25 bp, Homo sapien
atacagaccactctctacacggaag

SEQ ID NO: 28055 - DNA, 25 bp, Homo sapien
atacagactacataattgaagagtt

SEQ ID NO: 28056 - DNA, 25 bp, Homo sapien
atacagactacgtaattgaagagtt

SEQ ID NO: 28057 - DNA, 25 bp, Homo sapien
atacagcaacataactcctgagtgt

SEQ ID NO: 28058 - DNA, 25 bp, Homo sapien
atacagcaacatgactcctgagtgt

SEQ ID NO: 28059 - DNA, 25 bp, Homo sapien
atacagcagatactatgatatccaa

SEQ ID NO: 28060 - DNA, 25 bp, Homo sapien
atacagcagatactctgatatccaa

SEQ ID NO: 28061 - DNA, 25 bp, Homo sapien
atacagccacctgctaaaggaggaa

SEQ ID NO: 28062 - DNA, 25 bp, Homo sapien
atacagccacgtagggcctcaatgc

SEQ ID NO: 28063 - DNA, 25 bp, Homo sapien
atacagccagggtcattgccatccc

SEQ ID NO: 28064 - DNA, 25 bp, Homo sapien
atacagccagggtcgttgccatccc

SEQ ID NO: 28065 - DNA, 25 bp, Homo sapien
atacagccatctgctaaaggaggaa

SEQ ID NO: 28066 - DNA, 25 bp, Homo sapien
atacagccatgtagggcctcaatgc

SEQ ID NO: 28067 - DNA, 25 bp, Homo sapien
atacagcctacattttaactaactc

SEQ ID NO: 28068 - DNA, 25 bp, Homo sapien
atacagcctaccttttaactaactc

SEQ ID NO: 28069 - DNA, 25 bp, Homo sapien
atacagctttgatcaaaacactcaa

SEQ ID NO: 28070 - DNA, 25 bp, Homo sapien
atacagctttgatcgaaacactcaa

SEQ ID NO: 28071 - DNA, 25 bp, Homo sapien
atacaggcatacacacaggagacca

SEQ ID NO: 28072 - DNA, 25 bp, Homo sapien
atacaggcgtacacacaggagacca

SEQ ID NO: 28073 - DNA, 25 bp, Homo sapien
atacaggtacttgtttttctgtggg

SEQ ID NO: 28074 - DNA, 25 bp, Homo sapien
atacaggtatttgtttttctgtggg

SEQ ID NO: 28075 - DNA, 25 bp, Homo sapien
atacaggtcttaaattcctggtctc

SEQ ID NO: 28076 - DNA, 25 bp, Homo sapien
atacaggtcttgaattcctggtctc

SEQ ID NO: 28077 - DNA, 25 bp, Homo sapien
atacaggttagacaacagtgatgca

SEQ ID NO: 28078 - DNA, 25 bp, Homo sapien
atacaggttagagaacagtgatgca

SEQ ID NO: 28079 - DNA, 25 bp, Homo sapien
atacagtcctcatcaacacacaaag

SEQ ID NO: 28080 - DNA, 25 bp, Homo sapien
atacagtcctcgtcaacacacaaag

SEQ ID NO: 28081 - DNA, 25 bp, Homo sapien
atacagtgagcctgctcaaacatcc

SEQ ID NO: 28082 - DNA, 25 bp, Homo sapien
atacagtgagcctgttcaaacatcc

SEQ ID NO: 28083 - DNA, 25 bp, Homo sapien
atacagtgtctacacatttgatgat

SEQ ID NO: 28084 - DNA, 25 bp, Homo sapien
atacagtgtctacatatttgatgat

SEQ ID NO: 28085 - DNA, 25 bp, Homo sapien
atacataaaaacagagaaacaacat

SEQ ID NO: 28086 - DNA, 25 bp, Homo sapien
atacataaaaacagggaaacaacat

SEQ ID NO: 28087 - DNA, 25 bp, Homo sapien
atacataaaatccatgacaacacct

SEQ ID NO: 28088 - DNA, 25 bp, Homo sapien
atacataaaatccatggcaacacct

SEQ ID NO: 28089 - DNA, 25 bp, Homo sapien
atacataaacttacaaaaagatgat

SEQ ID NO: 28090 - DNA, 25 bp, Homo sapien
atacataaacttacgaaaagatgat

SEQ ID NO: 28091 - DNA, 25 bp, Homo sapien
atacataaatctttgccgagagacc

SEQ ID NO: 28092 - DNA, 25 bp, Homo sapien
atacataagtctttgccgagagacc

SEQ ID NO: 28093 - DNA, 25 bp, Homo sapien
atacatacagactttttgtgtggtc

SEQ ID NO: 28094 - DNA, 25 bp, Homo sapien
atacatacagattttttgtgtggtc

SEQ ID NO: 28095 - DNA, 25 bp, Homo sapien
atacatagaatacaatgaaaatggt

SEQ ID NO: 28096 - DNA, 25 bp, Homo sapien
atacatagactacaatgaaaatggt

SEQ ID NO: 28097 - DNA, 25 bp, Homo sapien
atacatagtcagaggaccttaagaa

SEQ ID NO: 28098 - DNA, 25 bp, Homo sapien
atacatagtcagaggatcttaagaa

SEQ ID NO: 28099 - DNA, 25 bp, Homo sapien
atacatataaatccataaacaatat

SEQ ID NO: 28100 - DNA, 25 bp, Homo sapien
atacatatacatccataaacaatat

SEQ ID NO: 28101 - DNA, 25 bp, Homo sapien
atacatcaatacaacacccagcttc

SEQ ID NO: 28102 - DNA, 25 bp, Homo sapien
atacatcaatacaacatccagcttc

SEQ ID NO: 28103 - DNA, 25 bp, Homo sapien
atacatcagtttacatgagagactt

SEQ ID NO: 28104 - DNA, 25 bp, Homo sapien
atacatcattttacatgagagactt

SEQ ID NO: 28105 - DNA, 25 bp, Homo sapien
atacatccacactcgttttctgaaa

SEQ ID NO: 28106 - DNA, 25 bp, Homo sapien
atacatccatcctggcattaaaaag

SEQ ID NO: 28107 - DNA, 25 bp, Homo sapien
atacatccatcctggcgttaaaaag

SEQ ID NO: 28108 - DNA, 25 bp, Homo sapien
atacatccgcactcgttttctgaaa

SEQ ID NO: 28109 - DNA, 25 bp, Homo sapien
atacatcttcatagagataaaagtt

SEQ ID NO: 28110 - DNA, 25 bp, Homo sapien
atacatcttcatggagataaaagtt

SEQ ID NO: 28111 - DNA, 25 bp, Homo sapien
atacatgaattttgtttatcgtctg

SEQ ID NO: 28112 - DNA, 25 bp, Homo sapien
atacatgagttttgtttatcgtctg

SEQ ID NO: 28113 - DNA, 25 bp, Homo sapien
atacatgcagtccagcagaccatct

SEQ ID NO: 28114 - DNA, 25 bp, Homo sapien
atacatgcagtccagcggaccatct

SEQ ID NO: 28115 - DNA, 25 bp, Homo sapien
atacatggaacatcagatgaaacaa

SEQ ID NO: 28116 - DNA, 25 bp, Homo sapien
atacatggaacatcggatgaaacaa

SEQ ID NO: 28117 - DNA, 25 bp, Homo sapien
atacatgtgatcataagaagcaaca

SEQ ID NO: 28118 - DNA, 25 bp, Homo sapien
atacatgtgatcgtaagaagcaaca

SEQ ID NO: 28119 - DNA, 25 bp, Homo sapien
atacatgtgtgtttagaaggagcct

SEQ ID NO: 28120 - DNA, 25 bp, Homo sapien
atacatgtgtgtttagtaggagcct

SEQ ID NO: 28121 - DNA, 25 bp, Homo sapien
atacatgttagtttccattttcttc

SEQ ID NO: 28122 - DNA, 25 bp, Homo sapien
atacatgttagtttccgttttcttc

SEQ ID NO: 28123 - DNA, 25 bp, Homo sapien
atacattatgaaacacaggcttcta

SEQ ID NO: 28124 - DNA, 25 bp, Homo sapien
atacattatgaaccacaggcttcta

SEQ ID NO: 28125 - DNA, 25 bp, Homo sapien
atacattccactccaaatattaatg

SEQ ID NO: 28126 - DNA, 25 bp, Homo sapien
atacattccactgcaaatattaatg

SEQ ID NO: 28127 - DNA, 25 bp, Homo sapien
atacattctttcaattctgtccacc

SEQ ID NO: 28128 - DNA, 25 bp, Homo sapien
atacattctttcagttctgtccacc

SEQ ID NO: 28129 - DNA, 25 bp, Homo sapien
atacattgcacttgatgtctattgt

SEQ ID NO: 28130 - DNA, 25 bp, Homo sapien
atacattgcctaagacttagtgaga

SEQ ID NO: 28131 - DNA, 25 bp, Homo sapien
atacattgcgtaagacttagtgaga

SEQ ID NO: 28132 - DNA, 25 bp, Homo sapien
atacattggaacccttgcgcaccgt

SEQ ID NO: 28133 - DNA, 25 bp, Homo sapien
atacattggaactcttgcgcaccgt

SEQ ID NO: 28134 - DNA, 25 bp, Homo sapien
atacattggacttgatgtctattgt

SEQ ID NO: 28135 - DNA, 25 bp, Homo sapien
atacatttagaaaagagcaaaccgt

SEQ ID NO: 28136 - DNA, 25 bp, Homo sapien
atacatttagagaagagcaaaccgt

SEQ ID NO: 28137 - DNA, 25 bp, Homo sapien
atacatttcatctttcataatctcc

SEQ ID NO: 28138 - DNA, 25 bp, Homo sapien
atacatttcctgttgtggaagcagg

SEQ ID NO: 28139 - DNA, 25 bp, Homo sapien
atacatttccttttgtggaagcagg

SEQ ID NO: 28140 - DNA, 25 bp, Homo sapien
atacatttcgtaacgctatttctgc

SEQ ID NO: 28141 - DNA, 25 bp, Homo sapien
atacatttcgtaatgctatttctgc

SEQ ID NO: 28142 - DNA, 25 bp, Homo sapien
atacatttcgtctttcataatctcc

SEQ ID NO: 28143 - DNA, 25 bp, Homo sapien
atacatttgaattttataccacaca

SEQ ID NO: 28144 - DNA, 25 bp, Homo sapien
atacatttggattttataccacaca

SEQ ID NO: 28145 - DNA, 25 bp, Homo sapien
atacattttcaatcctcagagatgg

SEQ ID NO: 28146 - DNA, 25 bp, Homo sapien
atacattttcagtcctcagagatgg

SEQ ID NO: 28147 - DNA, 25 bp, Homo sapien
atacattttgtgaaatagtcacctg

SEQ ID NO: 28148 - DNA, 25 bp, Homo sapien
atacattttgtgcaatagtcacctg

SEQ ID NO: 28149 - DNA, 25 bp, Homo sapien
atacatttttgtgtttcttataatg

SEQ ID NO: 28150 - DNA, 25 bp, Homo sapien
atacatttttgtgtttgttataatg

SEQ ID NO: 28151 - DNA, 25 bp, Homo sapien
ataccaaaacccaaaagagacataa

SEQ ID NO: 28152 - DNA, 25 bp, Homo sapien
ataccaaaacccgaaagagacataa

SEQ ID NO: 28153 - DNA, 25 bp, Homo sapien
ataccaacaggagcaagaagtttat

SEQ ID NO: 28154 - DNA, 25 bp, Homo sapien
ataccaacaggggcaagaagtttat

SEQ ID NO: 28155 - DNA, 25 bp, Homo sapien
ataccaactaaaccacttatccact

SEQ ID NO: 28156 - DNA, 25 bp, Homo sapien
ataccaactaaaccgcttatccact

SEQ ID NO: 28157 - DNA, 25 bp, Homo sapien
ataccaactccatcatatcttcaga

SEQ ID NO: 28158 - DNA, 25 bp, Homo sapien
ataccaactccgtcatatcttcaga

SEQ ID NO: 28159 - DNA, 25 bp, Homo sapien
ataccaagaagacaaaaaactctcc

SEQ ID NO: 28160 - DNA, 25 bp, Homo sapien
ataccaagaaggcaaaaaactctcc

SEQ ID NO: 28161 - DNA, 25 bp, Homo sapien
ataccaagataatttgcaagctaga

SEQ ID NO: 28162 - DNA, 25 bp, Homo sapien
ataccaagatattttgcaagctaga

SEQ ID NO: 28163 - DNA, 25 bp, Homo sapien
ataccaaggagcacaactgttgaat

SEQ ID NO: 28164 - DNA, 25 bp, Homo sapien
ataccaaggagcataactgttgaat

SEQ ID NO: 28165 - DNA, 25 bp, Homo sapien
ataccaagggaagactgtatgtgta

SEQ ID NO: 28166 - DNA, 25 bp, Homo sapien
ataccaagggacgactgtatgtgta

SEQ ID NO: 28167 - DNA, 25 bp, Homo sapien
ataccaagtggaaccattatatcag

SEQ ID NO: 28168 - DNA, 25 bp, Homo sapien
ataccaagtggaactattatatcag

SEQ ID NO: 28169 - DNA, 25 bp, Homo sapien
ataccacaaatttatagtttggttg

SEQ ID NO: 28170 - DNA, 25 bp, Homo sapien
ataccacaaatttgtagtttggttg

SEQ ID NO: 28171 - DNA, 25 bp, Homo sapien
ataccacctcaaaggcctatttcag

SEQ ID NO: 28172 - DNA, 25 bp, Homo sapien
ataccacctcaaatgcctatttcag

SEQ ID NO: 28173 - DNA, 25 bp, Homo sapien
ataccacgaacaggtgataggtcct

SEQ ID NO: 28174 - DNA, 25 bp, Homo sapien
ataccacgaacaggtgttaggtcct

SEQ ID NO: 28175 - DNA, 25 bp, Homo sapien
ataccagaaagtgcaaaggaaaaag

SEQ ID NO: 28176 - DNA, 25 bp, Homo sapien
ataccagaaagtgcgaaggaaaaag

SEQ ID NO: 28177 - DNA, 25 bp, Homo sapien
ataccagacttgaaatcagcactat

SEQ ID NO: 28178 - DNA, 25 bp, Homo sapien
ataccagacttgaaattagcactat

SEQ ID NO: 28179 - DNA, 25 bp, Homo sapien
ataccagcctttggcacgtgaagat

SEQ ID NO: 28180 - DNA, 25 bp, Homo sapien
ataccagcctttggcatgtgaagat

SEQ ID NO: 28181 - DNA, 25 bp, Homo sapien
ataccaggaaccagacagcagaaga

SEQ ID NO: 28182 - DNA, 25 bp, Homo sapien
ataccaggaaccaggcagcagaaga

SEQ ID NO: 28183 - DNA, 25 bp, Homo sapien
ataccaggatttagtcattcagcac

SEQ ID NO: 28184 - DNA, 25 bp, Homo sapien
ataccaggatttagtcgttcagcac

SEQ ID NO: 28185 - DNA, 25 bp, Homo sapien
ataccaggccagagacagctatcct

SEQ ID NO: 28186 - DNA, 25 bp, Homo sapien
ataccaggccagagactgctatcct

SEQ ID NO: 28187 - DNA, 25 bp, Homo sapien
ataccagtagcaagtcagtttctga

SEQ ID NO: 28188 - DNA, 25 bp, Homo sapien
ataccagtatcaagtcagtttctga

SEQ ID NO: 28189 - DNA, 25 bp, Homo sapien
ataccagtgatatacgagggctgaa

SEQ ID NO: 28190 - DNA, 25 bp, Homo sapien
ataccagtgatatatgagggctgaa

SEQ ID NO: 28191 - DNA, 25 bp, Homo sapien
ataccatacaatcagtagattttaa

SEQ ID NO: 28192 - DNA, 25 bp, Homo sapien
ataccatacaatcggtagattttaa

SEQ ID NO: 28193 - DNA, 25 bp, Homo sapien
ataccatataacttggcactcatta

SEQ ID NO: 28194 - DNA, 25 bp, Homo sapien
ataccatatgacttggcactcatta

SEQ ID NO: 28195 - DNA, 25 bp, Homo sapien
ataccatcagagaaatctgcccctt

SEQ ID NO: 28196 - DNA, 25 bp, Homo sapien
ataccatcagaggaatctgcccctt

SEQ ID NO: 28197 - DNA, 25 bp, Homo sapien
ataccattgcttgcatgtcaaattg

SEQ ID NO: 28198 - DNA, 25 bp, Homo sapien
ataccattgtttgcatgtcaaattg

SEQ ID NO: 28199 - DNA, 25 bp, Homo sapien
atacccaaatattcatttcatggac

SEQ ID NO: 28200 - DNA, 25 bp, Homo sapien
atacccaaatattgatttcatggac

SEQ ID NO: 28201 - DNA, 25 bp, Homo sapien
atacccagacaaaaacaaacataag

SEQ ID NO: 28202 - DNA, 25 bp, Homo sapien
atacccagacacaaacaaacataag

SEQ ID NO: 28203 - DNA, 25 bp, Homo sapien
ataccctataaagcaaccatgcagt

SEQ ID NO: 28204 - DNA, 25 bp, Homo sapien
ataccctataaagtaaccatgcagt

SEQ ID NO: 28205 - DNA, 25 bp, Homo sapien
ataccctatagttaaaaaatgtaca

SEQ ID NO: 28206 - DNA, 25 bp, Homo sapien
ataccctatggttaaaaaatgtaca

SEQ ID NO: 28207 - DNA, 25 bp, Homo sapien
ataccctgcaagggatccattttca

SEQ ID NO: 28208 - DNA, 25 bp, Homo sapien
ataccctgcaaggggtccattttca

SEQ ID NO: 28209 - DNA, 25 bp, Homo sapien
ataccgagcgtaaaaaatgaatata

SEQ ID NO: 28210 - DNA, 25 bp, Homo sapien
ataccgagtgtaaaaaatgaatata

SEQ ID NO: 28211 - DNA, 25 bp, Homo sapien
ataccgtttcattgcctccgattta

SEQ ID NO: 28212 - DNA, 25 bp, Homo sapien
ataccgtttcatttcctccgattta

SEQ ID NO: 28213 - DNA, 25 bp, Homo sapien
atacctaacagcttatctgtctctt

SEQ ID NO: 28214 - DNA, 25 bp, Homo sapien
atacctaacctctcagcattgactc

SEQ ID NO: 28215 - DNA, 25 bp, Homo sapien
atacctaacctttcagcattgactc

SEQ ID NO: 28216 - DNA, 25 bp, Homo sapien
atacctaatagcttatctgtctctt

SEQ ID NO: 28217 - DNA, 25 bp, Homo sapien
atacctaatataatgtctgatactc

SEQ ID NO: 28218 - DNA, 25 bp, Homo sapien
atacctaatgtaatgtctgatactc

SEQ ID NO: 28219 - DNA, 25 bp, Homo sapien
atacctagaaaaagaaccgctgcat

SEQ ID NO: 28220 - DNA, 25 bp, Homo sapien
atacctagaaatagaaccgctgcat

SEQ ID NO: 28221 - DNA, 25 bp, Homo sapien
atacctagagagctcagtaaccatg

SEQ ID NO: 28222 - DNA, 25 bp, Homo sapien
atacctagcgagctcagtaaccatg

SEQ ID NO: 28223 - DNA, 25 bp, Homo sapien
atacctagcgtcagattcttttctg

SEQ ID NO: 28224 - DNA, 25 bp, Homo sapien
atacctagcttcagattcttttctg

SEQ ID NO: 28225 - DNA, 25 bp, Homo sapien
atacctatcgataaatatgtgtgtg

SEQ ID NO: 28226 - DNA, 25 bp, Homo sapien
atacctatcgataagtatgtgtgtg

SEQ ID NO: 28227 - DNA, 25 bp, Homo sapien
atacctcaatttatttcacttggtt

SEQ ID NO: 28228 - DNA, 25 bp, Homo sapien
atacctcattttatttcacttggtt

SEQ ID NO: 28229 - DNA, 25 bp, Homo sapien
atacctccaattgtaaacacctaaa

SEQ ID NO: 28230 - DNA, 25 bp, Homo sapien
atacctccagttgtaaacacctaaa

SEQ ID NO: 28231 - DNA, 25 bp, Homo sapien
atacctcgtgccaatccatcatgtc

SEQ ID NO: 28232 - DNA, 25 bp, Homo sapien
atacctcgtgccaatctatcatgtc

SEQ ID NO: 28233 - DNA, 25 bp, Homo sapien
atacctgacaaaagagattctaaag

SEQ ID NO: 28234 - DNA, 25 bp, Homo sapien
atacctgacaaaattgcgtgatatg

SEQ ID NO: 28235 - DNA, 25 bp, Homo sapien
atacctgacaaaattgtgtgatatg

SEQ ID NO: 28236 - DNA, 25 bp, Homo sapien
atacctgacgaaagagattctaaag

SEQ ID NO: 28237 - DNA, 25 bp, Homo sapien
atacctgatgacctaatctttttat

SEQ ID NO: 28238 - DNA, 25 bp, Homo sapien
atacctgatgacgtaatctttttat

SEQ ID NO: 28239 - DNA, 25 bp, Homo sapien
atacctgcaaaagtaaaaaacacca

SEQ ID NO: 28240 - DNA, 25 bp, Homo sapien
atacctgcaaaagtcaaaaacacca

SEQ ID NO: 28241 - DNA, 25 bp, Homo sapien
atacctgcgcaaatcgctatcactg

SEQ ID NO: 28242 - DNA, 25 bp, Homo sapien
atacctgctaacgcaatctagctaa

SEQ ID NO: 28243 - DNA, 25 bp, Homo sapien
atacctgctaacggaatctagctaa

SEQ ID NO: 28244 - DNA, 25 bp, Homo sapien
atacctgctatttgctgtttgtctt

SEQ ID NO: 28245 - DNA, 25 bp, Homo sapien
atacctgctattttctgtttgtctt

SEQ ID NO: 28246 - DNA, 25 bp, Homo sapien
atacctgctcaaatcgctatcactg

SEQ ID NO: 28247 - DNA, 25 bp, Homo sapien
atacctggcatcgaatctataaact

SEQ ID NO: 28248 - DNA, 25 bp, Homo sapien
atacctggcatctaatctataaact

SEQ ID NO: 28249 - DNA, 25 bp, Homo sapien
atacctggctcaatacattactgga

SEQ ID NO: 28250 - DNA, 25 bp, Homo sapien
atacctggctcaatccattactgga

SEQ ID NO: 28251 - DNA, 25 bp, Homo sapien
atacctgggatatctgggatatcgg

SEQ ID NO: 28252 - DNA, 25 bp, Homo sapien
atacctgggttatctgggatatcgg

SEQ ID NO: 28253 - DNA, 25 bp, Homo sapien
atacctgtatctcttcacagtcatg

SEQ ID NO: 28254 - DNA, 25 bp, Homo sapien
atacctgtatctcttcgcagtcatg

SEQ ID NO: 28255 - DNA, 25 bp, Homo sapien
atacctgtcatcctagagaaaaaac

SEQ ID NO: 28256 - DNA, 25 bp, Homo sapien
atacctgtcatcttagagaaaaaac

SEQ ID NO: 28257 - DNA, 25 bp, Homo sapien
atacctgtgtccatgtaagttattt

SEQ ID NO: 28258 - DNA, 25 bp, Homo sapien
atacctgtgtccctgtaagttattt

SEQ ID NO: 28259 - DNA, 25 bp, Homo sapien
atacctgttgaacgaaacattttca

SEQ ID NO: 28260 - DNA, 25 bp, Homo sapien
atacctgttgaatgaaacattttca

SEQ ID NO: 28261 - DNA, 25 bp, Homo sapien
ataccttgcctggctaaactttatt

SEQ ID NO: 28262 - DNA, 25 bp, Homo sapien
ataccttgcctggctatactttatt

SEQ ID NO: 28263 - DNA, 25 bp, Homo sapien
atacctttaatgcaactccatcaaa

SEQ ID NO: 28264 - DNA, 25 bp, Homo sapien
atacctttaatgcacctccatcaaa

SEQ ID NO: 28265 - DNA, 25 bp, Homo sapien
ataccttttgatagaagacacgttt

SEQ ID NO: 28266 - DNA, 25 bp, Homo sapien
atacctttttatagaagacacgttt

SEQ ID NO: 28267 - DNA, 25 bp, Homo sapien
atacgaatccctccttgtcagctgc

SEQ ID NO: 28268 - DNA, 25 bp, Homo sapien
atacgaatctctccttgtcagctgc

SEQ ID NO: 28269 - DNA, 25 bp, Homo sapien
atacgacaacggctgaggaatgttg

SEQ ID NO: 28270 - DNA, 25 bp, Homo sapien
atacgacaatggctgaggaatgttg

SEQ ID NO: 28271 - DNA, 25 bp, Homo sapien
atacgagtctgtgaaattcaagctt

SEQ ID NO: 28272 - DNA, 25 bp, Homo sapien
atacgagtttgtgaaattcaagctt

SEQ ID NO: 28273 - DNA, 25 bp, Homo sapien
atacgatgaaaaccaaggattcaaa

SEQ ID NO: 28274 - DNA, 25 bp, Homo sapien
atacgatgaaaagcaaggattcaaa

SEQ ID NO: 28275 - DNA, 25 bp, Homo sapien
atacgctactgatagaatgtaaatt

SEQ ID NO: 28276 - DNA, 25 bp, Homo sapien
atacgctactgatggaatgtaaatt

SEQ ID NO: 28277 - DNA, 25 bp, Homo sapien
atacgctcaatactaaatagttctc

SEQ ID NO: 28278 - DNA, 25 bp, Homo sapien
atacgctcaatactaagtagttctc

SEQ ID NO: 28279 - DNA, 25 bp, Homo sapien
atacgcttttcaaactttttgtgtt

SEQ ID NO: 28280 - DNA, 25 bp, Homo sapien
atacgcttttcatactttttgtgtt

SEQ ID NO: 28281 - DNA, 25 bp, Homo sapien
atacgggctcttttccgttctatat

SEQ ID NO: 28282 - DNA, 25 bp, Homo sapien
atacgggctctttttcgttctatat

SEQ ID NO: 28283 - DNA, 25 bp, Homo sapien
atacgtaacaaaatatgttcaagat

SEQ ID NO: 28284 - DNA, 25 bp, Homo sapien
atacgtaacaaagtatgttcaagat

SEQ ID NO: 28285 - DNA, 25 bp, Homo sapien
atacgtatgaacgatacagtttact

SEQ ID NO: 28286 - DNA, 25 bp, Homo sapien
atacgtatgaatgatacagtttact

SEQ ID NO: 28287 - DNA, 25 bp, Homo sapien
atacgtctcaaagcagttcctcaga

SEQ ID NO: 28288 - DNA, 25 bp, Homo sapien
atacgtctcaaagcggttcctcaga

SEQ ID NO: 28289 - DNA, 25 bp, Homo sapien
atacgtgcacaacgggacatagacc

SEQ ID NO: 28290 - DNA, 25 bp, Homo sapien
atacgtgcacaatgggacatagacc

SEQ ID NO: 28291 - DNA, 25 bp, Homo sapien
atacgtgtcaggattcatctggaac

SEQ ID NO: 28292 - DNA, 25 bp, Homo sapien
atacgtgtgaggattcatctggaac

SEQ ID NO: 28293 - DNA, 25 bp, Homo sapien
atactaaataaacgcttggagtgcg

SEQ ID NO: 28294 - DNA, 25 bp, Homo sapien
atactaaataaatgcttggagtgcg

SEQ ID NO: 28295 - DNA, 25 bp, Homo sapien
atactaacatgccgtccatagcaga

SEQ ID NO: 28296 - DNA, 25 bp, Homo sapien
atactaacatgctgtccatagcaga

SEQ ID NO: 28297 - DNA, 25 bp, Homo sapien
atactaatgctatgcttctattttg

SEQ ID NO: 28298 - DNA, 25 bp, Homo sapien
atactaatgctgtgcttctattttg

SEQ ID NO: 28299 - DNA, 25 bp, Homo sapien
atactacacatgaccgctatactat

SEQ ID NO: 28300 - DNA, 25 bp, Homo sapien
atactacacatgcccgctatactat

SEQ ID NO: 28301 - DNA, 25 bp, Homo sapien
atactacagggaaacaaaccaaaac

SEQ ID NO: 28302 - DNA, 25 bp, Homo sapien
atactacagggaagcaaaccaaaac

SEQ ID NO: 28303 - DNA, 25 bp, Homo sapien
atactacgcactgtttcgtgtaagg

SEQ ID NO: 28304 - DNA, 25 bp, Homo sapien
atactacgcactgttttgtgtaagg

SEQ ID NO: 28305 - DNA, 25 bp, Homo sapien
atactactgcacacctgtgaagcca

SEQ ID NO: 28306 - DNA, 25 bp, Homo sapien
atactactgtacacctgtgaagcca

SEQ ID NO: 28307 - DNA, 25 bp, Homo sapien
atactagaaatgtatagcctttgtc

SEQ ID NO: 28308 - DNA, 25 bp, Homo sapien
atactagaaatttatagcctttgtc

SEQ ID NO: 28309 - DNA, 25 bp, Homo sapien
atactagcagtagaggattcagaag

SEQ ID NO: 28310 - DNA, 25 bp, Homo sapien
atactagccacatagaataagtttg

SEQ ID NO: 28311 - DNA, 25 bp, Homo sapien
atactagccacgtagaataagtttg

SEQ ID NO: 28312 - DNA, 25 bp, Homo sapien
atactagcggtagaggattcagaag

SEQ ID NO: 28313 - DNA, 25 bp, Homo sapien
atactagtaatcactcactctgcta

SEQ ID NO: 28314 - DNA, 25 bp, Homo sapien
atactagtaatcactctctctgcta

SEQ ID NO: 28315 - DNA, 25 bp, Homo sapien
atactatgtggcaacaaatggtgga

SEQ ID NO: 28316 - DNA, 25 bp, Homo sapien
atactatgtggcaataaatggtgga

SEQ ID NO: 28317 - DNA, 25 bp, Homo sapien
atactatgtttggcaagcatgtggg

SEQ ID NO: 28318 - DNA, 25 bp, Homo sapien
atactatgtttggtaagcatgtggg

SEQ ID NO: 28319 - DNA, 25 bp, Homo sapien
atactattcataacaaccctcaact

SEQ ID NO: 28320 - DNA, 25 bp, Homo sapien
atactattccaaaaacaatgcccgc

SEQ ID NO: 28321 - DNA, 25 bp, Homo sapien
atactattccaaagacaatgcccgc

SEQ ID NO: 28322 - DNA, 25 bp, Homo sapien
atactattcctaacaaccctcaact

SEQ ID NO: 28323 - DNA, 25 bp, Homo sapien
atactatttacattaacaccaaaca

SEQ ID NO: 28324 - DNA, 25 bp, Homo sapien
atactatttacgttaacaccaaaca

SEQ ID NO: 28325 - DNA, 25 bp, Homo sapien
atactcaaactgttcttaggaaatt

SEQ ID NO: 28326 - DNA, 25 bp, Homo sapien
atactcaaacttttcttaggaaatt

SEQ ID NO: 28327 - DNA, 25 bp, Homo sapien
atactcaaatgctcgtaagaatatg

SEQ ID NO: 28328 - DNA, 25 bp, Homo sapien
atactcaaatgcttgtaagaatatg

SEQ ID NO: 28329 - DNA, 25 bp, Homo sapien
atactcacaggctccagggttaagg

SEQ ID NO: 28330 - DNA, 25 bp, Homo sapien
atactcacgggctccagggttaagg

SEQ ID NO: 28331 - DNA, 25 bp, Homo sapien
atactcagatttgatataagaggac

SEQ ID NO: 28332 - DNA, 25 bp, Homo sapien
atactcagatttggtataagaggac

SEQ ID NO: 28333 - DNA, 25 bp, Homo sapien
atactcatcatatcagtgattggct

SEQ ID NO: 28334 - DNA, 25 bp, Homo sapien
atactcatcgtatcagtgattggct

SEQ ID NO: 28335 - DNA, 25 bp, Homo sapien
atactcatctgtacaaacaaggcct

SEQ ID NO: 28336 - DNA, 25 bp, Homo sapien
atactcatgtgtacaaacaaggcct

SEQ ID NO: 28337 - DNA, 25 bp, Homo sapien
atactccaaagcccgcttatgagat

SEQ ID NO: 28338 - DNA, 25 bp, Homo sapien
atactccaaaggccgcttatgagat

SEQ ID NO: 28339 - DNA, 25 bp, Homo sapien
atactcctcagtccatgaaaccaaa

SEQ ID NO: 28340 - DNA, 25 bp, Homo sapien
atactcctgagtccatgaaaccaaa

SEQ ID NO: 28341 - DNA, 25 bp, Homo sapien
atactcctttttcctatccttgctg

SEQ ID NO: 28342 - DNA, 25 bp, Homo sapien
atactcctttttcttatccttgctg

SEQ ID NO: 28343 - DNA, 25 bp, Homo sapien
atactcggtctccttaattcaggat

SEQ ID NO: 28344 - DNA, 25 bp, Homo sapien
atactcggtcttcttaattcaggat

SEQ ID NO: 28345 - DNA, 25 bp, Homo sapien
atactctacggactgaaacacaata

SEQ ID NO: 28346 - DNA, 25 bp, Homo sapien
atactctactggattgctttacata

SEQ ID NO: 28347 - DNA, 25 bp, Homo sapien
atactctactggtttgctttacata

SEQ ID NO: 28348 - DNA, 25 bp, Homo sapien
atactctatggactgaaacacaata

SEQ ID NO: 28349 - DNA, 25 bp, Homo sapien
atactctcatcttctgacaaaacca

SEQ ID NO: 28350 - DNA, 25 bp, Homo sapien
atactctccatccatagccattcct

SEQ ID NO: 28351 - DNA, 25 bp, Homo sapien
atactctcgtcttctgacaaaacca

SEQ ID NO: 28352 - DNA, 25 bp, Homo sapien
atactctctatccatagccattcct

SEQ ID NO: 28353 - DNA, 25 bp, Homo sapien
atactctggctgtaactcactgaaa

SEQ ID NO: 28354 - DNA, 25 bp, Homo sapien
atactctggctgtgactcactgaaa

SEQ ID NO: 28355 - DNA, 25 bp, Homo sapien
atactcttaccagtcaataaggcag

SEQ ID NO: 28356 - DNA, 25 bp, Homo sapien
atactcttaccggtcaataaggcag

SEQ ID NO: 28357 - DNA, 25 bp, Homo sapien
atactcttcttagaaacgtcagaat

SEQ ID NO: 28358 - DNA, 25 bp, Homo sapien
atactcttcttagaaatgtcagaat

SEQ ID NO: 28359 - DNA, 25 bp, Homo sapien
atactcttgatcatatcacagattg

SEQ ID NO: 28360 - DNA, 25 bp, Homo sapien
atactcttgatcgtatcacagattg

SEQ ID NO: 28361 - DNA, 25 bp, Homo sapien
atactcttgcggttttgtgaatcta

SEQ ID NO: 28362 - DNA, 25 bp, Homo sapien
atactcttgtggttttgtgaatcta

SEQ ID NO: 28363 - DNA, 25 bp, Homo sapien
atactgagcgtccactctgtgcctg

SEQ ID NO: 28364 - DNA, 25 bp, Homo sapien
atactgagcgtctactctgtgcctg

SEQ ID NO: 28365 - DNA, 25 bp, Homo sapien
atactgcaagccaatgaggtccaca

SEQ ID NO: 28366 - DNA, 25 bp, Homo sapien
atactgcaagccgatgaggtccaca

SEQ ID NO: 28367 - DNA, 25 bp, Homo sapien
atactgcaattactgatatggatat

SEQ ID NO: 28368 - DNA, 25 bp, Homo sapien
atactgcagttactgatatggatat

SEQ ID NO: 28369 - DNA, 25 bp, Homo sapien
atactggaatgcataagattaatga

SEQ ID NO: 28370 - DNA, 25 bp, Homo sapien
atactggaatggataagattaatga

SEQ ID NO: 28371 - DNA, 25 bp, Homo sapien
atactggatcataaaggccaacttc

SEQ ID NO: 28372 - DNA, 25 bp, Homo sapien
atactggattagagtaggccttaag

SEQ ID NO: 28373 - DNA, 25 bp, Homo sapien
atactggattagcgtaggccttaag

SEQ ID NO: 28374 - DNA, 25 bp, Homo sapien
atactggattataaaggccaacttc

SEQ ID NO: 28375 - DNA, 25 bp, Homo sapien
atactggggagatgcaattcagccc

SEQ ID NO: 28376 - DNA, 25 bp, Homo sapien
atactggggagatgcatttcagccc

SEQ ID NO: 28377 - DNA, 25 bp, Homo sapien
atactgtaagcaaaattccacgctc

SEQ ID NO: 28378 - DNA, 25 bp, Homo sapien
atactgtaagcagaattccacgctc

SEQ ID NO: 28379 - DNA, 25 bp, Homo sapien
atactgttcggatctgccaaagtct

SEQ ID NO: 28380 - DNA, 25 bp, Homo sapien
atactgtttggatctgccaaagtct

SEQ ID NO: 28381 - DNA, 25 bp, Homo sapien
atactgttttggttaacgtactctt

SEQ ID NO: 28382 - DNA, 25 bp, Homo sapien
atactgttttggttaatgtactctt

SEQ ID NO: 28383 - DNA, 25 bp, Homo sapien
atactgttttttttgcggcacacag

SEQ ID NO: 28384 - DNA, 25 bp, Homo sapien
atactgttttttttgctgcacacag

SEQ ID NO: 28385 - DNA, 25 bp, Homo sapien
atacttaatttgcgtttctttaatt

SEQ ID NO: 28386 - DNA, 25 bp, Homo sapien
atacttaatttgtgtttctttaatt

SEQ ID NO: 28387 - DNA, 25 bp, Homo sapien
atacttaccatgcaatacttttcca

SEQ ID NO: 28388 - DNA, 25 bp, Homo sapien
atacttaccatgcagtacttttcca

SEQ ID NO: 28389 - DNA, 25 bp, Homo sapien
atacttacctccatataatacattc

SEQ ID NO: 28390 - DNA, 25 bp, Homo sapien
atacttacctccatgtaatacattc

SEQ ID NO: 28391 - DNA, 25 bp, Homo sapien
atacttactgtaacagagcttgatt

SEQ ID NO: 28392 - DNA, 25 bp, Homo sapien
atacttactgtaatagagcttgatt

SEQ ID NO: 28393 - DNA, 25 bp, Homo sapien
atacttagacatctttgaattttca

SEQ ID NO: 28394 - DNA, 25 bp, Homo sapien
atacttagacatgtttgaattttca

SEQ ID NO: 28395 - DNA, 25 bp, Homo sapien
atacttatatggccaatagcgttta

SEQ ID NO: 28396 - DNA, 25 bp, Homo sapien
atacttatcgcgtttccatcataac

SEQ ID NO: 28397 - DNA, 25 bp, Homo sapien
atacttatctcgtttccatcataac

SEQ ID NO: 28398 - DNA, 25 bp, Homo sapien
atacttatttggccaatagcgttta

SEQ ID NO: 28399 - DNA, 25 bp, Homo sapien
atacttcaaacaattcctttaaact

SEQ ID NO: 28400 - DNA, 25 bp, Homo sapien
atacttcaaaccattcctttaaact

SEQ ID NO: 28401 - DNA, 25 bp, Homo sapien
atacttcacaactactagggtggct

SEQ ID NO: 28402 - DNA, 25 bp, Homo sapien
atacttcacaactgctagggtggct

SEQ ID NO: 28403 - DNA, 25 bp, Homo sapien
atacttcaggcttcacaggccatgc

SEQ ID NO: 28404 - DNA, 25 bp, Homo sapien
atacttcaggcttcgcaggccatgc

SEQ ID NO: 28405 - DNA, 25 bp, Homo sapien
atacttccaatatcatattcattgt

SEQ ID NO: 28406 - DNA, 25 bp, Homo sapien
atacttccgatatcatattcattgt

SEQ ID NO: 28407 - DNA, 25 bp, Homo sapien
atacttgacatttgaagaaactagg

SEQ ID NO: 28408 - DNA, 25 bp, Homo sapien
atacttgacattttaagaaactagg

SEQ ID NO: 28409 - DNA, 25 bp, Homo sapien
atacttgacttttatattcaatgga

SEQ ID NO: 28410 - DNA, 25 bp, Homo sapien
atacttgatttttatattcaatgga

SEQ ID NO: 28411 - DNA, 25 bp, Homo sapien
atacttggcgcatgctattcttaag

SEQ ID NO: 28412 - DNA, 25 bp, Homo sapien
atacttggtgcatgctattcttaag

SEQ ID NO: 28413 - DNA, 25 bp, Homo sapien
atacttgtacgctaggaattttctc

SEQ ID NO: 28414 - DNA, 25 bp, Homo sapien
atacttgtacgctaggcattttctc

SEQ ID NO: 28415 - DNA, 25 bp, Homo sapien
atacttgtgcctcgattccagaagt

SEQ ID NO: 28416 - DNA, 25 bp, Homo sapien
atacttgtgccttgattccagaagt

SEQ ID NO: 28417 - DNA, 25 bp, Homo sapien
atactttaaatacactctaggcaat

SEQ ID NO: 28418 - DNA, 25 bp, Homo sapien
atactttaaatactctctaggcaat

SEQ ID NO: 28419 - DNA, 25 bp, Homo sapien
atactttagcccaaaaagaaagcca

SEQ ID NO: 28420 - DNA, 25 bp, Homo sapien
atactttagcccataaagaaagcca

SEQ ID NO: 28421 - DNA, 25 bp, Homo sapien
atactttcaggcccaacaatactgg

SEQ ID NO: 28422 - DNA, 25 bp, Homo sapien
atactttcaggtccaacaatactgg

SEQ ID NO: 28423 - DNA, 25 bp, Homo sapien
atactttcatagaatagaacaggac

SEQ ID NO: 28424 - DNA, 25 bp, Homo sapien
atactttcatagactagaacaggac

SEQ ID NO: 28425 - DNA, 25 bp, Homo sapien
atactttccaacatcgattttgatt

SEQ ID NO: 28426 - DNA, 25 bp, Homo sapien
atactttccaacgtcgattttgatt

SEQ ID NO: 28427 - DNA, 25 bp, Homo sapien
atactttcttactcccttgacggtg

SEQ ID NO: 28428 - DNA, 25 bp, Homo sapien
atactttcttactctcttgacggtg

SEQ ID NO: 28429 - DNA, 25 bp, Homo sapien
atactttgaaatacagaaaatcaga

SEQ ID NO: 28430 - DNA, 25 bp, Homo sapien
atactttgaaatacggaaaatcaga

SEQ ID NO: 28431 - DNA, 25 bp, Homo sapien
atactttgacaaaagtgccacaatg

SEQ ID NO: 28432 - DNA, 25 bp, Homo sapien
atactttgacagaagtgccacaatg

SEQ ID NO: 28433 - DNA, 25 bp, Homo sapien
atactttgctgcaactaattttttc

SEQ ID NO: 28434 - DNA, 25 bp, Homo sapien
atactttgctgcaattaattttttc

SEQ ID NO: 28435 - DNA, 25 bp, Homo sapien
atactttggttcaaaagcggggttc

SEQ ID NO: 28436 - DNA, 25 bp, Homo sapien
atactttggtttaaaagcggggttc

SEQ ID NO: 28437 - DNA, 25 bp, Homo sapien
atacttttatacatgaaatgggtcc

SEQ ID NO: 28438 - DNA, 25 bp, Homo sapien
atacttttatacgtgaaatgggtcc

SEQ ID NO: 28439 - DNA, 25 bp, Homo sapien
atactttttcagctctgaagtttca

SEQ ID NO: 28440 - DNA, 25 bp, Homo sapien
atactttttcagttctgaagtttca

SEQ ID NO: 28441 - DNA, 25 bp, Homo sapien
atactttttggtttcctggcttcta

SEQ ID NO: 28442 - DNA, 25 bp, Homo sapien
atacttttttgtttcctggcttcta

SEQ ID NO: 28443 - DNA, 25 bp, Homo sapien
atagaaaaaatcgacatatttgact

SEQ ID NO: 28444 - DNA, 25 bp, Homo sapien
atagaaaaaatcggcatatttgact

SEQ ID NO: 28445 - DNA, 25 bp, Homo sapien
atagaaaaagataatcaaagtgtaa

SEQ ID NO: 28446 - DNA, 25 bp, Homo sapien
atagaaaagccaatcctttaagtgg

SEQ ID NO: 28447 - DNA, 25 bp, Homo sapien
atagaaaaggaaagagtaactacaa

SEQ ID NO: 28448 - DNA, 25 bp, Homo sapien
atagaaaaggataatcaaagtgtaa

SEQ ID NO: 28449 - DNA, 25 bp, Homo sapien
atagaaaagtaaagagtaactacaa

SEQ ID NO: 28450 - DNA, 25 bp, Homo sapien
atagaaaagtcaatcctttaagtgg

SEQ ID NO: 28451 - DNA, 25 bp, Homo sapien
atagaaacaaagtgcgaagttcaga

SEQ ID NO: 28452 - DNA, 25 bp, Homo sapien
atagaaacaaagtgtgaagttcaga

SEQ ID NO: 28453 - DNA, 25 bp, Homo sapien
atagaaacttacacccattgattag

SEQ ID NO: 28454 - DNA, 25 bp, Homo sapien
atagaaacttacgcccattgattag

SEQ ID NO: 28455 - DNA, 25 bp, Homo sapien
atagaaagaaaacggcaagctggga

SEQ ID NO: 28456 - DNA, 25 bp, Homo sapien
atagaaagaaaatggcaagctggga

SEQ ID NO: 28457 - DNA, 25 bp, Homo sapien
atagaaagaagaaattgaagatgtt

SEQ ID NO: 28458 - DNA, 25 bp, Homo sapien
atagaaagaagagattgaagatgtt

SEQ ID NO: 28459 - DNA, 25 bp, Homo sapien
atagaaagaattaggtaatgtggcc

SEQ ID NO: 28460 - DNA, 25 bp, Homo sapien
atagaaagaattagttaatgtggcc

SEQ ID NO: 28461 - DNA, 25 bp, Homo sapien
atagaaagacgatagagataatatc

SEQ ID NO: 28462 - DNA, 25 bp, Homo sapien
atagaaagatgatagagataatatc

SEQ ID NO: 28463 - DNA, 25 bp, Homo sapien
atagaaagcgtaggttgattgattc

SEQ ID NO: 28464 - DNA, 25 bp, Homo sapien
atagaaagggtaggttgattgattc

SEQ ID NO: 28465 - DNA, 25 bp, Homo sapien
atagaacaccctgcaactgagcaaa

SEQ ID NO: 28466 - DNA, 25 bp, Homo sapien
atagaacaccctgcaattgagcaaa

SEQ ID NO: 28467 - DNA, 25 bp, Homo sapien
atagaacctataatcaacttttaat

SEQ ID NO: 28468 - DNA, 25 bp, Homo sapien
atagaacctatagtcaacttttaat

SEQ ID NO: 28469 - DNA, 25 bp, Homo sapien
atagaacttgaaaacgggccttgtg

SEQ ID NO: 28470 - DNA, 25 bp, Homo sapien
atagaacttgaaaatgggccttgtg

SEQ ID NO: 28471 - DNA, 25 bp, Homo sapien
atagaagaatgacgagagaaacgca

SEQ ID NO: 28472 - DNA, 25 bp, Homo sapien
atagaagaatgatgagagaaacgca

SEQ ID NO: 28473 - DNA, 25 bp, Homo sapien
atagaagacaatttaggagcctttc

SEQ ID NO: 28474 - DNA, 25 bp, Homo sapien
atagaagacgatttaggagcctttc

SEQ ID NO: 28475 - DNA, 25 bp, Homo sapien
atagaaggaaaagtcagggaaatgt

SEQ ID NO: 28476 - DNA, 25 bp, Homo sapien
atagaaggaaatgtcagggaaatgt

SEQ ID NO: 28477 - DNA, 25 bp, Homo sapien
atagaaggacaattctactcagtga

SEQ ID NO: 28478 - DNA, 25 bp, Homo sapien
atagaaggacagttctactcagtga

SEQ ID NO: 28479 - DNA, 25 bp, Homo sapien
atagaaggtagggcactacagaaca

SEQ ID NO: 28480 - DNA, 25 bp, Homo sapien
atagaaggtagggcgctacagaaca

SEQ ID NO: 28481 - DNA, 25 bp, Homo sapien
atagaagtcacaacatatccagttc

SEQ ID NO: 28482 - DNA, 25 bp, Homo sapien
atagaagtcgcaacatatccagttc

SEQ ID NO: 28483 - DNA, 25 bp, Homo sapien
atagaatagcaataaaacctacttc

SEQ ID NO: 28484 - DNA, 25 bp, Homo sapien
atagaatagcaattaaacctacttc

SEQ ID NO: 28485 - DNA, 25 bp, Homo sapien
atagaatagttttctcagaacttgt

SEQ ID NO: 28486 - DNA, 25 bp, Homo sapien
atagaatatttttctcagaacttgt

SEQ ID NO: 28487 - DNA, 25 bp, Homo sapien
atagaatcacagcaaccttaggtga

SEQ ID NO: 28488 - DNA, 25 bp, Homo sapien
atagaatcatagcaaccttaggtga

SEQ ID NO: 28489 - DNA, 25 bp, Homo sapien
atagaatcttgccctgtcttccagg

SEQ ID NO: 28490 - DNA, 25 bp, Homo sapien
atagaatcttgctctgtcttccagg

SEQ ID NO: 28491 - DNA, 25 bp, Homo sapien
atagaatgagtgattaaaaccagga

SEQ ID NO: 28492 - DNA, 25 bp, Homo sapien
atagaatgagtggttaaaaccagga

SEQ ID NO: 28493 - DNA, 25 bp, Homo sapien
atagaattagcgaaacagaaaagta

SEQ ID NO: 28494 - DNA, 25 bp, Homo sapien
atagaattagctaaacagaaaagta

SEQ ID NO: 28495 - DNA, 25 bp, Homo sapien
atagaattcacataggattcatgaa

SEQ ID NO: 28496 - DNA, 25 bp, Homo sapien
atagaattcacgtaggattcatgaa

SEQ ID NO: 28497 - DNA, 25 bp, Homo sapien
atagaattcaggaactcagttgaag

SEQ ID NO: 28498 - DNA, 25 bp, Homo sapien
atagaattcaggtactcagttgaag

SEQ ID NO: 28499 - DNA, 25 bp, Homo sapien
atagacactaaaaaaaaatttgaag

SEQ ID NO: 28500 - DNA, 25 bp, Homo sapien
atagacactgaaaaaaaatttgaag

SEQ ID NO: 28501 - DNA, 25 bp, Homo sapien
atagacactgacgttcagttttgct

SEQ ID NO: 28502 - DNA, 25 bp, Homo sapien
atagacactgatgttcagttttgct

SEQ ID NO: 28503 - DNA, 25 bp, Homo sapien
atagacagaattgtatcctctctgc

SEQ ID NO: 28504 - DNA, 25 bp, Homo sapien
atagacagaattgtgtcctctctgc

SEQ ID NO: 28505 - DNA, 25 bp, Homo sapien
atagacatcctggcagctaagtcag

SEQ ID NO: 28506 - DNA, 25 bp, Homo sapien
atagacatcttggcagctaagtcag

SEQ ID NO: 28507 - DNA, 25 bp, Homo sapien
atagacatttcaatagttgcccagc

SEQ ID NO: 28508 - DNA, 25 bp, Homo sapien
atagacatttcagtagttgcccagc

SEQ ID NO: 28509 - DNA, 25 bp, Homo sapien
atagaccacggcttcagcctgcctc

SEQ ID NO: 28510 - DNA, 25 bp, Homo sapien
atagaccatggcttcagcctgcctc

SEQ ID NO: 28511 - DNA, 25 bp, Homo sapien
atagacctgcacatatagaatcaat

SEQ ID NO: 28512 - DNA, 25 bp, Homo sapien
atagacctgcacgtatagaatcaat

SEQ ID NO: 28513 - DNA, 25 bp, Homo sapien
atagaccttccatgtcctctctggg

SEQ ID NO: 28514 - DNA, 25 bp, Homo sapien
atagaccttccatgtcgtctctggg

SEQ ID NO: 28515 - DNA, 25 bp, Homo sapien
atagactacgcattctcttatttat

SEQ ID NO: 28516 - DNA, 25 bp, Homo sapien
atagactatgcattctcttatttat

SEQ ID NO: 28517 - DNA, 25 bp, Homo sapien
atagacttattgcgaagaatgtact

SEQ ID NO: 28518 - DNA, 25 bp, Homo sapien
atagacttattgtgaagaatgtact

SEQ ID NO: 28519 - DNA, 25 bp, Homo sapien
atagacttctaaaattcactgtgat

SEQ ID NO: 28520 - DNA, 25 bp, Homo sapien
atagacttctaaaatttactgtgat

SEQ ID NO: 28521 - DNA, 25 bp, Homo sapien
atagactttcatgtaacggaaatgg

SEQ ID NO: 28522 - DNA, 25 bp, Homo sapien
atagactttcatttaacggaaatgg

SEQ ID NO: 28523 - DNA, 25 bp, Homo sapien
atagagaaaacactgtattggttaa

SEQ ID NO: 28524 - DNA, 25 bp, Homo sapien
atagagaaaacgctgtattggttaa

SEQ ID NO: 28525 - DNA, 25 bp, Homo sapien
atagagaagcaccctgaagcctggt

SEQ ID NO: 28526 - DNA, 25 bp, Homo sapien
atagagaagcatcctgaagcctggt

SEQ ID NO: 28527 - DNA, 25 bp, Homo sapien
atagagaatatccaaattgaagtcg

SEQ ID NO: 28528 - DNA, 25 bp, Homo sapien
atagagaatatccgaattgaagtcg

SEQ ID NO: 28529 - DNA, 25 bp, Homo sapien
atagagacattcagccaaggataac

SEQ ID NO: 28530 - DNA, 25 bp, Homo sapien
atagagacgttcagccaaggataac

SEQ ID NO: 28531 - DNA, 25 bp, Homo sapien
atagagacttaaaaagagcaacagt

SEQ ID NO: 28532 - DNA, 25 bp, Homo sapien
atagagacttaaatagagcaacagt

SEQ ID NO: 28533 - DNA, 25 bp, Homo sapien
atagagagcctgtataaaatggctg

SEQ ID NO: 28534 - DNA, 25 bp, Homo sapien
atagagagcctgtatacaatggctg

SEQ ID NO: 28535 - DNA, 25 bp, Homo sapien
atagagataagacagaggaaatata

SEQ ID NO: 28536 - DNA, 25 bp, Homo sapien
atagagataagactgaggaaatata

SEQ ID NO: 28537 - DNA, 25 bp, Homo sapien
atagagatgacacaattattttaga

SEQ ID NO: 28538 - DNA, 25 bp, Homo sapien
atagagatgacagaattattttaga

SEQ ID NO: 28539 - DNA, 25 bp, Homo sapien
atagagatgttaaccacttggttga

SEQ ID NO: 28540 - DNA, 25 bp, Homo sapien
atagagattttaaccacttggttga

SEQ ID NO: 28541 - DNA, 25 bp, Homo sapien
atagagattttcggttttatccatt

SEQ ID NO: 28542 - DNA, 25 bp, Homo sapien
atagagatttttggttttatccatt

SEQ ID NO: 28543 - DNA, 25 bp, Homo sapien
atagagcaaggcatggctaaaatac

SEQ ID NO: 28544 - DNA, 25 bp, Homo sapien
atagagcaaggcgtggctaaaatac

SEQ ID NO: 28545 - DNA, 25 bp, Homo sapien
atagagcacataagctttcacacag

SEQ ID NO: 28546 - DNA, 25 bp, Homo sapien
atagagcacgtaagctttcacacag

SEQ ID NO: 28547 - DNA, 25 bp, Homo sapien
atagagcatagctaattggcctaac

SEQ ID NO: 28548 - DNA, 25 bp, Homo sapien
atagagcatagcttattggcctaac

SEQ ID NO: 28549 - DNA, 25 bp, Homo sapien
atagagccacgtccagcatcactta

SEQ ID NO: 28550 - DNA, 25 bp, Homo sapien
atagagccatgtccagcatcactta

SEQ ID NO: 28551 - DNA, 25 bp, Homo sapien
atagagcctacataaattagagtta

SEQ ID NO: 28552 - DNA, 25 bp, Homo sapien
atagagcctacctaaattagagtta

SEQ ID NO: 28553 - DNA, 25 bp, Homo sapien
atagagcttaacgaaggaatagaaa

SEQ ID NO: 28554 - DNA, 25 bp, Homo sapien
atagagcttaatgaaggaatagaaa

SEQ ID NO: 28555 - DNA, 25 bp, Homo sapien
atagaggatgaagacagggtacaga

SEQ ID NO: 28556 - DNA, 25 bp, Homo sapien
atagaggatgacgacagggtacaga

SEQ ID NO: 28557 - DNA, 25 bp, Homo sapien
atagaggcatggtcttggaaatcta

SEQ ID NO: 28558 - DNA, 25 bp, Homo sapien
atagaggcatggttttggaaatcta

SEQ ID NO: 28559 - DNA, 25 bp, Homo sapien
atagaggctgatccctgtctgtaca

SEQ ID NO: 28560 - DNA, 25 bp, Homo sapien
atagaggctgatctctgtctgtaca

SEQ ID NO: 28561 - DNA, 25 bp, Homo sapien
atagaggtggacaatcataaaattg

SEQ ID NO: 28562 - DNA, 25 bp, Homo sapien
atagaggtggagaatcataaaattg

SEQ ID NO: 28563 - DNA, 25 bp, Homo sapien
atagagtaagtctaataaagcgtgg

SEQ ID NO: 28564 - DNA, 25 bp, Homo sapien
atagagtaagtctagtaaagcgtgg

SEQ ID NO: 28565 - DNA, 25 bp, Homo sapien
atagagtatatgaccagcacagttt

SEQ ID NO: 28566 - DNA, 25 bp, Homo sapien
atagagtatatgactagcacagttt

SEQ ID NO: 28567 - DNA, 25 bp, Homo sapien
atagagtctcccatgcatgcaggcc

SEQ ID NO: 28568 - DNA, 25 bp, Homo sapien
atagagtctcccgtgcatgcaggcc

SEQ ID NO: 28569 - DNA, 25 bp, Homo sapien
atagagtgcacagtatgttcaaagg

SEQ ID NO: 28570 - DNA, 25 bp, Homo sapien
atagagtgcacagtgtgttcaaagg

SEQ ID NO: 28571 - DNA, 25 bp, Homo sapien
atagagttcaaaaaaatcaagatag

SEQ ID NO: 28572 - DNA, 25 bp, Homo sapien
atagagttcaaagaaatcaagatag

SEQ ID NO: 28573 - DNA, 25 bp, Homo sapien
atagagttctcctttgatttgaact

SEQ ID NO: 28574 - DNA, 25 bp, Homo sapien
atagagttttcctttgatttgaact

SEQ ID NO: 28575 - DNA, 25 bp, Homo sapien
atagataaaaggtaggcatgagagc

SEQ ID NO: 28576 - DNA, 25 bp, Homo sapien
atagataaaaggtgggcatgagagc

SEQ ID NO: 28577 - DNA, 25 bp, Homo sapien
atagataagttcagaatagtcacaa

SEQ ID NO: 28578 - DNA, 25 bp, Homo sapien
atagataagttccgaatagtcacaa

SEQ ID NO: 28579 - DNA, 25 bp, Homo sapien
atagataataacttcctagtctaca

SEQ ID NO: 28580 - DNA, 25 bp, Homo sapien
atagataataatttcctagtctaca

SEQ ID NO: 28581 - DNA, 25 bp, Homo sapien
atagataatccaggatattctcctt

SEQ ID NO: 28582 - DNA, 25 bp, Homo sapien
atagataatccaggttattctcctt

SEQ ID NO: 28583 - DNA, 25 bp, Homo sapien
atagatacaaattcaggaaagcatc

SEQ ID NO: 28584 - DNA, 25 bp, Homo sapien
atagatacaatagctagatggagat

SEQ ID NO: 28585 - DNA, 25 bp, Homo sapien
atagatacgaattcaggaaagcatc

SEQ ID NO: 28586 - DNA, 25 bp, Homo sapien
atagatacgatagctagatggagat

SEQ ID NO: 28587 - DNA, 25 bp, Homo sapien
atagatagacaatttgccttaagat

SEQ ID NO: 28588 - DNA, 25 bp, Homo sapien
atagatagatacaaccatggagtcc

SEQ ID NO: 28589 - DNA, 25 bp, Homo sapien
atagatagatacaatagctagatgg

SEQ ID NO: 28590 - DNA, 25 bp, Homo sapien
atagatagatacgatagctagatgg

SEQ ID NO: 28591 - DNA, 25 bp, Homo sapien
atagatagatataaccatggagtcc

SEQ ID NO: 28592 - DNA, 25 bp, Homo sapien
atagatagtcaatttgccttaagat

SEQ ID NO: 28593 - DNA, 25 bp, Homo sapien
atagatatcctcacagtactcattc

SEQ ID NO: 28594 - DNA, 25 bp, Homo sapien
atagatatcctcacggtactcattc

SEQ ID NO: 28595 - DNA, 25 bp, Homo sapien
atagatcaaagagcaagctaaacag

SEQ ID NO: 28596 - DNA, 25 bp, Homo sapien
atagatcaaagagcgagctaaacag

SEQ ID NO: 28597 - DNA, 25 bp, Homo sapien
atagatcatagatgacagatatgta

SEQ ID NO: 28598 - DNA, 25 bp, Homo sapien
atagatcatagttgacagatatgta

SEQ ID NO: 28599 - DNA, 25 bp, Homo sapien
atagatcctcacattcattccctga

SEQ ID NO: 28600 - DNA, 25 bp, Homo sapien
atagatcctcagattcattccctga

SEQ ID NO: 28601 - DNA, 25 bp, Homo sapien
atagatctaacactggactgctttg

SEQ ID NO: 28602 - DNA, 25 bp, Homo sapien
atagatctaacattggactgctttg

SEQ ID NO: 28603 - DNA, 25 bp, Homo sapien
atagatctgatcatgaattctctta

SEQ ID NO: 28604 - DNA, 25 bp, Homo sapien
atagatctgatcgtgaattctctta

SEQ ID NO: 28605 - DNA, 25 bp, Homo sapien
atagatcttattatcaggcatatat

SEQ ID NO: 28606 - DNA, 25 bp, Homo sapien
atagatcttattatgaggcatatat

SEQ ID NO: 28607 - DNA, 25 bp, Homo sapien
atagatgaggacattttggactcag

SEQ ID NO: 28608 - DNA, 25 bp, Homo sapien
atagatgatgacattttggactcag

SEQ ID NO: 28609 - DNA, 25 bp, Homo sapien
atagatgctaataaacatttgggta

SEQ ID NO: 28610 - DNA, 25 bp, Homo sapien
atagatgctagaacttcactcccag

SEQ ID NO: 28611 - DNA, 25 bp, Homo sapien
atagatgctagagcttcactcccag

SEQ ID NO: 28612 - DNA, 25 bp, Homo sapien
atagatgctcataaacatttgggta

SEQ ID NO: 28613 - DNA, 25 bp, Homo sapien
atagatgcttatttatgacctttta

SEQ ID NO: 28614 - DNA, 25 bp, Homo sapien
atagatgcttatttgtgacctttta

SEQ ID NO: 28615 - DNA, 25 bp, Homo sapien
atagatggacatcgagatagagctg

SEQ ID NO: 28616 - DNA, 25 bp, Homo sapien
atagatggatatcgagatagagctg

SEQ ID NO: 28617 - DNA, 25 bp, Homo sapien
atagatgtaaagatgtatgtgtata

SEQ ID NO: 28618 - DNA, 25 bp, Homo sapien
atagatgtaaagcttcatttttttt

SEQ ID NO: 28619 - DNA, 25 bp, Homo sapien
atagatgtaaagcttcgtttttttt

SEQ ID NO: 28620 - DNA, 25 bp, Homo sapien
atagatgtaaaggtgtatgtgtata

SEQ ID NO: 28621 - DNA, 25 bp, Homo sapien
atagatgtacagaaagctaattaaa

SEQ ID NO: 28622 - DNA, 25 bp, Homo sapien
atagatgtacagaatgctaattaaa

SEQ ID NO: 28623 - DNA, 25 bp, Homo sapien
atagatgttacagtcagggaaattt

SEQ ID NO: 28624 - DNA, 25 bp, Homo sapien
atagatgttacattcagggaaattt

SEQ ID NO: 28625 - DNA, 25 bp, Homo sapien
atagatgtttggacgaccatgaaaa

SEQ ID NO: 28626 - DNA, 25 bp, Homo sapien
atagatgtttggatgaccatgaaaa

SEQ ID NO: 28627 - DNA, 25 bp, Homo sapien
atagattcagcattaaaatacagga

SEQ ID NO: 28628 - DNA, 25 bp, Homo sapien
atagattccaaatttctcctcttat

SEQ ID NO: 28629 - DNA, 25 bp, Homo sapien
atagattccgcattaaaatacagga

SEQ ID NO: 28630 - DNA, 25 bp, Homo sapien
atagattctaaatttctcctcttat

SEQ ID NO: 28631 - DNA, 25 bp, Homo sapien
atagattgaggtaacgctcataact

SEQ ID NO: 28632 - DNA, 25 bp, Homo sapien
atagattgaggtaatgctcataact

SEQ ID NO: 28633 - DNA, 25 bp, Homo sapien
atagatttttcataatgtacttaag

SEQ ID NO: 28634 - DNA, 25 bp, Homo sapien
atagatttttcgtaatgtacttaag

SEQ ID NO: 28635 - DNA, 25 bp, Homo sapien
atagcaaagatgtgcgaacaaacca

SEQ ID NO: 28636 - DNA, 25 bp, Homo sapien
atagcaaaggtgtgcgaacaaacca

SEQ ID NO: 28637 - DNA, 25 bp, Homo sapien
atagcaaatatacggctttagaaga

SEQ ID NO: 28638 - DNA, 25 bp, Homo sapien
atagcaaatatagggctttagaaga

SEQ ID NO: 28639 - DNA, 25 bp, Homo sapien
atagcaacaataatagaatgatagc

SEQ ID NO: 28640 - DNA, 25 bp, Homo sapien
atagcaacacgatttctgaaaatga

SEQ ID NO: 28641 - DNA, 25 bp, Homo sapien
atagcaacatgatttctgaaaatga

SEQ ID NO: 28642 - DNA, 25 bp, Homo sapien
atagcaaccataatagaatgatagc

SEQ ID NO: 28643 - DNA, 25 bp, Homo sapien
atagcaataaaacctacttctttgg

SEQ ID NO: 28644 - DNA, 25 bp, Homo sapien
atagcaatagtaactatccaggatg

SEQ ID NO: 28645 - DNA, 25 bp, Homo sapien
atagcaatagtagctatccaggatg

SEQ ID NO: 28646 - DNA, 25 bp, Homo sapien
atagcaatgtctcccaaatttataa

SEQ ID NO: 28647 - DNA, 25 bp, Homo sapien
atagcaatgtctcccagatttataa

SEQ ID NO: 28648 - DNA, 25 bp, Homo sapien
atagcaattaaacctacttctttgg

SEQ ID NO: 28649 - DNA, 25 bp, Homo sapien
atagcacaactgaaatattttacaa

SEQ ID NO: 28650 - DNA, 25 bp, Homo sapien
atagcacaactgaagtattttacaa

SEQ ID NO: 28651 - DNA, 25 bp, Homo sapien
atagcacaccatcctaaattttttt

SEQ ID NO: 28652 - DNA, 25 bp, Homo sapien
atagcacaccatcctagattttttt

SEQ ID NO: 28653 - DNA, 25 bp, Homo sapien
atagcacagactagtttttcagttt

SEQ ID NO: 28654 - DNA, 25 bp, Homo sapien
atagcacagactggtttttcagttt

SEQ ID NO: 28655 - DNA, 25 bp, Homo sapien
atagcacagagaaataagaaccagg

SEQ ID NO: 28656 - DNA, 25 bp, Homo sapien
atagcacagagaaataggaaccagg

SEQ ID NO: 28657 - DNA, 25 bp, Homo sapien
atagcactgattcctaacagggtta

SEQ ID NO: 28658 - DNA, 25 bp, Homo sapien
atagcactgattcctagcagggtta

SEQ ID NO: 28659 - DNA, 25 bp, Homo sapien
atagcagaaacagagactcctggtt

SEQ ID NO: 28660 - DNA, 25 bp, Homo sapien
atagcagaaacggagactcctggtt

SEQ ID NO: 28661 - DNA, 25 bp, Homo sapien
atagcagataagacacaattaaaga

SEQ ID NO: 28662 - DNA, 25 bp, Homo sapien
atagcagataatacacaattaaaga

SEQ ID NO: 28663 - DNA, 25 bp, Homo sapien
atagcagcaagcccgtgggagcgca

SEQ ID NO: 28664 - DNA, 25 bp, Homo sapien
atagcagcaagcctgtgggagcgca

SEQ ID NO: 28665 - DNA, 25 bp, Homo sapien
atagcagcaatagaaaatggacata

SEQ ID NO: 28666 - DNA, 25 bp, Homo sapien
atagcagcagtagaaaatggacata

SEQ ID NO: 28667 - DNA, 25 bp, Homo sapien
atagcagcattttaaaaagtagcca

SEQ ID NO: 28668 - DNA, 25 bp, Homo sapien
atagcagcgttttaaaaagtagcca

SEQ ID NO: 28669 - DNA, 25 bp, Homo sapien
atagcagcttaccaagaccaaaagg

SEQ ID NO: 28670 - DNA, 25 bp, Homo sapien
atagcagcttaccgagaccaaaagg

SEQ ID NO: 28671 - DNA, 25 bp, Homo sapien
atagcaggatatagggttcagtcta

SEQ ID NO: 28672 - DNA, 25 bp, Homo sapien
atagcaggatatatggttcagtcta

SEQ ID NO: 28673 - DNA, 25 bp, Homo sapien
atagcagggaaccatagcctagcca

SEQ ID NO: 28674 - DNA, 25 bp, Homo sapien
atagcaggggaccatagcctagcca

SEQ ID NO: 28675 - DNA, 25 bp, Homo sapien
atagcagggtctttctgcagacaaa

SEQ ID NO: 28676 - DNA, 25 bp, Homo sapien
atagcagggtctttgtgcagacaaa

SEQ ID NO: 28677 - DNA, 25 bp, Homo sapien
atagcaggtagtgtactttttgtga

SEQ ID NO: 28678 - DNA, 25 bp, Homo sapien
atagcaggtagtgtgctttttgtga

SEQ ID NO: 28679 - DNA, 25 bp, Homo sapien
atagcagtggtcatctcttggttcc

SEQ ID NO: 28680 - DNA, 25 bp, Homo sapien
atagcagtggtcatttcttggttcc

SEQ ID NO: 28681 - DNA, 25 bp, Homo sapien
atagcagttttatagccgtattact

SEQ ID NO: 28682 - DNA, 25 bp, Homo sapien
atagcagttttatagctgtattact

SEQ ID NO: 28683 - DNA, 25 bp, Homo sapien
atagcataggcagtccatcattgac

SEQ ID NO: 28684 - DNA, 25 bp, Homo sapien
atagcataggcagtccgtcattgac

SEQ ID NO: 28685 - DNA, 25 bp, Homo sapien
atagcatattctagcctgttaggtg

SEQ ID NO: 28686 - DNA, 25 bp, Homo sapien
atagcatattctagtctgttaggtg

SEQ ID NO: 28687 - DNA, 25 bp, Homo sapien
atagcatctaaagacaatatatgaa

SEQ ID NO: 28688 - DNA, 25 bp, Homo sapien
atagcatctgaagacaatatatgaa

SEQ ID NO: 28689 - DNA, 25 bp, Homo sapien
atagcattgtctgacgtgattctaa

SEQ ID NO: 28690 - DNA, 25 bp, Homo sapien
atagcattgtctgatgtgattctaa

SEQ ID NO: 28691 - DNA, 25 bp, Homo sapien
atagccaaaattgaaagctattgaa

SEQ ID NO: 28692 - DNA, 25 bp, Homo sapien
atagccaaaattggaagctattgaa

SEQ ID NO: 28693 - DNA, 25 bp, Homo sapien
atagccacgatgtacctccttccaa

SEQ ID NO: 28694 - DNA, 25 bp, Homo sapien
atagccacgttgtacctccttccaa

SEQ ID NO: 28695 - DNA, 25 bp, Homo sapien
atagccagcaggatgaatttaaact

SEQ ID NO: 28696 - DNA, 25 bp, Homo sapien
atagccagctacaacttgggcagcc

SEQ ID NO: 28697 - DNA, 25 bp, Homo sapien
atagccagctacgacttgggcagcc

SEQ ID NO: 28698 - DNA, 25 bp, Homo sapien
atagccaggattcatacgtctagga

SEQ ID NO: 28699 - DNA, 25 bp, Homo sapien
atagccaggattcataggtctagga

SEQ ID NO: 28700 - DNA, 25 bp, Homo sapien
atagccagtaggatgaatttaaact

SEQ ID NO: 28701 - DNA, 25 bp, Homo sapien
atagccatattgcttcactctcatt

SEQ ID NO: 28702 - DNA, 25 bp, Homo sapien
atagccatattgtttcactctcatt

SEQ ID NO: 28703 - DNA, 25 bp, Homo sapien
atagccatggcatattgtagtccta

SEQ ID NO: 28704 - DNA, 25 bp, Homo sapien
atagccatggcgtattgtagtccta

SEQ ID NO: 28705 - DNA, 25 bp, Homo sapien
atagcccatagatggatgcctgaat

SEQ ID NO: 28706 - DNA, 25 bp, Homo sapien
atagcccatagatgtatgcctgaat

SEQ ID NO: 28707 - DNA, 25 bp, Homo sapien
atagccctgaggtctgaagtcaccc

SEQ ID NO: 28708 - DNA, 25 bp, Homo sapien
atagccctgaggtctggagtcaccc

SEQ ID NO: 28709 - DNA, 25 bp, Homo sapien
atagctaaaggtgacctctgcaacc

SEQ ID NO: 28710 - DNA, 25 bp, Homo sapien
atagctaaaggtggcctctgcaacc

SEQ ID NO: 28711 - DNA, 25 bp, Homo sapien
atagctactgaggactgtttctttt

SEQ ID NO: 28712 - DNA, 25 bp, Homo sapien
atagctactgatgactgtttctttt

SEQ ID NO: 28713 - DNA, 25 bp, Homo sapien
atagctagatgctaattatttggaa

SEQ ID NO: 28714 - DNA, 25 bp, Homo sapien
atagctagatgttaattatttggaa

SEQ ID NO: 28715 - DNA, 25 bp, Homo sapien
atagctatacattgagacaaccaaa

SEQ ID NO: 28716 - DNA, 25 bp, Homo sapien
atagctatacgttggatgacattga

SEQ ID NO: 28717 - DNA, 25 bp, Homo sapien
atagctatatattgagacaaccaaa

SEQ ID NO: 28718 - DNA, 25 bp, Homo sapien
atagctatatgttggatgacattga

SEQ ID NO: 28719 - DNA, 25 bp, Homo sapien
atagctcaagaaatgctgttataat

SEQ ID NO: 28720 - DNA, 25 bp, Homo sapien
atagctcaagaagtgctgttataat

SEQ ID NO: 28721 - DNA, 25 bp, Homo sapien
atagctcaatacatcagtgcaagct

SEQ ID NO: 28722 - DNA, 25 bp, Homo sapien
atagctcaatacgtcagtgcaagct

SEQ ID NO: 28723 - DNA, 25 bp, Homo sapien
atagctcccagtaaaatttaagggc

SEQ ID NO: 28724 - DNA, 25 bp, Homo sapien
atagctcccagtacaatttaagggc

SEQ ID NO: 28725 - DNA, 25 bp, Homo sapien
atagctctacaatggagattttagt

SEQ ID NO: 28726 - DNA, 25 bp, Homo sapien
atagctctacttgaccttcatctct

SEQ ID NO: 28727 - DNA, 25 bp, Homo sapien
atagctctagcctcagtacccgcca

SEQ ID NO: 28728 - DNA, 25 bp, Homo sapien
atagctctagcttcagtacccgcca

SEQ ID NO: 28729 - DNA, 25 bp, Homo sapien
atagctctataatggagattttagt

SEQ ID NO: 28730 - DNA, 25 bp, Homo sapien
atagctctgcttgaccttcatctct

SEQ ID NO: 28731 - DNA, 25 bp, Homo sapien
atagctgacatttgattctcctcta

SEQ ID NO: 28732 - DNA, 25 bp, Homo sapien
atagctgacattttattctcctcta

SEQ ID NO: 28733 - DNA, 25 bp, Homo sapien
atagctgagggaactgaggtccagg

SEQ ID NO: 28734 - DNA, 25 bp, Homo sapien
atagctgagggaattgaggtccagg

SEQ ID NO: 28735 - DNA, 25 bp, Homo sapien
atagctgcaaagttacaaattaagg

SEQ ID NO: 28736 - DNA, 25 bp, Homo sapien
atagctgcatagttacaaattaagg

SEQ ID NO: 28737 - DNA, 25 bp, Homo sapien
atagctgctctcaaacatacgctag

SEQ ID NO: 28738 - DNA, 25 bp, Homo sapien
atagctgctctgaaacatacgctag

SEQ ID NO: 28739 - DNA, 25 bp, Homo sapien
atagctgtttcactgtcagacaagt

SEQ ID NO: 28740 - DNA, 25 bp, Homo sapien
atagctgtttcgctgtcagacaagt

SEQ ID NO: 28741 - DNA, 25 bp, Homo sapien
atagcttaaaaaataatctccataa

SEQ ID NO: 28742 - DNA, 25 bp, Homo sapien
atagcttacaaaataatctccataa

SEQ ID NO: 28743 - DNA, 25 bp, Homo sapien
atagcttatctaggaatactgttta

SEQ ID NO: 28744 - DNA, 25 bp, Homo sapien
atagcttatgatgatgcctagagat

SEQ ID NO: 28745 - DNA, 25 bp, Homo sapien
atagcttatgatggtgcctagagat

SEQ ID NO: 28746 - DNA, 25 bp, Homo sapien
atagcttatttaggaatactgttta

SEQ ID NO: 28747 - DNA, 25 bp, Homo sapien
atagcttcaacataaaagtccagag

SEQ ID NO: 28748 - DNA, 25 bp, Homo sapien
atagcttcaacgtaaaagtccagag

SEQ ID NO: 28749 - DNA, 25 bp, Homo sapien
atagcttcaatacagtccagaggga

SEQ ID NO: 28750 - DNA, 25 bp, Homo sapien
atagcttcagtacagtccagaggga

SEQ ID NO: 28751 - DNA, 25 bp, Homo sapien
ataggaaaatgtcatattgaatcaa

SEQ ID NO: 28752 - DNA, 25 bp, Homo sapien
ataggaaaatgtcctattgaatcaa

SEQ ID NO: 28753 - DNA, 25 bp, Homo sapien
ataggaagagaaaactgcacattaa

SEQ ID NO: 28754 - DNA, 25 bp, Homo sapien
ataggaagggaaaactgcacattaa

SEQ ID NO: 28755 - DNA, 25 bp, Homo sapien
ataggaagggctctctgtgatctgg

SEQ ID NO: 28756 - DNA, 25 bp, Homo sapien
ataggaaggtctctctgtgatctgg

SEQ ID NO: 28757 - DNA, 25 bp, Homo sapien
ataggaataagttttgctggttttc

SEQ ID NO: 28758 - DNA, 25 bp, Homo sapien
ataggaataagttttgttggttttc

SEQ ID NO: 28759 - DNA, 25 bp, Homo sapien
ataggaatttaacaggagcttcagg

SEQ ID NO: 28760 - DNA, 25 bp, Homo sapien
ataggaatttaacaggcgcttcagg

SEQ ID NO: 28761 - DNA, 25 bp, Homo sapien
ataggagacatcacaggaggaaaac

SEQ ID NO: 28762 - DNA, 25 bp, Homo sapien
ataggagacatctcaggaggaaaac

SEQ ID NO: 28763 - DNA, 25 bp, Homo sapien
ataggagagaaacaacgaagatata

SEQ ID NO: 28764 - DNA, 25 bp, Homo sapien
ataggagagaagcaacgaagatata

SEQ ID NO: 28765 - DNA, 25 bp, Homo sapien
ataggagagccactatgtaggtgag

SEQ ID NO: 28766 - DNA, 25 bp, Homo sapien
ataggagagccattatgtaggtgag

SEQ ID NO: 28767 - DNA, 25 bp, Homo sapien
ataggagcacggaggccaagttagc

SEQ ID NO: 28768 - DNA, 25 bp, Homo sapien
ataggagcatggaggccaagttagc

SEQ ID NO: 28769 - DNA, 25 bp, Homo sapien
ataggagccgggaccatttctggct

SEQ ID NO: 28770 - DNA, 25 bp, Homo sapien
ataggagcgactcacgcgctgggtc

SEQ ID NO: 28771 - DNA, 25 bp, Homo sapien
ataggagcgtctcacgcgctgggtc

SEQ ID NO: 28772 - DNA, 25 bp, Homo sapien
ataggagctgggaccatttctggct

SEQ ID NO: 28773 - DNA, 25 bp, Homo sapien
ataggaggcgctggaaatgtaagaa

SEQ ID NO: 28774 - DNA, 25 bp, Homo sapien
ataggaggtgctggaaatgtaagaa

SEQ ID NO: 28775 - DNA, 25 bp, Homo sapien
ataggataaaaatacacacatgaag

SEQ ID NO: 28776 - DNA, 25 bp, Homo sapien
ataggataaaaatatacacatgaag

SEQ ID NO: 28777 - DNA, 25 bp, Homo sapien
ataggatcacaaccagtgaaactat

SEQ ID NO: 28778 - DNA, 25 bp, Homo sapien
ataggatcacaactagtgaaactat

SEQ ID NO: 28779 - DNA, 25 bp, Homo sapien
ataggatccaagttctgagtgtggc

SEQ ID NO: 28780 - DNA, 25 bp, Homo sapien
ataggatcccagttctgagtgtggc

SEQ ID NO: 28781 - DNA, 25 bp, Homo sapien
ataggattgctaagcttgatgaatt

SEQ ID NO: 28782 - DNA, 25 bp, Homo sapien
ataggattgctgagcttgatgaatt

SEQ ID NO: 28783 - DNA, 25 bp, Homo sapien
ataggattggtggaaacgttcttag

SEQ ID NO: 28784 - DNA, 25 bp, Homo sapien
ataggattggtggaaatgttcttag

SEQ ID NO: 28785 - DNA, 25 bp, Homo sapien
ataggatttacatctacatatgcag

SEQ ID NO: 28786 - DNA, 25 bp, Homo sapien
ataggatttacgtctacatatgcag

SEQ ID NO: 28787 - DNA, 25 bp, Homo sapien
ataggcaacgcagattcaattcatg

SEQ ID NO: 28788 - DNA, 25 bp, Homo sapien
ataggcaatccttttgtgtgtgtgt

SEQ ID NO: 28789 - DNA, 25 bp, Homo sapien
ataggcaatgcagattcaattcatg

SEQ ID NO: 28790 - DNA, 25 bp, Homo sapien
ataggcaatggtatgaaagttggct

SEQ ID NO: 28791 - DNA, 25 bp, Homo sapien
ataggcaatggtgtgaaagttggct

SEQ ID NO: 28792 - DNA, 25 bp, Homo sapien
ataggcaattcttttgtgtgtgtgt

SEQ ID NO: 28793 - DNA, 25 bp, Homo sapien
ataggcacttagcgaatggagagaa

SEQ ID NO: 28794 - DNA, 25 bp, Homo sapien
ataggcacttagtgaatggagagaa

SEQ ID NO: 28795 - DNA, 25 bp, Homo sapien
ataggcagctgctacactacagcgc

SEQ ID NO: 28796 - DNA, 25 bp, Homo sapien
ataggcagctgctacattacagcgc

SEQ ID NO: 28797 - DNA, 25 bp, Homo sapien
ataggcaggaaaatagataacatta

SEQ ID NO: 28798 - DNA, 25 bp, Homo sapien
ataggcaggaaaatcgataacatta

SEQ ID NO: 28799 - DNA, 25 bp, Homo sapien
ataggcaggctggaaagtcagatga

SEQ ID NO: 28800 - DNA, 25 bp, Homo sapien
ataggcaggctgggaagtcagatga

SEQ ID NO: 28801 - DNA, 25 bp, Homo sapien
ataggcagtccatcattgaccaaaa

SEQ ID NO: 28802 - DNA, 25 bp, Homo sapien
ataggcagtccgtcattgaccaaaa

SEQ ID NO: 28803 - DNA, 25 bp, Homo sapien
ataggcatcagaaatgtgagaaatg

SEQ ID NO: 28804 - DNA, 25 bp, Homo sapien
ataggcattagaaatgtgagaaatg

SEQ ID NO: 28805 - DNA, 25 bp, Homo sapien
ataggccacttaacagctttgtgct

SEQ ID NO: 28806 - DNA, 25 bp, Homo sapien
ataggccagttaacagctttgtgct

SEQ ID NO: 28807 - DNA, 25 bp, Homo sapien
ataggccctatctgaaacattctaa

SEQ ID NO: 28808 - DNA, 25 bp, Homo sapien
ataggccctatctgaatcattctaa

SEQ ID NO: 28809 - DNA, 25 bp, Homo sapien
ataggctatatggagagtttatttg

SEQ ID NO: 28810 - DNA, 25 bp, Homo sapien
ataggctatattgagagtttatttg

SEQ ID NO: 28811 - DNA, 25 bp, Homo sapien
ataggctctgatatagctctcacca

SEQ ID NO: 28812 - DNA, 25 bp, Homo sapien
ataggctctgatgtagctctcacca

SEQ ID NO: 28813 - DNA, 25 bp, Homo sapien
ataggctgttagaagaagccatatc

SEQ ID NO: 28814 - DNA, 25 bp, Homo sapien
ataggctgttataagaagccatatc

SEQ ID NO: 28815 - DNA, 25 bp, Homo sapien
ataggcttaggctcaaaatactacc

SEQ ID NO: 28816 - DNA, 25 bp, Homo sapien
ataggcttaggttcaaaatactacc

SEQ ID NO: 28817 - DNA, 25 bp, Homo sapien
ataggcttattcagcggcagcccag

SEQ ID NO: 28818 - DNA, 25 bp, Homo sapien
ataggcttattcagtggcagcccag

SEQ ID NO: 28819 - DNA, 25 bp, Homo sapien
atagggattcctctaacagatctgg

SEQ ID NO: 28820 - DNA, 25 bp, Homo sapien
atagggattcctgtaacagatctgg

SEQ ID NO: 28821 - DNA, 25 bp, Homo sapien
atagggcacgaccgaacttggtttg

SEQ ID NO: 28822 - DNA, 25 bp, Homo sapien
atagggcaggactctgtacttcagg

SEQ ID NO: 28823 - DNA, 25 bp, Homo sapien
atagggcaggactgtgtacttcagg

SEQ ID NO: 28824 - DNA, 25 bp, Homo sapien
atagggcatgaccgaacttggtttg

SEQ ID NO: 28825 - DNA, 25 bp, Homo sapien
atagggccattgaaaaacacacgta

SEQ ID NO: 28826 - DNA, 25 bp, Homo sapien
atagggccgttgaaaaacacacgta

SEQ ID NO: 28827 - DNA, 25 bp, Homo sapien
atagggcctggtatacctattttga

SEQ ID NO: 28828 - DNA, 25 bp, Homo sapien
atagggcctggtatccctattttga

SEQ ID NO: 28829 - DNA, 25 bp, Homo sapien
atagggctatagtaaggagtaaaac

SEQ ID NO: 28830 - DNA, 25 bp, Homo sapien
atagggctcactaactgattgcaaa

SEQ ID NO: 28831 - DNA, 25 bp, Homo sapien
atagggctcactgactgattgcaaa

SEQ ID NO: 28832 - DNA, 25 bp, Homo sapien
atagggctgtagtaaggagtaaaac

SEQ ID NO: 28833 - DNA, 25 bp, Homo sapien
ataggggaaagtctatgggatcaaa

SEQ ID NO: 28834 - DNA, 25 bp, Homo sapien
ataggggaaagtctgtgggatcaaa

SEQ ID NO: 28835 - DNA, 25 bp, Homo sapien
atagggtaccagtcagagtcatgag

SEQ ID NO: 28836 - DNA, 25 bp, Homo sapien
atagggtaccagtccgagtcatgag

SEQ ID NO: 28837 - DNA, 25 bp, Homo sapien
atagggtcatcacacactagtcatt

SEQ ID NO: 28838 - DNA, 25 bp, Homo sapien
atagggtcatcacatactagtcatt

SEQ ID NO: 28839 - DNA, 25 bp, Homo sapien
ataggtaggtgtactggaatgctcc

SEQ ID NO: 28840 - DNA, 25 bp, Homo sapien
ataggtaggtgtgctggaatgctcc

SEQ ID NO: 28841 - DNA, 25 bp, Homo sapien
ataggtcatagtcatttgcttcagg

SEQ ID NO: 28842 - DNA, 25 bp, Homo sapien
ataggtcatagtgatttgcttcagg

SEQ ID NO: 28843 - DNA, 25 bp, Homo sapien
ataggtgaaaaaaacagcttatagg

SEQ ID NO: 28844 - DNA, 25 bp, Homo sapien
ataggtgaaaaaagcagcttatagg

SEQ ID NO: 28845 - DNA, 25 bp, Homo sapien
ataggtgacaaaagaaattcatagt

SEQ ID NO: 28846 - DNA, 25 bp, Homo sapien
ataggtgacaaaagaatttcatagt

SEQ ID NO: 28847 - DNA, 25 bp, Homo sapien
ataggtgtgctagaatgtactcatt

SEQ ID NO: 28848 - DNA, 25 bp, Homo sapien
ataggtgtgttagaatgtactcatt

SEQ ID NO: 28849 - DNA, 25 bp, Homo sapien
ataggttcacaggacgtcaaggcta

SEQ ID NO: 28850 - DNA, 25 bp, Homo sapien
ataggttcacaggatgtcaaggcta

SEQ ID NO: 28851 - DNA, 25 bp, Homo sapien
ataggttcttccatttctgttatga

SEQ ID NO: 28852 - DNA, 25 bp, Homo sapien
ataggttcttccgtttctgttatga

SEQ ID NO: 28853 - DNA, 25 bp, Homo sapien
ataggttgacttagctttgttcatc

SEQ ID NO: 28854 - DNA, 25 bp, Homo sapien
ataggttggcttagctttgttcatc

SEQ ID NO: 28855 - DNA, 25 bp, Homo sapien
atagtaaaagactgaatgctgtttc

SEQ ID NO: 28856 - DNA, 25 bp, Homo sapien
atagtaaaatactgaatgctgtttc

SEQ ID NO: 28857 - DNA, 25 bp, Homo sapien
atagtaacagggctcatttggttgc

SEQ ID NO: 28858 - DNA, 25 bp, Homo sapien
atagtaacagggttcatttggttgc

SEQ ID NO: 28859 - DNA, 25 bp, Homo sapien
atagtaatacataggaaatcctgga

SEQ ID NO: 28860 - DNA, 25 bp, Homo sapien
atagtaatacatgggaaatcctgga

SEQ ID NO: 28861 - DNA, 25 bp, Homo sapien
atagtaatcacaataatggcagcat

SEQ ID NO: 28862 - DNA, 25 bp, Homo sapien
atagtaatcacagtaatggcagcat

SEQ ID NO: 28863 - DNA, 25 bp, Homo sapien
atagtacagctccaaaggtagaatc

SEQ ID NO: 28864 - DNA, 25 bp, Homo sapien
atagtacagctccgaaggtagaatc

SEQ ID NO: 28865 - DNA, 25 bp, Homo sapien
atagtactccatcatagagttatta

SEQ ID NO: 28866 - DNA, 25 bp, Homo sapien
atagtacttacagcagttacacagt

SEQ ID NO: 28867 - DNA, 25 bp, Homo sapien
atagtacttacagcggttacacagt

SEQ ID NO: 28868 - DNA, 25 bp, Homo sapien
atagtacttcatcatagagttatta

SEQ ID NO: 28869 - DNA, 25 bp, Homo sapien
atagtagcaaggactccataggaat

SEQ ID NO: 28870 - DNA, 25 bp, Homo sapien
atagtagcaaggactctataggaat

SEQ ID NO: 28871 - DNA, 25 bp, Homo sapien
atagtcaaaaatcgtgtgttctaaa

SEQ ID NO: 28872 - DNA, 25 bp, Homo sapien
atagtcaaaaattgtgtgttctaaa

SEQ ID NO: 28873 - DNA, 25 bp, Homo sapien
atagtcaaacagctcatcagtgtct

SEQ ID NO: 28874 - DNA, 25 bp, Homo sapien
atagtcaaacagttcatcagtgtct

SEQ ID NO: 28875 - DNA, 25 bp, Homo sapien
atagtcaaagaaattaaagcagaga

SEQ ID NO: 28876 - DNA, 25 bp, Homo sapien
atagtcaaataaattaaagcagaga

SEQ ID NO: 28877 - DNA, 25 bp, Homo sapien
atagtcaacgtaagaaaaaaatcta

SEQ ID NO: 28878 - DNA, 25 bp, Homo sapien
atagtcaatgtaagaaaaaaatcta

SEQ ID NO: 28879 - DNA, 25 bp, Homo sapien
atagtcagaggaccttaagaaagag

SEQ ID NO: 28880 - DNA, 25 bp, Homo sapien
atagtcagaggatcttaagaaagag

SEQ ID NO: 28881 - DNA, 25 bp, Homo sapien
atagtcagatactaggcaagaacca

SEQ ID NO: 28882 - DNA, 25 bp, Homo sapien
atagtcagatactcggcaagaacca

SEQ ID NO: 28883 - DNA, 25 bp, Homo sapien
atagtcagtgccaattgaaacacat

SEQ ID NO: 28884 - DNA, 25 bp, Homo sapien
atagtcagtgccagttgaaacacat

SEQ ID NO: 28885 - DNA, 25 bp, Homo sapien
atagtccagcgttaaatgcctcctc

SEQ ID NO: 28886 - DNA, 25 bp, Homo sapien
atagtccagggttaaatgcctcctc

SEQ ID NO: 28887 - DNA, 25 bp, Homo sapien
atagtcctgcaaagccagagtattg

SEQ ID NO: 28888 - DNA, 25 bp, Homo sapien
atagtcctgttcattcagtcctaat

SEQ ID NO: 28889 - DNA, 25 bp, Homo sapien
atagtcctgttcgttcagtcctaat

SEQ ID NO: 28890 - DNA, 25 bp, Homo sapien
atagtccttcaaagccagagtattg

SEQ ID NO: 28891 - DNA, 25 bp, Homo sapien
atagtctattcaggtatctaaacaa

SEQ ID NO: 28892 - DNA, 25 bp, Homo sapien
atagtctattcagttatctaaacaa

SEQ ID NO: 28893 - DNA, 25 bp, Homo sapien
atagtctcaaatgttcatgagattt

SEQ ID NO: 28894 - DNA, 25 bp, Homo sapien
atagtctcacatgttcatgagattt

SEQ ID NO: 28895 - DNA, 25 bp, Homo sapien
atagtctgactggaatccccatggg

SEQ ID NO: 28896 - DNA, 25 bp, Homo sapien
atagtctgactgtaatccccatggg

SEQ ID NO: 28897 - DNA, 25 bp, Homo sapien
atagtctttttcacagaacagttgc

SEQ ID NO: 28898 - DNA, 25 bp, Homo sapien
atagtctttttcacagcacagttgc

SEQ ID NO: 28899 - DNA, 25 bp, Homo sapien
atagtgaacgagtctcacgagatct

SEQ ID NO: 28900 - DNA, 25 bp, Homo sapien
atagtgaagcagaatggtaaaccag

SEQ ID NO: 28901 - DNA, 25 bp, Homo sapien
atagtgaagcagagtggtaaaccag

SEQ ID NO: 28902 - DNA, 25 bp, Homo sapien
atagtgaatgagtctcacgagatct

SEQ ID NO: 28903 - DNA, 25 bp, Homo sapien
atagtgaatgtggtagcttctggaa

SEQ ID NO: 28904 - DNA, 25 bp, Homo sapien
atagtgaatgtgttagcttctggaa

SEQ ID NO: 28905 - DNA, 25 bp, Homo sapien
atagtgagattactaggtttgcttt

SEQ ID NO: 28906 - DNA, 25 bp, Homo sapien
atagtgagattactgggtttgcttt

SEQ ID NO: 28907 - DNA, 25 bp, Homo sapien
atagtgagcagcagagcaggaattt

SEQ ID NO: 28908 - DNA, 25 bp, Homo sapien
atagtgagcagcatagcaggaattt

SEQ ID NO: 28909 - DNA, 25 bp, Homo sapien
atagtgcacatcccctaaggcagga

SEQ ID NO: 28910 - DNA, 25 bp, Homo sapien
atagtgcatatcccctaaggcagga

SEQ ID NO: 28911 - DNA, 25 bp, Homo sapien
atagtggctaatacatgaggtgcat

SEQ ID NO: 28912 - DNA, 25 bp, Homo sapien
atagtggctaatatatgaggtgcat

SEQ ID NO: 28913 - DNA, 25 bp, Homo sapien
atagtgggaaaactagtcaggattt

SEQ ID NO: 28914 - DNA, 25 bp, Homo sapien
atagtgggaccaaagagagagaata

SEQ ID NO: 28915 - DNA, 25 bp, Homo sapien
atagtgggatcaaagagagagaata

SEQ ID NO: 28916 - DNA, 25 bp, Homo sapien
atagtggggaaactagtcaggattt

SEQ ID NO: 28917 - DNA, 25 bp, Homo sapien
atagtgtaaaatcaactgtctcacc

SEQ ID NO: 28918 - DNA, 25 bp, Homo sapien
atagtgtaaaatcgactgtctcacc

SEQ ID NO: 28919 - DNA, 25 bp, Homo sapien
atagtgtacgtctacatactaaatg

SEQ ID NO: 28920 - DNA, 25 bp, Homo sapien
atagtgtaggtctacatactaaatg

SEQ ID NO: 28921 - DNA, 25 bp, Homo sapien
atagtgtatgtgcaacctaaaaatc

SEQ ID NO: 28922 - DNA, 25 bp, Homo sapien
atagtgtatgtgtaacctaaaaatc

SEQ ID NO: 28923 - DNA, 25 bp, Homo sapien
atagtgttagaaactgggaatctgt

SEQ ID NO: 28924 - DNA, 25 bp, Homo sapien
atagtgttagagactgggaatctgt

SEQ ID NO: 28925 - DNA, 25 bp, Homo sapien
atagtgttagctcctataggattta

SEQ ID NO: 28926 - DNA, 25 bp, Homo sapien
atagtgttagcttctataggattta

SEQ ID NO: 28927 - DNA, 25 bp, Homo sapien
atagttattgatacagggcaaagaa

SEQ ID NO: 28928 - DNA, 25 bp, Homo sapien
atagttattgatagagggcaaagaa

SEQ ID NO: 28929 - DNA, 25 bp, Homo sapien
atagttcaaactacttagacgttct

SEQ ID NO: 28930 - DNA, 25 bp, Homo sapien
atagttcaacctacttagacgttct

SEQ ID NO: 28931 - DNA, 25 bp, Homo sapien
atagttcaagtgcagtaaataatga

SEQ ID NO: 28932 - DNA, 25 bp, Homo sapien
atagttcaagtgtagtaaataatga

SEQ ID NO: 28933 - DNA, 25 bp, Homo sapien
atagttcacgtgtaattacaaggaa

SEQ ID NO: 28934 - DNA, 25 bp, Homo sapien
atagttcacttgtaattacaaggaa

SEQ ID NO: 28935 - DNA, 25 bp, Homo sapien
atagttctctgtacccctgaaaata

SEQ ID NO: 28936 - DNA, 25 bp, Homo sapien
atagttctctgtactcctgaaaata

SEQ ID NO: 28937 - DNA, 25 bp, Homo sapien
atagttctgagatatcaatgcaatt

SEQ ID NO: 28938 - DNA, 25 bp, Homo sapien
atagttctgagatgtcaatgcaatt

SEQ ID NO: 28939 - DNA, 25 bp, Homo sapien
atagttgacataaccttggcagcca

SEQ ID NO: 28940 - DNA, 25 bp, Homo sapien
atagttgacgtaaccttggcagcca

SEQ ID NO: 28941 - DNA, 25 bp, Homo sapien
atagttgcatcttgaagaaagaaga

SEQ ID NO: 28942 - DNA, 25 bp, Homo sapien
atagttgcgtcttgaagaaagaaga

SEQ ID NO: 28943 - DNA, 25 bp, Homo sapien
atagttggagccacaatagaactgc

SEQ ID NO: 28944 - DNA, 25 bp, Homo sapien
atagttggagcctcaatagaactgc

SEQ ID NO: 28945 - DNA, 25 bp, Homo sapien
atagttgtcatcagtagggaaccta

SEQ ID NO: 28946 - DNA, 25 bp, Homo sapien
atagttgtcgtcagtagggaaccta

SEQ ID NO: 28947 - DNA, 25 bp, Homo sapien
atagtttatggccaatttgctacag

SEQ ID NO: 28948 - DNA, 25 bp, Homo sapien
atagtttatggcctatttgctacag

SEQ ID NO: 28949 - DNA, 25 bp, Homo sapien
atagtttcaattctcacatgaagca

SEQ ID NO: 28950 - DNA, 25 bp, Homo sapien
atagtttctattctcacatgaagca

SEQ ID NO: 28951 - DNA, 25 bp, Homo sapien
atagtttgctcaaagattgtagttt

SEQ ID NO: 28952 - DNA, 25 bp, Homo sapien
atagtttgctcagagattgtagttt

SEQ ID NO: 28953 - DNA, 25 bp, Homo sapien
atagttttaatgtttaatgagctta

SEQ ID NO: 28954 - DNA, 25 bp, Homo sapien
atagttttaatttttaatgagctta

SEQ ID NO: 28955 - DNA, 25 bp, Homo sapien
atagttttacctcttatatttcatt

SEQ ID NO: 28956 - DNA, 25 bp, Homo sapien
atagttttacctgttatatttcatt

SEQ ID NO: 28957 - DNA, 25 bp, Homo sapien
atagttttctactggaccccaccat

SEQ ID NO: 28958 - DNA, 25 bp, Homo sapien
atagttttctattggaccccaccat

SEQ ID NO: 28959 - DNA, 25 bp, Homo sapien
atataaaacgtgatatgtaagtgta

SEQ ID NO: 28960 - DNA, 25 bp, Homo sapien
atataaaatgtgatatgtaagtgta

SEQ ID NO: 28961 - DNA, 25 bp, Homo sapien
atataaacagctaatggggttagtg

SEQ ID NO: 28962 - DNA, 25 bp, Homo sapien
atataaacggctaatggggttagtg

SEQ ID NO: 28963 - DNA, 25 bp, Homo sapien
atataaagcatgcactgtaatacca

SEQ ID NO: 28964 - DNA, 25 bp, Homo sapien
atataaagcatgcactttaatacca

SEQ ID NO: 28965 - DNA, 25 bp, Homo sapien
atataaagcgctctggaaggtagaa

SEQ ID NO: 28966 - DNA, 25 bp, Homo sapien
atataaagctagcattaattttcca

SEQ ID NO: 28967 - DNA, 25 bp, Homo sapien
atataaagctaggattaattttcca

SEQ ID NO: 28968 - DNA, 25 bp, Homo sapien
atataaagtacttgaaaccaggacc

SEQ ID NO: 28969 - DNA, 25 bp, Homo sapien
atataaagtacttgaagccaggacc

SEQ ID NO: 28970 - DNA, 25 bp, Homo sapien
atataaagtgctctggaaggtagaa

SEQ ID NO: 28971 - DNA, 25 bp, Homo sapien
atataaatgagaacacactgagcat

SEQ ID NO: 28972 - DNA, 25 bp, Homo sapien
atataaatgcgaacacactgagcat

SEQ ID NO: 28973 - DNA, 25 bp, Homo sapien
atataaatgtgcaaagaagtaactg

SEQ ID NO: 28974 - DNA, 25 bp, Homo sapien
atataaatgtgcaaaggagtaactg

SEQ ID NO: 28975 - DNA, 25 bp, Homo sapien
atataacaaaacaaatgtaggatta

SEQ ID NO: 28976 - DNA, 25 bp, Homo sapien
atataacaaaataaatgtaggatta

SEQ ID NO: 28977 - DNA, 25 bp, Homo sapien
atataacatcaattgactttccact

SEQ ID NO: 28978 - DNA, 25 bp, Homo sapien
atataacatcagttgactttccact

SEQ ID NO: 28979 - DNA, 25 bp, Homo sapien
atataacccagaatacagaagtaca

SEQ ID NO: 28980 - DNA, 25 bp, Homo sapien
atataacccagaatacggaagtaca

SEQ ID NO: 28981 - DNA, 25 bp, Homo sapien
atataactaatcccattctagctac

SEQ ID NO: 28982 - DNA, 25 bp, Homo sapien
atataactaatccctttctagctac

SEQ ID NO: 28983 - DNA, 25 bp, Homo sapien
atataactacataatttcagcagta

SEQ ID NO: 28984 - DNA, 25 bp, Homo sapien
atataactacatcatttcagcagta

SEQ ID NO: 28985 - DNA, 25 bp, Homo sapien
atataactttttaaaaaatcaagca

SEQ ID NO: 28986 - DNA, 25 bp, Homo sapien
atataactttttaaaatatcaagca

SEQ ID NO: 28987 - DNA, 25 bp, Homo sapien
atataagacggtcaactaaaatctc

SEQ ID NO: 28988 - DNA, 25 bp, Homo sapien
atataagatggtcaactaaaatctc

SEQ ID NO: 28989 - DNA, 25 bp, Homo sapien
atataagcatttaaataaagtgcag

SEQ ID NO: 28990 - DNA, 25 bp, Homo sapien
atataagcatttaaatgaagtgcag

SEQ ID NO: 28991 - DNA, 25 bp, Homo sapien
atataagtatggtaccaagaagaaa

SEQ ID NO: 28992 - DNA, 25 bp, Homo sapien
atataagtatggtacccagaagaaa

SEQ ID NO: 28993 - DNA, 25 bp, Homo sapien
atataataaagaacgaacatctgca

SEQ ID NO: 28994 - DNA, 25 bp, Homo sapien
atataataaagaatgaacatctgca

SEQ ID NO: 28995 - DNA, 25 bp, Homo sapien
atataatacaaaaaacgctatgtct

SEQ ID NO: 28996 - DNA, 25 bp, Homo sapien
atataatacgaaaaacgctatgtct

SEQ ID NO: 28997 - DNA, 25 bp, Homo sapien
atataatcaaagggcaagcttcagg

SEQ ID NO: 28998 - DNA, 25 bp, Homo sapien
atataatcaaagggcacgcttcagg

SEQ ID NO: 28999 - DNA, 25 bp, Homo sapien
atataatgaattgcagttcccaaaa

SEQ ID NO: 29000 - DNA, 25 bp, Homo sapien
atataatgcaacactgagttttcct

SEQ ID NO: 29001 - DNA, 25 bp, Homo sapien
atataatgcaacactgtgttttcct

SEQ ID NO: 29002 - DNA, 25 bp, Homo sapien
atataatgctgaattactggccacg

SEQ ID NO: 29003 - DNA, 25 bp, Homo sapien
atataatggataccggaagctttaa

SEQ ID NO: 29004 - DNA, 25 bp, Homo sapien
atataatggattccggaagctttaa

SEQ ID NO: 29005 - DNA, 25 bp, Homo sapien
atataatggattgcagttcccaaaa

SEQ ID NO: 29006 - DNA, 25 bp, Homo sapien
atataatggtagctgtagtttattg

SEQ ID NO: 29007 - DNA, 25 bp, Homo sapien
atataatggtagctgtggtttattg

SEQ ID NO: 29008 - DNA, 25 bp, Homo sapien
atataatgttgaattactggccacg

SEQ ID NO: 29009 - DNA, 25 bp, Homo sapien
atatacaaacacaagcttttaaaaa

SEQ ID NO: 29010 - DNA, 25 bp, Homo sapien
atatacaaatacaagcttttaaaaa

SEQ ID NO: 29011 - DNA, 25 bp, Homo sapien
atatacaaatggatgtcttttacag

SEQ ID NO: 29012 - DNA, 25 bp, Homo sapien
atatacaaatgggtgtcttttacag

SEQ ID NO: 29013 - DNA, 25 bp, Homo sapien
atatacaatttaaaaagccttcaga

SEQ ID NO: 29014 - DNA, 25 bp, Homo sapien
atatacaattttaaaagccttcaga

SEQ ID NO: 29015 - DNA, 25 bp, Homo sapien
atatacagagaaatttttaggctga

SEQ ID NO: 29016 - DNA, 25 bp, Homo sapien
atatacagataaatttttaggctga

SEQ ID NO: 29017 - DNA, 25 bp, Homo sapien
atatacataattaaaggattcaaag

SEQ ID NO: 29018 - DNA, 25 bp, Homo sapien
atatacataattcaaggattcaaag

SEQ ID NO: 29019 - DNA, 25 bp, Homo sapien
atatacatacttttttctgttgcac

SEQ ID NO: 29020 - DNA, 25 bp, Homo sapien
atatacatatttttttctgttgcac

SEQ ID NO: 29021 - DNA, 25 bp, Homo sapien
atatacatcgcttggagtttgttag

SEQ ID NO: 29022 - DNA, 25 bp, Homo sapien
atatacatgcgggagaaactcagag

SEQ ID NO: 29023 - DNA, 25 bp, Homo sapien
atatacatggcttggagtttgttag

SEQ ID NO: 29024 - DNA, 25 bp, Homo sapien
atatacatgtgggagaaactcagag

SEQ ID NO: 29025 - DNA, 25 bp, Homo sapien
atatacattcctaccatctgtgtaa

SEQ ID NO: 29026 - DNA, 25 bp, Homo sapien
atatacattcctagcatctgtgtaa

SEQ ID NO: 29027 - DNA, 25 bp, Homo sapien
atatacattttcaatcctcagagat

SEQ ID NO: 29028 - DNA, 25 bp, Homo sapien
atatacattttcagtcctcagagat

SEQ ID NO: 29029 - DNA, 25 bp, Homo sapien
atatacccagatacagctgcagaac

SEQ ID NO: 29030 - DNA, 25 bp, Homo sapien
atatacccagatgcagctgcagaac

SEQ ID NO: 29031 - DNA, 25 bp, Homo sapien
atatacctagaaaaagaaccgctgc

SEQ ID NO: 29032 - DNA, 25 bp, Homo sapien
atatacctagaaatagaaccgctgc

SEQ ID NO: 29033 - DNA, 25 bp, Homo sapien
atatacctagaatagtgcatacgtt

SEQ ID NO: 29034 - DNA, 25 bp, Homo sapien
atatacctagaatagttcatacgtt

SEQ ID NO: 29035 - DNA, 25 bp, Homo sapien
atatacctcttattacaacctggaa

SEQ ID NO: 29036 - DNA, 25 bp, Homo sapien
atatacctcttattaccacctggaa

SEQ ID NO: 29037 - DNA, 25 bp, Homo sapien
atatacctgattacatttttgctct

SEQ ID NO: 29038 - DNA, 25 bp, Homo sapien
atatacctggcatcgaatctataaa

SEQ ID NO: 29039 - DNA, 25 bp, Homo sapien
atatacctggcatctaatctataaa

SEQ ID NO: 29040 - DNA, 25 bp, Homo sapien
atatacctgtttacatttttgctct

SEQ ID NO: 29041 - DNA, 25 bp, Homo sapien
atatactaacatgcgtcaaagaata

SEQ ID NO: 29042 - DNA, 25 bp, Homo sapien
atatactaacatgtgtcaaagaata

SEQ ID NO: 29043 - DNA, 25 bp, Homo sapien
atatactcatctagccacaggtatg

SEQ ID NO: 29044 - DNA, 25 bp, Homo sapien
atatactcatctcgccacaggtatg

SEQ ID NO: 29045 - DNA, 25 bp, Homo sapien
atatacttagacatctttgaatttt

SEQ ID NO: 29046 - DNA, 25 bp, Homo sapien
atatacttagacatgtttgaatttt

SEQ ID NO: 29047 - DNA, 25 bp, Homo sapien
atatagaagaggaaaagaatgtaag

SEQ ID NO: 29048 - DNA, 25 bp, Homo sapien
atatagaagaggtaaagaatgtaag

SEQ ID NO: 29049 - DNA, 25 bp, Homo sapien
atatagaatatctgaaccgaggcca

SEQ ID NO: 29050 - DNA, 25 bp, Homo sapien
atatagaatcttgccctgtcttcca

SEQ ID NO: 29051 - DNA, 25 bp, Homo sapien
atatagaatcttgctctgtcttcca

SEQ ID NO: 29052 - DNA, 25 bp, Homo sapien
atatagaatgtctgaaccgaggcca

SEQ ID NO: 29053 - DNA, 25 bp, Homo sapien
atatagactggctaaatggattttt

SEQ ID NO: 29054 - DNA, 25 bp, Homo sapien
atatagactggctgaatggattttt

SEQ ID NO: 29055 - DNA, 25 bp, Homo sapien
atatagatggacgaaggggacaaag

SEQ ID NO: 29056 - DNA, 25 bp, Homo sapien
atatagattgacgaaggggacaaag

SEQ ID NO: 29057 - DNA, 25 bp, Homo sapien
atatagcacaagtgatacatatttg

SEQ ID NO: 29058 - DNA, 25 bp, Homo sapien
atatagcacgagtgatacatatttg

SEQ ID NO: 29059 - DNA, 25 bp, Homo sapien
atatagcccatagatggatgcctga

SEQ ID NO: 29060 - DNA, 25 bp, Homo sapien
atatagcccatagatgtatgcctga

SEQ ID NO: 29061 - DNA, 25 bp, Homo sapien
atatagcttatctaggaatactgtt

SEQ ID NO: 29062 - DNA, 25 bp, Homo sapien
atatagcttatttaggaatactgtt

SEQ ID NO: 29063 - DNA, 25 bp, Homo sapien
atataggtgaaaagatttgcctgag

SEQ ID NO: 29064 - DNA, 25 bp, Homo sapien
atataggtgaaatgatttgcctgag

SEQ ID NO: 29065 - DNA, 25 bp, Homo sapien
atatagtaagcaatgaaaagtagta

SEQ ID NO: 29066 - DNA, 25 bp, Homo sapien
atatagtaagcactgaaaagtagta

SEQ ID NO: 29067 - DNA, 25 bp, Homo sapien
atatagtacctcacgcattatgact

SEQ ID NO: 29068 - DNA, 25 bp, Homo sapien
atatagtacctcgcgcattatgact

SEQ ID NO: 29069 - DNA, 25 bp, Homo sapien
atatagtatgaagaagaaaacagcc

SEQ ID NO: 29070 - DNA, 25 bp, Homo sapien
atatagtattaagaagaaaacagcc

SEQ ID NO: 29071 - DNA, 25 bp, Homo sapien
atatagtcaatatccgtgtagactt

SEQ ID NO: 29072 - DNA, 25 bp, Homo sapien
atatagtcgatatccgtgtagactt

SEQ ID NO: 29073 - DNA, 25 bp, Homo sapien
atatagtgaaaaaaactgggttgat

SEQ ID NO: 29074 - DNA, 25 bp, Homo sapien
atatagtggccatagtaagaagaag

SEQ ID NO: 29075 - DNA, 25 bp, Homo sapien
atatagtggccatggtaagaagaag

SEQ ID NO: 29076 - DNA, 25 bp, Homo sapien
atatagtgtaaaaaactgggttgat

SEQ ID NO: 29077 - DNA, 25 bp, Homo sapien
atatataactacataatttcagcag

SEQ ID NO: 29078 - DNA, 25 bp, Homo sapien
atatataactacatcatttcagcag

SEQ ID NO: 29079 - DNA, 25 bp, Homo sapien
atatataatacaaaaaacgctatgt

SEQ ID NO: 29080 - DNA, 25 bp, Homo sapien
atatataatacgaaaaacgctatgt

SEQ ID NO: 29081 - DNA, 25 bp, Homo sapien
atatatactgagcgtccactctgtg

SEQ ID NO: 29082 - DNA, 25 bp, Homo sapien
atatatactgagcgtctactctgtg

SEQ ID NO: 29083 - DNA, 25 bp, Homo sapien
atatataggttgacttagctttgtt

SEQ ID NO: 29084 - DNA, 25 bp, Homo sapien
atatataggttggcttagctttgtt

SEQ ID NO: 29085 - DNA, 25 bp, Homo sapien
atatatagtacctcacgcattatga

SEQ ID NO: 29086 - DNA, 25 bp, Homo sapien
atatatagtacctcgcgcattatga

SEQ ID NO: 29087 - DNA, 25 bp, Homo sapien
atatatatcattctcagctggacaa

SEQ ID NO: 29088 - DNA, 25 bp, Homo sapien
atatatatcgttctcagctggacaa

SEQ ID NO: 29089 - DNA, 25 bp, Homo sapien
atatatgaatagtcctaaaatagag

SEQ ID NO: 29090 - DNA, 25 bp, Homo sapien
atatatgaatagtcgtaaaatagag

SEQ ID NO: 29091 - DNA, 25 bp, Homo sapien
atatatgagcaaatgaatccaagta

SEQ ID NO: 29092 - DNA, 25 bp, Homo sapien
atatatgagcaactgaatccaagta

SEQ ID NO: 29093 - DNA, 25 bp, Homo sapien
atatatgatctcacttgttcctcat

SEQ ID NO: 29094 - DNA, 25 bp, Homo sapien
atatatgatctcgcttgttcctcat

SEQ ID NO: 29095 - DNA, 25 bp, Homo sapien
atatatgcactgcctaacaacaccc

SEQ ID NO: 29096 - DNA, 25 bp, Homo sapien
atatatgcactgcgtaacaacaccc

SEQ ID NO: 29097 - DNA, 25 bp, Homo sapien
atatatggacaactgatttgcaacc

SEQ ID NO: 29098 - DNA, 25 bp, Homo sapien
atatatggacagctgatttgcaacc

SEQ ID NO: 29099 - DNA, 25 bp, Homo sapien
atatatggctttcattgtgttgatg

SEQ ID NO: 29100 - DNA, 25 bp, Homo sapien
atatatgggtttcattgtgttgatg

SEQ ID NO: 29101 - DNA, 25 bp, Homo sapien
atatatgtatacgattgagcaggac

SEQ ID NO: 29102 - DNA, 25 bp, Homo sapien
atatatgtatatgattgagcaggac

SEQ ID NO: 29103 - DNA, 25 bp, Homo sapien
atatatgtgttcgactttatatctg

SEQ ID NO: 29104 - DNA, 25 bp, Homo sapien
atatatgtgttcggctttatatctg

SEQ ID NO: 29105 - DNA, 25 bp, Homo sapien
atatattaaacagaacagggcccat

SEQ ID NO: 29106 - DNA, 25 bp, Homo sapien
atatattaaacataacagggcccat

SEQ ID NO: 29107 - DNA, 25 bp, Homo sapien
atatattgctttaagaagtgcggtc

SEQ ID NO: 29108 - DNA, 25 bp, Homo sapien
atatattgctttgagaagtgcggtc

SEQ ID NO: 29109 - DNA, 25 bp, Homo sapien
atatatttaaagctgtgtgccaggt

SEQ ID NO: 29110 - DNA, 25 bp, Homo sapien
atatatttaaagttgtgtgccaggt

SEQ ID NO: 29111 - DNA, 25 bp, Homo sapien
atatatttatttgcatattgtggtt

SEQ ID NO: 29112 - DNA, 25 bp, Homo sapien
atatatttatttgcatgttgtggtt

SEQ ID NO: 29113 - DNA, 25 bp, Homo sapien
atatatttctcacttacctttctct

SEQ ID NO: 29114 - DNA, 25 bp, Homo sapien
atatatttctcttaacgacctgttt

SEQ ID NO: 29115 - DNA, 25 bp, Homo sapien
atatatttcttttgccaacctgcat

SEQ ID NO: 29116 - DNA, 25 bp, Homo sapien
atatatttcttttgtcaacctgcat

SEQ ID NO: 29117 - DNA, 25 bp, Homo sapien
atatatttgtcacttacctttctct

SEQ ID NO: 29118 - DNA, 25 bp, Homo sapien
atatattttaccatgccgtttattc

SEQ ID NO: 29119 - DNA, 25 bp, Homo sapien
atatattttaccatgctgtttattc

SEQ ID NO: 29120 - DNA, 25 bp, Homo sapien
atatattttctgacttaatttttaa

SEQ ID NO: 29121 - DNA, 25 bp, Homo sapien
atatattttctgatttaatttttaa

SEQ ID NO: 29122 - DNA, 25 bp, Homo sapien
atatattttcttcaggccagctact

SEQ ID NO: 29123 - DNA, 25 bp, Homo sapien
atatattttcttcgggccagctact

SEQ ID NO: 29124 - DNA, 25 bp, Homo sapien
atatatttttcttaacgacctgttt

SEQ ID NO: 29125 - DNA, 25 bp, Homo sapien
atatcaaaatttgcaggatatggtt

SEQ ID NO: 29126 - DNA, 25 bp, Homo sapien
atatcaaaatttgtaggatatggtt

SEQ ID NO: 29127 - DNA, 25 bp, Homo sapien
atatcaaagaatccaaaatatcaag

SEQ ID NO: 29128 - DNA, 25 bp, Homo sapien
atatcaaataatccaaaatatcaag

SEQ ID NO: 29129 - DNA, 25 bp, Homo sapien
atatcaatcaaatgtcagtaaacaa

SEQ ID NO: 29130 - DNA, 25 bp, Homo sapien
atatcaatcaaatttcagtaaacaa

SEQ ID NO: 29131 - DNA, 25 bp, Homo sapien
atatcacaaagagatgttcttaatc

SEQ ID NO: 29132 - DNA, 25 bp, Homo sapien
atatcacacgatcaagtgctgtcat

SEQ ID NO: 29133 - DNA, 25 bp, Homo sapien
atatcacactagccatttccacaac

SEQ ID NO: 29134 - DNA, 25 bp, Homo sapien
atatcacactagtcatttccacaac

SEQ ID NO: 29135 - DNA, 25 bp, Homo sapien
atatcacagagagatgttcttaatc

SEQ ID NO: 29136 - DNA, 25 bp, Homo sapien
atatcacatgatcaagtgctgtcat

SEQ ID NO: 29137 - DNA, 25 bp, Homo sapien
atatcacatgcatcctcacatgcac

SEQ ID NO: 29138 - DNA, 25 bp, Homo sapien
atatcacatgcattctcacatgcac

SEQ ID NO: 29139 - DNA, 25 bp, Homo sapien
atatcaccaaaggatttaaatgtat

SEQ ID NO: 29140 - DNA, 25 bp, Homo sapien
atatcaccaaaggttttaaatgtat

SEQ ID NO: 29141 - DNA, 25 bp, Homo sapien
atatcaccacctaagaaaggcatgt

SEQ ID NO: 29142 - DNA, 25 bp, Homo sapien
atatcaccacctacgaaaggcatgt

SEQ ID NO: 29143 - DNA, 25 bp, Homo sapien
atatcagcaactactgaatgtgagg

SEQ ID NO: 29144 - DNA, 25 bp, Homo sapien
atatcagcaactattgaatgtgagg

SEQ ID NO: 29145 - DNA, 25 bp, Homo sapien
atatcagcccattaagcatcatttc

SEQ ID NO: 29146 - DNA, 25 bp, Homo sapien
atatcagctcattaagcatcatttc

SEQ ID NO: 29147 - DNA, 25 bp, Homo sapien
atatcaggttaccgtcaacattaat

SEQ ID NO: 29148 - DNA, 25 bp, Homo sapien
atatcaggttagcgtcaacattaat

SEQ ID NO: 29149 - DNA, 25 bp, Homo sapien
atatcagtcacatgcaactaagtat

SEQ ID NO: 29150 - DNA, 25 bp, Homo sapien
atatcagtcacgtgcaactaagtat

SEQ ID NO: 29151 - DNA, 25 bp, Homo sapien
atatcagtggcttcatataccaaag

SEQ ID NO: 29152 - DNA, 25 bp, Homo sapien
atatcagtgtcttcatataccaaag

SEQ ID NO: 29153 - DNA, 25 bp, Homo sapien
atatcagttaatcggtaatatctcc

SEQ ID NO: 29154 - DNA, 25 bp, Homo sapien
atatcagttaattggtaatatctcc

SEQ ID NO: 29155 - DNA, 25 bp, Homo sapien
atatcagttataaggactagattaa

SEQ ID NO: 29156 - DNA, 25 bp, Homo sapien
atatcagttttaaggactagattaa

SEQ ID NO: 29157 - DNA, 25 bp, Homo sapien
atatcatcgtccaggagggttccat

SEQ ID NO: 29158 - DNA, 25 bp, Homo sapien
atatcatctgtgttcctacatatag

SEQ ID NO: 29159 - DNA, 25 bp, Homo sapien
atatcatctgtgtttctacatatag

SEQ ID NO: 29160 - DNA, 25 bp, Homo sapien
atatcatcttccaggagggttccat

SEQ ID NO: 29161 - DNA, 25 bp, Homo sapien
atatcatctttgccgtgatttgagt

SEQ ID NO: 29162 - DNA, 25 bp, Homo sapien
atatcatctttgctgtgatttgagt

SEQ ID NO: 29163 - DNA, 25 bp, Homo sapien
atatcatttagtataacattgatgc

SEQ ID NO: 29164 - DNA, 25 bp, Homo sapien
atatcatttagtgtaacattgatgc

SEQ ID NO: 29165 - DNA, 25 bp, Homo sapien
atatcatttcttctcattaaatctc

SEQ ID NO: 29166 - DNA, 25 bp, Homo sapien
atatcatttcttctgattaaatctc

SEQ ID NO: 29167 - DNA, 25 bp, Homo sapien
atatccaaacaagtcaagctagaac

SEQ ID NO: 29168 - DNA, 25 bp, Homo sapien
atatccaagcaagtcaagctagaac

SEQ ID NO: 29169 - DNA, 25 bp, Homo sapien
atatccacaatctacaaagtgctga

SEQ ID NO: 29170 - DNA, 25 bp, Homo sapien
atatccacaatctacagagtgctga

SEQ ID NO: 29171 - DNA, 25 bp, Homo sapien
atatccagggttacttctagccctc

SEQ ID NO: 29172 - DNA, 25 bp, Homo sapien
atatccagggttccttctagccctc

SEQ ID NO: 29173 - DNA, 25 bp, Homo sapien
atatccatgaatataatgctacaat

SEQ ID NO: 29174 - DNA, 25 bp, Homo sapien
atatccatgaatttaatgctacaat

SEQ ID NO: 29175 - DNA, 25 bp, Homo sapien
atatccattcacagatcctaccaca

SEQ ID NO: 29176 - DNA, 25 bp, Homo sapien
atatccattcacagattctaccaca

SEQ ID NO: 29177 - DNA, 25 bp, Homo sapien
atatcccaggaagttgaaagtaatg

SEQ ID NO: 29178 - DNA, 25 bp, Homo sapien
atatcccaggaatttgaaagtaatg

SEQ ID NO: 29179 - DNA, 25 bp, Homo sapien
atatcccctagcacaaaaaagaaag

SEQ ID NO: 29180 - DNA, 25 bp, Homo sapien
atatcccctagcacaagaaagaaag

SEQ ID NO: 29181 - DNA, 25 bp, Homo sapien
atatcctctaagagaactttcagct

SEQ ID NO: 29182 - DNA, 25 bp, Homo sapien
atatcctctaagggaactttcagct

SEQ ID NO: 29183 - DNA, 25 bp, Homo sapien
atatcctttactatcctcttagtct

SEQ ID NO: 29184 - DNA, 25 bp, Homo sapien
atatcctttactattctcttagtct

SEQ ID NO: 29185 - DNA, 25 bp, Homo sapien
atatcgccggccccagtcttaagtg

SEQ ID NO: 29186 - DNA, 25 bp, Homo sapien
atatcgcctgccccagtcttaagtg

SEQ ID NO: 29187 - DNA, 25 bp, Homo sapien
atatcgctattattcaatgtggcaa

SEQ ID NO: 29188 - DNA, 25 bp, Homo sapien
atatcgctattgttcaatgtggcaa

SEQ ID NO: 29189 - DNA, 25 bp, Homo sapien
atatcggtgtatatcaaattttcct

SEQ ID NO: 29190 - DNA, 25 bp, Homo sapien
atatcggtgtatttcaaattttcct

SEQ ID NO: 29191 - DNA, 25 bp, Homo sapien
atatcgtcatggcagaacatagatt

SEQ ID NO: 29192 - DNA, 25 bp, Homo sapien
atatcgtcgtggcagaacatagatt

SEQ ID NO: 29193 - DNA, 25 bp, Homo sapien
atatctaataaacattgatacattt

SEQ ID NO: 29194 - DNA, 25 bp, Homo sapien
atatctaataagcattgatacattt

SEQ ID NO: 29195 - DNA, 25 bp, Homo sapien
atatctacagaaataattgtctctc

SEQ ID NO: 29196 - DNA, 25 bp, Homo sapien
atatctacagaagtaattgtctctc

SEQ ID NO: 29197 - DNA, 25 bp, Homo sapien
atatctatgcataccacaaaaggaa

SEQ ID NO: 29198 - DNA, 25 bp, Homo sapien
atatctatgcataccataaaaggaa

SEQ ID NO: 29199 - DNA, 25 bp, Homo sapien
atatctatggcaaactttttctgct

SEQ ID NO: 29200 - DNA, 25 bp, Homo sapien
atatctatggcaaagtttttctgct

SEQ ID NO: 29201 - DNA, 25 bp, Homo sapien
atatctattacattacccagcatag

SEQ ID NO: 29202 - DNA, 25 bp, Homo sapien
atatctattacgttacccagcatag

SEQ ID NO: 29203 - DNA, 25 bp, Homo sapien
atatctattagctataccaaggtta

SEQ ID NO: 29204 - DNA, 25 bp, Homo sapien
atatctattagctctaccaaggtta

SEQ ID NO: 29205 - DNA, 25 bp, Homo sapien
atatctattattcctacgtgtttct

SEQ ID NO: 29206 - DNA, 25 bp, Homo sapien
atatctattattcctatgtgtttct

SEQ ID NO: 29207 - DNA, 25 bp, Homo sapien
atatctcacagcatgattttattac

SEQ ID NO: 29208 - DNA, 25 bp, Homo sapien
atatctcacagtatgattttattac

SEQ ID NO: 29209 - DNA, 25 bp, Homo sapien
atatctctaatatgctatcgtgaac

SEQ ID NO: 29210 - DNA, 25 bp, Homo sapien
atatctctaatatgctgtcgtgaac

SEQ ID NO: 29211 - DNA, 25 bp, Homo sapien
atatctgccctgcaatgttgctaaa

SEQ ID NO: 29212 - DNA, 25 bp, Homo sapien
atatctgccttgcaatgttgctaaa

SEQ ID NO: 29213 - DNA, 25 bp, Homo sapien
atatctggggagccaacgggcagta

SEQ ID NO: 29214 - DNA, 25 bp, Homo sapien
atatctggggagccaatgggcagta

SEQ ID NO: 29215 - DNA, 25 bp, Homo sapien
atatctgtttaggtgcaactttgct

SEQ ID NO: 29216 - DNA, 25 bp, Homo sapien
atatctgtttaggttcaactttgct

SEQ ID NO: 29217 - DNA, 25 bp, Homo sapien
atatcttcacttaatcatctctgaa

SEQ ID NO: 29218 - DNA, 25 bp, Homo sapien
atatcttcccttaatcatctctgaa

SEQ ID NO: 29219 - DNA, 25 bp, Homo sapien
atatcttgagaaaacagggctaaat

SEQ ID NO: 29220 - DNA, 25 bp, Homo sapien
atatcttgagaagacagggctaaat

SEQ ID NO: 29221 - DNA, 25 bp, Homo sapien
atatctttcatccggtaaccactca

SEQ ID NO: 29222 - DNA, 25 bp, Homo sapien
atatctttcatctggtaaccactca

SEQ ID NO: 29223 - DNA, 25 bp, Homo sapien
atatgaaaaagccacttgggtctaa

SEQ ID NO: 29224 - DNA, 25 bp, Homo sapien
atatgaaaaggccacttgggtctaa

SEQ ID NO: 29225 - DNA, 25 bp, Homo sapien
atatgaaagtgtctacctaagatag

SEQ ID NO: 29226 - DNA, 25 bp, Homo sapien
atatgaaagtgtctgcctaagatag

SEQ ID NO: 29227 - DNA, 25 bp, Homo sapien
atatgaaatagctgctcctccagaa

SEQ ID NO: 29228 - DNA, 25 bp, Homo sapien
atatgaaatagcttctcctccagaa

SEQ ID NO: 29229 - DNA, 25 bp, Homo sapien
atatgaacaaaaatatcctagtgaa

SEQ ID NO: 29230 - DNA, 25 bp, Homo sapien
atatgaacaattaacatttcttgga

SEQ ID NO: 29231 - DNA, 25 bp, Homo sapien
atatgaacagaaatatcctagtgaa

SEQ ID NO: 29232 - DNA, 25 bp, Homo sapien
atatgaacagcttaacaaagatcag

SEQ ID NO: 29233 - DNA, 25 bp, Homo sapien
atatgaacagcttaccaaagatcag

SEQ ID NO: 29234 - DNA, 25 bp, Homo sapien
atatgaacagttaacatttcttgga

SEQ ID NO: 29235 - DNA, 25 bp, Homo sapien
atatgaacccaatttgtggtagtat

SEQ ID NO: 29236 - DNA, 25 bp, Homo sapien
atatgaacctaatttgtggtagtat

SEQ ID NO: 29237 - DNA, 25 bp, Homo sapien
atatgaacggagtattcaaggcgta

SEQ ID NO: 29238 - DNA, 25 bp, Homo sapien
atatgaactgagtattcaaggcgta

SEQ ID NO: 29239 - DNA, 25 bp, Homo sapien
atatgaatagtcctaaaatagaggg

SEQ ID NO: 29240 - DNA, 25 bp, Homo sapien
atatgaatagtcgtaaaatagaggg

SEQ ID NO: 29241 - DNA, 25 bp, Homo sapien
atatgaatatgaacttcctgatcct

SEQ ID NO: 29242 - DNA, 25 bp, Homo sapien
atatgaatatgaactttctgatcct

SEQ ID NO: 29243 - DNA, 25 bp, Homo sapien
atatgacaaatatttaatgctgata

SEQ ID NO: 29244 - DNA, 25 bp, Homo sapien
atatgacaaatgtttaatgctgata

SEQ ID NO: 29245 - DNA, 25 bp, Homo sapien
atatgacacaaatacatgtgcatat

SEQ ID NO: 29246 - DNA, 25 bp, Homo sapien
atatgacacaaatatatgtgcatat

SEQ ID NO: 29247 - DNA, 25 bp, Homo sapien
atatgacacgaacaaaggaatgtaa

SEQ ID NO: 29248 - DNA, 25 bp, Homo sapien
atatgacacgagaaaaaatggtcaa

SEQ ID NO: 29249 - DNA, 25 bp, Homo sapien
atatgacatgaacaaaggaatgtaa

SEQ ID NO: 29250 - DNA, 25 bp, Homo sapien
atatgacatgagaaaaaatggtcaa

SEQ ID NO: 29251 - DNA, 25 bp, Homo sapien
atatgactcgtaactttccaataac

SEQ ID NO: 29252 - DNA, 25 bp, Homo sapien
atatgacttgtaactttccaataac

SEQ ID NO: 29253 - DNA, 25 bp, Homo sapien
atatgagagcccaataactgtgaat

SEQ ID NO: 29254 - DNA, 25 bp, Homo sapien
atatgagagcccgataactgtgaat

SEQ ID NO: 29255 - DNA, 25 bp, Homo sapien
atatgagcatcaaaaaagatggact

SEQ ID NO: 29256 - DNA, 25 bp, Homo sapien
atatgagcatcagaaaagatggact

SEQ ID NO: 29257 - DNA, 25 bp, Homo sapien
atatgagccctttccggtaaaaagc

SEQ ID NO: 29258 - DNA, 25 bp, Homo sapien
atatgagccctttctggtaaaaagc

SEQ ID NO: 29259 - DNA, 25 bp, Homo sapien
atatgagctggaatccgacttttct

SEQ ID NO: 29260 - DNA, 25 bp, Homo sapien
atatgagctggaattcgacttttct

SEQ ID NO: 29261 - DNA, 25 bp, Homo sapien
atatgagggaaaatcagccatgaaa

SEQ ID NO: 29262 - DNA, 25 bp, Homo sapien
atatgagggaaaattagccatgaaa

SEQ ID NO: 29263 - DNA, 25 bp, Homo sapien
atatgaggtttaggtcctctttcaa

SEQ ID NO: 29264 - DNA, 25 bp, Homo sapien
atatgaggtttgggtcctctttcaa

SEQ ID NO: 29265 - DNA, 25 bp, Homo sapien
atatgagttcattaaaaaatatata

SEQ ID NO: 29266 - DNA, 25 bp, Homo sapien
atatgagttcattcaaaaatatata

SEQ ID NO: 29267 - DNA, 25 bp, Homo sapien
atatgatacaatgatggcacatatt

SEQ ID NO: 29268 - DNA, 25 bp, Homo sapien
atatgataccgacaggctattaata

SEQ ID NO: 29269 - DNA, 25 bp, Homo sapien
atatgatacgccaagcattgtgcta

SEQ ID NO: 29270 - DNA, 25 bp, Homo sapien
atatgatactgacaggctattaata

SEQ ID NO: 29271 - DNA, 25 bp, Homo sapien
atatgatataatgatggcacatatt

SEQ ID NO: 29272 - DNA, 25 bp, Homo sapien
atatgatatgccaagcattgtgcta

SEQ ID NO: 29273 - DNA, 25 bp, Homo sapien
atatgatcaaattttgcgaagataa

SEQ ID NO: 29274 - DNA, 25 bp, Homo sapien
atatgatcaaattttgtgaagataa

SEQ ID NO: 29275 - DNA, 25 bp, Homo sapien
atatgatccctgtaaagcatagact

SEQ ID NO: 29276 - DNA, 25 bp, Homo sapien
atatgatcgctgtaaagcatagact

SEQ ID NO: 29277 - DNA, 25 bp, Homo sapien
atatgatctaacgggacttaatttc

SEQ ID NO: 29278 - DNA, 25 bp, Homo sapien
atatgatctaatgggacttaatttc

SEQ ID NO: 29279 - DNA, 25 bp, Homo sapien
atatgatggttatcttgattttggt

SEQ ID NO: 29280 - DNA, 25 bp, Homo sapien
atatgatgtttatcttgattttggt

SEQ ID NO: 29281 - DNA, 25 bp, Homo sapien
atatgattagaaaacaatgcattat

SEQ ID NO: 29282 - DNA, 25 bp, Homo sapien
atatgattgcttaggtaaggtatgt

SEQ ID NO: 29283 - DNA, 25 bp, Homo sapien
atatgattgcttatgtaaggtatgt

SEQ ID NO: 29284 - DNA, 25 bp, Homo sapien
atatgattggaaaacaatgcattat

SEQ ID NO: 29285 - DNA, 25 bp, Homo sapien
atatgatttcagttgggccagttag

SEQ ID NO: 29286 - DNA, 25 bp, Homo sapien
atatgatttcatttgggccagttag

SEQ ID NO: 29287 - DNA, 25 bp, Homo sapien
atatgcaaaaacatgaacttcagtt

SEQ ID NO: 29288 - DNA, 25 bp, Homo sapien
atatgcaaaaatatgaacttcagtt

SEQ ID NO: 29289 - DNA, 25 bp, Homo sapien
atatgcaaagaactcttacaagtca

SEQ ID NO: 29290 - DNA, 25 bp, Homo sapien
atatgcaaataactcttacaagtca

SEQ ID NO: 29291 - DNA, 25 bp, Homo sapien
atatgcaaatacatcagtttacatg

SEQ ID NO: 29292 - DNA, 25 bp, Homo sapien
atatgcaaatacatcattttacatg

SEQ ID NO: 29293 - DNA, 25 bp, Homo sapien
atatgcaaatggaaatggtaataaa

SEQ ID NO: 29294 - DNA, 25 bp, Homo sapien
atatgcaaatggcaatggtaataaa

SEQ ID NO: 29295 - DNA, 25 bp, Homo sapien
atatgcaacaccaaaagtgagccct

SEQ ID NO: 29296 - DNA, 25 bp, Homo sapien
atatgcaacaccaagagtgagccct

SEQ ID NO: 29297 - DNA, 25 bp, Homo sapien
atatgcaactctctaatggctaata

SEQ ID NO: 29298 - DNA, 25 bp, Homo sapien
atatgcaactctttaatggctaata

SEQ ID NO: 29299 - DNA, 25 bp, Homo sapien
atatgcactttccttaataaaaatg

SEQ ID NO: 29300 - DNA, 25 bp, Homo sapien
atatgcactttcgttaataaaaatg

SEQ ID NO: 29301 - DNA, 25 bp, Homo sapien
atatgcatgtttctgcgaagaactc

SEQ ID NO: 29302 - DNA, 25 bp, Homo sapien
atatgcatgtttctgctaagaactc

SEQ ID NO: 29303 - DNA, 25 bp, Homo sapien
atatgccaaatactgtgaagtgttg

SEQ ID NO: 29304 - DNA, 25 bp, Homo sapien
atatgccaattactgtgaagtgttg

SEQ ID NO: 29305 - DNA, 25 bp, Homo sapien
atatgccacaagaaaggaacagagt

SEQ ID NO: 29306 - DNA, 25 bp, Homo sapien
atatgccacaagagaggaacagagt

SEQ ID NO: 29307 - DNA, 25 bp, Homo sapien
atatgccagatcactgaaggcagat

SEQ ID NO: 29308 - DNA, 25 bp, Homo sapien
atatgccagatcattgaaggcagat

SEQ ID NO: 29309 - DNA, 25 bp, Homo sapien
atatgcctcacagttgcattggacc

SEQ ID NO: 29310 - DNA, 25 bp, Homo sapien
atatgcctcgcagttgcattggacc

SEQ ID NO: 29311 - DNA, 25 bp, Homo sapien
atatgcctgaacatttgattggatg

SEQ ID NO: 29312 - DNA, 25 bp, Homo sapien
atatgcctggacatttgattggatg

SEQ ID NO: 29313 - DNA, 25 bp, Homo sapien
atatgcgtttacatcgaagggcttg

SEQ ID NO: 29314 - DNA, 25 bp, Homo sapien
atatgcgtttacgtcgaagggcttg

SEQ ID NO: 29315 - DNA, 25 bp, Homo sapien
atatgctgtcaatggtcaacactct

SEQ ID NO: 29316 - DNA, 25 bp, Homo sapien
atatgctgtcaattgtcaacactct

SEQ ID NO: 29317 - DNA, 25 bp, Homo sapien
atatgctgtgtaaggcctgttcctc

SEQ ID NO: 29318 - DNA, 25 bp, Homo sapien
atatgctgtgtaagtcctgttcctc

SEQ ID NO: 29319 - DNA, 25 bp, Homo sapien
atatgctttattatgtatgcataca

SEQ ID NO: 29320 - DNA, 25 bp, Homo sapien
atatgctttgttatgtatgcataca

SEQ ID NO: 29321 - DNA, 25 bp, Homo sapien
atatggacaactgatttgcaaccaa

SEQ ID NO: 29322 - DNA, 25 bp, Homo sapien
atatggacagctgatttgcaaccaa

SEQ ID NO: 29323 - DNA, 25 bp, Homo sapien
atatggatcacatgggtataatggg

SEQ ID NO: 29324 - DNA, 25 bp, Homo sapien
atatggatcacgtgggtataatggg

SEQ ID NO: 29325 - DNA, 25 bp, Homo sapien
atatggatcgttaatacctcaatag

SEQ ID NO: 29326 - DNA, 25 bp, Homo sapien
atatggatctttaatacctcaatag

SEQ ID NO: 29327 - DNA, 25 bp, Homo sapien
atatggattttgataaggattgtgt

SEQ ID NO: 29328 - DNA, 25 bp, Homo sapien
atatggattttgttaaggattgtgt

SEQ ID NO: 29329 - DNA, 25 bp, Homo sapien
atatggcaaaattacatatgagctt

SEQ ID NO: 29330 - DNA, 25 bp, Homo sapien
atatggcaaaattatatatgagctt

SEQ ID NO: 29331 - DNA, 25 bp, Homo sapien
atatggcacacaactctaaaatttt

SEQ ID NO: 29332 - DNA, 25 bp, Homo sapien
atatggcacacaagtctaaaatttt

SEQ ID NO: 29333 - DNA, 25 bp, Homo sapien
atatggcacatggctggggacctga

SEQ ID NO: 29334 - DNA, 25 bp, Homo sapien
atatggcacatggttggggacctga

SEQ ID NO: 29335 - DNA, 25 bp, Homo sapien
atatggcctaagaaaatgcagttaa

SEQ ID NO: 29336 - DNA, 25 bp, Homo sapien
atatggcctaaggaaatgcagttaa

SEQ ID NO: 29337 - DNA, 25 bp, Homo sapien
atatggctctaagtcagagtaatag

SEQ ID NO: 29338 - DNA, 25 bp, Homo sapien
atatggcttccaatttgagctccct

SEQ ID NO: 29339 - DNA, 25 bp, Homo sapien
atatggctttaagtcagagtaatag

SEQ ID NO: 29340 - DNA, 25 bp, Homo sapien
atatggctttcaatttgagctccct

SEQ ID NO: 29341 - DNA, 25 bp, Homo sapien
atatggcttttttattcactgaata

SEQ ID NO: 29342 - DNA, 25 bp, Homo sapien
atatggctttttttttcactgaata

SEQ ID NO: 29343 - DNA, 25 bp, Homo sapien
atatgggaagaaagatttggtttct

SEQ ID NO: 29344 - DNA, 25 bp, Homo sapien
atatgggaagaaaggtttggtttct

SEQ ID NO: 29345 - DNA, 25 bp, Homo sapien
atatgggtgctagacatttgacttg

SEQ ID NO: 29346 - DNA, 25 bp, Homo sapien
atatgggtgttagacatttgacttg

SEQ ID NO: 29347 - DNA, 25 bp, Homo sapien
atatggtacaggctattgttcctag

SEQ ID NO: 29348 - DNA, 25 bp, Homo sapien
atatggtagcaccaggttttgaacg

SEQ ID NO: 29349 - DNA, 25 bp, Homo sapien
atatggtagtaccaggttttgaacg

SEQ ID NO: 29350 - DNA, 25 bp, Homo sapien
atatggtataggctattgttcctag

SEQ ID NO: 29351 - DNA, 25 bp, Homo sapien
atatggtctactggcggtatccttt

SEQ ID NO: 29352 - DNA, 25 bp, Homo sapien
atatggtctactggtggtatccttt

SEQ ID NO: 29353 - DNA, 25 bp, Homo sapien
atatggtctgaccattgtctgtttg

SEQ ID NO: 29354 - DNA, 25 bp, Homo sapien
atatggtctgaccgttgtctgtttg

SEQ ID NO: 29355 - DNA, 25 bp, Homo sapien
atatggtgaaatgactatgggttct

SEQ ID NO: 29356 - DNA, 25 bp, Homo sapien
atatggtgaaatgactctgggttct

SEQ ID NO: 29357 - DNA, 25 bp, Homo sapien
atatggtgactgataactacccact

SEQ ID NO: 29358 - DNA, 25 bp, Homo sapien
atatggtgactgataattacccact

SEQ ID NO: 29359 - DNA, 25 bp, Homo sapien
atatggttccagagaacactgaact

SEQ ID NO: 29360 - DNA, 25 bp, Homo sapien
atatggttccatagaacactgaact

SEQ ID NO: 29361 - DNA, 25 bp, Homo sapien
atatggttgatcctaaattgaccag

SEQ ID NO: 29362 - DNA, 25 bp, Homo sapien
atatggttgattctaaattgaccag

SEQ ID NO: 29363 - DNA, 25 bp, Homo sapien
atatggttgtttcctttctatttga

SEQ ID NO: 29364 - DNA, 25 bp, Homo sapien
atatggttgttttctttctatttga

SEQ ID NO: 29365 - DNA, 25 bp, Homo sapien
atatgtaagtttgacgtgaagtggg

SEQ ID NO: 29366 - DNA, 25 bp, Homo sapien
atatgtaagtttgaggtgaagtggg

SEQ ID NO: 29367 - DNA, 25 bp, Homo sapien
atatgtacaactaggaagtatgagg

SEQ ID NO: 29368 - DNA, 25 bp, Homo sapien
atatgtacaactgggaagtatgagg

SEQ ID NO: 29369 - DNA, 25 bp, Homo sapien
atatgtacatacacatgcggatgtt

SEQ ID NO: 29370 - DNA, 25 bp, Homo sapien
atatgtacctacacatgcggatgtt

SEQ ID NO: 29371 - DNA, 25 bp, Homo sapien
atatgtagcctgtgggatcctcaaa

SEQ ID NO: 29372 - DNA, 25 bp, Homo sapien
atatgtagtctgtgggatcctcaaa

SEQ ID NO: 29373 - DNA, 25 bp, Homo sapien
atatgtatacgttaatctggaagct

SEQ ID NO: 29374 - DNA, 25 bp, Homo sapien
atatgtatatgttaatctggaagct

SEQ ID NO: 29375 - DNA, 25 bp, Homo sapien
atatgtcaggcactaatgctcagta

SEQ ID NO: 29376 - DNA, 25 bp, Homo sapien
atatgtcaggcagtaatgctcagta

SEQ ID NO: 29377 - DNA, 25 bp, Homo sapien
atatgtcctcacaaagatatgtgtt

SEQ ID NO: 29378 - DNA, 25 bp, Homo sapien
atatgtcctcacgaagatatgtgtt

SEQ ID NO: 29379 - DNA, 25 bp, Homo sapien
atatgtctacgcattcttgtaaagc

SEQ ID NO: 29380 - DNA, 25 bp, Homo sapien
atatgtctatgacgatttgcttggt

SEQ ID NO: 29381 - DNA, 25 bp, Homo sapien
atatgtctatgatgatttgcttggt

SEQ ID NO: 29382 - DNA, 25 bp, Homo sapien
atatgtctatgcattcttgtaaagc

SEQ ID NO: 29383 - DNA, 25 bp, Homo sapien
atatgtcttaaacttttgatatgag

SEQ ID NO: 29384 - DNA, 25 bp, Homo sapien
atatgtcttaatcttttgatatgag

SEQ ID NO: 29385 - DNA, 25 bp, Homo sapien
atatgtgaaagtctttcgattgttt

SEQ ID NO: 29386 - DNA, 25 bp, Homo sapien
atatgtgaaagtcttttgattgttt

SEQ ID NO: 29387 - DNA, 25 bp, Homo sapien
atatgtgaaatccgcaaatagagag

SEQ ID NO: 29388 - DNA, 25 bp, Homo sapien
atatgtgaaatctgcaaatagagag

SEQ ID NO: 29389 - DNA, 25 bp, Homo sapien
atatgtgagtatctacttccttttt

SEQ ID NO: 29390 - DNA, 25 bp, Homo sapien
atatgtgagtatttacttccttttt

SEQ ID NO: 29391 - DNA, 25 bp, Homo sapien
atatgtgatagagtagtgaagaatt

SEQ ID NO: 29392 - DNA, 25 bp, Homo sapien
atatgtgatagattagtgaagaatt

SEQ ID NO: 29393 - DNA, 25 bp, Homo sapien
atatgtgcaccttattgtatgtcag

SEQ ID NO: 29394 - DNA, 25 bp, Homo sapien
atatgtgcgccttattgtatgtcag

SEQ ID NO: 29395 - DNA, 25 bp, Homo sapien
atatgtgtagagctattatcctcat

SEQ ID NO: 29396 - DNA, 25 bp, Homo sapien
atatgtgtagatctattatcctcat

SEQ ID NO: 29397 - DNA, 25 bp, Homo sapien
atatgtgtgatatgtttgttatgta

SEQ ID NO: 29398 - DNA, 25 bp, Homo sapien
atatgtgtgatatttttgttatgta

SEQ ID NO: 29399 - DNA, 25 bp, Homo sapien
atatgtgtggcatgcgttatatttc

SEQ ID NO: 29400 - DNA, 25 bp, Homo sapien
atatgtgtggcatgtgttatatttc

SEQ ID NO: 29401 - DNA, 25 bp, Homo sapien
atatgtgttcgactttatatctgcc

SEQ ID NO: 29402 - DNA, 25 bp, Homo sapien
atatgtgttcggctttatatctgcc

SEQ ID NO: 29403 - DNA, 25 bp, Homo sapien
atatgttacagtcaaatcctctgct

SEQ ID NO: 29404 - DNA, 25 bp, Homo sapien
atatgttactgtcaaatcctctgct

SEQ ID NO: 29405 - DNA, 25 bp, Homo sapien
atatgttcagtgccttgaaataaaa

SEQ ID NO: 29406 - DNA, 25 bp, Homo sapien
atatgttcagtgtcttgaaataaaa

SEQ ID NO: 29407 - DNA, 25 bp, Homo sapien
atatgttcattttatgtgagcaaat

SEQ ID NO: 29408 - DNA, 25 bp, Homo sapien
atatgttcattttttgtgagcaaat

SEQ ID NO: 29409 - DNA, 25 bp, Homo sapien
atatgttccggaccccaagaaaatt

SEQ ID NO: 29410 - DNA, 25 bp, Homo sapien
atatgttctggaccccaagaaaatt

SEQ ID NO: 29411 - DNA, 25 bp, Homo sapien
atatgttgagtctctgctgctactt

SEQ ID NO: 29412 - DNA, 25 bp, Homo sapien
atatgttgagtttctgctgctactt

SEQ ID NO: 29413 - DNA, 25 bp, Homo sapien
atatgttgcctagagcccgatgcta

SEQ ID NO: 29414 - DNA, 25 bp, Homo sapien
atatgttgcctagagctcgatgcta

SEQ ID NO: 29415 - DNA, 25 bp, Homo sapien
atatgttgggccacgtgacaaacat

SEQ ID NO: 29416 - DNA, 25 bp, Homo sapien
atatgttgggctacgtgacaaacat

SEQ ID NO: 29417 - DNA, 25 bp, Homo sapien
atatgtttagtgtcggtaagatcta

SEQ ID NO: 29418 - DNA, 25 bp, Homo sapien
atatgtttagtgttggtaagatcta

SEQ ID NO: 29419 - DNA, 25 bp, Homo sapien
atatgtttatcaaaatactcccata

SEQ ID NO: 29420 - DNA, 25 bp, Homo sapien
atatgtttatccaaatactcccata

SEQ ID NO: 29421 - DNA, 25 bp, Homo sapien
atatgtttgcaatgagcatgctttc

SEQ ID NO: 29422 - DNA, 25 bp, Homo sapien
atatgtttggaatgagcatgctttc

SEQ ID NO: 29423 - DNA, 25 bp, Homo sapien
atatgttttatcatcctgtttctgc

SEQ ID NO: 29424 - DNA, 25 bp, Homo sapien
atatgttttattatcctgtttctgc

SEQ ID NO: 29425 - DNA, 25 bp, Homo sapien
atatgttttattcacgttctcggtg

SEQ ID NO: 29426 - DNA, 25 bp, Homo sapien
atatgttttattcatgttctcggtg

SEQ ID NO: 29427 - DNA, 25 bp, Homo sapien
atatgttttccacaaggcttgcaat

SEQ ID NO: 29428 - DNA, 25 bp, Homo sapien
atatgttttccacgaggcttgcaat

SEQ ID NO: 29429 - DNA, 25 bp, Homo sapien
atattaaacacaaggataatgaatc

SEQ ID NO: 29430 - DNA, 25 bp, Homo sapien
atattaaacacaagtataatgaatc

SEQ ID NO: 29431 - DNA, 25 bp, Homo sapien
atattaaatcactcttagtacgcag

SEQ ID NO: 29432 - DNA, 25 bp, Homo sapien
atattaaatcactgttagtacgcag

SEQ ID NO: 29433 - DNA, 25 bp, Homo sapien
atattaaccatgatgcagatcccct

SEQ ID NO: 29434 - DNA, 25 bp, Homo sapien
atattaaccatgatgctgatcccct

SEQ ID NO: 29435 - DNA, 25 bp, Homo sapien
atattaagaggctttatacacttct

SEQ ID NO: 29436 - DNA, 25 bp, Homo sapien
atattaagatgctttatacacttct

SEQ ID NO: 29437 - DNA, 25 bp, Homo sapien
atattaatcacaactagtttcagaa

SEQ ID NO: 29438 - DNA, 25 bp, Homo sapien
atattaatcacgactagtttcagaa

SEQ ID NO: 29439 - DNA, 25 bp, Homo sapien
atattaccaatgctactgataaagc

SEQ ID NO: 29440 - DNA, 25 bp, Homo sapien
atattaccagtgctactgataaagc

SEQ ID NO: 29441 - DNA, 25 bp, Homo sapien
atattagacacaagtacttaggcag

SEQ ID NO: 29442 - DNA, 25 bp, Homo sapien
atattagacctgcgttctacctaac

SEQ ID NO: 29443 - DNA, 25 bp, Homo sapien
atattagacctgtgttctacctaac

SEQ ID NO: 29444 - DNA, 25 bp, Homo sapien
atattagacgcaagtacttaggcag

SEQ ID NO: 29445 - DNA, 25 bp, Homo sapien
atattagatctgcatgcctctatat

SEQ ID NO: 29446 - DNA, 25 bp, Homo sapien
atattagatctgcatgtctctatat

SEQ ID NO: 29447 - DNA, 25 bp, Homo sapien
atattagtgatgattcaatgcattt

SEQ ID NO: 29448 - DNA, 25 bp, Homo sapien
atattagtgatggttcaatgcattt

SEQ ID NO: 29449 - DNA, 25 bp, Homo sapien
atattagttgttactcatttgtgag

SEQ ID NO: 29450 - DNA, 25 bp, Homo sapien
atattagttgttattcatttgtgag

SEQ ID NO: 29451 - DNA, 25 bp, Homo sapien
atattagtttttagcagtgtcaaaa

SEQ ID NO: 29452 - DNA, 25 bp, Homo sapien
atattagtttttagtagtgtcaaaa

SEQ ID NO: 29453 - DNA, 25 bp, Homo sapien
atattataacttcgcctcaaaattc

SEQ ID NO: 29454 - DNA, 25 bp, Homo sapien
atattataacttctcctcaaaattc

SEQ ID NO: 29455 - DNA, 25 bp, Homo sapien
atattatacaccttgttctgtatct

SEQ ID NO: 29456 - DNA, 25 bp, Homo sapien
atattatacacgttgttctgtatct

SEQ ID NO: 29457 - DNA, 25 bp, Homo sapien
atattatacgtaggagcaatcacag

SEQ ID NO: 29458 - DNA, 25 bp, Homo sapien
atattatatgtaggagcaatcacag

SEQ ID NO: 29459 - DNA, 25 bp, Homo sapien
atattatcaaaaacagcttgtcacg

SEQ ID NO: 29460 - DNA, 25 bp, Homo sapien
atattatcaacacgacagaagagaa

SEQ ID NO: 29461 - DNA, 25 bp, Homo sapien
atattatcaacatgacagaagagaa

SEQ ID NO: 29462 - DNA, 25 bp, Homo sapien
atattatcatccgagccataactgg

SEQ ID NO: 29463 - DNA, 25 bp, Homo sapien
atattatcatcggagccataactgg

SEQ ID NO: 29464 - DNA, 25 bp, Homo sapien
atattatccaaaacagcttgtcacg

SEQ ID NO: 29465 - DNA, 25 bp, Homo sapien
atattatccatcattatggcaaaga

SEQ ID NO: 29466 - DNA, 25 bp, Homo sapien
atattatccatctttatggcaaaga

SEQ ID NO: 29467 - DNA, 25 bp, Homo sapien
atattatctcaaatggcacaaggga

SEQ ID NO: 29468 - DNA, 25 bp, Homo sapien
atattatctcacatggcacaaggga

SEQ ID NO: 29469 - DNA, 25 bp, Homo sapien
atattatgagaattagtggtcactg

SEQ ID NO: 29470 - DNA, 25 bp, Homo sapien
atattatgagagttagtggtcactg

SEQ ID NO: 29471 - DNA, 25 bp, Homo sapien
atattatgcacagttggatttattt

SEQ ID NO: 29472 - DNA, 25 bp, Homo sapien
atattatgcccagttggatttattt

SEQ ID NO: 29473 - DNA, 25 bp, Homo sapien
atattatttccatcattccattgtg

SEQ ID NO: 29474 - DNA, 25 bp, Homo sapien
atattatttccatctttccattgtg

SEQ ID NO: 29475 - DNA, 25 bp, Homo sapien
atattcaaagagccacgaagagaaa

SEQ ID NO: 29476 - DNA, 25 bp, Homo sapien
atattcaaagagctacgaagagaaa

SEQ ID NO: 29477 - DNA, 25 bp, Homo sapien
atattcaatgaaattcagaagatgt

SEQ ID NO: 29478 - DNA, 25 bp, Homo sapien
atattcaatgaaattcggaagatgt

SEQ ID NO: 29479 - DNA, 25 bp, Homo sapien
atattcactcttacattttaactca

SEQ ID NO: 29480 - DNA, 25 bp, Homo sapien
atattcactcttagattttaactca

SEQ ID NO: 29481 - DNA, 25 bp, Homo sapien
atattcactctttgacatgtagggc

SEQ ID NO: 29482 - DNA, 25 bp, Homo sapien
atattcactctttggcatgtagggc

SEQ ID NO: 29483 - DNA, 25 bp, Homo sapien
atattcactttccggtcttgttata

SEQ ID NO: 29484 - DNA, 25 bp, Homo sapien
atattcactttctggtcttgttata

SEQ ID NO: 29485 - DNA, 25 bp, Homo sapien
atattcagaagaaaactttccagca

SEQ ID NO: 29486 - DNA, 25 bp, Homo sapien
atattcagaagaaacctttccagca

SEQ ID NO: 29487 - DNA, 25 bp, Homo sapien
atattcagcattattcaagcagcta

SEQ ID NO: 29488 - DNA, 25 bp, Homo sapien
atattcagcattgttcaagcagcta

SEQ ID NO: 29489 - DNA, 25 bp, Homo sapien
atattcatcagaaatacttgtctat

SEQ ID NO: 29490 - DNA, 25 bp, Homo sapien
atattcatcaggaatacttgtctat

SEQ ID NO: 29491 - DNA, 25 bp, Homo sapien
atattccattctgcggataggccac

SEQ ID NO: 29492 - DNA, 25 bp, Homo sapien
atattccattctgtggataggccac

SEQ ID NO: 29493 - DNA, 25 bp, Homo sapien
atattcctatccttctgtggacagt

SEQ ID NO: 29494 - DNA, 25 bp, Homo sapien
atattcctatccttttgtggacagt

SEQ ID NO: 29495 - DNA, 25 bp, Homo sapien
atattcctcacctatggtttttgta

SEQ ID NO: 29496 - DNA, 25 bp, Homo sapien
atattccttacctatggtttttgta

SEQ ID NO: 29497 - DNA, 25 bp, Homo sapien
atattcgaacggtctgggttaggag

SEQ ID NO: 29498 - DNA, 25 bp, Homo sapien
atattcgaatggtctgggttaggag

SEQ ID NO: 29499 - DNA, 25 bp, Homo sapien
atattctaaaacagactgaatgatt

SEQ ID NO: 29500 - DNA, 25 bp, Homo sapien
atattctaacacagactgaatgatt

SEQ ID NO: 29501 - DNA, 25 bp, Homo sapien
atattctcaacacggcaatgatttt

SEQ ID NO: 29502 - DNA, 25 bp, Homo sapien
atattctcaacatggcaatgatttt

SEQ ID NO: 29503 - DNA, 25 bp, Homo sapien
atattctgtgacagtagcccaaatg

SEQ ID NO: 29504 - DNA, 25 bp, Homo sapien
atattctgtgatagtagcccaaatg

SEQ ID NO: 29505 - DNA, 25 bp, Homo sapien
atattcttacaaaattcacatggta

SEQ ID NO: 29506 - DNA, 25 bp, Homo sapien
atattcttacaaaatttacatggta

SEQ ID NO: 29507 - DNA, 25 bp, Homo sapien
atattgaaaagcagattccaaagtt

SEQ ID NO: 29508 - DNA, 25 bp, Homo sapien
atattgaaaagcaggttccaaagtt

SEQ ID NO: 29509 - DNA, 25 bp, Homo sapien
atattgaactctgatacaggatatt

SEQ ID NO: 29510 - DNA, 25 bp, Homo sapien
atattgaactctgatataggatatt

SEQ ID NO: 29511 - DNA, 25 bp, Homo sapien
atattgacaaacactcagaccagtt

SEQ ID NO: 29512 - DNA, 25 bp, Homo sapien
atattgacaaatactcagaccagtt

SEQ ID NO: 29513 - DNA, 25 bp, Homo sapien
atattgagaaaatggcaataaaaag

SEQ ID NO: 29514 - DNA, 25 bp, Homo sapien
atattgagaaaatggcgataaaaag

SEQ ID NO: 29515 - DNA, 25 bp, Homo sapien
atattgaggcttaagagtcatgaag

SEQ ID NO: 29516 - DNA, 25 bp, Homo sapien
atattgaggtgactgataaagtttg

SEQ ID NO: 29517 - DNA, 25 bp, Homo sapien
atattgaggtgattgataaagtttg

SEQ ID NO: 29518 - DNA, 25 bp, Homo sapien
atattgagtcttaagagtcatgaag

SEQ ID NO: 29519 - DNA, 25 bp, Homo sapien
atattgatcaccttattacctagac

SEQ ID NO: 29520 - DNA, 25 bp, Homo sapien
atattgattaccttattacctagac

SEQ ID NO: 29521 - DNA, 25 bp, Homo sapien
atattgcccttgctccaaaatacag

SEQ ID NO: 29522 - DNA, 25 bp, Homo sapien
atattgcctttgctccaaaatacag

SEQ ID NO: 29523 - DNA, 25 bp, Homo sapien
atattggataggtaacccacagtca

SEQ ID NO: 29524 - DNA, 25 bp, Homo sapien
atattggataggtaccccacagtca

SEQ ID NO: 29525 - DNA, 25 bp, Homo sapien
atattggatatcgtgaattgtctgt

SEQ ID NO: 29526 - DNA, 25 bp, Homo sapien
atattggatatcttgaattgtctgt

SEQ ID NO: 29527 - DNA, 25 bp, Homo sapien
atattggcaaaccatgtgttgttat

SEQ ID NO: 29528 - DNA, 25 bp, Homo sapien
atattggcaaactatgtgttgttat

SEQ ID NO: 29529 - DNA, 25 bp, Homo sapien
atattgggtaagtttctgggcacat

SEQ ID NO: 29530 - DNA, 25 bp, Homo sapien
atattgggtgagtttctgggcacat

SEQ ID NO: 29531 - DNA, 25 bp, Homo sapien
atattgtcaaaacggccatactacc

SEQ ID NO: 29532 - DNA, 25 bp, Homo sapien
atattgtcaaaagggccatactacc

SEQ ID NO: 29533 - DNA, 25 bp, Homo sapien
atattgtcacatctaatttgcaagc

SEQ ID NO: 29534 - DNA, 25 bp, Homo sapien
atattgtcccatctaatttgcaagc

SEQ ID NO: 29535 - DNA, 25 bp, Homo sapien
atattgtccttttaagttttttgat

SEQ ID NO: 29536 - DNA, 25 bp, Homo sapien
atattgtccttttacgttttttgat

SEQ ID NO: 29537 - DNA, 25 bp, Homo sapien
atattgtctggttttgacaatcata

SEQ ID NO: 29538 - DNA, 25 bp, Homo sapien
atattgtctggttttggcaatcata

SEQ ID NO: 29539 - DNA, 25 bp, Homo sapien
atattgtcttcaaaacatctgcatt

SEQ ID NO: 29540 - DNA, 25 bp, Homo sapien
atattgtcttcaaaacgtctgcatt

SEQ ID NO: 29541 - DNA, 25 bp, Homo sapien
atattgtgcatgacacctagaaaac

SEQ ID NO: 29542 - DNA, 25 bp, Homo sapien
atattgtgcgtgacacctagaaaac

SEQ ID NO: 29543 - DNA, 25 bp, Homo sapien
atattgtggaaacaaacagaatgca

SEQ ID NO: 29544 - DNA, 25 bp, Homo sapien
atattgtggaagcaaacagaatgca

SEQ ID NO: 29545 - DNA, 25 bp, Homo sapien
atattgttactgacatgatgcccct

SEQ ID NO: 29546 - DNA, 25 bp, Homo sapien
atattgttactgacattatgcccct

SEQ ID NO: 29547 - DNA, 25 bp, Homo sapien
atattgttccatttcccttctctac

SEQ ID NO: 29548 - DNA, 25 bp, Homo sapien
atattgttccatttcctttctctac

SEQ ID NO: 29549 - DNA, 25 bp, Homo sapien
atattgtttggcatcaatatcacaa

SEQ ID NO: 29550 - DNA, 25 bp, Homo sapien
atattgttttgcatcaatatcacaa

SEQ ID NO: 29551 - DNA, 25 bp, Homo sapien
atatttaaaaatacgaccactttgg

SEQ ID NO: 29552 - DNA, 25 bp, Homo sapien
atatttaaaaatatgaccactttgg

SEQ ID NO: 29553 - DNA, 25 bp, Homo sapien
atatttaagcgtacaattcagcagc

SEQ ID NO: 29554 - DNA, 25 bp, Homo sapien
atatttaagtgtacaattcagcagc

SEQ ID NO: 29555 - DNA, 25 bp, Homo sapien
atatttaatgtaggcaatttgatga

SEQ ID NO: 29556 - DNA, 25 bp, Homo sapien
atatttaatgtatgcaatttgatga

SEQ ID NO: 29557 - DNA, 25 bp, Homo sapien
atatttacagagaccaacagcaaaa

SEQ ID NO: 29558 - DNA, 25 bp, Homo sapien
atatttacagaggccaacagcaaaa

SEQ ID NO: 29559 - DNA, 25 bp, Homo sapien
atatttaccaaagggattctttatt

SEQ ID NO: 29560 - DNA, 25 bp, Homo sapien
atatttaccgaagggattctttatt

SEQ ID NO: 29561 - DNA, 25 bp, Homo sapien
atatttagaattatgatttgagctt

SEQ ID NO: 29562 - DNA, 25 bp, Homo sapien
atatttagaattgtgatttgagctt

SEQ ID NO: 29563 - DNA, 25 bp, Homo sapien
atatttagctcatttccaaatgacc

SEQ ID NO: 29564 - DNA, 25 bp, Homo sapien
atatttagttcatttccaaatgacc

SEQ ID NO: 29565 - DNA, 25 bp, Homo sapien
atatttatcaatgtgcaaaacagct

SEQ ID NO: 29566 - DNA, 25 bp, Homo sapien
atatttatcgatgtgcaaaacagct

SEQ ID NO: 29567 - DNA, 25 bp, Homo sapien
atatttcaacactaaaatttagcga

SEQ ID NO: 29568 - DNA, 25 bp, Homo sapien
atatttcaacagtaaaatttagcga

SEQ ID NO: 29569 - DNA, 25 bp, Homo sapien
atatttcagagacaacaaggcctat

SEQ ID NO: 29570 - DNA, 25 bp, Homo sapien
atatttcagagacaactaggcctat

SEQ ID NO: 29571 - DNA, 25 bp, Homo sapien
atatttcaggtggagcaaatgctta

SEQ ID NO: 29572 - DNA, 25 bp, Homo sapien
atatttcaggttgagcaaatgctta

SEQ ID NO: 29573 - DNA, 25 bp, Homo sapien
atatttcagtagtcaggtatgttta

SEQ ID NO: 29574 - DNA, 25 bp, Homo sapien
atatttcattagtcaggtatgttta

SEQ ID NO: 29575 - DNA, 25 bp, Homo sapien
atatttccataaacagcagaaagcc

SEQ ID NO: 29576 - DNA, 25 bp, Homo sapien
atatttccataagcagcagaaagcc

SEQ ID NO: 29577 - DNA, 25 bp, Homo sapien
atatttcctactagctataagagtg

SEQ ID NO: 29578 - DNA, 25 bp, Homo sapien
atatttcctactagctgtaagagtg

SEQ ID NO: 29579 - DNA, 25 bp, Homo sapien
atatttcctcactaatatctataag

SEQ ID NO: 29580 - DNA, 25 bp, Homo sapien
atatttcctcactaatctctataag

SEQ ID NO: 29581 - DNA, 25 bp, Homo sapien
atatttctccttaagtacaattgga

SEQ ID NO: 29582 - DNA, 25 bp, Homo sapien
atatttctccttaagttcaattgga

SEQ ID NO: 29583 - DNA, 25 bp, Homo sapien
atatttctgccacaactaagaggaa

SEQ ID NO: 29584 - DNA, 25 bp, Homo sapien
atatttctgccacgactaagaggaa

SEQ ID NO: 29585 - DNA, 25 bp, Homo sapien
atatttcttctgaagggtattctgc

SEQ ID NO: 29586 - DNA, 25 bp, Homo sapien
atatttcttctgaaggttattctgc

SEQ ID NO: 29587 - DNA, 25 bp, Homo sapien
atatttcttttgccaacctgcatct

SEQ ID NO: 29588 - DNA, 25 bp, Homo sapien
atatttcttttgtcaacctgcatct

SEQ ID NO: 29589 - DNA, 25 bp, Homo sapien
atatttgaaaaaagacttcatatcc

SEQ ID NO: 29590 - DNA, 25 bp, Homo sapien
atatttgacatggaaagtctaggta

SEQ ID NO: 29591 - DNA, 25 bp, Homo sapien
atatttgacatggcttcctccttca

SEQ ID NO: 29592 - DNA, 25 bp, Homo sapien
atatttgacatgggaagtctaggta

SEQ ID NO: 29593 - DNA, 25 bp, Homo sapien
atatttgacgtggcttcctccttca

SEQ ID NO: 29594 - DNA, 25 bp, Homo sapien
atatttgataaaagacttcatatcc

SEQ ID NO: 29595 - DNA, 25 bp, Homo sapien
atatttgatgaggccgtgaaatgcc

SEQ ID NO: 29596 - DNA, 25 bp, Homo sapien
atatttgatgaggctgtgaaatgcc

SEQ ID NO: 29597 - DNA, 25 bp, Homo sapien
atatttgcctggatttggccttatc

SEQ ID NO: 29598 - DNA, 25 bp, Homo sapien
atatttgcctgggtttggccttatc

SEQ ID NO: 29599 - DNA, 25 bp, Homo sapien
atatttggaaaaccataaagggcta

SEQ ID NO: 29600 - DNA, 25 bp, Homo sapien
atatttggaaagccataaagggcta

SEQ ID NO: 29601 - DNA, 25 bp, Homo sapien
atatttggattccagtcctttatgt

SEQ ID NO: 29602 - DNA, 25 bp, Homo sapien
atatttgggaacaactctttggcag

SEQ ID NO: 29603 - DNA, 25 bp, Homo sapien
atatttgggaacaattctttggcag

SEQ ID NO: 29604 - DNA, 25 bp, Homo sapien
atatttgggttccagtcctttatgt

SEQ ID NO: 29605 - DNA, 25 bp, Homo sapien
atatttgtattgcttcatccctgcc

SEQ ID NO: 29606 - DNA, 25 bp, Homo sapien
atatttgtattgcttcgtccctgcc

SEQ ID NO: 29607 - DNA, 25 bp, Homo sapien
atatttgtttttagtttctcaggct

SEQ ID NO: 29608 - DNA, 25 bp, Homo sapien
atatttgttttttgtttctcaggct

SEQ ID NO: 29609 - DNA, 25 bp, Homo sapien
atattttaccatgccgtttattcat

SEQ ID NO: 29610 - DNA, 25 bp, Homo sapien
atattttaccatgctgtttattcat

SEQ ID NO: 29611 - DNA, 25 bp, Homo sapien
atattttacgtcctttgcatatggg

SEQ ID NO: 29612 - DNA, 25 bp, Homo sapien
atattttagtgcactggttccctga

SEQ ID NO: 29613 - DNA, 25 bp, Homo sapien
atattttagtgcgctggttccctga

SEQ ID NO: 29614 - DNA, 25 bp, Homo sapien
atattttatgtcctttgcatatggg

SEQ ID NO: 29615 - DNA, 25 bp, Homo sapien
atattttcaatctctgattcataag

SEQ ID NO: 29616 - DNA, 25 bp, Homo sapien
atattttctatctctgattcataag

SEQ ID NO: 29617 - DNA, 25 bp, Homo sapien
atattttcttcaggccagctactct

SEQ ID NO: 29618 - DNA, 25 bp, Homo sapien
atattttcttcgggccagctactct

SEQ ID NO: 29619 - DNA, 25 bp, Homo sapien
atattttgtgctcacgtcctatgta

SEQ ID NO: 29620 - DNA, 25 bp, Homo sapien
atattttgtgctcatgtcctatgta

SEQ ID NO: 29621 - DNA, 25 bp, Homo sapien
atattttgttcacatttttaacaga

SEQ ID NO: 29622 - DNA, 25 bp, Homo sapien
atattttgttcacgtttttaacaga

SEQ ID NO: 29623 - DNA, 25 bp, Homo sapien
atatttttaagtcaaatggacaaaa

SEQ ID NO: 29624 - DNA, 25 bp, Homo sapien
atatttttagagcacttctgcaaca

SEQ ID NO: 29625 - DNA, 25 bp, Homo sapien
atatttttagagcccttctgcaaca

SEQ ID NO: 29626 - DNA, 25 bp, Homo sapien
atatttttaggtcaaatggacaaaa

SEQ ID NO: 29627 - DNA, 25 bp, Homo sapien
atatttttcaaactacctccatgat

SEQ ID NO: 29628 - DNA, 25 bp, Homo sapien
atatttttcctcttcactctcctcc

SEQ ID NO: 29629 - DNA, 25 bp, Homo sapien
atatttttgaaactacctccatgat

SEQ ID NO: 29630 - DNA, 25 bp, Homo sapien
atattttttctcttcactctcctcc

SEQ ID NO: 29631 - DNA, 25 bp, Homo sapien
atattttttgtatgcttcctttcat

SEQ ID NO: 29632 - DNA, 25 bp, Homo sapien
atattttttgtgtgcttcctttcat

SEQ ID NO: 29633 - DNA, 25 bp, Homo sapien
atcaaaaaagcatgatattagtaca

SEQ ID NO: 29634 - DNA, 25 bp, Homo sapien
atcaaaaaagcatggtattagtaca

SEQ ID NO: 29635 - DNA, 25 bp, Homo sapien
atcaaaaatcaattggacttagtgt

SEQ ID NO: 29636 - DNA, 25 bp, Homo sapien
atcaaaaatcacttggacttagtgt

SEQ ID NO: 29637 - DNA, 25 bp, Homo sapien
atcaaaacacagtgtgcctttgtat

SEQ ID NO: 29638 - DNA, 25 bp, Homo sapien
atcaaaacagagtgtgcctttgtat

SEQ ID NO: 29639 - DNA, 25 bp, Homo sapien
atcaaaacgagtagaaatgaaacta

SEQ ID NO: 29640 - DNA, 25 bp, Homo sapien
atcaaaacgagtggaaatgaaacta

SEQ ID NO: 29641 - DNA, 25 bp, Homo sapien
atcaaaataattcagtaaatcatgc

SEQ ID NO: 29642 - DNA, 25 bp, Homo sapien
atcaaaataattcagttaatcatgc

SEQ ID NO: 29643 - DNA, 25 bp, Homo sapien
atcaaaatttgcaggatatggttga

SEQ ID NO: 29644 - DNA, 25 bp, Homo sapien
atcaaaatttgtaggatatggttga

SEQ ID NO: 29645 - DNA, 25 bp, Homo sapien
atcaaacatttatactcaacttgcc

SEQ ID NO: 29646 - DNA, 25 bp, Homo sapien
atcaaacatttatattcaacttgcc

SEQ ID NO: 29647 - DNA, 25 bp, Homo sapien
atcaaagaccatttgactctatttg

SEQ ID NO: 29648 - DNA, 25 bp, Homo sapien
atcaaagaccattttactctatttg

SEQ ID NO: 29649 - DNA, 25 bp, Homo sapien
atcaaagatcacaaacagtgcaaat

SEQ ID NO: 29650 - DNA, 25 bp, Homo sapien
atcaaagatcataaacagtgcaaat

SEQ ID NO: 29651 - DNA, 25 bp, Homo sapien
atcaaagcaacgtatcaaaagctat

SEQ ID NO: 29652 - DNA, 25 bp, Homo sapien
atcaaagcaacgtatcgaaagctat

SEQ ID NO: 29653 - DNA, 25 bp, Homo sapien
atcaaagctgtatgaagtaagactg

SEQ ID NO: 29654 - DNA, 25 bp, Homo sapien
atcaaagctttatgaagtaagactg

SEQ ID NO: 29655 - DNA, 25 bp, Homo sapien
atcaaaggattcttgtcttcattat

SEQ ID NO: 29656 - DNA, 25 bp, Homo sapien
atcaaaggattgttgtcttcattat

SEQ ID NO: 29657 - DNA, 25 bp, Homo sapien
atcaaagtcatacgtgtagagaaga

SEQ ID NO: 29658 - DNA, 25 bp, Homo sapien
atcaaagtcatatgtgtagagaaga

SEQ ID NO: 29659 - DNA, 25 bp, Homo sapien
atcaaagtggaatccacaagccagc

SEQ ID NO: 29660 - DNA, 25 bp, Homo sapien
atcaaagtggagtccacaagccagc

SEQ ID NO: 29661 - DNA, 25 bp, Homo sapien
atcaaagttatgtcctccaatctaa

SEQ ID NO: 29662 - DNA, 25 bp, Homo sapien
atcaaagttatgttctccaatctaa

SEQ ID NO: 29663 - DNA, 25 bp, Homo sapien
atcaaagttttgcctgagctatagg

SEQ ID NO: 29664 - DNA, 25 bp, Homo sapien
atcaaagttttgcttgagctatagg

SEQ ID NO: 29665 - DNA, 25 bp, Homo sapien
atcaaataatcctcacgtatagggt

SEQ ID NO: 29666 - DNA, 25 bp, Homo sapien
atcaaatagtcctcacgtatagggt

SEQ ID NO: 29667 - DNA, 25 bp, Homo sapien
atcaaatatacaaacacaagctttt

SEQ ID NO: 29668 - DNA, 25 bp, Homo sapien
atcaaatatacaaatacaagctttt

SEQ ID NO: 29669 - DNA, 25 bp, Homo sapien
atcaaatatctccggcatttcaaag

SEQ ID NO: 29670 - DNA, 25 bp, Homo sapien
atcaaatatctctggcatttcaaag

SEQ ID NO: 29671 - DNA, 25 bp, Homo sapien
atcaaatatgattagaaaacaatgc

SEQ ID NO: 29672 - DNA, 25 bp, Homo sapien
atcaaatatgattggaaaacaatgc

SEQ ID NO: 29673 - DNA, 25 bp, Homo sapien
atcaaatattccatgagtgttccaa

SEQ ID NO: 29674 - DNA, 25 bp, Homo sapien
atcaaatattccgtgagtgttccaa

SEQ ID NO: 29675 - DNA, 25 bp, Homo sapien
atcaaatcaattttcgatgctcatg

SEQ ID NO: 29676 - DNA, 25 bp, Homo sapien
atcaaatcaatttttgatgctcatg

SEQ ID NO: 29677 - DNA, 25 bp, Homo sapien
atcaaatccactgacaatgttatat

SEQ ID NO: 29678 - DNA, 25 bp, Homo sapien
atcaaatccactgccaatgttatat

SEQ ID NO: 29679 - DNA, 25 bp, Homo sapien
atcaaatccattgaaggccaataat

SEQ ID NO: 29680 - DNA, 25 bp, Homo sapien
atcaaatccatttaaggccaataat

SEQ ID NO: 29681 - DNA, 25 bp, Homo sapien
atcaaatcctgtcgttgtaggtaaa

SEQ ID NO: 29682 - DNA, 25 bp, Homo sapien
atcaaatcctgttgttgtaggtaaa

SEQ ID NO: 29683 - DNA, 25 bp, Homo sapien
atcaaatgaaaccaaaaggaattac

SEQ ID NO: 29684 - DNA, 25 bp, Homo sapien
atcaaatgaaaccgaaaggaattac

SEQ ID NO: 29685 - DNA, 25 bp, Homo sapien
atcaaatgataatacaagctcataa

SEQ ID NO: 29686 - DNA, 25 bp, Homo sapien
atcaaatgataattcaagctcataa

SEQ ID NO: 29687 - DNA, 25 bp, Homo sapien
atcaaatgttcaaagcgcttgcaac

SEQ ID NO: 29688 - DNA, 25 bp, Homo sapien
atcaaatgttcaacgcgcttgcaac

SEQ ID NO: 29689 - DNA, 25 bp, Homo sapien
atcaaattcacatgcaaggatggct

SEQ ID NO: 29690 - DNA, 25 bp, Homo sapien
atcaaattcacatgcagggatggct

SEQ ID NO: 29691 - DNA, 25 bp, Homo sapien
atcaaattggttgtcttatttcatc

SEQ ID NO: 29692 - DNA, 25 bp, Homo sapien
atcaaattggttgttttatttcatc

SEQ ID NO: 29693 - DNA, 25 bp, Homo sapien
atcaacaattatcaagcgtcaaaaa

SEQ ID NO: 29694 - DNA, 25 bp, Homo sapien
atcaacaattatcaagtgtcaaaaa

SEQ ID NO: 29695 - DNA, 25 bp, Homo sapien
atcaacacattgattctctaacgct

SEQ ID NO: 29696 - DNA, 25 bp, Homo sapien
atcaacacatttattctctaacgct

SEQ ID NO: 29697 - DNA, 25 bp, Homo sapien
atcaacactccttattaactgctgt

SEQ ID NO: 29698 - DNA, 25 bp, Homo sapien
atcaacacttcttattaactgctgt

SEQ ID NO: 29699 - DNA, 25 bp, Homo sapien
atcaacagagtataatgtttaaatg

SEQ ID NO: 29700 - DNA, 25 bp, Homo sapien
atcaacagagtatagtgtttaaatg

SEQ ID NO: 29701 - DNA, 25 bp, Homo sapien
atcaacaggtgaattcataaacaaa

SEQ ID NO: 29702 - DNA, 25 bp, Homo sapien
atcaacaggtgaattcgtaaacaaa

SEQ ID NO: 29703 - DNA, 25 bp, Homo sapien
atcaaccatgaaaataaagtgggct

SEQ ID NO: 29704 - DNA, 25 bp, Homo sapien
atcaaccatgaatataaagtgggct

SEQ ID NO: 29705 - DNA, 25 bp, Homo sapien
atcaaccttgaagtgacatacaaaa

SEQ ID NO: 29706 - DNA, 25 bp, Homo sapien
atcaacctttaagtgacatacaaaa

SEQ ID NO: 29707 - DNA, 25 bp, Homo sapien
atcaacgtaatagtaaaaattctta

SEQ ID NO: 29708 - DNA, 25 bp, Homo sapien
atcaacgtaatggtaaaaattctta

SEQ ID NO: 29709 - DNA, 25 bp, Homo sapien
atcaactccgttaatttcagagctg

SEQ ID NO: 29710 - DNA, 25 bp, Homo sapien
atcaactcctttaatttcagagctg

SEQ ID NO: 29711 - DNA, 25 bp, Homo sapien
atcaactggattaattggatgcttt

SEQ ID NO: 29712 - DNA, 25 bp, Homo sapien
atcaactggattgattggatgcttt

SEQ ID NO: 29713 - DNA, 25 bp, Homo sapien
atcaacttatacctatcatatagca

SEQ ID NO: 29714 - DNA, 25 bp, Homo sapien
atcaacttatacctgtcatatagca

SEQ ID NO: 29715 - DNA, 25 bp, Homo sapien
atcaacttcattgcacttttcccta

SEQ ID NO: 29716 - DNA, 25 bp, Homo sapien
atcaacttcatttcacttttcccta

SEQ ID NO: 29717 - DNA, 25 bp, Homo sapien
atcaagaaagaggaattttgctaaa

SEQ ID NO: 29718 - DNA, 25 bp, Homo sapien
atcaagaaggagataccgtatataa

SEQ ID NO: 29719 - DNA, 25 bp, Homo sapien
atcaagaaggaggtaccgtatataa

SEQ ID NO: 29720 - DNA, 25 bp, Homo sapien
atcaagaataaccccataaacaagc

SEQ ID NO: 29721 - DNA, 25 bp, Homo sapien
atcaagaataatcccataaacaagc

SEQ ID NO: 29722 - DNA, 25 bp, Homo sapien
atcaagaatgaggaattttgctaaa

SEQ ID NO: 29723 - DNA, 25 bp, Homo sapien
atcaagatgaggatacaaagcagag

SEQ ID NO: 29724 - DNA, 25 bp, Homo sapien
atcaagatgaggatacgaagcagag

SEQ ID NO: 29725 - DNA, 25 bp, Homo sapien
atcaagcacgttcatgaggagttac

SEQ ID NO: 29726 - DNA, 25 bp, Homo sapien
atcaagcactttcatgaggagttac

SEQ ID NO: 29727 - DNA, 25 bp, Homo sapien
atcaagcagaagaacgaatgagcga

SEQ ID NO: 29728 - DNA, 25 bp, Homo sapien
atcaagcagaagaacgcatgagcga

SEQ ID NO: 29729 - DNA, 25 bp, Homo sapien
atcaagcatacaacgatagaaaact

SEQ ID NO: 29730 - DNA, 25 bp, Homo sapien
atcaagcatacaaggatagaaaact

SEQ ID NO: 29731 - DNA, 25 bp, Homo sapien
atcaagcatcaacctttaggtactc

SEQ ID NO: 29732 - DNA, 25 bp, Homo sapien
atcaagcatcagcctttaggtactc

SEQ ID NO: 29733 - DNA, 25 bp, Homo sapien
atcaagccagaatgactctgaactt

SEQ ID NO: 29734 - DNA, 25 bp, Homo sapien
atcaagccagaatgtctctgaactt

SEQ ID NO: 29735 - DNA, 25 bp, Homo sapien
atcaagcctagttactcttggccca

SEQ ID NO: 29736 - DNA, 25 bp, Homo sapien
atcaagcctagttacttttggccca

SEQ ID NO: 29737 - DNA, 25 bp, Homo sapien
atcaaggatgtcataatgtcatgtg

SEQ ID NO: 29738 - DNA, 25 bp, Homo sapien
atcaaggatgtcatgatgtcatgtg

SEQ ID NO: 29739 - DNA, 25 bp, Homo sapien
atcaaggcaaaagactagagagtga

SEQ ID NO: 29740 - DNA, 25 bp, Homo sapien
atcaaggcaaaagattagagagtga

SEQ ID NO: 29741 - DNA, 25 bp, Homo sapien
atcaaggcttttgacacttattgcc

SEQ ID NO: 29742 - DNA, 25 bp, Homo sapien
atcaaggcttttgatacttattgcc

SEQ ID NO: 29743 - DNA, 25 bp, Homo sapien
atcaagggaaattcaacaggtgaaa

SEQ ID NO: 29744 - DNA, 25 bp, Homo sapien
atcaagggaaattcaagaggtgaaa

SEQ ID NO: 29745 - DNA, 25 bp, Homo sapien
atcaagggccatttctgtgtaagca

SEQ ID NO: 29746 - DNA, 25 bp, Homo sapien
atcaagggctatttctgtgtaagca

SEQ ID NO: 29747 - DNA, 25 bp, Homo sapien
atcaagtagcctatttcctctaaat

SEQ ID NO: 29748 - DNA, 25 bp, Homo sapien
atcaagtagcctgtttcctctaaat

SEQ ID NO: 29749 - DNA, 25 bp, Homo sapien
atcaagtaggaaaggttacagaggc

SEQ ID NO: 29750 - DNA, 25 bp, Homo sapien
atcaagtaggaaatgttacagaggc

SEQ ID NO: 29751 - DNA, 25 bp, Homo sapien
atcaagtcagaggttcatccaaggc

SEQ ID NO: 29752 - DNA, 25 bp, Homo sapien
atcaagtcagaggttcgtccaaggc

SEQ ID NO: 29753 - DNA, 25 bp, Homo sapien
atcaagtgaattctagccacttatt

SEQ ID NO: 29754 - DNA, 25 bp, Homo sapien
atcaagtgaattttagccacttatt

SEQ ID NO: 29755 - DNA, 25 bp, Homo sapien
atcaagtgtttgctctataactgga

SEQ ID NO: 29756 - DNA, 25 bp, Homo sapien
atcaagtgtttgctctttaactgga

SEQ ID NO: 29757 - DNA, 25 bp, Homo sapien
atcaagttgacacccgatcactcaa

SEQ ID NO: 29758 - DNA, 25 bp, Homo sapien
atcaagttgacaccggatcactcaa

SEQ ID NO: 29759 - DNA, 25 bp, Homo sapien
atcaagtttgacttcgcaacagtgc

SEQ ID NO: 29760 - DNA, 25 bp, Homo sapien
atcaagtttgactttgcaacagtgc

SEQ ID NO: 29761 - DNA, 25 bp, Homo sapien
atcaataactggagcccaatagctt

SEQ ID NO: 29762 - DNA, 25 bp, Homo sapien
atcaataactggagcctaatagctt

SEQ ID NO: 29763 - DNA, 25 bp, Homo sapien
atcaatacaacacccagcttcattt

SEQ ID NO: 29764 - DNA, 25 bp, Homo sapien
atcaatacaacatccagcttcattt

SEQ ID NO: 29765 - DNA, 25 bp, Homo sapien
atcaatatccctacatggaactctt

SEQ ID NO: 29766 - DNA, 25 bp, Homo sapien
atcaatatccctgcatggaactctt

SEQ ID NO: 29767 - DNA, 25 bp, Homo sapien
atcaatcacacctgtcctctaacta

SEQ ID NO: 29768 - DNA, 25 bp, Homo sapien
atcaatcatacctgtcctctaacta

SEQ ID NO: 29769 - DNA, 25 bp, Homo sapien
atcaatcccagacgtttaaccctca

SEQ ID NO: 29770 - DNA, 25 bp, Homo sapien
atcaatcccagatgtttaaccctca

SEQ ID NO: 29771 - DNA, 25 bp, Homo sapien
atcaatgaatggatggaaaatccac

SEQ ID NO: 29772 - DNA, 25 bp, Homo sapien
atcaatgaatggatggcaaatccac

SEQ ID NO: 29773 - DNA, 25 bp, Homo sapien
atcaatgacaacactcactcaatgg

SEQ ID NO: 29774 - DNA, 25 bp, Homo sapien
atcaatgacaacattcactcaatgg

SEQ ID NO: 29775 - DNA, 25 bp, Homo sapien
atcaatgacataatattcccattca

SEQ ID NO: 29776 - DNA, 25 bp, Homo sapien
atcaatgacatagtattcccattca

SEQ ID NO: 29777 - DNA, 25 bp, Homo sapien
atcaatgactaacgaaaaaactacc

SEQ ID NO: 29778 - DNA, 25 bp, Homo sapien
atcaatgactaatgaaaaaactacc

SEQ ID NO: 29779 - DNA, 25 bp, Homo sapien
atcaatgagacaaaaagaaaatcaa

SEQ ID NO: 29780 - DNA, 25 bp, Homo sapien
atcaatgaggcaaaaagaaaatcaa

SEQ ID NO: 29781 - DNA, 25 bp, Homo sapien
atcaatgatagaacatcatccttcc

SEQ ID NO: 29782 - DNA, 25 bp, Homo sapien
atcaatgatagaacgtcatccttcc

SEQ ID NO: 29783 - DNA, 25 bp, Homo sapien
atcaatgcaacagaattcagtccag

SEQ ID NO: 29784 - DNA, 25 bp, Homo sapien
atcaatgcaacataattcagtccag

SEQ ID NO: 29785 - DNA, 25 bp, Homo sapien
atcaatgggatcaatcaagaacctt

SEQ ID NO: 29786 - DNA, 25 bp, Homo sapien
atcaatgggatcagtcaagaacctt

SEQ ID NO: 29787 - DNA, 25 bp, Homo sapien
atcaatgtcagttacgacttatgga

SEQ ID NO: 29788 - DNA, 25 bp, Homo sapien
atcaatgtcagttaggacttatgga

SEQ ID NO: 29789 - DNA, 25 bp, Homo sapien
atcaatgttggtttcaatgtttgat

SEQ ID NO: 29790 - DNA, 25 bp, Homo sapien
atcaatgttggtttcagtgtttgat

SEQ ID NO: 29791 - DNA, 25 bp, Homo sapien
atcaattaggactacagtttcttga

SEQ ID NO: 29792 - DNA, 25 bp, Homo sapien
atcaattaggactatagtttcttga

SEQ ID NO: 29793 - DNA, 25 bp, Homo sapien
atcaatttctgtggtttgtaagcca

SEQ ID NO: 29794 - DNA, 25 bp, Homo sapien
atcaatttctgttgtttgtaagcca

SEQ ID NO: 29795 - DNA, 25 bp, Homo sapien
atcaatttgcttctctgtgtaatca

SEQ ID NO: 29796 - DNA, 25 bp, Homo sapien
atcaattttcgatgctcatggaaga

SEQ ID NO: 29797 - DNA, 25 bp, Homo sapien
atcaattttcttctctgtgtaatca

SEQ ID NO: 29798 - DNA, 25 bp, Homo sapien
atcaatttttgatgctcatggaaga

SEQ ID NO: 29799 - DNA, 25 bp, Homo sapien
atcacaaacaaaagaaattcaaaac

SEQ ID NO: 29800 - DNA, 25 bp, Homo sapien
atcacaaacaaaataaattcaaaac

SEQ ID NO: 29801 - DNA, 25 bp, Homo sapien
atcacaaacacagcctatcagccct

SEQ ID NO: 29802 - DNA, 25 bp, Homo sapien
atcacaaacaccctagttcaatcca

SEQ ID NO: 29803 - DNA, 25 bp, Homo sapien
atcacaaacatctaagtttctaagc

SEQ ID NO: 29804 - DNA, 25 bp, Homo sapien
atcacaaacatttaagtttctaagc

SEQ ID NO: 29805 - DNA, 25 bp, Homo sapien
atcacaaacgcagcctatcagccct

SEQ ID NO: 29806 - DNA, 25 bp, Homo sapien
atcacaaacgccctagttcaatcca

SEQ ID NO: 29807 - DNA, 25 bp, Homo sapien
atcacaacattcatctcctctgagt

SEQ ID NO: 29808 - DNA, 25 bp, Homo sapien
atcacaacattcatgtcctctgagt

SEQ ID NO: 29809 - DNA, 25 bp, Homo sapien
atcacaaccagtgaaactatccgaa

SEQ ID NO: 29810 - DNA, 25 bp, Homo sapien
atcacaactagtgaaactatccgaa

SEQ ID NO: 29811 - DNA, 25 bp, Homo sapien
atcacaagattttggaaaagcccca

SEQ ID NO: 29812 - DNA, 25 bp, Homo sapien
atcacaaggttttggaaaagcccca

SEQ ID NO: 29813 - DNA, 25 bp, Homo sapien
atcacaattgaggaatggaggaact

SEQ ID NO: 29814 - DNA, 25 bp, Homo sapien
atcacaattgaggactggaggaact

SEQ ID NO: 29815 - DNA, 25 bp, Homo sapien
atcacacaacattctaggttcatgg

SEQ ID NO: 29816 - DNA, 25 bp, Homo sapien
atcacacaatctatctcaaataaca

SEQ ID NO: 29817 - DNA, 25 bp, Homo sapien
atcacacaatctgtctcaaataaca

SEQ ID NO: 29818 - DNA, 25 bp, Homo sapien
atcacacacttagcagatgaaaaca

SEQ ID NO: 29819 - DNA, 25 bp, Homo sapien
atcacacagcattctaggttcatgg

SEQ ID NO: 29820 - DNA, 25 bp, Homo sapien
atcacacatgctgactagttgcttg

SEQ ID NO: 29821 - DNA, 25 bp, Homo sapien
atcacacatgctgattagttgcttg

SEQ ID NO: 29822 - DNA, 25 bp, Homo sapien
atcacacatttagcagatgaaaaca

SEQ ID NO: 29823 - DNA, 25 bp, Homo sapien
atcacactgtctcgactaatgtacc

SEQ ID NO: 29824 - DNA, 25 bp, Homo sapien
atcacactgtcttgactaatgtacc

SEQ ID NO: 29825 - DNA, 25 bp, Homo sapien
atcacagaattagcaggtggcagac

SEQ ID NO: 29826 - DNA, 25 bp, Homo sapien
atcacagaattagcagttggcagac

SEQ ID NO: 29827 - DNA, 25 bp, Homo sapien
atcacagagaattttaaaacagcat

SEQ ID NO: 29828 - DNA, 25 bp, Homo sapien
atcacagataattttaaaacagcat

SEQ ID NO: 29829 - DNA, 25 bp, Homo sapien
atcacaggagtctatcacagttttc

SEQ ID NO: 29830 - DNA, 25 bp, Homo sapien
atcacaggagtttatcacagttttc

SEQ ID NO: 29831 - DNA, 25 bp, Homo sapien
atcacagtgagttacatgacctggt

SEQ ID NO: 29832 - DNA, 25 bp, Homo sapien
atcacagtgagttatatgacctggt

SEQ ID NO: 29833 - DNA, 25 bp, Homo sapien
atcacagtttagcctagcctacctt

SEQ ID NO: 29834 - DNA, 25 bp, Homo sapien
atcacagtttagtctagcctacctt

SEQ ID NO: 29835 - DNA, 25 bp, Homo sapien
atcacataagctcctcctctattgt

SEQ ID NO: 29836 - DNA, 25 bp, Homo sapien
atcacatatgctcctcctctattgt

SEQ ID NO: 29837 - DNA, 25 bp, Homo sapien
atcacatgcatcctcacatgcacaa

SEQ ID NO: 29838 - DNA, 25 bp, Homo sapien
atcacatgcattctcacatgcacaa

SEQ ID NO: 29839 - DNA, 25 bp, Homo sapien
atcaccaaaggatttaaatgtatag

SEQ ID NO: 29840 - DNA, 25 bp, Homo sapien
atcaccaaaggttttaaatgtatag

SEQ ID NO: 29841 - DNA, 25 bp, Homo sapien
atcaccaacaacaataaatcaggag

SEQ ID NO: 29842 - DNA, 25 bp, Homo sapien
atcaccaacaataataaatcaggag

SEQ ID NO: 29843 - DNA, 25 bp, Homo sapien
atcaccaatggccactaaaatcatc

SEQ ID NO: 29844 - DNA, 25 bp, Homo sapien
atcaccaatggctactaaaatcatc

SEQ ID NO: 29845 - DNA, 25 bp, Homo sapien
atcaccacaatcgattttatatttt

SEQ ID NO: 29846 - DNA, 25 bp, Homo sapien
atcaccacaattgattttatatttt

SEQ ID NO: 29847 - DNA, 25 bp, Homo sapien
atcaccacctaagaaaggcatgtat

SEQ ID NO: 29848 - DNA, 25 bp, Homo sapien
atcaccacctacgaaaggcatgtat

SEQ ID NO: 29849 - DNA, 25 bp, Homo sapien
atcaccagcagaacgaagaaaaaat

SEQ ID NO: 29850 - DNA, 25 bp, Homo sapien
atcaccagcagaatgaagaaaaaat

SEQ ID NO: 29851 - DNA, 25 bp, Homo sapien
atcaccaggggaatttctgaaacca

SEQ ID NO: 29852 - DNA, 25 bp, Homo sapien
atcaccaggggagtttctgaaacca

SEQ ID NO: 29853 - DNA, 25 bp, Homo sapien
atcacccagtgggtcacgatgttta

SEQ ID NO: 29854 - DNA, 25 bp, Homo sapien
atcacccagtgggtcaggatgttta

SEQ ID NO: 29855 - DNA, 25 bp, Homo sapien
atcaccccatacattttctagttgg

SEQ ID NO: 29856 - DNA, 25 bp, Homo sapien
atcaccccatacgttttctagttgg

SEQ ID NO: 29857 - DNA, 25 bp, Homo sapien
atcacctacagctccgtggagctat

SEQ ID NO: 29858 - DNA, 25 bp, Homo sapien
atcacctatagctccgtggagctat

SEQ ID NO: 29859 - DNA, 25 bp, Homo sapien
atcacctctgaattacttgtaatac

SEQ ID NO: 29860 - DNA, 25 bp, Homo sapien
atcacctctgagttacttgtaatac

SEQ ID NO: 29861 - DNA, 25 bp, Homo sapien
atcaccttaaactgaaactcgatta

SEQ ID NO: 29862 - DNA, 25 bp, Homo sapien
atcaccttaaattgaaactcgatta

SEQ ID NO: 29863 - DNA, 25 bp, Homo sapien
atcacgagtagagtttgtttcaaga

SEQ ID NO: 29864 - DNA, 25 bp, Homo sapien
atcacgagtagattttgtttcaaga

SEQ ID NO: 29865 - DNA, 25 bp, Homo sapien
atcacgagtcctacgggaaaccagc

SEQ ID NO: 29866 - DNA, 25 bp, Homo sapien
atcacgagtcctgcgggaaaccagc

SEQ ID NO: 29867 - DNA, 25 bp, Homo sapien
atcacgctcatttgttcaaagcaca

SEQ ID NO: 29868 - DNA, 25 bp, Homo sapien
atcacgctcattttttcaaagcaca

SEQ ID NO: 29869 - DNA, 25 bp, Homo sapien
atcacgttcttcttttatcttgcca

SEQ ID NO: 29870 - DNA, 25 bp, Homo sapien
atcacgttcttcttttctcttgcca

SEQ ID NO: 29871 - DNA, 25 bp, Homo sapien
atcacgtttcatagtgcgagttcag

SEQ ID NO: 29872 - DNA, 25 bp, Homo sapien
atcacgtttcatagtgggagttcag

SEQ ID NO: 29873 - DNA, 25 bp, Homo sapien
atcactaaacataaaacgatacaca

SEQ ID NO: 29874 - DNA, 25 bp, Homo sapien
atcactaaacataaaatgatacaca

SEQ ID NO: 29875 - DNA, 25 bp, Homo sapien
atcactaatatggtcaactcttata

SEQ ID NO: 29876 - DNA, 25 bp, Homo sapien
atcactaatatgttcaactcttata

SEQ ID NO: 29877 - DNA, 25 bp, Homo sapien
atcactatactcctaaagaaataaa

SEQ ID NO: 29878 - DNA, 25 bp, Homo sapien
atcactatactcgtaaagaaataaa

SEQ ID NO: 29879 - DNA, 25 bp, Homo sapien
atcactatgcctacttgtaataaga

SEQ ID NO: 29880 - DNA, 25 bp, Homo sapien
atcactatgcctatttgtaataaga

SEQ ID NO: 29881 - DNA, 25 bp, Homo sapien
atcactatttccacatctcattggc

SEQ ID NO: 29882 - DNA, 25 bp, Homo sapien
atcactatttccacgtctcattggc

SEQ ID NO: 29883 - DNA, 25 bp, Homo sapien
atcactcaaagtctcatagataggc

SEQ ID NO: 29884 - DNA, 25 bp, Homo sapien
atcactcaagactattgtgtcaaaa

SEQ ID NO: 29885 - DNA, 25 bp, Homo sapien
atcactcaaggtctcatagataggc

SEQ ID NO: 29886 - DNA, 25 bp, Homo sapien
atcactcagatttaatacattttaa

SEQ ID NO: 29887 - DNA, 25 bp, Homo sapien
atcactcagatttgatacattttaa

SEQ ID NO: 29888 - DNA, 25 bp, Homo sapien
atcactcaggactattgtgtcaaaa

SEQ ID NO: 29889 - DNA, 25 bp, Homo sapien
atcactcatcaattccacaactctc

SEQ ID NO: 29890 - DNA, 25 bp, Homo sapien
atcactcattaattccacaactctc

SEQ ID NO: 29891 - DNA, 25 bp, Homo sapien
atcactcccgattgctctcagatta

SEQ ID NO: 29892 - DNA, 25 bp, Homo sapien
atcactcccggcaaggatcttaaac

SEQ ID NO: 29893 - DNA, 25 bp, Homo sapien
atcactcccggcaaggttcttaaac

SEQ ID NO: 29894 - DNA, 25 bp, Homo sapien
atcactccctcctggttttcttcct

SEQ ID NO: 29895 - DNA, 25 bp, Homo sapien
atcactcctgattgctctcagatta

SEQ ID NO: 29896 - DNA, 25 bp, Homo sapien
atcactccttcctggttttcttcct

SEQ ID NO: 29897 - DNA, 25 bp, Homo sapien
atcactctgcaagatattgtaggaa

SEQ ID NO: 29898 - DNA, 25 bp, Homo sapien
atcactctgcaaggtattgtaggaa

SEQ ID NO: 29899 - DNA, 25 bp, Homo sapien
atcactgcagttttctccatctttg

SEQ ID NO: 29900 - DNA, 25 bp, Homo sapien
atcactgccgttttctccatctttg

SEQ ID NO: 29901 - DNA, 25 bp, Homo sapien
atcactggaattataacagacatgt

SEQ ID NO: 29902 - DNA, 25 bp, Homo sapien
atcactggaattataatagacatgt

SEQ ID NO: 29903 - DNA, 25 bp, Homo sapien
atcactggcctgactaccactggac

SEQ ID NO: 29904 - DNA, 25 bp, Homo sapien
atcactggcttgactaccactggac

SEQ ID NO: 29905 - DNA, 25 bp, Homo sapien
atcactggggcacgaagactccaag

SEQ ID NO: 29906 - DNA, 25 bp, Homo sapien
atcactggggcatgaagactccaag

SEQ ID NO: 29907 - DNA, 25 bp, Homo sapien
atcactgtagacttttccagatagg

SEQ ID NO: 29908 - DNA, 25 bp, Homo sapien
atcactgtagactttttcagatagg

SEQ ID NO: 29909 - DNA, 25 bp, Homo sapien
atcactgttttattcgtccagaaag

SEQ ID NO: 29910 - DNA, 25 bp, Homo sapien
atcactgttttatttgtccagaaag

SEQ ID NO: 29911 - DNA, 25 bp, Homo sapien
atcacttaaacacacccagtgctca

SEQ ID NO: 29912 - DNA, 25 bp, Homo sapien
atcacttaaacacacctagtgctca

SEQ ID NO: 29913 - DNA, 25 bp, Homo sapien
atcacttcacaccgggatggctggc

SEQ ID NO: 29914 - DNA, 25 bp, Homo sapien
atcacttcacactgggatggctggc

SEQ ID NO: 29915 - DNA, 25 bp, Homo sapien
atcactttgtcagagccttatccca

SEQ ID NO: 29916 - DNA, 25 bp, Homo sapien
atcactttgtcagatccttatccca

SEQ ID NO: 29917 - DNA, 25 bp, Homo sapien
atcacttttttttgcagtgcattta

SEQ ID NO: 29918 - DNA, 25 bp, Homo sapien
atcacttttttttgcattgcattta

SEQ ID NO: 29919 - DNA, 25 bp, Homo sapien
atcagaaaaatatagaaggaaactg

SEQ ID NO: 29920 - DNA, 25 bp, Homo sapien
atcagaaaaatatagagggaaactg

SEQ ID NO: 29921 - DNA, 25 bp, Homo sapien
atcagaaaaatatttgaagaaataa

SEQ ID NO: 29922 - DNA, 25 bp, Homo sapien
atcagaaaacaccatttatagtcat

SEQ ID NO: 29923 - DNA, 25 bp, Homo sapien
atcagaaaacaccctttatagtcat

SEQ ID NO: 29924 - DNA, 25 bp, Homo sapien
atcagaaaagtatttgaagaaataa

SEQ ID NO: 29925 - DNA, 25 bp, Homo sapien
atcagaaagggtcttacgagccatt

SEQ ID NO: 29926 - DNA, 25 bp, Homo sapien
atcagaaagggtcttatgagccatt

SEQ ID NO: 29927 - DNA, 25 bp, Homo sapien
atcagaaatgaagaagctgcataat

SEQ ID NO: 29928 - DNA, 25 bp, Homo sapien
atcagaaatgaagaagttgcataat

SEQ ID NO: 29929 - DNA, 25 bp, Homo sapien
atcagaacaaaatcattcaagccca

SEQ ID NO: 29930 - DNA, 25 bp, Homo sapien
atcagaacaaaatcgttcaagccca

SEQ ID NO: 29931 - DNA, 25 bp, Homo sapien
atcagaactgttcaacttccaagca

SEQ ID NO: 29932 - DNA, 25 bp, Homo sapien
atcagaactgtttaacttccaagca

SEQ ID NO: 29933 - DNA, 25 bp, Homo sapien
atcagaagcgttttgtgtaaatagt

SEQ ID NO: 29934 - DNA, 25 bp, Homo sapien
atcagaagtgttttgtgtaaatagt

SEQ ID NO: 29935 - DNA, 25 bp, Homo sapien
atcagaatagtcctgcaaagccaga

SEQ ID NO: 29936 - DNA, 25 bp, Homo sapien
atcagaatagtccttcaaagccaga

SEQ ID NO: 29937 - DNA, 25 bp, Homo sapien
atcagaatctcacgtgggagggata

SEQ ID NO: 29938 - DNA, 25 bp, Homo sapien
atcagaatctcaggtgggagggata

SEQ ID NO: 29939 - DNA, 25 bp, Homo sapien
atcagaatttaagccactcttttct

SEQ ID NO: 29940 - DNA, 25 bp, Homo sapien
atcagaatttaagtcactcttttct

SEQ ID NO: 29941 - DNA, 25 bp, Homo sapien
atcagacagcttatcttcagctcag

SEQ ID NO: 29942 - DNA, 25 bp, Homo sapien
atcagacagcttattttcagctcag

SEQ ID NO: 29943 - DNA, 25 bp, Homo sapien
atcagactcctatacctgcataatc

SEQ ID NO: 29944 - DNA, 25 bp, Homo sapien
atcagacttctatacctgcataatc

SEQ ID NO: 29945 - DNA, 25 bp, Homo sapien
atcagagaactcagccagcctagct

SEQ ID NO: 29946 - DNA, 25 bp, Homo sapien
atcagagaatcaatgtattcctttt

SEQ ID NO: 29947 - DNA, 25 bp, Homo sapien
atcagagaatcagtgtattcctttt

SEQ ID NO: 29948 - DNA, 25 bp, Homo sapien
atcagagaattcagccagcctagct

SEQ ID NO: 29949 - DNA, 25 bp, Homo sapien
atcagagagagctgagtggataaga

SEQ ID NO: 29950 - DNA, 25 bp, Homo sapien
atcagagagaggtgagtggataaga

SEQ ID NO: 29951 - DNA, 25 bp, Homo sapien
atcagagcacatcaacctagtaaga

SEQ ID NO: 29952 - DNA, 25 bp, Homo sapien
atcagagcacatcagcctagtaaga

SEQ ID NO: 29953 - DNA, 25 bp, Homo sapien
atcagagcatcaagaacactgcata

SEQ ID NO: 29954 - DNA, 25 bp, Homo sapien
atcagagcgtcaagaacactgcata

SEQ ID NO: 29955 - DNA, 25 bp, Homo sapien
atcagagtagagcaagtagcagttt

SEQ ID NO: 29956 - DNA, 25 bp, Homo sapien
atcagagtagagtaagtagcagttt

SEQ ID NO: 29957 - DNA, 25 bp, Homo sapien
atcagatactgggaaggcacaatgg

SEQ ID NO: 29958 - DNA, 25 bp, Homo sapien
atcagatactgtgaaggcacaatgg

SEQ ID NO: 29959 - DNA, 25 bp, Homo sapien
atcagatagactacgcattctctta

SEQ ID NO: 29960 - DNA, 25 bp, Homo sapien
atcagatagactatgcattctctta

SEQ ID NO: 29961 - DNA, 25 bp, Homo sapien
atcagatatcgaacttataaactac

SEQ ID NO: 29962 - DNA, 25 bp, Homo sapien
atcagatatcgaatttataaactac

SEQ ID NO: 29963 - DNA, 25 bp, Homo sapien
atcagatcaaaacctgaaatgatca

SEQ ID NO: 29964 - DNA, 25 bp, Homo sapien
atcagatcaaagcctgaaatgatca

SEQ ID NO: 29965 - DNA, 25 bp, Homo sapien
atcagatcatcttaatcctattgac

SEQ ID NO: 29966 - DNA, 25 bp, Homo sapien
atcagatcgtcttaatcctattgac

SEQ ID NO: 29967 - DNA, 25 bp, Homo sapien
atcagatggtttttgcttttaattc

SEQ ID NO: 29968 - DNA, 25 bp, Homo sapien
atcagatgttttttgcttttaattc

SEQ ID NO: 29969 - DNA, 25 bp, Homo sapien
atcagattatcagtaaaacaagtga

SEQ ID NO: 29970 - DNA, 25 bp, Homo sapien
atcagattgtcagtaaaacaagtga

SEQ ID NO: 29971 - DNA, 25 bp, Homo sapien
atcagatttcggaacgtgctgatct

SEQ ID NO: 29972 - DNA, 25 bp, Homo sapien
atcagatttcggaatgtgctgatct

SEQ ID NO: 29973 - DNA, 25 bp, Homo sapien
atcagcaactactgaatgtgaggca

SEQ ID NO: 29974 - DNA, 25 bp, Homo sapien
atcagcaactattgaatgtgaggca

SEQ ID NO: 29975 - DNA, 25 bp, Homo sapien
atcagcaactgaaatgatatgacct

SEQ ID NO: 29976 - DNA, 25 bp, Homo sapien
atcagcaactgaagtgatatgacct

SEQ ID NO: 29977 - DNA, 25 bp, Homo sapien
atcagcaagtcttgatatttccaca

SEQ ID NO: 29978 - DNA, 25 bp, Homo sapien
atcagcaattcttgatatttccaca

SEQ ID NO: 29979 - DNA, 25 bp, Homo sapien
atcagcactaacaccacataccagc

SEQ ID NO: 29980 - DNA, 25 bp, Homo sapien
atcagcactaacgccacataccagc

SEQ ID NO: 29981 - DNA, 25 bp, Homo sapien
atcagcactggcatctcattttggc

SEQ ID NO: 29982 - DNA, 25 bp, Homo sapien
atcagcactggcttctcattttggc

SEQ ID NO: 29983 - DNA, 25 bp, Homo sapien
atcagcagagcaggcagagccgttc

SEQ ID NO: 29984 - DNA, 25 bp, Homo sapien
atcagcagagcaggtagagccgttc

SEQ ID NO: 29985 - DNA, 25 bp, Homo sapien
atcagcagagtcattatacaattgc

SEQ ID NO: 29986 - DNA, 25 bp, Homo sapien
atcagcagtgtcattatacaattgc

SEQ ID NO: 29987 - DNA, 25 bp, Homo sapien
atcagcatacgcatctcgcctcaag

SEQ ID NO: 29988 - DNA, 25 bp, Homo sapien
atcagcatacgcatcttgcctcaag

SEQ ID NO: 29989 - DNA, 25 bp, Homo sapien
atcagcatactcttttcgttcagcc

SEQ ID NO: 29990 - DNA, 25 bp, Homo sapien
atcagcatactctttttgttcagcc

SEQ ID NO: 29991 - DNA, 25 bp, Homo sapien
atcagcatcactccctttaaaggat

SEQ ID NO: 29992 - DNA, 25 bp, Homo sapien
atcagcatcactccttttaaaggat

SEQ ID NO: 29993 - DNA, 25 bp, Homo sapien
atcagcatttacaagctcagtgtcc

SEQ ID NO: 29994 - DNA, 25 bp, Homo sapien
atcagcatttacgagctcagtgtcc

SEQ ID NO: 29995 - DNA, 25 bp, Homo sapien
atcagcccggaacttctgatgaatt

SEQ ID NO: 29996 - DNA, 25 bp, Homo sapien
atcagcccggagcttctgatgaatt

SEQ ID NO: 29997 - DNA, 25 bp, Homo sapien
atcagcctctctctttttatttcta

SEQ ID NO: 29998 - DNA, 25 bp, Homo sapien
atcagcctgccaaggttccaataaa

SEQ ID NO: 29999 - DNA, 25 bp, Homo sapien
atcagcctgccaatgttccaataaa

SEQ ID NO: 30000 - DNA, 25 bp, Homo sapien
atcagccttacaaccttatctcgtt

SEQ ID NO: 30001 - DNA, 25 bp, Homo sapien
atcagccttacaagcttatctcgtt

SEQ ID NO: 30002 - DNA, 25 bp, Homo sapien
atcagccttctctgccacgaatttt

SEQ ID NO: 30003 - DNA, 25 bp, Homo sapien
atcagcctttctctttttatttcta

SEQ ID NO: 30004 - DNA, 25 bp, Homo sapien
atcagccttttctgccacgaatttt

SEQ ID NO: 30005 - DNA, 25 bp, Homo sapien
atcagctcaaaataaaccaaggaaa

SEQ ID NO: 30006 - DNA, 25 bp, Homo sapien
atcagctcaaaataaagcaaggaaa

SEQ ID NO: 30007 - DNA, 25 bp, Homo sapien
atcagctttggcaccaaggccaggg

SEQ ID NO: 30008 - DNA, 25 bp, Homo sapien
atcagctttggcactaaggccaggg

SEQ ID NO: 30009 - DNA, 25 bp, Homo sapien
atcaggaaagtaacacaagtagtgc

SEQ ID NO: 30010 - DNA, 25 bp, Homo sapien
atcaggaaagtaatacaagtagtgc

SEQ ID NO: 30011 - DNA, 25 bp, Homo sapien
atcaggagataataaaaagttctaa

SEQ ID NO: 30012 - DNA, 25 bp, Homo sapien
atcaggagttaataaaaagttctaa

SEQ ID NO: 30013 - DNA, 25 bp, Homo sapien
atcaggctcaggatgaaatcgagtc

SEQ ID NO: 30014 - DNA, 25 bp, Homo sapien
atcaggctcaggttgaaatcgagtc

SEQ ID NO: 30015 - DNA, 25 bp, Homo sapien
atcaggcttatttttccgctcataa

SEQ ID NO: 30016 - DNA, 25 bp, Homo sapien
atcaggcttatttttctgctcataa

SEQ ID NO: 30017 - DNA, 25 bp, Homo sapien
atcagggattgctacttcctgtcaa

SEQ ID NO: 30018 - DNA, 25 bp, Homo sapien
atcagggattgctagttcctgtcaa

SEQ ID NO: 30019 - DNA, 25 bp, Homo sapien
atcagggcaaagaagacaggcatgg

SEQ ID NO: 30020 - DNA, 25 bp, Homo sapien
atcagggcacgatctgtctccaatt

SEQ ID NO: 30021 - DNA, 25 bp, Homo sapien
atcagggcaggatctgtctccaatt

SEQ ID NO: 30022 - DNA, 25 bp, Homo sapien
atcagggcatagaagacaggcatgg

SEQ ID NO: 30023 - DNA, 25 bp, Homo sapien
atcagggtcattagaaaattggcct

SEQ ID NO: 30024 - DNA, 25 bp, Homo sapien
atcagggtcgttagaaaattggcct

SEQ ID NO: 30025 - DNA, 25 bp, Homo sapien
atcaggtaaggaatacaggtgtgtc

SEQ ID NO: 30026 - DNA, 25 bp, Homo sapien
atcaggtaatgaatacaggtgtgtc

SEQ ID NO: 30027 - DNA, 25 bp, Homo sapien
atcaggtctcatgaacccagccatt

SEQ ID NO: 30028 - DNA, 25 bp, Homo sapien
atcaggtctcatgaccccagccatt

SEQ ID NO: 30029 - DNA, 25 bp, Homo sapien
atcaggtggcgaacatcccgtcctt

SEQ ID NO: 30030 - DNA, 25 bp, Homo sapien
atcaggtgggtcatttgagcccagg

SEQ ID NO: 30031 - DNA, 25 bp, Homo sapien
atcaggtgggttatttgagcccagg

SEQ ID NO: 30032 - DNA, 25 bp, Homo sapien
atcaggtggtgaacatcccgtcctt

SEQ ID NO: 30033 - DNA, 25 bp, Homo sapien
atcaggtgtaaattctgaaacagat

SEQ ID NO: 30034 - DNA, 25 bp, Homo sapien
atcaggtgtcagacatacattgcag

SEQ ID NO: 30035 - DNA, 25 bp, Homo sapien
atcaggtgtcagacatgcattgcag

SEQ ID NO: 30036 - DNA, 25 bp, Homo sapien
atcaggtgtgaattctgaaacagat

SEQ ID NO: 30037 - DNA, 25 bp, Homo sapien
atcaggttactgagactatgtgagc

SEQ ID NO: 30038 - DNA, 25 bp, Homo sapien
atcaggttactgggactatgtgagc

SEQ ID NO: 30039 - DNA, 25 bp, Homo sapien
atcaggttttcttattggttttcat

SEQ ID NO: 30040 - DNA, 25 bp, Homo sapien
atcaggttttcttatttgttttcat

SEQ ID NO: 30041 - DNA, 25 bp, Homo sapien
atcagtaaacatactcaagtctcta

SEQ ID NO: 30042 - DNA, 25 bp, Homo sapien
atcagtaaacatagtcaagtctcta

SEQ ID NO: 30043 - DNA, 25 bp, Homo sapien
atcagtaacaaagcctatatgttcc

SEQ ID NO: 30044 - DNA, 25 bp, Homo sapien
atcagtaaccaagcctatatgttcc

SEQ ID NO: 30045 - DNA, 25 bp, Homo sapien
atcagtagattgctgaaaaatattc

SEQ ID NO: 30046 - DNA, 25 bp, Homo sapien
atcagtagattgttgaaaaatattc

SEQ ID NO: 30047 - DNA, 25 bp, Homo sapien
atcagtatacaatgggaaatcatgc

SEQ ID NO: 30048 - DNA, 25 bp, Homo sapien
atcagtatacagtgggaaatcatgc

SEQ ID NO: 30049 - DNA, 25 bp, Homo sapien
atcagtatgcctagcaataggagat

SEQ ID NO: 30050 - DNA, 25 bp, Homo sapien
atcagtatgtctagcaataggagat

SEQ ID NO: 30051 - DNA, 25 bp, Homo sapien
atcagtccatgagtaatactgcttt

SEQ ID NO: 30052 - DNA, 25 bp, Homo sapien
atcagtccgtgagtaatactgcttt

SEQ ID NO: 30053 - DNA, 25 bp, Homo sapien
atcagtctctggaacgtgggatcta

SEQ ID NO: 30054 - DNA, 25 bp, Homo sapien
atcagtctctggaatgtgggatcta

SEQ ID NO: 30055 - DNA, 25 bp, Homo sapien
atcagtgaagttaatcgtgccccaa

SEQ ID NO: 30056 - DNA, 25 bp, Homo sapien
atcagtgaagttcatcgtgccccaa

SEQ ID NO: 30057 - DNA, 25 bp, Homo sapien
atcagtgacaaagtacaaactgttg

SEQ ID NO: 30058 - DNA, 25 bp, Homo sapien
atcagtgaccaagtacaaactgttg

SEQ ID NO: 30059 - DNA, 25 bp, Homo sapien
atcagtgacgctcttctcttccctg

SEQ ID NO: 30060 - DNA, 25 bp, Homo sapien
atcagtgataacattgaaagttgac

SEQ ID NO: 30061 - DNA, 25 bp, Homo sapien
atcagtgataacgttgaaagttgac

SEQ ID NO: 30062 - DNA, 25 bp, Homo sapien
atcagtgatgctcttctcttccctg

SEQ ID NO: 30063 - DNA, 25 bp, Homo sapien
atcagtgcattctaataggaggtac

SEQ ID NO: 30064 - DNA, 25 bp, Homo sapien
atcagtgccacagttgcaccaatct

SEQ ID NO: 30065 - DNA, 25 bp, Homo sapien
atcagtgccttctaataggaggtac

SEQ ID NO: 30066 - DNA, 25 bp, Homo sapien
atcagtgctacagttgcaccaatct

SEQ ID NO: 30067 - DNA, 25 bp, Homo sapien
atcagtgctcaatggaatcccgtga

SEQ ID NO: 30068 - DNA, 25 bp, Homo sapien
atcagtgctcagtggaatcccgtga

SEQ ID NO: 30069 - DNA, 25 bp, Homo sapien
atcagtgtagcctaatctactcttc

SEQ ID NO: 30070 - DNA, 25 bp, Homo sapien
atcagtgtcgcctaatctactcttc

SEQ ID NO: 30071 - DNA, 25 bp, Homo sapien
atcagtgtctaatctgatgttaaac

SEQ ID NO: 30072 - DNA, 25 bp, Homo sapien
atcagtgtctagtctgatgttaaac

SEQ ID NO: 30073 - DNA, 25 bp, Homo sapien
atcagtgtgcaccttatcccactcc

SEQ ID NO: 30074 - DNA, 25 bp, Homo sapien
atcagtgtgcactttatcccactcc

SEQ ID NO: 30075 - DNA, 25 bp, Homo sapien
atcagttttaaccttgctagcctaa

SEQ ID NO: 30076 - DNA, 25 bp, Homo sapien
atcagttttaacgttgctagcctaa

SEQ ID NO: 30077 - DNA, 25 bp, Homo sapien
atcagttttcagcgatcaggaagac

SEQ ID NO: 30078 - DNA, 25 bp, Homo sapien
atcagttttcagggatcaggaagac

SEQ ID NO: 30079 - DNA, 25 bp, Homo sapien
atcataaagtgcatcagtataaaac

SEQ ID NO: 30080 - DNA, 25 bp, Homo sapien
atcataaagtgcatcattataaaac

SEQ ID NO: 30081 - DNA, 25 bp, Homo sapien
atcataaagttactaagaagaggca

SEQ ID NO: 30082 - DNA, 25 bp, Homo sapien
atcataaagttactcagaagaggca

SEQ ID NO: 30083 - DNA, 25 bp, Homo sapien
atcataacatatttgaagaagaagc

SEQ ID NO: 30084 - DNA, 25 bp, Homo sapien
atcataacatatttgaggaagaagc

SEQ ID NO: 30085 - DNA, 25 bp, Homo sapien
atcataagattgagagattaccctg

SEQ ID NO: 30086 - DNA, 25 bp, Homo sapien
atcataagattgggagattaccctg

SEQ ID NO: 30087 - DNA, 25 bp, Homo sapien
atcataaggaagaaagtttggtttg

SEQ ID NO: 30088 - DNA, 25 bp, Homo sapien
atcataaggaagcaagtttggtttg

SEQ ID NO: 30089 - DNA, 25 bp, Homo sapien
atcataagggtctataaaagtagaa

SEQ ID NO: 30090 - DNA, 25 bp, Homo sapien
atcataagggtctgtaaaagtagaa

SEQ ID NO: 30091 - DNA, 25 bp, Homo sapien
atcataatatttcctgacatgtgaa

SEQ ID NO: 30092 - DNA, 25 bp, Homo sapien
atcataatattttctgacatgtgaa

SEQ ID NO: 30093 - DNA, 25 bp, Homo sapien
atcataatcaaaaagcatcatctaa

SEQ ID NO: 30094 - DNA, 25 bp, Homo sapien
atcataatccaaaagcatcatctaa

SEQ ID NO: 30095 - DNA, 25 bp, Homo sapien
atcataatttttgagttacagctca

SEQ ID NO: 30096 - DNA, 25 bp, Homo sapien
atcataattttttagttacagctca

SEQ ID NO: 30097 - DNA, 25 bp, Homo sapien
atcatacacttgctgttgtctctgt

SEQ ID NO: 30098 - DNA, 25 bp, Homo sapien
atcatacacttgcttttgtctctgt

SEQ ID NO: 30099 - DNA, 25 bp, Homo sapien
atcatacaggcatacacacaggaga

SEQ ID NO: 30100 - DNA, 25 bp, Homo sapien
atcatacaggcgtacacacaggaga

SEQ ID NO: 30101 - DNA, 25 bp, Homo sapien
atcataccaccttaagtttttcaaa

SEQ ID NO: 30102 - DNA, 25 bp, Homo sapien
atcataccatcttaagtttttcaaa

SEQ ID NO: 30103 - DNA, 25 bp, Homo sapien
atcataccctatagttaaaaaatgt

SEQ ID NO: 30104 - DNA, 25 bp, Homo sapien
atcataccctatggttaaaaaatgt

SEQ ID NO: 30105 - DNA, 25 bp, Homo sapien
atcatagctgttactgccacttaaa

SEQ ID NO: 30106 - DNA, 25 bp, Homo sapien
atcatagctgttattgccacttaaa

SEQ ID NO: 30107 - DNA, 25 bp, Homo sapien
atcatattatacgtaggagcaatca

SEQ ID NO: 30108 - DNA, 25 bp, Homo sapien
atcatattatatgtaggagcaatca

SEQ ID NO: 30109 - DNA, 25 bp, Homo sapien
atcatatttacagatacatcgaaaa

SEQ ID NO: 30110 - DNA, 25 bp, Homo sapien
atcatatttacggatacatcgaaaa

SEQ ID NO: 30111 - DNA, 25 bp, Homo sapien
atcatcaagtcctattattgaatta

SEQ ID NO: 30112 - DNA, 25 bp, Homo sapien
atcatcaagtcctattcttgaatta

SEQ ID NO: 30113 - DNA, 25 bp, Homo sapien
atcatcacatttgtcaccattgaac

SEQ ID NO: 30114 - DNA, 25 bp, Homo sapien
atcatcacgtttgtcaccattgaac

SEQ ID NO: 30115 - DNA, 25 bp, Homo sapien
atcatcatcatcccgcaaacaatta

SEQ ID NO: 30116 - DNA, 25 bp, Homo sapien
atcatcatcatcctgcaaacaatta

SEQ ID NO: 30117 - DNA, 25 bp, Homo sapien
atcatccaaattgctttggctctgc

SEQ ID NO: 30118 - DNA, 25 bp, Homo sapien
atcatccaaattgttttggctctgc

SEQ ID NO: 30119 - DNA, 25 bp, Homo sapien
atcatccaaccataattgtctaaac

SEQ ID NO: 30120 - DNA, 25 bp, Homo sapien
atcatccaaccgtaattgtctaaac

SEQ ID NO: 30121 - DNA, 25 bp, Homo sapien
atcatccaccagaagaatgtgagtg

SEQ ID NO: 30122 - DNA, 25 bp, Homo sapien
atcatccaccaggagaatgtgagtg

SEQ ID NO: 30123 - DNA, 25 bp, Homo sapien
atcatccacctctttgatatagacc

SEQ ID NO: 30124 - DNA, 25 bp, Homo sapien
atcatccacctctttgttatagacc

SEQ ID NO: 30125 - DNA, 25 bp, Homo sapien
atcatccaggaataaaaagatttag

SEQ ID NO: 30126 - DNA, 25 bp, Homo sapien
atcatccaggaataaacagatttag

SEQ ID NO: 30127 - DNA, 25 bp, Homo sapien
atcatcctaagcaaaattccctaag

SEQ ID NO: 30128 - DNA, 25 bp, Homo sapien
atcatcctaagcaacattccctaag

SEQ ID NO: 30129 - DNA, 25 bp, Homo sapien
atcatcggaaaatatccaggagcca

SEQ ID NO: 30130 - DNA, 25 bp, Homo sapien
atcatcggacaatatccaggagcca

SEQ ID NO: 30131 - DNA, 25 bp, Homo sapien
atcatctagggtctaatgggtagaa

SEQ ID NO: 30132 - DNA, 25 bp, Homo sapien
atcatctagtgtctaatgggtagaa

SEQ ID NO: 30133 - DNA, 25 bp, Homo sapien
atcatctcagagccagaaaagggtt

SEQ ID NO: 30134 - DNA, 25 bp, Homo sapien
atcatctcagagccggaaaagggtt

SEQ ID NO: 30135 - DNA, 25 bp, Homo sapien
atcatctccaccgttattattttag

SEQ ID NO: 30136 - DNA, 25 bp, Homo sapien
atcatctccactgttattattttag

SEQ ID NO: 30137 - DNA, 25 bp, Homo sapien
atcatctctggtatatggtaggtag

SEQ ID NO: 30138 - DNA, 25 bp, Homo sapien
atcatctctggtatattgtaggtag

SEQ ID NO: 30139 - DNA, 25 bp, Homo sapien
atcatctgaatccatgcagaaaaaa

SEQ ID NO: 30140 - DNA, 25 bp, Homo sapien
atcatctgaatctatgcagaaaaaa

SEQ ID NO: 30141 - DNA, 25 bp, Homo sapien
atcatctgatctcatcattcttcct

SEQ ID NO: 30142 - DNA, 25 bp, Homo sapien
atcatctgccaaaacatccttagaa

SEQ ID NO: 30143 - DNA, 25 bp, Homo sapien
atcatctgccaaagcatccttagaa

SEQ ID NO: 30144 - DNA, 25 bp, Homo sapien
atcatctggtctcatcattcttcct

SEQ ID NO: 30145 - DNA, 25 bp, Homo sapien
atcatctgtgttcctacatatagac

SEQ ID NO: 30146 - DNA, 25 bp, Homo sapien
atcatctgtgtttctacatatagac

SEQ ID NO: 30147 - DNA, 25 bp, Homo sapien
atcatcttctcctgcctaaacaaca

SEQ ID NO: 30148 - DNA, 25 bp, Homo sapien
atcatcttctcctgtctaaacaaca

SEQ ID NO: 30149 - DNA, 25 bp, Homo sapien
atcatgaaagagatagcggatatgg

SEQ ID NO: 30150 - DNA, 25 bp, Homo sapien
atcatgaaagagatagtggatatgg

SEQ ID NO: 30151 - DNA, 25 bp, Homo sapien
atcatgagagagcaaacgttcaata

SEQ ID NO: 30152 - DNA, 25 bp, Homo sapien
atcatgagagagcaaatgttcaata

SEQ ID NO: 30153 - DNA, 25 bp, Homo sapien
atcatgagcgtactagaggctatgg

SEQ ID NO: 30154 - DNA, 25 bp, Homo sapien
atcatgagcgtagtagaggctatgg

SEQ ID NO: 30155 - DNA, 25 bp, Homo sapien
atcatgcgtgacccctgaagtctgc

SEQ ID NO: 30156 - DNA, 25 bp, Homo sapien
atcatgcgtgatccctgaagtctgc

SEQ ID NO: 30157 - DNA, 25 bp, Homo sapien
atcatgctcccattgtgaacttcat

SEQ ID NO: 30158 - DNA, 25 bp, Homo sapien
atcatgctcccgttgtgaacttcat

SEQ ID NO: 30159 - DNA, 25 bp, Homo sapien
atcatggaaggtgtgaactttgaaa

SEQ ID NO: 30160 - DNA, 25 bp, Homo sapien
atcatggaaggtgtgatctttgaaa

SEQ ID NO: 30161 - DNA, 25 bp, Homo sapien
atcatggaatgctcagggatcagaa

SEQ ID NO: 30162 - DNA, 25 bp, Homo sapien
atcatggaatggtcagggatcagaa

SEQ ID NO: 30163 - DNA, 25 bp, Homo sapien
atcatggactacttcatgtcttaag

SEQ ID NO: 30164 - DNA, 25 bp, Homo sapien
atcatggactatttcatgtcttaag

SEQ ID NO: 30165 - DNA, 25 bp, Homo sapien
atcatgggacacacttctgaaagca

SEQ ID NO: 30166 - DNA, 25 bp, Homo sapien
atcatgggattaagaaaaaaaacaa

SEQ ID NO: 30167 - DNA, 25 bp, Homo sapien
atcatggggcacacttctgaaagca

SEQ ID NO: 30168 - DNA, 25 bp, Homo sapien
atcatggggttaagaaaaaaaacaa

SEQ ID NO: 30169 - DNA, 25 bp, Homo sapien
atcatggtatgacctctgtttacct

SEQ ID NO: 30170 - DNA, 25 bp, Homo sapien
atcatggtatgagctctgtttacct

SEQ ID NO: 30171 - DNA, 25 bp, Homo sapien
atcatggtcaagttccagtgagggc

SEQ ID NO: 30172 - DNA, 25 bp, Homo sapien
atcatggtcaagttccggtgagggc

SEQ ID NO: 30173 - DNA, 25 bp, Homo sapien
atcatgtacctaattacatcattgc

SEQ ID NO: 30174 - DNA, 25 bp, Homo sapien
atcatgtacctaattatatcattgc

SEQ ID NO: 30175 - DNA, 25 bp, Homo sapien
atcatgtaggtgcagacgtttagca

SEQ ID NO: 30176 - DNA, 25 bp, Homo sapien
atcatgtaggtgtagacgtttagca

SEQ ID NO: 30177 - DNA, 25 bp, Homo sapien
atcatgtccagtaagagacaaggac

SEQ ID NO: 30178 - DNA, 25 bp, Homo sapien
atcatgtccagtaggagacaaggac

SEQ ID NO: 30179 - DNA, 25 bp, Homo sapien
atcatgtgatgacgagaggagaagg

SEQ ID NO: 30180 - DNA, 25 bp, Homo sapien
atcatgtgatgatgagaggagaagg

SEQ ID NO: 30181 - DNA, 25 bp, Homo sapien
atcatgtggaacagggaaagatatt

SEQ ID NO: 30182 - DNA, 25 bp, Homo sapien
atcatgtggaacagtgaaagatatt

SEQ ID NO: 30183 - DNA, 25 bp, Homo sapien
atcattaaacgttacctaaaactca

SEQ ID NO: 30184 - DNA, 25 bp, Homo sapien
atcattaaacgttatctaaaactca

SEQ ID NO: 30185 - DNA, 25 bp, Homo sapien
atcattatctttcaatctcctccat

SEQ ID NO: 30186 - DNA, 25 bp, Homo sapien
atcattatctttcgatctcctccat

SEQ ID NO: 30187 - DNA, 25 bp, Homo sapien
atcattcatctttattctcaatcta

SEQ ID NO: 30188 - DNA, 25 bp, Homo sapien
atcattcatctttgttctcaatcta

SEQ ID NO: 30189 - DNA, 25 bp, Homo sapien
atcattccaaacagagactagcagg

SEQ ID NO: 30190 - DNA, 25 bp, Homo sapien
atcattccaaaccgagactagcagg

SEQ ID NO: 30191 - DNA, 25 bp, Homo sapien
atcattccctgggattagtctccag

SEQ ID NO: 30192 - DNA, 25 bp, Homo sapien
atcattccctgggattcgtctccag

SEQ ID NO: 30193 - DNA, 25 bp, Homo sapien
atcattgacaggcattttggcaact

SEQ ID NO: 30194 - DNA, 25 bp, Homo sapien
atcattgacaggtattttggcaact

SEQ ID NO: 30195 - DNA, 25 bp, Homo sapien
atcattgacattacatatgcccagt

SEQ ID NO: 30196 - DNA, 25 bp, Homo sapien
atcattgacattgcatatgcccagt

SEQ ID NO: 30197 - DNA, 25 bp, Homo sapien
atcattgcaggaaaggaagaaacca

SEQ ID NO: 30198 - DNA, 25 bp, Homo sapien
atcattgcagggaaggaagaaacca

SEQ ID NO: 30199 - DNA, 25 bp, Homo sapien
atcattgcctggccatgtatctttt

SEQ ID NO: 30200 - DNA, 25 bp, Homo sapien
atcattgcctggccttgtatctttt

SEQ ID NO: 30201 - DNA, 25 bp, Homo sapien
atcattgcctgggttgcagtcttct

SEQ ID NO: 30202 - DNA, 25 bp, Homo sapien
atcattgcttgggttgcagtcttct

SEQ ID NO: 30203 - DNA, 25 bp, Homo sapien
atcattggatttccatggttttttt

SEQ ID NO: 30204 - DNA, 25 bp, Homo sapien
atcattggattttcatggttttttt

SEQ ID NO: 30205 - DNA, 25 bp, Homo sapien
atcattggtgcaaatgcaggtattg

SEQ ID NO: 30206 - DNA, 25 bp, Homo sapien
atcattggtgcagatgcaggtattg

SEQ ID NO: 30207 - DNA, 25 bp, Homo sapien
atcattgtgaccatacatttaaaaa

SEQ ID NO: 30208 - DNA, 25 bp, Homo sapien
atcattgtgaccatacgtttaaaaa

SEQ ID NO: 30209 - DNA, 25 bp, Homo sapien
atcatttaatgagcatcttagttat

SEQ ID NO: 30210 - DNA, 25 bp, Homo sapien
atcatttaatgagcgtcttagttat

SEQ ID NO: 30211 - DNA, 25 bp, Homo sapien
atcatttacttttcgtcatgctgga

SEQ ID NO: 30212 - DNA, 25 bp, Homo sapien
atcatttacttttggtcatgctgga

SEQ ID NO: 30213 - DNA, 25 bp, Homo sapien
atcatttcttctcattaaatctcct

SEQ ID NO: 30214 - DNA, 25 bp, Homo sapien
atcatttcttctgattaaatctcct

SEQ ID NO: 30215 - DNA, 25 bp, Homo sapien
atcatttcttgcctggattatagta

SEQ ID NO: 30216 - DNA, 25 bp, Homo sapien
atcatttcttgcttggattatagta

SEQ ID NO: 30217 - DNA, 25 bp, Homo sapien
atcatttgaaaccagaaaactgttg

SEQ ID NO: 30218 - DNA, 25 bp, Homo sapien
atcatttgaaactagaaaactgttg

SEQ ID NO: 30219 - DNA, 25 bp, Homo sapien
atcatttgtgagacgcacaattcac

SEQ ID NO: 30220 - DNA, 25 bp, Homo sapien
atcatttgtgagatgcacaattcac

SEQ ID NO: 30221 - DNA, 25 bp, Homo sapien
atcatttgtgcattcactgaagtag

SEQ ID NO: 30222 - DNA, 25 bp, Homo sapien
atcatttgtgcgttcactgaagtag

SEQ ID NO: 30223 - DNA, 25 bp, Homo sapien
atcattttaatcagttcctgaaaat

SEQ ID NO: 30224 - DNA, 25 bp, Homo sapien
atcattttaatcagtttctgaaaat

SEQ ID NO: 30225 - DNA, 25 bp, Homo sapien
atcattttatccagtgttaaggctt

SEQ ID NO: 30226 - DNA, 25 bp, Homo sapien
atcattttatccggtgttaaggctt

SEQ ID NO: 30227 - DNA, 25 bp, Homo sapien
atcattttctcaccatattgctcaa

SEQ ID NO: 30228 - DNA, 25 bp, Homo sapien
atcattttctcactatattgctcaa

SEQ ID NO: 30229 - DNA, 25 bp, Homo sapien
atcattttcttacatggctatataa

SEQ ID NO: 30230 - DNA, 25 bp, Homo sapien
atcattttgcaactcctaacaacaa

SEQ ID NO: 30231 - DNA, 25 bp, Homo sapien
atcattttgcagctcctaacaacaa

SEQ ID NO: 30232 - DNA, 25 bp, Homo sapien
atcatttttttacatggctatataa

SEQ ID NO: 30233 - DNA, 25 bp, Homo sapien
atccaaaaatagaccctaggttttc

SEQ ID NO: 30234 - DNA, 25 bp, Homo sapien
atccaaaaataggccctaggttttc

SEQ ID NO: 30235 - DNA, 25 bp, Homo sapien
atccaaaacaagactcaagctataa

SEQ ID NO: 30236 - DNA, 25 bp, Homo sapien
atccaaaactagactcaagctataa

SEQ ID NO: 30237 - DNA, 25 bp, Homo sapien
atccaaaataaaacctttgtggtct

SEQ ID NO: 30238 - DNA, 25 bp, Homo sapien
atccaaaataaaatctttgtggtct

SEQ ID NO: 30239 - DNA, 25 bp, Homo sapien
atccaaagttttcgtgcaaaatgta

SEQ ID NO: 30240 - DNA, 25 bp, Homo sapien
atccaaagtttttgtgcaaaatgta

SEQ ID NO: 30241 - DNA, 25 bp, Homo sapien
atccaaatgtcaataatcagttgga

SEQ ID NO: 30242 - DNA, 25 bp, Homo sapien
atccaaatgtcagtaatcagttgga

SEQ ID NO: 30243 - DNA, 25 bp, Homo sapien
atccaaattatacctttgtgaatac

SEQ ID NO: 30244 - DNA, 25 bp, Homo sapien
atccaaattatatctttgtgaatac

SEQ ID NO: 30245 - DNA, 25 bp, Homo sapien
atccaacaaaacacagtggctcagt

SEQ ID NO: 30246 - DNA, 25 bp, Homo sapien
atccaacaaaacacggtggctcagt

SEQ ID NO: 30247 - DNA, 25 bp, Homo sapien
atccaacacagtaggtttcactatc

SEQ ID NO: 30248 - DNA, 25 bp, Homo sapien
atccaacacagtagttttcactatc

SEQ ID NO: 30249 - DNA, 25 bp, Homo sapien
atccaaccataattgtctaaacttc

SEQ ID NO: 30250 - DNA, 25 bp, Homo sapien
atccaaccgtaattgtctaaacttc

SEQ ID NO: 30251 - DNA, 25 bp, Homo sapien
atccaacggactctccagacaactc

SEQ ID NO: 30252 - DNA, 25 bp, Homo sapien
atccaacggactgtccagacaactc

SEQ ID NO: 30253 - DNA, 25 bp, Homo sapien
atccaactctttgacaccaggttat

SEQ ID NO: 30254 - DNA, 25 bp, Homo sapien
atccaactctttgacatcaggttat

SEQ ID NO: 30255 - DNA, 25 bp, Homo sapien
atccaagagtcagcgagatggtgcc

SEQ ID NO: 30256 - DNA, 25 bp, Homo sapien
atccaagagtcagtgagatggtgcc

SEQ ID NO: 30257 - DNA, 25 bp, Homo sapien
atccaagatcataaacccaagttac

SEQ ID NO: 30258 - DNA, 25 bp, Homo sapien
atccaagattataaacccaagttac

SEQ ID NO: 30259 - DNA, 25 bp, Homo sapien
atccaagcaatggcgtcagtcattt

SEQ ID NO: 30260 - DNA, 25 bp, Homo sapien
atccaagcaatggtgtcagtcattt

SEQ ID NO: 30261 - DNA, 25 bp, Homo sapien
atccaagcatctgaaaattgtactt

SEQ ID NO: 30262 - DNA, 25 bp, Homo sapien
atccaagcgtctgaaaattgtactt

SEQ ID NO: 30263 - DNA, 25 bp, Homo sapien
atccaagctgtagtccacagatcta

SEQ ID NO: 30264 - DNA, 25 bp, Homo sapien
atccaagctgtcgtccacagatcta

SEQ ID NO: 30265 - DNA, 25 bp, Homo sapien
atccaaggaggtccaacatccaaat

SEQ ID NO: 30266 - DNA, 25 bp, Homo sapien
atccaaggaggtccgacatccaaat

SEQ ID NO: 30267 - DNA, 25 bp, Homo sapien
atccaaggctcccattctgagcatc

SEQ ID NO: 30268 - DNA, 25 bp, Homo sapien
atccaaggctcctattctgagcatc

SEQ ID NO: 30269 - DNA, 25 bp, Homo sapien
atccaagttttacgagatgacaaaa

SEQ ID NO: 30270 - DNA, 25 bp, Homo sapien
atccaagttttatgagatgacaaaa

SEQ ID NO: 30271 - DNA, 25 bp, Homo sapien
atccaatcgccctaaagaatgattt

SEQ ID NO: 30272 - DNA, 25 bp, Homo sapien
atccaatcgccttaaagaatgattt

SEQ ID NO: 30273 - DNA, 25 bp, Homo sapien
atccaatgcgtatgtgcaatgccaa

SEQ ID NO: 30274 - DNA, 25 bp, Homo sapien
atccaatgtgtatgtgcaatgccaa

SEQ ID NO: 30275 - DNA, 25 bp, Homo sapien
atccaatttaatactcagatttcat

SEQ ID NO: 30276 - DNA, 25 bp, Homo sapien
atccaatttaatactcggatttcat

SEQ ID NO: 30277 - DNA, 25 bp, Homo sapien
atccacaagataattctgtgagccg

SEQ ID NO: 30278 - DNA, 25 bp, Homo sapien
atccacaagatgattctgtgagccg

SEQ ID NO: 30279 - DNA, 25 bp, Homo sapien
atccacaagcgtcaagaccattcag

SEQ ID NO: 30280 - DNA, 25 bp, Homo sapien
atccacaagtgtcaagaccattcag

SEQ ID NO: 30281 - DNA, 25 bp, Homo sapien
atccacacctagaagaggaaaagct

SEQ ID NO: 30282 - DNA, 25 bp, Homo sapien
atccacacctagcagaggaaaagct

SEQ ID NO: 30283 - DNA, 25 bp, Homo sapien
atccacatggcaaaggtatggtggc

SEQ ID NO: 30284 - DNA, 25 bp, Homo sapien
atccacatggcagaggtatggtggc

SEQ ID NO: 30285 - DNA, 25 bp, Homo sapien
atccacattaagataaggctgggag

SEQ ID NO: 30286 - DNA, 25 bp, Homo sapien
atccacattgagataaggctgggag

SEQ ID NO: 30287 - DNA, 25 bp, Homo sapien
atccacattgatagtgacatggctt

SEQ ID NO: 30288 - DNA, 25 bp, Homo sapien
atccacattgatattgacatggctt

SEQ ID NO: 30289 - DNA, 25 bp, Homo sapien
atccaccaaccaggccaaaataaac

SEQ ID NO: 30290 - DNA, 25 bp, Homo sapien
atccaccaaccaggtcaaaataaac

SEQ ID NO: 30291 - DNA, 25 bp, Homo sapien
atccaccacattccatatttgtctt

SEQ ID NO: 30292 - DNA, 25 bp, Homo sapien
atccaccacggaaatcgtattgcag

SEQ ID NO: 30293 - DNA, 25 bp, Homo sapien
atccaccatattccatatttgtctt

SEQ ID NO: 30294 - DNA, 25 bp, Homo sapien
atccaccatggaaatcgtattgcag

SEQ ID NO: 30295 - DNA, 25 bp, Homo sapien
atccacgctgccatcgtgttccctc

SEQ ID NO: 30296 - DNA, 25 bp, Homo sapien
atccacgctgccgtcgtgttccctc

SEQ ID NO: 30297 - DNA, 25 bp, Homo sapien
atccactaacagcagagatattatt

SEQ ID NO: 30298 - DNA, 25 bp, Homo sapien
atccactaacagcagatatattatt

SEQ ID NO: 30299 - DNA, 25 bp, Homo sapien
atccactccggttgatcagaatgcc

SEQ ID NO: 30300 - DNA, 25 bp, Homo sapien
atccactctggttgatcagaatgcc

SEQ ID NO: 30301 - DNA, 25 bp, Homo sapien
atccactctgttgctagatcacaga

SEQ ID NO: 30302 - DNA, 25 bp, Homo sapien
atccactctgttgttagatcacaga

SEQ ID NO: 30303 - DNA, 25 bp, Homo sapien
atccactgaaaatacaaaccaagac

SEQ ID NO: 30304 - DNA, 25 bp, Homo sapien
atccactgacaatgttatattccta

SEQ ID NO: 30305 - DNA, 25 bp, Homo sapien
atccactgagaatacaaaccaagac

SEQ ID NO: 30306 - DNA, 25 bp, Homo sapien
atccactgccaatgttatattccta

SEQ ID NO: 30307 - DNA, 25 bp, Homo sapien
atccacttaacttcctgaagactca

SEQ ID NO: 30308 - DNA, 25 bp, Homo sapien
atccacttcacttcctgaagactca

SEQ ID NO: 30309 - DNA, 25 bp, Homo sapien
atccacttccaatcttaccaattcc

SEQ ID NO: 30310 - DNA, 25 bp, Homo sapien
atccacttccacgatccaaatacct

SEQ ID NO: 30311 - DNA, 25 bp, Homo sapien
atccacttccactatccaaatacct

SEQ ID NO: 30312 - DNA, 25 bp, Homo sapien
atccacttctaatcttaccaattcc

SEQ ID NO: 30313 - DNA, 25 bp, Homo sapien
atccacttggagaacgtttttttgt

SEQ ID NO: 30314 - DNA, 25 bp, Homo sapien
atccacttggagaatgtttttttgt

SEQ ID NO: 30315 - DNA, 25 bp, Homo sapien
atccacttggtaaaatattggtcta

SEQ ID NO: 30316 - DNA, 25 bp, Homo sapien
atccacttggtagaatattggtcta

SEQ ID NO: 30317 - DNA, 25 bp, Homo sapien
atccagaaaacttgctaaaagtgag

SEQ ID NO: 30318 - DNA, 25 bp, Homo sapien
atccagaaagagacctgaaggtggg

SEQ ID NO: 30319 - DNA, 25 bp, Homo sapien
atccagaaagagagctgaaggtggg

SEQ ID NO: 30320 - DNA, 25 bp, Homo sapien
atccagaaagcttgctaaaagtgag

SEQ ID NO: 30321 - DNA, 25 bp, Homo sapien
atccagaagtgcgcatgcagatttt

SEQ ID NO: 30322 - DNA, 25 bp, Homo sapien
atccagaagtgtgcatgcagatttt

SEQ ID NO: 30323 - DNA, 25 bp, Homo sapien
atccagacattaaaccaagaaggaa

SEQ ID NO: 30324 - DNA, 25 bp, Homo sapien
atccagacattaaaccgagaaggaa

SEQ ID NO: 30325 - DNA, 25 bp, Homo sapien
atccagagcaatagtcaatgcatag

SEQ ID NO: 30326 - DNA, 25 bp, Homo sapien
atccagagcaatagtcgatgcatag

SEQ ID NO: 30327 - DNA, 25 bp, Homo sapien
atccagaggcgtggacttagtactc

SEQ ID NO: 30328 - DNA, 25 bp, Homo sapien
atccagaggtgtggacttagtactc

SEQ ID NO: 30329 - DNA, 25 bp, Homo sapien
atccagagtatgctactttccgagg

SEQ ID NO: 30330 - DNA, 25 bp, Homo sapien
atccagagtatgcttctttccgagg

SEQ ID NO: 30331 - DNA, 25 bp, Homo sapien
atccagataaaactgtttttttcct

SEQ ID NO: 30332 - DNA, 25 bp, Homo sapien
atccagataaaattgtttttttcct

SEQ ID NO: 30333 - DNA, 25 bp, Homo sapien
atccagcaacggatgatgtgctttt

SEQ ID NO: 30334 - DNA, 25 bp, Homo sapien
atccagcaagggatgatgtgctttt

SEQ ID NO: 30335 - DNA, 25 bp, Homo sapien
atccagcacagtgaattaacgtaaa

SEQ ID NO: 30336 - DNA, 25 bp, Homo sapien
atccagcacagtgcattaacgtaaa

SEQ ID NO: 30337 - DNA, 25 bp, Homo sapien
atccagcagtaaaggtcagcagctg

SEQ ID NO: 30338 - DNA, 25 bp, Homo sapien
atccagcagtaaaggtgagcagctg

SEQ ID NO: 30339 - DNA, 25 bp, Homo sapien
atccagcgccattcccacaggcttc

SEQ ID NO: 30340 - DNA, 25 bp, Homo sapien
atccagcggcattcccacaggcttc

SEQ ID NO: 30341 - DNA, 25 bp, Homo sapien
atccagctgggaaagtgttgggaaa

SEQ ID NO: 30342 - DNA, 25 bp, Homo sapien
atccagctgggaaggtgttgggaaa

SEQ ID NO: 30343 - DNA, 25 bp, Homo sapien
atccagctgttatttttgtatgtgg

SEQ ID NO: 30344 - DNA, 25 bp, Homo sapien
atccagctgttctttttgtatgtgg

SEQ ID NO: 30345 - DNA, 25 bp, Homo sapien
atccagcttctcaacgtgttacttg

SEQ ID NO: 30346 - DNA, 25 bp, Homo sapien
atccagcttctcaatgtgttacttg

SEQ ID NO: 30347 - DNA, 25 bp, Homo sapien
atccaggaataaaaagatttagagt

SEQ ID NO: 30348 - DNA, 25 bp, Homo sapien
atccaggaataaacagatttagagt

SEQ ID NO: 30349 - DNA, 25 bp, Homo sapien
atccaggcacatagcacgaagcatc

SEQ ID NO: 30350 - DNA, 25 bp, Homo sapien
atccaggcacatagcaggaagcatc

SEQ ID NO: 30351 - DNA, 25 bp, Homo sapien
atccaggctgcctctcacttgttgt

SEQ ID NO: 30352 - DNA, 25 bp, Homo sapien
atccaggctgcctctcgcttgttgt

SEQ ID NO: 30353 - DNA, 25 bp, Homo sapien
atccaggtcctggctcctggaaagc

SEQ ID NO: 30354 - DNA, 25 bp, Homo sapien
atccaggttctggctcctggaaagc

SEQ ID NO: 30355 - DNA, 25 bp, Homo sapien
atccagtatcggtggcccactggct

SEQ ID NO: 30356 - DNA, 25 bp, Homo sapien
atccagtattggtggcccactggct

SEQ ID NO: 30357 - DNA, 25 bp, Homo sapien
atccagttctcaaatgaccatcagt

SEQ ID NO: 30358 - DNA, 25 bp, Homo sapien
atccagtttagacagagtctgcttt

SEQ ID NO: 30359 - DNA, 25 bp, Homo sapien
atccagtttagatagagtctgcttt

SEQ ID NO: 30360 - DNA, 25 bp, Homo sapien
atccagttttcaaatgaccatcagt

SEQ ID NO: 30361 - DNA, 25 bp, Homo sapien
atccataagacaatgtcaccatagt

SEQ ID NO: 30362 - DNA, 25 bp, Homo sapien
atccataagacagtgtcaccatagt

SEQ ID NO: 30363 - DNA, 25 bp, Homo sapien
atccataagcgattaagtggtattt

SEQ ID NO: 30364 - DNA, 25 bp, Homo sapien
atccataaggcatgaggccggagac

SEQ ID NO: 30365 - DNA, 25 bp, Homo sapien
atccataagtcatttaggagcaaat

SEQ ID NO: 30366 - DNA, 25 bp, Homo sapien
atccataagtcgtttaggagcaaat

SEQ ID NO: 30367 - DNA, 25 bp, Homo sapien
atccataagtgattaagtggtattt

SEQ ID NO: 30368 - DNA, 25 bp, Homo sapien
atccataatgcatgaggccggagac

SEQ ID NO: 30369 - DNA, 25 bp, Homo sapien
atccatacataggtgcattagtagc

SEQ ID NO: 30370 - DNA, 25 bp, Homo sapien
atccatacatatgtgcattagtagc

SEQ ID NO: 30371 - DNA, 25 bp, Homo sapien
atccatatcattgtcactgatacaa

SEQ ID NO: 30372 - DNA, 25 bp, Homo sapien
atccatattattgtcactgatacaa

SEQ ID NO: 30373 - DNA, 25 bp, Homo sapien
atccatattcatacctatagcccac

SEQ ID NO: 30374 - DNA, 25 bp, Homo sapien
atccatattcatacttatagcccac

SEQ ID NO: 30375 - DNA, 25 bp, Homo sapien
atccatattgtttggcatcaatatc

SEQ ID NO: 30376 - DNA, 25 bp, Homo sapien
atccatattgttttgcatcaatatc

SEQ ID NO: 30377 - DNA, 25 bp, Homo sapien
atccatcaacactggagtagggttg

SEQ ID NO: 30378 - DNA, 25 bp, Homo sapien
atccatcaacactgtagtagggttg

SEQ ID NO: 30379 - DNA, 25 bp, Homo sapien
atccatcaacttataatttaatact

SEQ ID NO: 30380 - DNA, 25 bp, Homo sapien
atccatcagcttataatttaatact

SEQ ID NO: 30381 - DNA, 25 bp, Homo sapien
atccatcctggcattaaaaagtaga

SEQ ID NO: 30382 - DNA, 25 bp, Homo sapien
atccatcctggcgttaaaaagtaga

SEQ ID NO: 30383 - DNA, 25 bp, Homo sapien
atccatctctatcgcatggcagcct

SEQ ID NO: 30384 - DNA, 25 bp, Homo sapien
atccatctctattgcatggcagcct

SEQ ID NO: 30385 - DNA, 25 bp, Homo sapien
atccatcttgtatattttcaaaaca

SEQ ID NO: 30386 - DNA, 25 bp, Homo sapien
atccatcttgtatcttttcaaaaca

SEQ ID NO: 30387 - DNA, 25 bp, Homo sapien
atccatcttgttcattcttctgctt

SEQ ID NO: 30388 - DNA, 25 bp, Homo sapien
atccatcttgttcgttcttctgctt

SEQ ID NO: 30389 - DNA, 25 bp, Homo sapien
atccatgacatcaatagtttagcaa

SEQ ID NO: 30390 - DNA, 25 bp, Homo sapien
atccatgacattaatagtttagcaa

SEQ ID NO: 30391 - DNA, 25 bp, Homo sapien
atccatgtaaaagtgaatctatgca

SEQ ID NO: 30392 - DNA, 25 bp, Homo sapien
atccatgtacaagtgaatctatgca

SEQ ID NO: 30393 - DNA, 25 bp, Homo sapien
atccatgtgcgcagaactcagaagg

SEQ ID NO: 30394 - DNA, 25 bp, Homo sapien
atccatgtgtgcagaactcagaagg

SEQ ID NO: 30395 - DNA, 25 bp, Homo sapien
atccattaaactaacctttaaaagc

SEQ ID NO: 30396 - DNA, 25 bp, Homo sapien
atccattaaactaatctttaaaagc

SEQ ID NO: 30397 - DNA, 25 bp, Homo sapien
atccattcacagatcctaccacaac

SEQ ID NO: 30398 - DNA, 25 bp, Homo sapien
atccattcacagattctaccacaac

SEQ ID NO: 30399 - DNA, 25 bp, Homo sapien
atccattcagggacttatataccag

SEQ ID NO: 30400 - DNA, 25 bp, Homo sapien
atccattcaggggcttatataccag

SEQ ID NO: 30401 - DNA, 25 bp, Homo sapien
atccattgttgtagtacgatattcc

SEQ ID NO: 30402 - DNA, 25 bp, Homo sapien
atccattgttgtagtatgatattcc

SEQ ID NO: 30403 - DNA, 25 bp, Homo sapien
atccattgtttagcgacttctccaa

SEQ ID NO: 30404 - DNA, 25 bp, Homo sapien
atccattgtttagtgacttctccaa

SEQ ID NO: 30405 - DNA, 25 bp, Homo sapien
atcccaaatatcgtctagtgtaggt

SEQ ID NO: 30406 - DNA, 25 bp, Homo sapien
atcccaaatatcttctagtgtaggt

SEQ ID NO: 30407 - DNA, 25 bp, Homo sapien
atcccacaaaggaggcctttccttg

SEQ ID NO: 30408 - DNA, 25 bp, Homo sapien
atcccacaaaggaggcttttccttg

SEQ ID NO: 30409 - DNA, 25 bp, Homo sapien
atcccacacatctcttcattgtgct

SEQ ID NO: 30410 - DNA, 25 bp, Homo sapien
atcccacacatctctttattgtgct

SEQ ID NO: 30411 - DNA, 25 bp, Homo sapien
atcccactaggttctgatgaatctt

SEQ ID NO: 30412 - DNA, 25 bp, Homo sapien
atcccacttggttctgatgaatctt

SEQ ID NO: 30413 - DNA, 25 bp, Homo sapien
atcccagaaatgccaacggctacag

SEQ ID NO: 30414 - DNA, 25 bp, Homo sapien
atcccagaaatgccaatggctacag

SEQ ID NO: 30415 - DNA, 25 bp, Homo sapien
atcccagacatgcaaggagattcaa

SEQ ID NO: 30416 - DNA, 25 bp, Homo sapien
atcccagacattcaaggagattcaa

SEQ ID NO: 30417 - DNA, 25 bp, Homo sapien
atcccagacgtttaaccctcaaaac

SEQ ID NO: 30418 - DNA, 25 bp, Homo sapien
atcccagagcccgaatttctgaggc

SEQ ID NO: 30419 - DNA, 25 bp, Homo sapien
atcccagagcctgaatttctgaggc

SEQ ID NO: 30420 - DNA, 25 bp, Homo sapien
atcccagatgtttaaccctcaaaac

SEQ ID NO: 30421 - DNA, 25 bp, Homo sapien
atcccagcttaacattttaacccag

SEQ ID NO: 30422 - DNA, 25 bp, Homo sapien
atcccagcttaatattttaacccag

SEQ ID NO: 30423 - DNA, 25 bp, Homo sapien
atcccagtagaatatgtagcaattc

SEQ ID NO: 30424 - DNA, 25 bp, Homo sapien
atcccagtggaatatgtagcaattc

SEQ ID NO: 30425 - DNA, 25 bp, Homo sapien
atcccatcaaaacataaaggtcagt

SEQ ID NO: 30426 - DNA, 25 bp, Homo sapien
atcccatcaaaagataaaggtcagt

SEQ ID NO: 30427 - DNA, 25 bp, Homo sapien
atcccatcaggtgggtcatttgagc

SEQ ID NO: 30428 - DNA, 25 bp, Homo sapien
atcccatcaggtgggttatttgagc

SEQ ID NO: 30429 - DNA, 25 bp, Homo sapien
atcccatcttaccatctctaaccta

SEQ ID NO: 30430 - DNA, 25 bp, Homo sapien
atcccatcttactatctctaaccta

SEQ ID NO: 30431 - DNA, 25 bp, Homo sapien
atcccatgcgtacttgcctaatttt

SEQ ID NO: 30432 - DNA, 25 bp, Homo sapien
atcccatgcttttcccactcagctc

SEQ ID NO: 30433 - DNA, 25 bp, Homo sapien
atcccatgcttttcccgctcagctc

SEQ ID NO: 30434 - DNA, 25 bp, Homo sapien
atcccatgtgtacttgcctaatttt

SEQ ID NO: 30435 - DNA, 25 bp, Homo sapien
atcccatttttcaagttaggttgta

SEQ ID NO: 30436 - DNA, 25 bp, Homo sapien
atcccatttttccagttaggttgta

SEQ ID NO: 30437 - DNA, 25 bp, Homo sapien
atccccatcctcgacctcacaaatc

SEQ ID NO: 30438 - DNA, 25 bp, Homo sapien
atccccatccttgacctcacaaatc

SEQ ID NO: 30439 - DNA, 25 bp, Homo sapien
atccccatctcttggcctcaacctg

SEQ ID NO: 30440 - DNA, 25 bp, Homo sapien
atccccatctcttggcttcaacctg

SEQ ID NO: 30441 - DNA, 25 bp, Homo sapien
atcccgtgccttctggaggtaatag

SEQ ID NO: 30442 - DNA, 25 bp, Homo sapien
atcccgtgctttctggaggtaatag

SEQ ID NO: 30443 - DNA, 25 bp, Homo sapien
atcccgttggagaagctacaaagaa

SEQ ID NO: 30444 - DNA, 25 bp, Homo sapien
atcccgttggagaggctacaaagaa

SEQ ID NO: 30445 - DNA, 25 bp, Homo sapien
atccctacatgataagaaactgcat

SEQ ID NO: 30446 - DNA, 25 bp, Homo sapien
atccctacgtgataagaaactgcat

SEQ ID NO: 30447 - DNA, 25 bp, Homo sapien
atccctagctctgtctctatcatct

SEQ ID NO: 30448 - DNA, 25 bp, Homo sapien
atccctagctctgtctttatcatct

SEQ ID NO: 30449 - DNA, 25 bp, Homo sapien
atccctaggtgcgctttctcgactg

SEQ ID NO: 30450 - DNA, 25 bp, Homo sapien
atccctaggtgctctttctcgactg

SEQ ID NO: 30451 - DNA, 25 bp, Homo sapien
atccctatacaccaaggtttgctat

SEQ ID NO: 30452 - DNA, 25 bp, Homo sapien
atccctatataccaaggtttgctat

SEQ ID NO: 30453 - DNA, 25 bp, Homo sapien
atccctattttgccaagcttagatt

SEQ ID NO: 30454 - DNA, 25 bp, Homo sapien
atccctattttgctaagcttagatt

SEQ ID NO: 30455 - DNA, 25 bp, Homo sapien
atccctcattcctaaccatcctcag

SEQ ID NO: 30456 - DNA, 25 bp, Homo sapien
atccctcattcttaaccatcctcag

SEQ ID NO: 30457 - DNA, 25 bp, Homo sapien
atccctctcatttttcaggcagctc

SEQ ID NO: 30458 - DNA, 25 bp, Homo sapien
atccctcttatttttcaggcagctc

SEQ ID NO: 30459 - DNA, 25 bp, Homo sapien
atccctgaatgccacacttcctgta

SEQ ID NO: 30460 - DNA, 25 bp, Homo sapien
atccctgagtgccacacttcctgta

SEQ ID NO: 30461 - DNA, 25 bp, Homo sapien
atccctggctccaattattcccatt

SEQ ID NO: 30462 - DNA, 25 bp, Homo sapien
atccctggctccgattattcccatt

SEQ ID NO: 30463 - DNA, 25 bp, Homo sapien
atccctgggcggtcacgttggctca

SEQ ID NO: 30464 - DNA, 25 bp, Homo sapien
atccctgggtggtcacgttggctca

SEQ ID NO: 30465 - DNA, 25 bp, Homo sapien
atccctgtggcattaacagtgatga

SEQ ID NO: 30466 - DNA, 25 bp, Homo sapien
atccctgtggcgttaacagtgatga

SEQ ID NO: 30467 - DNA, 25 bp, Homo sapien
atccctgtttcacatgacagccctt

SEQ ID NO: 30468 - DNA, 25 bp, Homo sapien
atccctgtttcacatggcagccctt

SEQ ID NO: 30469 - DNA, 25 bp, Homo sapien
atcccttacaaatggcttggtgctg

SEQ ID NO: 30470 - DNA, 25 bp, Homo sapien
atcccttacgaatggcttggtgctg

SEQ ID NO: 30471 - DNA, 25 bp, Homo sapien
atcccttagaacagactagaaaatg

SEQ ID NO: 30472 - DNA, 25 bp, Homo sapien
atcccttagaacggactagaaaatg

SEQ ID NO: 30473 - DNA, 25 bp, Homo sapien
atcccttcaccatcattgttccagg

SEQ ID NO: 30474 - DNA, 25 bp, Homo sapien
atcccttcgccatcattgttccagg

SEQ ID NO: 30475 - DNA, 25 bp, Homo sapien
atcccttggaagacagtggtagaaa

SEQ ID NO: 30476 - DNA, 25 bp, Homo sapien
atcccttggaagagagtggtagaaa

SEQ ID NO: 30477 - DNA, 25 bp, Homo sapien
atccctttaacaccattaccatgga

SEQ ID NO: 30478 - DNA, 25 bp, Homo sapien
atccctttaacatcattaccatgga

SEQ ID NO: 30479 - DNA, 25 bp, Homo sapien
atccctttatccagcttcctcttcc

SEQ ID NO: 30480 - DNA, 25 bp, Homo sapien
atccctttatcctgcttcctcttcc

SEQ ID NO: 30481 - DNA, 25 bp, Homo sapien
atccgaataaagctgaataagctcc

SEQ ID NO: 30482 - DNA, 25 bp, Homo sapien
atccgaatagagctgaataagctcc

SEQ ID NO: 30483 - DNA, 25 bp, Homo sapien
atccgagtattacattgccactatt

SEQ ID NO: 30484 - DNA, 25 bp, Homo sapien
atccgagtattatattgccactatt

SEQ ID NO: 30485 - DNA, 25 bp, Homo sapien
atccgagtcttgaaggaagagtgag

SEQ ID NO: 30486 - DNA, 25 bp, Homo sapien
atccgagtcttgagggaagagtgag

SEQ ID NO: 30487 - DNA, 25 bp, Homo sapien
atccgatatcagtcacatgcaacta

SEQ ID NO: 30488 - DNA, 25 bp, Homo sapien
atccgatatcagtcacgtgcaacta

SEQ ID NO: 30489 - DNA, 25 bp, Homo sapien
atccgctctgtcaacttctctcttt

SEQ ID NO: 30490 - DNA, 25 bp, Homo sapien
atccgctctgtcagcttctctcttt

SEQ ID NO: 30491 - DNA, 25 bp, Homo sapien
atccggctgtggaagtgtgagatgg

SEQ ID NO: 30492 - DNA, 25 bp, Homo sapien
atccggctgtgggagtgtgagatgg

SEQ ID NO: 30493 - DNA, 25 bp, Homo sapien
atccgggtcctccatccacaggggc

SEQ ID NO: 30494 - DNA, 25 bp, Homo sapien
atccgggtcctctatccacaggggc

SEQ ID NO: 30495 - DNA, 25 bp, Homo sapien
atccgtaacttagcaaaataaaaag

SEQ ID NO: 30496 - DNA, 25 bp, Homo sapien
atccgtaacttggcaaaataaaaag

SEQ ID NO: 30497 - DNA, 25 bp, Homo sapien
atccgtcttgactcagcttcatttg

SEQ ID NO: 30498 - DNA, 25 bp, Homo sapien
atccgtcttgactgagcttcatttg

SEQ ID NO: 30499 - DNA, 25 bp, Homo sapien
atccgtgattattggtagtaagcca

SEQ ID NO: 30500 - DNA, 25 bp, Homo sapien
atccgtgattattggttgtaagcca

SEQ ID NO: 30501 - DNA, 25 bp, Homo sapien
atcctaaaacagcttatggacgtgg

SEQ ID NO: 30502 - DNA, 25 bp, Homo sapien
atcctaaaagagcttatggacgtgg

SEQ ID NO: 30503 - DNA, 25 bp, Homo sapien
atcctaaattttgcctacctccagt

SEQ ID NO: 30504 - DNA, 25 bp, Homo sapien
atcctaaattttgtctacctccagt

SEQ ID NO: 30505 - DNA, 25 bp, Homo sapien
atcctagaaataaaggaagcagtgt

SEQ ID NO: 30506 - DNA, 25 bp, Homo sapien
atcctagatataaaggaagcagtgt

SEQ ID NO: 30507 - DNA, 25 bp, Homo sapien
atcctagcagaattcacgccctgct

SEQ ID NO: 30508 - DNA, 25 bp, Homo sapien
atcctagcagaattcatgccctgct

SEQ ID NO: 30509 - DNA, 25 bp, Homo sapien
atcctatagagcatttcaggaatgg

SEQ ID NO: 30510 - DNA, 25 bp, Homo sapien
atcctatagagcatttgaggaatgg

SEQ ID NO: 30511 - DNA, 25 bp, Homo sapien
atcctattttcttgccaaactccat

SEQ ID NO: 30512 - DNA, 25 bp, Homo sapien
atcctattttcttgccgaactccat

SEQ ID NO: 30513 - DNA, 25 bp, Homo sapien
atcctcaacagtccttatccaaact

SEQ ID NO: 30514 - DNA, 25 bp, Homo sapien
atcctcaacagttcttatccaaact

SEQ ID NO: 30515 - DNA, 25 bp, Homo sapien
atcctcaacattactgccataccct

SEQ ID NO: 30516 - DNA, 25 bp, Homo sapien
atcctcaacattgtactgtaaagtc

SEQ ID NO: 30517 - DNA, 25 bp, Homo sapien
atcctcaacgttactgccataccct

SEQ ID NO: 30518 - DNA, 25 bp, Homo sapien
atcctcaatattgtactgtaaagtc

SEQ ID NO: 30519 - DNA, 25 bp, Homo sapien
atcctcagggcctactgttcagcct

SEQ ID NO: 30520 - DNA, 25 bp, Homo sapien
atcctcagggcttactgttcagcct

SEQ ID NO: 30521 - DNA, 25 bp, Homo sapien
atcctcatgaccctgagttaagcca

SEQ ID NO: 30522 - DNA, 25 bp, Homo sapien
atcctcatgaccttgagttaagcca

SEQ ID NO: 30523 - DNA, 25 bp, Homo sapien
atcctcattcagaagcagtcattct

SEQ ID NO: 30524 - DNA, 25 bp, Homo sapien
atcctcattgagaagcagtcattct

SEQ ID NO: 30525 - DNA, 25 bp, Homo sapien
atcctccagagactgccgcttttcc

SEQ ID NO: 30526 - DNA, 25 bp, Homo sapien
atcctccagagactgctgcttttcc

SEQ ID NO: 30527 - DNA, 25 bp, Homo sapien
atcctctaagtaacagcctgaaaga

SEQ ID NO: 30528 - DNA, 25 bp, Homo sapien
atcctctaagtaacaggctgaaaga

SEQ ID NO: 30529 - DNA, 25 bp, Homo sapien
atcctctgcacgttcattagtgacg

SEQ ID NO: 30530 - DNA, 25 bp, Homo sapien
atcctctgcactttcattagtgacg

SEQ ID NO: 30531 - DNA, 25 bp, Homo sapien
atcctcttgttcttccacagaagga

SEQ ID NO: 30532 - DNA, 25 bp, Homo sapien
atcctctttaatactgaattatgcc

SEQ ID NO: 30533 - DNA, 25 bp, Homo sapien
atcctctttaatgctgaattatgcc

SEQ ID NO: 30534 - DNA, 25 bp, Homo sapien
atcctctttttcttccacagaagga

SEQ ID NO: 30535 - DNA, 25 bp, Homo sapien
atcctgacaacatgttcaacaaagt

SEQ ID NO: 30536 - DNA, 25 bp, Homo sapien
atcctgacaacgtgttcaacaaagt

SEQ ID NO: 30537 - DNA, 25 bp, Homo sapien
atcctgacccaaaaggtagactgga

SEQ ID NO: 30538 - DNA, 25 bp, Homo sapien
atcctgacccaagaggtagactgga

SEQ ID NO: 30539 - DNA, 25 bp, Homo sapien
atcctgagatatacactgttttgcc

SEQ ID NO: 30540 - DNA, 25 bp, Homo sapien
atcctgagatattcactgttttgcc

SEQ ID NO: 30541 - DNA, 25 bp, Homo sapien
atcctgagcgtaacccactccactt

SEQ ID NO: 30542 - DNA, 25 bp, Homo sapien
atcctgagcgtaacccgctccactt

SEQ ID NO: 30543 - DNA, 25 bp, Homo sapien
atcctgagtaacccaccgtgtacca

SEQ ID NO: 30544 - DNA, 25 bp, Homo sapien
atcctgagtaacctaccgtgtacca

SEQ ID NO: 30545 - DNA, 25 bp, Homo sapien
atcctgatgacacgtgcacaaggtg

SEQ ID NO: 30546 - DNA, 25 bp, Homo sapien
atcctgatgacatgtgcacaaggtg

SEQ ID NO: 30547 - DNA, 25 bp, Homo sapien
atcctgcaacgcacagtcccccatg

SEQ ID NO: 30548 - DNA, 25 bp, Homo sapien
atcctgcaatgcacagtcccccatg

SEQ ID NO: 30549 - DNA, 25 bp, Homo sapien
atcctgcacagatacgaaggcttac

SEQ ID NO: 30550 - DNA, 25 bp, Homo sapien
atcctgcacagatatgaaggcttac

SEQ ID NO: 30551 - DNA, 25 bp, Homo sapien
atcctgcttctttttctgtgttctc

SEQ ID NO: 30552 - DNA, 25 bp, Homo sapien
atcctgcttttttttctgtgttctc

SEQ ID NO: 30553 - DNA, 25 bp, Homo sapien
atcctggaaagaaaaaaaattcctc

SEQ ID NO: 30554 - DNA, 25 bp, Homo sapien
atcctggactctaaaaaaacggaat

SEQ ID NO: 30555 - DNA, 25 bp, Homo sapien
atcctggactctgaaaaaacggaat

SEQ ID NO: 30556 - DNA, 25 bp, Homo sapien
atcctggagagaaaaaaaattcctc

SEQ ID NO: 30557 - DNA, 25 bp, Homo sapien
atcctggagagacgtccgcaaacag

SEQ ID NO: 30558 - DNA, 25 bp, Homo sapien
atcctggagagatgtccgcaaacag

SEQ ID NO: 30559 - DNA, 25 bp, Homo sapien
atcctggcattaaaaagtagaaaag

SEQ ID NO: 30560 - DNA, 25 bp, Homo sapien
atcctggcgttaaaaagtagaaaag

SEQ ID NO: 30561 - DNA, 25 bp, Homo sapien
atcctgggaatcaaaatcagactaa

SEQ ID NO: 30562 - DNA, 25 bp, Homo sapien
atcctgggagtcaaaatcagactaa

SEQ ID NO: 30563 - DNA, 25 bp, Homo sapien
atcctgggccttatctcaccaagtt

SEQ ID NO: 30564 - DNA, 25 bp, Homo sapien
atcctgggccttatgtcaccaagtt

SEQ ID NO: 30565 - DNA, 25 bp, Homo sapien
atcctgtgttgcctattgatttcaa

SEQ ID NO: 30566 - DNA, 25 bp, Homo sapien
atcctgtgttgcctgttgatttcaa

SEQ ID NO: 30567 - DNA, 25 bp, Homo sapien
atcctgttgatcaatgacactaatc

SEQ ID NO: 30568 - DNA, 25 bp, Homo sapien
atcctgttgatcagtgacactaatc

SEQ ID NO: 30569 - DNA, 25 bp, Homo sapien
atcctgtttacttcactcaggcaaa

SEQ ID NO: 30570 - DNA, 25 bp, Homo sapien
atcctgttttcttcactcaggcaaa

SEQ ID NO: 30571 - DNA, 25 bp, Homo sapien
atccttaaagacagaataggattgg

SEQ ID NO: 30572 - DNA, 25 bp, Homo sapien
atccttaaatacagaataggattgg

SEQ ID NO: 30573 - DNA, 25 bp, Homo sapien
atccttaatatcatcacatctgtga

SEQ ID NO: 30574 - DNA, 25 bp, Homo sapien
atccttaatgtcatcacatctgtga

SEQ ID NO: 30575 - DNA, 25 bp, Homo sapien
atccttaggagtcagaaatagcagg

SEQ ID NO: 30576 - DNA, 25 bp, Homo sapien
atccttaggagtctgaaatagcagg

SEQ ID NO: 30577 - DNA, 25 bp, Homo sapien
atccttcactgtgcatatgtgagag

SEQ ID NO: 30578 - DNA, 25 bp, Homo sapien
atccttcactgtgcgtatgtgagag

SEQ ID NO: 30579 - DNA, 25 bp, Homo sapien
atccttcatggataccaacggacaa

SEQ ID NO: 30580 - DNA, 25 bp, Homo sapien
atccttcatggatatcaacggacaa

SEQ ID NO: 30581 - DNA, 25 bp, Homo sapien
atccttgaaaaatgatagcatgact

SEQ ID NO: 30582 - DNA, 25 bp, Homo sapien
atccttgaaaagacggtccataaca

SEQ ID NO: 30583 - DNA, 25 bp, Homo sapien
atccttgaaaagatggtccataaca

SEQ ID NO: 30584 - DNA, 25 bp, Homo sapien
atccttgaaatcctgtgctcagggg

SEQ ID NO: 30585 - DNA, 25 bp, Homo sapien
atccttgaaatcgtgtgctcagggg

SEQ ID NO: 30586 - DNA, 25 bp, Homo sapien
atccttgaacaatgatagcatgact

SEQ ID NO: 30587 - DNA, 25 bp, Homo sapien
atccttgaactctgtgtctgaaagt

SEQ ID NO: 30588 - DNA, 25 bp, Homo sapien
atccttgaactctttgtctgaaagt

SEQ ID NO: 30589 - DNA, 25 bp, Homo sapien
atccttggcaagagttcactgcaga

SEQ ID NO: 30590 - DNA, 25 bp, Homo sapien
atccttggcgagagttcactgcaga

SEQ ID NO: 30591 - DNA, 25 bp, Homo sapien
atccttggtccactgacttatcttg

SEQ ID NO: 30592 - DNA, 25 bp, Homo sapien
atccttggtccattgacttatcttg

SEQ ID NO: 30593 - DNA, 25 bp, Homo sapien
atccttggtggtgccggactccagt

SEQ ID NO: 30594 - DNA, 25 bp, Homo sapien
atccttggtggtgctggactccagt

SEQ ID NO: 30595 - DNA, 25 bp, Homo sapien
atcctttaaactcagaatttataac

SEQ ID NO: 30596 - DNA, 25 bp, Homo sapien
atcctttaaactcggaatttataac

SEQ ID NO: 30597 - DNA, 25 bp, Homo sapien
atcctttaaatcacgaaaagcccac

SEQ ID NO: 30598 - DNA, 25 bp, Homo sapien
atcctttaaatcatgaaaagcccac

SEQ ID NO: 30599 - DNA, 25 bp, Homo sapien
atcctttactatcctcttagtcttc

SEQ ID NO: 30600 - DNA, 25 bp, Homo sapien
atcctttactattctcttagtcttc

SEQ ID NO: 30601 - DNA, 25 bp, Homo sapien
atcctttagaacatgatgaaagcca

SEQ ID NO: 30602 - DNA, 25 bp, Homo sapien
atcctttagaatatgatgaaagcca

SEQ ID NO: 30603 - DNA, 25 bp, Homo sapien
atcctttatgtccttttctctgaat

SEQ ID NO: 30604 - DNA, 25 bp, Homo sapien
atcctttatgtctttttctctgaat

SEQ ID NO: 30605 - DNA, 25 bp, Homo sapien
atcctttcctcccacccagaatagt

SEQ ID NO: 30606 - DNA, 25 bp, Homo sapien
atcctttcctcccaccgagaatagt

SEQ ID NO: 30607 - DNA, 25 bp, Homo sapien
atcctttcctggaatctgtctgaag

SEQ ID NO: 30608 - DNA, 25 bp, Homo sapien
atcctttcctgggatctgtctgaag

SEQ ID NO: 30609 - DNA, 25 bp, Homo sapien
atcctttcttcaatataagttctca

SEQ ID NO: 30610 - DNA, 25 bp, Homo sapien
atcctttcttcaatgtaagttctca

SEQ ID NO: 30611 - DNA, 25 bp, Homo sapien
atccttttagagtaaagcaggtaaa

SEQ ID NO: 30612 - DNA, 25 bp, Homo sapien
atccttttagagtgaagcaggtaaa

SEQ ID NO: 30613 - DNA, 25 bp, Homo sapien
atcgaacagtacggcaatgtggaaa

SEQ ID NO: 30614 - DNA, 25 bp, Homo sapien
atcgaacagtatggcaatgtggaaa

SEQ ID NO: 30615 - DNA, 25 bp, Homo sapien
atcgaaccctgtgttctgttctgcg

SEQ ID NO: 30616 - DNA, 25 bp, Homo sapien
atcgaaccttgtgttctgttctgcg

SEQ ID NO: 30617 - DNA, 25 bp, Homo sapien
atcgaagctgaacagcagcaggggt

SEQ ID NO: 30618 - DNA, 25 bp, Homo sapien
atcgaagctgaacggcagcaggggt

SEQ ID NO: 30619 - DNA, 25 bp, Homo sapien
atcgagagcactaacgagaatgtga

SEQ ID NO: 30620 - DNA, 25 bp, Homo sapien
atcgagagtactaacgagaatgtga

SEQ ID NO: 30621 - DNA, 25 bp, Homo sapien
atcgagatgatatcttgattttcaa

SEQ ID NO: 30622 - DNA, 25 bp, Homo sapien
atcgagatgatattttgattttcaa

SEQ ID NO: 30623 - DNA, 25 bp, Homo sapien
atcgaggctgtcagaccatgagagg

SEQ ID NO: 30624 - DNA, 25 bp, Homo sapien
atcgaggctgtcaggccatgagagg

SEQ ID NO: 30625 - DNA, 25 bp, Homo sapien
atcgattctcactatactgttttat

SEQ ID NO: 30626 - DNA, 25 bp, Homo sapien
atcgattctcactatattgttttat

SEQ ID NO: 30627 - DNA, 25 bp, Homo sapien
atcgatttttgtatgctgaaccagc

SEQ ID NO: 30628 - DNA, 25 bp, Homo sapien
atcgatttttgtgtgctgaaccagc

SEQ ID NO: 30629 - DNA, 25 bp, Homo sapien
atcgccatatccaggctcctgggtc

SEQ ID NO: 30630 - DNA, 25 bp, Homo sapien
atcgccatgcagtgcggtgttcaga

SEQ ID NO: 30631 - DNA, 25 bp, Homo sapien
atcgccatgcagtgtggtgttcaga

SEQ ID NO: 30632 - DNA, 25 bp, Homo sapien
atcgccatgtccaggctcctgggtc

SEQ ID NO: 30633 - DNA, 25 bp, Homo sapien
atcgcttctatcatattctgagtct

SEQ ID NO: 30634 - DNA, 25 bp, Homo sapien
atcgcttctatcatgttctgagtct

SEQ ID NO: 30635 - DNA, 25 bp, Homo sapien
atcggatggtctagcaccttttttg

SEQ ID NO: 30636 - DNA, 25 bp, Homo sapien
atcggatggtctagcatcttttttg

SEQ ID NO: 30637 - DNA, 25 bp, Homo sapien
atcggcattgtgaaaaaatagatgg

SEQ ID NO: 30638 - DNA, 25 bp, Homo sapien
atcggcattgtgaaaagatagatgg

SEQ ID NO: 30639 - DNA, 25 bp, Homo sapien
atcggccagatttaatccaaataaa

SEQ ID NO: 30640 - DNA, 25 bp, Homo sapien
atcggccagatttgatccaaataaa

SEQ ID NO: 30641 - DNA, 25 bp, Homo sapien
atcggccttttccactggcaacttc

SEQ ID NO: 30642 - DNA, 25 bp, Homo sapien
atcggcctttttcactggcaacttc

SEQ ID NO: 30643 - DNA, 25 bp, Homo sapien
atcgggcagccattgtgcacttgga

SEQ ID NO: 30644 - DNA, 25 bp, Homo sapien
atcgggcagccgttgtgcacttgga

SEQ ID NO: 30645 - DNA, 25 bp, Homo sapien
atcggtgttggtcacgcccaagaca

SEQ ID NO: 30646 - DNA, 25 bp, Homo sapien
atcggtgttggtcatgcccaagaca

SEQ ID NO: 30647 - DNA, 25 bp, Homo sapien
atcggttgataaatgaacaaacaca

SEQ ID NO: 30648 - DNA, 25 bp, Homo sapien
atcggttgataaatgagcaaacaca

SEQ ID NO: 30649 - DNA, 25 bp, Homo sapien
atcgtatctctgaatgccgcctctt

SEQ ID NO: 30650 - DNA, 25 bp, Homo sapien
atcgtatctgtgaatgccgcctctt

SEQ ID NO: 30651 - DNA, 25 bp, Homo sapien
atcgtgtaatgtctcatggctttta

SEQ ID NO: 30652 - DNA, 25 bp, Homo sapien
atcgtgtaatgtcttatggctttta

SEQ ID NO: 30653 - DNA, 25 bp, Homo sapien
atcgttatccatgactgcttttaac

SEQ ID NO: 30654 - DNA, 25 bp, Homo sapien
atcgttatctatgactgcttttaac

SEQ ID NO: 30655 - DNA, 25 bp, Homo sapien
atcgttcagtcgaggccagtttgga

SEQ ID NO: 30656 - DNA, 25 bp, Homo sapien
atcgttcagtcgatgccagtttgga

SEQ ID NO: 30657 - DNA, 25 bp, Homo sapien
atcgttgaatttccaacatctcact

SEQ ID NO: 30658 - DNA, 25 bp, Homo sapien
atcgttgaatttgcaacatctcact

SEQ ID NO: 30659 - DNA, 25 bp, Homo sapien
atcgttttcagaacatctctgtcta

SEQ ID NO: 30660 - DNA, 25 bp, Homo sapien
atcgttttcggaacatctctgtcta

SEQ ID NO: 30661 - DNA, 25 bp, Homo sapien
atctaaaaatttgaaaactcctcat

SEQ ID NO: 30662 - DNA, 25 bp, Homo sapien
atctaaaaatttgaaagctcctcat

SEQ ID NO: 30663 - DNA, 25 bp, Homo sapien
atctaaaacagatgaagattaagct

SEQ ID NO: 30664 - DNA, 25 bp, Homo sapien
atctaaaacggatgaagattaagct

SEQ ID NO: 30665 - DNA, 25 bp, Homo sapien
atctaaaattgcatttattgtgtgc

SEQ ID NO: 30666 - DNA, 25 bp, Homo sapien
atctaaaattgtatttattgtgtgc

SEQ ID NO: 30667 - DNA, 25 bp, Homo sapien
atctaaacagtcccatgagtaagaa

SEQ ID NO: 30668 - DNA, 25 bp, Homo sapien
atctaaacagtcccgtgagtaagaa

SEQ ID NO: 30669 - DNA, 25 bp, Homo sapien
atctaaagcaataaaaacatacccc

SEQ ID NO: 30670 - DNA, 25 bp, Homo sapien
atctaaagcaatagaaacatacccc

SEQ ID NO: 30671 - DNA, 25 bp, Homo sapien
atctaacacgataggcttgtataat

SEQ ID NO: 30672 - DNA, 25 bp, Homo sapien
atctaacactggactgctttgaagg

SEQ ID NO: 30673 - DNA, 25 bp, Homo sapien
atctaacatgataggcttgtataat

SEQ ID NO: 30674 - DNA, 25 bp, Homo sapien
atctaacattggactgctttgaagg

SEQ ID NO: 30675 - DNA, 25 bp, Homo sapien
atctaacatttgaaagtgatttgaa

SEQ ID NO: 30676 - DNA, 25 bp, Homo sapien
atctaacatttgatagtgatttgaa

SEQ ID NO: 30677 - DNA, 25 bp, Homo sapien
atctaacccttacttgaatctgttc

SEQ ID NO: 30678 - DNA, 25 bp, Homo sapien
atctaacccttatttgaatctgttc

SEQ ID NO: 30679 - DNA, 25 bp, Homo sapien
atctaactaagggctatttgtgact

SEQ ID NO: 30680 - DNA, 25 bp, Homo sapien
atctaactaaggtctatttgtgact

SEQ ID NO: 30681 - DNA, 25 bp, Homo sapien
atctaactggcttcgtattgcactt

SEQ ID NO: 30682 - DNA, 25 bp, Homo sapien
atctaactggctttgtattgcactt

SEQ ID NO: 30683 - DNA, 25 bp, Homo sapien
atctaagaactgtaaatcagaagca

SEQ ID NO: 30684 - DNA, 25 bp, Homo sapien
atctaagaagaaacatgtttgaggc

SEQ ID NO: 30685 - DNA, 25 bp, Homo sapien
atctaagaagaaatatgtttgaggc

SEQ ID NO: 30686 - DNA, 25 bp, Homo sapien
atctaagaattgtaaatcagaagca

SEQ ID NO: 30687 - DNA, 25 bp, Homo sapien
atctaagacttcagaaagaaacaaa

SEQ ID NO: 30688 - DNA, 25 bp, Homo sapien
atctaagacttcggaaagaaacaaa

SEQ ID NO: 30689 - DNA, 25 bp, Homo sapien
atctaagcatttggcttgtttgaag

SEQ ID NO: 30690 - DNA, 25 bp, Homo sapien
atctaagcatttggtttgtttgaag

SEQ ID NO: 30691 - DNA, 25 bp, Homo sapien
atctaagtcactacggcacacagga

SEQ ID NO: 30692 - DNA, 25 bp, Homo sapien
atctaagtcactatggcacacagga

SEQ ID NO: 30693 - DNA, 25 bp, Homo sapien
atctaagttttgaacagaatctaag

SEQ ID NO: 30694 - DNA, 25 bp, Homo sapien
atctaagttttgaatagaatctaag

SEQ ID NO: 30695 - DNA, 25 bp, Homo sapien
atctaataaacattgatacattttc

SEQ ID NO: 30696 - DNA, 25 bp, Homo sapien
atctaataagcattgatacattttc

SEQ ID NO: 30697 - DNA, 25 bp, Homo sapien
atctaatccaattccttcagtgact

SEQ ID NO: 30698 - DNA, 25 bp, Homo sapien
atctaatctaattccttcagtgact

SEQ ID NO: 30699 - DNA, 25 bp, Homo sapien
atctaatggcgaataaagagaatga

SEQ ID NO: 30700 - DNA, 25 bp, Homo sapien
atctaatggtgaataaagagaatga

SEQ ID NO: 30701 - DNA, 25 bp, Homo sapien
atctacaaatcacgtacacataaca

SEQ ID NO: 30702 - DNA, 25 bp, Homo sapien
atctacaaatcatgtacacataaca

SEQ ID NO: 30703 - DNA, 25 bp, Homo sapien
atctacaaattgcccagggaaggta

SEQ ID NO: 30704 - DNA, 25 bp, Homo sapien
atctacaaattgctcagggaaggta

SEQ ID NO: 30705 - DNA, 25 bp, Homo sapien
atctacacttagaaaaattgtgagc

SEQ ID NO: 30706 - DNA, 25 bp, Homo sapien
atctacacttagataaattgtgagc

SEQ ID NO: 30707 - DNA, 25 bp, Homo sapien
atctaccaaacagaatttgaagtct

SEQ ID NO: 30708 - DNA, 25 bp, Homo sapien
atctaccaaacagtatttgaagtct

SEQ ID NO: 30709 - DNA, 25 bp, Homo sapien
atctacctaaacattcattgccaag

SEQ ID NO: 30710 - DNA, 25 bp, Homo sapien
atctacctaaacgttcattgccaag

SEQ ID NO: 30711 - DNA, 25 bp, Homo sapien
atctactacatacatgagctgtaga

SEQ ID NO: 30712 - DNA, 25 bp, Homo sapien
atctactacatacgtgagctgtaga

SEQ ID NO: 30713 - DNA, 25 bp, Homo sapien
atctactcaaacaagaaagcccttt

SEQ ID NO: 30714 - DNA, 25 bp, Homo sapien
atctactcgaacaagaaagcccttt

SEQ ID NO: 30715 - DNA, 25 bp, Homo sapien
atctactgacactgttttcacactt

SEQ ID NO: 30716 - DNA, 25 bp, Homo sapien
atctactgatactgttttcacactt

SEQ ID NO: 30717 - DNA, 25 bp, Homo sapien
atctacttgcattacacctatgggt

SEQ ID NO: 30718 - DNA, 25 bp, Homo sapien
atctacttgcattacatctatgggt

SEQ ID NO: 30719 - DNA, 25 bp, Homo sapien
atctacttgccgttatttacattta

SEQ ID NO: 30720 - DNA, 25 bp, Homo sapien
atctacttgccgttgtttacattta

SEQ ID NO: 30721 - DNA, 25 bp, Homo sapien
atctactttcttagcactttttgag

SEQ ID NO: 30722 - DNA, 25 bp, Homo sapien
atctactttcttagcagtttttgag

SEQ ID NO: 30723 - DNA, 25 bp, Homo sapien
atctagagttatgaatggaaacaga

SEQ ID NO: 30724 - DNA, 25 bp, Homo sapien
atctagagttatgactggaaacaga

SEQ ID NO: 30725 - DNA, 25 bp, Homo sapien
atctagcacagatgctatatctcta

SEQ ID NO: 30726 - DNA, 25 bp, Homo sapien
atctagcacagatgttatatctcta

SEQ ID NO: 30727 - DNA, 25 bp, Homo sapien
atctagcagccgaactgtgcttttc

SEQ ID NO: 30728 - DNA, 25 bp, Homo sapien
atctagcagcctaactgtgcttttc

SEQ ID NO: 30729 - DNA, 25 bp, Homo sapien
atctagcaggacttcaatgtacatt

SEQ ID NO: 30730 - DNA, 25 bp, Homo sapien
atctagcaggagttcaatgtacatt

SEQ ID NO: 30731 - DNA, 25 bp, Homo sapien
atctagcatcgctttatgataaaaa

SEQ ID NO: 30732 - DNA, 25 bp, Homo sapien
atctagcatggctttatgataaaaa

SEQ ID NO: 30733 - DNA, 25 bp, Homo sapien
atctagctcactatgttctccatgg

SEQ ID NO: 30734 - DNA, 25 bp, Homo sapien
atctagctcactgtgttctccatgg

SEQ ID NO: 30735 - DNA, 25 bp, Homo sapien
atctagcttgcaaaatatcttggta

SEQ ID NO: 30736 - DNA, 25 bp, Homo sapien
atctagcttgcaaattatcttggta

SEQ ID NO: 30737 - DNA, 25 bp, Homo sapien
atctaggcaatgatcatcagtgaat

SEQ ID NO: 30738 - DNA, 25 bp, Homo sapien
atctaggcattgatcatcagtgaat

SEQ ID NO: 30739 - DNA, 25 bp, Homo sapien
atctaggtacggagacagccttgaa

SEQ ID NO: 30740 - DNA, 25 bp, Homo sapien
atctaggtatggagacagccttgaa

SEQ ID NO: 30741 - DNA, 25 bp, Homo sapien
atctagtctatcaagctatttactg

SEQ ID NO: 30742 - DNA, 25 bp, Homo sapien
atctagtctatcaggctatttactg

SEQ ID NO: 30743 - DNA, 25 bp, Homo sapien
atctagtcttcactgtccttcttgt

SEQ ID NO: 30744 - DNA, 25 bp, Homo sapien
atctagtcttcattgtccttcttgt

SEQ ID NO: 30745 - DNA, 25 bp, Homo sapien
atctagtgccactttccactccagc

SEQ ID NO: 30746 - DNA, 25 bp, Homo sapien
atctagtgccattttccactccagc

SEQ ID NO: 30747 - DNA, 25 bp, Homo sapien
atctagtttatccattattctgaat

SEQ ID NO: 30748 - DNA, 25 bp, Homo sapien
atctagtttatcccttattctgaat

SEQ ID NO: 30749 - DNA, 25 bp, Homo sapien
atctagtttgaagtacggcatcatt

SEQ ID NO: 30750 - DNA, 25 bp, Homo sapien
atctagtttgaggtacggcatcatt

SEQ ID NO: 30751 - DNA, 25 bp, Homo sapien
atctataatgaacggttaatacttt

SEQ ID NO: 30752 - DNA, 25 bp, Homo sapien
atctataatgaatggttaatacttt

SEQ ID NO: 30753 - DNA, 25 bp, Homo sapien
atctatacactgcccaaactcagca

SEQ ID NO: 30754 - DNA, 25 bp, Homo sapien
atctatacactgtccaaactcagca

SEQ ID NO: 30755 - DNA, 25 bp, Homo sapien
atctatactatgtcaggtgccatgc

SEQ ID NO: 30756 - DNA, 25 bp, Homo sapien
atctatactgtgtcaggtgccatgc

SEQ ID NO: 30757 - DNA, 25 bp, Homo sapien
atctatatgtacatacacatgcgga

SEQ ID NO: 30758 - DNA, 25 bp, Homo sapien
atctatatgtacctacacatgcgga

SEQ ID NO: 30759 - DNA, 25 bp, Homo sapien
atctatcaagcaaaactgaacacaa

SEQ ID NO: 30760 - DNA, 25 bp, Homo sapien
atctatcagggtcattagaaaattg

SEQ ID NO: 30761 - DNA, 25 bp, Homo sapien
atctatcagggtcgttagaaaattg

SEQ ID NO: 30762 - DNA, 25 bp, Homo sapien
atctatcatgcaaaactgaacacaa

SEQ ID NO: 30763 - DNA, 25 bp, Homo sapien
atctatctattcgcgaacaaaagga

SEQ ID NO: 30764 - DNA, 25 bp, Homo sapien
atctatctattcgggaacaaaagga

SEQ ID NO: 30765 - DNA, 25 bp, Homo sapien
atctatcttgagaatggaatttgcc

SEQ ID NO: 30766 - DNA, 25 bp, Homo sapien
atctatcttgagagtggaatttgcc

SEQ ID NO: 30767 - DNA, 25 bp, Homo sapien
atctatgcttttgagtcccaatgtg

SEQ ID NO: 30768 - DNA, 25 bp, Homo sapien
atctatgctttttagtcccaatgtg

SEQ ID NO: 30769 - DNA, 25 bp, Homo sapien
atctatggcaaactttttctgcttt

SEQ ID NO: 30770 - DNA, 25 bp, Homo sapien
atctatggcaaagtttttctgcttt

SEQ ID NO: 30771 - DNA, 25 bp, Homo sapien
atctatggccaactcatgcacaata

SEQ ID NO: 30772 - DNA, 25 bp, Homo sapien
atctatggccagctcatgcacaata

SEQ ID NO: 30773 - DNA, 25 bp, Homo sapien
atctatggttccgtgatgctgactg

SEQ ID NO: 30774 - DNA, 25 bp, Homo sapien
atctatggttctgtgatgctgactg

SEQ ID NO: 30775 - DNA, 25 bp, Homo sapien
atctatgtaatgcggctaatgccaa

SEQ ID NO: 30776 - DNA, 25 bp, Homo sapien
atctatgtaatggggctaatgccaa

SEQ ID NO: 30777 - DNA, 25 bp, Homo sapien
atctattacctgtaaccggtccttg

SEQ ID NO: 30778 - DNA, 25 bp, Homo sapien
atctattacctgtaactggtccttg

SEQ ID NO: 30779 - DNA, 25 bp, Homo sapien
atctattacttcaattcaactctca

SEQ ID NO: 30780 - DNA, 25 bp, Homo sapien
atctattacttcgattcaactctca

SEQ ID NO: 30781 - DNA, 25 bp, Homo sapien
atctattattcctacgtgtttcttt

SEQ ID NO: 30782 - DNA, 25 bp, Homo sapien
atctattattcctatgtgtttcttt

SEQ ID NO: 30783 - DNA, 25 bp, Homo sapien
atctattcaagccttttttattttg

SEQ ID NO: 30784 - DNA, 25 bp, Homo sapien
atctattcaaggcttttttattttg

SEQ ID NO: 30785 - DNA, 25 bp, Homo sapien
atctattcattactataaagttcca

SEQ ID NO: 30786 - DNA, 25 bp, Homo sapien
atctattcattattataaagttcca

SEQ ID NO: 30787 - DNA, 25 bp, Homo sapien
atctattccttctcctcctctttat

SEQ ID NO: 30788 - DNA, 25 bp, Homo sapien
atctattccttctcttcctctttat

SEQ ID NO: 30789 - DNA, 25 bp, Homo sapien
atctattgcacagattattgtttaa

SEQ ID NO: 30790 - DNA, 25 bp, Homo sapien
atctattgcacggattattgtttaa

SEQ ID NO: 30791 - DNA, 25 bp, Homo sapien
atctatttcaactaagcaatggtga

SEQ ID NO: 30792 - DNA, 25 bp, Homo sapien
atctatttcagatgtggaatcgcga

SEQ ID NO: 30793 - DNA, 25 bp, Homo sapien
atctatttcagatttggaatcgcga

SEQ ID NO: 30794 - DNA, 25 bp, Homo sapien
atctatttccactaagcaatggtga

SEQ ID NO: 30795 - DNA, 25 bp, Homo sapien
atctatttctgccttttattttaat

SEQ ID NO: 30796 - DNA, 25 bp, Homo sapien
atctatttctggcttttattttaat

SEQ ID NO: 30797 - DNA, 25 bp, Homo sapien
atctcaaaaccaaagttcgctttct

SEQ ID NO: 30798 - DNA, 25 bp, Homo sapien
atctcaaaaccgaagttcgctttct

SEQ ID NO: 30799 - DNA, 25 bp, Homo sapien
atctcaaagggcttttgtgagcact

SEQ ID NO: 30800 - DNA, 25 bp, Homo sapien
atctcaaagggtttttgtgagcact

SEQ ID NO: 30801 - DNA, 25 bp, Homo sapien
atctcaaataaaatatttcaaaact

SEQ ID NO: 30802 - DNA, 25 bp, Homo sapien
atctcaaataaagtatttcaaaact

SEQ ID NO: 30803 - DNA, 25 bp, Homo sapien
atctcaacactttgaaaacccaagg

SEQ ID NO: 30804 - DNA, 25 bp, Homo sapien
atctcaacactttggaaacccaagg

SEQ ID NO: 30805 - DNA, 25 bp, Homo sapien
atctcaacatacaaatattaaagga

SEQ ID NO: 30806 - DNA, 25 bp, Homo sapien
atctcaacatacgaatattaaagga

SEQ ID NO: 30807 - DNA, 25 bp, Homo sapien
atctcaagtgaacctggagaagcaa

SEQ ID NO: 30808 - DNA, 25 bp, Homo sapien
atctcaagtgaatctggagaagcaa

SEQ ID NO: 30809 - DNA, 25 bp, Homo sapien
atctcaattacaccaactccatctg

SEQ ID NO: 30810 - DNA, 25 bp, Homo sapien
atctcaattacaccgactccatctg

SEQ ID NO: 30811 - DNA, 25 bp, Homo sapien
atctcacaatgttcacaggatttgt

SEQ ID NO: 30812 - DNA, 25 bp, Homo sapien
atctcacacatacgtagttcacaat

SEQ ID NO: 30813 - DNA, 25 bp, Homo sapien
atctcacacatatgtagttcacaat

SEQ ID NO: 30814 - DNA, 25 bp, Homo sapien
atctcacagcatgattttattacag

SEQ ID NO: 30815 - DNA, 25 bp, Homo sapien
atctcacagtatgattttattacag

SEQ ID NO: 30816 - DNA, 25 bp, Homo sapien
atctcacagtgttcacaggatttgt

SEQ ID NO: 30817 - DNA, 25 bp, Homo sapien
atctcaccattggctgactccatct

SEQ ID NO: 30818 - DNA, 25 bp, Homo sapien
atctcaccgttggctgactccatct

SEQ ID NO: 30819 - DNA, 25 bp, Homo sapien
atctcagaacactagcagcgagaaa

SEQ ID NO: 30820 - DNA, 25 bp, Homo sapien
atctcagaacactagcggcgagaaa

SEQ ID NO: 30821 - DNA, 25 bp, Homo sapien
atctcagaattttgcaagtgcttca

SEQ ID NO: 30822 - DNA, 25 bp, Homo sapien
atctcagaattttggaagtgcttca

SEQ ID NO: 30823 - DNA, 25 bp, Homo sapien
atctcagagccagaaaagggttttt

SEQ ID NO: 30824 - DNA, 25 bp, Homo sapien
atctcagagccggaaaagggttttt

SEQ ID NO: 30825 - DNA, 25 bp, Homo sapien
atctcagagtctcaccaaaggtttt

SEQ ID NO: 30826 - DNA, 25 bp, Homo sapien
atctcagagtctcatcaaaggtttt

SEQ ID NO: 30827 - DNA, 25 bp, Homo sapien
atctcagatatattagagaaaaaaa

SEQ ID NO: 30828 - DNA, 25 bp, Homo sapien
atctcagatatattagggaaaaaaa

SEQ ID NO: 30829 - DNA, 25 bp, Homo sapien
atctcagccctgagagtccttgcct

SEQ ID NO: 30830 - DNA, 25 bp, Homo sapien
atctcagccctgagggtccttgcct

SEQ ID NO: 30831 - DNA, 25 bp, Homo sapien
atctcagcccttatcatgccttcct

SEQ ID NO: 30832 - DNA, 25 bp, Homo sapien
atctcagctctgccacatactatct

SEQ ID NO: 30833 - DNA, 25 bp, Homo sapien
atctcagctcttatcatgccttcct

SEQ ID NO: 30834 - DNA, 25 bp, Homo sapien
atctcagctttcgatatgcctccct

SEQ ID NO: 30835 - DNA, 25 bp, Homo sapien
atctcagctttgccacatactatct

SEQ ID NO: 30836 - DNA, 25 bp, Homo sapien
atctcagcttttgatatgcctccct

SEQ ID NO: 30837 - DNA, 25 bp, Homo sapien
atctcaggacatccgctagcaaatc

SEQ ID NO: 30838 - DNA, 25 bp, Homo sapien
atctcaggacatctgctagcaaatc

SEQ ID NO: 30839 - DNA, 25 bp, Homo sapien
atctcagggcacgacgagaagccca

SEQ ID NO: 30840 - DNA, 25 bp, Homo sapien
atctcagggcacgatgagaagccca

SEQ ID NO: 30841 - DNA, 25 bp, Homo sapien
atctcagtcatcaagaacaactaga

SEQ ID NO: 30842 - DNA, 25 bp, Homo sapien
atctcagtcatcaggaacaactaga

SEQ ID NO: 30843 - DNA, 25 bp, Homo sapien
atctcataagcggcctttggagtat

SEQ ID NO: 30844 - DNA, 25 bp, Homo sapien
atctcataagcgggctttggagtat

SEQ ID NO: 30845 - DNA, 25 bp, Homo sapien
atctcatccttggctgccttctctt

SEQ ID NO: 30846 - DNA, 25 bp, Homo sapien
atctcatccttgtctgccttctctt

SEQ ID NO: 30847 - DNA, 25 bp, Homo sapien
atctcatgcgtagtatgtaaatcag

SEQ ID NO: 30848 - DNA, 25 bp, Homo sapien
atctcatgtgtagtatgtaaatcag

SEQ ID NO: 30849 - DNA, 25 bp, Homo sapien
atctcattacatctgaatttatgca

SEQ ID NO: 30850 - DNA, 25 bp, Homo sapien
atctcattgcatctgaatttatgca

SEQ ID NO: 30851 - DNA, 25 bp, Homo sapien
atctcatttaatcctcataataact

SEQ ID NO: 30852 - DNA, 25 bp, Homo sapien
atctcatttaattctcataataact

SEQ ID NO: 30853 - DNA, 25 bp, Homo sapien
atctcatttacaatctctgagaacc

SEQ ID NO: 30854 - DNA, 25 bp, Homo sapien
atctcatttatctccacattctttg

SEQ ID NO: 30855 - DNA, 25 bp, Homo sapien
atctcatttgcaatctctgagaacc

SEQ ID NO: 30856 - DNA, 25 bp, Homo sapien
atctcatttgtctccacattctttg

SEQ ID NO: 30857 - DNA, 25 bp, Homo sapien
atctccaagaataagtctcatttgt

SEQ ID NO: 30858 - DNA, 25 bp, Homo sapien
atctccaataataagtctcatttgt

SEQ ID NO: 30859 - DNA, 25 bp, Homo sapien
atctccaatcaaaaccttggagtaa

SEQ ID NO: 30860 - DNA, 25 bp, Homo sapien
atctccaatcaacaccttggagtaa

SEQ ID NO: 30861 - DNA, 25 bp, Homo sapien
atctccaatgttcagcagcttgcat

SEQ ID NO: 30862 - DNA, 25 bp, Homo sapien
atctccaatgtttagcagcttgcat

SEQ ID NO: 30863 - DNA, 25 bp, Homo sapien
atctccacaattgttgctttaggaa

SEQ ID NO: 30864 - DNA, 25 bp, Homo sapien
atctccacaatttttgctttaggaa

SEQ ID NO: 30865 - DNA, 25 bp, Homo sapien
atctccaccgttattattttagtcc

SEQ ID NO: 30866 - DNA, 25 bp, Homo sapien
atctccactgttattattttagtcc

SEQ ID NO: 30867 - DNA, 25 bp, Homo sapien
atctccaggaaaatattgccttctt

SEQ ID NO: 30868 - DNA, 25 bp, Homo sapien
atctccaggaaaatgttgccttctt

SEQ ID NO: 30869 - DNA, 25 bp, Homo sapien
atctccatgttgaatattcccagtg

SEQ ID NO: 30870 - DNA, 25 bp, Homo sapien
atctccatgttggatattcccagtg

SEQ ID NO: 30871 - DNA, 25 bp, Homo sapien
atctccctctgcgctgacacgaaca

SEQ ID NO: 30872 - DNA, 25 bp, Homo sapien
atctccctctgcgttgacacgaaca

SEQ ID NO: 30873 - DNA, 25 bp, Homo sapien
atctcctcactatggaaacattgga

SEQ ID NO: 30874 - DNA, 25 bp, Homo sapien
atctcctcactgtggaaacattgga

SEQ ID NO: 30875 - DNA, 25 bp, Homo sapien
atctcctccatcttgccatcatacc

SEQ ID NO: 30876 - DNA, 25 bp, Homo sapien
atctcctccattttgccatcatacc

SEQ ID NO: 30877 - DNA, 25 bp, Homo sapien
atctcctcttccttttcttataagg

SEQ ID NO: 30878 - DNA, 25 bp, Homo sapien
atctcctcttctttttcttataagg

SEQ ID NO: 30879 - DNA, 25 bp, Homo sapien
atctccttcaacgagcttgttgtcc

SEQ ID NO: 30880 - DNA, 25 bp, Homo sapien
atctccttcaatgagcttgttgtcc

SEQ ID NO: 30881 - DNA, 25 bp, Homo sapien
atctcctttctctcggatcaattac

SEQ ID NO: 30882 - DNA, 25 bp, Homo sapien
atctcctttctcttggatcaattac

SEQ ID NO: 30883 - DNA, 25 bp, Homo sapien
atctcggctgagataaaacaaggcc

SEQ ID NO: 30884 - DNA, 25 bp, Homo sapien
atctcggctgaggtaaaacaaggcc

SEQ ID NO: 30885 - DNA, 25 bp, Homo sapien
atctctaaactaccactggcaagag

SEQ ID NO: 30886 - DNA, 25 bp, Homo sapien
atctctaaactatcactggcaagag

SEQ ID NO: 30887 - DNA, 25 bp, Homo sapien
atctctaagttccaaataagtgaat

SEQ ID NO: 30888 - DNA, 25 bp, Homo sapien
atctctaagttctaaataagtgaat

SEQ ID NO: 30889 - DNA, 25 bp, Homo sapien
atctctaatttgggaaatgatcaat

SEQ ID NO: 30890 - DNA, 25 bp, Homo sapien
atctctaattttggaaatgatcaat

SEQ ID NO: 30891 - DNA, 25 bp, Homo sapien
atctctaccactattttggagtaaa

SEQ ID NO: 30892 - DNA, 25 bp, Homo sapien
atctctactactattttggagtaaa

SEQ ID NO: 30893 - DNA, 25 bp, Homo sapien
atctctattccttcaagaaaaaatt

SEQ ID NO: 30894 - DNA, 25 bp, Homo sapien
atctctattccttccagaaaaaatt

SEQ ID NO: 30895 - DNA, 25 bp, Homo sapien
atctctcctcaccgcaagcttcacc

SEQ ID NO: 30896 - DNA, 25 bp, Homo sapien
atctctcctcaccgcaggcttcacc

SEQ ID NO: 30897 - DNA, 25 bp, Homo sapien
atctctctatccatcactatatcaa

SEQ ID NO: 30898 - DNA, 25 bp, Homo sapien
atctctctctccatcactatatcaa

SEQ ID NO: 30899 - DNA, 25 bp, Homo sapien
atctctctgcggctaaagtagaaac

SEQ ID NO: 30900 - DNA, 25 bp, Homo sapien
atctctctgtggctaaagtagaaac

SEQ ID NO: 30901 - DNA, 25 bp, Homo sapien
atctctgaccccatagcatccttct

SEQ ID NO: 30902 - DNA, 25 bp, Homo sapien
atctctgaccccgtagcatccttct

SEQ ID NO: 30903 - DNA, 25 bp, Homo sapien
atctctgactctcactgatatttat

SEQ ID NO: 30904 - DNA, 25 bp, Homo sapien
atctctgactctcgctgatatttat

SEQ ID NO: 30905 - DNA, 25 bp, Homo sapien
atctctgcaaatacctagtactgtt

SEQ ID NO: 30906 - DNA, 25 bp, Homo sapien
atctctgcaaatagctagtactgtt

SEQ ID NO: 30907 - DNA, 25 bp, Homo sapien
atctctgcaacaaaatgccaggtgt

SEQ ID NO: 30908 - DNA, 25 bp, Homo sapien
atctctgcaacagaatgccaggtgt

SEQ ID NO: 30909 - DNA, 25 bp, Homo sapien
atctctgcagagtcagttaaacaca

SEQ ID NO: 30910 - DNA, 25 bp, Homo sapien
atctctgccctcgtcgatcttacat

SEQ ID NO: 30911 - DNA, 25 bp, Homo sapien
atctctgccgagtcagttaaacaca

SEQ ID NO: 30912 - DNA, 25 bp, Homo sapien
atctctgccttcgtcgatcttacat

SEQ ID NO: 30913 - DNA, 25 bp, Homo sapien
atctctgcttaaataaccaagatgt

SEQ ID NO: 30914 - DNA, 25 bp, Homo sapien
atctctgcttaagtaaccaagatgt

SEQ ID NO: 30915 - DNA, 25 bp, Homo sapien
atctctgcttcctccctagcagttg

SEQ ID NO: 30916 - DNA, 25 bp, Homo sapien
atctctgcttcttccctagcagttg

SEQ ID NO: 30917 - DNA, 25 bp, Homo sapien
atctctgctttactgtgaaaatgta

SEQ ID NO: 30918 - DNA, 25 bp, Homo sapien
atctctgctttattgtgaaaatgta

SEQ ID NO: 30919 - DNA, 25 bp, Homo sapien
atctctggatctttatccaccttct

SEQ ID NO: 30920 - DNA, 25 bp, Homo sapien
atctctggatctttattcaccttct

SEQ ID NO: 30921 - DNA, 25 bp, Homo sapien
atctctggctctctcaattttgaat

SEQ ID NO: 30922 - DNA, 25 bp, Homo sapien
atctctggctctcttaattttgaat

SEQ ID NO: 30923 - DNA, 25 bp, Homo sapien
atctctggtatatggtaggtagtgt

SEQ ID NO: 30924 - DNA, 25 bp, Homo sapien
atctctggtatattgtaggtagtgt

SEQ ID NO: 30925 - DNA, 25 bp, Homo sapien
atctctgtagatttagaattaaatg

SEQ ID NO: 30926 - DNA, 25 bp, Homo sapien
atctctgtagattttgaattaaatg

SEQ ID NO: 30927 - DNA, 25 bp, Homo sapien
atctcttaagcgcataggaatctct

SEQ ID NO: 30928 - DNA, 25 bp, Homo sapien
atctcttaagcgcgtaggaatctct

SEQ ID NO: 30929 - DNA, 25 bp, Homo sapien
atctcttcgcttcctgtaaatagat

SEQ ID NO: 30930 - DNA, 25 bp, Homo sapien
atctcttcgctttctgtaaatagat

SEQ ID NO: 30931 - DNA, 25 bp, Homo sapien
atctcttgcgagtacgatttcaatt

SEQ ID NO: 30932 - DNA, 25 bp, Homo sapien
atctcttgggagtacgatttcaatt

SEQ ID NO: 30933 - DNA, 25 bp, Homo sapien
atctctttgtacatcaccttcagaa

SEQ ID NO: 30934 - DNA, 25 bp, Homo sapien
atctctttgtacgtcaccttcagaa

SEQ ID NO: 30935 - DNA, 25 bp, Homo sapien
atctcttttcgcatctctgccctac

SEQ ID NO: 30936 - DNA, 25 bp, Homo sapien
atctcttttgagctagtttttatat

SEQ ID NO: 30937 - DNA, 25 bp, Homo sapien
atctcttttgagcttgtttttatat

SEQ ID NO: 30938 - DNA, 25 bp, Homo sapien
atctctttttactgaggtatactgt

SEQ ID NO: 30939 - DNA, 25 bp, Homo sapien
atctctttttagtgaggtatactgt

SEQ ID NO: 30940 - DNA, 25 bp, Homo sapien
atctctttttgcatctctgccctac

SEQ ID NO: 30941 - DNA, 25 bp, Homo sapien
atctgaaactagagttcgtatgtaa

SEQ ID NO: 30942 - DNA, 25 bp, Homo sapien
atctgaaattagagttcgtatgtaa

SEQ ID NO: 30943 - DNA, 25 bp, Homo sapien
atctgaacccaacaggatcagttac

SEQ ID NO: 30944 - DNA, 25 bp, Homo sapien
atctgaactaaacaggatgtgtaag

SEQ ID NO: 30945 - DNA, 25 bp, Homo sapien
atctgaactaaacagggtgtgtaag

SEQ ID NO: 30946 - DNA, 25 bp, Homo sapien
atctgaactcaacaggatcagttac

SEQ ID NO: 30947 - DNA, 25 bp, Homo sapien
atctgaacttacgactacatgggtt

SEQ ID NO: 30948 - DNA, 25 bp, Homo sapien
atctgaacttatgactacatgggtt

SEQ ID NO: 30949 - DNA, 25 bp, Homo sapien
atctgaagagaacactggaaaagag

SEQ ID NO: 30950 - DNA, 25 bp, Homo sapien
atctgaagagaacattggaaaagag

SEQ ID NO: 30951 - DNA, 25 bp, Homo sapien
atctgaagcaacgacagcaaagacc

SEQ ID NO: 30952 - DNA, 25 bp, Homo sapien
atctgaagcaatgacagcaaagacc

SEQ ID NO: 30953 - DNA, 25 bp, Homo sapien
atctgaatccagattctgaaacttt

SEQ ID NO: 30954 - DNA, 25 bp, Homo sapien
atctgaatccatattctgaaacttt

SEQ ID NO: 30955 - DNA, 25 bp, Homo sapien
atctgaatccatgcagaaaaaaata

SEQ ID NO: 30956 - DNA, 25 bp, Homo sapien
atctgaatctatgcagaaaaaaata

SEQ ID NO: 30957 - DNA, 25 bp, Homo sapien
atctgaatgaactacggtgatggcc

SEQ ID NO: 30958 - DNA, 25 bp, Homo sapien
atctgaatgaactagggtgatggcc

SEQ ID NO: 30959 - DNA, 25 bp, Homo sapien
atctgacaattggcctaacaggaag

SEQ ID NO: 30960 - DNA, 25 bp, Homo sapien
atctgacagttggcctaacaggaag

SEQ ID NO: 30961 - DNA, 25 bp, Homo sapien
atctgacatggcatttgcacatttg

SEQ ID NO: 30962 - DNA, 25 bp, Homo sapien
atctgacatggcgtttgcacatttg

SEQ ID NO: 30963 - DNA, 25 bp, Homo sapien
atctgactactaatgcagctaaatg

SEQ ID NO: 30964 - DNA, 25 bp, Homo sapien
atctgactactgatgcagctaaatg

SEQ ID NO: 30965 - DNA, 25 bp, Homo sapien
atctgactgttacggagaaaagatt

SEQ ID NO: 30966 - DNA, 25 bp, Homo sapien
atctgactgttatggagaaaagatt

SEQ ID NO: 30967 - DNA, 25 bp, Homo sapien
atctgacttacctaggtgattttat

SEQ ID NO: 30968 - DNA, 25 bp, Homo sapien
atctgacttacttaggtgattttat

SEQ ID NO: 30969 - DNA, 25 bp, Homo sapien
atctgagaacctagaggaagatgct

SEQ ID NO: 30970 - DNA, 25 bp, Homo sapien
atctgagaacctggaggaagatgct

SEQ ID NO: 30971 - DNA, 25 bp, Homo sapien
atctgagatttccttctgcgcctca

SEQ ID NO: 30972 - DNA, 25 bp, Homo sapien
atctgagatttctttctgcgcctca

SEQ ID NO: 30973 - DNA, 25 bp, Homo sapien
atctgatactaatatagccattcct

SEQ ID NO: 30974 - DNA, 25 bp, Homo sapien
atctgatactagtatagccattcct

SEQ ID NO: 30975 - DNA, 25 bp, Homo sapien
atctgatatttcagttgcaggctat

SEQ ID NO: 30976 - DNA, 25 bp, Homo sapien
atctgatatttcggttgcaggctat

SEQ ID NO: 30977 - DNA, 25 bp, Homo sapien
atctgatgaataattcctaaaatac

SEQ ID NO: 30978 - DNA, 25 bp, Homo sapien
atctgatgaataattcttaaaatac

SEQ ID NO: 30979 - DNA, 25 bp, Homo sapien
atctgcaacaagaaacattgtccat

SEQ ID NO: 30980 - DNA, 25 bp, Homo sapien
atctgcaacaagaatcattgtccat

SEQ ID NO: 30981 - DNA, 25 bp, Homo sapien
atctgcaacatttcatttaatattt

SEQ ID NO: 30982 - DNA, 25 bp, Homo sapien
atctgcaacttttcatttaatattt

SEQ ID NO: 30983 - DNA, 25 bp, Homo sapien
atctgcaggagaactggtgcccttc

SEQ ID NO: 30984 - DNA, 25 bp, Homo sapien
atctgcaggagagctggtgcccttc

SEQ ID NO: 30985 - DNA, 25 bp, Homo sapien
atctgcaggcagccctagaattaac

SEQ ID NO: 30986 - DNA, 25 bp, Homo sapien
atctgcaggcagccctggaattaac

SEQ ID NO: 30987 - DNA, 25 bp, Homo sapien
atctgcatgcctctatattgttaat

SEQ ID NO: 30988 - DNA, 25 bp, Homo sapien
atctgcatgtctctatattgttaat

SEQ ID NO: 30989 - DNA, 25 bp, Homo sapien
atctgcatttcactttaatgaatct

SEQ ID NO: 30990 - DNA, 25 bp, Homo sapien
atctgcatttcagtttaatgaatct

SEQ ID NO: 30991 - DNA, 25 bp, Homo sapien
atctgccacataattaaaagtaggt

SEQ ID NO: 30992 - DNA, 25 bp, Homo sapien
atctgccacgtaattaaaagtaggt

SEQ ID NO: 30993 - DNA, 25 bp, Homo sapien
atctgccaggtgcttcaccaagtga

SEQ ID NO: 30994 - DNA, 25 bp, Homo sapien
atctgccaggtgcttcgccaagtga

SEQ ID NO: 30995 - DNA, 25 bp, Homo sapien
atctgccatttgcttccccgtatat

SEQ ID NO: 30996 - DNA, 25 bp, Homo sapien
atctgccatttgtttccccgtatat

SEQ ID NO: 30997 - DNA, 25 bp, Homo sapien
atctgcccagttgctcagccagaag

SEQ ID NO: 30998 - DNA, 25 bp, Homo sapien
atctgcccagttgttcagccagaag

SEQ ID NO: 30999 - DNA, 25 bp, Homo sapien
atctgcctactgctcaaactcagcg

SEQ ID NO: 31000 - DNA, 25 bp, Homo sapien
atctgcctactgttcaaactcagcg

SEQ ID NO: 31001 - DNA, 25 bp, Homo sapien
atctgcgagcgtctaactgtgccct

SEQ ID NO: 31002 - DNA, 25 bp, Homo sapien
atctgcgagtgtctaactgtgccct

SEQ ID NO: 31003 - DNA, 25 bp, Homo sapien
atctgctagcagggatcagtgaggg

SEQ ID NO: 31004 - DNA, 25 bp, Homo sapien
atctgctagcagggctcagtgaggg

SEQ ID NO: 31005 - DNA, 25 bp, Homo sapien
atctgctccacacaatttctcagtg

SEQ ID NO: 31006 - DNA, 25 bp, Homo sapien
atctgctccacgcaatttctcagtg

SEQ ID NO: 31007 - DNA, 25 bp, Homo sapien
atctgctgaacacacattttaatac

SEQ ID NO: 31008 - DNA, 25 bp, Homo sapien
atctgctgaacatacattttaatac

SEQ ID NO: 31009 - DNA, 25 bp, Homo sapien
atctgctggcgggattaaagtatta

SEQ ID NO: 31010 - DNA, 25 bp, Homo sapien
atctgctggtgggattaaagtatta

SEQ ID NO: 31011 - DNA, 25 bp, Homo sapien
atctgctggtgtttttgggttagtt

SEQ ID NO: 31012 - DNA, 25 bp, Homo sapien
atctgctggtgttttttggttagtt

SEQ ID NO: 31013 - DNA, 25 bp, Homo sapien
atctggaaaccctttacagaagagc

SEQ ID NO: 31014 - DNA, 25 bp, Homo sapien
atctggaaaccctttagagaagagc

SEQ ID NO: 31015 - DNA, 25 bp, Homo sapien
atctggacaactacccttttcagga

SEQ ID NO: 31016 - DNA, 25 bp, Homo sapien
atctggacaactatccttttcagga

SEQ ID NO: 31017 - DNA, 25 bp, Homo sapien
atctggagtcaggattcttctttag

SEQ ID NO: 31018 - DNA, 25 bp, Homo sapien
atctggagtcagggttcttctttag

SEQ ID NO: 31019 - DNA, 25 bp, Homo sapien
atctggataatttagaacttctcag

SEQ ID NO: 31020 - DNA, 25 bp, Homo sapien
atctggatagtttagaacttctcag

SEQ ID NO: 31021 - DNA, 25 bp, Homo sapien
atctggcacactgcagtaccctgta

SEQ ID NO: 31022 - DNA, 25 bp, Homo sapien
atctggcacactgcggtaccctgta

SEQ ID NO: 31023 - DNA, 25 bp, Homo sapien
atctggcataataaactatttgggc

SEQ ID NO: 31024 - DNA, 25 bp, Homo sapien
atctggcataataagctatttgggc

SEQ ID NO: 31025 - DNA, 25 bp, Homo sapien
atctggcatttcgcccattattccc

SEQ ID NO: 31026 - DNA, 25 bp, Homo sapien
atctggcatttctcccattattccc

SEQ ID NO: 31027 - DNA, 25 bp, Homo sapien
atctggccacgccaaattggaacct

SEQ ID NO: 31028 - DNA, 25 bp, Homo sapien
atctggccatgccaaattggaacct

SEQ ID NO: 31029 - DNA, 25 bp, Homo sapien
atctggctcaaaaaccactgcacca

SEQ ID NO: 31030 - DNA, 25 bp, Homo sapien
atctggctcaaaagccactgcacca

SEQ ID NO: 31031 - DNA, 25 bp, Homo sapien
atctggctgacttctcttcaagctt

SEQ ID NO: 31032 - DNA, 25 bp, Homo sapien
atctggctgccttctcttcaagctt

SEQ ID NO: 31033 - DNA, 25 bp, Homo sapien
atctgggaagtcaaatgcctctttg

SEQ ID NO: 31034 - DNA, 25 bp, Homo sapien
atctgggaagtcgaatgcctctttg

SEQ ID NO: 31035 - DNA, 25 bp, Homo sapien
atctggggttctttcgttctgaaac

SEQ ID NO: 31036 - DNA, 25 bp, Homo sapien
atctggggttctttggttctgaaac

SEQ ID NO: 31037 - DNA, 25 bp, Homo sapien
atctgggttgaagtttaatttctgc

SEQ ID NO: 31038 - DNA, 25 bp, Homo sapien
atctgggttgaggtttaatttctgc

SEQ ID NO: 31039 - DNA, 25 bp, Homo sapien
atctggtataaattttcttcaaaag

SEQ ID NO: 31040 - DNA, 25 bp, Homo sapien
atctggtataatttttcttcaaaag

SEQ ID NO: 31041 - DNA, 25 bp, Homo sapien
atctggtcctggaaatgtcagactc

SEQ ID NO: 31042 - DNA, 25 bp, Homo sapien
atctggtcctgggaatgtcagactc

SEQ ID NO: 31043 - DNA, 25 bp, Homo sapien
atctggtctagcaaaaaatcggata

SEQ ID NO: 31044 - DNA, 25 bp, Homo sapien
atctggtctagcacaaaatcggata

SEQ ID NO: 31045 - DNA, 25 bp, Homo sapien
atctgtacatttccttagggcattg

SEQ ID NO: 31046 - DNA, 25 bp, Homo sapien
atctgtacctgcattatactggaga

SEQ ID NO: 31047 - DNA, 25 bp, Homo sapien
atctgtacgtttccttagggcattg

SEQ ID NO: 31048 - DNA, 25 bp, Homo sapien
atctgtactatatctttatcactga

SEQ ID NO: 31049 - DNA, 25 bp, Homo sapien
atctgtactgtatctttatcactga

SEQ ID NO: 31050 - DNA, 25 bp, Homo sapien
atctgtacttgcattatactggaga

SEQ ID NO: 31051 - DNA, 25 bp, Homo sapien
atctgtatttgcttgaatggtgaag

SEQ ID NO: 31052 - DNA, 25 bp, Homo sapien
atctgtatttgtttgaatggtgaag

SEQ ID NO: 31053 - DNA, 25 bp, Homo sapien
atctgtcactactggccagaacaag

SEQ ID NO: 31054 - DNA, 25 bp, Homo sapien
atctgtcactattggccagaacaag

SEQ ID NO: 31055 - DNA, 25 bp, Homo sapien
atctgtcattgcccaacgtcacact

SEQ ID NO: 31056 - DNA, 25 bp, Homo sapien
atctgtcattgcccaatgtcacact

SEQ ID NO: 31057 - DNA, 25 bp, Homo sapien
atctgtccaaattgtaattagcagc

SEQ ID NO: 31058 - DNA, 25 bp, Homo sapien
atctgtccactttgtgcgccagaat

SEQ ID NO: 31059 - DNA, 25 bp, Homo sapien
atctgtccactttgtgtgccagaat

SEQ ID NO: 31060 - DNA, 25 bp, Homo sapien
atctgtccctatgcaatgagaaagc

SEQ ID NO: 31061 - DNA, 25 bp, Homo sapien
atctgtccctatgcgatgagaaagc

SEQ ID NO: 31062 - DNA, 25 bp, Homo sapien
atctgtccgaattgtaattagcagc

SEQ ID NO: 31063 - DNA, 25 bp, Homo sapien
atctgtctaaaagcattaggaactt

SEQ ID NO: 31064 - DNA, 25 bp, Homo sapien
atctgtctagtgaatgagctgagag

SEQ ID NO: 31065 - DNA, 25 bp, Homo sapien
atctgtctagtgaatgggctgagag

SEQ ID NO: 31066 - DNA, 25 bp, Homo sapien
atctgtctgaaagcattaggaactt

SEQ ID NO: 31067 - DNA, 25 bp, Homo sapien
atctgtgaccaaaccaggccatttc

SEQ ID NO: 31068 - DNA, 25 bp, Homo sapien
atctgtgactaaaccaggccatttc

SEQ ID NO: 31069 - DNA, 25 bp, Homo sapien
atctgtgcaaaacttctaggagtac

SEQ ID NO: 31070 - DNA, 25 bp, Homo sapien
atctgtgcaaagcttctaggagtac

SEQ ID NO: 31071 - DNA, 25 bp, Homo sapien
atctgtgccggcagtttttgttact

SEQ ID NO: 31072 - DNA, 25 bp, Homo sapien
atctgtgcctgcagtttttgttact

SEQ ID NO: 31073 - DNA, 25 bp, Homo sapien
atctgtgctgatcgttgtagtgtga

SEQ ID NO: 31074 - DNA, 25 bp, Homo sapien
atctgtgctgattgttgtagtgtga

SEQ ID NO: 31075 - DNA, 25 bp, Homo sapien
atctgtgcttctcataactactggg

SEQ ID NO: 31076 - DNA, 25 bp, Homo sapien
atctgtgcttctcctaactactggg

SEQ ID NO: 31077 - DNA, 25 bp, Homo sapien
atctgtggaagagaactgagaaaaa

SEQ ID NO: 31078 - DNA, 25 bp, Homo sapien
atctgtggaagggaactgagaaaaa

SEQ ID NO: 31079 - DNA, 25 bp, Homo sapien
atctgtggacctgttattttccatc

SEQ ID NO: 31080 - DNA, 25 bp, Homo sapien
atctgtggaccttttattttccatc

SEQ ID NO: 31081 - DNA, 25 bp, Homo sapien
atctgtggatcaatttgaacatact

SEQ ID NO: 31082 - DNA, 25 bp, Homo sapien
atctgtggatccatttgaacatact

SEQ ID NO: 31083 - DNA, 25 bp, Homo sapien
atctgtggtttaagcttttcactaa

SEQ ID NO: 31084 - DNA, 25 bp, Homo sapien
atctgtggtttacgcttttcactaa

SEQ ID NO: 31085 - DNA, 25 bp, Homo sapien
atctgtgtattgcactaaatggact

SEQ ID NO: 31086 - DNA, 25 bp, Homo sapien
atctgtgtattgtactaaatggact

SEQ ID NO: 31087 - DNA, 25 bp, Homo sapien
atctgtgttcctacatatagacgta

SEQ ID NO: 31088 - DNA, 25 bp, Homo sapien
atctgtgtttctacatatagacgta

SEQ ID NO: 31089 - DNA, 25 bp, Homo sapien
atctgttaatgtaaatgtattttgg

SEQ ID NO: 31090 - DNA, 25 bp, Homo sapien
atctgttaatgtgaatgtattttgg

SEQ ID NO: 31091 - DNA, 25 bp, Homo sapien
atctgttacgtgatgccatcctaga

SEQ ID NO: 31092 - DNA, 25 bp, Homo sapien
atctgttatgtgatgccatcctaga

SEQ ID NO: 31093 - DNA, 25 bp, Homo sapien
atctgttcatatatctgcttcccat

SEQ ID NO: 31094 - DNA, 25 bp, Homo sapien
atctgttcatatgtctgcttcccat

SEQ ID NO: 31095 - DNA, 25 bp, Homo sapien
atctgttcatcagcatattctgtaa

SEQ ID NO: 31096 - DNA, 25 bp, Homo sapien
atctgttcatcagcgtattctgtaa

SEQ ID NO: 31097 - DNA, 25 bp, Homo sapien
atctgttcatctctctatccatcac

SEQ ID NO: 31098 - DNA, 25 bp, Homo sapien
atctgttcatctctctctccatcac

SEQ ID NO: 31099 - DNA, 25 bp, Homo sapien
atctgttctaggatacaacaagaag

SEQ ID NO: 31100 - DNA, 25 bp, Homo sapien
atctgttctaggataccacaagaag

SEQ ID NO: 31101 - DNA, 25 bp, Homo sapien
atctgttctgtccctacagtgattt

SEQ ID NO: 31102 - DNA, 25 bp, Homo sapien
atctgttctgttcctacagtgattt

SEQ ID NO: 31103 - DNA, 25 bp, Homo sapien
atctgttgctatgacagaggtatta

SEQ ID NO: 31104 - DNA, 25 bp, Homo sapien
atctgttgctatgagagaggtatta

SEQ ID NO: 31105 - DNA, 25 bp, Homo sapien
atctgttgttaggaagaataaatac

SEQ ID NO: 31106 - DNA, 25 bp, Homo sapien
atctgttgttaggatgaataaatac

SEQ ID NO: 31107 - DNA, 25 bp, Homo sapien
atctgtttaggtgcaactttgcttt

SEQ ID NO: 31108 - DNA, 25 bp, Homo sapien
atctgtttaggttcaactttgcttt

SEQ ID NO: 31109 - DNA, 25 bp, Homo sapien
atctgtttcagaaaaccggcattct

SEQ ID NO: 31110 - DNA, 25 bp, Homo sapien
atctgtttcagaaaactggcattct

SEQ ID NO: 31111 - DNA, 25 bp, Homo sapien
atctgtttctactgctcctgttttt

SEQ ID NO: 31112 - DNA, 25 bp, Homo sapien
atctgtttctactgcttctgttttt

SEQ ID NO: 31113 - DNA, 25 bp, Homo sapien
atctgtttgacttgctgatgattcc

SEQ ID NO: 31114 - DNA, 25 bp, Homo sapien
atctgtttgacttgttgatgattcc

SEQ ID NO: 31115 - DNA, 25 bp, Homo sapien
atctgttttctgaaaaagtttgtgt

SEQ ID NO: 31116 - DNA, 25 bp, Homo sapien
atctgttttctgaaaaggtttgtgt

SEQ ID NO: 31117 - DNA, 25 bp, Homo sapien
atcttaaatacattgcctaagactt

SEQ ID NO: 31118 - DNA, 25 bp, Homo sapien
atcttaaatacattgcgtaagactt

SEQ ID NO: 31119 - DNA, 25 bp, Homo sapien
atcttaaccattcacagagaaagca

SEQ ID NO: 31120 - DNA, 25 bp, Homo sapien
atcttaaccattcgcagagaaagca

SEQ ID NO: 31121 - DNA, 25 bp, Homo sapien
atcttaacctcaattctgcttctta

SEQ ID NO: 31122 - DNA, 25 bp, Homo sapien
atcttaacctcagttctgcttctta

SEQ ID NO: 31123 - DNA, 25 bp, Homo sapien
atcttaactcactacagcttcaagt

SEQ ID NO: 31124 - DNA, 25 bp, Homo sapien
atcttaactcattacagcttcaagt

SEQ ID NO: 31125 - DNA, 25 bp, Homo sapien
atcttaaggcagcattttctccaga

SEQ ID NO: 31126 - DNA, 25 bp, Homo sapien
atcttaagtcagcattttctccaga

SEQ ID NO: 31127 - DNA, 25 bp, Homo sapien
atcttacaaaaacagaacctctgtt

SEQ ID NO: 31128 - DNA, 25 bp, Homo sapien
atcttacaacaacagaacctctgtt

SEQ ID NO: 31129 - DNA, 25 bp, Homo sapien
atcttacatcgcagaaaatgttaat

SEQ ID NO: 31130 - DNA, 25 bp, Homo sapien
atcttacatcgcagcaaatgttaat

SEQ ID NO: 31131 - DNA, 25 bp, Homo sapien
atcttaccagaagttatgtaccaaa

SEQ ID NO: 31132 - DNA, 25 bp, Homo sapien
atcttaccagaatttatgtaccaaa

SEQ ID NO: 31133 - DNA, 25 bp, Homo sapien
atcttacccgcacatggctaccagg

SEQ ID NO: 31134 - DNA, 25 bp, Homo sapien
atcttaccctggaagtctccatgtt

SEQ ID NO: 31135 - DNA, 25 bp, Homo sapien
atcttacctgcacatggctaccagg

SEQ ID NO: 31136 - DNA, 25 bp, Homo sapien
atcttaccttggaagtctccatgtt

SEQ ID NO: 31137 - DNA, 25 bp, Homo sapien
atcttacgcgtactcagtttgagag

SEQ ID NO: 31138 - DNA, 25 bp, Homo sapien
atcttacgtgtactcagtttgagag

SEQ ID NO: 31139 - DNA, 25 bp, Homo sapien
atcttagacaataggagactttttt

SEQ ID NO: 31140 - DNA, 25 bp, Homo sapien
atcttagacaataggatactttttt

SEQ ID NO: 31141 - DNA, 25 bp, Homo sapien
atcttagagtcccgatcagctagtt

SEQ ID NO: 31142 - DNA, 25 bp, Homo sapien
atcttagagtcccgattagctagtt

SEQ ID NO: 31143 - DNA, 25 bp, Homo sapien
atcttagcaaagacagaacaagggt

SEQ ID NO: 31144 - DNA, 25 bp, Homo sapien
atcttagcaaaggcagaacaagggt

SEQ ID NO: 31145 - DNA, 25 bp, Homo sapien
atcttagcactgagggtcctcttgt

SEQ ID NO: 31146 - DNA, 25 bp, Homo sapien
atcttagcactgggggtcctcttgt

SEQ ID NO: 31147 - DNA, 25 bp, Homo sapien
atcttagtccctttatgcttctata

SEQ ID NO: 31148 - DNA, 25 bp, Homo sapien
atcttagtccctttgtgcttctata

SEQ ID NO: 31149 - DNA, 25 bp, Homo sapien
atcttatacccactagctgtcactc

SEQ ID NO: 31150 - DNA, 25 bp, Homo sapien
atcttatactcactagctgtcactc

SEQ ID NO: 31151 - DNA, 25 bp, Homo sapien
atcttatcaccatgaacgtaatgaa

SEQ ID NO: 31152 - DNA, 25 bp, Homo sapien
atcttatcaccatgaatgtaatgaa

SEQ ID NO: 31153 - DNA, 25 bp, Homo sapien
atcttatccatgaccttttttgccc

SEQ ID NO: 31154 - DNA, 25 bp, Homo sapien
atcttatccgtgaccttttttgccc

SEQ ID NO: 31155 - DNA, 25 bp, Homo sapien
atcttatgttctgttccactgcggc

SEQ ID NO: 31156 - DNA, 25 bp, Homo sapien
atcttatgttctgttctactgcggc

SEQ ID NO: 31157 - DNA, 25 bp, Homo sapien
atcttattagtacattttccctgga

SEQ ID NO: 31158 - DNA, 25 bp, Homo sapien
atcttattagtacgttttccctgga

SEQ ID NO: 31159 - DNA, 25 bp, Homo sapien
atcttattcaattcctggccattca

SEQ ID NO: 31160 - DNA, 25 bp, Homo sapien
atcttatttaattcctggccattca

SEQ ID NO: 31161 - DNA, 25 bp, Homo sapien
atcttcaaaatgacaaggccatgtg

SEQ ID NO: 31162 - DNA, 25 bp, Homo sapien
atcttcaaagtgacaaggccatgtg

SEQ ID NO: 31163 - DNA, 25 bp, Homo sapien
atcttcagacacaaaagtgcaaaca

SEQ ID NO: 31164 - DNA, 25 bp, Homo sapien
atcttcagacacagaagtgcaaaca

SEQ ID NO: 31165 - DNA, 25 bp, Homo sapien
atcttcaggttagattgtcactgtg

SEQ ID NO: 31166 - DNA, 25 bp, Homo sapien
atcttcaggttaggttgtcactgtg

SEQ ID NO: 31167 - DNA, 25 bp, Homo sapien
atcttcagtccttatccacattttg

SEQ ID NO: 31168 - DNA, 25 bp, Homo sapien
atcttcagtccttgtccacattttg

SEQ ID NO: 31169 - DNA, 25 bp, Homo sapien
atcttcagttggctgggataaaaac

SEQ ID NO: 31170 - DNA, 25 bp, Homo sapien
atcttcagttggttgggataaaaac

SEQ ID NO: 31171 - DNA, 25 bp, Homo sapien
atcttcatagagataaaagttgtgg

SEQ ID NO: 31172 - DNA, 25 bp, Homo sapien
atcttcatcactctgacgttggtgc

SEQ ID NO: 31173 - DNA, 25 bp, Homo sapien
atcttcatcactctgatgttggtgc

SEQ ID NO: 31174 - DNA, 25 bp, Homo sapien
atcttcatggagataaaagttgtgg

SEQ ID NO: 31175 - DNA, 25 bp, Homo sapien
atcttcattttagccacatgagacc

SEQ ID NO: 31176 - DNA, 25 bp, Homo sapien
atcttcattttcgccacatgagacc

SEQ ID NO: 31177 - DNA, 25 bp, Homo sapien
atcttccaacaaatagattaggagg

SEQ ID NO: 31178 - DNA, 25 bp, Homo sapien
atcttccaacaagtagattaggagg

SEQ ID NO: 31179 - DNA, 25 bp, Homo sapien
atcttccaactgacctactgatttc

SEQ ID NO: 31180 - DNA, 25 bp, Homo sapien
atcttccaactgacctcctgatttc

SEQ ID NO: 31181 - DNA, 25 bp, Homo sapien
atcttccaagacagttacagattaa

SEQ ID NO: 31182 - DNA, 25 bp, Homo sapien
atcttccaagaccgttacagattaa

SEQ ID NO: 31183 - DNA, 25 bp, Homo sapien
atcttccacatgatagttatggctt

SEQ ID NO: 31184 - DNA, 25 bp, Homo sapien
atcttccacgtgatagttatggctt

SEQ ID NO: 31185 - DNA, 25 bp, Homo sapien
atcttccagcctttctattgaagtt

SEQ ID NO: 31186 - DNA, 25 bp, Homo sapien
atcttccagcctttttattgaagtt

SEQ ID NO: 31187 - DNA, 25 bp, Homo sapien
atcttcccacgatcagcttcaagaa

SEQ ID NO: 31188 - DNA, 25 bp, Homo sapien
atcttcccacgatcagtttcaagaa

SEQ ID NO: 31189 - DNA, 25 bp, Homo sapien
atcttccttctgtgttactgattgg

SEQ ID NO: 31190 - DNA, 25 bp, Homo sapien
atcttccttctgtgttcctgattgg

SEQ ID NO: 31191 - DNA, 25 bp, Homo sapien
atcttcgtgtttcagcttactaacc

SEQ ID NO: 31192 - DNA, 25 bp, Homo sapien
atcttcgtttttcagcttactaacc

SEQ ID NO: 31193 - DNA, 25 bp, Homo sapien
atcttctaaataatccacccaatgc

SEQ ID NO: 31194 - DNA, 25 bp, Homo sapien
atcttctaaatactccacccaatgc

SEQ ID NO: 31195 - DNA, 25 bp, Homo sapien
atcttctaaatatcacttttactgc

SEQ ID NO: 31196 - DNA, 25 bp, Homo sapien
atcttctaaatatcgcttttactgc

SEQ ID NO: 31197 - DNA, 25 bp, Homo sapien
atcttctcaatttcaagccacctgc

SEQ ID NO: 31198 - DNA, 25 bp, Homo sapien
atcttctcaatttccagccacctgc

SEQ ID NO: 31199 - DNA, 25 bp, Homo sapien
atcttctcatctgtccaaattgtaa

SEQ ID NO: 31200 - DNA, 25 bp, Homo sapien
atcttctcatctgtccgaattgtaa

SEQ ID NO: 31201 - DNA, 25 bp, Homo sapien
atcttctcctgcctaaacaacagcc

SEQ ID NO: 31202 - DNA, 25 bp, Homo sapien
atcttctcctgtctaaacaacagcc

SEQ ID NO: 31203 - DNA, 25 bp, Homo sapien
atcttctctgacaacaaggaaataa

SEQ ID NO: 31204 - DNA, 25 bp, Homo sapien
atcttctctgactacaaggaaataa

SEQ ID NO: 31205 - DNA, 25 bp, Homo sapien
atcttctgaacttcgacttcgcact

SEQ ID NO: 31206 - DNA, 25 bp, Homo sapien
atcttctgaactttgacttcgcact

SEQ ID NO: 31207 - DNA, 25 bp, Homo sapien
atcttcttccaatagacggctgtgt

SEQ ID NO: 31208 - DNA, 25 bp, Homo sapien
atcttcttccaatagagggctgtgt

SEQ ID NO: 31209 - DNA, 25 bp, Homo sapien
atcttcttggtccataagttttaac

SEQ ID NO: 31210 - DNA, 25 bp, Homo sapien
atcttcttggtccatatgttttaac

SEQ ID NO: 31211 - DNA, 25 bp, Homo sapien
atcttctttattcactacaggttgt

SEQ ID NO: 31212 - DNA, 25 bp, Homo sapien
atcttctttattcactgcaggttgt

SEQ ID NO: 31213 - DNA, 25 bp, Homo sapien
atcttgaaagtaacaaacttgctta

SEQ ID NO: 31214 - DNA, 25 bp, Homo sapien
atcttgaaagtagcaaacttgctta

SEQ ID NO: 31215 - DNA, 25 bp, Homo sapien
atcttgaggcctaattactttcaat

SEQ ID NO: 31216 - DNA, 25 bp, Homo sapien
atcttgaggcctgattactttcaat

SEQ ID NO: 31217 - DNA, 25 bp, Homo sapien
atcttgatttgtacaaactgctata

SEQ ID NO: 31218 - DNA, 25 bp, Homo sapien
atcttgatttgtgcaaactgctata

SEQ ID NO: 31219 - DNA, 25 bp, Homo sapien
atcttgcactgtgacattgagtaac

SEQ ID NO: 31220 - DNA, 25 bp, Homo sapien
atcttgcactgtgatattgagtaac

SEQ ID NO: 31221 - DNA, 25 bp, Homo sapien
atcttgctgagttctagtcgcagat

SEQ ID NO: 31222 - DNA, 25 bp, Homo sapien
atcttgcttagttctagtcgcagat

SEQ ID NO: 31223 - DNA, 25 bp, Homo sapien
atcttgcttcaccttccgagaaatg

SEQ ID NO: 31224 - DNA, 25 bp, Homo sapien
atcttgcttcaccttctgagaaatg

SEQ ID NO: 31225 - DNA, 25 bp, Homo sapien
atcttgcttcttaagtgtatttata

SEQ ID NO: 31226 - DNA, 25 bp, Homo sapien
atcttgcttcttaggtgtatttata

SEQ ID NO: 31227 - DNA, 25 bp, Homo sapien
atcttggagtgctatgtcttgttcc

SEQ ID NO: 31228 - DNA, 25 bp, Homo sapien
atcttggagtgttatgtcttgttcc

SEQ ID NO: 31229 - DNA, 25 bp, Homo sapien
atcttggccatattctgagccacct

SEQ ID NO: 31230 - DNA, 25 bp, Homo sapien
atcttggccgtattctgagccacct

SEQ ID NO: 31231 - DNA, 25 bp, Homo sapien
atcttggggcaggacgttctccttc

SEQ ID NO: 31232 - DNA, 25 bp, Homo sapien
atcttggggcaggatgttctccttc

SEQ ID NO: 31233 - DNA, 25 bp, Homo sapien
atcttggtattgttcatcaatttta

SEQ ID NO: 31234 - DNA, 25 bp, Homo sapien
atcttggtatttttcatcaatttta

SEQ ID NO: 31235 - DNA, 25 bp, Homo sapien
atcttgtaaattgagacagctctat

SEQ ID NO: 31236 - DNA, 25 bp, Homo sapien
atcttgtaagttgagacagctctat

SEQ ID NO: 31237 - DNA, 25 bp, Homo sapien
atcttgtcctgactaatggctggat

SEQ ID NO: 31238 - DNA, 25 bp, Homo sapien
atcttgtcttgactaatggctggat

SEQ ID NO: 31239 - DNA, 25 bp, Homo sapien
atcttgtggagaccattttaaccat

SEQ ID NO: 31240 - DNA, 25 bp, Homo sapien
atcttgtggagatcattttaaccat

SEQ ID NO: 31241 - DNA, 25 bp, Homo sapien
atcttgttcattcttctgcttcagg

SEQ ID NO: 31242 - DNA, 25 bp, Homo sapien
atcttgttcgttcttctgcttcagg

SEQ ID NO: 31243 - DNA, 25 bp, Homo sapien
atctttaatatacggttagtgtgtg

SEQ ID NO: 31244 - DNA, 25 bp, Homo sapien
atctttaatatactgttagtgtgtg

SEQ ID NO: 31245 - DNA, 25 bp, Homo sapien
atctttacaagacctgagccataga

SEQ ID NO: 31246 - DNA, 25 bp, Homo sapien
atctttacaagagctgagccataga

SEQ ID NO: 31247 - DNA, 25 bp, Homo sapien
atctttacagaacttcagtatttcc

SEQ ID NO: 31248 - DNA, 25 bp, Homo sapien
atctttacagagcttcagtatttcc

SEQ ID NO: 31249 - DNA, 25 bp, Homo sapien
atctttagccttgaaaactgagtag

SEQ ID NO: 31250 - DNA, 25 bp, Homo sapien
atctttagctttgaaaactgagtag

SEQ ID NO: 31251 - DNA, 25 bp, Homo sapien
atctttagtagaagtgctgccactt

SEQ ID NO: 31252 - DNA, 25 bp, Homo sapien
atctttagtaggagtgctgccactt

SEQ ID NO: 31253 - DNA, 25 bp, Homo sapien
atctttatcccaagtcctctgactc

SEQ ID NO: 31254 - DNA, 25 bp, Homo sapien
atctttatcccaagtcttctgactc

SEQ ID NO: 31255 - DNA, 25 bp, Homo sapien
atctttatgccaatgtgtgcccaac

SEQ ID NO: 31256 - DNA, 25 bp, Homo sapien
atctttatgccagtgtgtgcccaac

SEQ ID NO: 31257 - DNA, 25 bp, Homo sapien
atctttcaaaaaagaaaaactggca

SEQ ID NO: 31258 - DNA, 25 bp, Homo sapien
atctttcaaaaaaggaaaactggca

SEQ ID NO: 31259 - DNA, 25 bp, Homo sapien
atctttcaaacagagaatcagaatc

SEQ ID NO: 31260 - DNA, 25 bp, Homo sapien
atctttcaaacagggaatcagaatc

SEQ ID NO: 31261 - DNA, 25 bp, Homo sapien
atctttcaaggtatcgttgggagtg

SEQ ID NO: 31262 - DNA, 25 bp, Homo sapien
atctttcagagttacaatactccta

SEQ ID NO: 31263 - DNA, 25 bp, Homo sapien
atctttcagagttccaatactccta

SEQ ID NO: 31264 - DNA, 25 bp, Homo sapien
atctttcatggtatcgttgggagtg

SEQ ID NO: 31265 - DNA, 25 bp, Homo sapien
atctttcctaaacacactctaccat

SEQ ID NO: 31266 - DNA, 25 bp, Homo sapien
atctttcctaaacacattctaccat

SEQ ID NO: 31267 - DNA, 25 bp, Homo sapien
atctttcgggtaaatgattcttctc

SEQ ID NO: 31268 - DNA, 25 bp, Homo sapien
atctttcgggtaagtgattcttctc

SEQ ID NO: 31269 - DNA, 25 bp, Homo sapien
atctttctgcctaacctgtattttg

SEQ ID NO: 31270 - DNA, 25 bp, Homo sapien
atctttctgggcactattatataca

SEQ ID NO: 31271 - DNA, 25 bp, Homo sapien
atctttctgggcgctattatataca

SEQ ID NO: 31272 - DNA, 25 bp, Homo sapien
atctttctgtctaacctgtattttg

SEQ ID NO: 31273 - DNA, 25 bp, Homo sapien
atctttctgtctacgctcccatctt

SEQ ID NO: 31274 - DNA, 25 bp, Homo sapien
atctttctgtctatgctcccatctt

SEQ ID NO: 31275 - DNA, 25 bp, Homo sapien
atctttctgtcttacgtttataccg

SEQ ID NO: 31276 - DNA, 25 bp, Homo sapien
atctttctgtcttatgtttataccg

SEQ ID NO: 31277 - DNA, 25 bp, Homo sapien
atctttcttgaagtagccatactat

SEQ ID NO: 31278 - DNA, 25 bp, Homo sapien
atctttcttgaagtagtcatactat

SEQ ID NO: 31279 - DNA, 25 bp, Homo sapien
atctttgaaaatgccctcagctgtg

SEQ ID NO: 31280 - DNA, 25 bp, Homo sapien
atctttgaaaatgtcctcagctgtg

SEQ ID NO: 31281 - DNA, 25 bp, Homo sapien
atctttgagaatagttaaaaaatta

SEQ ID NO: 31282 - DNA, 25 bp, Homo sapien
atctttgagaatagtttaaaaatta

SEQ ID NO: 31283 - DNA, 25 bp, Homo sapien
atctttgagatgatgtcactaggat

SEQ ID NO: 31284 - DNA, 25 bp, Homo sapien
atctttgagatggtgtcactaggat

SEQ ID NO: 31285 - DNA, 25 bp, Homo sapien
atctttgatttgtaaacttgtggta

SEQ ID NO: 31286 - DNA, 25 bp, Homo sapien
atctttgatttgtatacttgtggta

SEQ ID NO: 31287 - DNA, 25 bp, Homo sapien
atctttgcactcagggttgaaattt

SEQ ID NO: 31288 - DNA, 25 bp, Homo sapien
atctttgcatcaaattaacataatg

SEQ ID NO: 31289 - DNA, 25 bp, Homo sapien
atctttgcatcagattaacataatg

SEQ ID NO: 31290 - DNA, 25 bp, Homo sapien
atctttgccgtgatttgagtcacac

SEQ ID NO: 31291 - DNA, 25 bp, Homo sapien
atctttgcgctcagggttgaaattt

SEQ ID NO: 31292 - DNA, 25 bp, Homo sapien
atctttgctctaggcactgttcagt

SEQ ID NO: 31293 - DNA, 25 bp, Homo sapien
atctttgctgtgatttgagtcacac

SEQ ID NO: 31294 - DNA, 25 bp, Homo sapien
atctttgctttaggcactgttcagt

SEQ ID NO: 31295 - DNA, 25 bp, Homo sapien
atctttggtgcaaattattttattg

SEQ ID NO: 31296 - DNA, 25 bp, Homo sapien
atctttggtgcaagttattttattg

SEQ ID NO: 31297 - DNA, 25 bp, Homo sapien
atctttgtgggagaacagttactat

SEQ ID NO: 31298 - DNA, 25 bp, Homo sapien
atctttgtgggagaacggttactat

SEQ ID NO: 31299 - DNA, 25 bp, Homo sapien
atctttgtttggagaaatttacttg

SEQ ID NO: 31300 - DNA, 25 bp, Homo sapien
atctttgtttggagaattttacttg

SEQ ID NO: 31301 - DNA, 25 bp, Homo sapien
atcttttaacaaacataattccctc

SEQ ID NO: 31302 - DNA, 25 bp, Homo sapien
atcttttaacaaacatcattccctc

SEQ ID NO: 31303 - DNA, 25 bp, Homo sapien
atcttttaccagaactttgaatact

SEQ ID NO: 31304 - DNA, 25 bp, Homo sapien
atcttttaccagcactttgaatact

SEQ ID NO: 31305 - DNA, 25 bp, Homo sapien
atcttttacttgtggttaggcttac

SEQ ID NO: 31306 - DNA, 25 bp, Homo sapien
atcttttaggatcaattgacccttg

SEQ ID NO: 31307 - DNA, 25 bp, Homo sapien
atcttttaggatcagttgacccttg

SEQ ID NO: 31308 - DNA, 25 bp, Homo sapien
atcttttagtcaaatgtatcaaact

SEQ ID NO: 31309 - DNA, 25 bp, Homo sapien
atcttttagtcaagtgtatcaaact

SEQ ID NO: 31310 - DNA, 25 bp, Homo sapien
atcttttatccaacaaagtataaag

SEQ ID NO: 31311 - DNA, 25 bp, Homo sapien
atcttttatccatcaaagtataaag

SEQ ID NO: 31312 - DNA, 25 bp, Homo sapien
atcttttatggctgtacgctgaaat

SEQ ID NO: 31313 - DNA, 25 bp, Homo sapien
atcttttatggctgtatgctgaaat

SEQ ID NO: 31314 - DNA, 25 bp, Homo sapien
atcttttatttgtggttaggcttac

SEQ ID NO: 31315 - DNA, 25 bp, Homo sapien
atcttttgagagcatggtttagtga

SEQ ID NO: 31316 - DNA, 25 bp, Homo sapien
atcttttgcgagcatggtttagtga

SEQ ID NO: 31317 - DNA, 25 bp, Homo sapien
atcttttgctagagaatgaaatcaa

SEQ ID NO: 31318 - DNA, 25 bp, Homo sapien
atcttttgctatagaatgaaatcaa

SEQ ID NO: 31319 - DNA, 25 bp, Homo sapien
atcttttgctttaatagtaaggtga

SEQ ID NO: 31320 - DNA, 25 bp, Homo sapien
atcttttgctttagtagtaaggtga

SEQ ID NO: 31321 - DNA, 25 bp, Homo sapien
atctttttcccgttcaatctatctt

SEQ ID NO: 31322 - DNA, 25 bp, Homo sapien
atctttttcccgttgaatctatctt

SEQ ID NO: 31323 - DNA, 25 bp, Homo sapien
atctttttctacaaatatgatcata

SEQ ID NO: 31324 - DNA, 25 bp, Homo sapien
atctttttctataaatatgatcata

SEQ ID NO: 31325 - DNA, 25 bp, Homo sapien
atctttttgaatctactacacccac

SEQ ID NO: 31326 - DNA, 25 bp, Homo sapien
atctttttggatctactacacccac

SEQ ID NO: 31327 - DNA, 25 bp, Homo sapien
atctttttggccattacgttattgt

SEQ ID NO: 31328 - DNA, 25 bp, Homo sapien
atctttttggccattatgttattgt

SEQ ID NO: 31329 - DNA, 25 bp, Homo sapien
atcttttttcggacaaagggtaaag

SEQ ID NO: 31330 - DNA, 25 bp, Homo sapien
atctttttttggacaaagggtaaag

SEQ ID NO: 31331 - DNA, 25 bp, Homo sapien
atgaaaaccaacgctttgtctctga

SEQ ID NO: 31332 - DNA, 25 bp, Homo sapien
atgaaaaccaatgctttgtctctga

SEQ ID NO: 31333 - DNA, 25 bp, Homo sapien
atgaaaagttaagcgattattttta

SEQ ID NO: 31334 - DNA, 25 bp, Homo sapien
atgaaaagttaagtgattattttta

SEQ ID NO: 31335 - DNA, 25 bp, Homo sapien
atgaaaataagcaagttaccaaagc

SEQ ID NO: 31336 - DNA, 25 bp, Homo sapien
atgaaaataagcgagttaccaaagc

SEQ ID NO: 31337 - DNA, 25 bp, Homo sapien
atgaaaatcagtagaccatgttgga

SEQ ID NO: 31338 - DNA, 25 bp, Homo sapien
atgaaaatcggtagaccatgttgga

SEQ ID NO: 31339 - DNA, 25 bp, Homo sapien
atgaaaatctcagtaagaaaaaaga

SEQ ID NO: 31340 - DNA, 25 bp, Homo sapien
atgaaaatctcggtaagaaaaaaga

SEQ ID NO: 31341 - DNA, 25 bp, Homo sapien
atgaaaatgaatcaagccctttatt

SEQ ID NO: 31342 - DNA, 25 bp, Homo sapien
atgaaaatgaatcgagccctttatt

SEQ ID NO: 31343 - DNA, 25 bp, Homo sapien
atgaaaatgtgctgttatcagatgt

SEQ ID NO: 31344 - DNA, 25 bp, Homo sapien
atgaaaatgtgctgttttcagatgt

SEQ ID NO: 31345 - DNA, 25 bp, Homo sapien
atgaaacaataaaggcttgctaaca

SEQ ID NO: 31346 - DNA, 25 bp, Homo sapien
atgaaacaataaagtcttgctaaca

SEQ ID NO: 31347 - DNA, 25 bp, Homo sapien
atgaaacaccacagatgccagagcc

SEQ ID NO: 31348 - DNA, 25 bp, Homo sapien
atgaaacaccacagctgccagagcc

SEQ ID NO: 31349 - DNA, 25 bp, Homo sapien
atgaaaccaaaaggaattacagcca

SEQ ID NO: 31350 - DNA, 25 bp, Homo sapien
atgaaaccgaaaggaattacagcca

SEQ ID NO: 31351 - DNA, 25 bp, Homo sapien
atgaaacgaatcactctaactctta

SEQ ID NO: 31352 - DNA, 25 bp, Homo sapien
atgaaacgagtcactctaactctta

SEQ ID NO: 31353 - DNA, 25 bp, Homo sapien
atgaaactgatacaatcatgtcaaa

SEQ ID NO: 31354 - DNA, 25 bp, Homo sapien
atgaaactgatacgatcatgtcaaa

SEQ ID NO: 31355 - DNA, 25 bp, Homo sapien
atgaaagacaaaagtacctctgatt

SEQ ID NO: 31356 - DNA, 25 bp, Homo sapien
atgaaagaccccattcaatatccgg

SEQ ID NO: 31357 - DNA, 25 bp, Homo sapien
atgaaagaccccgttcaatatccgg

SEQ ID NO: 31358 - DNA, 25 bp, Homo sapien
atgaaagacgaaagtacctctgatt

SEQ ID NO: 31359 - DNA, 25 bp, Homo sapien
atgaaagacgcttaataatggtctt

SEQ ID NO: 31360 - DNA, 25 bp, Homo sapien
atgaaagactccaacaaggcaggaa

SEQ ID NO: 31361 - DNA, 25 bp, Homo sapien
atgaaagagcaactagttatgggaa

SEQ ID NO: 31362 - DNA, 25 bp, Homo sapien
atgaaagagcaattagttatgggaa

SEQ ID NO: 31363 - DNA, 25 bp, Homo sapien
atgaaagaggtacgtcaaagataga

SEQ ID NO: 31364 - DNA, 25 bp, Homo sapien
atgaaagaggtatgtcaaagataga

SEQ ID NO: 31365 - DNA, 25 bp, Homo sapien
atgaaagatgcttaataatggtctt

SEQ ID NO: 31366 - DNA, 25 bp, Homo sapien
atgaaagattccaacaaggcaggaa

SEQ ID NO: 31367 - DNA, 25 bp, Homo sapien
atgaaagctatttctgaacatgagg

SEQ ID NO: 31368 - DNA, 25 bp, Homo sapien
atgaaagctatttttgaacatgagg

SEQ ID NO: 31369 - DNA, 25 bp, Homo sapien
atgaaaggccagagttggtccttga

SEQ ID NO: 31370 - DNA, 25 bp, Homo sapien
atgaaaggtcagagttggtccttga

SEQ ID NO: 31371 - DNA, 25 bp, Homo sapien
atgaaagtcctttgagaaaaacatt

SEQ ID NO: 31372 - DNA, 25 bp, Homo sapien
atgaaagtcctttgggaaaaacatt

SEQ ID NO: 31373 - DNA, 25 bp, Homo sapien
atgaaagtgtctacctaagataggc

SEQ ID NO: 31374 - DNA, 25 bp, Homo sapien
atgaaagtgtctgcctaagataggc

SEQ ID NO: 31375 - DNA, 25 bp, Homo sapien
atgaaagttgcctaaaaaccacaca

SEQ ID NO: 31376 - DNA, 25 bp, Homo sapien
atgaaagttgtaaatttgaagaagg

SEQ ID NO: 31377 - DNA, 25 bp, Homo sapien
atgaaagttgtacatttgaagaagg

SEQ ID NO: 31378 - DNA, 25 bp, Homo sapien
atgaaagtttcctaaaaaccacaca

SEQ ID NO: 31379 - DNA, 25 bp, Homo sapien
atgaaatcacataaaccttagcacc

SEQ ID NO: 31380 - DNA, 25 bp, Homo sapien
atgaaatcacatcaaccttagcacc

SEQ ID NO: 31381 - DNA, 25 bp, Homo sapien
atgaaatccataaaggtcagagccc

SEQ ID NO: 31382 - DNA, 25 bp, Homo sapien
atgaaatccataagcctccatatat

SEQ ID NO: 31383 - DNA, 25 bp, Homo sapien
atgaaatccatgaaggtcagagccc

SEQ ID NO: 31384 - DNA, 25 bp, Homo sapien
atgaaatccgtaagcctccatatat

SEQ ID NO: 31385 - DNA, 25 bp, Homo sapien
atgaaatctccaaattttatctgtc

SEQ ID NO: 31386 - DNA, 25 bp, Homo sapien
atgaaatctccgaattttatctgtc

SEQ ID NO: 31387 - DNA, 25 bp, Homo sapien
atgaaatcttacgcgtactcagttt

SEQ ID NO: 31388 - DNA, 25 bp, Homo sapien
atgaaatcttacgtgtactcagttt

SEQ ID NO: 31389 - DNA, 25 bp, Homo sapien
atgaaatgccaaatatgctggagtc

SEQ ID NO: 31390 - DNA, 25 bp, Homo sapien
atgaaatgccaaatctgctggagtc

SEQ ID NO: 31391 - DNA, 25 bp, Homo sapien
atgaaatgctctttcagaggcacgg

SEQ ID NO: 31392 - DNA, 25 bp, Homo sapien
atgaaatggtctttcagaggcacgg

SEQ ID NO: 31393 - DNA, 25 bp, Homo sapien
atgaaatgtctgtatcaaccaagac

SEQ ID NO: 31394 - DNA, 25 bp, Homo sapien
atgaaatgtctgtatccaccaagac

SEQ ID NO: 31395 - DNA, 25 bp, Homo sapien
atgaaattcagaagatgtaagacaa

SEQ ID NO: 31396 - DNA, 25 bp, Homo sapien
atgaaattcagtcaaggcagctggc

SEQ ID NO: 31397 - DNA, 25 bp, Homo sapien
atgaaattcggaagatgtaagacaa

SEQ ID NO: 31398 - DNA, 25 bp, Homo sapien
atgaaattgagtcaaggcagctggc

SEQ ID NO: 31399 - DNA, 25 bp, Homo sapien
atgaaatttttaggcttattacttt

SEQ ID NO: 31400 - DNA, 25 bp, Homo sapien
atgaaatttttaggtttattacttt

SEQ ID NO: 31401 - DNA, 25 bp, Homo sapien
atgaacaaaaaacgtatctcattaa

SEQ ID NO: 31402 - DNA, 25 bp, Homo sapien
atgaacaaaaaatgtatctcattaa

SEQ ID NO: 31403 - DNA, 25 bp, Homo sapien
atgaacacgatatttttgtaacctc

SEQ ID NO: 31404 - DNA, 25 bp, Homo sapien
atgaacactatatttttgtaacctc

SEQ ID NO: 31405 - DNA, 25 bp, Homo sapien
atgaacagctatatactcacaaacc

SEQ ID NO: 31406 - DNA, 25 bp, Homo sapien
atgaacagctatttactcacaaacc

SEQ ID NO: 31407 - DNA, 25 bp, Homo sapien
atgaacagcttaacaaagatcagta

SEQ ID NO: 31408 - DNA, 25 bp, Homo sapien
atgaacagcttaccaaagatcagta

SEQ ID NO: 31409 - DNA, 25 bp, Homo sapien
atgaacaggatactatgaaaaaaga

SEQ ID NO: 31410 - DNA, 25 bp, Homo sapien
atgaacaggatattatgaaaaaaga

SEQ ID NO: 31411 - DNA, 25 bp, Homo sapien
atgaacataaagatggaaacgatgc

SEQ ID NO: 31412 - DNA, 25 bp, Homo sapien
atgaacataaagatggtaacgatgc

SEQ ID NO: 31413 - DNA, 25 bp, Homo sapien
atgaacattgacaaaacgcagaagg

SEQ ID NO: 31414 - DNA, 25 bp, Homo sapien
atgaacattgacaaaatgcagaagg

SEQ ID NO: 31415 - DNA, 25 bp, Homo sapien
atgaacatttattatctctgggctg

SEQ ID NO: 31416 - DNA, 25 bp, Homo sapien
atgaacatttattctctctgggctg

SEQ ID NO: 31417 - DNA, 25 bp, Homo sapien
atgaacatttgtatttcagttgcat

SEQ ID NO: 31418 - DNA, 25 bp, Homo sapien
atgaacatttgtattttagttgcat

SEQ ID NO: 31419 - DNA, 25 bp, Homo sapien
atgaacctgtaaaattgcaaatggt

SEQ ID NO: 31420 - DNA, 25 bp, Homo sapien
atgaacctgtaacattgcaaatggt

SEQ ID NO: 31421 - DNA, 25 bp, Homo sapien
atgaactaactgcctcatgttctgt

SEQ ID NO: 31422 - DNA, 25 bp, Homo sapien
atgaactaactgcctcgtgttctgt

SEQ ID NO: 31423 - DNA, 25 bp, Homo sapien
atgaactacggtataacacgtctga

SEQ ID NO: 31424 - DNA, 25 bp, Homo sapien
atgaactatggtataacacgtctga

SEQ ID NO: 31425 - DNA, 25 bp, Homo sapien
atgaactcagcattggaagtttttc

SEQ ID NO: 31426 - DNA, 25 bp, Homo sapien
atgaactcagcgttggaagtttttc

SEQ ID NO: 31427 - DNA, 25 bp, Homo sapien
atgaactcctgaggcagaagtatta

SEQ ID NO: 31428 - DNA, 25 bp, Homo sapien
atgaactcctgagtgattgcctcag

SEQ ID NO: 31429 - DNA, 25 bp, Homo sapien
atgaactcctgattgattgcctcag

SEQ ID NO: 31430 - DNA, 25 bp, Homo sapien
atgaactcctgcggcagaagtatta

SEQ ID NO: 31431 - DNA, 25 bp, Homo sapien
atgaactggaactgcaatattggat

SEQ ID NO: 31432 - DNA, 25 bp, Homo sapien
atgaactggaactgcagtattggat

SEQ ID NO: 31433 - DNA, 25 bp, Homo sapien
atgaacttacgccaataacttgcac

SEQ ID NO: 31434 - DNA, 25 bp, Homo sapien
atgaacttatgccaataacttgcac

SEQ ID NO: 31435 - DNA, 25 bp, Homo sapien
atgaacttcctgatcctcttataac

SEQ ID NO: 31436 - DNA, 25 bp, Homo sapien
atgaactttaagtctagctgacaaa

SEQ ID NO: 31437 - DNA, 25 bp, Homo sapien
atgaactttaattctagctgacaaa

SEQ ID NO: 31438 - DNA, 25 bp, Homo sapien
atgaactttctgatcctcttataac

SEQ ID NO: 31439 - DNA, 25 bp, Homo sapien
atgaacttttccaggcttttgatcc

SEQ ID NO: 31440 - DNA, 25 bp, Homo sapien
atgaacttttcccggcttttgatcc

SEQ ID NO: 31441 - DNA, 25 bp, Homo sapien
atgaagaaagctcttgaattcgttt

SEQ ID NO: 31442 - DNA, 25 bp, Homo sapien
atgaagaaagctcttgcattcgttt

SEQ ID NO: 31443 - DNA, 25 bp, Homo sapien
atgaagaacataatataaagcagta

SEQ ID NO: 31444 - DNA, 25 bp, Homo sapien
atgaagaacatattataaagcagta

SEQ ID NO: 31445 - DNA, 25 bp, Homo sapien
atgaagaagctgcataatgatgaag

SEQ ID NO: 31446 - DNA, 25 bp, Homo sapien
atgaagaagttgcataatgatgaag

SEQ ID NO: 31447 - DNA, 25 bp, Homo sapien
atgaagacatcattgcagcatgata

SEQ ID NO: 31448 - DNA, 25 bp, Homo sapien
atgaagacgtcattgcagcatgata

SEQ ID NO: 31449 - DNA, 25 bp, Homo sapien
atgaagactcttagtgcatgatatt

SEQ ID NO: 31450 - DNA, 25 bp, Homo sapien
atgaagactcttcgtgcatgatatt

SEQ ID NO: 31451 - DNA, 25 bp, Homo sapien
atgaagagtggctagagtttcttct

SEQ ID NO: 31452 - DNA, 25 bp, Homo sapien
atgaagagttgctagagtttcttct

SEQ ID NO: 31453 - DNA, 25 bp, Homo sapien
atgaagattgagaaaggagatggat

SEQ ID NO: 31454 - DNA, 25 bp, Homo sapien
atgaagattgaggaaggagatggat

SEQ ID NO: 31455 - DNA, 25 bp, Homo sapien
atgaagcaagtctcacaattcaagg

SEQ ID NO: 31456 - DNA, 25 bp, Homo sapien
atgaagcaagtctcgcaattcaagg

SEQ ID NO: 31457 - DNA, 25 bp, Homo sapien
atgaagcatgtggcctgtactttct

SEQ ID NO: 31458 - DNA, 25 bp, Homo sapien
atgaagcatgtggcgtgtactttct

SEQ ID NO: 31459 - DNA, 25 bp, Homo sapien
atgaagcctgacaatttaaaaaggg

SEQ ID NO: 31460 - DNA, 25 bp, Homo sapien
atgaagcctgacgatttaaaaaggg

SEQ ID NO: 31461 - DNA, 25 bp, Homo sapien
atgaagctagaacccaatgggacct

SEQ ID NO: 31462 - DNA, 25 bp, Homo sapien
atgaagctagaactcaatgggacct

SEQ ID NO: 31463 - DNA, 25 bp, Homo sapien
atgaaggagaaaaacaagataaatt

SEQ ID NO: 31464 - DNA, 25 bp, Homo sapien
atgaaggagaaaagcaagataaatt

SEQ ID NO: 31465 - DNA, 25 bp, Homo sapien
atgaaggagaatgaaggagttaggt

SEQ ID NO: 31466 - DNA, 25 bp, Homo sapien
atgaaggagaatgagggagttaggt

SEQ ID NO: 31467 - DNA, 25 bp, Homo sapien
atgaaggatagaaaatggaatcctg

SEQ ID NO: 31468 - DNA, 25 bp, Homo sapien
atgaaggatagagaatggaatcctg

SEQ ID NO: 31469 - DNA, 25 bp, Homo sapien
atgaaggctcactctactttcaaga

SEQ ID NO: 31470 - DNA, 25 bp, Homo sapien
atgaaggctcactgtactttcaaga

SEQ ID NO: 31471 - DNA, 25 bp, Homo sapien
atgaaggttcggattgtggcatctt

SEQ ID NO: 31472 - DNA, 25 bp, Homo sapien
atgaaggtttggattgtggcatctt

SEQ ID NO: 31473 - DNA, 25 bp, Homo sapien
atgaagtaccactttaacccaccag

SEQ ID NO: 31474 - DNA, 25 bp, Homo sapien
atgaagtaccattttaacccaccag

SEQ ID NO: 31475 - DNA, 25 bp, Homo sapien
atgaagtcagttgcatcacacccta

SEQ ID NO: 31476 - DNA, 25 bp, Homo sapien
atgaagtcagttgcgtcacacccta

SEQ ID NO: 31477 - DNA, 25 bp, Homo sapien
atgaagtctcaaaattaatgttcca

SEQ ID NO: 31478 - DNA, 25 bp, Homo sapien
atgaagtctcaaaatttatgttcca

SEQ ID NO: 31479 - DNA, 25 bp, Homo sapien
atgaagtgatgcgataacagctcct

SEQ ID NO: 31480 - DNA, 25 bp, Homo sapien
atgaagtgatgtgataacagctcct

SEQ ID NO: 31481 - DNA, 25 bp, Homo sapien
atgaataaaaaagcgaaacagcctt

SEQ ID NO: 31482 - DNA, 25 bp, Homo sapien
atgaataaaaaagctaaacagcctt

SEQ ID NO: 31483 - DNA, 25 bp, Homo sapien
atgaataaaaccgttctcaggatgc

SEQ ID NO: 31484 - DNA, 25 bp, Homo sapien
atgaataaaactgttctcaggatgc

SEQ ID NO: 31485 - DNA, 25 bp, Homo sapien
atgaataaatctaaccagtgagagt

SEQ ID NO: 31486 - DNA, 25 bp, Homo sapien
atgaataaatctaatcagtgagagt

SEQ ID NO: 31487 - DNA, 25 bp, Homo sapien
atgaataacatccaacagtgtgaaa

SEQ ID NO: 31488 - DNA, 25 bp, Homo sapien
atgaataacatccaactgtgtgaaa

SEQ ID NO: 31489 - DNA, 25 bp, Homo sapien
atgaataacccatctgtggacactg

SEQ ID NO: 31490 - DNA, 25 bp, Homo sapien
atgaataacgcatctgtggacactg

SEQ ID NO: 31491 - DNA, 25 bp, Homo sapien
atgaataactacatcttatttttat

SEQ ID NO: 31492 - DNA, 25 bp, Homo sapien
atgaataactacattttatttttat

SEQ ID NO: 31493 - DNA, 25 bp, Homo sapien
atgaataagtaagcccttgttaaca

SEQ ID NO: 31494 - DNA, 25 bp, Homo sapien
atgaataagtaagctcttgttaaca

SEQ ID NO: 31495 - DNA, 25 bp, Homo sapien
atgaataatatcgccggctgtttac

SEQ ID NO: 31496 - DNA, 25 bp, Homo sapien
atgaataatatcgctggctgtttac

SEQ ID NO: 31497 - DNA, 25 bp, Homo sapien
atgaataatgaacggcagacttaaa

SEQ ID NO: 31498 - DNA, 25 bp, Homo sapien
atgaataatgaatggcagacttaaa

SEQ ID NO: 31499 - DNA, 25 bp, Homo sapien
atgaataattcctaaaatacgcaaa

SEQ ID NO: 31500 - DNA, 25 bp, Homo sapien
atgaataattcttaaaatacgcaaa

SEQ ID NO: 31501 - DNA, 25 bp, Homo sapien
atgaatacgacagcgacaacttacg

SEQ ID NO: 31502 - DNA, 25 bp, Homo sapien
atgaatacgacggcgacaacttacg

SEQ ID NO: 31503 - DNA, 25 bp, Homo sapien
atgaatagagagtgcgttgagttgt

SEQ ID NO: 31504 - DNA, 25 bp, Homo sapien
atgaatagagtctcccatgcatgca

SEQ ID NO: 31505 - DNA, 25 bp, Homo sapien
atgaatagagtctcccgtgcatgca

SEQ ID NO: 31506 - DNA, 25 bp, Homo sapien
atgaatagatagaggacaaagattt

SEQ ID NO: 31507 - DNA, 25 bp, Homo sapien
atgaatagatagtgcgttgagttgt

SEQ ID NO: 31508 - DNA, 25 bp, Homo sapien
atgaataggtagaggacaaagattt

SEQ ID NO: 31509 - DNA, 25 bp, Homo sapien
atgaatagtcaaaaatcgtgtgttc

SEQ ID NO: 31510 - DNA, 25 bp, Homo sapien
atgaatagtcaaaaattgtgtgttc

SEQ ID NO: 31511 - DNA, 25 bp, Homo sapien
atgaatatcggtgtatatcaaattt

SEQ ID NO: 31512 - DNA, 25 bp, Homo sapien
atgaatatcggtgtatttcaaattt

SEQ ID NO: 31513 - DNA, 25 bp, Homo sapien
atgaatatgaacttcctgatcctct

SEQ ID NO: 31514 - DNA, 25 bp, Homo sapien
atgaatatgaactttctgatcctct

SEQ ID NO: 31515 - DNA, 25 bp, Homo sapien
atgaatcatctttcgctcaaataaa

SEQ ID NO: 31516 - DNA, 25 bp, Homo sapien
atgaatcatcttttgctcaaataaa

SEQ ID NO: 31517 - DNA, 25 bp, Homo sapien
atgaatccaaaacaagactcaagct

SEQ ID NO: 31518 - DNA, 25 bp, Homo sapien
atgaatccaaaactagactcaagct

SEQ ID NO: 31519 - DNA, 25 bp, Homo sapien
atgaatccacacaaagcaaagcatt

SEQ ID NO: 31520 - DNA, 25 bp, Homo sapien
atgaatccacacaaggcaaagcatt

SEQ ID NO: 31521 - DNA, 25 bp, Homo sapien
atgaatctaggcaatgatcatcagt

SEQ ID NO: 31522 - DNA, 25 bp, Homo sapien
atgaatctaggcattgatcatcagt

SEQ ID NO: 31523 - DNA, 25 bp, Homo sapien
atgaatctccacacaataaaacatt

SEQ ID NO: 31524 - DNA, 25 bp, Homo sapien
atgaatctctacacaataaaacatt

SEQ ID NO: 31525 - DNA, 25 bp, Homo sapien
atgaatctgtgagttggttacgtct

SEQ ID NO: 31526 - DNA, 25 bp, Homo sapien
atgaatctgtgggttggttacgtct

SEQ ID NO: 31527 - DNA, 25 bp, Homo sapien
atgaatcttactttaatttctcccc

SEQ ID NO: 31528 - DNA, 25 bp, Homo sapien
atgaatctttctttaatttctcccc

SEQ ID NO: 31529 - DNA, 25 bp, Homo sapien
atgaatcttttccctttttgctttt

SEQ ID NO: 31530 - DNA, 25 bp, Homo sapien
atgaatcttttctctttttgctttt

SEQ ID NO: 31531 - DNA, 25 bp, Homo sapien
atgaatgaatactgaccatgtgctc

SEQ ID NO: 31532 - DNA, 25 bp, Homo sapien
atgaatgaatattgaccatgtgctc

SEQ ID NO: 31533 - DNA, 25 bp, Homo sapien
atgaatgacaaaataaggaatagca

SEQ ID NO: 31534 - DNA, 25 bp, Homo sapien
atgaatgagaaaataaggaatagca

SEQ ID NO: 31535 - DNA, 25 bp, Homo sapien
atgaatgagcaaacataaaaaagaa

SEQ ID NO: 31536 - DNA, 25 bp, Homo sapien
atgaatgagcaaagataaaaaagaa

SEQ ID NO: 31537 - DNA, 25 bp, Homo sapien
atgaatgattccggaaagttaactt

SEQ ID NO: 31538 - DNA, 25 bp, Homo sapien
atgaatgattccgggaagttaactt

SEQ ID NO: 31539 - DNA, 25 bp, Homo sapien
atgaatgcctaatatgcacatgaaa

SEQ ID NO: 31540 - DNA, 25 bp, Homo sapien
atgaatgcctagtatgcacatgaaa

SEQ ID NO: 31541 - DNA, 25 bp, Homo sapien
atgaatgctcacagaagatctgaga

SEQ ID NO: 31542 - DNA, 25 bp, Homo sapien
atgaatgctcacagaatatctgaga

SEQ ID NO: 31543 - DNA, 25 bp, Homo sapien
atgaatggactggccacaaaaatat

SEQ ID NO: 31544 - DNA, 25 bp, Homo sapien
atgaatggatggaaaatccactcat

SEQ ID NO: 31545 - DNA, 25 bp, Homo sapien
atgaatggatggcaaatccactcat

SEQ ID NO: 31546 - DNA, 25 bp, Homo sapien
atgaatgggctggccacaaaaatat

SEQ ID NO: 31547 - DNA, 25 bp, Homo sapien
atgaatgtaagctggatgtactatt

SEQ ID NO: 31548 - DNA, 25 bp, Homo sapien
atgaatgtaagttggatgtactatt

SEQ ID NO: 31549 - DNA, 25 bp, Homo sapien
atgaatgtacgggttagcagggctc

SEQ ID NO: 31550 - DNA, 25 bp, Homo sapien
atgaatgtatgcaactcttgtcctt

SEQ ID NO: 31551 - DNA, 25 bp, Homo sapien
atgaatgtatgctactcttgtcctt

SEQ ID NO: 31552 - DNA, 25 bp, Homo sapien
atgaatgtatgggttagcagggctc

SEQ ID NO: 31553 - DNA, 25 bp, Homo sapien
atgaatgtcacaacggaaaaggtgg

SEQ ID NO: 31554 - DNA, 25 bp, Homo sapien
atgaatgtcacaagggaaaaggtgg

SEQ ID NO: 31555 - DNA, 25 bp, Homo sapien
atgaatgttaaaaggtaagtgcttg

SEQ ID NO: 31556 - DNA, 25 bp, Homo sapien
atgaatgttaaagggtaagtgcttg

SEQ ID NO: 31557 - DNA, 25 bp, Homo sapien
atgaatgtttacaacacattttcag

SEQ ID NO: 31558 - DNA, 25 bp, Homo sapien
atgaatgtttacgacacattttcag

SEQ ID NO: 31559 - DNA, 25 bp, Homo sapien
atgaattagaaagtataagtgaaga

SEQ ID NO: 31560 - DNA, 25 bp, Homo sapien
atgaattagaaagtgtaagtgaaga

SEQ ID NO: 31561 - DNA, 25 bp, Homo sapien
atgaattattgagagttgttcattg

SEQ ID NO: 31562 - DNA, 25 bp, Homo sapien
atgaattattgagggttgttcattg

SEQ ID NO: 31563 - DNA, 25 bp, Homo sapien
atgaattcccgaattccgctgtctg

SEQ ID NO: 31564 - DNA, 25 bp, Homo sapien
atgaattcccgaattctgctgtctg

SEQ ID NO: 31565 - DNA, 25 bp, Homo sapien
atgaattgacaatttgtagcctttg

SEQ ID NO: 31566 - DNA, 25 bp, Homo sapien
atgaattggcaatttgtagcctttg

SEQ ID NO: 31567 - DNA, 25 bp, Homo sapien
atgaatttattgcaacactgtgagt

SEQ ID NO: 31568 - DNA, 25 bp, Homo sapien
atgaatttattgccacactgtgagt

SEQ ID NO: 31569 - DNA, 25 bp, Homo sapien
atgaattttcccgagggcaggagag

SEQ ID NO: 31570 - DNA, 25 bp, Homo sapien
atgaattttcctgagggcaggagag

SEQ ID NO: 31571 - DNA, 25 bp, Homo sapien
atgacaaaagacaagaagagagcaa

SEQ ID NO: 31572 - DNA, 25 bp, Homo sapien
atgacaaaagaccagaagagagcaa

SEQ ID NO: 31573 - DNA, 25 bp, Homo sapien
atgacaaacgtccttataaatgaga

SEQ ID NO: 31574 - DNA, 25 bp, Homo sapien
atgacaaagaacaccattgtatgtg

SEQ ID NO: 31575 - DNA, 25 bp, Homo sapien
atgacaaagaactccattgtatgtg

SEQ ID NO: 31576 - DNA, 25 bp, Homo sapien
atgacaaagatcaatcactttctgc

SEQ ID NO: 31577 - DNA, 25 bp, Homo sapien
atgacaaaggtcaatcactttctgc

SEQ ID NO: 31578 - DNA, 25 bp, Homo sapien
atgacaaatatttaatgctgatact

SEQ ID NO: 31579 - DNA, 25 bp, Homo sapien
atgacaaatgtccttataaatgaga

SEQ ID NO: 31580 - DNA, 25 bp, Homo sapien
atgacaaatgtttaatgctgatact

SEQ ID NO: 31581 - DNA, 25 bp, Homo sapien
atgacaacaaataatttgatacgta

SEQ ID NO: 31582 - DNA, 25 bp, Homo sapien
atgacaacaaatagtttgatacgta

SEQ ID NO: 31583 - DNA, 25 bp, Homo sapien
atgacaacagggactgcagaaagtc

SEQ ID NO: 31584 - DNA, 25 bp, Homo sapien
atgacaacaggggctgcagaaagtc

SEQ ID NO: 31585 - DNA, 25 bp, Homo sapien
atgacaagatatactcatttgccta

SEQ ID NO: 31586 - DNA, 25 bp, Homo sapien
atgacaagatattctcatttgccta

SEQ ID NO: 31587 - DNA, 25 bp, Homo sapien
atgacaagggagcaaagatgggttc

SEQ ID NO: 31588 - DNA, 25 bp, Homo sapien
atgacaagggagcgaagatgggttc

SEQ ID NO: 31589 - DNA, 25 bp, Homo sapien
atgacaatatatctgtgaggattcc

SEQ ID NO: 31590 - DNA, 25 bp, Homo sapien
atgacaatcaccgtggtgggtttgg

SEQ ID NO: 31591 - DNA, 25 bp, Homo sapien
atgacaatcactgtggtgggtttgg

SEQ ID NO: 31592 - DNA, 25 bp, Homo sapien
atgacaatcttcctggcctcaacca

SEQ ID NO: 31593 - DNA, 25 bp, Homo sapien
atgacaatgtatctgtgaggattcc

SEQ ID NO: 31594 - DNA, 25 bp, Homo sapien
atgacaatgttcctggcctcaacca

SEQ ID NO: 31595 - DNA, 25 bp, Homo sapien
atgacacaaatacatgtgcatatgt

SEQ ID NO: 31596 - DNA, 25 bp, Homo sapien
atgacacaaatatatgtgcatatgt

SEQ ID NO: 31597 - DNA, 25 bp, Homo sapien
atgacacacctattgatatgtggca

SEQ ID NO: 31598 - DNA, 25 bp, Homo sapien
atgacacagaaatggtaagcttgct

SEQ ID NO: 31599 - DNA, 25 bp, Homo sapien
atgacacagattctaaacccttcat

SEQ ID NO: 31600 - DNA, 25 bp, Homo sapien
atgacacagcaatggtaagcttgct

SEQ ID NO: 31601 - DNA, 25 bp, Homo sapien
atgacacagctattgatatgtggca

SEQ ID NO: 31602 - DNA, 25 bp, Homo sapien
atgacacagtttctaaacccttcat

SEQ ID NO: 31603 - DNA, 25 bp, Homo sapien
atgacaccacggactagagtagctc

SEQ ID NO: 31604 - DNA, 25 bp, Homo sapien
atgacaccatggactagagtagctc

SEQ ID NO: 31605 - DNA, 25 bp, Homo sapien
atgacactaataggtgcgttgaagg

SEQ ID NO: 31606 - DNA, 25 bp, Homo sapien
atgacactaataggtgtgttgaagg

SEQ ID NO: 31607 - DNA, 25 bp, Homo sapien
atgacactcgggtgattacaaatgg

SEQ ID NO: 31608 - DNA, 25 bp, Homo sapien
atgacactctggtgattacaaatgg

SEQ ID NO: 31609 - DNA, 25 bp, Homo sapien
atgacacttgttccggctctaatct

SEQ ID NO: 31610 - DNA, 25 bp, Homo sapien
atgacacttgttctggctctaatct

SEQ ID NO: 31611 - DNA, 25 bp, Homo sapien
atgacagaaatttggggaagttgat

SEQ ID NO: 31612 - DNA, 25 bp, Homo sapien
atgacagaaatttgggtaagttgat

SEQ ID NO: 31613 - DNA, 25 bp, Homo sapien
atgacagacggtaagaaaataacat

SEQ ID NO: 31614 - DNA, 25 bp, Homo sapien
atgacagagggtaagaaaataacat

SEQ ID NO: 31615 - DNA, 25 bp, Homo sapien
atgacagagttatcaaaatgaatgc

SEQ ID NO: 31616 - DNA, 25 bp, Homo sapien
atgacagagttatcaagatgaatgc

SEQ ID NO: 31617 - DNA, 25 bp, Homo sapien
atgacagataatccactgctgtgtt

SEQ ID NO: 31618 - DNA, 25 bp, Homo sapien
atgacagataatccgctgctgtgtt

SEQ ID NO: 31619 - DNA, 25 bp, Homo sapien
atgacagcatccaccacggaaatcg

SEQ ID NO: 31620 - DNA, 25 bp, Homo sapien
atgacagcatccaccatggaaatcg

SEQ ID NO: 31621 - DNA, 25 bp, Homo sapien
atgacagtgttcgacgagaccaaaa

SEQ ID NO: 31622 - DNA, 25 bp, Homo sapien
atgacagtgttcgatgagaccaaaa

SEQ ID NO: 31623 - DNA, 25 bp, Homo sapien
atgacataatattcccattcatgtg

SEQ ID NO: 31624 - DNA, 25 bp, Homo sapien
atgacatagtattcccattcatgtg

SEQ ID NO: 31625 - DNA, 25 bp, Homo sapien
atgacatattcaaagtgctaaaagg

SEQ ID NO: 31626 - DNA, 25 bp, Homo sapien
atgacatattcgaagtgctaaaagg

SEQ ID NO: 31627 - DNA, 25 bp, Homo sapien
atgacatcaacttttattaatttca

SEQ ID NO: 31628 - DNA, 25 bp, Homo sapien
atgacatctacttttattaatttca

SEQ ID NO: 31629 - DNA, 25 bp, Homo sapien
atgacatctatacacacaaagagta

SEQ ID NO: 31630 - DNA, 25 bp, Homo sapien
atgacatctatatacacaaagagta

SEQ ID NO: 31631 - DNA, 25 bp, Homo sapien
atgacatgtccatcacacgatttat

SEQ ID NO: 31632 - DNA, 25 bp, Homo sapien
atgacatgtccatcccacgatttat

SEQ ID NO: 31633 - DNA, 25 bp, Homo sapien
atgacattaatccattcatgaagac

SEQ ID NO: 31634 - DNA, 25 bp, Homo sapien
atgacattagtccattcatgaagac

SEQ ID NO: 31635 - DNA, 25 bp, Homo sapien
atgacattttccactatgtactcca

SEQ ID NO: 31636 - DNA, 25 bp, Homo sapien
atgacattttccattatgtactcca

SEQ ID NO: 31637 - DNA, 25 bp, Homo sapien
atgacattttctctcagtgttctta

SEQ ID NO: 31638 - DNA, 25 bp, Homo sapien
atgacattttctgtcagtgttctta

SEQ ID NO: 31639 - DNA, 25 bp, Homo sapien
atgaccacaatgcagtctgttacga

SEQ ID NO: 31640 - DNA, 25 bp, Homo sapien
atgaccacagtgcagtctgttacga

SEQ ID NO: 31641 - DNA, 25 bp, Homo sapien
atgaccaccagtagaaattcctcct

SEQ ID NO: 31642 - DNA, 25 bp, Homo sapien
atgaccaccagtagaatttcctcct

SEQ ID NO: 31643 - DNA, 25 bp, Homo sapien
atgaccaggaagtgccaccaaacct

SEQ ID NO: 31644 - DNA, 25 bp, Homo sapien
atgaccaggaagtgccgccaaacct

SEQ ID NO: 31645 - DNA, 25 bp, Homo sapien
atgaccaggagaaagaagacaacca

SEQ ID NO: 31646 - DNA, 25 bp, Homo sapien
atgaccaggagaaagatgacaacca

SEQ ID NO: 31647 - DNA, 25 bp, Homo sapien
atgaccaggtacgctgtcaatgagc

SEQ ID NO: 31648 - DNA, 25 bp, Homo sapien
atgaccaggtatgctgtcaatgagc

SEQ ID NO: 31649 - DNA, 25 bp, Homo sapien
atgaccagttcttcctaagtctttc

SEQ ID NO: 31650 - DNA, 25 bp, Homo sapien
atgaccagttctttctaagtctttc

SEQ ID NO: 31651 - DNA, 25 bp, Homo sapien
atgaccatttctggaaattcataga

SEQ ID NO: 31652 - DNA, 25 bp, Homo sapien
atgaccatttctgtaaattcataga

SEQ ID NO: 31653 - DNA, 25 bp, Homo sapien
atgacccaaatttaccatcctccct

SEQ ID NO: 31654 - DNA, 25 bp, Homo sapien
atgacccagatttaccatcctccct

SEQ ID NO: 31655 - DNA, 25 bp, Homo sapien
atgacccatctcaacatgtttgttt

SEQ ID NO: 31656 - DNA, 25 bp, Homo sapien
atgacccatctctacatgtttgttt

SEQ ID NO: 31657 - DNA, 25 bp, Homo sapien
atgacctcatcacgcatttcttaga

SEQ ID NO: 31658 - DNA, 25 bp, Homo sapien
atgacctcatcatgcatttcttaga

SEQ ID NO: 31659 - DNA, 25 bp, Homo sapien
atgaccttataagtgcagtcttcca

SEQ ID NO: 31660 - DNA, 25 bp, Homo sapien
atgaccttataagtgcggtcttcca

SEQ ID NO: 31661 - DNA, 25 bp, Homo sapien
atgaccttcagctcccagttcctga

SEQ ID NO: 31662 - DNA, 25 bp, Homo sapien
atgaccttcagcttccagttcctga

SEQ ID NO: 31663 - DNA, 25 bp, Homo sapien
atgacgagctcactaagaagggtct

SEQ ID NO: 31664 - DNA, 25 bp, Homo sapien
atgacgagctcattaagaagggtct

SEQ ID NO: 31665 - DNA, 25 bp, Homo sapien
atgacgagttacagaaggtagaacc

SEQ ID NO: 31666 - DNA, 25 bp, Homo sapien
atgacgagttacggaaggtagaacc

SEQ ID NO: 31667 - DNA, 25 bp, Homo sapien
atgacgcttgtaagtggagctattt

SEQ ID NO: 31668 - DNA, 25 bp, Homo sapien
atgacgcttgtgagtggagctattt

SEQ ID NO: 31669 - DNA, 25 bp, Homo sapien
atgacggtccactctttacttggaa

SEQ ID NO: 31670 - DNA, 25 bp, Homo sapien
atgacggtccactgtttacttggaa

SEQ ID NO: 31671 - DNA, 25 bp, Homo sapien
atgacgtttgctcagtcttatttca

SEQ ID NO: 31672 - DNA, 25 bp, Homo sapien
atgacgtttgctcggtcttatttca

SEQ ID NO: 31673 - DNA, 25 bp, Homo sapien
atgactaaaacaattgcatttaaat

SEQ ID NO: 31674 - DNA, 25 bp, Homo sapien
atgactaaaacacttgcatttaaat

SEQ ID NO: 31675 - DNA, 25 bp, Homo sapien
atgactaccacatctataattcttg

SEQ ID NO: 31676 - DNA, 25 bp, Homo sapien
atgactacctcatctataattcttg

SEQ ID NO: 31677 - DNA, 25 bp, Homo sapien
atgactagatgttcagcgtatttgg

SEQ ID NO: 31678 - DNA, 25 bp, Homo sapien
atgactagatgttcagtgtatttgg

SEQ ID NO: 31679 - DNA, 25 bp, Homo sapien
atgactagtcagccttctatgaaat

SEQ ID NO: 31680 - DNA, 25 bp, Homo sapien
atgactagtcagccttttatgaaat

SEQ ID NO: 31681 - DNA, 25 bp, Homo sapien
atgactatcagtaatttacaccccc

SEQ ID NO: 31682 - DNA, 25 bp, Homo sapien
atgactatcggtaatttacaccccc

SEQ ID NO: 31683 - DNA, 25 bp, Homo sapien
atgactccaaaattacaccctatgc

SEQ ID NO: 31684 - DNA, 25 bp, Homo sapien
atgactccaaaattacgccctatgc

SEQ ID NO: 31685 - DNA, 25 bp, Homo sapien
atgactccgactgcagtgcggacaa

SEQ ID NO: 31686 - DNA, 25 bp, Homo sapien
atgactccgactgcggtgcggacaa

SEQ ID NO: 31687 - DNA, 25 bp, Homo sapien
atgactgagaaataattgatacatt

SEQ ID NO: 31688 - DNA, 25 bp, Homo sapien
atgactgagaactaattgatacatt

SEQ ID NO: 31689 - DNA, 25 bp, Homo sapien
atgactgatggtactccaaatcacc

SEQ ID NO: 31690 - DNA, 25 bp, Homo sapien
atgactgatggtactcgaaatcacc

SEQ ID NO: 31691 - DNA, 25 bp, Homo sapien
atgactgcacaaagatactaataac

SEQ ID NO: 31692 - DNA, 25 bp, Homo sapien
atgactgcacaaagatgctaataac

SEQ ID NO: 31693 - DNA, 25 bp, Homo sapien
atgactgggatatcatgaggtttaa

SEQ ID NO: 31694 - DNA, 25 bp, Homo sapien
atgactgggatgtcatgaggtttaa

SEQ ID NO: 31695 - DNA, 25 bp, Homo sapien
atgactggtctgagattttcttgtg

SEQ ID NO: 31696 - DNA, 25 bp, Homo sapien
atgactggtgtgagattttcttgtg

SEQ ID NO: 31697 - DNA, 25 bp, Homo sapien
atgacttaagtacacttgctttaca

SEQ ID NO: 31698 - DNA, 25 bp, Homo sapien
atgacttaagtacatttgctttaca

SEQ ID NO: 31699 - DNA, 25 bp, Homo sapien
atgacttaatcatccagggtaccct

SEQ ID NO: 31700 - DNA, 25 bp, Homo sapien
atgacttattcatccagggtaccct

SEQ ID NO: 31701 - DNA, 25 bp, Homo sapien
atgacttcctgaatattgcaaggtc

SEQ ID NO: 31702 - DNA, 25 bp, Homo sapien
atgacttcctgaatcttgcaaggtc

SEQ ID NO: 31703 - DNA, 25 bp, Homo sapien
atgacttcttagcttcataatgcaa

SEQ ID NO: 31704 - DNA, 25 bp, Homo sapien
atgacttcttagcttcgtaatgcaa

SEQ ID NO: 31705 - DNA, 25 bp, Homo sapien
atgacttgaacatttcccaagtttg

SEQ ID NO: 31706 - DNA, 25 bp, Homo sapien
atgacttgaacgtttcccaagtttg

SEQ ID NO: 31707 - DNA, 25 bp, Homo sapien
atgacttgttgcactccatcacatt

SEQ ID NO: 31708 - DNA, 25 bp, Homo sapien
atgacttgttgcactctatcacatt

SEQ ID NO: 31709 - DNA, 25 bp, Homo sapien
atgactttaaccggtcgatctcaaa

SEQ ID NO: 31710 - DNA, 25 bp, Homo sapien
atgactttaactggtcgatctcaaa

SEQ ID NO: 31711 - DNA, 25 bp, Homo sapien
atgactttacctggtcgatctcaaa

SEQ ID NO: 31712 - DNA, 25 bp, Homo sapien
atgactttgggttccttattaatgt

SEQ ID NO: 31713 - DNA, 25 bp, Homo sapien
atgactttgtcacgattgtgttcac

SEQ ID NO: 31714 - DNA, 25 bp, Homo sapien
atgactttgtcacggttgtgttcac

SEQ ID NO: 31715 - DNA, 25 bp, Homo sapien
atgactttgtgttccttattaatgt

SEQ ID NO: 31716 - DNA, 25 bp, Homo sapien
atgacttttcaggatatattcttac

SEQ ID NO: 31717 - DNA, 25 bp, Homo sapien
atgacttttcagtatatattcttac

SEQ ID NO: 31718 - DNA, 25 bp, Homo sapien
atgagaaaaaggctgtattcagtgc

SEQ ID NO: 31719 - DNA, 25 bp, Homo sapien
atgagaaaaaggctgttttcagtgc

SEQ ID NO: 31720 - DNA, 25 bp, Homo sapien
atgagaaaacgaaggcataaaaaga

SEQ ID NO: 31721 - DNA, 25 bp, Homo sapien
atgagaaaatactacaatggaaaaa

SEQ ID NO: 31722 - DNA, 25 bp, Homo sapien
atgagaaaatagtacaatggaaaaa

SEQ ID NO: 31723 - DNA, 25 bp, Homo sapien
atgagaaaatgaaggcataaaaaga

SEQ ID NO: 31724 - DNA, 25 bp, Homo sapien
atgagaaagaatttttttgcccctc

SEQ ID NO: 31725 - DNA, 25 bp, Homo sapien
atgagaaataaatcggagctgcttg

SEQ ID NO: 31726 - DNA, 25 bp, Homo sapien
atgagaaataatttttttgcccctc

SEQ ID NO: 31727 - DNA, 25 bp, Homo sapien
atgagaaatagcttcaatacagtcc

SEQ ID NO: 31728 - DNA, 25 bp, Homo sapien
atgagaaatagcttcagtacagtcc

SEQ ID NO: 31729 - DNA, 25 bp, Homo sapien
atgagaaatcaatcggagctgcttg

SEQ ID NO: 31730 - DNA, 25 bp, Homo sapien
atgagaaatggcctctccgtgagct

SEQ ID NO: 31731 - DNA, 25 bp, Homo sapien
atgagaaatggtctctccgtgagct

SEQ ID NO: 31732 - DNA, 25 bp, Homo sapien
atgagaaccctaaagcttaatgaat

SEQ ID NO: 31733 - DNA, 25 bp, Homo sapien
atgagaaccctacagcttaatgaat

SEQ ID NO: 31734 - DNA, 25 bp, Homo sapien
atgagaactgccataaccagaaaag

SEQ ID NO: 31735 - DNA, 25 bp, Homo sapien
atgagaactgccgtaaccagaaaag

SEQ ID NO: 31736 - DNA, 25 bp, Homo sapien
atgagaagaaaagagaaagaactgc

SEQ ID NO: 31737 - DNA, 25 bp, Homo sapien
atgagaagaaaggagaaagaactgc

SEQ ID NO: 31738 - DNA, 25 bp, Homo sapien
atgagaagaaccttacagtagccaa

SEQ ID NO: 31739 - DNA, 25 bp, Homo sapien
atgagaagacccttacagtagccaa

SEQ ID NO: 31740 - DNA, 25 bp, Homo sapien
atgagaagggtaagagacttaggac

SEQ ID NO: 31741 - DNA, 25 bp, Homo sapien
atgagaagggtaggagacttaggac

SEQ ID NO: 31742 - DNA, 25 bp, Homo sapien
atgagaatactctccatccatagcc

SEQ ID NO: 31743 - DNA, 25 bp, Homo sapien
atgagaatactctctatccatagcc

SEQ ID NO: 31744 - DNA, 25 bp, Homo sapien
atgagaatgaaaacagagataagca

SEQ ID NO: 31745 - DNA, 25 bp, Homo sapien
atgagaatgaaagcagagataagca

SEQ ID NO: 31746 - DNA, 25 bp, Homo sapien
atgagaattacatcatctgcttctc

SEQ ID NO: 31747 - DNA, 25 bp, Homo sapien
atgagaattacttcatctgcttctc

SEQ ID NO: 31748 - DNA, 25 bp, Homo sapien
atgagacactcttactaccatactc

SEQ ID NO: 31749 - DNA, 25 bp, Homo sapien
atgagacactcttagtaccatactc

SEQ ID NO: 31750 - DNA, 25 bp, Homo sapien
atgagacctctgtattataacttga

SEQ ID NO: 31751 - DNA, 25 bp, Homo sapien
atgagacctttgtattataacttga

SEQ ID NO: 31752 - DNA, 25 bp, Homo sapien
atgagactagaatcaattaactcca

SEQ ID NO: 31753 - DNA, 25 bp, Homo sapien
atgagactagaatgaattaactcca

SEQ ID NO: 31754 - DNA, 25 bp, Homo sapien
atgagactgtgtacattgaacttct

SEQ ID NO: 31755 - DNA, 25 bp, Homo sapien
atgagactgtgtacgttgaacttct

SEQ ID NO: 31756 - DNA, 25 bp, Homo sapien
atgagagaagacacactctttggat

SEQ ID NO: 31757 - DNA, 25 bp, Homo sapien
atgagagaagacacgctctttggat

SEQ ID NO: 31758 - DNA, 25 bp, Homo sapien
atgagagattccgacagtttcttgc

SEQ ID NO: 31759 - DNA, 25 bp, Homo sapien
atgagagattctgacagtttcttgc

SEQ ID NO: 31760 - DNA, 25 bp, Homo sapien
atgagagcaccaaattatctacaac

SEQ ID NO: 31761 - DNA, 25 bp, Homo sapien
atgagagcagattcattttcagacc

SEQ ID NO: 31762 - DNA, 25 bp, Homo sapien
atgagagcagattcgttttcagacc

SEQ ID NO: 31763 - DNA, 25 bp, Homo sapien
atgagagcgccaaattatctacaac

SEQ ID NO: 31764 - DNA, 25 bp, Homo sapien
atgagatcacttaggaaatgagtgt

SEQ ID NO: 31765 - DNA, 25 bp, Homo sapien
atgagatcgcttaggaaatgagtgt

SEQ ID NO: 31766 - DNA, 25 bp, Homo sapien
atgagatgttcactggaggatttga

SEQ ID NO: 31767 - DNA, 25 bp, Homo sapien
atgagatgttcattggaggatttga

SEQ ID NO: 31768 - DNA, 25 bp, Homo sapien
atgagattaagaactggaataagaa

SEQ ID NO: 31769 - DNA, 25 bp, Homo sapien
atgagattaagaattggaataagaa

SEQ ID NO: 31770 - DNA, 25 bp, Homo sapien
atgagattcttcatggtgcattcag

SEQ ID NO: 31771 - DNA, 25 bp, Homo sapien
atgagattgattataaacctatgta

SEQ ID NO: 31772 - DNA, 25 bp, Homo sapien
atgagattgattgtaaacctatgta

SEQ ID NO: 31773 - DNA, 25 bp, Homo sapien
atgagatttttcatggtgcattcag

SEQ ID NO: 31774 - DNA, 25 bp, Homo sapien
atgagcaaatgaatccaagtatata

SEQ ID NO: 31775 - DNA, 25 bp, Homo sapien
atgagcaaattgtggtatattcatg

SEQ ID NO: 31776 - DNA, 25 bp, Homo sapien
atgagcaaattttggtatattcatg

SEQ ID NO: 31777 - DNA, 25 bp, Homo sapien
atgagcaacagacatttctgcaaca

SEQ ID NO: 31778 - DNA, 25 bp, Homo sapien
atgagcaacagacttttctgcaaca

SEQ ID NO: 31779 - DNA, 25 bp, Homo sapien
atgagcaactgaatccaagtatata

SEQ ID NO: 31780 - DNA, 25 bp, Homo sapien
atgagcacatttcattgcaagactg

SEQ ID NO: 31781 - DNA, 25 bp, Homo sapien
atgagcacattttattgcaagactg

SEQ ID NO: 31782 - DNA, 25 bp, Homo sapien
atgagcagaagagttaaagcttgta

SEQ ID NO: 31783 - DNA, 25 bp, Homo sapien
atgagcagaggagttaaagcttgta

SEQ ID NO: 31784 - DNA, 25 bp, Homo sapien
atgagcatgatgacaaattaacacc

SEQ ID NO: 31785 - DNA, 25 bp, Homo sapien
atgagcatgatgacaagttaacacc

SEQ ID NO: 31786 - DNA, 25 bp, Homo sapien
atgagcatggaactttggtcaaacc

SEQ ID NO: 31787 - DNA, 25 bp, Homo sapien
atgagcatggaacttttgtcaaacc

SEQ ID NO: 31788 - DNA, 25 bp, Homo sapien
atgagcattatgaagtttaacatgt

SEQ ID NO: 31789 - DNA, 25 bp, Homo sapien
atgagcattgtgaagtttaacatgt

SEQ ID NO: 31790 - DNA, 25 bp, Homo sapien
atgagcccgtcaaaagcattcttat

SEQ ID NO: 31791 - DNA, 25 bp, Homo sapien
atgagcccgtcaaaggcattcttat

SEQ ID NO: 31792 - DNA, 25 bp, Homo sapien
atgagccctttccggtaaaaagcaa

SEQ ID NO: 31793 - DNA, 25 bp, Homo sapien
atgagccctttctggtaaaaagcaa

SEQ ID NO: 31794 - DNA, 25 bp, Homo sapien
atgagcctataacctctgttgtttt

SEQ ID NO: 31795 - DNA, 25 bp, Homo sapien
atgagcctataagctctgttgtttt

SEQ ID NO: 31796 - DNA, 25 bp, Homo sapien
atgagcgaggctccatgcagacagg

SEQ ID NO: 31797 - DNA, 25 bp, Homo sapien
atgagcgaggctccgtgcagacagg

SEQ ID NO: 31798 - DNA, 25 bp, Homo sapien
atgagcgagtaatccttttaaggga

SEQ ID NO: 31799 - DNA, 25 bp, Homo sapien
atgagcgagtaatctttttaaggga

SEQ ID NO: 31800 - DNA, 25 bp, Homo sapien
atgagctgcccctcatcttcgcaga

SEQ ID NO: 31801 - DNA, 25 bp, Homo sapien
atgagctgcccctcgtcttcgcaga

SEQ ID NO: 31802 - DNA, 25 bp, Homo sapien
atgagctgctcagatgtcatacatt

SEQ ID NO: 31803 - DNA, 25 bp, Homo sapien
atgagctgctcagttgtcatacatt

SEQ ID NO: 31804 - DNA, 25 bp, Homo sapien
atgagctggaatccgacttttcttg

SEQ ID NO: 31805 - DNA, 25 bp, Homo sapien
atgagctggaattcgacttttcttg

SEQ ID NO: 31806 - DNA, 25 bp, Homo sapien
atgagctgtaaaacaaaagcatcag

SEQ ID NO: 31807 - DNA, 25 bp, Homo sapien
atgagctgtaaagcaaaagcatcag

SEQ ID NO: 31808 - DNA, 25 bp, Homo sapien
atgagcttcatcagagcagtcagta

SEQ ID NO: 31809 - DNA, 25 bp, Homo sapien
atgagcttcatcagggcagtcagta

SEQ ID NO: 31810 - DNA, 25 bp, Homo sapien
atgaggaaaataaaagcttataact

SEQ ID NO: 31811 - DNA, 25 bp, Homo sapien
atgaggaaaataaaagtttataact

SEQ ID NO: 31812 - DNA, 25 bp, Homo sapien
atgaggaaaccaagttatggtctac

SEQ ID NO: 31813 - DNA, 25 bp, Homo sapien
atgaggaaaccgagttatggtctac

SEQ ID NO: 31814 - DNA, 25 bp, Homo sapien
atgaggaaagtttgaacccagtgac

SEQ ID NO: 31815 - DNA, 25 bp, Homo sapien
atgaggaaagtttgaagccagtgac

SEQ ID NO: 31816 - DNA, 25 bp, Homo sapien
atgaggacatgtcaaaatcacaatt

SEQ ID NO: 31817 - DNA, 25 bp, Homo sapien
atgaggacatgtcgaaatcacaatt

SEQ ID NO: 31818 - DNA, 25 bp, Homo sapien
atgaggagacgaacaaggcctatat

SEQ ID NO: 31819 - DNA, 25 bp, Homo sapien
atgaggagatgaacaaggcctatat

SEQ ID NO: 31820 - DNA, 25 bp, Homo sapien
atgaggagatgcactacattcaaaa

SEQ ID NO: 31821 - DNA, 25 bp, Homo sapien
atgaggagatgcgctacattcaaaa

SEQ ID NO: 31822 - DNA, 25 bp, Homo sapien
atgaggataactaatacattggcca

SEQ ID NO: 31823 - DNA, 25 bp, Homo sapien
atgaggatagctaatacattggcca

SEQ ID NO: 31824 - DNA, 25 bp, Homo sapien
atgaggccacggaaagggtggatat

SEQ ID NO: 31825 - DNA, 25 bp, Homo sapien
atgaggccatggaaagggtggatat

SEQ ID NO: 31826 - DNA, 25 bp, Homo sapien
atgaggctgtgtggttaaggcaatc

SEQ ID NO: 31827 - DNA, 25 bp, Homo sapien
atgaggcttcaagaagtctgtttcc

SEQ ID NO: 31828 - DNA, 25 bp, Homo sapien
atgaggcttcaggaagtctgtttcc

SEQ ID NO: 31829 - DNA, 25 bp, Homo sapien
atgaggctttgtggttaaggcaatc

SEQ ID NO: 31830 - DNA, 25 bp, Homo sapien
atgagggaaaatcagccatgaaaaa

SEQ ID NO: 31831 - DNA, 25 bp, Homo sapien
atgagggaaaattagccatgaaaaa

SEQ ID NO: 31832 - DNA, 25 bp, Homo sapien
atgagggaatgctcagtgtgactga

SEQ ID NO: 31833 - DNA, 25 bp, Homo sapien
atgagggaatgcttagtgtgactga

SEQ ID NO: 31834 - DNA, 25 bp, Homo sapien
atgagggtgaatagaaatgaagaac

SEQ ID NO: 31835 - DNA, 25 bp, Homo sapien
atgagggtgaatggaaatgaagaac

SEQ ID NO: 31836 - DNA, 25 bp, Homo sapien
atgaggtcaccaagtgatggattct

SEQ ID NO: 31837 - DNA, 25 bp, Homo sapien
atgaggtccataagtagatcagagt

SEQ ID NO: 31838 - DNA, 25 bp, Homo sapien
atgaggtccataattagatcagagt

SEQ ID NO: 31839 - DNA, 25 bp, Homo sapien
atgaggtcgcagccttctctgtctt

SEQ ID NO: 31840 - DNA, 25 bp, Homo sapien
atgaggtcgcaggcttctctgtctt

SEQ ID NO: 31841 - DNA, 25 bp, Homo sapien
atgaggtcgccaagtgatggattct

SEQ ID NO: 31842 - DNA, 25 bp, Homo sapien
atgaggttaaagaaaaactgtggca

SEQ ID NO: 31843 - DNA, 25 bp, Homo sapien
atgaggttaaagcaaaactgtggca

SEQ ID NO: 31844 - DNA, 25 bp, Homo sapien
atgaggttaacactgatgatcagta

SEQ ID NO: 31845 - DNA, 25 bp, Homo sapien
atgaggttaacattgatgatcagta

SEQ ID NO: 31846 - DNA, 25 bp, Homo sapien
atgaggttaagagcaatattttttt

SEQ ID NO: 31847 - DNA, 25 bp, Homo sapien
atgaggttgagagcaatattttttt

SEQ ID NO: 31848 - DNA, 25 bp, Homo sapien
atgagtaaaacaaactgtagcttcc

SEQ ID NO: 31849 - DNA, 25 bp, Homo sapien
atgagtaaatcaaactgtagcttcc

SEQ ID NO: 31850 - DNA, 25 bp, Homo sapien
atgagtacaaactatctacagcagt

SEQ ID NO: 31851 - DNA, 25 bp, Homo sapien
atgagtacaaattatctacagcagt

SEQ ID NO: 31852 - DNA, 25 bp, Homo sapien
atgagtacactttacaggccaaggc

SEQ ID NO: 31853 - DNA, 25 bp, Homo sapien
atgagtacgctttacaggccaaggc

SEQ ID NO: 31854 - DNA, 25 bp, Homo sapien
atgagtactatggtgtaatactaga

SEQ ID NO: 31855 - DNA, 25 bp, Homo sapien
atgagtactatggtgtgatactaga

SEQ ID NO: 31856 - DNA, 25 bp, Homo sapien
atgagtagttcagcttgtgacatgg

SEQ ID NO: 31857 - DNA, 25 bp, Homo sapien
atgagtagttcagtttgtgacatgg

SEQ ID NO: 31858 - DNA, 25 bp, Homo sapien
atgagtatagtgtgaaggttaaact

SEQ ID NO: 31859 - DNA, 25 bp, Homo sapien
atgagtatcgtgtgaaggttaaact

SEQ ID NO: 31860 - DNA, 25 bp, Homo sapien
atgagtatgccctaaaattgtgtgt

SEQ ID NO: 31861 - DNA, 25 bp, Homo sapien
atgagtatgccttaaaattgtgtgt

SEQ ID NO: 31862 - DNA, 25 bp, Homo sapien
atgagtcaaagatgggcagaaatgt

SEQ ID NO: 31863 - DNA, 25 bp, Homo sapien
atgagtcaaaggtgggcagaaatgt

SEQ ID NO: 31864 - DNA, 25 bp, Homo sapien
atgagtcatcgcaaaccaccatgaa

SEQ ID NO: 31865 - DNA, 25 bp, Homo sapien
atgagtcatcgccaaccaccatgaa

SEQ ID NO: 31866 - DNA, 25 bp, Homo sapien
atgagtcatgggtcaacgtccttct

SEQ ID NO: 31867 - DNA, 25 bp, Homo sapien
atgagtcatgggtcaatgtccttct

SEQ ID NO: 31868 - DNA, 25 bp, Homo sapien
atgagtccaactgaaaaaattgaca

SEQ ID NO: 31869 - DNA, 25 bp, Homo sapien
atgagtccagctgaaaaaattgaca

SEQ ID NO: 31870 - DNA, 25 bp, Homo sapien
atgagtgcctgaacaaaatggaatt

SEQ ID NO: 31871 - DNA, 25 bp, Homo sapien
atgagtgcctgaataaaatggaatt

SEQ ID NO: 31872 - DNA, 25 bp, Homo sapien
atgagtgtcaaaaaccgatgatgac

SEQ ID NO: 31873 - DNA, 25 bp, Homo sapien
atgagtgtcaaaacccgatgatgac

SEQ ID NO: 31874 - DNA, 25 bp, Homo sapien
atgagtgtgcataatctcttccaga

SEQ ID NO: 31875 - DNA, 25 bp, Homo sapien
atgagtgtgcatattctcttccaga

SEQ ID NO: 31876 - DNA, 25 bp, Homo sapien
atgagtgttggtggatccaagtcta

SEQ ID NO: 31877 - DNA, 25 bp, Homo sapien
atgagtgttggttgatccaagtcta

SEQ ID NO: 31878 - DNA, 25 bp, Homo sapien
atgagttagcagtcccagaatgtta

SEQ ID NO: 31879 - DNA, 25 bp, Homo sapien
atgagttagcagtctcagaatgtta

SEQ ID NO: 31880 - DNA, 25 bp, Homo sapien
atgagttcagcagatatttgactct

SEQ ID NO: 31881 - DNA, 25 bp, Homo sapien
atgagttcagcaggtatttgactct

SEQ ID NO: 31882 - DNA, 25 bp, Homo sapien
atgagttcatgcatcaactatagtg

SEQ ID NO: 31883 - DNA, 25 bp, Homo sapien
atgagttcatgtcccgagccaataa

SEQ ID NO: 31884 - DNA, 25 bp, Homo sapien
atgagttcatgtcctgagccaataa

SEQ ID NO: 31885 - DNA, 25 bp, Homo sapien
atgagttcctgacaggttactggcc

SEQ ID NO: 31886 - DNA, 25 bp, Homo sapien
atgagttcctgataggttactggcc

SEQ ID NO: 31887 - DNA, 25 bp, Homo sapien
atgagttcgtgcatcaactatagtg

SEQ ID NO: 31888 - DNA, 25 bp, Homo sapien
atgagtttcagaagagttgttattt

SEQ ID NO: 31889 - DNA, 25 bp, Homo sapien
atgagtttcggaagagttgttattt

SEQ ID NO: 31890 - DNA, 25 bp, Homo sapien
atgagttttgcatgttgcgttccat

SEQ ID NO: 31891 - DNA, 25 bp, Homo sapien
atgagttttgcgtgttgcgttccat

SEQ ID NO: 31892 - DNA, 25 bp, Homo sapien
atgataaagggttaaagcagataga

SEQ ID NO: 31893 - DNA, 25 bp, Homo sapien
atgataaagggttagagcagataga

SEQ ID NO: 31894 - DNA, 25 bp, Homo sapien
atgataaatcaagttgagcactttt

SEQ ID NO: 31895 - DNA, 25 bp, Homo sapien
atgataaatgaagttgagcactttt

SEQ ID NO: 31896 - DNA, 25 bp, Homo sapien
atgataactcccatttttggagccc

SEQ ID NO: 31897 - DNA, 25 bp, Homo sapien
atgataactcccttttttggagccc

SEQ ID NO: 31898 - DNA, 25 bp, Homo sapien
atgataagaaacatttgagatctct

SEQ ID NO: 31899 - DNA, 25 bp, Homo sapien
atgataaggaacatttgagatctct

SEQ ID NO: 31900 - DNA, 25 bp, Homo sapien
atgataatacaagctcataaaagag

SEQ ID NO: 31901 - DNA, 25 bp, Homo sapien
atgataatgaagcattcctggccat

SEQ ID NO: 31902 - DNA, 25 bp, Homo sapien
atgataatgaagtattcctggccat

SEQ ID NO: 31903 - DNA, 25 bp, Homo sapien
atgataattcaagctcataaaagag

SEQ ID NO: 31904 - DNA, 25 bp, Homo sapien
atgatacagaagcggaagcctgagc

SEQ ID NO: 31905 - DNA, 25 bp, Homo sapien
atgatacagaagtggaagcctgagc

SEQ ID NO: 31906 - DNA, 25 bp, Homo sapien
atgatacccaaatattcatttcatg

SEQ ID NO: 31907 - DNA, 25 bp, Homo sapien
atgatacccaaatattgatttcatg

SEQ ID NO: 31908 - DNA, 25 bp, Homo sapien
atgatactctacacatgctctataa

SEQ ID NO: 31909 - DNA, 25 bp, Homo sapien
atgatactctacacgtgctctataa

SEQ ID NO: 31910 - DNA, 25 bp, Homo sapien
atgatagaaaaggaaagagtaacta

SEQ ID NO: 31911 - DNA, 25 bp, Homo sapien
atgatagaaaagtaaagagtaacta

SEQ ID NO: 31912 - DNA, 25 bp, Homo sapien
atgatagctgcaatagaaagtaaag

SEQ ID NO: 31913 - DNA, 25 bp, Homo sapien
atgatagctgcagtagaaagtaaag

SEQ ID NO: 31914 - DNA, 25 bp, Homo sapien
atgatagttttctcctctgtcctca

SEQ ID NO: 31915 - DNA, 25 bp, Homo sapien
atgatagttttctcctgtgtcctca

SEQ ID NO: 31916 - DNA, 25 bp, Homo sapien
atgatataatgctgaattactggcc

SEQ ID NO: 31917 - DNA, 25 bp, Homo sapien
atgatataatgttgaattactggcc

SEQ ID NO: 31918 - DNA, 25 bp, Homo sapien
atgatatagggaattgaaaagacat

SEQ ID NO: 31919 - DNA, 25 bp, Homo sapien
atgatatatctgtctactcctcagt

SEQ ID NO: 31920 - DNA, 25 bp, Homo sapien
atgatatatggaattgaaaagacat

SEQ ID NO: 31921 - DNA, 25 bp, Homo sapien
atgatatatgtatacgattgagcag

SEQ ID NO: 31922 - DNA, 25 bp, Homo sapien
atgatatatgtatatgattgagcag

SEQ ID NO: 31923 - DNA, 25 bp, Homo sapien
atgatatatttgtctactcctcagt

SEQ ID NO: 31924 - DNA, 25 bp, Homo sapien
atgatatgaacaattaacatttctt

SEQ ID NO: 31925 - DNA, 25 bp, Homo sapien
atgatatgaacagttaacatttctt

SEQ ID NO: 31926 - DNA, 25 bp, Homo sapien
atgatattaatagtgggctggccag

SEQ ID NO: 31927 - DNA, 25 bp, Homo sapien
atgatattcaccgccgactgcccaa

SEQ ID NO: 31928 - DNA, 25 bp, Homo sapien
atgatattcgccgccgactgcccaa

SEQ ID NO: 31929 - DNA, 25 bp, Homo sapien
atgatattgatagtgggctggccag

SEQ ID NO: 31930 - DNA, 25 bp, Homo sapien
atgatattgttccataacctgttaa

SEQ ID NO: 31931 - DNA, 25 bp, Homo sapien
atgatattgttctataacctgttaa

SEQ ID NO: 31932 - DNA, 25 bp, Homo sapien
atgatcaaaactgcatgatcttctg

SEQ ID NO: 31933 - DNA, 25 bp, Homo sapien
atgatcaaaactgcgtgatcttctg

SEQ ID NO: 31934 - DNA, 25 bp, Homo sapien
atgatcaaatacaaacagatggaaa

SEQ ID NO: 31935 - DNA, 25 bp, Homo sapien
atgatcaaatacacacagatggaaa

SEQ ID NO: 31936 - DNA, 25 bp, Homo sapien
atgatcaaattttgcgaagataaga

SEQ ID NO: 31937 - DNA, 25 bp, Homo sapien
atgatcaaattttgtgaagataaga

SEQ ID NO: 31938 - DNA, 25 bp, Homo sapien
atgatcaacgatacggcagaagtat

SEQ ID NO: 31939 - DNA, 25 bp, Homo sapien
atgatcaacgatatggcagaagtat

SEQ ID NO: 31940 - DNA, 25 bp, Homo sapien
atgatcaagttccaccaagtattct

SEQ ID NO: 31941 - DNA, 25 bp, Homo sapien
atgatcaatttccaccaagtattct

SEQ ID NO: 31942 - DNA, 25 bp, Homo sapien
atgatcaccttaaactgaaactcga

SEQ ID NO: 31943 - DNA, 25 bp, Homo sapien
atgatcaccttaaattgaaactcga

SEQ ID NO: 31944 - DNA, 25 bp, Homo sapien
atgatcactctgcaagatattgtag

SEQ ID NO: 31945 - DNA, 25 bp, Homo sapien
atgatcactctgcaaggtattgtag

SEQ ID NO: 31946 - DNA, 25 bp, Homo sapien
atgatcagctaattccacaaataag

SEQ ID NO: 31947 - DNA, 25 bp, Homo sapien
atgatcagctagttccacaaataag

SEQ ID NO: 31948 - DNA, 25 bp, Homo sapien
atgatcatctggccaattctatagg

SEQ ID NO: 31949 - DNA, 25 bp, Homo sapien
atgatcatctggtcaattctatagg

SEQ ID NO: 31950 - DNA, 25 bp, Homo sapien
atgatcattatcctatcccatttct

SEQ ID NO: 31951 - DNA, 25 bp, Homo sapien
atgatcattatcttatcccatttct

SEQ ID NO: 31952 - DNA, 25 bp, Homo sapien
atgatccatctttatgaataagaaa

SEQ ID NO: 31953 - DNA, 25 bp, Homo sapien
atgatccatgtttatgaataagaaa

SEQ ID NO: 31954 - DNA, 25 bp, Homo sapien
atgatcccgttggagaagctacaaa

SEQ ID NO: 31955 - DNA, 25 bp, Homo sapien
atgatcccgttggagaggctacaaa

SEQ ID NO: 31956 - DNA, 25 bp, Homo sapien
atgatcctagcctaatgtgctattt

SEQ ID NO: 31957 - DNA, 25 bp, Homo sapien
atgatcctagcttaatgtgctattt

SEQ ID NO: 31958 - DNA, 25 bp, Homo sapien
atgatcctgatcttatcttttctat

SEQ ID NO: 31959 - DNA, 25 bp, Homo sapien
atgatcctggaaagaaaaaaaattc

SEQ ID NO: 31960 - DNA, 25 bp, Homo sapien
atgatcctggagagaaaaaaaattc

SEQ ID NO: 31961 - DNA, 25 bp, Homo sapien
atgatcctggtcttatcttttctat

SEQ ID NO: 31962 - DNA, 25 bp, Homo sapien
atgatcgaggacagctaactagata

SEQ ID NO: 31963 - DNA, 25 bp, Homo sapien
atgatcgatgacagctaactagata

SEQ ID NO: 31964 - DNA, 25 bp, Homo sapien
atgatctaacgggacttaatttcct

SEQ ID NO: 31965 - DNA, 25 bp, Homo sapien
atgatctaatgggacttaatttcct

SEQ ID NO: 31966 - DNA, 25 bp, Homo sapien
atgatctcacttgttcctcataaca

SEQ ID NO: 31967 - DNA, 25 bp, Homo sapien
atgatctcgcttgttcctcataaca

SEQ ID NO: 31968 - DNA, 25 bp, Homo sapien
atgatctgacagaggaaactctggg

SEQ ID NO: 31969 - DNA, 25 bp, Homo sapien
atgatctgagtattcactggagaat

SEQ ID NO: 31970 - DNA, 25 bp, Homo sapien
atgatctgatagaggaaactctggg

SEQ ID NO: 31971 - DNA, 25 bp, Homo sapien
atgatctgcgagcgtctaactgtgc

SEQ ID NO: 31972 - DNA, 25 bp, Homo sapien
atgatctgcgagtgtctaactgtgc

SEQ ID NO: 31973 - DNA, 25 bp, Homo sapien
atgatctgtgtattcactggagaat

SEQ ID NO: 31974 - DNA, 25 bp, Homo sapien
atgatcttcccagagattttttaaa

SEQ ID NO: 31975 - DNA, 25 bp, Homo sapien
atgatcttcccggagattttttaaa

SEQ ID NO: 31976 - DNA, 25 bp, Homo sapien
atgatctttcaaggtatcgttggga

SEQ ID NO: 31977 - DNA, 25 bp, Homo sapien
atgatctttcatggtatcgttggga

SEQ ID NO: 31978 - DNA, 25 bp, Homo sapien
atgatgaaatctccaaattttatct

SEQ ID NO: 31979 - DNA, 25 bp, Homo sapien
atgatgaaatctccgaattttatct

SEQ ID NO: 31980 - DNA, 25 bp, Homo sapien
atgatgacaaaattcgaagatttac

SEQ ID NO: 31981 - DNA, 25 bp, Homo sapien
atgatgacaaaatttgaagatttac

SEQ ID NO: 31982 - DNA, 25 bp, Homo sapien
atgatgactgtatctggattatgtg

SEQ ID NO: 31983 - DNA, 25 bp, Homo sapien
atgatgactgtatctgtattatgtg

SEQ ID NO: 31984 - DNA, 25 bp, Homo sapien
atgatgccaaattcaggaaattaac

SEQ ID NO: 31985 - DNA, 25 bp, Homo sapien
atgatgccaaattcgggaaattaac

SEQ ID NO: 31986 - DNA, 25 bp, Homo sapien
atgatgccattagataactttagat

SEQ ID NO: 31987 - DNA, 25 bp, Homo sapien
atgatgccattatataactttagat

SEQ ID NO: 31988 - DNA, 25 bp, Homo sapien
atgatgctcatcaaactgttattta

SEQ ID NO: 31989 - DNA, 25 bp, Homo sapien
atgatgctcatcagactgttattta

SEQ ID NO: 31990 - DNA, 25 bp, Homo sapien
atgatgcttaaacccaatagaagcc

SEQ ID NO: 31991 - DNA, 25 bp, Homo sapien
atgatgcttaaacccattagaagcc

SEQ ID NO: 31992 - DNA, 25 bp, Homo sapien
atgatgggtgtccaaaaagtgttaa

SEQ ID NO: 31993 - DNA, 25 bp, Homo sapien
atgatgggtgttcaaaaagtgttaa

SEQ ID NO: 31994 - DNA, 25 bp, Homo sapien
atgatgtatggccgtgcaatgtgtt

SEQ ID NO: 31995 - DNA, 25 bp, Homo sapien
atgatgtatggctgtgcaatgtgtt

SEQ ID NO: 31996 - DNA, 25 bp, Homo sapien
atgatgtgctaaatgttgccagatg

SEQ ID NO: 31997 - DNA, 25 bp, Homo sapien
atgatgtgctaagtgttgccagatg

SEQ ID NO: 31998 - DNA, 25 bp, Homo sapien
atgatgtgctaatacatggtatcat

SEQ ID NO: 31999 - DNA, 25 bp, Homo sapien
atgatgtgctaatgcatggtatcat

SEQ ID NO: 32000 - DNA, 25 bp, Homo sapien
atgatgttacccagagcccagaaaa

SEQ ID NO: 32001 - DNA, 25 bp, Homo sapien
atgatgttatccagagcccagaaaa

SEQ ID NO: 32002 - DNA, 25 bp, Homo sapien
atgatgttccactaaggatgggtgc

SEQ ID NO: 32003 - DNA, 25 bp, Homo sapien
atgatgttccagtaaggatgggtgc

SEQ ID NO: 32004 - DNA, 25 bp, Homo sapien
atgatgttcccagctcatttggctt

SEQ ID NO: 32005 - DNA, 25 bp, Homo sapien
atgatgttcccaggtcatttggctt

SEQ ID NO: 32006 - DNA, 25 bp, Homo sapien
atgatgttcgtgttgcaatttgtac

SEQ ID NO: 32007 - DNA, 25 bp, Homo sapien
atgatgttgatgctcatgataatat

SEQ ID NO: 32008 - DNA, 25 bp, Homo sapien
atgatgttgatgctgatgataatat

SEQ ID NO: 32009 - DNA, 25 bp, Homo sapien
atgatgtttctggtatagggaagag

SEQ ID NO: 32010 - DNA, 25 bp, Homo sapien
atgatgtttctggtgtagggaagag

SEQ ID NO: 32011 - DNA, 25 bp, Homo sapien
atgatgtttgtgttgcaatttgtac

SEQ ID NO: 32012 - DNA, 25 bp, Homo sapien
atgattaaattcagctctggtgtag

SEQ ID NO: 32013 - DNA, 25 bp, Homo sapien
atgattaaatttagctctggtgtag

SEQ ID NO: 32014 - DNA, 25 bp, Homo sapien
atgattaatccatcttctatctaca

SEQ ID NO: 32015 - DNA, 25 bp, Homo sapien
atgattaatccgtcttctatctaca

SEQ ID NO: 32016 - DNA, 25 bp, Homo sapien
atgattacagagtgaagacatttca

SEQ ID NO: 32017 - DNA, 25 bp, Homo sapien
atgattacggagtgaagacatttca

SEQ ID NO: 32018 - DNA, 25 bp, Homo sapien
atgattagatgagtatagtgtgaag

SEQ ID NO: 32019 - DNA, 25 bp, Homo sapien
atgattagatgagtatcgtgtgaag

SEQ ID NO: 32020 - DNA, 25 bp, Homo sapien
atgattatgccaacattcacttact

SEQ ID NO: 32021 - DNA, 25 bp, Homo sapien
atgattattccaacattcacttact

SEQ ID NO: 32022 - DNA, 25 bp, Homo sapien
atgattcaaagacggttagaggatt

SEQ ID NO: 32023 - DNA, 25 bp, Homo sapien
atgattcaaagatggttagaggatt

SEQ ID NO: 32024 - DNA, 25 bp, Homo sapien
atgattcatcagcaacctaagagac

SEQ ID NO: 32025 - DNA, 25 bp, Homo sapien
atgattcatcagcagcctaagagac

SEQ ID NO: 32026 - DNA, 25 bp, Homo sapien
atgattccaggctaagattggacaa

SEQ ID NO: 32027 - DNA, 25 bp, Homo sapien
atgattccaggttaagattggacaa

SEQ ID NO: 32028 - DNA, 25 bp, Homo sapien
atgattctgctgatataaagtcaaa

SEQ ID NO: 32029 - DNA, 25 bp, Homo sapien
atgattctgctgatgtaaagtcaaa

SEQ ID NO: 32030 - DNA, 25 bp, Homo sapien
atgattcttaaataacatcatgcag

SEQ ID NO: 32031 - DNA, 25 bp, Homo sapien
atgattcttaagtaacatcatgcag

SEQ ID NO: 32032 - DNA, 25 bp, Homo sapien
atgattctttcttgcacccaagatt

SEQ ID NO: 32033 - DNA, 25 bp, Homo sapien
atgattctttctttcacccaagatt

SEQ ID NO: 32034 - DNA, 25 bp, Homo sapien
atgattgatgcacgccccttgttct

SEQ ID NO: 32035 - DNA, 25 bp, Homo sapien
atgattgatgcatgccccttgttct

SEQ ID NO: 32036 - DNA, 25 bp, Homo sapien
atgattgtagatgttcatcaggcat

SEQ ID NO: 32037 - DNA, 25 bp, Homo sapien
atgattgtagatgttcgtcaggcat

SEQ ID NO: 32038 - DNA, 25 bp, Homo sapien
atgattgtcacctcctgaattaaag

SEQ ID NO: 32039 - DNA, 25 bp, Homo sapien
atgattgtcgcctcctgaattaaag

SEQ ID NO: 32040 - DNA, 25 bp, Homo sapien
atgatttacaggcttttggcttgag

SEQ ID NO: 32041 - DNA, 25 bp, Homo sapien
atgatttacaggtttttggcttgag

SEQ ID NO: 32042 - DNA, 25 bp, Homo sapien
atgatttacggccagcttttgtaca

SEQ ID NO: 32043 - DNA, 25 bp, Homo sapien
atgatttatggccagcttttgtaca

SEQ ID NO: 32044 - DNA, 25 bp, Homo sapien
atgatttccattgcatttagagaac

SEQ ID NO: 32045 - DNA, 25 bp, Homo sapien
atgatttccattgcgtttagagaac

SEQ ID NO: 32046 - DNA, 25 bp, Homo sapien
atgatttctttcaattgtattcctt

SEQ ID NO: 32047 - DNA, 25 bp, Homo sapien
atgatttctttccacaatgtttgta

SEQ ID NO: 32048 - DNA, 25 bp, Homo sapien
atgatttctttccattgtattcctt

SEQ ID NO: 32049 - DNA, 25 bp, Homo sapien
atgatttctttccgcaatgtttgta

SEQ ID NO: 32050 - DNA, 25 bp, Homo sapien
atgattttctctgcaatttaacatt

SEQ ID NO: 32051 - DNA, 25 bp, Homo sapien
atgattttctcttcaatttaacatt

SEQ ID NO: 32052 - DNA, 25 bp, Homo sapien
atgatttttaacagcaagaaattaa

SEQ ID NO: 32053 - DNA, 25 bp, Homo sapien
atgatttttaacagtaagaaattaa

SEQ ID NO: 32054 - DNA, 25 bp, Homo sapien
atgatttttctctttggggaaactt

SEQ ID NO: 32055 - DNA, 25 bp, Homo sapien
atgatttttttctttggggaaactt

SEQ ID NO: 32056 - DNA, 25 bp, Homo sapien
atgcaaaaacatgaacttcagttca

SEQ ID NO: 32057 - DNA, 25 bp, Homo sapien
atgcaaaaatatgaacttcagttca

SEQ ID NO: 32058 - DNA, 25 bp, Homo sapien
atgcaaaactggcactgatggaggg

SEQ ID NO: 32059 - DNA, 25 bp, Homo sapien
atgcaaaagagcataagagctggga

SEQ ID NO: 32060 - DNA, 25 bp, Homo sapien
atgcaaaaggtacaaaaaccaatgg

SEQ ID NO: 32061 - DNA, 25 bp, Homo sapien
atgcaaaaggtacgaaaaccaatgg

SEQ ID NO: 32062 - DNA, 25 bp, Homo sapien
atgcaaaagtcccacatgtcctcat

SEQ ID NO: 32063 - DNA, 25 bp, Homo sapien
atgcaaaagtcccgcatgtcctcat

SEQ ID NO: 32064 - DNA, 25 bp, Homo sapien
atgcaaaatacaccagaaagtccca

SEQ ID NO: 32065 - DNA, 25 bp, Homo sapien
atgcaaaatacaccggaaagtccca

SEQ ID NO: 32066 - DNA, 25 bp, Homo sapien
atgcaaaatagcataagagctggga

SEQ ID NO: 32067 - DNA, 25 bp, Homo sapien
atgcaaaattggcactgatggaggg

SEQ ID NO: 32068 - DNA, 25 bp, Homo sapien
atgcaaactgacaggcttgaataaa

SEQ ID NO: 32069 - DNA, 25 bp, Homo sapien
atgcaaactgactggcttgaataaa

SEQ ID NO: 32070 - DNA, 25 bp, Homo sapien
atgcaaaggcgtaatgtggctacaa

SEQ ID NO: 32071 - DNA, 25 bp, Homo sapien
atgcaaaggtgtaatgtggctacaa

SEQ ID NO: 32072 - DNA, 25 bp, Homo sapien
atgcaaagtattaatcctgcgtgtg

SEQ ID NO: 32073 - DNA, 25 bp, Homo sapien
atgcaaagtattgatcctgcgtgtg

SEQ ID NO: 32074 - DNA, 25 bp, Homo sapien
atgcaaataatggatgacaaatgct

SEQ ID NO: 32075 - DNA, 25 bp, Homo sapien
atgcaaataatggatggcaaatgct

SEQ ID NO: 32076 - DNA, 25 bp, Homo sapien
atgcaaatgacagcttgttatcttc

SEQ ID NO: 32077 - DNA, 25 bp, Homo sapien
atgcaaatgagccttttttccttca

SEQ ID NO: 32078 - DNA, 25 bp, Homo sapien
atgcaaatgagtcttttttccttca

SEQ ID NO: 32079 - DNA, 25 bp, Homo sapien
atgcaaatggcagcttgttatcttc

SEQ ID NO: 32080 - DNA, 25 bp, Homo sapien
atgcaacaaacattcacatagaata

SEQ ID NO: 32081 - DNA, 25 bp, Homo sapien
atgcaacaaacgttcacatagaata

SEQ ID NO: 32082 - DNA, 25 bp, Homo sapien
atgcaacaccaaaagtgagccctaa

SEQ ID NO: 32083 - DNA, 25 bp, Homo sapien
atgcaacaccaagagtgagccctaa

SEQ ID NO: 32084 - DNA, 25 bp, Homo sapien
atgcaacactgagttttcctcaaaa

SEQ ID NO: 32085 - DNA, 25 bp, Homo sapien
atgcaacactgtgttttcctcaaaa

SEQ ID NO: 32086 - DNA, 25 bp, Homo sapien
atgcaacagaattcagtccagatga

SEQ ID NO: 32087 - DNA, 25 bp, Homo sapien
atgcaacataattcagtccagatga

SEQ ID NO: 32088 - DNA, 25 bp, Homo sapien
atgcaacctattttctgggttccaa

SEQ ID NO: 32089 - DNA, 25 bp, Homo sapien
atgcaacctcttttctgggttccaa

SEQ ID NO: 32090 - DNA, 25 bp, Homo sapien
atgcaagatttatgagtcatgaaaa

SEQ ID NO: 32091 - DNA, 25 bp, Homo sapien
atgcaagatttgtgagtcatgaaaa

SEQ ID NO: 32092 - DNA, 25 bp, Homo sapien
atgcaaggccatgcatggaaatatt

SEQ ID NO: 32093 - DNA, 25 bp, Homo sapien
atgcaagggtaaaaaataaacaagt

SEQ ID NO: 32094 - DNA, 25 bp, Homo sapien
atgcaagggtaagaaataaacaagt

SEQ ID NO: 32095 - DNA, 25 bp, Homo sapien
atgcaaggtcatgcatggaaatatt

SEQ ID NO: 32096 - DNA, 25 bp, Homo sapien
atgcaagtaagtcagattttgtttt

SEQ ID NO: 32097 - DNA, 25 bp, Homo sapien
atgcaagtgagtcagattttgtttt

SEQ ID NO: 32098 - DNA, 25 bp, Homo sapien
atgcaagttttcagcttattggcac

SEQ ID NO: 32099 - DNA, 25 bp, Homo sapien
atgcaagttttccgcttattggcac

SEQ ID NO: 32100 - DNA, 25 bp, Homo sapien
atgcaatacacagatgctctcctat

SEQ ID NO: 32101 - DNA, 25 bp, Homo sapien
atgcaatacacagatgttctcctat

SEQ ID NO: 32102 - DNA, 25 bp, Homo sapien
atgcaatatatacctgtaatcatat

SEQ ID NO: 32103 - DNA, 25 bp, Homo sapien
atgcaatatatatctgtaatcatat

SEQ ID NO: 32104 - DNA, 25 bp, Homo sapien
atgcaatcattgaccttgaaaatag

SEQ ID NO: 32105 - DNA, 25 bp, Homo sapien
atgcaatcgttgaccttgaaaatag

SEQ ID NO: 32106 - DNA, 25 bp, Homo sapien
atgcaatgaagacattggactgagt

SEQ ID NO: 32107 - DNA, 25 bp, Homo sapien
atgcaatgaagatattggactgagt

SEQ ID NO: 32108 - DNA, 25 bp, Homo sapien
atgcaatgctggagacatggtgaaa

SEQ ID NO: 32109 - DNA, 25 bp, Homo sapien
atgcaatgctggagacgtggtgaaa

SEQ ID NO: 32110 - DNA, 25 bp, Homo sapien
atgcaattagtggagactttaatag

SEQ ID NO: 32111 - DNA, 25 bp, Homo sapien
atgcaattagtggagattttaatag

SEQ ID NO: 32112 - DNA, 25 bp, Homo sapien
atgcaattccaacggctcagagcaa

SEQ ID NO: 32113 - DNA, 25 bp, Homo sapien
atgcaattccaagggctcagagcaa

SEQ ID NO: 32114 - DNA, 25 bp, Homo sapien
atgcaattccagctgaaatgggcaa

SEQ ID NO: 32115 - DNA, 25 bp, Homo sapien
atgcaattctagctgaaatgggcaa

SEQ ID NO: 32116 - DNA, 25 bp, Homo sapien
atgcaattgttccatcagagaattt

SEQ ID NO: 32117 - DNA, 25 bp, Homo sapien
atgcaattgttccgtcagagaattt

SEQ ID NO: 32118 - DNA, 25 bp, Homo sapien
atgcacaataccgacttataaaaag

SEQ ID NO: 32119 - DNA, 25 bp, Homo sapien
atgcacaatactgacttataaaaag

SEQ ID NO: 32120 - DNA, 25 bp, Homo sapien
atgcacacttgaataattagtgttt

SEQ ID NO: 32121 - DNA, 25 bp, Homo sapien
atgcacacttggataattagtgttt

SEQ ID NO: 32122 - DNA, 25 bp, Homo sapien
atgcacagaaacagggcagcacaag

SEQ ID NO: 32123 - DNA, 25 bp, Homo sapien
atgcacagaaacggggcagcacaag

SEQ ID NO: 32124 - DNA, 25 bp, Homo sapien
atgcacataaaaaaaattcaacacc

SEQ ID NO: 32125 - DNA, 25 bp, Homo sapien
atgcacataaaaaacattcaacacc

SEQ ID NO: 32126 - DNA, 25 bp, Homo sapien
atgcacatattgtagcttgggaact

SEQ ID NO: 32127 - DNA, 25 bp, Homo sapien
atgcacatcacaaagacataccatt

SEQ ID NO: 32128 - DNA, 25 bp, Homo sapien
atgcacatgttgtagcttgggaact

SEQ ID NO: 32129 - DNA, 25 bp, Homo sapien
atgcacattacaaagacataccatt

SEQ ID NO: 32130 - DNA, 25 bp, Homo sapien
atgcacattcataattgcaaaattc

SEQ ID NO: 32131 - DNA, 25 bp, Homo sapien
atgcacattcatcattgcaaaattc

SEQ ID NO: 32132 - DNA, 25 bp, Homo sapien
atgcaccaatacttttaacggagcc

SEQ ID NO: 32133 - DNA, 25 bp, Homo sapien
atgcaccagtacttttaacggagcc

SEQ ID NO: 32134 - DNA, 25 bp, Homo sapien
atgcacccgtttatacttggtgtcc

SEQ ID NO: 32135 - DNA, 25 bp, Homo sapien
atgcacccgtttttacttggtgtcc

SEQ ID NO: 32136 - DNA, 25 bp, Homo sapien
atgcacctgaagaactgtttcacct

SEQ ID NO: 32137 - DNA, 25 bp, Homo sapien
atgcacctgaagaactttttcacct

SEQ ID NO: 32138 - DNA, 25 bp, Homo sapien
atgcaccttctctgtcccatctctt

SEQ ID NO: 32139 - DNA, 25 bp, Homo sapien
atgcaccttctctttcccatctctt

SEQ ID NO: 32140 - DNA, 25 bp, Homo sapien
atgcacttgaaataaggatctactg

SEQ ID NO: 32141 - DNA, 25 bp, Homo sapien
atgcacttgaagtaaggatctactg

SEQ ID NO: 32142 - DNA, 25 bp, Homo sapien
atgcacttgttatagaataataaac

SEQ ID NO: 32143 - DNA, 25 bp, Homo sapien
atgcacttgttatataataataaac

SEQ ID NO: 32144 - DNA, 25 bp, Homo sapien
atgcagaaactacagccttgttctt

SEQ ID NO: 32145 - DNA, 25 bp, Homo sapien
atgcagaaactacggccttgttctt

SEQ ID NO: 32146 - DNA, 25 bp, Homo sapien
atgcagaaaggtcttgcctctaaag

SEQ ID NO: 32147 - DNA, 25 bp, Homo sapien
atgcagaaaggtcttgtctctaaag

SEQ ID NO: 32148 - DNA, 25 bp, Homo sapien
atgcagaaatagtaaatttgacaac

SEQ ID NO: 32149 - DNA, 25 bp, Homo sapien
atgcagaaatagtcaatttgacaac

SEQ ID NO: 32150 - DNA, 25 bp, Homo sapien
atgcagaaatgagagaggaacatgg

SEQ ID NO: 32151 - DNA, 25 bp, Homo sapien
atgcagaagtgagagaggaacatgg

SEQ ID NO: 32152 - DNA, 25 bp, Homo sapien
atgcagaggtttggctacacagatg

SEQ ID NO: 32153 - DNA, 25 bp, Homo sapien
atgcagaggtttggttacacagatg

SEQ ID NO: 32154 - DNA, 25 bp, Homo sapien
atgcagagtttcacaacataaatga

SEQ ID NO: 32155 - DNA, 25 bp, Homo sapien
atgcagagttttacaacataaatga

SEQ ID NO: 32156 - DNA, 25 bp, Homo sapien
atgcagatgacaggctgaaaggttt

SEQ ID NO: 32157 - DNA, 25 bp, Homo sapien
atgcagatgacgggctgaaaggttt

SEQ ID NO: 32158 - DNA, 25 bp, Homo sapien
atgcagatgacttcagatacagaaa

SEQ ID NO: 32159 - DNA, 25 bp, Homo sapien
atgcagatgacttcaggtacagaaa

SEQ ID NO: 32160 - DNA, 25 bp, Homo sapien
atgcagattcgttttcacccttgag

SEQ ID NO: 32161 - DNA, 25 bp, Homo sapien
atgcagatttgttttcacccttgag

SEQ ID NO: 32162 - DNA, 25 bp, Homo sapien
atgcagcagatcattcagctctttc

SEQ ID NO: 32163 - DNA, 25 bp, Homo sapien
atgcagcagatctttcagctctttc

SEQ ID NO: 32164 - DNA, 25 bp, Homo sapien
atgcagcaggccgacaatcataggc

SEQ ID NO: 32165 - DNA, 25 bp, Homo sapien
atgcagcaggccgacagtcataggc

SEQ ID NO: 32166 - DNA, 25 bp, Homo sapien
atgcagctactgagagagatgccag

SEQ ID NO: 32167 - DNA, 25 bp, Homo sapien
atgcagctattgagagagatgccag

SEQ ID NO: 32168 - DNA, 25 bp, Homo sapien
atgcagcttaccaatgacggtcttc

SEQ ID NO: 32169 - DNA, 25 bp, Homo sapien
atgcagcttaccagtgacggtcttc

SEQ ID NO: 32170 - DNA, 25 bp, Homo sapien
atgcagggctgaacccagtctaaat

SEQ ID NO: 32171 - DNA, 25 bp, Homo sapien
atgcagggctggacccagtctaaat

SEQ ID NO: 32172 - DNA, 25 bp, Homo sapien
atgcaggtatagaagtctgatgctg

SEQ ID NO: 32173 - DNA, 25 bp, Homo sapien
atgcaggtataggagtctgatgctg

SEQ ID NO: 32174 - DNA, 25 bp, Homo sapien
atgcaggtggaccccgtgtcataaa

SEQ ID NO: 32175 - DNA, 25 bp, Homo sapien
atgcaggtggaccctgtgtcataaa

SEQ ID NO: 32176 - DNA, 25 bp, Homo sapien
atgcagtatatccaaagtttaattc

SEQ ID NO: 32177 - DNA, 25 bp, Homo sapien
atgcagtatatccgaagtttaattc

SEQ ID NO: 32178 - DNA, 25 bp, Homo sapien
atgcagtcaggtgaaacttaaaaga

SEQ ID NO: 32179 - DNA, 25 bp, Homo sapien
atgcagtcaggtgacacttaaaaga

SEQ ID NO: 32180 - DNA, 25 bp, Homo sapien
atgcagtccagcagaccatctaggg

SEQ ID NO: 32181 - DNA, 25 bp, Homo sapien
atgcagtccagcggaccatctaggg

SEQ ID NO: 32182 - DNA, 25 bp, Homo sapien
atgcagtgaatacaaactcattctc

SEQ ID NO: 32183 - DNA, 25 bp, Homo sapien
atgcagtgaatataaactcattctc

SEQ ID NO: 32184 - DNA, 25 bp, Homo sapien
atgcagtgcggtgttcagagcctgg

SEQ ID NO: 32185 - DNA, 25 bp, Homo sapien
atgcagtgctttgatgaataataaa

SEQ ID NO: 32186 - DNA, 25 bp, Homo sapien
atgcagtgctttggtgaataataaa

SEQ ID NO: 32187 - DNA, 25 bp, Homo sapien
atgcagtgtggtgttcagagcctgg

SEQ ID NO: 32188 - DNA, 25 bp, Homo sapien
atgcagttcagtggaatgttagaga

SEQ ID NO: 32189 - DNA, 25 bp, Homo sapien
atgcagttcagtgtaatgttagaga

SEQ ID NO: 32190 - DNA, 25 bp, Homo sapien
atgcagttgtaacaaatgacataaa

SEQ ID NO: 32191 - DNA, 25 bp, Homo sapien
atgcagttgtaacgaatgacataaa

SEQ ID NO: 32192 - DNA, 25 bp, Homo sapien
atgcatacacctacttcctttttat

SEQ ID NO: 32193 - DNA, 25 bp, Homo sapien
atgcatactcctacttcctttttat

SEQ ID NO: 32194 - DNA, 25 bp, Homo sapien
atgcatacttatatggccaatagcg

SEQ ID NO: 32195 - DNA, 25 bp, Homo sapien
atgcatacttatttggccaatagcg

SEQ ID NO: 32196 - DNA, 25 bp, Homo sapien
atgcatagaacctataatcaacttt

SEQ ID NO: 32197 - DNA, 25 bp, Homo sapien
atgcatagaacctatagtcaacttt

SEQ ID NO: 32198 - DNA, 25 bp, Homo sapien
atgcatataaggagatggtagtcat

SEQ ID NO: 32199 - DNA, 25 bp, Homo sapien
atgcatataaggagttggtagtcat

SEQ ID NO: 32200 - DNA, 25 bp, Homo sapien
atgcatatacccatcacctccattc

SEQ ID NO: 32201 - DNA, 25 bp, Homo sapien
atgcatatacctatcacctccattc

SEQ ID NO: 32202 - DNA, 25 bp, Homo sapien
atgcatatgctttgcagtaacatgg

SEQ ID NO: 32203 - DNA, 25 bp, Homo sapien
atgcatatgctttgtagtaacatgg

SEQ ID NO: 32204 - DNA, 25 bp, Homo sapien
atgcatatttgcctggatttggcct

SEQ ID NO: 32205 - DNA, 25 bp, Homo sapien
atgcatatttgcctgggtttggcct

SEQ ID NO: 32206 - DNA, 25 bp, Homo sapien
atgcatcaacctatcgtcagtcaaa

SEQ ID NO: 32207 - DNA, 25 bp, Homo sapien
atgcatcaagctatcgtcagtcaaa

SEQ ID NO: 32208 - DNA, 25 bp, Homo sapien
atgcatcactcatctaaaagggctg

SEQ ID NO: 32209 - DNA, 25 bp, Homo sapien
atgcatcattaaatagagacataag

SEQ ID NO: 32210 - DNA, 25 bp, Homo sapien
atgcatcattaagtagagacataag

SEQ ID NO: 32211 - DNA, 25 bp, Homo sapien
atgcatcattcatctaaaagggctg

SEQ ID NO: 32212 - DNA, 25 bp, Homo sapien
atgcatgaaaacaccttcacaaaga

SEQ ID NO: 32213 - DNA, 25 bp, Homo sapien
atgcatgaaaataccttcacaaaga

SEQ ID NO: 32214 - DNA, 25 bp, Homo sapien
atgcatgaatgtaaggtatgaatcc

SEQ ID NO: 32215 - DNA, 25 bp, Homo sapien
atgcatgacaaatggcctgtaaact

SEQ ID NO: 32216 - DNA, 25 bp, Homo sapien
atgcatgaggttaagagcaatattt

SEQ ID NO: 32217 - DNA, 25 bp, Homo sapien
atgcatgaggttgagagcaatattt

SEQ ID NO: 32218 - DNA, 25 bp, Homo sapien
atgcatgataaatggcctgtaaact

SEQ ID NO: 32219 - DNA, 25 bp, Homo sapien
atgcatgattgtaaggtatgaatcc

SEQ ID NO: 32220 - DNA, 25 bp, Homo sapien
atgcatgcacctgattagtggaacc

SEQ ID NO: 32221 - DNA, 25 bp, Homo sapien
atgcatgcatctgattagtggaacc

SEQ ID NO: 32222 - DNA, 25 bp, Homo sapien
atgcatgccctgaatctaaaataga

SEQ ID NO: 32223 - DNA, 25 bp, Homo sapien
atgcatgccctgcatctaaaataga

SEQ ID NO: 32224 - DNA, 25 bp, Homo sapien
atgcatgctctttaaatagaaaagg

SEQ ID NO: 32225 - DNA, 25 bp, Homo sapien
atgcatgctttttaaatagaaaagg

SEQ ID NO: 32226 - DNA, 25 bp, Homo sapien
atgcatggaagccactgggttcatc

SEQ ID NO: 32227 - DNA, 25 bp, Homo sapien
atgcatggaagccattgggttcatc

SEQ ID NO: 32228 - DNA, 25 bp, Homo sapien
atgcatgtgaaacactactgaatga

SEQ ID NO: 32229 - DNA, 25 bp, Homo sapien
atgcatgtgaagcactactgaatga

SEQ ID NO: 32230 - DNA, 25 bp, Homo sapien
atgcatgtgttacaaagaatgagcc

SEQ ID NO: 32231 - DNA, 25 bp, Homo sapien
atgcatgttttacaaagaatgagcc

SEQ ID NO: 32232 - DNA, 25 bp, Homo sapien
atgcattctttactaagcggtctca

SEQ ID NO: 32233 - DNA, 25 bp, Homo sapien
atgcattctttagtaagcggtctca

SEQ ID NO: 32234 - DNA, 25 bp, Homo sapien
atgcattgtatctgccactgattgc

SEQ ID NO: 32235 - DNA, 25 bp, Homo sapien
atgcattgtatctgccgctgattgc

SEQ ID NO: 32236 - DNA, 25 bp, Homo sapien
atgcattgtttcatatgccaattgt

SEQ ID NO: 32237 - DNA, 25 bp, Homo sapien
atgcattgtttcgtatgccaattgt

SEQ ID NO: 32238 - DNA, 25 bp, Homo sapien
atgcatttaagcagatgtcaagggg

SEQ ID NO: 32239 - DNA, 25 bp, Homo sapien
atgcatttaaggagatgtcaagggg

SEQ ID NO: 32240 - DNA, 25 bp, Homo sapien
atgcatttcacagcctcttctcaag

SEQ ID NO: 32241 - DNA, 25 bp, Homo sapien
atgcatttcacatcctcttctcaag

SEQ ID NO: 32242 - DNA, 25 bp, Homo sapien
atgcatttccttcgtgtccaagcta

SEQ ID NO: 32243 - DNA, 25 bp, Homo sapien
atgcatttcctttgtgtccaagcta

SEQ ID NO: 32244 - DNA, 25 bp, Homo sapien
atgcatttcggccatgaggttaaag

SEQ ID NO: 32245 - DNA, 25 bp, Homo sapien
atgcatttctccataccaagaaaat

SEQ ID NO: 32246 - DNA, 25 bp, Homo sapien
atgcatttctccgtaccaagaaaat

SEQ ID NO: 32247 - DNA, 25 bp, Homo sapien
atgcatttggctccaagagagatga

SEQ ID NO: 32248 - DNA, 25 bp, Homo sapien
atgcatttggctccaatagagatga

SEQ ID NO: 32249 - DNA, 25 bp, Homo sapien
atgcattttgaccatcttttacact

SEQ ID NO: 32250 - DNA, 25 bp, Homo sapien
atgcattttgactatcttttacact

SEQ ID NO: 32251 - DNA, 25 bp, Homo sapien
atgcattttggccatgaggttaaag

SEQ ID NO: 32252 - DNA, 25 bp, Homo sapien
atgcattttgtcatttcgggatgag

SEQ ID NO: 32253 - DNA, 25 bp, Homo sapien
atgcattttgtcattttgggatgag

SEQ ID NO: 32254 - DNA, 25 bp, Homo sapien
atgcattttgtgtatgataaagaat

SEQ ID NO: 32255 - DNA, 25 bp, Homo sapien
atgcattttttgtatgataaagaat

SEQ ID NO: 32256 - DNA, 25 bp, Homo sapien
atgccaaaaatatgctctcaaaggg

SEQ ID NO: 32257 - DNA, 25 bp, Homo sapien
atgccaaaacggaaagtcaagattc

SEQ ID NO: 32258 - DNA, 25 bp, Homo sapien
atgccaaaatggaaagtcaagattc

SEQ ID NO: 32259 - DNA, 25 bp, Homo sapien
atgccaaacatatgctctcaaaggg

SEQ ID NO: 32260 - DNA, 25 bp, Homo sapien
atgccaaaggacagtgaggccataa

SEQ ID NO: 32261 - DNA, 25 bp, Homo sapien
atgccaaaggacagtgtggccataa

SEQ ID NO: 32262 - DNA, 25 bp, Homo sapien
atgccaaattcaggaaattaacaaa

SEQ ID NO: 32263 - DNA, 25 bp, Homo sapien
atgccaaattcgggaaattaacaaa

SEQ ID NO: 32264 - DNA, 25 bp, Homo sapien
atgccaagtggaataagccagacac

SEQ ID NO: 32265 - DNA, 25 bp, Homo sapien
atgccaagtggagtaagccagacac

SEQ ID NO: 32266 - DNA, 25 bp, Homo sapien
atgccaatcaagaagaaaggaggag

SEQ ID NO: 32267 - DNA, 25 bp, Homo sapien
atgccaatcaagaggaaaggaggag

SEQ ID NO: 32268 - DNA, 25 bp, Homo sapien
atgccaatcatcagtagcacgcacc

SEQ ID NO: 32269 - DNA, 25 bp, Homo sapien
atgccaatcatcggtagcacgcacc

SEQ ID NO: 32270 - DNA, 25 bp, Homo sapien
atgccaatcgatactctgacaagga

SEQ ID NO: 32271 - DNA, 25 bp, Homo sapien
atgccaatctgagagcattgttagg

SEQ ID NO: 32272 - DNA, 25 bp, Homo sapien
atgccaatctgagagcgttgttagg

SEQ ID NO: 32273 - DNA, 25 bp, Homo sapien
atgccaattatagaacaaaatttaa

SEQ ID NO: 32274 - DNA, 25 bp, Homo sapien
atgccaattatagaaccaaatttaa

SEQ ID NO: 32275 - DNA, 25 bp, Homo sapien
atgccaattgatactctgacaagga

SEQ ID NO: 32276 - DNA, 25 bp, Homo sapien
atgccacaacaagaatgattagtga

SEQ ID NO: 32277 - DNA, 25 bp, Homo sapien
atgccacaacatgactggaatgctc

SEQ ID NO: 32278 - DNA, 25 bp, Homo sapien
atgccacaacatggctggaatgctc

SEQ ID NO: 32279 - DNA, 25 bp, Homo sapien
atgccacaagaaaggaacagagttt

SEQ ID NO: 32280 - DNA, 25 bp, Homo sapien
atgccacaagagaggaacagagttt

SEQ ID NO: 32281 - DNA, 25 bp, Homo sapien
atgccacaataagaatgattagtga

SEQ ID NO: 32282 - DNA, 25 bp, Homo sapien
atgccaccattgacttcagttgagg

SEQ ID NO: 32283 - DNA, 25 bp, Homo sapien
atgccaccgttgacttcagttgagg

SEQ ID NO: 32284 - DNA, 25 bp, Homo sapien
atgccactaatcattagggaaatgc

SEQ ID NO: 32285 - DNA, 25 bp, Homo sapien
atgccactaatcgttagggaaatgc

SEQ ID NO: 32286 - DNA, 25 bp, Homo sapien
atgccactccataaatttgttcttt

SEQ ID NO: 32287 - DNA, 25 bp, Homo sapien
atgccactctataaatttgttcttt

SEQ ID NO: 32288 - DNA, 25 bp, Homo sapien
atgccagataaaagacatgaattat

SEQ ID NO: 32289 - DNA, 25 bp, Homo sapien
atgccagataaaaggcatgaattat

SEQ ID NO: 32290 - DNA, 25 bp, Homo sapien
atgccagatcactgaaggcagatat

SEQ ID NO: 32291 - DNA, 25 bp, Homo sapien
atgccagatcattgaaggcagatat

SEQ ID NO: 32292 - DNA, 25 bp, Homo sapien
atgccagcagaatgcactaggacct

SEQ ID NO: 32293 - DNA, 25 bp, Homo sapien
atgccagcagaatgcagtaggacct

SEQ ID NO: 32294 - DNA, 25 bp, Homo sapien
atgccatgtcggacttcagaactat

SEQ ID NO: 32295 - DNA, 25 bp, Homo sapien
atgccatgttggacttcagaactat

SEQ ID NO: 32296 - DNA, 25 bp, Homo sapien
atgccattagataactttagatgct

SEQ ID NO: 32297 - DNA, 25 bp, Homo sapien
atgccattatataactttagatgct

SEQ ID NO: 32298 - DNA, 25 bp, Homo sapien
atgccattcaagaataaaaatgatt

SEQ ID NO: 32299 - DNA, 25 bp, Homo sapien
atgccattcaaggataaaaatgatt

SEQ ID NO: 32300 - DNA, 25 bp, Homo sapien
atgccattgttttacttgttgttat

SEQ ID NO: 32301 - DNA, 25 bp, Homo sapien
atgccattgttttgcttgttgttat

SEQ ID NO: 32302 - DNA, 25 bp, Homo sapien
atgcccactcttctgcccagaggcc

SEQ ID NO: 32303 - DNA, 25 bp, Homo sapien
atgcccactttcatttctctagtgg

SEQ ID NO: 32304 - DNA, 25 bp, Homo sapien
atgcccacttttatttctctagtgg

SEQ ID NO: 32305 - DNA, 25 bp, Homo sapien
atgcccacttttctgcccagaggcc

SEQ ID NO: 32306 - DNA, 25 bp, Homo sapien
atgcccagagattggatttaggtga

SEQ ID NO: 32307 - DNA, 25 bp, Homo sapien
atgcccagagatttgatttaggtga

SEQ ID NO: 32308 - DNA, 25 bp, Homo sapien
atgcccagatgctgaaagaacattt

SEQ ID NO: 32309 - DNA, 25 bp, Homo sapien
atgcccagatgctggaagaacattt

SEQ ID NO: 32310 - DNA, 25 bp, Homo sapien
atgcccattatgaacaaggcactgg

SEQ ID NO: 32311 - DNA, 25 bp, Homo sapien
atgcccattatgagcaaggcactgg

SEQ ID NO: 32312 - DNA, 25 bp, Homo sapien
atgccccagtgctcgtctggtctaa

SEQ ID NO: 32313 - DNA, 25 bp, Homo sapien
atgccccagtgcttgtctggtctaa

SEQ ID NO: 32314 - DNA, 25 bp, Homo sapien
atgcccctgtctgacatcggtgtct

SEQ ID NO: 32315 - DNA, 25 bp, Homo sapien
atgcccctgtctggcatcggtgtct

SEQ ID NO: 32316 - DNA, 25 bp, Homo sapien
atgcccggctgcatacatagcagtc

SEQ ID NO: 32317 - DNA, 25 bp, Homo sapien
atgcccggctgcatacgtagcagtc

SEQ ID NO: 32318 - DNA, 25 bp, Homo sapien
atgccctcaagcgatgccttttcct

SEQ ID NO: 32319 - DNA, 25 bp, Homo sapien
atgccctcaagtgatgccttttcct

SEQ ID NO: 32320 - DNA, 25 bp, Homo sapien
atgccctcctctttagtttagtgtg

SEQ ID NO: 32321 - DNA, 25 bp, Homo sapien
atgccctcctcttttgtttagtgtg

SEQ ID NO: 32322 - DNA, 25 bp, Homo sapien
atgccctgatactaatgggagacaa

SEQ ID NO: 32323 - DNA, 25 bp, Homo sapien
atgccctgatagtaatgggagacaa

SEQ ID NO: 32324 - DNA, 25 bp, Homo sapien
atgcccttctgcatatagccatctc

SEQ ID NO: 32325 - DNA, 25 bp, Homo sapien
atgccctttcaaggagcctacagcc

SEQ ID NO: 32326 - DNA, 25 bp, Homo sapien
atgccctttcatggagcctacagcc

SEQ ID NO: 32327 - DNA, 25 bp, Homo sapien
atgcccttttcaagactcaacacac

SEQ ID NO: 32328 - DNA, 25 bp, Homo sapien
atgcccttttcaaggctcaacacac

SEQ ID NO: 32329 - DNA, 25 bp, Homo sapien
atgcccttttgcatatagccatctc

SEQ ID NO: 32330 - DNA, 25 bp, Homo sapien
atgccgaatttacgaacagctgtgg

SEQ ID NO: 32331 - DNA, 25 bp, Homo sapien
atgccgaatttatgaacagctgtgg

SEQ ID NO: 32332 - DNA, 25 bp, Homo sapien
atgccggttacgtcctcactgttgt

SEQ ID NO: 32333 - DNA, 25 bp, Homo sapien
atgccggttgcgtcctcactgttgt

SEQ ID NO: 32334 - DNA, 25 bp, Homo sapien
atgcctacccgattctgatagtttc

SEQ ID NO: 32335 - DNA, 25 bp, Homo sapien
atgcctacctgattctgatagtttc

SEQ ID NO: 32336 - DNA, 25 bp, Homo sapien
atgcctagaagctcctccaaatgaa

SEQ ID NO: 32337 - DNA, 25 bp, Homo sapien
atgcctagaagctcttccaaatgaa

SEQ ID NO: 32338 - DNA, 25 bp, Homo sapien
atgcctcaattaaagtaatagcatc

SEQ ID NO: 32339 - DNA, 25 bp, Homo sapien
atgcctcaattacagtaatagcatc

SEQ ID NO: 32340 - DNA, 25 bp, Homo sapien
atgcctcactttactcctctgtaaa

SEQ ID NO: 32341 - DNA, 25 bp, Homo sapien
atgcctcactttattcctctgtaaa

SEQ ID NO: 32342 - DNA, 25 bp, Homo sapien
atgcctctccactcgcaaagtcaaa

SEQ ID NO: 32343 - DNA, 25 bp, Homo sapien
atgcctctctactcgcaaagtcaaa

SEQ ID NO: 32344 - DNA, 25 bp, Homo sapien
atgcctgaataattttttgtagaga

SEQ ID NO: 32345 - DNA, 25 bp, Homo sapien
atgcctgagtaattttttgtagaga

SEQ ID NO: 32346 - DNA, 25 bp, Homo sapien
atgcctgcacttcctagaagggcaa

SEQ ID NO: 32347 - DNA, 25 bp, Homo sapien
atgcctgcagttgtcaaggccatgg

SEQ ID NO: 32348 - DNA, 25 bp, Homo sapien
atgcctgccaacgcaacatccattc

SEQ ID NO: 32349 - DNA, 25 bp, Homo sapien
atgcctgccaatgcaacatccattc

SEQ ID NO: 32350 - DNA, 25 bp, Homo sapien
atgcctgcgcttcctagaagggcaa

SEQ ID NO: 32351 - DNA, 25 bp, Homo sapien
atgcctgcggttgtcaaggccatgg

SEQ ID NO: 32352 - DNA, 25 bp, Homo sapien
atgcctggaattgacactgttgctt

SEQ ID NO: 32353 - DNA, 25 bp, Homo sapien
atgcctggaattgacagtgttgctt

SEQ ID NO: 32354 - DNA, 25 bp, Homo sapien
atgcctggcaacgttctgggtgctg

SEQ ID NO: 32355 - DNA, 25 bp, Homo sapien
atgcctggcaatgttctgggtgctg

SEQ ID NO: 32356 - DNA, 25 bp, Homo sapien
atgcctggtgccgcacttgctgggt

SEQ ID NO: 32357 - DNA, 25 bp, Homo sapien
atgcctggtgcctcacttgctgggt

SEQ ID NO: 32358 - DNA, 25 bp, Homo sapien
atgcctgtaaagtttctcattcaac

SEQ ID NO: 32359 - DNA, 25 bp, Homo sapien
atgcctgtcattgaaccaggagtca

SEQ ID NO: 32360 - DNA, 25 bp, Homo sapien
atgcctgtcgttgaaccaggagtca

SEQ ID NO: 32361 - DNA, 25 bp, Homo sapien
atgcctgtgatgtgactaactttta

SEQ ID NO: 32362 - DNA, 25 bp, Homo sapien
atgcctgtgatttgactaactttta

SEQ ID NO: 32363 - DNA, 25 bp, Homo sapien
atgcctgttaagtttctcattcaac

SEQ ID NO: 32364 - DNA, 25 bp, Homo sapien
atgccttatattccagcgagggcaa

SEQ ID NO: 32365 - DNA, 25 bp, Homo sapien
atgccttatggcaatgtagaagaaa

SEQ ID NO: 32366 - DNA, 25 bp, Homo sapien
atgccttatgttccagcgagggcaa

SEQ ID NO: 32367 - DNA, 25 bp, Homo sapien
atgccttattgcaatgtagaagaaa

SEQ ID NO: 32368 - DNA, 25 bp, Homo sapien
atgccttcaaattttttcttgattg

SEQ ID NO: 32369 - DNA, 25 bp, Homo sapien
atgccttcctgagcgagtactgggt

SEQ ID NO: 32370 - DNA, 25 bp, Homo sapien
atgccttcctgagcgattactgggt

SEQ ID NO: 32371 - DNA, 25 bp, Homo sapien
atgccttcctttgtacttcagtgca

SEQ ID NO: 32372 - DNA, 25 bp, Homo sapien
atgccttctaattttttcttgattg

SEQ ID NO: 32373 - DNA, 25 bp, Homo sapien
atgccttcttttgtacttcagtgca

SEQ ID NO: 32374 - DNA, 25 bp, Homo sapien
atgccttgaccaaacacggaaatag

SEQ ID NO: 32375 - DNA, 25 bp, Homo sapien
atgccttgaccaaacatggaaatag

SEQ ID NO: 32376 - DNA, 25 bp, Homo sapien
atgccttgatgacactcgttttgta

SEQ ID NO: 32377 - DNA, 25 bp, Homo sapien
atgccttgatgatactcgttttgta

SEQ ID NO: 32378 - DNA, 25 bp, Homo sapien
atgccttgcctttcaatctttcact

SEQ ID NO: 32379 - DNA, 25 bp, Homo sapien
atgccttgcttttcaatctttcact

SEQ ID NO: 32380 - DNA, 25 bp, Homo sapien
atgccttgggggctttctttagaat

SEQ ID NO: 32381 - DNA, 25 bp, Homo sapien
atgccttgggggctttgtttagaat

SEQ ID NO: 32382 - DNA, 25 bp, Homo sapien
atgccttgggtcattggtcccattc

SEQ ID NO: 32383 - DNA, 25 bp, Homo sapien
atgccttgggtcgttggtcccattc

SEQ ID NO: 32384 - DNA, 25 bp, Homo sapien
atgcctttattcagatgatcctaca

SEQ ID NO: 32385 - DNA, 25 bp, Homo sapien
atgcctttattcagattatcctaca

SEQ ID NO: 32386 - DNA, 25 bp, Homo sapien
atgccttttgagtaaacaaaattat

SEQ ID NO: 32387 - DNA, 25 bp, Homo sapien
atgccttttgattaaacaaaattat

SEQ ID NO: 32388 - DNA, 25 bp, Homo sapien
atgcgaccactgaatactactgagt

SEQ ID NO: 32389 - DNA, 25 bp, Homo sapien
atgcgaccactgaatattactgagt

SEQ ID NO: 32390 - DNA, 25 bp, Homo sapien
atgcgatgaaatttctgatttgtaa

SEQ ID NO: 32391 - DNA, 25 bp, Homo sapien
atgcgatgaaatttgtgatttgtaa

SEQ ID NO: 32392 - DNA, 25 bp, Homo sapien
atgcgcagtttaaaaatttccagga

SEQ ID NO: 32393 - DNA, 25 bp, Homo sapien
atgcgcagttttaaaatttccagga

SEQ ID NO: 32394 - DNA, 25 bp, Homo sapien
atgcgctttctaatgtctgagtgaa

SEQ ID NO: 32395 - DNA, 25 bp, Homo sapien
atgcgctttctactgtctgagtgaa

SEQ ID NO: 32396 - DNA, 25 bp, Homo sapien
atgcggtttacaaacattttctcac

SEQ ID NO: 32397 - DNA, 25 bp, Homo sapien
atgcggtttacaaatattttctcac

SEQ ID NO: 32398 - DNA, 25 bp, Homo sapien
atgcgtacaagccgctgtgccgccc

SEQ ID NO: 32399 - DNA, 25 bp, Homo sapien
atgcgtacaagcctctgtgccgccc

SEQ ID NO: 32400 - DNA, 25 bp, Homo sapien
atgcgtacctgcgctaagagaagtt

SEQ ID NO: 32401 - DNA, 25 bp, Homo sapien
atgcgtacctgctctaagagaagtt

SEQ ID NO: 32402 - DNA, 25 bp, Homo sapien
atgcgttcctcatgcactctgttgt

SEQ ID NO: 32403 - DNA, 25 bp, Homo sapien
atgcgttcctcatgcattctgttgt

SEQ ID NO: 32404 - DNA, 25 bp, Homo sapien
atgctaaaatgatgtgtaaaatata

SEQ ID NO: 32405 - DNA, 25 bp, Homo sapien
atgctaaagtgatgtgtaaaatata

SEQ ID NO: 32406 - DNA, 25 bp, Homo sapien
atgctaaatttcaggccttgtggca

SEQ ID NO: 32407 - DNA, 25 bp, Homo sapien
atgctaaatttcgggccttgtggca

SEQ ID NO: 32408 - DNA, 25 bp, Homo sapien
atgctaagtcagagtttcagctgta

SEQ ID NO: 32409 - DNA, 25 bp, Homo sapien
atgctaagtcagtgtttcagctgta

SEQ ID NO: 32410 - DNA, 25 bp, Homo sapien
atgctaatatacatcgcttggagtt

SEQ ID NO: 32411 - DNA, 25 bp, Homo sapien
atgctaatatacatggcttggagtt

SEQ ID NO: 32412 - DNA, 25 bp, Homo sapien
atgctaattctacaccaattcttcc

SEQ ID NO: 32413 - DNA, 25 bp, Homo sapien
atgctaattctacacctattcttcc

SEQ ID NO: 32414 - DNA, 25 bp, Homo sapien
atgctacactacacaacttgataca

SEQ ID NO: 32415 - DNA, 25 bp, Homo sapien
atgctacactatacaacttgataca

SEQ ID NO: 32416 - DNA, 25 bp, Homo sapien
atgctacttttagcgatggcaactt

SEQ ID NO: 32417 - DNA, 25 bp, Homo sapien
atgctacttttagtgatggcaactt

SEQ ID NO: 32418 - DNA, 25 bp, Homo sapien
atgctagaacttcactcccagagaa

SEQ ID NO: 32419 - DNA, 25 bp, Homo sapien
atgctagagcttcactcccagagaa

SEQ ID NO: 32420 - DNA, 25 bp, Homo sapien
atgctaggtcagcgatcagcaccaa

SEQ ID NO: 32421 - DNA, 25 bp, Homo sapien
atgctaggtcagtgatcagcaccaa

SEQ ID NO: 32422 - DNA, 25 bp, Homo sapien
atgctagtggcgttcagtggtttaa

SEQ ID NO: 32423 - DNA, 25 bp, Homo sapien
atgctagtggctttcagtggtttaa

SEQ ID NO: 32424 - DNA, 25 bp, Homo sapien
atgctataacaaaagggtcttccat

SEQ ID NO: 32425 - DNA, 25 bp, Homo sapien
atgctataacaacagggtcttccat

SEQ ID NO: 32426 - DNA, 25 bp, Homo sapien
atgctattggctttccctcgctagc

SEQ ID NO: 32427 - DNA, 25 bp, Homo sapien
atgctattgggccacatgtagccta

SEQ ID NO: 32428 - DNA, 25 bp, Homo sapien
atgctattgggtcacatgtagccta

SEQ ID NO: 32429 - DNA, 25 bp, Homo sapien
atgctattgtctttccctcgctagc

SEQ ID NO: 32430 - DNA, 25 bp, Homo sapien
atgctcaacaaatggaagaacaaag

SEQ ID NO: 32431 - DNA, 25 bp, Homo sapien
atgctcaacaagccacttatcttat

SEQ ID NO: 32432 - DNA, 25 bp, Homo sapien
atgctcaacaatccacttatcttat

SEQ ID NO: 32433 - DNA, 25 bp, Homo sapien
atgctcaataaatggaagaacaaag

SEQ ID NO: 32434 - DNA, 25 bp, Homo sapien
atgctcaatcctgcttctttttctg

SEQ ID NO: 32435 - DNA, 25 bp, Homo sapien
atgctcaatcctgcttttttttctg

SEQ ID NO: 32436 - DNA, 25 bp, Homo sapien
atgctcacagaagatctgagaagac

SEQ ID NO: 32437 - DNA, 25 bp, Homo sapien
atgctcacagaatatctgagaagac

SEQ ID NO: 32438 - DNA, 25 bp, Homo sapien
atgctcacagaccgcagtgaaagaa

SEQ ID NO: 32439 - DNA, 25 bp, Homo sapien
atgctcacagacctcagtgaaagaa

SEQ ID NO: 32440 - DNA, 25 bp, Homo sapien
atgctccatgaaataattgcttttg

SEQ ID NO: 32441 - DNA, 25 bp, Homo sapien
atgctccatgacataattgcttttg

SEQ ID NO: 32442 - DNA, 25 bp, Homo sapien
atgctcctggcaattaataggaacc

SEQ ID NO: 32443 - DNA, 25 bp, Homo sapien
atgctcctggcaattactaggaacc

SEQ ID NO: 32444 - DNA, 25 bp, Homo sapien
atgctctaatcactgaattaaatag

SEQ ID NO: 32445 - DNA, 25 bp, Homo sapien
atgctctaatcattgaattaaatag

SEQ ID NO: 32446 - DNA, 25 bp, Homo sapien
atgctctgaaatctccacttatctc

SEQ ID NO: 32447 - DNA, 25 bp, Homo sapien
atgctctgaaatctccgcttatctc

SEQ ID NO: 32448 - DNA, 25 bp, Homo sapien
atgctctgatccgaaattttaataa

SEQ ID NO: 32449 - DNA, 25 bp, Homo sapien
atgctctgatctgaaattttaataa

SEQ ID NO: 32450 - DNA, 25 bp, Homo sapien
atgctctgccaatttgggattttta

SEQ ID NO: 32451 - DNA, 25 bp, Homo sapien
atgctctgccattttgggattttta

SEQ ID NO: 32452 - DNA, 25 bp, Homo sapien
atgctctgctaatgtgacatttgtt

SEQ ID NO: 32453 - DNA, 25 bp, Homo sapien
atgctctgctaatgtggcatttgtt

SEQ ID NO: 32454 - DNA, 25 bp, Homo sapien
atgctctggttatcaggacagagaa

SEQ ID NO: 32455 - DNA, 25 bp, Homo sapien
atgctctggttatcgggacagagaa

SEQ ID NO: 32456 - DNA, 25 bp, Homo sapien
atgctcttcaaattcagaactcaca

SEQ ID NO: 32457 - DNA, 25 bp, Homo sapien
atgctcttccaattcagaactcaca

SEQ ID NO: 32458 - DNA, 25 bp, Homo sapien
atgctgaaaaatataaaaagtgttg

SEQ ID NO: 32459 - DNA, 25 bp, Homo sapien
atgctgaaaaatctaaaaagtgttg

SEQ ID NO: 32460 - DNA, 25 bp, Homo sapien
atgctgaacatggaaaccacaactc

SEQ ID NO: 32461 - DNA, 25 bp, Homo sapien
atgctgaacttggaaaccacaactc

SEQ ID NO: 32462 - DNA, 25 bp, Homo sapien
atgctgaatattgtgcatgacacct

SEQ ID NO: 32463 - DNA, 25 bp, Homo sapien
atgctgaatattgtgcgtgacacct

SEQ ID NO: 32464 - DNA, 25 bp, Homo sapien
atgctgaattaacttgctgatgtac

SEQ ID NO: 32465 - DNA, 25 bp, Homo sapien
atgctgaattaacttgttgatgtac

SEQ ID NO: 32466 - DNA, 25 bp, Homo sapien
atgctgacatataacctatacctgt

SEQ ID NO: 32467 - DNA, 25 bp, Homo sapien
atgctgacatataatctatacctgt

SEQ ID NO: 32468 - DNA, 25 bp, Homo sapien
atgctgaccaagatgaacactttga

SEQ ID NO: 32469 - DNA, 25 bp, Homo sapien
atgctgaccaaggtgaacactttga

SEQ ID NO: 32470 - DNA, 25 bp, Homo sapien
atgctgactctaaccaattgaatgt

SEQ ID NO: 32471 - DNA, 25 bp, Homo sapien
atgctgactttaaccaattgaatgt

SEQ ID NO: 32472 - DNA, 25 bp, Homo sapien
atgctgagaatgtaaaatactggga

SEQ ID NO: 32473 - DNA, 25 bp, Homo sapien
atgctgagagtgtaaaatactggga

SEQ ID NO: 32474 - DNA, 25 bp, Homo sapien
atgctgaggaaaaagtgcacgcaaa

SEQ ID NO: 32475 - DNA, 25 bp, Homo sapien
atgctgagggaaaagtgcacgcaaa

SEQ ID NO: 32476 - DNA, 25 bp, Homo sapien
atgctgagtatgtcgactgatccaa

SEQ ID NO: 32477 - DNA, 25 bp, Homo sapien
atgctgagtatgttgactgatccaa

SEQ ID NO: 32478 - DNA, 25 bp, Homo sapien
atgctgataatcatgcaaggcttca

SEQ ID NO: 32479 - DNA, 25 bp, Homo sapien
atgctgatgatcatgcaaggcttca

SEQ ID NO: 32480 - DNA, 25 bp, Homo sapien
atgctgcaaaaacatctctcctgga

SEQ ID NO: 32481 - DNA, 25 bp, Homo sapien
atgctgcaaaaacctctctcctgga

SEQ ID NO: 32482 - DNA, 25 bp, Homo sapien
atgctgcagtcgcattttcaaggaa

SEQ ID NO: 32483 - DNA, 25 bp, Homo sapien
atgctgcagtctcattttcaaggaa

SEQ ID NO: 32484 - DNA, 25 bp, Homo sapien
atgctgcatagctcttttactcaga

SEQ ID NO: 32485 - DNA, 25 bp, Homo sapien
atgctgcatagcttttttactcaga

SEQ ID NO: 32486 - DNA, 25 bp, Homo sapien
atgctgccatcaagaatttaaaaga

SEQ ID NO: 32487 - DNA, 25 bp, Homo sapien
atgctgccatcatgaatttaaaaga

SEQ ID NO: 32488 - DNA, 25 bp, Homo sapien
atgctggaagcacttgggaacagct

SEQ ID NO: 32489 - DNA, 25 bp, Homo sapien
atgctggaagcacttgtgaacagct

SEQ ID NO: 32490 - DNA, 25 bp, Homo sapien
atgctggagcctggaattcaaaaga

SEQ ID NO: 32491 - DNA, 25 bp, Homo sapien
atgctggagcctggcattcaaaaga

SEQ ID NO: 32492 - DNA, 25 bp, Homo sapien
atgctggatctgctttactagcaca

SEQ ID NO: 32493 - DNA, 25 bp, Homo sapien
atgctggatctgttttactagcaca

SEQ ID NO: 32494 - DNA, 25 bp, Homo sapien
atgctggattccgcagtgccaaacc

SEQ ID NO: 32495 - DNA, 25 bp, Homo sapien
atgctggattccgcggtgccaaacc

SEQ ID NO: 32496 - DNA, 25 bp, Homo sapien
atgctgggggaatagcattacctga

SEQ ID NO: 32497 - DNA, 25 bp, Homo sapien
atgctgggggaatcgcattacctga

SEQ ID NO: 32498 - DNA, 25 bp, Homo sapien
atgctgggtgactatgtaatctgaa

SEQ ID NO: 32499 - DNA, 25 bp, Homo sapien
atgctgggtgattatgtaatctgaa

SEQ ID NO: 32500 - DNA, 25 bp, Homo sapien
atgctgtagtggacatacctggttt

SEQ ID NO: 32501 - DNA, 25 bp, Homo sapien
atgctgtagtggatatacctggttt

SEQ ID NO: 32502 - DNA, 25 bp, Homo sapien
atgctgtcaatggtcaacactctta

SEQ ID NO: 32503 - DNA, 25 bp, Homo sapien
atgctgtcaattgtcaacactctta

SEQ ID NO: 32504 - DNA, 25 bp, Homo sapien
atgctgtcactgtgcgggttatcca

SEQ ID NO: 32505 - DNA, 25 bp, Homo sapien
atgctgtcactgtgtgggttatcca

SEQ ID NO: 32506 - DNA, 25 bp, Homo sapien
atgctgtgagaccacaaggccatta

SEQ ID NO: 32507 - DNA, 25 bp, Homo sapien
atgctgtgcagcagttatcccttta

SEQ ID NO: 32508 - DNA, 25 bp, Homo sapien
atgctgtgcagcggttatcccttta

SEQ ID NO: 32509 - DNA, 25 bp, Homo sapien
atgctgtgggaccacaaggccatta

SEQ ID NO: 32510 - DNA, 25 bp, Homo sapien
atgctgtggtaagagaggaagagaa

SEQ ID NO: 32511 - DNA, 25 bp, Homo sapien
atgctgtggtacgagaggaagagaa

SEQ ID NO: 32512 - DNA, 25 bp, Homo sapien
atgctgtgtaaggcctgttcctctt

SEQ ID NO: 32513 - DNA, 25 bp, Homo sapien
atgctgtgtaagtcctgttcctctt

SEQ ID NO: 32514 - DNA, 25 bp, Homo sapien
atgctgtgtttttagttagctctcc

SEQ ID NO: 32515 - DNA, 25 bp, Homo sapien
atgctgtgtttttggttagctctcc

SEQ ID NO: 32516 - DNA, 25 bp, Homo sapien
atgctgttaaaatggctgagtatat

SEQ ID NO: 32517 - DNA, 25 bp, Homo sapien
atgctgttaaagtggctgagtatat

SEQ ID NO: 32518 - DNA, 25 bp, Homo sapien
atgctgttaccagaagaaagttatg

SEQ ID NO: 32519 - DNA, 25 bp, Homo sapien
atgctgttaccagaaggaagttatg

SEQ ID NO: 32520 - DNA, 25 bp, Homo sapien
atgctgtttgggatacactgtgctt

SEQ ID NO: 32521 - DNA, 25 bp, Homo sapien
atgctgtttgggatacgctgtgctt

SEQ ID NO: 32522 - DNA, 25 bp, Homo sapien
atgcttaaccggagttctcaccatt

SEQ ID NO: 32523 - DNA, 25 bp, Homo sapien
atgcttaaccggcgttctcaccatt

SEQ ID NO: 32524 - DNA, 25 bp, Homo sapien
atgcttaccaaatgctgacacgtta

SEQ ID NO: 32525 - DNA, 25 bp, Homo sapien
atgcttactaaatgctgacacgtta

SEQ ID NO: 32526 - DNA, 25 bp, Homo sapien
atgcttactatgctcatgcagctaa

SEQ ID NO: 32527 - DNA, 25 bp, Homo sapien
atgcttactatgttcatgcagctaa

SEQ ID NO: 32528 - DNA, 25 bp, Homo sapien
atgcttagttttaactccacagaat

SEQ ID NO: 32529 - DNA, 25 bp, Homo sapien
atgcttagttttatctccacagaat

SEQ ID NO: 32530 - DNA, 25 bp, Homo sapien
atgcttattggtgcacggtagtatg

SEQ ID NO: 32531 - DNA, 25 bp, Homo sapien
atgcttattggtgtacggtagtatg

SEQ ID NO: 32532 - DNA, 25 bp, Homo sapien
atgcttatttagaaaactcaactat

SEQ ID NO: 32533 - DNA, 25 bp, Homo sapien
atgcttatttagaaaattcaactat

SEQ ID NO: 32534 - DNA, 25 bp, Homo sapien
atgcttattttctaacgtcataatc

SEQ ID NO: 32535 - DNA, 25 bp, Homo sapien
atgcttattttgtaacgtcataatc

SEQ ID NO: 32536 - DNA, 25 bp, Homo sapien
atgcttcaaatacgttgtcatctcc

SEQ ID NO: 32537 - DNA, 25 bp, Homo sapien
atgcttcaaatatgttgtcatctcc

SEQ ID NO: 32538 - DNA, 25 bp, Homo sapien
atgcttcactcagataatcatagtg

SEQ ID NO: 32539 - DNA, 25 bp, Homo sapien
atgcttcactcagatagtcatagtg

SEQ ID NO: 32540 - DNA, 25 bp, Homo sapien
atgcttcactccaatttctacctcc

SEQ ID NO: 32541 - DNA, 25 bp, Homo sapien
atgcttcactccagtttctacctcc

SEQ ID NO: 32542 - DNA, 25 bp, Homo sapien
atgcttccaagacaattggctcggg

SEQ ID NO: 32543 - DNA, 25 bp, Homo sapien
atgcttccaaggcaattggctcggg

SEQ ID NO: 32544 - DNA, 25 bp, Homo sapien
atgcttccaatatctctagtacatg

SEQ ID NO: 32545 - DNA, 25 bp, Homo sapien
atgcttccaatatttctagtacatg

SEQ ID NO: 32546 - DNA, 25 bp, Homo sapien
atgcttccataatgcaggaagaaac

SEQ ID NO: 32547 - DNA, 25 bp, Homo sapien
atgcttccataattcaggaagaaac

SEQ ID NO: 32548 - DNA, 25 bp, Homo sapien
atgcttcctggaggctggtattgtc

SEQ ID NO: 32549 - DNA, 25 bp, Homo sapien
atgcttcctggagtctggtattgtc

SEQ ID NO: 32550 - DNA, 25 bp, Homo sapien
atgcttcttttctacaacttacact

SEQ ID NO: 32551 - DNA, 25 bp, Homo sapien
atgcttcttttctacaccttacact

SEQ ID NO: 32552 - DNA, 25 bp, Homo sapien
atgcttgaattcttcaaaataagta

SEQ ID NO: 32553 - DNA, 25 bp, Homo sapien
atgcttgaattctttaaaataagta

SEQ ID NO: 32554 - DNA, 25 bp, Homo sapien
atgcttggaaaggaagtttaagttg

SEQ ID NO: 32555 - DNA, 25 bp, Homo sapien
atgcttggaaatgaagtttaagttg

SEQ ID NO: 32556 - DNA, 25 bp, Homo sapien
atgcttggctaacttttgtattttt

SEQ ID NO: 32557 - DNA, 25 bp, Homo sapien
atgcttgggtaacttttgtattttt

SEQ ID NO: 32558 - DNA, 25 bp, Homo sapien
atgcttgttaccccggaatatgctg

SEQ ID NO: 32559 - DNA, 25 bp, Homo sapien
atgcttgttaccccgggatatgctg

SEQ ID NO: 32560 - DNA, 25 bp, Homo sapien
atgctttaaaggaatttatggaatt

SEQ ID NO: 32561 - DNA, 25 bp, Homo sapien
atgctttaaagtaatttatggaatt

SEQ ID NO: 32562 - DNA, 25 bp, Homo sapien
atgctttattcaaacgactggttgg

SEQ ID NO: 32563 - DNA, 25 bp, Homo sapien
atgctttattcaaatgactggttgg

SEQ ID NO: 32564 - DNA, 25 bp, Homo sapien
atgctttcagttactttggataaat

SEQ ID NO: 32565 - DNA, 25 bp, Homo sapien
atgctttcagttattttggataaat

SEQ ID NO: 32566 - DNA, 25 bp, Homo sapien
atgctttgcagtaacatgggatttt

SEQ ID NO: 32567 - DNA, 25 bp, Homo sapien
atgctttggagtggcgaggttaaag

SEQ ID NO: 32568 - DNA, 25 bp, Homo sapien
atgctttggagtggtgaggttaaag

SEQ ID NO: 32569 - DNA, 25 bp, Homo sapien
atgctttgtagtaacatgggatttt

SEQ ID NO: 32570 - DNA, 25 bp, Homo sapien
atgctttgtgaatgcctgttaactt

SEQ ID NO: 32571 - DNA, 25 bp, Homo sapien
atgctttgtgaatgtctgttaactt

SEQ ID NO: 32572 - DNA, 25 bp, Homo sapien
atgcttttcatcttcctcacatttg

SEQ ID NO: 32573 - DNA, 25 bp, Homo sapien
atgcttttcccactcagctcattgt

SEQ ID NO: 32574 - DNA, 25 bp, Homo sapien
atgcttttcccgctcagctcattgt

SEQ ID NO: 32575 - DNA, 25 bp, Homo sapien
atgcttttgagtcccaatgtggggt

SEQ ID NO: 32576 - DNA, 25 bp, Homo sapien
atgcttttgatccttcccatataaa

SEQ ID NO: 32577 - DNA, 25 bp, Homo sapien
atgcttttggtccttcccatataaa

SEQ ID NO: 32578 - DNA, 25 bp, Homo sapien
atgctttttagtcccaatgtggggt

SEQ ID NO: 32579 - DNA, 25 bp, Homo sapien
atgctttttatcttcctcacatttg

SEQ ID NO: 32580 - DNA, 25 bp, Homo sapien
atggaaaaaaatgaccaagaatagc

SEQ ID NO: 32581 - DNA, 25 bp, Homo sapien
atggaaaaaaatgaccgagaatagc

SEQ ID NO: 32582 - DNA, 25 bp, Homo sapien
atggaaaaaagtgagtgagctataa

SEQ ID NO: 32583 - DNA, 25 bp, Homo sapien
atggaaaaaagttagtgagctataa

SEQ ID NO: 32584 - DNA, 25 bp, Homo sapien
atggaaaaagggcctgacaaatgat

SEQ ID NO: 32585 - DNA, 25 bp, Homo sapien
atggaaaaagggcttgacaaatgat

SEQ ID NO: 32586 - DNA, 25 bp, Homo sapien
atggaaaacgcatgtcaaagacctt

SEQ ID NO: 32587 - DNA, 25 bp, Homo sapien
atggaaaatatgccgtgactagtca

SEQ ID NO: 32588 - DNA, 25 bp, Homo sapien
atggaaaatatgctgtgactagtca

SEQ ID NO: 32589 - DNA, 25 bp, Homo sapien
atggaaaatgatcgtttaaatttag

SEQ ID NO: 32590 - DNA, 25 bp, Homo sapien
atggaaaatgattgtttaaatttag

SEQ ID NO: 32591 - DNA, 25 bp, Homo sapien
atggaaaatgcatgtcaaagacctt

SEQ ID NO: 32592 - DNA, 25 bp, Homo sapien
atggaaacagtcctcaatacccaat

SEQ ID NO: 32593 - DNA, 25 bp, Homo sapien
atggaaacagtcctgaatacccaat

SEQ ID NO: 32594 - DNA, 25 bp, Homo sapien
atggaaactacagaaaattggactc

SEQ ID NO: 32595 - DNA, 25 bp, Homo sapien
atggaaactacagagaattggactc

SEQ ID NO: 32596 - DNA, 25 bp, Homo sapien
atggaaagactagacttgctgagtc

SEQ ID NO: 32597 - DNA, 25 bp, Homo sapien
atggaaagactaggcttgctgagtc

SEQ ID NO: 32598 - DNA, 25 bp, Homo sapien
atggaaagatatatatgcatctttg

SEQ ID NO: 32599 - DNA, 25 bp, Homo sapien
atggaaagatatgtatgcatctttg

SEQ ID NO: 32600 - DNA, 25 bp, Homo sapien
atggaaagtatggagcatggaaaaa

SEQ ID NO: 32601 - DNA, 25 bp, Homo sapien
atggaaagtatggagcctggaaaaa

SEQ ID NO: 32602 - DNA, 25 bp, Homo sapien
atggaaataatgccaaggctgtcac

SEQ ID NO: 32603 - DNA, 25 bp, Homo sapien
atggaaatcatgccaaggctgtcac

SEQ ID NO: 32604 - DNA, 25 bp, Homo sapien
atggaaatgtgaggttgaagtcccc

SEQ ID NO: 32605 - DNA, 25 bp, Homo sapien
atggaaatgtgaggtttaagtcccc

SEQ ID NO: 32606 - DNA, 25 bp, Homo sapien
atggaaatgtgccaagtcacacctg

SEQ ID NO: 32607 - DNA, 25 bp, Homo sapien
atggaaatgtgccgagtcacacctg

SEQ ID NO: 32608 - DNA, 25 bp, Homo sapien
atggaaatgttctgtatttgcacta

SEQ ID NO: 32609 - DNA, 25 bp, Homo sapien
atggaaatgttttgtatttgcacta

SEQ ID NO: 32610 - DNA, 25 bp, Homo sapien
atggaaattctagcactcttaagaa

SEQ ID NO: 32611 - DNA, 25 bp, Homo sapien
atggaaattgtagcactcttaagaa

SEQ ID NO: 32612 - DNA, 25 bp, Homo sapien
atggaaattttgctgtgagaatgtc

SEQ ID NO: 32613 - DNA, 25 bp, Homo sapien
atggaaattttggtgtgagaatgtc

SEQ ID NO: 32614 - DNA, 25 bp, Homo sapien
atggaacaaaattaagaaggcctat

SEQ ID NO: 32615 - DNA, 25 bp, Homo sapien
atggaacaagcagatgatgttgtga

SEQ ID NO: 32616 - DNA, 25 bp, Homo sapien
atggaacaagcagctgatgttgtga

SEQ ID NO: 32617 - DNA, 25 bp, Homo sapien
atggaacaatgttcaagattaaata

SEQ ID NO: 32618 - DNA, 25 bp, Homo sapien
atggaacaatgtttaagattaaata

SEQ ID NO: 32619 - DNA, 25 bp, Homo sapien
atggaacactgcaacatatttcttc

SEQ ID NO: 32620 - DNA, 25 bp, Homo sapien
atggaacactggaacatatttcttc

SEQ ID NO: 32621 - DNA, 25 bp, Homo sapien
atggaacagaattaagaaggcctat

SEQ ID NO: 32622 - DNA, 25 bp, Homo sapien
atggaagaaatctattattaagtac

SEQ ID NO: 32623 - DNA, 25 bp, Homo sapien
atggaagaagagcagcctacactta

SEQ ID NO: 32624 - DNA, 25 bp, Homo sapien
atggaagaagagcggcctacactta

SEQ ID NO: 32625 - DNA, 25 bp, Homo sapien
atggaagaagtctattattaagtac

SEQ ID NO: 32626 - DNA, 25 bp, Homo sapien
atggaagagagccgttttctaccta

SEQ ID NO: 32627 - DNA, 25 bp, Homo sapien
atggaagagagctgttttctaccta

SEQ ID NO: 32628 - DNA, 25 bp, Homo sapien
atggaagaggtaattgccccaccag

SEQ ID NO: 32629 - DNA, 25 bp, Homo sapien
atggaagaggtacaaaaaaacagtc

SEQ ID NO: 32630 - DNA, 25 bp, Homo sapien
atggaagaggtagaaaaaaacagtc

SEQ ID NO: 32631 - DNA, 25 bp, Homo sapien
atggaagaggtcattgccccaccag

SEQ ID NO: 32632 - DNA, 25 bp, Homo sapien
atggaaggaaactttttgcaagtgg

SEQ ID NO: 32633 - DNA, 25 bp, Homo sapien
atggaaggaaattttttgcaagtgg

SEQ ID NO: 32634 - DNA, 25 bp, Homo sapien
atggaaggcggacagcggccatctt

SEQ ID NO: 32635 - DNA, 25 bp, Homo sapien
atggaaggctactggaataatattt

SEQ ID NO: 32636 - DNA, 25 bp, Homo sapien
atggaaggctactggagtaatattt

SEQ ID NO: 32637 - DNA, 25 bp, Homo sapien
atggaaggtggacagcggccatctt

SEQ ID NO: 32638 - DNA, 25 bp, Homo sapien
atggaataaggaatccagtaacttg

SEQ ID NO: 32639 - DNA, 25 bp, Homo sapien
atggaataaggaatccggtaacttg

SEQ ID NO: 32640 - DNA, 25 bp, Homo sapien
atggaataggagcacggaggccaag

SEQ ID NO: 32641 - DNA, 25 bp, Homo sapien
atggaataggagcatggaggccaag

SEQ ID NO: 32642 - DNA, 25 bp, Homo sapien
atggaatgaatatggtttctgccgt

SEQ ID NO: 32643 - DNA, 25 bp, Homo sapien
atggaatgactgagaaataattgat

SEQ ID NO: 32644 - DNA, 25 bp, Homo sapien
atggaatgactgagaactaattgat

SEQ ID NO: 32645 - DNA, 25 bp, Homo sapien
atggaatgagcaaattgtggtatat

SEQ ID NO: 32646 - DNA, 25 bp, Homo sapien
atggaatgagcaaattttggtatat

SEQ ID NO: 32647 - DNA, 25 bp, Homo sapien
atggaatgctcagggatcagaattc

SEQ ID NO: 32648 - DNA, 25 bp, Homo sapien
atggaatgcttcaggatggccaaga

SEQ ID NO: 32649 - DNA, 25 bp, Homo sapien
atggaatgctttaggatggccaaga

SEQ ID NO: 32650 - DNA, 25 bp, Homo sapien
atggaatggatatggtttctgccgt

SEQ ID NO: 32651 - DNA, 25 bp, Homo sapien
atggaatggtcagggatcagaattc

SEQ ID NO: 32652 - DNA, 25 bp, Homo sapien
atggacaaccttgataagaccccac

SEQ ID NO: 32653 - DNA, 25 bp, Homo sapien
atggacaaccttggtaagaccccac

SEQ ID NO: 32654 - DNA, 25 bp, Homo sapien
atggacaggtgaaaggtcagcaacc

SEQ ID NO: 32655 - DNA, 25 bp, Homo sapien
atggacaggtgaaatgtcagcaacc

SEQ ID NO: 32656 - DNA, 25 bp, Homo sapien
atggaccacgcagtgttggagcatt

SEQ ID NO: 32657 - DNA, 25 bp, Homo sapien
atggaccactccaaagcgtgtgggt

SEQ ID NO: 32658 - DNA, 25 bp, Homo sapien
atggaccactccaaagtgtgtgggt

SEQ ID NO: 32659 - DNA, 25 bp, Homo sapien
atggaccatgcagtgttggagcatt

SEQ ID NO: 32660 - DNA, 25 bp, Homo sapien
atggactaaacattgggtcaagcag

SEQ ID NO: 32661 - DNA, 25 bp, Homo sapien
atggactacttcatgtcttaagtta

SEQ ID NO: 32662 - DNA, 25 bp, Homo sapien
atggactagacattgggtcaagcag

SEQ ID NO: 32663 - DNA, 25 bp, Homo sapien
atggactatttcatgtcttaagtta

SEQ ID NO: 32664 - DNA, 25 bp, Homo sapien
atggactgttagccgatttaacagc

SEQ ID NO: 32665 - DNA, 25 bp, Homo sapien
atggactgttagctgatttaacagc

SEQ ID NO: 32666 - DNA, 25 bp, Homo sapien
atggacttttcccgagaggcttaga

SEQ ID NO: 32667 - DNA, 25 bp, Homo sapien
atggacttttcctgagaggcttaga

SEQ ID NO: 32668 - DNA, 25 bp, Homo sapien
atggagaattgcctttggtgcctct

SEQ ID NO: 32669 - DNA, 25 bp, Homo sapien
atggagaattgcttttggtgcctct

SEQ ID NO: 32670 - DNA, 25 bp, Homo sapien
atggagaccgcctgaacttgggtgc

SEQ ID NO: 32671 - DNA, 25 bp, Homo sapien
atggagactgcctgaacttgggtgc

SEQ ID NO: 32672 - DNA, 25 bp, Homo sapien
atggagactggctcccactatgtaa

SEQ ID NO: 32673 - DNA, 25 bp, Homo sapien
atggagactggctcccgctatgtaa

SEQ ID NO: 32674 - DNA, 25 bp, Homo sapien
atggagagagtgactacgtcaggca

SEQ ID NO: 32675 - DNA, 25 bp, Homo sapien
atggagagagtgactatgtcaggca

SEQ ID NO: 32676 - DNA, 25 bp, Homo sapien
atggagataaatttgcaatcaccag

SEQ ID NO: 32677 - DNA, 25 bp, Homo sapien
atggagatacatttgcaatcaccag

SEQ ID NO: 32678 - DNA, 25 bp, Homo sapien
atggagatctggacatcatcagtgc

SEQ ID NO: 32679 - DNA, 25 bp, Homo sapien
atggagatctggacattatcagtgc

SEQ ID NO: 32680 - DNA, 25 bp, Homo sapien
atggagcaaagcagagaactcctgg

SEQ ID NO: 32681 - DNA, 25 bp, Homo sapien
atggagcaccaagcacctctatgaa

SEQ ID NO: 32682 - DNA, 25 bp, Homo sapien
atggagcaccaagcgcctctatgaa

SEQ ID NO: 32683 - DNA, 25 bp, Homo sapien
atggagcatagcagagaactcctgg

SEQ ID NO: 32684 - DNA, 25 bp, Homo sapien
atggagcatgaagctgcacaggcat

SEQ ID NO: 32685 - DNA, 25 bp, Homo sapien
atggagcatgaagttgcacaggcat

SEQ ID NO: 32686 - DNA, 25 bp, Homo sapien
atggagcatgatctgacagaggaaa

SEQ ID NO: 32687 - DNA, 25 bp, Homo sapien
atggagcatgatctgatagaggaaa

SEQ ID NO: 32688 - DNA, 25 bp, Homo sapien
atggagcgcatttcatataacacta

SEQ ID NO: 32689 - DNA, 25 bp, Homo sapien
atggagcgcatttcatctaacacta

SEQ ID NO: 32690 - DNA, 25 bp, Homo sapien
atggagctagtgcagtagacagacc

SEQ ID NO: 32691 - DNA, 25 bp, Homo sapien
atggagctagtggagtagacagacc

SEQ ID NO: 32692 - DNA, 25 bp, Homo sapien
atggaggctccgctacataggcatg

SEQ ID NO: 32693 - DNA, 25 bp, Homo sapien
atggaggctccgctacgtaggcatg

SEQ ID NO: 32694 - DNA, 25 bp, Homo sapien
atggaggtgattgcttggcttcctc

SEQ ID NO: 32695 - DNA, 25 bp, Homo sapien
atggaggtgatttcttggcttcctc

SEQ ID NO: 32696 - DNA, 25 bp, Homo sapien
atggagtcacaattacctattagtg

SEQ ID NO: 32697 - DNA, 25 bp, Homo sapien
atggagtcgcaattacctattagtg

SEQ ID NO: 32698 - DNA, 25 bp, Homo sapien
atggagtgaccatgagtgaatgatt

SEQ ID NO: 32699 - DNA, 25 bp, Homo sapien
atggagtgaccgtgagtgaatgatt

SEQ ID NO: 32700 - DNA, 25 bp, Homo sapien
atggagtgtcggcatgaaatatggt

SEQ ID NO: 32701 - DNA, 25 bp, Homo sapien
atggagtgttggcatgaaatatggt

SEQ ID NO: 32702 - DNA, 25 bp, Homo sapien
atggagttaattaagcacaaaatgt

SEQ ID NO: 32703 - DNA, 25 bp, Homo sapien
atggagttaattgagcacaaaatgt

SEQ ID NO: 32704 - DNA, 25 bp, Homo sapien
atggatacctgggttctaatcttaa

SEQ ID NO: 32705 - DNA, 25 bp, Homo sapien
atggatacctgtgttctaatcttaa

SEQ ID NO: 32706 - DNA, 25 bp, Homo sapien
atggatatgatggttatcttgattt

SEQ ID NO: 32707 - DNA, 25 bp, Homo sapien
atggatatgatgtttatcttgattt

SEQ ID NO: 32708 - DNA, 25 bp, Homo sapien
atggatatgcgtttacatcgaaggg

SEQ ID NO: 32709 - DNA, 25 bp, Homo sapien
atggatatgcgtttacgtcgaaggg

SEQ ID NO: 32710 - DNA, 25 bp, Homo sapien
atggatcaatgacataatattccca

SEQ ID NO: 32711 - DNA, 25 bp, Homo sapien
atggatcaatgacatagtattccca

SEQ ID NO: 32712 - DNA, 25 bp, Homo sapien
atggatcaatgagacaaaaagaaaa

SEQ ID NO: 32713 - DNA, 25 bp, Homo sapien
atggatcaatgaggcaaaaagaaaa

SEQ ID NO: 32714 - DNA, 25 bp, Homo sapien
atggatctgagtacctttagtagca

SEQ ID NO: 32715 - DNA, 25 bp, Homo sapien
atggatctgagtatctttagtagca

SEQ ID NO: 32716 - DNA, 25 bp, Homo sapien
atggatgaacagaaaatgtgatata

SEQ ID NO: 32717 - DNA, 25 bp, Homo sapien
atggatgaatagaaaatgtgatata

SEQ ID NO: 32718 - DNA, 25 bp, Homo sapien
atggatgatcgaggacagctaacta

SEQ ID NO: 32719 - DNA, 25 bp, Homo sapien
atggatgatcgatgacagctaacta

SEQ ID NO: 32720 - DNA, 25 bp, Homo sapien
atggatgatggatgaaaagatatag

SEQ ID NO: 32721 - DNA, 25 bp, Homo sapien
atggatgatggatggaaagatatag

SEQ ID NO: 32722 - DNA, 25 bp, Homo sapien
atggatgcgtgtacagggttggctg

SEQ ID NO: 32723 - DNA, 25 bp, Homo sapien
atggatgctgaacagatttttaaaa

SEQ ID NO: 32724 - DNA, 25 bp, Homo sapien
atggatgctgagcagatttttaaaa

SEQ ID NO: 32725 - DNA, 25 bp, Homo sapien
atggatgcttgtacagggttggctg

SEQ ID NO: 32726 - DNA, 25 bp, Homo sapien
atggatggaaaatccactcatgtca

SEQ ID NO: 32727 - DNA, 25 bp, Homo sapien
atggatggcaaatccactcatgtca

SEQ ID NO: 32728 - DNA, 25 bp, Homo sapien
atggatggcatcatttggttaaact

SEQ ID NO: 32729 - DNA, 25 bp, Homo sapien
atggatggcatcgtttggttaaact

SEQ ID NO: 32730 - DNA, 25 bp, Homo sapien
atggatgtacaagcatctgagtacc

SEQ ID NO: 32731 - DNA, 25 bp, Homo sapien
atggatgtacaagtatctgagtacc

SEQ ID NO: 32732 - DNA, 25 bp, Homo sapien
atggatgtcgagtttatcccatgtc

SEQ ID NO: 32733 - DNA, 25 bp, Homo sapien
atggatgttgagtttatcccatgtc

SEQ ID NO: 32734 - DNA, 25 bp, Homo sapien
atggattcctgttactgcataagaa

SEQ ID NO: 32735 - DNA, 25 bp, Homo sapien
atggattcctgttacttcataagaa

SEQ ID NO: 32736 - DNA, 25 bp, Homo sapien
atggattcttgcaaaagatagtaat

SEQ ID NO: 32737 - DNA, 25 bp, Homo sapien
atggattcttgcacaagatagtaat

SEQ ID NO: 32738 - DNA, 25 bp, Homo sapien
atggattgcaccagcgggcttctta

SEQ ID NO: 32739 - DNA, 25 bp, Homo sapien
atggattgcaccatcgggcttctta

SEQ ID NO: 32740 - DNA, 25 bp, Homo sapien
atggattgtctagtttatcacttgg

SEQ ID NO: 32741 - DNA, 25 bp, Homo sapien
atggattgtctagtttctcacttgg

SEQ ID NO: 32742 - DNA, 25 bp, Homo sapien
atggatttcattcccactgcttcct

SEQ ID NO: 32743 - DNA, 25 bp, Homo sapien
atggattttaaatgtaaatgacctc

SEQ ID NO: 32744 - DNA, 25 bp, Homo sapien
atggattttaagtgtaaatgacctc

SEQ ID NO: 32745 - DNA, 25 bp, Homo sapien
atggattttattcccactgcttcct

SEQ ID NO: 32746 - DNA, 25 bp, Homo sapien
atggattttgtaggtcaagtttgga

SEQ ID NO: 32747 - DNA, 25 bp, Homo sapien
atggattttgtaggtcgagtttgga

SEQ ID NO: 32748 - DNA, 25 bp, Homo sapien
atggcaaaagattataagtacacta

SEQ ID NO: 32749 - DNA, 25 bp, Homo sapien
atggcaaaattacatatgagcttcc

SEQ ID NO: 32750 - DNA, 25 bp, Homo sapien
atggcaaaattatatatgagcttcc

SEQ ID NO: 32751 - DNA, 25 bp, Homo sapien
atggcaaaccctatgaagagtcttg

SEQ ID NO: 32752 - DNA, 25 bp, Homo sapien
atggcaaaccctatgatgagtcttg

SEQ ID NO: 32753 - DNA, 25 bp, Homo sapien
atggcaaactttttctgctttaaga

SEQ ID NO: 32754 - DNA, 25 bp, Homo sapien
atggcaaaggattataagtacacta

SEQ ID NO: 32755 - DNA, 25 bp, Homo sapien
atggcaaagtttttctgctttaaga

SEQ ID NO: 32756 - DNA, 25 bp, Homo sapien
atggcaaatactgcgtttcatccca

SEQ ID NO: 32757 - DNA, 25 bp, Homo sapien
atggcaaatactgtgtttcatccca

SEQ ID NO: 32758 - DNA, 25 bp, Homo sapien
atggcaaattagctgggtttataat

SEQ ID NO: 32759 - DNA, 25 bp, Homo sapien
atggcaaattagttgggtttataat

SEQ ID NO: 32760 - DNA, 25 bp, Homo sapien
atggcaagccaatcttacacaaatg

SEQ ID NO: 32761 - DNA, 25 bp, Homo sapien
atggcaagccagtcttacacaaatg

SEQ ID NO: 32762 - DNA, 25 bp, Homo sapien
atggcaagccttgacgggagagcca

SEQ ID NO: 32763 - DNA, 25 bp, Homo sapien
atggcaagccttgatgggagagcca

SEQ ID NO: 32764 - DNA, 25 bp, Homo sapien
atggcaagggtagtcgccttctgat

SEQ ID NO: 32765 - DNA, 25 bp, Homo sapien
atggcaagggtagtcgtcttctgat

SEQ ID NO: 32766 - DNA, 25 bp, Homo sapien
atggcaagtttctggtattcaacaa

SEQ ID NO: 32767 - DNA, 25 bp, Homo sapien
atggcaagtttctggtcttcaacaa

SEQ ID NO: 32768 - DNA, 25 bp, Homo sapien
atggcacaacatatggagtccttac

SEQ ID NO: 32769 - DNA, 25 bp, Homo sapien
atggcacaaggttcgagaggccaaa

SEQ ID NO: 32770 - DNA, 25 bp, Homo sapien
atggcacaaggtttgagaggccaaa

SEQ ID NO: 32771 - DNA, 25 bp, Homo sapien
atggcacacaactctaaaattttac

SEQ ID NO: 32772 - DNA, 25 bp, Homo sapien
atggcacacaagtctaaaattttac

SEQ ID NO: 32773 - DNA, 25 bp, Homo sapien
atggcacagcatatggagtccttac

SEQ ID NO: 32774 - DNA, 25 bp, Homo sapien
atggcacatctgaaatttacataag

SEQ ID NO: 32775 - DNA, 25 bp, Homo sapien
atggcacatctgaactttacataag

SEQ ID NO: 32776 - DNA, 25 bp, Homo sapien
atggcacatggctggggacctgagg

SEQ ID NO: 32777 - DNA, 25 bp, Homo sapien
atggcacatggttggggacctgagg

SEQ ID NO: 32778 - DNA, 25 bp, Homo sapien
atggcacccaggcttcttctgtttc

SEQ ID NO: 32779 - DNA, 25 bp, Homo sapien
atggcacccaggtttcttctgtttc

SEQ ID NO: 32780 - DNA, 25 bp, Homo sapien
atggcactcagtctggtgggtatta

SEQ ID NO: 32781 - DNA, 25 bp, Homo sapien
atggcactcagtgtggtgggtatta

SEQ ID NO: 32782 - DNA, 25 bp, Homo sapien
atggcactctcagtgtctccgtaaa

SEQ ID NO: 32783 - DNA, 25 bp, Homo sapien
atggcactctcagtgtttccgtaaa

SEQ ID NO: 32784 - DNA, 25 bp, Homo sapien
atggcagaaaatttttttcaccttg

SEQ ID NO: 32785 - DNA, 25 bp, Homo sapien
atggcagaagagacaagctgagaaa

SEQ ID NO: 32786 - DNA, 25 bp, Homo sapien
atggcagaagagacaatctgagaaa

SEQ ID NO: 32787 - DNA, 25 bp, Homo sapien
atggcagaatatttttttcaccttg

SEQ ID NO: 32788 - DNA, 25 bp, Homo sapien
atggcagaatggatctttaaaaggc

SEQ ID NO: 32789 - DNA, 25 bp, Homo sapien
atggcagaatgggtctttaaaaggc

SEQ ID NO: 32790 - DNA, 25 bp, Homo sapien
atggcagagcatttcaaatttcaga

SEQ ID NO: 32791 - DNA, 25 bp, Homo sapien
atggcagagcatttcagatttcaga

SEQ ID NO: 32792 - DNA, 25 bp, Homo sapien
atggcagagtgcgtgatggagggct

SEQ ID NO: 32793 - DNA, 25 bp, Homo sapien
atggcagagtgtgtgatggagggct

SEQ ID NO: 32794 - DNA, 25 bp, Homo sapien
atggcagtccagcactctctaacag

SEQ ID NO: 32795 - DNA, 25 bp, Homo sapien
atggcagtccagcattctctaacag

SEQ ID NO: 32796 - DNA, 25 bp, Homo sapien
atggcatatgtaaaacaggaaagca

SEQ ID NO: 32797 - DNA, 25 bp, Homo sapien
atggcatatgtacaacaggaaagca

SEQ ID NO: 32798 - DNA, 25 bp, Homo sapien
atggcatggagcaaagcagagaact

SEQ ID NO: 32799 - DNA, 25 bp, Homo sapien
atggcatggagcatagcagagaact

SEQ ID NO: 32800 - DNA, 25 bp, Homo sapien
atggcattccaggctagctctgtta

SEQ ID NO: 32801 - DNA, 25 bp, Homo sapien
atggcattccaggttagctctgtta

SEQ ID NO: 32802 - DNA, 25 bp, Homo sapien
atggcattcgcaacctaagcccact

SEQ ID NO: 32803 - DNA, 25 bp, Homo sapien
atggcattcgcaacttaagcccact

SEQ ID NO: 32804 - DNA, 25 bp, Homo sapien
atggcattctgagcaggtatacaag

SEQ ID NO: 32805 - DNA, 25 bp, Homo sapien
atggcattctgagcgggtatacaag

SEQ ID NO: 32806 - DNA, 25 bp, Homo sapien
atggcattgtgtatagttgctgatc

SEQ ID NO: 32807 - DNA, 25 bp, Homo sapien
atggcattgtgtgtagttgctgatc

SEQ ID NO: 32808 - DNA, 25 bp, Homo sapien
atggccaccgtggaattcaccgaaa

SEQ ID NO: 32809 - DNA, 25 bp, Homo sapien
atggccactgtggaattcaccgaaa

SEQ ID NO: 32810 - DNA, 25 bp, Homo sapien
atggccagagaactgaaaatggctt

SEQ ID NO: 32811 - DNA, 25 bp, Homo sapien
atggccagagaattgaaaatggctt

SEQ ID NO: 32812 - DNA, 25 bp, Homo sapien
atggccagcaagggaagtgttatac

SEQ ID NO: 32813 - DNA, 25 bp, Homo sapien
atggccagcaagggcagtgttatac

SEQ ID NO: 32814 - DNA, 25 bp, Homo sapien
atggccagggaagagagcagtacca

SEQ ID NO: 32815 - DNA, 25 bp, Homo sapien
atggccagggaagatagcagtacca

SEQ ID NO: 32816 - DNA, 25 bp, Homo sapien
atggccatgtccagtttgccttctt

SEQ ID NO: 32817 - DNA, 25 bp, Homo sapien
atggccatgtcgagtttgccttctt

SEQ ID NO: 32818 - DNA, 25 bp, Homo sapien
atggccattgcagtcttttccttgg

SEQ ID NO: 32819 - DNA, 25 bp, Homo sapien
atggccattgcagtgttttccttgg

SEQ ID NO: 32820 - DNA, 25 bp, Homo sapien
atggcccaaccaatgctttcttggt

SEQ ID NO: 32821 - DNA, 25 bp, Homo sapien
atggcccaaccgatgctttcttggt

SEQ ID NO: 32822 - DNA, 25 bp, Homo sapien
atggccctcgttaattttatcagat

SEQ ID NO: 32823 - DNA, 25 bp, Homo sapien
atggccctctttaattttatcagat

SEQ ID NO: 32824 - DNA, 25 bp, Homo sapien
atggcctgtttccagatcttctctt

SEQ ID NO: 32825 - DNA, 25 bp, Homo sapien
atggcctgttttcagatcttctctt

SEQ ID NO: 32826 - DNA, 25 bp, Homo sapien
atggccttcagaaaaattgcagcag

SEQ ID NO: 32827 - DNA, 25 bp, Homo sapien
atggccttcagacaaattgcagcag

SEQ ID NO: 32828 - DNA, 25 bp, Homo sapien
atggcgataaacccaagaggaaggg

SEQ ID NO: 32829 - DNA, 25 bp, Homo sapien
atggcgataaacccgagaggaaggg

SEQ ID NO: 32830 - DNA, 25 bp, Homo sapien
atggcggtggactatgacttataaa

SEQ ID NO: 32831 - DNA, 25 bp, Homo sapien
atggcggtggattatgacttataaa

SEQ ID NO: 32832 - DNA, 25 bp, Homo sapien
atggctaaagagtatacaagggtgt

SEQ ID NO: 32833 - DNA, 25 bp, Homo sapien
atggctaaagattatacaagggtgt

SEQ ID NO: 32834 - DNA, 25 bp, Homo sapien
atggctaagcataaagctgttatca

SEQ ID NO: 32835 - DNA, 25 bp, Homo sapien
atggctaagcattaagctgttatca

SEQ ID NO: 32836 - DNA, 25 bp, Homo sapien
atggctacaaaacattttaaagcct

SEQ ID NO: 32837 - DNA, 25 bp, Homo sapien
atggctacaaggaaagaagagctat

SEQ ID NO: 32838 - DNA, 25 bp, Homo sapien
atggctacaaggaacgaagagctat

SEQ ID NO: 32839 - DNA, 25 bp, Homo sapien
atggctacgaaacattttaaagcct

SEQ ID NO: 32840 - DNA, 25 bp, Homo sapien
atggctagcagcatttccctttgcc

SEQ ID NO: 32841 - DNA, 25 bp, Homo sapien
atggctagcggcatttccctttgcc

SEQ ID NO: 32842 - DNA, 25 bp, Homo sapien
atggctatttatcctgcttacaaga

SEQ ID NO: 32843 - DNA, 25 bp, Homo sapien
atggctatttatgctgcttacaaga

SEQ ID NO: 32844 - DNA, 25 bp, Homo sapien
atggctcacccacaagtcagtgaag

SEQ ID NO: 32845 - DNA, 25 bp, Homo sapien
atggctcacccagaagtcagtgaag

SEQ ID NO: 32846 - DNA, 25 bp, Homo sapien
atggctcgcgtccacggttctggtt

SEQ ID NO: 32847 - DNA, 25 bp, Homo sapien
atggctcgtgtccacggttctggtt

SEQ ID NO: 32848 - DNA, 25 bp, Homo sapien
atggctctcttctaaccatcttatt

SEQ ID NO: 32849 - DNA, 25 bp, Homo sapien
atggctctcttctaactatcttatt

SEQ ID NO: 32850 - DNA, 25 bp, Homo sapien
atggctgcaacctcaaaaaaagcaa

SEQ ID NO: 32851 - DNA, 25 bp, Homo sapien
atggctgcatcctcaaaaaaagcaa

SEQ ID NO: 32852 - DNA, 25 bp, Homo sapien
atggctgttcgtaggaatggaagga

SEQ ID NO: 32853 - DNA, 25 bp, Homo sapien
atggctgtttgtaggaatggaagga

SEQ ID NO: 32854 - DNA, 25 bp, Homo sapien
atggcttagttgatccctttgaata

SEQ ID NO: 32855 - DNA, 25 bp, Homo sapien
atggcttatttgatccctttgaata

SEQ ID NO: 32856 - DNA, 25 bp, Homo sapien
atggcttcttttcgtaaagaggaag

SEQ ID NO: 32857 - DNA, 25 bp, Homo sapien
atggcttctttttgtaaagaggaag

SEQ ID NO: 32858 - DNA, 25 bp, Homo sapien
atggcttgaccgtggactttccagc

SEQ ID NO: 32859 - DNA, 25 bp, Homo sapien
atggcttgatcgtggactttccagc

SEQ ID NO: 32860 - DNA, 25 bp, Homo sapien
atggcttgctgcaggcatgaagaga

SEQ ID NO: 32861 - DNA, 25 bp, Homo sapien
atggcttgctgcaggcgtgaagaga

SEQ ID NO: 32862 - DNA, 25 bp, Homo sapien
atggcttgtagctagggcactgaag

SEQ ID NO: 32863 - DNA, 25 bp, Homo sapien
atggcttgtagctggggcactgaag

SEQ ID NO: 32864 - DNA, 25 bp, Homo sapien
atggctttaatggaaaactctttca

SEQ ID NO: 32865 - DNA, 25 bp, Homo sapien
atggctttaatggaaatctctttca

SEQ ID NO: 32866 - DNA, 25 bp, Homo sapien
atggctttctgataacagtgataag

SEQ ID NO: 32867 - DNA, 25 bp, Homo sapien
atggctttctgatagcagtgataag

SEQ ID NO: 32868 - DNA, 25 bp, Homo sapien
atggctttgatagtttgatagaaat

SEQ ID NO: 32869 - DNA, 25 bp, Homo sapien
atggctttgatggtttgatagaaat

SEQ ID NO: 32870 - DNA, 25 bp, Homo sapien
atggcttttttattcactgaatatg

SEQ ID NO: 32871 - DNA, 25 bp, Homo sapien
atggctttttttttcactgaatatg

SEQ ID NO: 32872 - DNA, 25 bp, Homo sapien
atgggaacaagcgagacagagcctg

SEQ ID NO: 32873 - DNA, 25 bp, Homo sapien
atgggaacaagtgagacagagcctg

SEQ ID NO: 32874 - DNA, 25 bp, Homo sapien
atgggaactgtctgcaaatagacat

SEQ ID NO: 32875 - DNA, 25 bp, Homo sapien
atgggaactgtctgcacatagacat

SEQ ID NO: 32876 - DNA, 25 bp, Homo sapien
atgggaagaaagatttggtttctaa

SEQ ID NO: 32877 - DNA, 25 bp, Homo sapien
atgggaagaaaggtttggtttctaa

SEQ ID NO: 32878 - DNA, 25 bp, Homo sapien
atgggaagacaagtaggactgaaat

SEQ ID NO: 32879 - DNA, 25 bp, Homo sapien
atgggaagacaagtcggactgaaat

SEQ ID NO: 32880 - DNA, 25 bp, Homo sapien
atgggaagacttctgcattgaactt

SEQ ID NO: 32881 - DNA, 25 bp, Homo sapien
atgggaagccttctgcattgaactt

SEQ ID NO: 32882 - DNA, 25 bp, Homo sapien
atgggaataatgtgatgaaaacaag

SEQ ID NO: 32883 - DNA, 25 bp, Homo sapien
atgggaatattgtgatgaaaacaag

SEQ ID NO: 32884 - DNA, 25 bp, Homo sapien
atgggaatctagtcaggactctcag

SEQ ID NO: 32885 - DNA, 25 bp, Homo sapien
atgggaatctattcaggactctcag

SEQ ID NO: 32886 - DNA, 25 bp, Homo sapien
atgggaatttttatttgagacagat

SEQ ID NO: 32887 - DNA, 25 bp, Homo sapien
atgggaatttttgtttgagacagat

SEQ ID NO: 32888 - DNA, 25 bp, Homo sapien
atgggacatagtatatatttctgtt

SEQ ID NO: 32889 - DNA, 25 bp, Homo sapien
atgggacatagtatgtatttctgtt

SEQ ID NO: 32890 - DNA, 25 bp, Homo sapien
atgggactcagcaattagtgaaaca

SEQ ID NO: 32891 - DNA, 25 bp, Homo sapien
atgggactcagtaattagtgaaaca

SEQ ID NO: 32892 - DNA, 25 bp, Homo sapien
atgggagtagtgatcaggacatttt

SEQ ID NO: 32893 - DNA, 25 bp, Homo sapien
atgggagtggtgatcaggacatttt

SEQ ID NO: 32894 - DNA, 25 bp, Homo sapien
atgggatactcagtactttgaagag

SEQ ID NO: 32895 - DNA, 25 bp, Homo sapien
atgggatactcagtcctttgaagag

SEQ ID NO: 32896 - DNA, 25 bp, Homo sapien
atgggatcaatcaagaaccttatca

SEQ ID NO: 32897 - DNA, 25 bp, Homo sapien
atgggatcagtcaagaaccttatca

SEQ ID NO: 32898 - DNA, 25 bp, Homo sapien
atgggatgcattttctaaacaacct

SEQ ID NO: 32899 - DNA, 25 bp, Homo sapien
atgggatgcgttttctaaacaacct

SEQ ID NO: 32900 - DNA, 25 bp, Homo sapien
atgggattcctataagcattgtatt

SEQ ID NO: 32901 - DNA, 25 bp, Homo sapien
atgggattcctgtaagcattgtatt

SEQ ID NO: 32902 - DNA, 25 bp, Homo sapien
atgggcaaatctgcagataactttg

SEQ ID NO: 32903 - DNA, 25 bp, Homo sapien
atgggcaaatctgtagataactttg

SEQ ID NO: 32904 - DNA, 25 bp, Homo sapien
atgggcaaatttaatgtaagagggc

SEQ ID NO: 32905 - DNA, 25 bp, Homo sapien
atgggcaaatttgatgtaagagggc

SEQ ID NO: 32906 - DNA, 25 bp, Homo sapien
atgggcacccaaaccaagcagttta

SEQ ID NO: 32907 - DNA, 25 bp, Homo sapien
atgggcacccacaccaagcagttta

SEQ ID NO: 32908 - DNA, 25 bp, Homo sapien
atgggcagcctataaaagctggtgt

SEQ ID NO: 32909 - DNA, 25 bp, Homo sapien
atgggcagcgtataaaagctggtgt

SEQ ID NO: 32910 - DNA, 25 bp, Homo sapien
atgggcagtctcattttctagaaca

SEQ ID NO: 32911 - DNA, 25 bp, Homo sapien
atgggcagtctctttttctagaaca

SEQ ID NO: 32912 - DNA, 25 bp, Homo sapien
atgggcatagaccctgcctagcact

SEQ ID NO: 32913 - DNA, 25 bp, Homo sapien
atgggcatagactctgcctagcact

SEQ ID NO: 32914 - DNA, 25 bp, Homo sapien
atgggccctttcgtcacctggactt

SEQ ID NO: 32915 - DNA, 25 bp, Homo sapien
atgggcccttttgtcacctggactt

SEQ ID NO: 32916 - DNA, 25 bp, Homo sapien
atgggcgaagaggcaaattgcagaa

SEQ ID NO: 32917 - DNA, 25 bp, Homo sapien
atgggcgaagaggcaagttgcagaa

SEQ ID NO: 32918 - DNA, 25 bp, Homo sapien
atgggctaatacagtaaatgcagtg

SEQ ID NO: 32919 - DNA, 25 bp, Homo sapien
atgggctaatatagtaaatgcagtg

SEQ ID NO: 32920 - DNA, 25 bp, Homo sapien
atgggctatctctccgtttacttag

SEQ ID NO: 32921 - DNA, 25 bp, Homo sapien
atgggctatctcttcgtttacttag

SEQ ID NO: 32922 - DNA, 25 bp, Homo sapien
atgggcttacagtcgtgtgtgctac

SEQ ID NO: 32923 - DNA, 25 bp, Homo sapien
atgggcttccagtcgtgtgtgctac

SEQ ID NO: 32924 - DNA, 25 bp, Homo sapien
atggggaatctggacttatttcttc

SEQ ID NO: 32925 - DNA, 25 bp, Homo sapien
atggggaatttggacttatttcttc

SEQ ID NO: 32926 - DNA, 25 bp, Homo sapien
atggggacaaaaatgcactctgaga

SEQ ID NO: 32927 - DNA, 25 bp, Homo sapien
atggggacagaaatgcactctgaga

SEQ ID NO: 32928 - DNA, 25 bp, Homo sapien
atggggacatgcggaacactgaaaa

SEQ ID NO: 32929 - DNA, 25 bp, Homo sapien
atggggacatgcgtaacactgaaaa

SEQ ID NO: 32930 - DNA, 25 bp, Homo sapien
atggggagatgacgagtttaatttt

SEQ ID NO: 32931 - DNA, 25 bp, Homo sapien
atggggagatgatgagtttaatttt

SEQ ID NO: 32932 - DNA, 25 bp, Homo sapien
atggggatgacaatgcttcctgtct

SEQ ID NO: 32933 - DNA, 25 bp, Homo sapien
atggggatgacagtgcttcctgtct

SEQ ID NO: 32934 - DNA, 25 bp, Homo sapien
atggggctcttttctaagtgcatgt

SEQ ID NO: 32935 - DNA, 25 bp, Homo sapien
atggggctcttttgtaagtgcatgt

SEQ ID NO: 32936 - DNA, 25 bp, Homo sapien
atggggtaccttcatcggactcatc

SEQ ID NO: 32937 - DNA, 25 bp, Homo sapien
atggggtacctttatcggactcatc

SEQ ID NO: 32938 - DNA, 25 bp, Homo sapien
atggggttgaaatgcatgctcccca

SEQ ID NO: 32939 - DNA, 25 bp, Homo sapien
atggggttgaattgcatgctcccca

SEQ ID NO: 32940 - DNA, 25 bp, Homo sapien
atggggttgccagacacctagtcct

SEQ ID NO: 32941 - DNA, 25 bp, Homo sapien
atggggttgcctgacacctagtcct

SEQ ID NO: 32942 - DNA, 25 bp, Homo sapien
atggggtttaataaggtttcaaagt

SEQ ID NO: 32943 - DNA, 25 bp, Homo sapien
atggggtttgaactcatctctgaaa

SEQ ID NO: 32944 - DNA, 25 bp, Homo sapien
atggggtttgataaggtttcaaagt

SEQ ID NO: 32945 - DNA, 25 bp, Homo sapien
atggggtttgatctcatctctgaaa

SEQ ID NO: 32946 - DNA, 25 bp, Homo sapien
atgggtatgttcacgatatcactga

SEQ ID NO: 32947 - DNA, 25 bp, Homo sapien
atgggtatgttcatgatatcactga

SEQ ID NO: 32948 - DNA, 25 bp, Homo sapien
atgggtattgtaatcggagcagggc

SEQ ID NO: 32949 - DNA, 25 bp, Homo sapien
atgggtattgtaattggagcagggc

SEQ ID NO: 32950 - DNA, 25 bp, Homo sapien
atgggtccaaaagcatgcagttcat

SEQ ID NO: 32951 - DNA, 25 bp, Homo sapien
atgggtcccacatgcaaattcaaag

SEQ ID NO: 32952 - DNA, 25 bp, Homo sapien
atgggtcccacgtgcaaattcaaag

SEQ ID NO: 32953 - DNA, 25 bp, Homo sapien
atgggtccgaaagcatgcagttcat

SEQ ID NO: 32954 - DNA, 25 bp, Homo sapien
atgggtgtccaaaaagtgttaacat

SEQ ID NO: 32955 - DNA, 25 bp, Homo sapien
atgggtgtgcaacactgggttttgc

SEQ ID NO: 32956 - DNA, 25 bp, Homo sapien
atgggtgtgcaacattgggttttgc

SEQ ID NO: 32957 - DNA, 25 bp, Homo sapien
atgggtgttcaaaaagtgttaacat

SEQ ID NO: 32958 - DNA, 25 bp, Homo sapien
atgggtgttgtacaaatggtagttc

SEQ ID NO: 32959 - DNA, 25 bp, Homo sapien
atgggtgttgtacacatggtagttc

SEQ ID NO: 32960 - DNA, 25 bp, Homo sapien
atgggttacaatttgtcatcttgat

SEQ ID NO: 32961 - DNA, 25 bp, Homo sapien
atgggttacaatttgttatcttgat

SEQ ID NO: 32962 - DNA, 25 bp, Homo sapien
atgggttacgttaattgttttgcgt

SEQ ID NO: 32963 - DNA, 25 bp, Homo sapien
atgggttatgttaattgttttgcgt

SEQ ID NO: 32964 - DNA, 25 bp, Homo sapien
atgggtttccatgcaccaataaaat

SEQ ID NO: 32965 - DNA, 25 bp, Homo sapien
atgggtttccatgtaccaataaaat

SEQ ID NO: 32966 - DNA, 25 bp, Homo sapien
atgggttttcaactgacagccttct

SEQ ID NO: 32967 - DNA, 25 bp, Homo sapien
atgggttttcagctgacagccttct

SEQ ID NO: 32968 - DNA, 25 bp, Homo sapien
atggtaaaagcaatgtaggctgata

SEQ ID NO: 32969 - DNA, 25 bp, Homo sapien
atggtaaaatagctcctttgcacta

SEQ ID NO: 32970 - DNA, 25 bp, Homo sapien
atggtaaagctccttggtctctgga

SEQ ID NO: 32971 - DNA, 25 bp, Homo sapien
atggtaaagctctttggtctctgga

SEQ ID NO: 32972 - DNA, 25 bp, Homo sapien
atggtaaaggcaatgtaggctgata

SEQ ID NO: 32973 - DNA, 25 bp, Homo sapien
atggtaaagtagctcctttgcacta

SEQ ID NO: 32974 - DNA, 25 bp, Homo sapien
atggtaactacatcgtctgaaagga

SEQ ID NO: 32975 - DNA, 25 bp, Homo sapien
atggtaactacattgtctgaaagga

SEQ ID NO: 32976 - DNA, 25 bp, Homo sapien
atggtaagagagacttttctaacaa

SEQ ID NO: 32977 - DNA, 25 bp, Homo sapien
atggtaagagatacttttctaacaa

SEQ ID NO: 32978 - DNA, 25 bp, Homo sapien
atggtaagatacagagaatttagat

SEQ ID NO: 32979 - DNA, 25 bp, Homo sapien
atggtaagatagagagaatttagat

SEQ ID NO: 32980 - DNA, 25 bp, Homo sapien
atggtaatgttaagacacaaattaa

SEQ ID NO: 32981 - DNA, 25 bp, Homo sapien
atggtaatgttgagacacaaattaa

SEQ ID NO: 32982 - DNA, 25 bp, Homo sapien
atggtaattaaagtcatgagagtgg

SEQ ID NO: 32983 - DNA, 25 bp, Homo sapien
atggtaattaaagtgatgagagtgg

SEQ ID NO: 32984 - DNA, 25 bp, Homo sapien
atggtacacatagtagattcatagt

SEQ ID NO: 32985 - DNA, 25 bp, Homo sapien
atggtacacatagtggattcatagt

SEQ ID NO: 32986 - DNA, 25 bp, Homo sapien
atggtaccaagaagaaatatctgca

SEQ ID NO: 32987 - DNA, 25 bp, Homo sapien
atggtacccagaagaaatatctgca

SEQ ID NO: 32988 - DNA, 25 bp, Homo sapien
atggtactgatgataaaaaaaaaaa

SEQ ID NO: 32989 - DNA, 25 bp, Homo sapien
atggtactgatgttaaaaaaaaaaa

SEQ ID NO: 32990 - DNA, 25 bp, Homo sapien
atggtacttaggcattaggacttta

SEQ ID NO: 32991 - DNA, 25 bp, Homo sapien
atggtacttaggcattgggacttta

SEQ ID NO: 32992 - DNA, 25 bp, Homo sapien
atggtagatatgactcttttttggc

SEQ ID NO: 32993 - DNA, 25 bp, Homo sapien
atggtagatatggctcttttttggc

SEQ ID NO: 32994 - DNA, 25 bp, Homo sapien
atggtagattacactgatagatttt

SEQ ID NO: 32995 - DNA, 25 bp, Homo sapien
atggtagattacattgatagatttt

SEQ ID NO: 32996 - DNA, 25 bp, Homo sapien
atggtagctgtagtttattgagtac

SEQ ID NO: 32997 - DNA, 25 bp, Homo sapien
atggtagctgtggtttattgagtac

SEQ ID NO: 32998 - DNA, 25 bp, Homo sapien
atggtatagcgccaacattcgaagt

SEQ ID NO: 32999 - DNA, 25 bp, Homo sapien
atggtatagtgccaacattcgaagt

SEQ ID NO: 33000 - DNA, 25 bp, Homo sapien
atggtatcaataaagagatgaaggc

SEQ ID NO: 33001 - DNA, 25 bp, Homo sapien
atggtatcagtaaagagatgaaggc

SEQ ID NO: 33002 - DNA, 25 bp, Homo sapien
atggtatctcactcttgaaaatggg

SEQ ID NO: 33003 - DNA, 25 bp, Homo sapien
atggtatctcattcttgaaaatggg

SEQ ID NO: 33004 - DNA, 25 bp, Homo sapien
atggtatgctgggtgactatgtaat

SEQ ID NO: 33005 - DNA, 25 bp, Homo sapien
atggtatgctgggtgattatgtaat

SEQ ID NO: 33006 - DNA, 25 bp, Homo sapien
atggtatgggtcctagcactgagga

SEQ ID NO: 33007 - DNA, 25 bp, Homo sapien
atggtatgggtcttagcactgagga

SEQ ID NO: 33008 - DNA, 25 bp, Homo sapien
atggtattgatacttgcagatgttt

SEQ ID NO: 33009 - DNA, 25 bp, Homo sapien
atggtattgatgcttgcagatgttt

SEQ ID NO: 33010 - DNA, 25 bp, Homo sapien
atggtcaagtcctgtctcctataac

SEQ ID NO: 33011 - DNA, 25 bp, Homo sapien
atggtcaagtcctttctcctataac

SEQ ID NO: 33012 - DNA, 25 bp, Homo sapien
atggtcaagttccagtgagggccct

SEQ ID NO: 33013 - DNA, 25 bp, Homo sapien
atggtcaagttccggtgagggccct

SEQ ID NO: 33014 - DNA, 25 bp, Homo sapien
atggtcacacctggcacaaccgcca

SEQ ID NO: 33015 - DNA, 25 bp, Homo sapien
atggtcacgcctggcacaaccgcca

SEQ ID NO: 33016 - DNA, 25 bp, Homo sapien
atggtcagaatgtttgctgccctcc

SEQ ID NO: 33017 - DNA, 25 bp, Homo sapien
atggtcagaatgtttgttgccctcc

SEQ ID NO: 33018 - DNA, 25 bp, Homo sapien
atggtcattatttgaccgtacatgt

SEQ ID NO: 33019 - DNA, 25 bp, Homo sapien
atggtcattatttgactgtacatgt

SEQ ID NO: 33020 - DNA, 25 bp, Homo sapien
atggtccaagcaagagtttcctact

SEQ ID NO: 33021 - DNA, 25 bp, Homo sapien
atggtccaggcaagagtttcctact

SEQ ID NO: 33022 - DNA, 25 bp, Homo sapien
atggtcctcgcaacttctgagtcac

SEQ ID NO: 33023 - DNA, 25 bp, Homo sapien
atggtcctcgccacttctgagtcac

SEQ ID NO: 33024 - DNA, 25 bp, Homo sapien
atggtcctgcacaagttggatttga

SEQ ID NO: 33025 - DNA, 25 bp, Homo sapien
atggtcctgtacaagttggatttga

SEQ ID NO: 33026 - DNA, 25 bp, Homo sapien
atggtctaatgaattccctttcttc

SEQ ID NO: 33027 - DNA, 25 bp, Homo sapien
atggtctaatgaattctctttcttc

SEQ ID NO: 33028 - DNA, 25 bp, Homo sapien
atggtctactggcggtatcctttcc

SEQ ID NO: 33029 - DNA, 25 bp, Homo sapien
atggtctactggtggtatcctttcc

SEQ ID NO: 33030 - DNA, 25 bp, Homo sapien
atggtctcaaggcctctatacatta

SEQ ID NO: 33031 - DNA, 25 bp, Homo sapien
atggtctcactaactgatatgtcaa

SEQ ID NO: 33032 - DNA, 25 bp, Homo sapien
atggtctcactaattgatatgtcaa

SEQ ID NO: 33033 - DNA, 25 bp, Homo sapien
atggtctcacttacaatggaatatc

SEQ ID NO: 33034 - DNA, 25 bp, Homo sapien
atggtctcacttgcaatggaatatc

SEQ ID NO: 33035 - DNA, 25 bp, Homo sapien
atggtctcgaggcctctatacatta

SEQ ID NO: 33036 - DNA, 25 bp, Homo sapien
atggtctctgagtgatagtgatgtg

SEQ ID NO: 33037 - DNA, 25 bp, Homo sapien
atggtctcttagtgatagtgatgtg

SEQ ID NO: 33038 - DNA, 25 bp, Homo sapien
atggtctgaccattgtctgtttgta

SEQ ID NO: 33039 - DNA, 25 bp, Homo sapien
atggtctgaccgttgtctgtttgta

SEQ ID NO: 33040 - DNA, 25 bp, Homo sapien
atggtcttccttccggaacataatc

SEQ ID NO: 33041 - DNA, 25 bp, Homo sapien
atggtcttctttccggaacataatc

SEQ ID NO: 33042 - DNA, 25 bp, Homo sapien
atggtcttggttcattttcacccat

SEQ ID NO: 33043 - DNA, 25 bp, Homo sapien
atggtctttccttggtgtgtgcatg

SEQ ID NO: 33044 - DNA, 25 bp, Homo sapien
atggtctttgttcattttcacccat

SEQ ID NO: 33045 - DNA, 25 bp, Homo sapien
atggtcttttcttggtgtgtgcatg

SEQ ID NO: 33046 - DNA, 25 bp, Homo sapien
atggtgaaatgactatgggttctgt

SEQ ID NO: 33047 - DNA, 25 bp, Homo sapien
atggtgaaatgactctgggttctgt

SEQ ID NO: 33048 - DNA, 25 bp, Homo sapien
atggtgacaacaaaaatgaaatggt

SEQ ID NO: 33049 - DNA, 25 bp, Homo sapien
atggtgacaacagaaatgaaatggt

SEQ ID NO: 33050 - DNA, 25 bp, Homo sapien
atggtgactgataactacccactct

SEQ ID NO: 33051 - DNA, 25 bp, Homo sapien
atggtgactgataattacccactct

SEQ ID NO: 33052 - DNA, 25 bp, Homo sapien
atggtgagataagccacgagtgcag

SEQ ID NO: 33053 - DNA, 25 bp, Homo sapien
atggtgagataagccatgagtgcag

SEQ ID NO: 33054 - DNA, 25 bp, Homo sapien
atggtgaggaagcactaacacttgt

SEQ ID NO: 33055 - DNA, 25 bp, Homo sapien
atggtgaggaagcagtaacacttgt

SEQ ID NO: 33056 - DNA, 25 bp, Homo sapien
atggtgatcctacaagattataatg

SEQ ID NO: 33057 - DNA, 25 bp, Homo sapien
atggtgatcctataagattataatg

SEQ ID NO: 33058 - DNA, 25 bp, Homo sapien
atggtgatttgctatatagatcaac

SEQ ID NO: 33059 - DNA, 25 bp, Homo sapien
atggtgatttgctgtatagatcaac

SEQ ID NO: 33060 - DNA, 25 bp, Homo sapien
atggtgccagcaaaagagaaggcaa

SEQ ID NO: 33061 - DNA, 25 bp, Homo sapien
atggtgccagcgaaagagaaggcaa

SEQ ID NO: 33062 - DNA, 25 bp, Homo sapien
atggtggtaagagagctgacataac

SEQ ID NO: 33063 - DNA, 25 bp, Homo sapien
atggtggtatgagagctgacataac

SEQ ID NO: 33064 - DNA, 25 bp, Homo sapien
atggtggtgacaagataaaataagg

SEQ ID NO: 33065 - DNA, 25 bp, Homo sapien
atggtggtgacaaggtaaaataagg

SEQ ID NO: 33066 - DNA, 25 bp, Homo sapien
atggtggtgcattactggaggtccc

SEQ ID NO: 33067 - DNA, 25 bp, Homo sapien
atggtggtgcattacttgaggtccc

SEQ ID NO: 33068 - DNA, 25 bp, Homo sapien
atggtgtaccacagggagcctggac

SEQ ID NO: 33069 - DNA, 25 bp, Homo sapien
atggtgtaccacggggagcctggac

SEQ ID NO: 33070 - DNA, 25 bp, Homo sapien
atggtgtgctctactcccaggagtc

SEQ ID NO: 33071 - DNA, 25 bp, Homo sapien
atggtgtgctctactcgcaggagtc

SEQ ID NO: 33072 - DNA, 25 bp, Homo sapien
atggtgttgctagaagtattatatc

SEQ ID NO: 33073 - DNA, 25 bp, Homo sapien
atggtgttgctagcagtattatatc

SEQ ID NO: 33074 - DNA, 25 bp, Homo sapien
atggtgttggacttacataagagaa

SEQ ID NO: 33075 - DNA, 25 bp, Homo sapien
atggtgttggatttacataagagaa

SEQ ID NO: 33076 - DNA, 25 bp, Homo sapien
atggttaacgataatggtctccact

SEQ ID NO: 33077 - DNA, 25 bp, Homo sapien
atggttaactaactacatgctaaga

SEQ ID NO: 33078 - DNA, 25 bp, Homo sapien
atggttaactaattacatgctaaga

SEQ ID NO: 33079 - DNA, 25 bp, Homo sapien
atggttaatcacgaagcagtggcca

SEQ ID NO: 33080 - DNA, 25 bp, Homo sapien
atggttaatcatgaagcagtggcca

SEQ ID NO: 33081 - DNA, 25 bp, Homo sapien
atggttaatgataatggtctccact

SEQ ID NO: 33082 - DNA, 25 bp, Homo sapien
atggttacacgtccttccctggata

SEQ ID NO: 33083 - DNA, 25 bp, Homo sapien
atggttacagcatgtatgctttcaa

SEQ ID NO: 33084 - DNA, 25 bp, Homo sapien
atggttacagcatttatgctttcaa

SEQ ID NO: 33085 - DNA, 25 bp, Homo sapien
atggttacatgtccttccctggata

SEQ ID NO: 33086 - DNA, 25 bp, Homo sapien
atggttacctacatatcagtttttc

SEQ ID NO: 33087 - DNA, 25 bp, Homo sapien
atggttacctacgtatcagtttttc

SEQ ID NO: 33088 - DNA, 25 bp, Homo sapien
atggttactccaactcaccttgtcc

SEQ ID NO: 33089 - DNA, 25 bp, Homo sapien
atggttactccaactcgccttgtcc

SEQ ID NO: 33090 - DNA, 25 bp, Homo sapien
atggttagaaagggaataaactgga

SEQ ID NO: 33091 - DNA, 25 bp, Homo sapien
atggttagaaatggaataaactgga

SEQ ID NO: 33092 - DNA, 25 bp, Homo sapien
atggttagaaggttaagttctgggt

SEQ ID NO: 33093 - DNA, 25 bp, Homo sapien
atggttaggaggttaagttctgggt

SEQ ID NO: 33094 - DNA, 25 bp, Homo sapien
atggttagtatggattggtgtattt

SEQ ID NO: 33095 - DNA, 25 bp, Homo sapien
atggttagtatgggttggtgtattt

SEQ ID NO: 33096 - DNA, 25 bp, Homo sapien
atggttcatagttttggtattgtat

SEQ ID NO: 33097 - DNA, 25 bp, Homo sapien
atggttcattgttttggtattgtat

SEQ ID NO: 33098 - DNA, 25 bp, Homo sapien
atggttccagagaacactgaactga

SEQ ID NO: 33099 - DNA, 25 bp, Homo sapien
atggttccatagaacactgaactga

SEQ ID NO: 33100 - DNA, 25 bp, Homo sapien
atggttcgtggccaaattagatcac

SEQ ID NO: 33101 - DNA, 25 bp, Homo sapien
atggttcgtggcctaattagatcac

SEQ ID NO: 33102 - DNA, 25 bp, Homo sapien
atggttgaacttctttttcctctca

SEQ ID NO: 33103 - DNA, 25 bp, Homo sapien
atggttgaattcccggaaatatgta

SEQ ID NO: 33104 - DNA, 25 bp, Homo sapien
atggttgaattcctggaaatatgta

SEQ ID NO: 33105 - DNA, 25 bp, Homo sapien
atggttgaatttctttttcctctca

SEQ ID NO: 33106 - DNA, 25 bp, Homo sapien
atggttgacagccttaagcagcata

SEQ ID NO: 33107 - DNA, 25 bp, Homo sapien
atggttgacagccttatgcagcata

SEQ ID NO: 33108 - DNA, 25 bp, Homo sapien
atggttgagattgtctcatagagaa

SEQ ID NO: 33109 - DNA, 25 bp, Homo sapien
atggttgagattttctcatagagaa

SEQ ID NO: 33110 - DNA, 25 bp, Homo sapien
atggttgatcctaaattgaccagtt

SEQ ID NO: 33111 - DNA, 25 bp, Homo sapien
atggttgattctaaattgaccagtt

SEQ ID NO: 33112 - DNA, 25 bp, Homo sapien
atggttgtactggagagcaatttgt

SEQ ID NO: 33113 - DNA, 25 bp, Homo sapien
atggttgtgcttgaatgatagagga

SEQ ID NO: 33114 - DNA, 25 bp, Homo sapien
atggttgtggttgaatgatagagga

SEQ ID NO: 33115 - DNA, 25 bp, Homo sapien
atggttgttctggagagcaatttgt

SEQ ID NO: 33116 - DNA, 25 bp, Homo sapien
atggttgttttacaccactgagttc

SEQ ID NO: 33117 - DNA, 25 bp, Homo sapien
atggttgttttataccactgagttc

SEQ ID NO: 33118 - DNA, 25 bp, Homo sapien
atggtttccagattcacatgcacat

SEQ ID NO: 33119 - DNA, 25 bp, Homo sapien
atggtttccaggcttacagaggagg

SEQ ID NO: 33120 - DNA, 25 bp, Homo sapien
atggtttccagggctgtaatattat

SEQ ID NO: 33121 - DNA, 25 bp, Homo sapien
atggtttccagggttgtaatattat

SEQ ID NO: 33122 - DNA, 25 bp, Homo sapien
atggtttccaggtttacagaggagg

SEQ ID NO: 33123 - DNA, 25 bp, Homo sapien
atggtttccggattcacatgcacat

SEQ ID NO: 33124 - DNA, 25 bp, Homo sapien
atggtttcgagttagagagaagaga

SEQ ID NO: 33125 - DNA, 25 bp, Homo sapien
atggtttcgagttcgagagaagaga

SEQ ID NO: 33126 - DNA, 25 bp, Homo sapien
atggtttctcaggcctaatgattta

SEQ ID NO: 33127 - DNA, 25 bp, Homo sapien
atggtttctcaggcttaatgattta

SEQ ID NO: 33128 - DNA, 25 bp, Homo sapien
atggtttgtatctggttattaaaag

SEQ ID NO: 33129 - DNA, 25 bp, Homo sapien
atggtttgtatctgtttattaaaag

SEQ ID NO: 33130 - DNA, 25 bp, Homo sapien
atggttttaatttgcgtccctaata

SEQ ID NO: 33131 - DNA, 25 bp, Homo sapien
atggttttaatttgtgtccctaata

SEQ ID NO: 33132 - DNA, 25 bp, Homo sapien
atggttttgactagccatgactgac

SEQ ID NO: 33133 - DNA, 25 bp, Homo sapien
atggttttgactggccatgactgac

SEQ ID NO: 33134 - DNA, 25 bp, Homo sapien
atgtaaaaattgttcaactatacag

SEQ ID NO: 33135 - DNA, 25 bp, Homo sapien
atgtaaaaattgttcagctatacag

SEQ ID NO: 33136 - DNA, 25 bp, Homo sapien
atgtaaaacacaatcgaagctatca

SEQ ID NO: 33137 - DNA, 25 bp, Homo sapien
atgtaaaacacagtcgaagctatca

SEQ ID NO: 33138 - DNA, 25 bp, Homo sapien
atgtaaaacatctccataatttttg

SEQ ID NO: 33139 - DNA, 25 bp, Homo sapien
atgtaaaacggtaggatgctaggag

SEQ ID NO: 33140 - DNA, 25 bp, Homo sapien
atgtaaaacgtctccataatttttg

SEQ ID NO: 33141 - DNA, 25 bp, Homo sapien
atgtaaaatggtaggatgctaggag

SEQ ID NO: 33142 - DNA, 25 bp, Homo sapien
atgtaaactggtacatctattccag

SEQ ID NO: 33143 - DNA, 25 bp, Homo sapien
atgtaaactggtgcatctattccag

SEQ ID NO: 33144 - DNA, 25 bp, Homo sapien
atgtaaagatgtatgtgtatataca

SEQ ID NO: 33145 - DNA, 25 bp, Homo sapien
atgtaaagcttcattttttttcctc

SEQ ID NO: 33146 - DNA, 25 bp, Homo sapien
atgtaaagcttcgttttttttcctc

SEQ ID NO: 33147 - DNA, 25 bp, Homo sapien
atgtaaaggtgtatgtgtatataca

SEQ ID NO: 33148 - DNA, 25 bp, Homo sapien
atgtaaagttgatcattttaaacac

SEQ ID NO: 33149 - DNA, 25 bp, Homo sapien
atgtaaagttgatcgttttaaacac

SEQ ID NO: 33150 - DNA, 25 bp, Homo sapien
atgtaaatagtgaaacaccattatc

SEQ ID NO: 33151 - DNA, 25 bp, Homo sapien
atgtaaatattgaaacaccattatc

SEQ ID NO: 33152 - DNA, 25 bp, Homo sapien
atgtaaatgggcctatggtatttta

SEQ ID NO: 33153 - DNA, 25 bp, Homo sapien
atgtaaatgggtctatggtatttta

SEQ ID NO: 33154 - DNA, 25 bp, Homo sapien
atgtaacattgctaaaagtcctatg

SEQ ID NO: 33155 - DNA, 25 bp, Homo sapien
atgtaacattgctcaaagtcctatg

SEQ ID NO: 33156 - DNA, 25 bp, Homo sapien
atgtaaccttctcggtcttgtaaaa

SEQ ID NO: 33157 - DNA, 25 bp, Homo sapien
atgtaaccttcttggtcttgtaaaa

SEQ ID NO: 33158 - DNA, 25 bp, Homo sapien
atgtaagcccagggaaatagtaatt

SEQ ID NO: 33159 - DNA, 25 bp, Homo sapien
atgtaagcccagggaactagtaatt

SEQ ID NO: 33160 - DNA, 25 bp, Homo sapien
atgtaagctctacaaaggcaggtgg

SEQ ID NO: 33161 - DNA, 25 bp, Homo sapien
atgtaagctctataaaggcaggtgg

SEQ ID NO: 33162 - DNA, 25 bp, Homo sapien
atgtaaggctcaccatgtcaactaa

SEQ ID NO: 33163 - DNA, 25 bp, Homo sapien
atgtaaggctcaccgtgtcaactaa

SEQ ID NO: 33164 - DNA, 25 bp, Homo sapien
atgtaagtgatagataagcttaatt

SEQ ID NO: 33165 - DNA, 25 bp, Homo sapien
atgtaagtgctagataagcttaatt

SEQ ID NO: 33166 - DNA, 25 bp, Homo sapien
atgtaagttggtgcttggtagagtt

SEQ ID NO: 33167 - DNA, 25 bp, Homo sapien
atgtaagttggtgtttggtagagtt

SEQ ID NO: 33168 - DNA, 25 bp, Homo sapien
atgtaagtttgacgtgaagtgggct

SEQ ID NO: 33169 - DNA, 25 bp, Homo sapien
atgtaagtttgaggtgaagtgggct

SEQ ID NO: 33170 - DNA, 25 bp, Homo sapien
atgtaatcatcagatccacttttta

SEQ ID NO: 33171 - DNA, 25 bp, Homo sapien
atgtaatcatctgatccacttttta

SEQ ID NO: 33172 - DNA, 25 bp, Homo sapien
atgtaatgcggctaatgccaactta

SEQ ID NO: 33173 - DNA, 25 bp, Homo sapien
atgtaatggggctaatgccaactta

SEQ ID NO: 33174 - DNA, 25 bp, Homo sapien
atgtaatgtcaacttacaaacctct

SEQ ID NO: 33175 - DNA, 25 bp, Homo sapien
atgtaatgtcaacttataaacctct

SEQ ID NO: 33176 - DNA, 25 bp, Homo sapien
atgtaattcctgacattgagcttca

SEQ ID NO: 33177 - DNA, 25 bp, Homo sapien
atgtaattcctgacgttgagcttca

SEQ ID NO: 33178 - DNA, 25 bp, Homo sapien
atgtaattcttccggtgaatttaac

SEQ ID NO: 33179 - DNA, 25 bp, Homo sapien
atgtaattcttctggtgaatttaac

SEQ ID NO: 33180 - DNA, 25 bp, Homo sapien
atgtacaaaaagaaccagataaatg

SEQ ID NO: 33181 - DNA, 25 bp, Homo sapien
atgtacaaaaagaatcagataaatg

SEQ ID NO: 33182 - DNA, 25 bp, Homo sapien
atgtacacaaacactcactgacccg

SEQ ID NO: 33183 - DNA, 25 bp, Homo sapien
atgtacacaaacgctcactgacccg

SEQ ID NO: 33184 - DNA, 25 bp, Homo sapien
atgtacacaatatgttttctttatc

SEQ ID NO: 33185 - DNA, 25 bp, Homo sapien
atgtacacattatgttttctttatc

SEQ ID NO: 33186 - DNA, 25 bp, Homo sapien
atgtacagaacgacgcagttgaagg

SEQ ID NO: 33187 - DNA, 25 bp, Homo sapien
atgtacagaacgatgcagttgaagg

SEQ ID NO: 33188 - DNA, 25 bp, Homo sapien
atgtacagtttaatgggttatgtta

SEQ ID NO: 33189 - DNA, 25 bp, Homo sapien
atgtacagtttagtgggttatgtta

SEQ ID NO: 33190 - DNA, 25 bp, Homo sapien
atgtacctaacagcatatgtatcag

SEQ ID NO: 33191 - DNA, 25 bp, Homo sapien
atgtacctaaccgcatatgtatcag

SEQ ID NO: 33192 - DNA, 25 bp, Homo sapien
atgtacctaattacatcattgcaat

SEQ ID NO: 33193 - DNA, 25 bp, Homo sapien
atgtacctaattatatcattgcaat

SEQ ID NO: 33194 - DNA, 25 bp, Homo sapien
atgtacctactgcaaatggcttctc

SEQ ID NO: 33195 - DNA, 25 bp, Homo sapien
atgtacctactgcatatggcttctc

SEQ ID NO: 33196 - DNA, 25 bp, Homo sapien
atgtacggtagacactgatgtgtta

SEQ ID NO: 33197 - DNA, 25 bp, Homo sapien
atgtacggtagacattgatgtgtta

SEQ ID NO: 33198 - DNA, 25 bp, Homo sapien
atgtacggtgttcatcaattcctat

SEQ ID NO: 33199 - DNA, 25 bp, Homo sapien
atgtacggtgttcgtcaattcctat

SEQ ID NO: 33200 - DNA, 25 bp, Homo sapien
atgtacggttgcactgctgactaag

SEQ ID NO: 33201 - DNA, 25 bp, Homo sapien
atgtacggttgcattgctgactaag

SEQ ID NO: 33202 - DNA, 25 bp, Homo sapien
atgtacgttcaaattcctcaattat

SEQ ID NO: 33203 - DNA, 25 bp, Homo sapien
atgtacgttcaagttcctcaattat

SEQ ID NO: 33204 - DNA, 25 bp, Homo sapien
atgtactatggcagcaaatcctgca

SEQ ID NO: 33205 - DNA, 25 bp, Homo sapien
atgtactatggcggcaaatcctgca

SEQ ID NO: 33206 - DNA, 25 bp, Homo sapien
atgtactcactgagattttgggcag

SEQ ID NO: 33207 - DNA, 25 bp, Homo sapien
atgtactcactgtgattttgggcag

SEQ ID NO: 33208 - DNA, 25 bp, Homo sapien
atgtactctccacgccataatttgt

SEQ ID NO: 33209 - DNA, 25 bp, Homo sapien
atgtactctccacggcataatttgt

SEQ ID NO: 33210 - DNA, 25 bp, Homo sapien
atgtactgaaggcttgaaacttcca

SEQ ID NO: 33211 - DNA, 25 bp, Homo sapien
atgtactgaaggcttgcaacttcca

SEQ ID NO: 33212 - DNA, 25 bp, Homo sapien
atgtactgcagtctataatatataa

SEQ ID NO: 33213 - DNA, 25 bp, Homo sapien
atgtactgcagtctatgatatataa

SEQ ID NO: 33214 - DNA, 25 bp, Homo sapien
atgtactttaaaccactgaaatgta

SEQ ID NO: 33215 - DNA, 25 bp, Homo sapien
atgtactttaaactactgaaatgta

SEQ ID NO: 33216 - DNA, 25 bp, Homo sapien
atgtagaaaagccatattttatgaa

SEQ ID NO: 33217 - DNA, 25 bp, Homo sapien
atgtagaaagatgaagattcaggca

SEQ ID NO: 33218 - DNA, 25 bp, Homo sapien
atgtagaaagatgaaggttcaggca

SEQ ID NO: 33219 - DNA, 25 bp, Homo sapien
atgtagaaaggccatattttatgaa

SEQ ID NO: 33220 - DNA, 25 bp, Homo sapien
atgtagaagtgaagcgtaaaatcta

SEQ ID NO: 33221 - DNA, 25 bp, Homo sapien
atgtagaagtgaagtgtaaaatcta

SEQ ID NO: 33222 - DNA, 25 bp, Homo sapien
atgtagagccagtaaaacattacaa

SEQ ID NO: 33223 - DNA, 25 bp, Homo sapien
atgtagagccagtgaaacattacaa

SEQ ID NO: 33224 - DNA, 25 bp, Homo sapien
atgtagaggcctactcctcacagca

SEQ ID NO: 33225 - DNA, 25 bp, Homo sapien
atgtagaggccttctcctcacagca

SEQ ID NO: 33226 - DNA, 25 bp, Homo sapien
atgtagcatatagaatatctgaacc

SEQ ID NO: 33227 - DNA, 25 bp, Homo sapien
atgtagcatatagaatgtctgaacc

SEQ ID NO: 33228 - DNA, 25 bp, Homo sapien
atgtagccaacgaattatgtcagaa

SEQ ID NO: 33229 - DNA, 25 bp, Homo sapien
atgtagccaacgaattgtgtcagaa

SEQ ID NO: 33230 - DNA, 25 bp, Homo sapien
atgtagcccaaactcaagaatgaga

SEQ ID NO: 33231 - DNA, 25 bp, Homo sapien
atgtagcccaaactgaagaatgaga

SEQ ID NO: 33232 - DNA, 25 bp, Homo sapien
atgtagcctctatcctgaccttagg

SEQ ID NO: 33233 - DNA, 25 bp, Homo sapien
atgtagcctctatgctgaccttagg

SEQ ID NO: 33234 - DNA, 25 bp, Homo sapien
atgtagctgataatgatgatcctaa

SEQ ID NO: 33235 - DNA, 25 bp, Homo sapien
atgtagctgataattatgatcctaa

SEQ ID NO: 33236 - DNA, 25 bp, Homo sapien
atgtagctgctgactttaaattgaa

SEQ ID NO: 33237 - DNA, 25 bp, Homo sapien
atgtagctgctgattttaaattgaa

SEQ ID NO: 33238 - DNA, 25 bp, Homo sapien
atgtaggaagactctacaaggacat

SEQ ID NO: 33239 - DNA, 25 bp, Homo sapien
atgtaggaagactctataaggacat

SEQ ID NO: 33240 - DNA, 25 bp, Homo sapien
atgtaggcatttttatacttttgaa

SEQ ID NO: 33241 - DNA, 25 bp, Homo sapien
atgtaggcatttttgtacttttgaa

SEQ ID NO: 33242 - DNA, 25 bp, Homo sapien
atgtaggtgttgaatacttgaaggg

SEQ ID NO: 33243 - DNA, 25 bp, Homo sapien
atgtaggtgttgaatagttgaaggg

SEQ ID NO: 33244 - DNA, 25 bp, Homo sapien
atgtagtcagttacaaatcaaacat

SEQ ID NO: 33245 - DNA, 25 bp, Homo sapien
atgtagtcagttacaattcaaacat

SEQ ID NO: 33246 - DNA, 25 bp, Homo sapien
atgtagtcttgaagtcagttggaat

SEQ ID NO: 33247 - DNA, 25 bp, Homo sapien
atgtagtcttgaattcagttggaat

SEQ ID NO: 33248 - DNA, 25 bp, Homo sapien
atgtataaattgatgtgtttttgta

SEQ ID NO: 33249 - DNA, 25 bp, Homo sapien
atgtataagttgatgtgtttttgta

SEQ ID NO: 33250 - DNA, 25 bp, Homo sapien
atgtataattaaccagaagtccagt

SEQ ID NO: 33251 - DNA, 25 bp, Homo sapien
atgtataattaactagaagtccagt

SEQ ID NO: 33252 - DNA, 25 bp, Homo sapien
atgtatagctttgccaccagtatct

SEQ ID NO: 33253 - DNA, 25 bp, Homo sapien
atgtatagctttgtcaccagtatct

SEQ ID NO: 33254 - DNA, 25 bp, Homo sapien
atgtataggtcatagtcatttgctt

SEQ ID NO: 33255 - DNA, 25 bp, Homo sapien
atgtataggtcatagtgatttgctt

SEQ ID NO: 33256 - DNA, 25 bp, Homo sapien
atgtatatggtacaggctattgttc

SEQ ID NO: 33257 - DNA, 25 bp, Homo sapien
atgtatatggtataggctattgttc

SEQ ID NO: 33258 - DNA, 25 bp, Homo sapien
atgtatccatcttaattctgccatc

SEQ ID NO: 33259 - DNA, 25 bp, Homo sapien
atgtatccctcttaattctgccatc

SEQ ID NO: 33260 - DNA, 25 bp, Homo sapien
atgtatcttgtaaattgagacagct

SEQ ID NO: 33261 - DNA, 25 bp, Homo sapien
atgtatcttgtaagttgagacagct

SEQ ID NO: 33262 - DNA, 25 bp, Homo sapien
atgtatgaagaaattaatgttgttt

SEQ ID NO: 33263 - DNA, 25 bp, Homo sapien
atgtatgaagaagttaatgttgttt

SEQ ID NO: 33264 - DNA, 25 bp, Homo sapien
atgtatgcaactcttgtccttcagt

SEQ ID NO: 33265 - DNA, 25 bp, Homo sapien
atgtatgctactcttgtccttcagt

SEQ ID NO: 33266 - DNA, 25 bp, Homo sapien
atgtatggaagaggtacaaaaaaac

SEQ ID NO: 33267 - DNA, 25 bp, Homo sapien
atgtatggaagaggtagaaaaaaac

SEQ ID NO: 33268 - DNA, 25 bp, Homo sapien
atgtatggccagagaactgaaaatg

SEQ ID NO: 33269 - DNA, 25 bp, Homo sapien
atgtatggccagagaattgaaaatg

SEQ ID NO: 33270 - DNA, 25 bp, Homo sapien
atgtatggttgagattgtctcatag

SEQ ID NO: 33271 - DNA, 25 bp, Homo sapien
atgtatggttgagattttctcatag

SEQ ID NO: 33272 - DNA, 25 bp, Homo sapien
atgtatgtattcagatgagtttcaa

SEQ ID NO: 33273 - DNA, 25 bp, Homo sapien
atgtatgtattgagatgagtttcaa

SEQ ID NO: 33274 - DNA, 25 bp, Homo sapien
atgtattactcacaatttttgccat

SEQ ID NO: 33275 - DNA, 25 bp, Homo sapien
atgtattactcacagtttttgccat

SEQ ID NO: 33276 - DNA, 25 bp, Homo sapien
atgtattcaaagtgatggagtatat

SEQ ID NO: 33277 - DNA, 25 bp, Homo sapien
atgtattcaattctcttatacttga

SEQ ID NO: 33278 - DNA, 25 bp, Homo sapien
atgtattcaattttcttatacttga

SEQ ID NO: 33279 - DNA, 25 bp, Homo sapien
atgtattcacagtgatggagtatat

SEQ ID NO: 33280 - DNA, 25 bp, Homo sapien
atgtattcttcacgcatcttaatat

SEQ ID NO: 33281 - DNA, 25 bp, Homo sapien
atgtattcttcatgcatcttaatat

SEQ ID NO: 33282 - DNA, 25 bp, Homo sapien
atgtatttctctctcacgttatatg

SEQ ID NO: 33283 - DNA, 25 bp, Homo sapien
atgtatttctctctcatgttatatg

SEQ ID NO: 33284 - DNA, 25 bp, Homo sapien
atgtatttgcatacctatagctctt

SEQ ID NO: 33285 - DNA, 25 bp, Homo sapien
atgtatttgcatacttatagctctt

SEQ ID NO: 33286 - DNA, 25 bp, Homo sapien
atgtattttaaattggccattccac

SEQ ID NO: 33287 - DNA, 25 bp, Homo sapien
atgtattttaaattggtcattccac

SEQ ID NO: 33288 - DNA, 25 bp, Homo sapien
atgtcaaaaacggtatctgacacta

SEQ ID NO: 33289 - DNA, 25 bp, Homo sapien
atgtcaaacacggtatctgacacta

SEQ ID NO: 33290 - DNA, 25 bp, Homo sapien
atgtcaaacttcatatcacttgaca

SEQ ID NO: 33291 - DNA, 25 bp, Homo sapien
atgtcaaacttcgtatcacttgaca

SEQ ID NO: 33292 - DNA, 25 bp, Homo sapien
atgtcaaagaaatacactttgattt

SEQ ID NO: 33293 - DNA, 25 bp, Homo sapien
atgtcaaagataaagtgcaacacat

SEQ ID NO: 33294 - DNA, 25 bp, Homo sapien
atgtcaaagattagatcaagcactt

SEQ ID NO: 33295 - DNA, 25 bp, Homo sapien
atgtcaaaggtaaagtgcaacacat

SEQ ID NO: 33296 - DNA, 25 bp, Homo sapien
atgtcaaaggttagatcaagcactt

SEQ ID NO: 33297 - DNA, 25 bp, Homo sapien
atgtcaaataaatacactttgattt

SEQ ID NO: 33298 - DNA, 25 bp, Homo sapien
atgtcaaccaggagaatgagttgga

SEQ ID NO: 33299 - DNA, 25 bp, Homo sapien
atgtcaacccggagaatgagttgga

SEQ ID NO: 33300 - DNA, 25 bp, Homo sapien
atgtcaactgtgtcaccctttacca

SEQ ID NO: 33301 - DNA, 25 bp, Homo sapien
atgtcaactgtgtcgccctttacca

SEQ ID NO: 33302 - DNA, 25 bp, Homo sapien
atgtcaacttacaaacctctcataa

SEQ ID NO: 33303 - DNA, 25 bp, Homo sapien
atgtcaacttataaacctctcataa

SEQ ID NO: 33304 - DNA, 25 bp, Homo sapien
atgtcaagtacagggctgcaaaaaa

SEQ ID NO: 33305 - DNA, 25 bp, Homo sapien
atgtcaagtacggggctgcaaaaaa

SEQ ID NO: 33306 - DNA, 25 bp, Homo sapien
atgtcaatggtaagatgttggacta

SEQ ID NO: 33307 - DNA, 25 bp, Homo sapien
atgtcaatggtaagattttggacta

SEQ ID NO: 33308 - DNA, 25 bp, Homo sapien
atgtcaattccacgaaaaaaatatg

SEQ ID NO: 33309 - DNA, 25 bp, Homo sapien
atgtcaattccatgaaaaaaatatg

SEQ ID NO: 33310 - DNA, 25 bp, Homo sapien
atgtcaatttccatttttctactat

SEQ ID NO: 33311 - DNA, 25 bp, Homo sapien
atgtcaatttccgtttttctactat

SEQ ID NO: 33312 - DNA, 25 bp, Homo sapien
atgtcacacaacttgttgttcttac

SEQ ID NO: 33313 - DNA, 25 bp, Homo sapien
atgtcacacaatttgttgttcttac

SEQ ID NO: 33314 - DNA, 25 bp, Homo sapien
atgtcaccaatggttgccagcatac

SEQ ID NO: 33315 - DNA, 25 bp, Homo sapien
atgtcaccaatggttgtcagcatac

SEQ ID NO: 33316 - DNA, 25 bp, Homo sapien
atgtcacctaacagcatgtggccct

SEQ ID NO: 33317 - DNA, 25 bp, Homo sapien
atgtcacctaatagcatgtggccct

SEQ ID NO: 33318 - DNA, 25 bp, Homo sapien
atgtcacctctccttgaatgtagag

SEQ ID NO: 33319 - DNA, 25 bp, Homo sapien
atgtcacctcttcttgaatgtagag

SEQ ID NO: 33320 - DNA, 25 bp, Homo sapien
atgtcacggaagagaaaaattcagg

SEQ ID NO: 33321 - DNA, 25 bp, Homo sapien
atgtcacggaagagaagaattcagg

SEQ ID NO: 33322 - DNA, 25 bp, Homo sapien
atgtcacttgattagatgccctctg

SEQ ID NO: 33323 - DNA, 25 bp, Homo sapien
atgtcacttgattcgatgccctctg

SEQ ID NO: 33324 - DNA, 25 bp, Homo sapien
atgtcagagatagcagtaccttgca

SEQ ID NO: 33325 - DNA, 25 bp, Homo sapien
atgtcagagatagtagtaccttgca

SEQ ID NO: 33326 - DNA, 25 bp, Homo sapien
atgtcagcactatggctcagaagga

SEQ ID NO: 33327 - DNA, 25 bp, Homo sapien
atgtcagcagtatggctcagaagga

SEQ ID NO: 33328 - DNA, 25 bp, Homo sapien
atgtcagcatcaatcacacctgtcc

SEQ ID NO: 33329 - DNA, 25 bp, Homo sapien
atgtcagcatcaatcatacctgtcc

SEQ ID NO: 33330 - DNA, 25 bp, Homo sapien
atgtcagtagcacataagatcccat

SEQ ID NO: 33331 - DNA, 25 bp, Homo sapien
atgtcagtagcacgtaagatcccat

SEQ ID NO: 33332 - DNA, 25 bp, Homo sapien
atgtcagtctccctgatgattctat

SEQ ID NO: 33333 - DNA, 25 bp, Homo sapien
atgtcagtctctctgatgattctat

SEQ ID NO: 33334 - DNA, 25 bp, Homo sapien
atgtcagtggctgaagtgtggtttt

SEQ ID NO: 33335 - DNA, 25 bp, Homo sapien
atgtcagtggctgaggtgtggtttt

SEQ ID NO: 33336 - DNA, 25 bp, Homo sapien
atgtcagtgtgggaacatgcacttg

SEQ ID NO: 33337 - DNA, 25 bp, Homo sapien
atgtcagtgtggtaacatgcacttg

SEQ ID NO: 33338 - DNA, 25 bp, Homo sapien
atgtcagttaccagctcatcttccc

SEQ ID NO: 33339 - DNA, 25 bp, Homo sapien
atgtcagttaccagcttatcttccc

SEQ ID NO: 33340 - DNA, 25 bp, Homo sapien
atgtcatcccacatttctccgtggc

SEQ ID NO: 33341 - DNA, 25 bp, Homo sapien
atgtcatcccactgtcatcttgaca

SEQ ID NO: 33342 - DNA, 25 bp, Homo sapien
atgtcatcccagtgtcatcttgaca

SEQ ID NO: 33343 - DNA, 25 bp, Homo sapien
atgtcatctcacatttctccgtggc

SEQ ID NO: 33344 - DNA, 25 bp, Homo sapien
atgtcatgaaatctttgtttgcacc

SEQ ID NO: 33345 - DNA, 25 bp, Homo sapien
atgtcatgcaatctttgtttgcacc

SEQ ID NO: 33346 - DNA, 25 bp, Homo sapien
atgtccactagaagaagtattcccc

SEQ ID NO: 33347 - DNA, 25 bp, Homo sapien
atgtccactggaagaagtattcccc

SEQ ID NO: 33348 - DNA, 25 bp, Homo sapien
atgtccagaaataaaatccgaggcc

SEQ ID NO: 33349 - DNA, 25 bp, Homo sapien
atgtccagaaataacatccgaggcc

SEQ ID NO: 33350 - DNA, 25 bp, Homo sapien
atgtccagaagatataaaactattc

SEQ ID NO: 33351 - DNA, 25 bp, Homo sapien
atgtccagaggatataaaactattc

SEQ ID NO: 33352 - DNA, 25 bp, Homo sapien
atgtccagctgctatcatcacacac

SEQ ID NO: 33353 - DNA, 25 bp, Homo sapien
atgtccagctgctgtcatcacacac

SEQ ID NO: 33354 - DNA, 25 bp, Homo sapien
atgtccatcacacgatttattatat

SEQ ID NO: 33355 - DNA, 25 bp, Homo sapien
atgtccatcccacgatttattatat

SEQ ID NO: 33356 - DNA, 25 bp, Homo sapien
atgtccatgtgacatttgtgggtca

SEQ ID NO: 33357 - DNA, 25 bp, Homo sapien
atgtccatgtgacttttgtgggtca

SEQ ID NO: 33358 - DNA, 25 bp, Homo sapien
atgtccattactaaaacaaagcaga

SEQ ID NO: 33359 - DNA, 25 bp, Homo sapien
atgtccattactcaaacaaagcaga

SEQ ID NO: 33360 - DNA, 25 bp, Homo sapien
atgtccattctcagggctcaaatgc

SEQ ID NO: 33361 - DNA, 25 bp, Homo sapien
atgtccattctcagtgctcaaatgc

SEQ ID NO: 33362 - DNA, 25 bp, Homo sapien
atgtccggccgacgtttctggggta

SEQ ID NO: 33363 - DNA, 25 bp, Homo sapien
atgtccggccgatgtttctggggta

SEQ ID NO: 33364 - DNA, 25 bp, Homo sapien
atgtcctaggtgttcaaattcattc

SEQ ID NO: 33365 - DNA, 25 bp, Homo sapien
atgtcctaggtgttcacattcattc

SEQ ID NO: 33366 - DNA, 25 bp, Homo sapien
atgtcctatggttacacgtccttcc

SEQ ID NO: 33367 - DNA, 25 bp, Homo sapien
atgtcctatggttacatgtccttcc

SEQ ID NO: 33368 - DNA, 25 bp, Homo sapien
atgtcctattaaaacaattttggca

SEQ ID NO: 33369 - DNA, 25 bp, Homo sapien
atgtcctattaaaagaattttggca

SEQ ID NO: 33370 - DNA, 25 bp, Homo sapien
atgtcctcaatatccaattcacggc

SEQ ID NO: 33371 - DNA, 25 bp, Homo sapien
atgtcctcagtatccaattcacggc

SEQ ID NO: 33372 - DNA, 25 bp, Homo sapien
atgtcctcatgagatcaaagtataa

SEQ ID NO: 33373 - DNA, 25 bp, Homo sapien
atgtcctcatgagttcaaagtataa

SEQ ID NO: 33374 - DNA, 25 bp, Homo sapien
atgtcctcatgcctacctactcggg

SEQ ID NO: 33375 - DNA, 25 bp, Homo sapien
atgtcctcgtgcctacctactcggg

SEQ ID NO: 33376 - DNA, 25 bp, Homo sapien
atgtcctgccgattgagtatattca

SEQ ID NO: 33377 - DNA, 25 bp, Homo sapien
atgtcctgctgattgagtatattca

SEQ ID NO: 33378 - DNA, 25 bp, Homo sapien
atgtccttcatagtgaaaagatcca

SEQ ID NO: 33379 - DNA, 25 bp, Homo sapien
atgtcctttagcttcaatgtattca

SEQ ID NO: 33380 - DNA, 25 bp, Homo sapien
atgtcctttagcttcactgtattca

SEQ ID NO: 33381 - DNA, 25 bp, Homo sapien
atgtcctttatagtgaaaagatcca

SEQ ID NO: 33382 - DNA, 25 bp, Homo sapien
atgtccttttaaaatctgatctgca

SEQ ID NO: 33383 - DNA, 25 bp, Homo sapien
atgtccttttaaagtctgatctgca

SEQ ID NO: 33384 - DNA, 25 bp, Homo sapien
atgtccttttgatcacatttcctgg

SEQ ID NO: 33385 - DNA, 25 bp, Homo sapien
atgtccttttggtcacatttcctgg

SEQ ID NO: 33386 - DNA, 25 bp, Homo sapien
atgtcgtttgcttaacatacaccct

SEQ ID NO: 33387 - DNA, 25 bp, Homo sapien
atgtcgtttgcttaacgtacaccct

SEQ ID NO: 33388 - DNA, 25 bp, Homo sapien
atgtctaaagaatcgatctgatttc

SEQ ID NO: 33389 - DNA, 25 bp, Homo sapien
atgtctaaagaatctatctgatttc

SEQ ID NO: 33390 - DNA, 25 bp, Homo sapien
atgtctaataaagggtcaaggtgga

SEQ ID NO: 33391 - DNA, 25 bp, Homo sapien
atgtctaataaatggtcaaggtgga

SEQ ID NO: 33392 - DNA, 25 bp, Homo sapien
atgtctactgaatctaaaggaatgc

SEQ ID NO: 33393 - DNA, 25 bp, Homo sapien
atgtctactgagtctaaaggaatgc

SEQ ID NO: 33394 - DNA, 25 bp, Homo sapien
atgtctcaaaatcaggtcatgctga

SEQ ID NO: 33395 - DNA, 25 bp, Homo sapien
atgtctcaaataataccatatactg

SEQ ID NO: 33396 - DNA, 25 bp, Homo sapien
atgtctcacaatcaggtcatgctga

SEQ ID NO: 33397 - DNA, 25 bp, Homo sapien
atgtctcacggcgaatcaaatgtca

SEQ ID NO: 33398 - DNA, 25 bp, Homo sapien
atgtctcacggctaatcaaatgtca

SEQ ID NO: 33399 - DNA, 25 bp, Homo sapien
atgtctcagataataccatatactg

SEQ ID NO: 33400 - DNA, 25 bp, Homo sapien
atgtctcagtcttcatctactttct

SEQ ID NO: 33401 - DNA, 25 bp, Homo sapien
atgtctcagtcttcgtctactttct

SEQ ID NO: 33402 - DNA, 25 bp, Homo sapien
atgtctctcaactgtacgtcagaag

SEQ ID NO: 33403 - DNA, 25 bp, Homo sapien
atgtctctcaactgtatgtcagaag

SEQ ID NO: 33404 - DNA, 25 bp, Homo sapien
atgtctcttcctcttttctgatttc

SEQ ID NO: 33405 - DNA, 25 bp, Homo sapien
atgtctcttgctcttttctgatttc

SEQ ID NO: 33406 - DNA, 25 bp, Homo sapien
atgtctctttctgaaacatgtatct

SEQ ID NO: 33407 - DNA, 25 bp, Homo sapien
atgtctctttctggaacatgtatct

SEQ ID NO: 33408 - DNA, 25 bp, Homo sapien
atgtctgagaactccagaagagcct

SEQ ID NO: 33409 - DNA, 25 bp, Homo sapien
atgtctgagaacttcagaagagcct

SEQ ID NO: 33410 - DNA, 25 bp, Homo sapien
atgtctgctaatacattcttcagcc

SEQ ID NO: 33411 - DNA, 25 bp, Homo sapien
atgtctgctaatatattcttcagcc

SEQ ID NO: 33412 - DNA, 25 bp, Homo sapien
atgtctggaaatctatcctatggtc

SEQ ID NO: 33413 - DNA, 25 bp, Homo sapien
atgtctggaaatctatgctatggtc

SEQ ID NO: 33414 - DNA, 25 bp, Homo sapien
atgtcttaaacttttgatatgaggc

SEQ ID NO: 33415 - DNA, 25 bp, Homo sapien
atgtcttaatcttttgatatgaggc

SEQ ID NO: 33416 - DNA, 25 bp, Homo sapien
atgtcttatcatatcttactctccc

SEQ ID NO: 33417 - DNA, 25 bp, Homo sapien
atgtcttatcatgtcttactctccc

SEQ ID NO: 33418 - DNA, 25 bp, Homo sapien
atgtcttcaagctcacccatctttt

SEQ ID NO: 33419 - DNA, 25 bp, Homo sapien
atgtcttcaggctcacccatctttt

SEQ ID NO: 33420 - DNA, 25 bp, Homo sapien
atgtcttcatcagtttatttcttct

SEQ ID NO: 33421 - DNA, 25 bp, Homo sapien
atgtcttcatcggtttatttcttct

SEQ ID NO: 33422 - DNA, 25 bp, Homo sapien
atgtcttcatttaattcactgctaa

SEQ ID NO: 33423 - DNA, 25 bp, Homo sapien
atgtcttcctatacctaccactact

SEQ ID NO: 33424 - DNA, 25 bp, Homo sapien
atgtcttcctatacttaccactact

SEQ ID NO: 33425 - DNA, 25 bp, Homo sapien
atgtcttcgctgtgcagataaggaa

SEQ ID NO: 33426 - DNA, 25 bp, Homo sapien
atgtcttcgttgtgcagataaggaa

SEQ ID NO: 33427 - DNA, 25 bp, Homo sapien
atgtcttcgtttaattcactgctaa

SEQ ID NO: 33428 - DNA, 25 bp, Homo sapien
atgtcttgcagatatgattatagag

SEQ ID NO: 33429 - DNA, 25 bp, Homo sapien
atgtcttgcagatatggttatagag

SEQ ID NO: 33430 - DNA, 25 bp, Homo sapien
atgtcttggccaaccacagcaacaa

SEQ ID NO: 33431 - DNA, 25 bp, Homo sapien
atgtcttggccagccacagcaacaa

SEQ ID NO: 33432 - DNA, 25 bp, Homo sapien
atgtgaaaagactacagtggcttag

SEQ ID NO: 33433 - DNA, 25 bp, Homo sapien
atgtgaaaagactagagtggcttag

SEQ ID NO: 33434 - DNA, 25 bp, Homo sapien
atgtgaaacttttgaaacagtaggt

SEQ ID NO: 33435 - DNA, 25 bp, Homo sapien
atgtgaaatttttgaaacagtaggt

SEQ ID NO: 33436 - DNA, 25 bp, Homo sapien
atgtgaacagagaagtgaccacaga

SEQ ID NO: 33437 - DNA, 25 bp, Homo sapien
atgtgaacagataagtgaccacaga

SEQ ID NO: 33438 - DNA, 25 bp, Homo sapien
atgtgaacatcatcaaacagatttt

SEQ ID NO: 33439 - DNA, 25 bp, Homo sapien
atgtgaacatcattaaacagatttt

SEQ ID NO: 33440 - DNA, 25 bp, Homo sapien
atgtgaagaagctggaacctttgtg

SEQ ID NO: 33441 - DNA, 25 bp, Homo sapien
atgtgaagaagttggaacctttgtg

SEQ ID NO: 33442 - DNA, 25 bp, Homo sapien
atgtgaagccatgaaggccattcag

SEQ ID NO: 33443 - DNA, 25 bp, Homo sapien
atgtgaaggacagcatcacaggtta

SEQ ID NO: 33444 - DNA, 25 bp, Homo sapien
atgtgaaggacagtatcacaggtta

SEQ ID NO: 33445 - DNA, 25 bp, Homo sapien
atgtgaagtcatgaaggccattcag

SEQ ID NO: 33446 - DNA, 25 bp, Homo sapien
atgtgaatatgtccctgaattgtct

SEQ ID NO: 33447 - DNA, 25 bp, Homo sapien
atgtgaatatttaaagagttcttgt

SEQ ID NO: 33448 - DNA, 25 bp, Homo sapien
atgtgaatatttaaagggttcttgt

SEQ ID NO: 33449 - DNA, 25 bp, Homo sapien
atgtgaatgctttatagttagttga

SEQ ID NO: 33450 - DNA, 25 bp, Homo sapien
atgtgaatgctttctagttagttga

SEQ ID NO: 33451 - DNA, 25 bp, Homo sapien
atgtgaatgtgtccctgaattgtct

SEQ ID NO: 33452 - DNA, 25 bp, Homo sapien
atgtgaattctacaaacccttgttg

SEQ ID NO: 33453 - DNA, 25 bp, Homo sapien
atgtgaattctacagacccttgttg

SEQ ID NO: 33454 - DNA, 25 bp, Homo sapien
atgtgacactcaagttttagcaaac

SEQ ID NO: 33455 - DNA, 25 bp, Homo sapien
atgtgacactcaggttttagcaaac

SEQ ID NO: 33456 - DNA, 25 bp, Homo sapien
atgtgacccgtttagtgtcaactca

SEQ ID NO: 33457 - DNA, 25 bp, Homo sapien
atgtgacctgtttagtgtcaactca

SEQ ID NO: 33458 - DNA, 25 bp, Homo sapien
atgtgacttggatactattaaaagc

SEQ ID NO: 33459 - DNA, 25 bp, Homo sapien
atgtgacttggatactgttaaaagc

SEQ ID NO: 33460 - DNA, 25 bp, Homo sapien
atgtgagccagaagatttttaatgg

SEQ ID NO: 33461 - DNA, 25 bp, Homo sapien
atgtgagccagaaggtttttaatgg

SEQ ID NO: 33462 - DNA, 25 bp, Homo sapien
atgtgagccatcttttcgcccctgc

SEQ ID NO: 33463 - DNA, 25 bp, Homo sapien
atgtgagccatctttttgcccctgc

SEQ ID NO: 33464 - DNA, 25 bp, Homo sapien
atgtgagcgggacactgagttcttc

SEQ ID NO: 33465 - DNA, 25 bp, Homo sapien
atgtgagcgggacagtgagttcttc

SEQ ID NO: 33466 - DNA, 25 bp, Homo sapien
atgtgagctattgttggactcatta

SEQ ID NO: 33467 - DNA, 25 bp, Homo sapien
atgtgagctattgttgtactcatta

SEQ ID NO: 33468 - DNA, 25 bp, Homo sapien
atgtgaggacataacaggaaaaggc

SEQ ID NO: 33469 - DNA, 25 bp, Homo sapien
atgtgaggacataccaggaaaaggc

SEQ ID NO: 33470 - DNA, 25 bp, Homo sapien
atgtgagggtacaaaattatgatgc

SEQ ID NO: 33471 - DNA, 25 bp, Homo sapien
atgtgagggtataaaattatgatgc

SEQ ID NO: 33472 - DNA, 25 bp, Homo sapien
atgtgatagacaagaaacaggagaa

SEQ ID NO: 33473 - DNA, 25 bp, Homo sapien
atgtgatagccaagaaacaggagaa

SEQ ID NO: 33474 - DNA, 25 bp, Homo sapien
atgtgatcataagaagcaacaatag

SEQ ID NO: 33475 - DNA, 25 bp, Homo sapien
atgtgatcgtaagaagcaacaatag

SEQ ID NO: 33476 - DNA, 25 bp, Homo sapien
atgtgatgacgagaggagaaggaag

SEQ ID NO: 33477 - DNA, 25 bp, Homo sapien
atgtgatgatgagaggagaaggaag

SEQ ID NO: 33478 - DNA, 25 bp, Homo sapien
atgtgatgggttacgttaattgttt

SEQ ID NO: 33479 - DNA, 25 bp, Homo sapien
atgtgatgggttatgttaattgttt

SEQ ID NO: 33480 - DNA, 25 bp, Homo sapien
atgtgatgtttgatatggacgtgaa

SEQ ID NO: 33481 - DNA, 25 bp, Homo sapien
atgtgatgtttggtatggacgtgaa

SEQ ID NO: 33482 - DNA, 25 bp, Homo sapien
atgtgattgccactggtcaagcctg

SEQ ID NO: 33483 - DNA, 25 bp, Homo sapien
atgtgattgccattggtcaagcctg

SEQ ID NO: 33484 - DNA, 25 bp, Homo sapien
atgtgcaatgcatgctctttaaata

SEQ ID NO: 33485 - DNA, 25 bp, Homo sapien
atgtgcaatgcatgctttttaaata

SEQ ID NO: 33486 - DNA, 25 bp, Homo sapien
atgtgcatttcctttatgaccagtg

SEQ ID NO: 33487 - DNA, 25 bp, Homo sapien
atgtgcatttcttttatgaccagtg

SEQ ID NO: 33488 - DNA, 25 bp, Homo sapien
atgtgcatttgcttagatgtttgat

SEQ ID NO: 33489 - DNA, 25 bp, Homo sapien
atgtgcatttgtttagatgtttgat

SEQ ID NO: 33490 - DNA, 25 bp, Homo sapien
atgtgccacattggatttaaaattg

SEQ ID NO: 33491 - DNA, 25 bp, Homo sapien
atgtgccacattggttttaaaattg

SEQ ID NO: 33492 - DNA, 25 bp, Homo sapien
atgtgcccaaaatgcagtcagtagg

SEQ ID NO: 33493 - DNA, 25 bp, Homo sapien
atgtgcccaaaatggagtcagtagg

SEQ ID NO: 33494 - DNA, 25 bp, Homo sapien
atgtgcctacgtccttccaactgta

SEQ ID NO: 33495 - DNA, 25 bp, Homo sapien
atgtgcctatgtccttccaactgta

SEQ ID NO: 33496 - DNA, 25 bp, Homo sapien
atgtgcctctaggtttgatcattga

SEQ ID NO: 33497 - DNA, 25 bp, Homo sapien
atgtgcctctagttttgatcattga

SEQ ID NO: 33498 - DNA, 25 bp, Homo sapien
atgtgcctgtcaatgttttttcaga

SEQ ID NO: 33499 - DNA, 25 bp, Homo sapien
atgtgcctgtcattgttttttcaga

SEQ ID NO: 33500 - DNA, 25 bp, Homo sapien
atgtgccttaatctctgtatctcct

SEQ ID NO: 33501 - DNA, 25 bp, Homo sapien
atgtgccttaatctttgtatctcct

SEQ ID NO: 33502 - DNA, 25 bp, Homo sapien
atgtgcgtatgccttaacttttcag

SEQ ID NO: 33503 - DNA, 25 bp, Homo sapien
atgtgcgtatgccttagcttttcag

SEQ ID NO: 33504 - DNA, 25 bp, Homo sapien
atgtgctaaatgttgccagatgaaa

SEQ ID NO: 33505 - DNA, 25 bp, Homo sapien
atgtgctaagtgttgccagatgaaa

SEQ ID NO: 33506 - DNA, 25 bp, Homo sapien
atgtgctaccttccaaggctgccag

SEQ ID NO: 33507 - DNA, 25 bp, Homo sapien
atgtgctacctttcaaggctgccag

SEQ ID NO: 33508 - DNA, 25 bp, Homo sapien
atgtgctcatgggacactaagctct

SEQ ID NO: 33509 - DNA, 25 bp, Homo sapien
atgtgctcgtgggacactaagctct

SEQ ID NO: 33510 - DNA, 25 bp, Homo sapien
atgtgcttaaaggagtcaaaacatt

SEQ ID NO: 33511 - DNA, 25 bp, Homo sapien
atgtgcttaaaggagttaaaacatt

SEQ ID NO: 33512 - DNA, 25 bp, Homo sapien
atgtgcttcctgaactccctgcagc

SEQ ID NO: 33513 - DNA, 25 bp, Homo sapien
atgtgcttcgttattaatttcattc

SEQ ID NO: 33514 - DNA, 25 bp, Homo sapien
atgtgcttcttgaactccctgcagc

SEQ ID NO: 33515 - DNA, 25 bp, Homo sapien
atgtgcttctttattaatttcattc

SEQ ID NO: 33516 - DNA, 25 bp, Homo sapien
atgtgctttgtttcatgtgctgtgc

SEQ ID NO: 33517 - DNA, 25 bp, Homo sapien
atgtgctttgtttcgtgtgctgtgc

SEQ ID NO: 33518 - DNA, 25 bp, Homo sapien
atgtggaaatacaaaagagcctaaa

SEQ ID NO: 33519 - DNA, 25 bp, Homo sapien
atgtggaaatacaatagagcctaaa

SEQ ID NO: 33520 - DNA, 25 bp, Homo sapien
atgtggaacagggaaagatattttc

SEQ ID NO: 33521 - DNA, 25 bp, Homo sapien
atgtggaacagtgaaagatattttc

SEQ ID NO: 33522 - DNA, 25 bp, Homo sapien
atgtggagaattttttaggacaaag

SEQ ID NO: 33523 - DNA, 25 bp, Homo sapien
atgtggagatttttttaggacaaag

SEQ ID NO: 33524 - DNA, 25 bp, Homo sapien
atgtggatggccgaggtgcccacag

SEQ ID NO: 33525 - DNA, 25 bp, Homo sapien
atgtggatggctgaggtgcccacag

SEQ ID NO: 33526 - DNA, 25 bp, Homo sapien
atgtggcatgtatcgtggcaatctt

SEQ ID NO: 33527 - DNA, 25 bp, Homo sapien
atgtggcatgtctcgtggcaatctt

SEQ ID NO: 33528 - DNA, 25 bp, Homo sapien
atgtggctatttactgaacaggaat

SEQ ID NO: 33529 - DNA, 25 bp, Homo sapien
atgtggctatttattgaacaggaat

SEQ ID NO: 33530 - DNA, 25 bp, Homo sapien
atgtggctcctaccaattgaggtca

SEQ ID NO: 33531 - DNA, 25 bp, Homo sapien
atgtggctcctgccaattgaggtca

SEQ ID NO: 33532 - DNA, 25 bp, Homo sapien
atgtggcttctccaggctcaaaaaa

SEQ ID NO: 33533 - DNA, 25 bp, Homo sapien
atgtggcttctccgggctcaaaaaa

SEQ ID NO: 33534 - DNA, 25 bp, Homo sapien
atgtgggaagacccatcgcatcatc

SEQ ID NO: 33535 - DNA, 25 bp, Homo sapien
atgtgggaagacccatggcatcatc

SEQ ID NO: 33536 - DNA, 25 bp, Homo sapien
atgtgggaatcagcaagaacaacaa

SEQ ID NO: 33537 - DNA, 25 bp, Homo sapien
atgtgggaatcggcaagaacaacaa

SEQ ID NO: 33538 - DNA, 25 bp, Homo sapien
atgtgggcaagcccgcctagatact

SEQ ID NO: 33539 - DNA, 25 bp, Homo sapien
atgtgggcaaggccgcctagatact

SEQ ID NO: 33540 - DNA, 25 bp, Homo sapien
atgtgggtgcttgctctcttcaggt

SEQ ID NO: 33541 - DNA, 25 bp, Homo sapien
atgtgggtgtctacttatgctaggt

SEQ ID NO: 33542 - DNA, 25 bp, Homo sapien
atgtgggtgtctacttttgctaggt

SEQ ID NO: 33543 - DNA, 25 bp, Homo sapien
atgtgggtgtttgctctcttcaggt

SEQ ID NO: 33544 - DNA, 25 bp, Homo sapien
atgtggtcacaatcaataggaaaca

SEQ ID NO: 33545 - DNA, 25 bp, Homo sapien
atgtggtcgcaatcaataggaaaca

SEQ ID NO: 33546 - DNA, 25 bp, Homo sapien
atgtggtctgtaatgactgacttct

SEQ ID NO: 33547 - DNA, 25 bp, Homo sapien
atgtggtctgtagtgactgacttct

SEQ ID NO: 33548 - DNA, 25 bp, Homo sapien
atgtggttatggagaactcagtcat

SEQ ID NO: 33549 - DNA, 25 bp, Homo sapien
atgtggttatggagaattcagtcat

SEQ ID NO: 33550 - DNA, 25 bp, Homo sapien
atgtggttgaccaacatcatcagat

SEQ ID NO: 33551 - DNA, 25 bp, Homo sapien
atgtggttgactaacatcatcagat

SEQ ID NO: 33552 - DNA, 25 bp, Homo sapien
atgtgtaaaacacttcacatatcat

SEQ ID NO: 33553 - DNA, 25 bp, Homo sapien
atgtgtaaaagacagtattttcaac

SEQ ID NO: 33554 - DNA, 25 bp, Homo sapien
atgtgtaaaagacattattttcaac

SEQ ID NO: 33555 - DNA, 25 bp, Homo sapien
atgtgtaagacacttcacatatcat

SEQ ID NO: 33556 - DNA, 25 bp, Homo sapien
atgtgtaatggtaatgtgctgtatg

SEQ ID NO: 33557 - DNA, 25 bp, Homo sapien
atgtgtaatggtcatgtgctgtatg

SEQ ID NO: 33558 - DNA, 25 bp, Homo sapien
atgtgtactcgtttcctggattgaa

SEQ ID NO: 33559 - DNA, 25 bp, Homo sapien
atgtgtacttgtttcctggattgaa

SEQ ID NO: 33560 - DNA, 25 bp, Homo sapien
atgtgtagaatttatagactcctca

SEQ ID NO: 33561 - DNA, 25 bp, Homo sapien
atgtgtagaatttgtagactcctca

SEQ ID NO: 33562 - DNA, 25 bp, Homo sapien
atgtgtagttttaataagtcttaac

SEQ ID NO: 33563 - DNA, 25 bp, Homo sapien
atgtgtagttttagtaagtcttaac

SEQ ID NO: 33564 - DNA, 25 bp, Homo sapien
atgtgtcaatattagttcaccaact

SEQ ID NO: 33565 - DNA, 25 bp, Homo sapien
atgtgtcaatatttgttcaccaact

SEQ ID NO: 33566 - DNA, 25 bp, Homo sapien
atgtgtcagcagagccagctcatca

SEQ ID NO: 33567 - DNA, 25 bp, Homo sapien
atgtgtcagcagggccagctcatca

SEQ ID NO: 33568 - DNA, 25 bp, Homo sapien
atgtgtccaaggacttgggttcaga

SEQ ID NO: 33569 - DNA, 25 bp, Homo sapien
atgtgtccaaggtcttgggttcaga

SEQ ID NO: 33570 - DNA, 25 bp, Homo sapien
atgtgtctcagaatgtaattgttag

SEQ ID NO: 33571 - DNA, 25 bp, Homo sapien
atgtgtctgcacaaggtcttttagg

SEQ ID NO: 33572 - DNA, 25 bp, Homo sapien
atgtgtctgtacaaggtcttttagg

SEQ ID NO: 33573 - DNA, 25 bp, Homo sapien
atgtgtcttagaatgtaattgttag

SEQ ID NO: 33574 - DNA, 25 bp, Homo sapien
atgtgtcttataattcagctctaac

SEQ ID NO: 33575 - DNA, 25 bp, Homo sapien
atgtgtcttataattcggctctaac

SEQ ID NO: 33576 - DNA, 25 bp, Homo sapien
atgtgtgactcatttgcatatcgga

SEQ ID NO: 33577 - DNA, 25 bp, Homo sapien
atgtgtgactcgtttgcatatcgga

SEQ ID NO: 33578 - DNA, 25 bp, Homo sapien
atgtgtggcatgcgttatatttcta

SEQ ID NO: 33579 - DNA, 25 bp, Homo sapien
atgtgtggcatgtgttatatttcta

SEQ ID NO: 33580 - DNA, 25 bp, Homo sapien
atgtgtgggttttctgggagttcaa

SEQ ID NO: 33581 - DNA, 25 bp, Homo sapien
atgtgtgggttttttgggagttcaa

SEQ ID NO: 33582 - DNA, 25 bp, Homo sapien
atgtgtgtcttctctggaaatgtgt

SEQ ID NO: 33583 - DNA, 25 bp, Homo sapien
atgtgtgtcttctttggaaatgtgt

SEQ ID NO: 33584 - DNA, 25 bp, Homo sapien
atgtgtgtttagaaggagccttttc

SEQ ID NO: 33585 - DNA, 25 bp, Homo sapien
atgtgtgtttagtaggagccttttc

SEQ ID NO: 33586 - DNA, 25 bp, Homo sapien
atgtgttaaaagaagcaatattgtt

SEQ ID NO: 33587 - DNA, 25 bp, Homo sapien
atgtgttaataaagatggtgctacc

SEQ ID NO: 33588 - DNA, 25 bp, Homo sapien
atgtgttaataaagattgtgctacc

SEQ ID NO: 33589 - DNA, 25 bp, Homo sapien
atgtgttagaagaagcaatattgtt

SEQ ID NO: 33590 - DNA, 25 bp, Homo sapien
atgtgttcgactttatatctgcctt

SEQ ID NO: 33591 - DNA, 25 bp, Homo sapien
atgtgttcggctttatatctgcctt

SEQ ID NO: 33592 - DNA, 25 bp, Homo sapien
atgtgtttgcacacttaaatggcta

SEQ ID NO: 33593 - DNA, 25 bp, Homo sapien
atgtgtttgcactcttaaatggcta

SEQ ID NO: 33594 - DNA, 25 bp, Homo sapien
atgtgtttggcttcaataattccat

SEQ ID NO: 33595 - DNA, 25 bp, Homo sapien
atgtgtttggctttaataattccat

SEQ ID NO: 33596 - DNA, 25 bp, Homo sapien
atgttaaaagatccttaagttaaag

SEQ ID NO: 33597 - DNA, 25 bp, Homo sapien
atgttaaaaggtaagtgcttggtga

SEQ ID NO: 33598 - DNA, 25 bp, Homo sapien
atgttaaaagtcaaccgtttactgg

SEQ ID NO: 33599 - DNA, 25 bp, Homo sapien
atgttaaaagtcagccgtttactgg

SEQ ID NO: 33600 - DNA, 25 bp, Homo sapien
atgttaaacacctcttgatcactgc

SEQ ID NO: 33601 - DNA, 25 bp, Homo sapien
atgttaaacattctgtagttaacac

SEQ ID NO: 33602 - DNA, 25 bp, Homo sapien
atgttaaacattgtgtagttaacac

SEQ ID NO: 33603 - DNA, 25 bp, Homo sapien
atgttaaagacctcttgatcactgc

SEQ ID NO: 33604 - DNA, 25 bp, Homo sapien
atgttaaagggtaagtgcttggtga

SEQ ID NO: 33605 - DNA, 25 bp, Homo sapien
atgttaaatactgactcacaggaga

SEQ ID NO: 33606 - DNA, 25 bp, Homo sapien
atgttaaatactgagtcacaggaga

SEQ ID NO: 33607 - DNA, 25 bp, Homo sapien
atgttaaatgatccttaagttaaag

SEQ ID NO: 33608 - DNA, 25 bp, Homo sapien
atgttaaatgtgctacagattcttc

SEQ ID NO: 33609 - DNA, 25 bp, Homo sapien
atgttaaatgtgctccagattcttc

SEQ ID NO: 33610 - DNA, 25 bp, Homo sapien
atgttaagctgatgataaaagaagt

SEQ ID NO: 33611 - DNA, 25 bp, Homo sapien
atgttaagctgatggtaaaagaagt

SEQ ID NO: 33612 - DNA, 25 bp, Homo sapien
atgttaagtggcaatgttccatgca

SEQ ID NO: 33613 - DNA, 25 bp, Homo sapien
atgttaagtggtaatgttccatgca

SEQ ID NO: 33614 - DNA, 25 bp, Homo sapien
atgttaattacggacgcaaacaagg

SEQ ID NO: 33615 - DNA, 25 bp, Homo sapien
atgttaattacggatgcaaacaagg

SEQ ID NO: 33616 - DNA, 25 bp, Homo sapien
atgttacatatattcatagactgag

SEQ ID NO: 33617 - DNA, 25 bp, Homo sapien
atgttacatgtattcatagactgag

SEQ ID NO: 33618 - DNA, 25 bp, Homo sapien
atgttacctctgatcccttatttta

SEQ ID NO: 33619 - DNA, 25 bp, Homo sapien
atgttacctttgatcccttatttta

SEQ ID NO: 33620 - DNA, 25 bp, Homo sapien
atgttagcatacgctttttaaactg

SEQ ID NO: 33621 - DNA, 25 bp, Homo sapien
atgttagcatatgctttttaaactg

SEQ ID NO: 33622 - DNA, 25 bp, Homo sapien
atgttagcctatcaatatttcatgg

SEQ ID NO: 33623 - DNA, 25 bp, Homo sapien
atgttagcgtatcaatatttcatgg

SEQ ID NO: 33624 - DNA, 25 bp, Homo sapien
atgttaggctacatggaagatggaa

SEQ ID NO: 33625 - DNA, 25 bp, Homo sapien
atgttaggctacatggcagatggaa

SEQ ID NO: 33626 - DNA, 25 bp, Homo sapien
atgttagtgcatctcatggatacaa

SEQ ID NO: 33627 - DNA, 25 bp, Homo sapien
atgttagtgcatttcatggatacaa

SEQ ID NO: 33628 - DNA, 25 bp, Homo sapien
atgttagtttccattttcttctgtt

SEQ ID NO: 33629 - DNA, 25 bp, Homo sapien
atgttagtttccgttttcttctgtt

SEQ ID NO: 33630 - DNA, 25 bp, Homo sapien
atgttataattccctgtctttccag

SEQ ID NO: 33631 - DNA, 25 bp, Homo sapien
atgttataatttaattggcagcatt

SEQ ID NO: 33632 - DNA, 25 bp, Homo sapien
atgttataatttcattggcagcatt

SEQ ID NO: 33633 - DNA, 25 bp, Homo sapien
atgttatacacccttttcatggctg

SEQ ID NO: 33634 - DNA, 25 bp, Homo sapien
atgttatacttccctgtctttccag

SEQ ID NO: 33635 - DNA, 25 bp, Homo sapien
atgttatatacccttttcatggctg

SEQ ID NO: 33636 - DNA, 25 bp, Homo sapien
atgttattcttagagattatgtcag

SEQ ID NO: 33637 - DNA, 25 bp, Homo sapien
atgttattcttagcgattatgtcag

SEQ ID NO: 33638 - DNA, 25 bp, Homo sapien
atgttcaacgttgcaatactgtttg

SEQ ID NO: 33639 - DNA, 25 bp, Homo sapien
atgttcaatatacgtttgttgatta

SEQ ID NO: 33640 - DNA, 25 bp, Homo sapien
atgttcaatatatgtttgttgatta

SEQ ID NO: 33641 - DNA, 25 bp, Homo sapien
atgttcaatgttgcaatactgtttg

SEQ ID NO: 33642 - DNA, 25 bp, Homo sapien
atgttcactggatgaattttgggtt

SEQ ID NO: 33643 - DNA, 25 bp, Homo sapien
atgttcactggttgaattttgggtt

SEQ ID NO: 33644 - DNA, 25 bp, Homo sapien
atgttcagacatccagttatagagc

SEQ ID NO: 33645 - DNA, 25 bp, Homo sapien
atgttcagagagcgtctaccctcaa

SEQ ID NO: 33646 - DNA, 25 bp, Homo sapien
atgttcagagagtgtctaccctcaa

SEQ ID NO: 33647 - DNA, 25 bp, Homo sapien
atgttcagatatccagttatagagc

SEQ ID NO: 33648 - DNA, 25 bp, Homo sapien
atgttcagcgtatttgggagagaac

SEQ ID NO: 33649 - DNA, 25 bp, Homo sapien
atgttcagtgtatttgggagagaac

SEQ ID NO: 33650 - DNA, 25 bp, Homo sapien
atgttcataccaaaaaaataaaaag

SEQ ID NO: 33651 - DNA, 25 bp, Homo sapien
atgttcataccacaaaaataaaaag

SEQ ID NO: 33652 - DNA, 25 bp, Homo sapien
atgttcattttatgtgagcaaatgg

SEQ ID NO: 33653 - DNA, 25 bp, Homo sapien
atgttcattttttgtgagcaaatgg

SEQ ID NO: 33654 - DNA, 25 bp, Homo sapien
atgttccaacaaacccattcatagg

SEQ ID NO: 33655 - DNA, 25 bp, Homo sapien
atgttccaacaaacccgttcatagg

SEQ ID NO: 33656 - DNA, 25 bp, Homo sapien
atgttccaatgaaaacagacataca

SEQ ID NO: 33657 - DNA, 25 bp, Homo sapien
atgttccactaaggatgggtgcagc

SEQ ID NO: 33658 - DNA, 25 bp, Homo sapien
atgttccagtaaggatgggtgcagc

SEQ ID NO: 33659 - DNA, 25 bp, Homo sapien
atgttccagtgaaaacagacataca

SEQ ID NO: 33660 - DNA, 25 bp, Homo sapien
atgttccatggttttacgcaaatgt

SEQ ID NO: 33661 - DNA, 25 bp, Homo sapien
atgttccatggttttatgcaaatgt

SEQ ID NO: 33662 - DNA, 25 bp, Homo sapien
atgttcctgcttcatgccactagct

SEQ ID NO: 33663 - DNA, 25 bp, Homo sapien
atgttcctgcttcgtgccactagct

SEQ ID NO: 33664 - DNA, 25 bp, Homo sapien
atgttctaaaatggattaccaggat

SEQ ID NO: 33665 - DNA, 25 bp, Homo sapien
atgttctaaaattgattaccaggat

SEQ ID NO: 33666 - DNA, 25 bp, Homo sapien
atgttctaaattcgtcgtgcgatgg

SEQ ID NO: 33667 - DNA, 25 bp, Homo sapien
atgttctaaatttgtcgtgcgatgg

SEQ ID NO: 33668 - DNA, 25 bp, Homo sapien
atgttctaacagcgaattttgagtg

SEQ ID NO: 33669 - DNA, 25 bp, Homo sapien
atgttctaacagtgaattttgagtg

SEQ ID NO: 33670 - DNA, 25 bp, Homo sapien
atgttctatactcacacaaatttat

SEQ ID NO: 33671 - DNA, 25 bp, Homo sapien
atgttctatacttacacaaatttat

SEQ ID NO: 33672 - DNA, 25 bp, Homo sapien
atgttctcagaacgttaccacactt

SEQ ID NO: 33673 - DNA, 25 bp, Homo sapien
atgttctcagaatgttaccacactt

SEQ ID NO: 33674 - DNA, 25 bp, Homo sapien
atgttctccttccatggttcttcac

SEQ ID NO: 33675 - DNA, 25 bp, Homo sapien
atgttctccttctatggttcttcac

SEQ ID NO: 33676 - DNA, 25 bp, Homo sapien
atgttctctactcgccttcataaat

SEQ ID NO: 33677 - DNA, 25 bp, Homo sapien
atgttctctacttgccttcataaat

SEQ ID NO: 33678 - DNA, 25 bp, Homo sapien
atgttctgctttcctcttgacctgc

SEQ ID NO: 33679 - DNA, 25 bp, Homo sapien
atgttctgcttttctcttgacctgc

SEQ ID NO: 33680 - DNA, 25 bp, Homo sapien
atgttctgggaatcgctccatatca

SEQ ID NO: 33681 - DNA, 25 bp, Homo sapien
atgttctgggaattgctccatatca

SEQ ID NO: 33682 - DNA, 25 bp, Homo sapien
atgttctgttccactgcggctaagc

SEQ ID NO: 33683 - DNA, 25 bp, Homo sapien
atgttctgttctactgcggctaagc

SEQ ID NO: 33684 - DNA, 25 bp, Homo sapien
atgttctgtttaatgagagtgatgc

SEQ ID NO: 33685 - DNA, 25 bp, Homo sapien
atgttctgtttaatgatagtgatgc

SEQ ID NO: 33686 - DNA, 25 bp, Homo sapien
atgttcttacagcgatgttaccaag

SEQ ID NO: 33687 - DNA, 25 bp, Homo sapien
atgttcttacagtgatgttaccaag

SEQ ID NO: 33688 - DNA, 25 bp, Homo sapien
atgttcttataatggagtggaaagg

SEQ ID NO: 33689 - DNA, 25 bp, Homo sapien
atgttcttcaggcataataggtgca

SEQ ID NO: 33690 - DNA, 25 bp, Homo sapien
atgttcttcaggcctaataggtgca

SEQ ID NO: 33691 - DNA, 25 bp, Homo sapien
atgttcttgactggtttagttacct

SEQ ID NO: 33692 - DNA, 25 bp, Homo sapien
atgttcttgtctggtttagttacct

SEQ ID NO: 33693 - DNA, 25 bp, Homo sapien
atgttcttttaatggagtggaaagg

SEQ ID NO: 33694 - DNA, 25 bp, Homo sapien
atgttgaaggacatcagtcaatctt

SEQ ID NO: 33695 - DNA, 25 bp, Homo sapien
atgttgaaggacgtcagtcaatctt

SEQ ID NO: 33696 - DNA, 25 bp, Homo sapien
atgttgaatccagaagtagcagctg

SEQ ID NO: 33697 - DNA, 25 bp, Homo sapien
atgttgaattcagaagtagcagctg

SEQ ID NO: 33698 - DNA, 25 bp, Homo sapien
atgttgacaaatcaaaattagtatt

SEQ ID NO: 33699 - DNA, 25 bp, Homo sapien
atgttgacaaatccaaattagtatt

SEQ ID NO: 33700 - DNA, 25 bp, Homo sapien
atgttgagattagaaaggtgagcac

SEQ ID NO: 33701 - DNA, 25 bp, Homo sapien
atgttgagattggaaaggtgagcac

SEQ ID NO: 33702 - DNA, 25 bp, Homo sapien
atgttgagtctctgctgctacttga

SEQ ID NO: 33703 - DNA, 25 bp, Homo sapien
atgttgagtttctgctgctacttga

SEQ ID NO: 33704 - DNA, 25 bp, Homo sapien
atgttgatgagaatacagagcaact

SEQ ID NO: 33705 - DNA, 25 bp, Homo sapien
atgttgatgagaatacggagcaact

SEQ ID NO: 33706 - DNA, 25 bp, Homo sapien
atgttgatttacctttaacaaactt

SEQ ID NO: 33707 - DNA, 25 bp, Homo sapien
atgttgatttatctttaacaaactt

SEQ ID NO: 33708 - DNA, 25 bp, Homo sapien
atgttgcaacaatgaataactgaat

SEQ ID NO: 33709 - DNA, 25 bp, Homo sapien
atgttgcaataatgaataactgaat

SEQ ID NO: 33710 - DNA, 25 bp, Homo sapien
atgttgcagaggcaccaatggttgc

SEQ ID NO: 33711 - DNA, 25 bp, Homo sapien
atgttgcagaggcagcaatggttgc

SEQ ID NO: 33712 - DNA, 25 bp, Homo sapien
atgttgcctacacaactgtatgggt

SEQ ID NO: 33713 - DNA, 25 bp, Homo sapien
atgttgcctacagaactgtatgggt

SEQ ID NO: 33714 - DNA, 25 bp, Homo sapien
atgttgcctagagcccgatgctatc

SEQ ID NO: 33715 - DNA, 25 bp, Homo sapien
atgttgcctagagctcgatgctatc

SEQ ID NO: 33716 - DNA, 25 bp, Homo sapien
atgttgccttcttattggtaaggag

SEQ ID NO: 33717 - DNA, 25 bp, Homo sapien
atgttgccttcttgttggtaaggag

SEQ ID NO: 33718 - DNA, 25 bp, Homo sapien
atgttgctaggcacctgtatctctt

SEQ ID NO: 33719 - DNA, 25 bp, Homo sapien
atgttgctaggcatctgtatctctt

SEQ ID NO: 33720 - DNA, 25 bp, Homo sapien
atgttgctgggtattacgaaagctt

SEQ ID NO: 33721 - DNA, 25 bp, Homo sapien
atgttgctgggtattatgaaagctt

SEQ ID NO: 33722 - DNA, 25 bp, Homo sapien
atgttggattacctatacaggctga

SEQ ID NO: 33723 - DNA, 25 bp, Homo sapien
atgttggattacctatgcaggctga

SEQ ID NO: 33724 - DNA, 25 bp, Homo sapien
atgttgggaatctttccaacaaaaa

SEQ ID NO: 33725 - DNA, 25 bp, Homo sapien
atgttgggaatctttctaacaaaaa

SEQ ID NO: 33726 - DNA, 25 bp, Homo sapien
atgttgggccacgtgacaaacatgg

SEQ ID NO: 33727 - DNA, 25 bp, Homo sapien
atgttgggctacgtgacaaacatgg

SEQ ID NO: 33728 - DNA, 25 bp, Homo sapien
atgttggtttcaatgtttgatttag

SEQ ID NO: 33729 - DNA, 25 bp, Homo sapien
atgttggtttcagtgtttgatttag

SEQ ID NO: 33730 - DNA, 25 bp, Homo sapien
atgttgtaatattcaaatgcccaac

SEQ ID NO: 33731 - DNA, 25 bp, Homo sapien
atgttgtaatattcaagtgcccaac

SEQ ID NO: 33732 - DNA, 25 bp, Homo sapien
atgttgtagcttgaaatctcttatg

SEQ ID NO: 33733 - DNA, 25 bp, Homo sapien
atgttgtagctttaaatctcttatg

SEQ ID NO: 33734 - DNA, 25 bp, Homo sapien
atgttgtatgactaaagaagatgag

SEQ ID NO: 33735 - DNA, 25 bp, Homo sapien
atgttgtatgagtaaagaagatgag

SEQ ID NO: 33736 - DNA, 25 bp, Homo sapien
atgttgtcaccaccatttcaagagg

SEQ ID NO: 33737 - DNA, 25 bp, Homo sapien
atgttgtcaccaccgtttcaagagg

SEQ ID NO: 33738 - DNA, 25 bp, Homo sapien
atgttgtgattgtacgagtcaatac

SEQ ID NO: 33739 - DNA, 25 bp, Homo sapien
atgttgtgattgtgcgagtcaatac

SEQ ID NO: 33740 - DNA, 25 bp, Homo sapien
atgttgtggcgagactgaaatccaa

SEQ ID NO: 33741 - DNA, 25 bp, Homo sapien
atgttgtggtgagactgaaatccaa

SEQ ID NO: 33742 - DNA, 25 bp, Homo sapien
atgttgttgaatctatcagtagtcc

SEQ ID NO: 33743 - DNA, 25 bp, Homo sapien
atgttgttgaatgtatcagtagtcc

SEQ ID NO: 33744 - DNA, 25 bp, Homo sapien
atgttgttggactgtacttcctcac

SEQ ID NO: 33745 - DNA, 25 bp, Homo sapien
atgttgttggactgtatttcctcac

SEQ ID NO: 33746 - DNA, 25 bp, Homo sapien
atgttgttggttctatttatgttat

SEQ ID NO: 33747 - DNA, 25 bp, Homo sapien
atgttgtttgttctatttatgttat

SEQ ID NO: 33748 - DNA, 25 bp, Homo sapien
atgtttaaaaaagtgaccttcctca

SEQ ID NO: 33749 - DNA, 25 bp, Homo sapien
atgtttaaacaagtgaccttcctca

SEQ ID NO: 33750 - DNA, 25 bp, Homo sapien
atgtttaaagtaattgttgatgtag

SEQ ID NO: 33751 - DNA, 25 bp, Homo sapien
atgtttaaagtgattgttgatgtag

SEQ ID NO: 33752 - DNA, 25 bp, Homo sapien
atgtttaaattgtcgtaatctgagt

SEQ ID NO: 33753 - DNA, 25 bp, Homo sapien
atgtttaaattgttgtaatctgagt

SEQ ID NO: 33754 - DNA, 25 bp, Homo sapien
atgtttaagggtcactttgtaaatt

SEQ ID NO: 33755 - DNA, 25 bp, Homo sapien
atgtttaagggtcattttgtaaatt

SEQ ID NO: 33756 - DNA, 25 bp, Homo sapien
atgtttaggttgcgctaaaatttac

SEQ ID NO: 33757 - DNA, 25 bp, Homo sapien
atgtttaggttgtgctaaaatttac

SEQ ID NO: 33758 - DNA, 25 bp, Homo sapien
atgtttagtgtcggtaagatctata

SEQ ID NO: 33759 - DNA, 25 bp, Homo sapien
atgtttagtgttggtaagatctata

SEQ ID NO: 33760 - DNA, 25 bp, Homo sapien
atgtttatagcagcattttaaaaag

SEQ ID NO: 33761 - DNA, 25 bp, Homo sapien
atgtttatagcagcgttttaaaaag

SEQ ID NO: 33762 - DNA, 25 bp, Homo sapien
atgtttatcaaaatactcccataaa

SEQ ID NO: 33763 - DNA, 25 bp, Homo sapien
atgtttatcagcaatattggcctat

SEQ ID NO: 33764 - DNA, 25 bp, Homo sapien
atgtttatcaggaatattggcctat

SEQ ID NO: 33765 - DNA, 25 bp, Homo sapien
atgtttatccaaatactcccataaa

SEQ ID NO: 33766 - DNA, 25 bp, Homo sapien
atgtttattaggccagaggatcaag

SEQ ID NO: 33767 - DNA, 25 bp, Homo sapien
atgtttattaggtcagaggatcaag

SEQ ID NO: 33768 - DNA, 25 bp, Homo sapien
atgtttattatataccagatgtgat

SEQ ID NO: 33769 - DNA, 25 bp, Homo sapien
atgtttattgtataccagatgtgat

SEQ ID NO: 33770 - DNA, 25 bp, Homo sapien
atgtttcaaatgtatgaatccctaa

SEQ ID NO: 33771 - DNA, 25 bp, Homo sapien
atgtttcaaatttatgaatccctaa

SEQ ID NO: 33772 - DNA, 25 bp, Homo sapien
atgtttcaggctacataattctttg

SEQ ID NO: 33773 - DNA, 25 bp, Homo sapien
atgtttcaggctacctaattctttg

SEQ ID NO: 33774 - DNA, 25 bp, Homo sapien
atgtttcattttagtaaccttgaac

SEQ ID NO: 33775 - DNA, 25 bp, Homo sapien
atgtttcattttggtaaccttgaac

SEQ ID NO: 33776 - DNA, 25 bp, Homo sapien
atgtttccatttatatgaaattcaa

SEQ ID NO: 33777 - DNA, 25 bp, Homo sapien
atgtttccatttatgtgaaattcaa

SEQ ID NO: 33778 - DNA, 25 bp, Homo sapien
atgtttccctcgagcccttggatat

SEQ ID NO: 33779 - DNA, 25 bp, Homo sapien
atgtttccctcgggcccttggatat

SEQ ID NO: 33780 - DNA, 25 bp, Homo sapien
atgtttctataagatggagagtggc

SEQ ID NO: 33781 - DNA, 25 bp, Homo sapien
atgtttctctaagatggagagtggc

SEQ ID NO: 33782 - DNA, 25 bp, Homo sapien
atgtttgctttgctctctctgcctt

SEQ ID NO: 33783 - DNA, 25 bp, Homo sapien
atgtttgctttgctgtctctgcctt

SEQ ID NO: 33784 - DNA, 25 bp, Homo sapien
atgtttgctttggctgtcttctgtt

SEQ ID NO: 33785 - DNA, 25 bp, Homo sapien
atgtttgcttttcatttgtcagtga

SEQ ID NO: 33786 - DNA, 25 bp, Homo sapien
atgtttgcttttgctgtcttctgtt

SEQ ID NO: 33787 - DNA, 25 bp, Homo sapien
atgtttgctttttatttgtcagtga

SEQ ID NO: 33788 - DNA, 25 bp, Homo sapien
atgtttggacgaccatgaaaatttg

SEQ ID NO: 33789 - DNA, 25 bp, Homo sapien
atgtttggatgaccatgaaaatttg

SEQ ID NO: 33790 - DNA, 25 bp, Homo sapien
atgtttggcaagcatgtgggaaaac

SEQ ID NO: 33791 - DNA, 25 bp, Homo sapien
atgtttggcatggtgctagttatga

SEQ ID NO: 33792 - DNA, 25 bp, Homo sapien
atgtttggcgtggtgctagttatga

SEQ ID NO: 33793 - DNA, 25 bp, Homo sapien
atgtttggtaagcatgtgggaaaac

SEQ ID NO: 33794 - DNA, 25 bp, Homo sapien
atgtttgtctgctctttgttgggtg

SEQ ID NO: 33795 - DNA, 25 bp, Homo sapien
atgtttgtctggtgatcattatttg

SEQ ID NO: 33796 - DNA, 25 bp, Homo sapien
atgtttgtctggtgatgattatttg

SEQ ID NO: 33797 - DNA, 25 bp, Homo sapien
atgtttgtgccacaagaatgttaag

SEQ ID NO: 33798 - DNA, 25 bp, Homo sapien
atgtttgtgccacaagcatgttaag

SEQ ID NO: 33799 - DNA, 25 bp, Homo sapien
atgtttgtttgctctttgttgggtg

SEQ ID NO: 33800 - DNA, 25 bp, Homo sapien
atgttttagtttccattctattcaa

SEQ ID NO: 33801 - DNA, 25 bp, Homo sapien
atgttttagtttccgttctattcaa

SEQ ID NO: 33802 - DNA, 25 bp, Homo sapien
atgttttatcatcctgtttctgcta

SEQ ID NO: 33803 - DNA, 25 bp, Homo sapien
atgttttatcatttatcagttggga

SEQ ID NO: 33804 - DNA, 25 bp, Homo sapien
atgttttatgatttatcagttggga

SEQ ID NO: 33805 - DNA, 25 bp, Homo sapien
atgttttattatcctgtttctgcta

SEQ ID NO: 33806 - DNA, 25 bp, Homo sapien
atgttttattcacgttctcggtggc

SEQ ID NO: 33807 - DNA, 25 bp, Homo sapien
atgttttattcatgttctcggtggc

SEQ ID NO: 33808 - DNA, 25 bp, Homo sapien
atgttttcacatcggtcactttaaa

SEQ ID NO: 33809 - DNA, 25 bp, Homo sapien
atgttttcacattggtcactttaaa

SEQ ID NO: 33810 - DNA, 25 bp, Homo sapien
atgttttcattcgctttgttgaaga

SEQ ID NO: 33811 - DNA, 25 bp, Homo sapien
atgttttcatttgctttgttgaaga

SEQ ID NO: 33812 - DNA, 25 bp, Homo sapien
atgttttcattttcagtttttactt

SEQ ID NO: 33813 - DNA, 25 bp, Homo sapien
atgttttccacaaggcttgcaattt

SEQ ID NO: 33814 - DNA, 25 bp, Homo sapien
atgttttccacgaggcttgcaattt

SEQ ID NO: 33815 - DNA, 25 bp, Homo sapien
atgttttcgttttcagtttttactt

SEQ ID NO: 33816 - DNA, 25 bp, Homo sapien
atgttttctacattatcctccttag

SEQ ID NO: 33817 - DNA, 25 bp, Homo sapien
atgttttctacattgtcctccttag

SEQ ID NO: 33818 - DNA, 25 bp, Homo sapien
atgttttctttgaccttacttacag

SEQ ID NO: 33819 - DNA, 25 bp, Homo sapien
atgttttctttgcccttacttacag

SEQ ID NO: 33820 - DNA, 25 bp, Homo sapien
atgttttggaatacgactcttgggc

SEQ ID NO: 33821 - DNA, 25 bp, Homo sapien
atgttttgggataaatatggcataa

SEQ ID NO: 33822 - DNA, 25 bp, Homo sapien
atgttttgggatacgactcttgggc

SEQ ID NO: 33823 - DNA, 25 bp, Homo sapien
atgttttggtatacacactaaagaa

SEQ ID NO: 33824 - DNA, 25 bp, Homo sapien
atgttttggtattcacactaaagaa

SEQ ID NO: 33825 - DNA, 25 bp, Homo sapien
atgttttgtgataaatatggcataa

SEQ ID NO: 33826 - DNA, 25 bp, Homo sapien
atgttttttagtcagggtgaatgga

SEQ ID NO: 33827 - DNA, 25 bp, Homo sapien
atgttttttagtgagggtgaatgga

SEQ ID NO: 33828 - DNA, 25 bp, Homo sapien
attaaaaacgatgccagaagtgtgg

SEQ ID NO: 33829 - DNA, 25 bp, Homo sapien
attaaaaatgatgccagaagtgtgg

SEQ ID NO: 33830 - DNA, 25 bp, Homo sapien
attaaaaattcacaaggaaatgtaa

SEQ ID NO: 33831 - DNA, 25 bp, Homo sapien
attaaaaattcacacggaaatgtaa

SEQ ID NO: 33832 - DNA, 25 bp, Homo sapien
attaaaacactgatgagaccttaga

SEQ ID NO: 33833 - DNA, 25 bp, Homo sapien
attaaaacattgatgagaccttaga

SEQ ID NO: 33834 - DNA, 25 bp, Homo sapien
attaaaacgtgattaagtcctgagg

SEQ ID NO: 33835 - DNA, 25 bp, Homo sapien
attaaaacgtggttaagtcctgagg

SEQ ID NO: 33836 - DNA, 25 bp, Homo sapien
attaaaagaatacacagctatacag

SEQ ID NO: 33837 - DNA, 25 bp, Homo sapien
attaaaagaatatacagctatacag

SEQ ID NO: 33838 - DNA, 25 bp, Homo sapien
attaaaagaccattcatatgcaaat

SEQ ID NO: 33839 - DNA, 25 bp, Homo sapien
attaaaagataagccagtacatctc

SEQ ID NO: 33840 - DNA, 25 bp, Homo sapien
attaaaagataggccagtacatctc

SEQ ID NO: 33841 - DNA, 25 bp, Homo sapien
attaaaagatcattcatatgcaaat

SEQ ID NO: 33842 - DNA, 25 bp, Homo sapien
attaaaagctgagagtgaatgaata

SEQ ID NO: 33843 - DNA, 25 bp, Homo sapien
attaaaagctgagagttaatgaata

SEQ ID NO: 33844 - DNA, 25 bp, Homo sapien
attaaaagtaccggcaaaaaccata

SEQ ID NO: 33845 - DNA, 25 bp, Homo sapien
attaaaagtactggcaaaaaccata

SEQ ID NO: 33846 - DNA, 25 bp, Homo sapien
attaaaagtatccttgcagttttcc

SEQ ID NO: 33847 - DNA, 25 bp, Homo sapien
attaaaagtatctttgcagttttcc

SEQ ID NO: 33848 - DNA, 25 bp, Homo sapien
attaaaatcacccgtcaaatcttta

SEQ ID NO: 33849 - DNA, 25 bp, Homo sapien
attaaaatcacccgtcgaatcttta

SEQ ID NO: 33850 - DNA, 25 bp, Homo sapien
attaaaatgagttgggaagaagttc

SEQ ID NO: 33851 - DNA, 25 bp, Homo sapien
attaaaatgagttgggtagaagttc

SEQ ID NO: 33852 - DNA, 25 bp, Homo sapien
attaaaatggagaccgcctgaactt

SEQ ID NO: 33853 - DNA, 25 bp, Homo sapien
attaaaatggagactgcctgaactt

SEQ ID NO: 33854 - DNA, 25 bp, Homo sapien
attaaaatggtcaataataggagag

SEQ ID NO: 33855 - DNA, 25 bp, Homo sapien
attaaaatggtcgataataggagag

SEQ ID NO: 33856 - DNA, 25 bp, Homo sapien
attaaaatgtgacacaagtgaagga

SEQ ID NO: 33857 - DNA, 25 bp, Homo sapien
attaaaatgtgatacaagtgaagga

SEQ ID NO: 33858 - DNA, 25 bp, Homo sapien
attaaaatgtgtcatagagctgaat

SEQ ID NO: 33859 - DNA, 25 bp, Homo sapien
attaaaatgtgtcgtagagctgaat

SEQ ID NO: 33860 - DNA, 25 bp, Homo sapien
attaaaattagaaccacattgtttg

SEQ ID NO: 33861 - DNA, 25 bp, Homo sapien
attaaaattagaactacattgtttg

SEQ ID NO: 33862 - DNA, 25 bp, Homo sapien
attaaaatttagccgagaacttcta

SEQ ID NO: 33863 - DNA, 25 bp, Homo sapien
attaaaatttagctgagaacttcta

SEQ ID NO: 33864 - DNA, 25 bp, Homo sapien
attaaacaagcacgtacaaaggaga

SEQ ID NO: 33865 - DNA, 25 bp, Homo sapien
attaaacaagcatgtacaaaggaga

SEQ ID NO: 33866 - DNA, 25 bp, Homo sapien
attaaacaagtcacacccttcttcc

SEQ ID NO: 33867 - DNA, 25 bp, Homo sapien
attaaacaagtcgcacccttcttcc

SEQ ID NO: 33868 - DNA, 25 bp, Homo sapien
attaaacacaaggataatgaatcag

SEQ ID NO: 33869 - DNA, 25 bp, Homo sapien
attaaacacaagtataatgaatcag

SEQ ID NO: 33870 - DNA, 25 bp, Homo sapien
attaaacacttatttctggcaatta

SEQ ID NO: 33871 - DNA, 25 bp, Homo sapien
attaaacagaacagggcccatgagc

SEQ ID NO: 33872 - DNA, 25 bp, Homo sapien
attaaacagtgaccggaagagcttg

SEQ ID NO: 33873 - DNA, 25 bp, Homo sapien
attaaacagtgactggaagagcttg

SEQ ID NO: 33874 - DNA, 25 bp, Homo sapien
attaaacataacagggcccatgagc

SEQ ID NO: 33875 - DNA, 25 bp, Homo sapien
attaaacattacgatgcagtttttc

SEQ ID NO: 33876 - DNA, 25 bp, Homo sapien
attaaacattatgatgcagtttttc

SEQ ID NO: 33877 - DNA, 25 bp, Homo sapien
attaaacatttatttctggcaatta

SEQ ID NO: 33878 - DNA, 25 bp, Homo sapien
attaaaccaagaaggaagtccagaa

SEQ ID NO: 33879 - DNA, 25 bp, Homo sapien
attaaaccgagaaggaagtccagaa

SEQ ID NO: 33880 - DNA, 25 bp, Homo sapien
attaaaccttagaatgtgaacgcct

SEQ ID NO: 33881 - DNA, 25 bp, Homo sapien
attaaaccttagagtgtgaacgcct

SEQ ID NO: 33882 - DNA, 25 bp, Homo sapien
attaaacgttacctaaaactcaaac

SEQ ID NO: 33883 - DNA, 25 bp, Homo sapien
attaaacgttatctaaaactcaaac

SEQ ID NO: 33884 - DNA, 25 bp, Homo sapien
attaaactcttaattctttcctctg

SEQ ID NO: 33885 - DNA, 25 bp, Homo sapien
attaaactcttacttctttcctctg

SEQ ID NO: 33886 - DNA, 25 bp, Homo sapien
attaaactgaaaacattctgcacag

SEQ ID NO: 33887 - DNA, 25 bp, Homo sapien
attaaactgaaaatattctgcacag

SEQ ID NO: 33888 - DNA, 25 bp, Homo sapien
attaaacttcactgctttcaaagtg

SEQ ID NO: 33889 - DNA, 25 bp, Homo sapien
attaaacttcagtgctttcaaagtg

SEQ ID NO: 33890 - DNA, 25 bp, Homo sapien
attaaagaaccacgcagaagtgctc

SEQ ID NO: 33891 - DNA, 25 bp, Homo sapien
attaaagaaccatgcagaagtgctc

SEQ ID NO: 33892 - DNA, 25 bp, Homo sapien
attaaagacaacacggtaccagaaa

SEQ ID NO: 33893 - DNA, 25 bp, Homo sapien
attaaagactaggagtggccatggt

SEQ ID NO: 33894 - DNA, 25 bp, Homo sapien
attaaagaggtgaggatggctgagg

SEQ ID NO: 33895 - DNA, 25 bp, Homo sapien
attaaagagttgaggatggctgagg

SEQ ID NO: 33896 - DNA, 25 bp, Homo sapien
attaaagataacacggtaccagaaa

SEQ ID NO: 33897 - DNA, 25 bp, Homo sapien
attaaagatatacattttcatagct

SEQ ID NO: 33898 - DNA, 25 bp, Homo sapien
attaaagatgtacattttcatagct

SEQ ID NO: 33899 - DNA, 25 bp, Homo sapien
attaaagattaggagtggccatggt

SEQ ID NO: 33900 - DNA, 25 bp, Homo sapien
attaaagctcagttttttgctgtag

SEQ ID NO: 33901 - DNA, 25 bp, Homo sapien
attaaagcttagttttttgctgtag

SEQ ID NO: 33902 - DNA, 25 bp, Homo sapien
attaaaggcttgaccctgggaagca

SEQ ID NO: 33903 - DNA, 25 bp, Homo sapien
attaaaggcttgatcctgggaagca

SEQ ID NO: 33904 - DNA, 25 bp, Homo sapien
attaaagggacccgcagtcatgttc

SEQ ID NO: 33905 - DNA, 25 bp, Homo sapien
attaaagggacctgcagtcatgttc

SEQ ID NO: 33906 - DNA, 25 bp, Homo sapien
attaaagggtaagatcggaaaccaa

SEQ ID NO: 33907 - DNA, 25 bp, Homo sapien
attaaagggtaagatctgaaaccaa

SEQ ID NO: 33908 - DNA, 25 bp, Homo sapien
attaaaggttgagttttccttagtg

SEQ ID NO: 33909 - DNA, 25 bp, Homo sapien
attaaaggttgatttttccttagtg

SEQ ID NO: 33910 - DNA, 25 bp, Homo sapien
attaaagtggcaatgcaccatgcac

SEQ ID NO: 33911 - DNA, 25 bp, Homo sapien
attaaagtggccatgcaccatgcac

SEQ ID NO: 33912 - DNA, 25 bp, Homo sapien
attaaagtgtgaattccgatttgag

SEQ ID NO: 33913 - DNA, 25 bp, Homo sapien
attaaagtgtgaattctgatttgag

SEQ ID NO: 33914 - DNA, 25 bp, Homo sapien
attaaagttcagaaagtttgcagcc

SEQ ID NO: 33915 - DNA, 25 bp, Homo sapien
attaaagttcataaagtttgcagcc

SEQ ID NO: 33916 - DNA, 25 bp, Homo sapien
attaaataaagagccgctatgttct

SEQ ID NO: 33917 - DNA, 25 bp, Homo sapien
attaaataaagagtcgctatgttct

SEQ ID NO: 33918 - DNA, 25 bp, Homo sapien
attaaataataagcacaagggacag

SEQ ID NO: 33919 - DNA, 25 bp, Homo sapien
attaaatagcacacgtatgaagtgt

SEQ ID NO: 33920 - DNA, 25 bp, Homo sapien
attaaatagcacatgtatgaagtgt

SEQ ID NO: 33921 - DNA, 25 bp, Homo sapien
attaaatagtaagcacaagggacag

SEQ ID NO: 33922 - DNA, 25 bp, Homo sapien
attaaatatgttccggaccccaaga

SEQ ID NO: 33923 - DNA, 25 bp, Homo sapien
attaaatatgttctggaccccaaga

SEQ ID NO: 33924 - DNA, 25 bp, Homo sapien
attaaatcactcttagtacgcagag

SEQ ID NO: 33925 - DNA, 25 bp, Homo sapien
attaaatcactgttagtacgcagag

SEQ ID NO: 33926 - DNA, 25 bp, Homo sapien
attaaatgaccacatgaaaaatgga

SEQ ID NO: 33927 - DNA, 25 bp, Homo sapien
attaaatgcagactctgttgaaact

SEQ ID NO: 33928 - DNA, 25 bp, Homo sapien
attaaatggccacatgaaaaatgga

SEQ ID NO: 33929 - DNA, 25 bp, Homo sapien
attaaatgtagactctgttgaaact

SEQ ID NO: 33930 - DNA, 25 bp, Homo sapien
attaaattcagctctggtgtagttt

SEQ ID NO: 33931 - DNA, 25 bp, Homo sapien
attaaattgcacaaaatatcaaaat

SEQ ID NO: 33932 - DNA, 25 bp, Homo sapien
attaaattgcacgaaatatcaaaat

SEQ ID NO: 33933 - DNA, 25 bp, Homo sapien
attaaattgttgtgagaccaccaaa

SEQ ID NO: 33934 - DNA, 25 bp, Homo sapien
attaaattgttttgagaccaccaaa

SEQ ID NO: 33935 - DNA, 25 bp, Homo sapien
attaaatttagctctggtgtagttt

SEQ ID NO: 33936 - DNA, 25 bp, Homo sapien
attaaatttcctctgtagcttgtaa

SEQ ID NO: 33937 - DNA, 25 bp, Homo sapien
attaaatttcctttgtagcttgtaa

SEQ ID NO: 33938 - DNA, 25 bp, Homo sapien
attaaatttctgcttgtttttctct

SEQ ID NO: 33939 - DNA, 25 bp, Homo sapien
attaaatttctgtttgtttttctct

SEQ ID NO: 33940 - DNA, 25 bp, Homo sapien
attaacacgtcaaaataacatgaat

SEQ ID NO: 33941 - DNA, 25 bp, Homo sapien
attaacacgtcagaataacatgaat

SEQ ID NO: 33942 - DNA, 25 bp, Homo sapien
attaacagattcacaagctctggcc

SEQ ID NO: 33943 - DNA, 25 bp, Homo sapien
attaacaggttcacaagctctggcc

SEQ ID NO: 33944 - DNA, 25 bp, Homo sapien
attaacagtgtttcaataaacatag

SEQ ID NO: 33945 - DNA, 25 bp, Homo sapien
attaacagtgtttcgataaacatag

SEQ ID NO: 33946 - DNA, 25 bp, Homo sapien
attaacataccaacaagtcaaattc

SEQ ID NO: 33947 - DNA, 25 bp, Homo sapien
attaacatccaaacaaacttgcagt

SEQ ID NO: 33948 - DNA, 25 bp, Homo sapien
attaacatccaagcaaacttgcagt

SEQ ID NO: 33949 - DNA, 25 bp, Homo sapien
attaacatgccaacaagtcaaattc

SEQ ID NO: 33950 - DNA, 25 bp, Homo sapien
attaacatttcagaagatctcgttt

SEQ ID NO: 33951 - DNA, 25 bp, Homo sapien
attaacatttcagaaggtctcgttt

SEQ ID NO: 33952 - DNA, 25 bp, Homo sapien
attaaccaaaagagttgttgtttgc

SEQ ID NO: 33953 - DNA, 25 bp, Homo sapien
attaaccaaaagggttgttgtttgc

SEQ ID NO: 33954 - DNA, 25 bp, Homo sapien
attaaccaaccctggatattagtat

SEQ ID NO: 33955 - DNA, 25 bp, Homo sapien
attaaccaaccgtggatattagtat

SEQ ID NO: 33956 - DNA, 25 bp, Homo sapien
attaaccagacatggtactatacac

SEQ ID NO: 33957 - DNA, 25 bp, Homo sapien
attaaccagatactgagccttcagg

SEQ ID NO: 33958 - DNA, 25 bp, Homo sapien
attaaccagatattgagccttcagg

SEQ ID NO: 33959 - DNA, 25 bp, Homo sapien
attaaccaggcatggtactatacac

SEQ ID NO: 33960 - DNA, 25 bp, Homo sapien
attaaccatgatgcagatcccctga

SEQ ID NO: 33961 - DNA, 25 bp, Homo sapien
attaaccatgatgctgatcccctga

SEQ ID NO: 33962 - DNA, 25 bp, Homo sapien
attaacgataattcatctggtagat

SEQ ID NO: 33963 - DNA, 25 bp, Homo sapien
attaacgataattcgtctggtagat

SEQ ID NO: 33964 - DNA, 25 bp, Homo sapien
attaactacatgcgcttggacaatt

SEQ ID NO: 33965 - DNA, 25 bp, Homo sapien
attaactacgtgcgcttggacaatt

SEQ ID NO: 33966 - DNA, 25 bp, Homo sapien
attaactcaggtctgactcacatta

SEQ ID NO: 33967 - DNA, 25 bp, Homo sapien
attaactcgggtctgactcacatta

SEQ ID NO: 33968 - DNA, 25 bp, Homo sapien
attaactctccttgcttatctttcc

SEQ ID NO: 33969 - DNA, 25 bp, Homo sapien
attaactcttcttgcttatctttcc

SEQ ID NO: 33970 - DNA, 25 bp, Homo sapien
attaactgcccagtgatgtcacact

SEQ ID NO: 33971 - DNA, 25 bp, Homo sapien
attaactgcccattgatgtcacact

SEQ ID NO: 33972 - DNA, 25 bp, Homo sapien
attaactgtggatgttgtcatcagt

SEQ ID NO: 33973 - DNA, 25 bp, Homo sapien
attaactgttgatgttgtcatcagt

SEQ ID NO: 33974 - DNA, 25 bp, Homo sapien
attaacttacccaatccttacaacc

SEQ ID NO: 33975 - DNA, 25 bp, Homo sapien
attaacttacctaatccttacaacc

SEQ ID NO: 33976 - DNA, 25 bp, Homo sapien
attaagaaacacttctgccaccctc

SEQ ID NO: 33977 - DNA, 25 bp, Homo sapien
attaagaaacagcagtatcatgaaa

SEQ ID NO: 33978 - DNA, 25 bp, Homo sapien
attaagaaacaggagtatcatgaaa

SEQ ID NO: 33979 - DNA, 25 bp, Homo sapien
attaagaaacatttctgccaccctc

SEQ ID NO: 33980 - DNA, 25 bp, Homo sapien
attaagaagattacacatggtgtat

SEQ ID NO: 33981 - DNA, 25 bp, Homo sapien
attaagaagattacacgtggtgtat

SEQ ID NO: 33982 - DNA, 25 bp, Homo sapien
attaagaataatacataccacatgc

SEQ ID NO: 33983 - DNA, 25 bp, Homo sapien
attaagaataatacgtaccacatgc

SEQ ID NO: 33984 - DNA, 25 bp, Homo sapien
attaagaccagatgtgagcacagag

SEQ ID NO: 33985 - DNA, 25 bp, Homo sapien
attaagaccagatgtgggcacagag

SEQ ID NO: 33986 - DNA, 25 bp, Homo sapien
attaagagaagtgaaccgatgttct

SEQ ID NO: 33987 - DNA, 25 bp, Homo sapien
attaagagaagtgaactgatgttct

SEQ ID NO: 33988 - DNA, 25 bp, Homo sapien
attaagagacacaaaagtttgatga

SEQ ID NO: 33989 - DNA, 25 bp, Homo sapien
attaagagccacaaaagtttgatga

SEQ ID NO: 33990 - DNA, 25 bp, Homo sapien
attaagagctgaccgtataaacgat

SEQ ID NO: 33991 - DNA, 25 bp, Homo sapien
attaagagctgactgtataaacgat

SEQ ID NO: 33992 - DNA, 25 bp, Homo sapien
attaagagtattgactccttcatgc

SEQ ID NO: 33993 - DNA, 25 bp, Homo sapien
attaagagtattgtctccttcatgc

SEQ ID NO: 33994 - DNA, 25 bp, Homo sapien
attaagagttgtacggcttggattg

SEQ ID NO: 33995 - DNA, 25 bp, Homo sapien
attaagagttgtgcggcttggattg

SEQ ID NO: 33996 - DNA, 25 bp, Homo sapien
attaagatagggttgtagtccaatt

SEQ ID NO: 33997 - DNA, 25 bp, Homo sapien
attaagatagggttgttgtccaatt

SEQ ID NO: 33998 - DNA, 25 bp, Homo sapien
attaagatcgctaaatgtcttagat

SEQ ID NO: 33999 - DNA, 25 bp, Homo sapien
attaagatcgcttaatgtcttagat

SEQ ID NO: 34000 - DNA, 25 bp, Homo sapien
attaagatgatagttaagatttgat

SEQ ID NO: 34001 - DNA, 25 bp, Homo sapien
attaagatgatatttaagatttgat

SEQ ID NO: 34002 - DNA, 25 bp, Homo sapien
attaagattcagaaatgtacagata

SEQ ID NO: 34003 - DNA, 25 bp, Homo sapien
attaagattcagagatgtacagata

SEQ ID NO: 34004 - DNA, 25 bp, Homo sapien
attaagcataacgataaatgaaggt

SEQ ID NO: 34005 - DNA, 25 bp, Homo sapien
attaagcataatgataaatgaaggt

SEQ ID NO: 34006 - DNA, 25 bp, Homo sapien
attaagccaaattttgaacataaag

SEQ ID NO: 34007 - DNA, 25 bp, Homo sapien
attaagccaaattttgcacataaag

SEQ ID NO: 34008 - DNA, 25 bp, Homo sapien
attaaggagataaggactggggtgt

SEQ ID NO: 34009 - DNA, 25 bp, Homo sapien
attaaggagataatgactggggtgt

SEQ ID NO: 34010 - DNA, 25 bp, Homo sapien
attaaggatcataagattgggagat

SEQ ID NO: 34011 - DNA, 25 bp, Homo sapien
attaaggatcatgagattgggagat

SEQ ID NO: 34012 - DNA, 25 bp, Homo sapien
attaaggatgtctaacaccaaacta

SEQ ID NO: 34013 - DNA, 25 bp, Homo sapien
attaaggatttctaacaccaaacta

SEQ ID NO: 34014 - DNA, 25 bp, Homo sapien
attaagtcacactttccattgtctt

SEQ ID NO: 34015 - DNA, 25 bp, Homo sapien
attaagtcacattttccattgtctt

SEQ ID NO: 34016 - DNA, 25 bp, Homo sapien
attaagtccaatgttactttgctaa

SEQ ID NO: 34017 - DNA, 25 bp, Homo sapien
attaagtccaatgttagtttgctaa

SEQ ID NO: 34018 - DNA, 25 bp, Homo sapien
attaagtttcctgtaacgccagcca

SEQ ID NO: 34019 - DNA, 25 bp, Homo sapien
attaagtttcctgtaatgccagcca

SEQ ID NO: 34020 - DNA, 25 bp, Homo sapien
attaataaaacaaaaagatgcatag

SEQ ID NO: 34021 - DNA, 25 bp, Homo sapien
attaataaaacaaagagatgcatag

SEQ ID NO: 34022 - DNA, 25 bp, Homo sapien
attaataaacaggctgcgaatctgt

SEQ ID NO: 34023 - DNA, 25 bp, Homo sapien
attaataaacaggctgtgaatctgt

SEQ ID NO: 34024 - DNA, 25 bp, Homo sapien
attaataaacccctggtacataata

SEQ ID NO: 34025 - DNA, 25 bp, Homo sapien
attaataaacccttggtacataata

SEQ ID NO: 34026 - DNA, 25 bp, Homo sapien
attaataacaaaacacacatgactt

SEQ ID NO: 34027 - DNA, 25 bp, Homo sapien
attaataacaaaatacacatgactt

SEQ ID NO: 34028 - DNA, 25 bp, Homo sapien
attaataagtggatgtcctcattta

SEQ ID NO: 34029 - DNA, 25 bp, Homo sapien
attaataagtgggtgtcctcattta

SEQ ID NO: 34030 - DNA, 25 bp, Homo sapien
attaatactagtctaaatagattca

SEQ ID NO: 34031 - DNA, 25 bp, Homo sapien
attaatactggaaagttcctaaaac

SEQ ID NO: 34032 - DNA, 25 bp, Homo sapien
attaatactgggaagttcctaaaac

SEQ ID NO: 34033 - DNA, 25 bp, Homo sapien
attaatacttgtctaaatagattca

SEQ ID NO: 34034 - DNA, 25 bp, Homo sapien
attaatatcctagtacctctccatc

SEQ ID NO: 34035 - DNA, 25 bp, Homo sapien
attaatatccttgtacctctccatc

SEQ ID NO: 34036 - DNA, 25 bp, Homo sapien
attaatattacataacatgaggtca

SEQ ID NO: 34037 - DNA, 25 bp, Homo sapien
attaatattacgtaacatgaggtca

SEQ ID NO: 34038 - DNA, 25 bp, Homo sapien
attaatattcaatatccagatcaac

SEQ ID NO: 34039 - DNA, 25 bp, Homo sapien
attaatattgaatatccagatcaac

SEQ ID NO: 34040 - DNA, 25 bp, Homo sapien
attaatattgaggcctttttatctg

SEQ ID NO: 34041 - DNA, 25 bp, Homo sapien
attaatattgagggctttttatctg

SEQ ID NO: 34042 - DNA, 25 bp, Homo sapien
attaatcacaactagtttcagaaac

SEQ ID NO: 34043 - DNA, 25 bp, Homo sapien
attaatcacagttgttttaaattcc

SEQ ID NO: 34044 - DNA, 25 bp, Homo sapien
attaatcacgactagtttcagaaac

SEQ ID NO: 34045 - DNA, 25 bp, Homo sapien
attaatcactcccgccactgtccat

SEQ ID NO: 34046 - DNA, 25 bp, Homo sapien
attaatcatagttgttttaaattcc

SEQ ID NO: 34047 - DNA, 25 bp, Homo sapien
attaatcatgtgatgacgagaggag

SEQ ID NO: 34048 - DNA, 25 bp, Homo sapien
attaatcatgtgatgatgagaggag

SEQ ID NO: 34049 - DNA, 25 bp, Homo sapien
attaatcattcccgccactgtccat

SEQ ID NO: 34050 - DNA, 25 bp, Homo sapien
attaatccatcggcctcctgtcagt

SEQ ID NO: 34051 - DNA, 25 bp, Homo sapien
attaatccatctgcctcctgtcagt

SEQ ID NO: 34052 - DNA, 25 bp, Homo sapien
attaatccatcttctatctacagat

SEQ ID NO: 34053 - DNA, 25 bp, Homo sapien
attaatccattcaactgttggtata

SEQ ID NO: 34054 - DNA, 25 bp, Homo sapien
attaatccgtcttctatctacagat

SEQ ID NO: 34055 - DNA, 25 bp, Homo sapien
attaatccgttcaactgttggtata

SEQ ID NO: 34056 - DNA, 25 bp, Homo sapien
attaatctatgaataagaaagaccc

SEQ ID NO: 34057 - DNA, 25 bp, Homo sapien
attaatctatgaatgagaaagaccc

SEQ ID NO: 34058 - DNA, 25 bp, Homo sapien
attaatctgatatttcagttgcagg

SEQ ID NO: 34059 - DNA, 25 bp, Homo sapien
attaatctgatatttcggttgcagg

SEQ ID NO: 34060 - DNA, 25 bp, Homo sapien
attaatgagcctataacctctgttg

SEQ ID NO: 34061 - DNA, 25 bp, Homo sapien
attaatgagcctataagctctgttg

SEQ ID NO: 34062 - DNA, 25 bp, Homo sapien
attaatgatagcaattcacgctaga

SEQ ID NO: 34063 - DNA, 25 bp, Homo sapien
attaatgatagcgattcacgctaga

SEQ ID NO: 34064 - DNA, 25 bp, Homo sapien
attaatgctgccatcaagaatttaa

SEQ ID NO: 34065 - DNA, 25 bp, Homo sapien
attaatgctgccatcatgaatttaa

SEQ ID NO: 34066 - DNA, 25 bp, Homo sapien
attaatggcactaatttttgtagtg

SEQ ID NO: 34067 - DNA, 25 bp, Homo sapien
attaatggtactaatttttgtagtg

SEQ ID NO: 34068 - DNA, 25 bp, Homo sapien
attaatggtccatggcctggtggtt

SEQ ID NO: 34069 - DNA, 25 bp, Homo sapien
attaatggtccgtggcctggtggtt

SEQ ID NO: 34070 - DNA, 25 bp, Homo sapien
attaatgtttcttcctgaatatttt

SEQ ID NO: 34071 - DNA, 25 bp, Homo sapien
attaatgtttcttgctgaatatttt

SEQ ID NO: 34072 - DNA, 25 bp, Homo sapien
attaattaagccttgagacagacca

SEQ ID NO: 34073 - DNA, 25 bp, Homo sapien
attaattacaactcctggcccacta

SEQ ID NO: 34074 - DNA, 25 bp, Homo sapien
attaattacgactcctggcccacta

SEQ ID NO: 34075 - DNA, 25 bp, Homo sapien
attaattaggccttgagacagacca

SEQ ID NO: 34076 - DNA, 25 bp, Homo sapien
attaattcagaggcgctgacacatg

SEQ ID NO: 34077 - DNA, 25 bp, Homo sapien
attaattcagaggtgctgacacatg

SEQ ID NO: 34078 - DNA, 25 bp, Homo sapien
attaattcatgttccaaaggtgact

SEQ ID NO: 34079 - DNA, 25 bp, Homo sapien
attaattcatgttgcaaaggtgact

SEQ ID NO: 34080 - DNA, 25 bp, Homo sapien
attaattctagtcattatccatcaa

SEQ ID NO: 34081 - DNA, 25 bp, Homo sapien
attaattctagtcgttatccatcaa

SEQ ID NO: 34082 - DNA, 25 bp, Homo sapien
attaattgcagctgaacttaaaccc

SEQ ID NO: 34083 - DNA, 25 bp, Homo sapien
attaattgcagcttaacttaaaccc

SEQ ID NO: 34084 - DNA, 25 bp, Homo sapien
attaattgcctaactgggtatgatg

SEQ ID NO: 34085 - DNA, 25 bp, Homo sapien
attaattgcctaattgggtatgatg

SEQ ID NO: 34086 - DNA, 25 bp, Homo sapien
attaattttatctgcagcatccttt

SEQ ID NO: 34087 - DNA, 25 bp, Homo sapien
attaattttgtctgcagcatccttt

SEQ ID NO: 34088 - DNA, 25 bp, Homo sapien
attaattttttaacaagtgccgtga

SEQ ID NO: 34089 - DNA, 25 bp, Homo sapien
attaattttttaataagtgccgtga

SEQ ID NO: 34090 - DNA, 25 bp, Homo sapien
attacaaacagtagatatgacacag

SEQ ID NO: 34091 - DNA, 25 bp, Homo sapien
attacaaacagtggatatgacacag

SEQ ID NO: 34092 - DNA, 25 bp, Homo sapien
attacaacagacccgataatcctca

SEQ ID NO: 34093 - DNA, 25 bp, Homo sapien
attacaacagaccctataatcctca

SEQ ID NO: 34094 - DNA, 25 bp, Homo sapien
attacaacatacactaaatgtaact

SEQ ID NO: 34095 - DNA, 25 bp, Homo sapien
attacaacatacgctaaatgtaact

SEQ ID NO: 34096 - DNA, 25 bp, Homo sapien
attacaagaactactgtattttctg

SEQ ID NO: 34097 - DNA, 25 bp, Homo sapien
attacaagaactattgtattttctg

SEQ ID NO: 34098 - DNA, 25 bp, Homo sapien
attacaagaggaccttttgcttaat

SEQ ID NO: 34099 - DNA, 25 bp, Homo sapien
attacaagagggccttttgcttaat

SEQ ID NO: 34100 - DNA, 25 bp, Homo sapien
attacaaggtgctacgagaacatgt

SEQ ID NO: 34101 - DNA, 25 bp, Homo sapien
attacaaggtgctatgagaacatgt

SEQ ID NO: 34102 - DNA, 25 bp, Homo sapien
attacaatggattgatatgattatt

SEQ ID NO: 34103 - DNA, 25 bp, Homo sapien
attacaatggattgatgtgattatt

SEQ ID NO: 34104 - DNA, 25 bp, Homo sapien
attacacaaaataaataactgaaga

SEQ ID NO: 34105 - DNA, 25 bp, Homo sapien
attacacaaaataaatcactgaaga

SEQ ID NO: 34106 - DNA, 25 bp, Homo sapien
attacacatctttttgaatctacta

SEQ ID NO: 34107 - DNA, 25 bp, Homo sapien
attacacatctttttggatctacta

SEQ ID NO: 34108 - DNA, 25 bp, Homo sapien
attacaccagtcattcaaaaataca

SEQ ID NO: 34109 - DNA, 25 bp, Homo sapien
attacaccagtcgttcaaaaataca

SEQ ID NO: 34110 - DNA, 25 bp, Homo sapien
attacacgttcttcctcttggaccc

SEQ ID NO: 34111 - DNA, 25 bp, Homo sapien
attacacgttcttcctgttggaccc

SEQ ID NO: 34112 - DNA, 25 bp, Homo sapien
attacagagttcacagtattcatat

SEQ ID NO: 34113 - DNA, 25 bp, Homo sapien
attacagagttcacggtattcatat

SEQ ID NO: 34114 - DNA, 25 bp, Homo sapien
attacagccgtgtaagacattttct

SEQ ID NO: 34115 - DNA, 25 bp, Homo sapien
attacagccgtttaagacattttct

SEQ ID NO: 34116 - DNA, 25 bp, Homo sapien
attacagtcagggactcatatctca

SEQ ID NO: 34117 - DNA, 25 bp, Homo sapien
attacagtcagggattcatatctca

SEQ ID NO: 34118 - DNA, 25 bp, Homo sapien
attacataagccactggctcatctc

SEQ ID NO: 34119 - DNA, 25 bp, Homo sapien
attacataagccgctggctcatctc

SEQ ID NO: 34120 - DNA, 25 bp, Homo sapien
attacatgttaattacacttctata

SEQ ID NO: 34121 - DNA, 25 bp, Homo sapien
attacatgttaattacgcttctata

SEQ ID NO: 34122 - DNA, 25 bp, Homo sapien
attacattacgcaaatgaaaacagc

SEQ ID NO: 34123 - DNA, 25 bp, Homo sapien
attacattaggcaaatgaaaacagc

SEQ ID NO: 34124 - DNA, 25 bp, Homo sapien
attacattgtgcccacgcagattaa

SEQ ID NO: 34125 - DNA, 25 bp, Homo sapien
attacattgtgtccacgcagattaa

SEQ ID NO: 34126 - DNA, 25 bp, Homo sapien
attacatttccatacaagaagtcca

SEQ ID NO: 34127 - DNA, 25 bp, Homo sapien
attacatttccgtacaagaagtcca

SEQ ID NO: 34128 - DNA, 25 bp, Homo sapien
attacatttttcaaagtgcacacat

SEQ ID NO: 34129 - DNA, 25 bp, Homo sapien
attacatttttgaaagtgcacacat

SEQ ID NO: 34130 - DNA, 25 bp, Homo sapien
attaccaaagtggctaataattgag

SEQ ID NO: 34131 - DNA, 25 bp, Homo sapien
attaccaaagtggctagtaattgag

SEQ ID NO: 34132 - DNA, 25 bp, Homo sapien
attaccaagctcaatgaataaatga

SEQ ID NO: 34133 - DNA, 25 bp, Homo sapien
attaccaagctcgatgaataaatga

SEQ ID NO: 34134 - DNA, 25 bp, Homo sapien
attaccattaccgtaactgctgtca

SEQ ID NO: 34135 - DNA, 25 bp, Homo sapien
attaccattactgtaactgctgtca

SEQ ID NO: 34136 - DNA, 25 bp, Homo sapien
attaccattctgtagcagaacctat

SEQ ID NO: 34137 - DNA, 25 bp, Homo sapien
attaccattttgtagcagaacctat

SEQ ID NO: 34138 - DNA, 25 bp, Homo sapien
attacctatacaggctgacattttc

SEQ ID NO: 34139 - DNA, 25 bp, Homo sapien
attacctatgcaggctgacattttc

SEQ ID NO: 34140 - DNA, 25 bp, Homo sapien
attacctatgtcttttctgcatttt

SEQ ID NO: 34141 - DNA, 25 bp, Homo sapien
attacctatgtgttttctgcatttt

SEQ ID NO: 34142 - DNA, 25 bp, Homo sapien
attacctcacttgccgcttatttta

SEQ ID NO: 34143 - DNA, 25 bp, Homo sapien
attacctcagcaggttcagtactta

SEQ ID NO: 34144 - DNA, 25 bp, Homo sapien
attacctcagcatgttcagtactta

SEQ ID NO: 34145 - DNA, 25 bp, Homo sapien
attacctcagttgccgcttatttta

SEQ ID NO: 34146 - DNA, 25 bp, Homo sapien
attacctggtggcaaattgattaca

SEQ ID NO: 34147 - DNA, 25 bp, Homo sapien
attacctggtggcagattgattaca

SEQ ID NO: 34148 - DNA, 25 bp, Homo sapien
attacctgtaaccggtccttgtctc

SEQ ID NO: 34149 - DNA, 25 bp, Homo sapien
attacctgtaactggtccttgtctc

SEQ ID NO: 34150 - DNA, 25 bp, Homo sapien
attaccttatcactgccttgaattc

SEQ ID NO: 34151 - DNA, 25 bp, Homo sapien
attaccttatcattgccttgaattc

SEQ ID NO: 34152 - DNA, 25 bp, Homo sapien
attacctttttatgagaagagataa

SEQ ID NO: 34153 - DNA, 25 bp, Homo sapien
attacctttttatgaggagagataa

SEQ ID NO: 34154 - DNA, 25 bp, Homo sapien
attactaaaaacaggttacaaatag

SEQ ID NO: 34155 - DNA, 25 bp, Homo sapien
attactaaaaacgggttacaaatag

SEQ ID NO: 34156 - DNA, 25 bp, Homo sapien
attactaacatcacatccatatcta

SEQ ID NO: 34157 - DNA, 25 bp, Homo sapien
attactaacatcccatccatatcta

SEQ ID NO: 34158 - DNA, 25 bp, Homo sapien
attactaacgtctcctttctgatcc

SEQ ID NO: 34159 - DNA, 25 bp, Homo sapien
attactaatgtctcctttctgatcc

SEQ ID NO: 34160 - DNA, 25 bp, Homo sapien
attactagcattacgcattttgatg

SEQ ID NO: 34161 - DNA, 25 bp, Homo sapien
attactagcattatgcattttgatg

SEQ ID NO: 34162 - DNA, 25 bp, Homo sapien
attactatataatagaactgcagcc

SEQ ID NO: 34163 - DNA, 25 bp, Homo sapien
attactatatattagaactgcagcc

SEQ ID NO: 34164 - DNA, 25 bp, Homo sapien
attactatgtaaggttactcaaggg

SEQ ID NO: 34165 - DNA, 25 bp, Homo sapien
attactatgtaatgttactcaaggg

SEQ ID NO: 34166 - DNA, 25 bp, Homo sapien
attactcaggaaggcgccagagaca

SEQ ID NO: 34167 - DNA, 25 bp, Homo sapien
attactcaggaaggtgccagagaca

SEQ ID NO: 34168 - DNA, 25 bp, Homo sapien
attactccacacttcaaggtcaaat

SEQ ID NO: 34169 - DNA, 25 bp, Homo sapien
attactccatacttcaaggtcaaat

SEQ ID NO: 34170 - DNA, 25 bp, Homo sapien
attactgaaggaacggaatttgatc

SEQ ID NO: 34171 - DNA, 25 bp, Homo sapien
attactgaaggaatggaatttgatc

SEQ ID NO: 34172 - DNA, 25 bp, Homo sapien
attactgattcccatcaatttctct

SEQ ID NO: 34173 - DNA, 25 bp, Homo sapien
attactgattcccgtcaatttctct

SEQ ID NO: 34174 - DNA, 25 bp, Homo sapien
attactgtcaccggtttacagatga

SEQ ID NO: 34175 - DNA, 25 bp, Homo sapien
attactgtcaccgttttacagatga

SEQ ID NO: 34176 - DNA, 25 bp, Homo sapien
attacttacgcatcacacatcaata

SEQ ID NO: 34177 - DNA, 25 bp, Homo sapien
attacttatgcatcacacatcaata

SEQ ID NO: 34178 - DNA, 25 bp, Homo sapien
attacttctgcatttactcattgaa

SEQ ID NO: 34179 - DNA, 25 bp, Homo sapien
attacttctgcctttactcattgaa

SEQ ID NO: 34180 - DNA, 25 bp, Homo sapien
attacttctgtaacaaattgccaga

SEQ ID NO: 34181 - DNA, 25 bp, Homo sapien
attacttctgtaaccaattgccaga

SEQ ID NO: 34182 - DNA, 25 bp, Homo sapien
attacttcttttagttgctgagctt

SEQ ID NO: 34183 - DNA, 25 bp, Homo sapien
attacttcttttagtttctgagctt

SEQ ID NO: 34184 - DNA, 25 bp, Homo sapien
attacttgtaattgcaagtgcaaaa

SEQ ID NO: 34185 - DNA, 25 bp, Homo sapien
attacttgtaatttcaagtgcaaaa

SEQ ID NO: 34186 - DNA, 25 bp, Homo sapien
attactttcaaccccatctgtttca

SEQ ID NO: 34187 - DNA, 25 bp, Homo sapien
attactttcgaccccatctgtttca

SEQ ID NO: 34188 - DNA, 25 bp, Homo sapien
attactttcttcttcggtgccaatt

SEQ ID NO: 34189 - DNA, 25 bp, Homo sapien
attactttcttctttggtgccaatt

SEQ ID NO: 34190 - DNA, 25 bp, Homo sapien
attactttgggacactgttctttcc

SEQ ID NO: 34191 - DNA, 25 bp, Homo sapien
attactttgggacattgttctttcc

SEQ ID NO: 34192 - DNA, 25 bp, Homo sapien
attactttgtgacttccatatgcta

SEQ ID NO: 34193 - DNA, 25 bp, Homo sapien
attactttgtgtcttccatatgcta

SEQ ID NO: 34194 - DNA, 25 bp, Homo sapien
attagaaaaccagtagtaggcaaaa

SEQ ID NO: 34195 - DNA, 25 bp, Homo sapien
attagaaaaccggtagtaggcaaaa

SEQ ID NO: 34196 - DNA, 25 bp, Homo sapien
attagaaagtttcaataaattaacc

SEQ ID NO: 34197 - DNA, 25 bp, Homo sapien
attagaaagtttgaataaattaacc

SEQ ID NO: 34198 - DNA, 25 bp, Homo sapien
attagaacacatctgatctgaattt

SEQ ID NO: 34199 - DNA, 25 bp, Homo sapien
attagaacaggcttacaagagaccc

SEQ ID NO: 34200 - DNA, 25 bp, Homo sapien
attagaaccacattgtttgcttatc

SEQ ID NO: 34201 - DNA, 25 bp, Homo sapien
attagaaccggcttacaagagaccc

SEQ ID NO: 34202 - DNA, 25 bp, Homo sapien
attagaactacattgtttgcttatc

SEQ ID NO: 34203 - DNA, 25 bp, Homo sapien
attagaactcatctgatctgaattt

SEQ ID NO: 34204 - DNA, 25 bp, Homo sapien
attagaagagaaaagtctgcctttg

SEQ ID NO: 34205 - DNA, 25 bp, Homo sapien
attagaagagaaatgtctgcctttg

SEQ ID NO: 34206 - DNA, 25 bp, Homo sapien
attagaagaggagattctgacacag

SEQ ID NO: 34207 - DNA, 25 bp, Homo sapien
attagaagaggagtttctgacacag

SEQ ID NO: 34208 - DNA, 25 bp, Homo sapien
attagaaggttaaattataggtcaa

SEQ ID NO: 34209 - DNA, 25 bp, Homo sapien
attagaaggttaaattgtaggtcaa

SEQ ID NO: 34210 - DNA, 25 bp, Homo sapien
attagactgcggcaaagccaggatt

SEQ ID NO: 34211 - DNA, 25 bp, Homo sapien
attagactgtggcaaagccaggatt

SEQ ID NO: 34212 - DNA, 25 bp, Homo sapien
attagacttgctattttttttccct

SEQ ID NO: 34213 - DNA, 25 bp, Homo sapien
attagacttgctcttttttttccct

SEQ ID NO: 34214 - DNA, 25 bp, Homo sapien
attagatacaaagaggccttaaaag

SEQ ID NO: 34215 - DNA, 25 bp, Homo sapien
attagatagaaagaggccttaaaag

SEQ ID NO: 34216 - DNA, 25 bp, Homo sapien
attagatcaggaacctaatctaacc

SEQ ID NO: 34217 - DNA, 25 bp, Homo sapien
attagatcaggaccctaatctaacc

SEQ ID NO: 34218 - DNA, 25 bp, Homo sapien
attagatcataccctgtttgtccta

SEQ ID NO: 34219 - DNA, 25 bp, Homo sapien
attagatcataccgtgtttgtccta

SEQ ID NO: 34220 - DNA, 25 bp, Homo sapien
attagatccgtagcttcttaacatt

SEQ ID NO: 34221 - DNA, 25 bp, Homo sapien
attagatccttagcttcttaacatt

SEQ ID NO: 34222 - DNA, 25 bp, Homo sapien
attagatctgcatgcctctatattg

SEQ ID NO: 34223 - DNA, 25 bp, Homo sapien
attagatctgcatgtctctatattg

SEQ ID NO: 34224 - DNA, 25 bp, Homo sapien
attagatcttacggatttatgagat

SEQ ID NO: 34225 - DNA, 25 bp, Homo sapien
attagatcttatggatttatgagat

SEQ ID NO: 34226 - DNA, 25 bp, Homo sapien
attagatgagtatagtgtgaaggtt

SEQ ID NO: 34227 - DNA, 25 bp, Homo sapien
attagatgagtatcgtgtgaaggtt

SEQ ID NO: 34228 - DNA, 25 bp, Homo sapien
attagattctcagaggtgcgtcaac

SEQ ID NO: 34229 - DNA, 25 bp, Homo sapien
attagattctcataggtgcgtcaac

SEQ ID NO: 34230 - DNA, 25 bp, Homo sapien
attagattgaaggaagcaaaatatt

SEQ ID NO: 34231 - DNA, 25 bp, Homo sapien
attagattgaaggaaggaaaatatt

SEQ ID NO: 34232 - DNA, 25 bp, Homo sapien
attagcaaaaatgctgagataggag

SEQ ID NO: 34233 - DNA, 25 bp, Homo sapien
attagcaaaaatgctgggataggag

SEQ ID NO: 34234 - DNA, 25 bp, Homo sapien
attagcacacaaaaacattaagaaa

SEQ ID NO: 34235 - DNA, 25 bp, Homo sapien
attagcacacaagaacattaagaaa

SEQ ID NO: 34236 - DNA, 25 bp, Homo sapien
attagcaggtggcagaccccagttt

SEQ ID NO: 34237 - DNA, 25 bp, Homo sapien
attagcagttggcagaccccagttt

SEQ ID NO: 34238 - DNA, 25 bp, Homo sapien
attagccaactatcaacatcgggta

SEQ ID NO: 34239 - DNA, 25 bp, Homo sapien
attagccaactgtcaacatcgggta

SEQ ID NO: 34240 - DNA, 25 bp, Homo sapien
attagccttccactgagatactgac

SEQ ID NO: 34241 - DNA, 25 bp, Homo sapien
attagccttccattgagatactgac

SEQ ID NO: 34242 - DNA, 25 bp, Homo sapien
attagctgtagccacacattccaga

SEQ ID NO: 34243 - DNA, 25 bp, Homo sapien
attagctgtagccgcacattccaga

SEQ ID NO: 34244 - DNA, 25 bp, Homo sapien
attagcttcaaaaccttacatgaat

SEQ ID NO: 34245 - DNA, 25 bp, Homo sapien
attagcttcaaaactttacatgaat

SEQ ID NO: 34246 - DNA, 25 bp, Homo sapien
attagcttctttctttcccaaaatc

SEQ ID NO: 34247 - DNA, 25 bp, Homo sapien
attagcttctttcttttccaaaatc

SEQ ID NO: 34248 - DNA, 25 bp, Homo sapien
attagctttcttacctgaaaatctg

SEQ ID NO: 34249 - DNA, 25 bp, Homo sapien
attagctttcttatctgaaaatctg

SEQ ID NO: 34250 - DNA, 25 bp, Homo sapien
attaggaagagcctactgaggtctg

SEQ ID NO: 34251 - DNA, 25 bp, Homo sapien
attaggaagagtctactgaggtctg

SEQ ID NO: 34252 - DNA, 25 bp, Homo sapien
attaggactcatttatctatttata

SEQ ID NO: 34253 - DNA, 25 bp, Homo sapien
attaggactcatttgtctatttata

SEQ ID NO: 34254 - DNA, 25 bp, Homo sapien
attaggagaacagtgtctaagaatt

SEQ ID NO: 34255 - DNA, 25 bp, Homo sapien
attaggaggacagtgtctaagaatt

SEQ ID NO: 34256 - DNA, 25 bp, Homo sapien
attaggcaagtctgatatttggtta

SEQ ID NO: 34257 - DNA, 25 bp, Homo sapien
attaggcaagtctgatctttggtta

SEQ ID NO: 34258 - DNA, 25 bp, Homo sapien
attaggcaataacactacttgctaa

SEQ ID NO: 34259 - DNA, 25 bp, Homo sapien
attaggcaataatactacttgctaa

SEQ ID NO: 34260 - DNA, 25 bp, Homo sapien
attaggccaacatgagtgcactgat

SEQ ID NO: 34261 - DNA, 25 bp, Homo sapien
attaggccaacatgcgtgcactgat

SEQ ID NO: 34262 - DNA, 25 bp, Homo sapien
attaggctcacatacactattttaa

SEQ ID NO: 34263 - DNA, 25 bp, Homo sapien
attaggctcacatacattattttaa

SEQ ID NO: 34264 - DNA, 25 bp, Homo sapien
attaggcttcatcctggttaccagt

SEQ ID NO: 34265 - DNA, 25 bp, Homo sapien
attaggctttatcctggttaccagt

SEQ ID NO: 34266 - DNA, 25 bp, Homo sapien
attagggcagcaataccaattggaa

SEQ ID NO: 34267 - DNA, 25 bp, Homo sapien
attagggcagcgataccaattggaa

SEQ ID NO: 34268 - DNA, 25 bp, Homo sapien
attagggctgtctgtaatgtctctc

SEQ ID NO: 34269 - DNA, 25 bp, Homo sapien
attagggctgtttgtaatgtctctc

SEQ ID NO: 34270 - DNA, 25 bp, Homo sapien
attaggtacaaaaccataatgactg

SEQ ID NO: 34271 - DNA, 25 bp, Homo sapien
attaggtacaaatccataatgactg

SEQ ID NO: 34272 - DNA, 25 bp, Homo sapien
attaggtgagaggtgccgtgtgtat

SEQ ID NO: 34273 - DNA, 25 bp, Homo sapien
attaggtgagaggtgctgtgtgtat

SEQ ID NO: 34274 - DNA, 25 bp, Homo sapien
attaggtgccttttcattcaatctg

SEQ ID NO: 34275 - DNA, 25 bp, Homo sapien
attaggtgtcttttcattcaatctg

SEQ ID NO: 34276 - DNA, 25 bp, Homo sapien
attaggttgcaagacttttctgtgt

SEQ ID NO: 34277 - DNA, 25 bp, Homo sapien
attaggttgcaagccttttctgtgt

SEQ ID NO: 34278 - DNA, 25 bp, Homo sapien
attagtaaatagaaaatccgtggac

SEQ ID NO: 34279 - DNA, 25 bp, Homo sapien
attagtaaatagagaatccgtggac

SEQ ID NO: 34280 - DNA, 25 bp, Homo sapien
attagtacaagtgcaaagccatgtt

SEQ ID NO: 34281 - DNA, 25 bp, Homo sapien
attagtacaagttcaaagccatgtt

SEQ ID NO: 34282 - DNA, 25 bp, Homo sapien
attagtacattttccctggaatctg

SEQ ID NO: 34283 - DNA, 25 bp, Homo sapien
attagtacgttttccctggaatctg

SEQ ID NO: 34284 - DNA, 25 bp, Homo sapien
attagtagcgtttctacatgctaac

SEQ ID NO: 34285 - DNA, 25 bp, Homo sapien
attagtagctacggtgaacagtgct

SEQ ID NO: 34286 - DNA, 25 bp, Homo sapien
attagtagctatggtgaacagtgct

SEQ ID NO: 34287 - DNA, 25 bp, Homo sapien
attagtagtgtttctacatgctaac

SEQ ID NO: 34288 - DNA, 25 bp, Homo sapien
attagtatcatccgaatgtcccagg

SEQ ID NO: 34289 - DNA, 25 bp, Homo sapien
attagtatcatctgaatgtcccagg

SEQ ID NO: 34290 - DNA, 25 bp, Homo sapien
attagtattttccaaacttattgta

SEQ ID NO: 34291 - DNA, 25 bp, Homo sapien
attagtattttccaaatttattgta

SEQ ID NO: 34292 - DNA, 25 bp, Homo sapien
attagtcaatactgaaccactgctc

SEQ ID NO: 34293 - DNA, 25 bp, Homo sapien
attagtcaatactgaatcactgctc

SEQ ID NO: 34294 - DNA, 25 bp, Homo sapien
attagtcataccttcccataattgt

SEQ ID NO: 34295 - DNA, 25 bp, Homo sapien
attagtcatactttcccataattgt

SEQ ID NO: 34296 - DNA, 25 bp, Homo sapien
attagtccacacaggtagccaacaa

SEQ ID NO: 34297 - DNA, 25 bp, Homo sapien
attagtccagacaggtagccaacaa

SEQ ID NO: 34298 - DNA, 25 bp, Homo sapien
attagtgaaattgcttcctgatttt

SEQ ID NO: 34299 - DNA, 25 bp, Homo sapien
attagtgacattgcttcctgatttt

SEQ ID NO: 34300 - DNA, 25 bp, Homo sapien
attagtgctttttaaactttggaaa

SEQ ID NO: 34301 - DNA, 25 bp, Homo sapien
attagtgctttttaaagtttggaaa

SEQ ID NO: 34302 - DNA, 25 bp, Homo sapien
attagttagttaagcttacattctt

SEQ ID NO: 34303 - DNA, 25 bp, Homo sapien
attagttatttaagcttacattctt

SEQ ID NO: 34304 - DNA, 25 bp, Homo sapien
attagtttccttactgggagagacc

SEQ ID NO: 34305 - DNA, 25 bp, Homo sapien
attagtttccttattgggagagacc

SEQ ID NO: 34306 - DNA, 25 bp, Homo sapien
attagtttttagcagtgtcaaaaat

SEQ ID NO: 34307 - DNA, 25 bp, Homo sapien
attagtttttagtagtgtcaaaaat

SEQ ID NO: 34308 - DNA, 25 bp, Homo sapien
attataaaaataagaggtacagtct

SEQ ID NO: 34309 - DNA, 25 bp, Homo sapien
attataaaaataagagttacagtct

SEQ ID NO: 34310 - DNA, 25 bp, Homo sapien
attataaaatgacgacatattcaat

SEQ ID NO: 34311 - DNA, 25 bp, Homo sapien
attataaaatgatgacatattcaat

SEQ ID NO: 34312 - DNA, 25 bp, Homo sapien
attataaacatatttaggagaccct

SEQ ID NO: 34313 - DNA, 25 bp, Homo sapien
attataaacatgtttaggagaccct

SEQ ID NO: 34314 - DNA, 25 bp, Homo sapien
attataaaccatcttttgaaaagga

SEQ ID NO: 34315 - DNA, 25 bp, Homo sapien
attataaaccattttttgaaaagga

SEQ ID NO: 34316 - DNA, 25 bp, Homo sapien
attataaagagacacgtaggctaag

SEQ ID NO: 34317 - DNA, 25 bp, Homo sapien
attataaagagacgcgtaggctaag

SEQ ID NO: 34318 - DNA, 25 bp, Homo sapien
attataaagcactaagagataacaa

SEQ ID NO: 34319 - DNA, 25 bp, Homo sapien
attataaagcactgagagataacaa

SEQ ID NO: 34320 - DNA, 25 bp, Homo sapien
attataaagccagacctcatgaaaa

SEQ ID NO: 34321 - DNA, 25 bp, Homo sapien
attataaagccagccctcatgaaaa

SEQ ID NO: 34322 - DNA, 25 bp, Homo sapien
attataacccaacctactaatcaaa

SEQ ID NO: 34323 - DNA, 25 bp, Homo sapien
attataactcaacctactaatcaaa

SEQ ID NO: 34324 - DNA, 25 bp, Homo sapien
attataagacttagcgtggcaacaa

SEQ ID NO: 34325 - DNA, 25 bp, Homo sapien
attataagacttagtgtggcaacaa

SEQ ID NO: 34326 - DNA, 25 bp, Homo sapien
attataagccataggtacagaactt

SEQ ID NO: 34327 - DNA, 25 bp, Homo sapien
attataaggcacatctatgtttaat

SEQ ID NO: 34328 - DNA, 25 bp, Homo sapien
attataaggcacctctatgtttaat

SEQ ID NO: 34329 - DNA, 25 bp, Homo sapien
attataagtcataggtacagaactt

SEQ ID NO: 34330 - DNA, 25 bp, Homo sapien
attataatgtgcaaccagattaagc

SEQ ID NO: 34331 - DNA, 25 bp, Homo sapien
attataatgtgcgaccagattaagc

SEQ ID NO: 34332 - DNA, 25 bp, Homo sapien
attataatgtttacagccatctcca

SEQ ID NO: 34333 - DNA, 25 bp, Homo sapien
attataatgtttacggccatctcca

SEQ ID NO: 34334 - DNA, 25 bp, Homo sapien
attataattcacggtagctttaaat

SEQ ID NO: 34335 - DNA, 25 bp, Homo sapien
attataattcatggtagctttaaat

SEQ ID NO: 34336 - DNA, 25 bp, Homo sapien
attataattccatatgttgtatctt

SEQ ID NO: 34337 - DNA, 25 bp, Homo sapien
attataattccgtatgttgtatctt

SEQ ID NO: 34338 - DNA, 25 bp, Homo sapien
attatacaccttgttctgtatcttg

SEQ ID NO: 34339 - DNA, 25 bp, Homo sapien
attatacacgttgttctgtatcttg

SEQ ID NO: 34340 - DNA, 25 bp, Homo sapien
attatagaagcagcttattgaaatg

SEQ ID NO: 34341 - DNA, 25 bp, Homo sapien
attatagaagcaggttattgaaatg

SEQ ID NO: 34342 - DNA, 25 bp, Homo sapien
attatagatcacaggcatgttttct

SEQ ID NO: 34343 - DNA, 25 bp, Homo sapien
attatagatgacaggcatgttttct

SEQ ID NO: 34344 - DNA, 25 bp, Homo sapien
attatagctatacattgagacaacc

SEQ ID NO: 34345 - DNA, 25 bp, Homo sapien
attatagctatatattgagacaacc

SEQ ID NO: 34346 - DNA, 25 bp, Homo sapien
attatagtctgtatgctttctattt

SEQ ID NO: 34347 - DNA, 25 bp, Homo sapien
attatagtgaacgagtctcacgaga

SEQ ID NO: 34348 - DNA, 25 bp, Homo sapien
attatagtgaatgagtctcacgaga

SEQ ID NO: 34349 - DNA, 25 bp, Homo sapien
attatagtttgtatgctttctattt

SEQ ID NO: 34350 - DNA, 25 bp, Homo sapien
attatatacaatttaaaaagccttc

SEQ ID NO: 34351 - DNA, 25 bp, Homo sapien
attatatacaattttaaaagccttc

SEQ ID NO: 34352 - DNA, 25 bp, Homo sapien
attatataggcacaccactcatcca

SEQ ID NO: 34353 - DNA, 25 bp, Homo sapien
attatataggcataccactcatcca

SEQ ID NO: 34354 - DNA, 25 bp, Homo sapien
attatatccctgtggcattaacagt

SEQ ID NO: 34355 - DNA, 25 bp, Homo sapien
attatatccctgtggcgttaacagt

SEQ ID NO: 34356 - DNA, 25 bp, Homo sapien
attatatctcacaatgttcacagga

SEQ ID NO: 34357 - DNA, 25 bp, Homo sapien
attatatctcacagtgttcacagga

SEQ ID NO: 34358 - DNA, 25 bp, Homo sapien
attatatgctaatggctctccactc

SEQ ID NO: 34359 - DNA, 25 bp, Homo sapien
attatatgctaattgctctccactc

SEQ ID NO: 34360 - DNA, 25 bp, Homo sapien
attatatgttacagtcaaatcctct

SEQ ID NO: 34361 - DNA, 25 bp, Homo sapien
attatatgttactgtcaaatcctct

SEQ ID NO: 34362 - DNA, 25 bp, Homo sapien
attatatttctgtgtacattttgag

SEQ ID NO: 34363 - DNA, 25 bp, Homo sapien
attatatttctgtgtatattttgag

SEQ ID NO: 34364 - DNA, 25 bp, Homo sapien
attatcaaagctgtatgaagtaaga

SEQ ID NO: 34365 - DNA, 25 bp, Homo sapien
attatcaaagctttatgaagtaaga

SEQ ID NO: 34366 - DNA, 25 bp, Homo sapien
attatcaacaatgataccactctga

SEQ ID NO: 34367 - DNA, 25 bp, Homo sapien
attatcaactatgataccactctga

SEQ ID NO: 34368 - DNA, 25 bp, Homo sapien
attatcaagcgtcaaaaattaagat

SEQ ID NO: 34369 - DNA, 25 bp, Homo sapien
attatcaagtgtcaaaaattaagat

SEQ ID NO: 34370 - DNA, 25 bp, Homo sapien
attatcaatgattaaaaagactaaa

SEQ ID NO: 34371 - DNA, 25 bp, Homo sapien
attatcaatgattagaaagactaaa

SEQ ID NO: 34372 - DNA, 25 bp, Homo sapien
attatcacacacttagcagatgaaa

SEQ ID NO: 34373 - DNA, 25 bp, Homo sapien
attatcacacatttagcagatgaaa

SEQ ID NO: 34374 - DNA, 25 bp, Homo sapien
attatcacctgcgctccgcctcctg

SEQ ID NO: 34375 - DNA, 25 bp, Homo sapien
attatcacctgtgctccgcctcctg

SEQ ID NO: 34376 - DNA, 25 bp, Homo sapien
attatcactcaaagtctcatagata

SEQ ID NO: 34377 - DNA, 25 bp, Homo sapien
attatcactcaaggtctcatagata

SEQ ID NO: 34378 - DNA, 25 bp, Homo sapien
attatcacttacaattattactagg

SEQ ID NO: 34379 - DNA, 25 bp, Homo sapien
attatcacttacaatttttactagg

SEQ ID NO: 34380 - DNA, 25 bp, Homo sapien
attatcagatatcgaacttataaac

SEQ ID NO: 34381 - DNA, 25 bp, Homo sapien
attatcagatatcgaatttataaac

SEQ ID NO: 34382 - DNA, 25 bp, Homo sapien
attatcaggattatcacaattgcct

SEQ ID NO: 34383 - DNA, 25 bp, Homo sapien
attatcaggtttatcacaattgcct

SEQ ID NO: 34384 - DNA, 25 bp, Homo sapien
attatcatccgagccataactggaa

SEQ ID NO: 34385 - DNA, 25 bp, Homo sapien
attatcatcggagccataactggaa

SEQ ID NO: 34386 - DNA, 25 bp, Homo sapien
attatccaattgttttgattttggt

SEQ ID NO: 34387 - DNA, 25 bp, Homo sapien
attatccagttgttttgattttggt

SEQ ID NO: 34388 - DNA, 25 bp, Homo sapien
attatccatcttgttcattcttctg

SEQ ID NO: 34389 - DNA, 25 bp, Homo sapien
attatccatcttgttcgttcttctg

SEQ ID NO: 34390 - DNA, 25 bp, Homo sapien
attatcctcaacattactgccatac

SEQ ID NO: 34391 - DNA, 25 bp, Homo sapien
attatcctcaacgttactgccatac

SEQ ID NO: 34392 - DNA, 25 bp, Homo sapien
attatcgaggcccaggctcatatgt

SEQ ID NO: 34393 - DNA, 25 bp, Homo sapien
attatcgaggcccgggctcatatgt

SEQ ID NO: 34394 - DNA, 25 bp, Homo sapien
attatctaaaacagatgaagattaa

SEQ ID NO: 34395 - DNA, 25 bp, Homo sapien
attatctaaaacggatgaagattaa

SEQ ID NO: 34396 - DNA, 25 bp, Homo sapien
attatctaatggcgaataaagagaa

SEQ ID NO: 34397 - DNA, 25 bp, Homo sapien
attatctaatggtgaataaagagaa

SEQ ID NO: 34398 - DNA, 25 bp, Homo sapien
attatctcaaatggcacaagggact

SEQ ID NO: 34399 - DNA, 25 bp, Homo sapien
attatctcacatggcacaagggact

SEQ ID NO: 34400 - DNA, 25 bp, Homo sapien
attatctcctgcatagagagacgat

SEQ ID NO: 34401 - DNA, 25 bp, Homo sapien
attatctcctgcgtagagagacgat

SEQ ID NO: 34402 - DNA, 25 bp, Homo sapien
attatctcttaagcgcataggaatc

SEQ ID NO: 34403 - DNA, 25 bp, Homo sapien
attatctcttaagcgcgtaggaatc

SEQ ID NO: 34404 - DNA, 25 bp, Homo sapien
attatctcttttcgcatctctgccc

SEQ ID NO: 34405 - DNA, 25 bp, Homo sapien
attatctctttttgcatctctgccc

SEQ ID NO: 34406 - DNA, 25 bp, Homo sapien
attatctggacaactacccttttca

SEQ ID NO: 34407 - DNA, 25 bp, Homo sapien
attatctggacaactatccttttca

SEQ ID NO: 34408 - DNA, 25 bp, Homo sapien
attatcttacagtttcagagacaga

SEQ ID NO: 34409 - DNA, 25 bp, Homo sapien
attatcttatagtttcagagacaga

SEQ ID NO: 34410 - DNA, 25 bp, Homo sapien
attatctttatgcagtatcccttca

SEQ ID NO: 34411 - DNA, 25 bp, Homo sapien
attatctttgtgcagtatcccttca

SEQ ID NO: 34412 - DNA, 25 bp, Homo sapien
attatgaaacacaggcttctaatga

SEQ ID NO: 34413 - DNA, 25 bp, Homo sapien
attatgaaccacaggcttctaatga

SEQ ID NO: 34414 - DNA, 25 bp, Homo sapien
attatgaataacccatctgtggaca

SEQ ID NO: 34415 - DNA, 25 bp, Homo sapien
attatgaataacgcatctgtggaca

SEQ ID NO: 34416 - DNA, 25 bp, Homo sapien
attatgagaattagtggtcactgtt

SEQ ID NO: 34417 - DNA, 25 bp, Homo sapien
attatgagagttagtggtcactgtt

SEQ ID NO: 34418 - DNA, 25 bp, Homo sapien
attatgatccatctttatgaataag

SEQ ID NO: 34419 - DNA, 25 bp, Homo sapien
attatgatccatgtttatgaataag

SEQ ID NO: 34420 - DNA, 25 bp, Homo sapien
attatgcaattgttccatcagagaa

SEQ ID NO: 34421 - DNA, 25 bp, Homo sapien
attatgcaattgttccgtcagagaa

SEQ ID NO: 34422 - DNA, 25 bp, Homo sapien
attatgcaggtaaacgtgtgctagt

SEQ ID NO: 34423 - DNA, 25 bp, Homo sapien
attatgcaggtaatcgtgtgctagt

SEQ ID NO: 34424 - DNA, 25 bp, Homo sapien
attatgcatgtgttacaaagaatga

SEQ ID NO: 34425 - DNA, 25 bp, Homo sapien
attatgcatgttttacaaagaatga

SEQ ID NO: 34426 - DNA, 25 bp, Homo sapien
attatgccactccataaatttgttc

SEQ ID NO: 34427 - DNA, 25 bp, Homo sapien
attatgccactctataaatttgttc

SEQ ID NO: 34428 - DNA, 25 bp, Homo sapien
attatgctcaactcgagtgccttta

SEQ ID NO: 34429 - DNA, 25 bp, Homo sapien
attatgctcaacttgagtgccttta

SEQ ID NO: 34430 - DNA, 25 bp, Homo sapien
attatgctctgatccgaaattttaa

SEQ ID NO: 34431 - DNA, 25 bp, Homo sapien
attatgctctgatctgaaattttaa

SEQ ID NO: 34432 - DNA, 25 bp, Homo sapien
attatgctgagtatgtcgactgatc

SEQ ID NO: 34433 - DNA, 25 bp, Homo sapien
attatgctgagtatgttgactgatc

SEQ ID NO: 34434 - DNA, 25 bp, Homo sapien
attatgctgagtcagaccgatgcca

SEQ ID NO: 34435 - DNA, 25 bp, Homo sapien
attatgctgggtcagaccgatgcca

SEQ ID NO: 34436 - DNA, 25 bp, Homo sapien
attatgctgtgtttttagttagctc

SEQ ID NO: 34437 - DNA, 25 bp, Homo sapien
attatgctgtgtttttggttagctc

SEQ ID NO: 34438 - DNA, 25 bp, Homo sapien
attatgcttagttttaactccacag

SEQ ID NO: 34439 - DNA, 25 bp, Homo sapien
attatgcttagttttatctccacag

SEQ ID NO: 34440 - DNA, 25 bp, Homo sapien
attatgcttccaaatgcagcacgta

SEQ ID NO: 34441 - DNA, 25 bp, Homo sapien
attatgctttcaaatgcagcacgta

SEQ ID NO: 34442 - DNA, 25 bp, Homo sapien
attatggaaattctagcactcttaa

SEQ ID NO: 34443 - DNA, 25 bp, Homo sapien
attatggaaattgtagcactcttaa

SEQ ID NO: 34444 - DNA, 25 bp, Homo sapien
attatggcacaacatatggagtcct

SEQ ID NO: 34445 - DNA, 25 bp, Homo sapien
attatggcacagcatatggagtcct

SEQ ID NO: 34446 - DNA, 25 bp, Homo sapien
attatggtgcacgcacatagccacc

SEQ ID NO: 34447 - DNA, 25 bp, Homo sapien
attatggtgcacgtacatagccacc

SEQ ID NO: 34448 - DNA, 25 bp, Homo sapien
attatgtacgcacgagataaaacct

SEQ ID NO: 34449 - DNA, 25 bp, Homo sapien
attatgtacgcatgagataaaacct

SEQ ID NO: 34450 - DNA, 25 bp, Homo sapien
attatgtcatgaaatctttgtttgc

SEQ ID NO: 34451 - DNA, 25 bp, Homo sapien
attatgtcatgcaatctttgtttgc

SEQ ID NO: 34452 - DNA, 25 bp, Homo sapien
attatgtggagaagcaactgcttat

SEQ ID NO: 34453 - DNA, 25 bp, Homo sapien
attatgtggaggagcaactgcttat

SEQ ID NO: 34454 - DNA, 25 bp, Homo sapien
attatgtggtcagtgatccaggaag

SEQ ID NO: 34455 - DNA, 25 bp, Homo sapien
attatgtggtcggtgatccaggaag

SEQ ID NO: 34456 - DNA, 25 bp, Homo sapien
attatgtgtcttacaacttttagcc

SEQ ID NO: 34457 - DNA, 25 bp, Homo sapien
attatgtgtcttataacttttagcc

SEQ ID NO: 34458 - DNA, 25 bp, Homo sapien
attattaaagctcagttttttgctg

SEQ ID NO: 34459 - DNA, 25 bp, Homo sapien
attattaaagcttagttttttgctg

SEQ ID NO: 34460 - DNA, 25 bp, Homo sapien
attattaagccatgttagcaatgaa

SEQ ID NO: 34461 - DNA, 25 bp, Homo sapien
attattaagtcatgttagcaatgaa

SEQ ID NO: 34462 - DNA, 25 bp, Homo sapien
attattaatattcaatatccagatc

SEQ ID NO: 34463 - DNA, 25 bp, Homo sapien
attattaatattgaatatccagatc

SEQ ID NO: 34464 - DNA, 25 bp, Homo sapien
attattacaagaggaccttttgctt

SEQ ID NO: 34465 - DNA, 25 bp, Homo sapien
attattacaagagggccttttgctt

SEQ ID NO: 34466 - DNA, 25 bp, Homo sapien
attattagactgcggcaaagccagg

SEQ ID NO: 34467 - DNA, 25 bp, Homo sapien
attattagactgtggcaaagccagg

SEQ ID NO: 34468 - DNA, 25 bp, Homo sapien
attattagatccgtagcttcttaac

SEQ ID NO: 34469 - DNA, 25 bp, Homo sapien
attattagatccttagcttcttaac

SEQ ID NO: 34470 - DNA, 25 bp, Homo sapien
attattatactgtacaaccagcaag

SEQ ID NO: 34471 - DNA, 25 bp, Homo sapien
attattatactgtacatccagcaag

SEQ ID NO: 34472 - DNA, 25 bp, Homo sapien
attattatctccaaaccaatatcta

SEQ ID NO: 34473 - DNA, 25 bp, Homo sapien
attattatgggaaaagctgttggca

SEQ ID NO: 34474 - DNA, 25 bp, Homo sapien
attattatggggaaagctgttggca

SEQ ID NO: 34475 - DNA, 25 bp, Homo sapien
attattatttccaaaccaatatcta

SEQ ID NO: 34476 - DNA, 25 bp, Homo sapien
attattcaaaacttaatgtaggctt

SEQ ID NO: 34477 - DNA, 25 bp, Homo sapien
attattcaaaatttaatgtaggctt

SEQ ID NO: 34478 - DNA, 25 bp, Homo sapien
attattcacagtgaaatgctgacag

SEQ ID NO: 34479 - DNA, 25 bp, Homo sapien
attattcacagttaaatgctgacag

SEQ ID NO: 34480 - DNA, 25 bp, Homo sapien
attattcattaacttcatcttttta

SEQ ID NO: 34481 - DNA, 25 bp, Homo sapien
attattcattagcttcatcttttta

SEQ ID NO: 34482 - DNA, 25 bp, Homo sapien
attattccactccatgacctcccgg

SEQ ID NO: 34483 - DNA, 25 bp, Homo sapien
attattcccattgttggtttaggca

SEQ ID NO: 34484 - DNA, 25 bp, Homo sapien
attattcccgttgttggtttaggca

SEQ ID NO: 34485 - DNA, 25 bp, Homo sapien
attattccgctccatgacctcccgg

SEQ ID NO: 34486 - DNA, 25 bp, Homo sapien
attattctcaagcctatatcccaga

SEQ ID NO: 34487 - DNA, 25 bp, Homo sapien
attattctcaaggctatatcccaga

SEQ ID NO: 34488 - DNA, 25 bp, Homo sapien
attattctgcatcttgcattccctg

SEQ ID NO: 34489 - DNA, 25 bp, Homo sapien
attattctgtatcttgcattccctg

SEQ ID NO: 34490 - DNA, 25 bp, Homo sapien
attattgcataaggtagtgtacctg

SEQ ID NO: 34491 - DNA, 25 bp, Homo sapien
attattgcgtaaggtagtgtacctg

SEQ ID NO: 34492 - DNA, 25 bp, Homo sapien
attattggtagtaagccagacactg

SEQ ID NO: 34493 - DNA, 25 bp, Homo sapien
attattggttgtaagccagacactg

SEQ ID NO: 34494 - DNA, 25 bp, Homo sapien
attattgtgagcagtaggtcttgaa

SEQ ID NO: 34495 - DNA, 25 bp, Homo sapien
attattgtgagcggtaggtcttgaa

SEQ ID NO: 34496 - DNA, 25 bp, Homo sapien
attatttaagcctcagttcctatat

SEQ ID NO: 34497 - DNA, 25 bp, Homo sapien
attatttaagccttagttcctatat

SEQ ID NO: 34498 - DNA, 25 bp, Homo sapien
attatttcagatacattgtgaagaa

SEQ ID NO: 34499 - DNA, 25 bp, Homo sapien
attatttcagatagattgtgaagaa

SEQ ID NO: 34500 - DNA, 25 bp, Homo sapien
attatttcatcagtccctgttagct

SEQ ID NO: 34501 - DNA, 25 bp, Homo sapien
attatttcatcagttcctgttagct

SEQ ID NO: 34502 - DNA, 25 bp, Homo sapien
attatttccatcattccattgtgtc

SEQ ID NO: 34503 - DNA, 25 bp, Homo sapien
attatttccatctttccattgtgtc

SEQ ID NO: 34504 - DNA, 25 bp, Homo sapien
attatttgcatagtatactcatttg

SEQ ID NO: 34505 - DNA, 25 bp, Homo sapien
attatttgcatagtgtactcatttg

SEQ ID NO: 34506 - DNA, 25 bp, Homo sapien
attatttgcctcgactgtctctaat

SEQ ID NO: 34507 - DNA, 25 bp, Homo sapien
attatttgccttgactgtctctaat

SEQ ID NO: 34508 - DNA, 25 bp, Homo sapien
attatttgtcaagtattaaaggccc

SEQ ID NO: 34509 - DNA, 25 bp, Homo sapien
attatttgttaagtattaaaggccc

SEQ ID NO: 34510 - DNA, 25 bp, Homo sapien
attattttacggtatctgcaggttt

SEQ ID NO: 34511 - DNA, 25 bp, Homo sapien
attattttatcatttctgtcatttt

SEQ ID NO: 34512 - DNA, 25 bp, Homo sapien
attattttatcgtttctgtcatttt

SEQ ID NO: 34513 - DNA, 25 bp, Homo sapien
attattttatggtatctgcaggttt

SEQ ID NO: 34514 - DNA, 25 bp, Homo sapien
attattttgatacagattacaatta

SEQ ID NO: 34515 - DNA, 25 bp, Homo sapien
attattttgatagagattacaatta

SEQ ID NO: 34516 - DNA, 25 bp, Homo sapien
attcaaaaccaaaatgctattccta

SEQ ID NO: 34517 - DNA, 25 bp, Homo sapien
attcaaaactaaaatgctattccta

SEQ ID NO: 34518 - DNA, 25 bp, Homo sapien
attcaaaactgtgcaaaatctatgt

SEQ ID NO: 34519 - DNA, 25 bp, Homo sapien
attcaaaaggatacgcactggcttt

SEQ ID NO: 34520 - DNA, 25 bp, Homo sapien
attcaaaaggatatgcactggcttt

SEQ ID NO: 34521 - DNA, 25 bp, Homo sapien
attcaaaagtgtgcaaaatctatgt

SEQ ID NO: 34522 - DNA, 25 bp, Homo sapien
attcaaaatatgcaaagaactctta

SEQ ID NO: 34523 - DNA, 25 bp, Homo sapien
attcaaaatatgcaaataactctta

SEQ ID NO: 34524 - DNA, 25 bp, Homo sapien
attcaaagacggttagaggatttaa

SEQ ID NO: 34525 - DNA, 25 bp, Homo sapien
attcaaagatggttagaggatttaa

SEQ ID NO: 34526 - DNA, 25 bp, Homo sapien
attcaaagccaacctgcacattagc

SEQ ID NO: 34527 - DNA, 25 bp, Homo sapien
attcaaagccaatctgcacattagc

SEQ ID NO: 34528 - DNA, 25 bp, Homo sapien
attcaaagctgtagtttttgtgact

SEQ ID NO: 34529 - DNA, 25 bp, Homo sapien
attcaaagttgtagtttttgtgact

SEQ ID NO: 34530 - DNA, 25 bp, Homo sapien
attcaaatactctgcttggttccgc

SEQ ID NO: 34531 - DNA, 25 bp, Homo sapien
attcaaatccaagtctttcctactt

SEQ ID NO: 34532 - DNA, 25 bp, Homo sapien
attcaaatccacattccacttaata

SEQ ID NO: 34533 - DNA, 25 bp, Homo sapien
attcaaatccactttccacttaata

SEQ ID NO: 34534 - DNA, 25 bp, Homo sapien
attcaaatccaggtctttcctactt

SEQ ID NO: 34535 - DNA, 25 bp, Homo sapien
attcaaatcccaatgtgatgctgaa

SEQ ID NO: 34536 - DNA, 25 bp, Homo sapien
attcaaatcccgatgtgatgctgaa

SEQ ID NO: 34537 - DNA, 25 bp, Homo sapien
attcaaatgacacattcattgagat

SEQ ID NO: 34538 - DNA, 25 bp, Homo sapien
attcaaatgacccattcattgagat

SEQ ID NO: 34539 - DNA, 25 bp, Homo sapien
attcaaatgcaccttccagaatgta

SEQ ID NO: 34540 - DNA, 25 bp, Homo sapien
attcaaatgcactttccagaatgta

SEQ ID NO: 34541 - DNA, 25 bp, Homo sapien
attcaaatgctctgcttggttccgc

SEQ ID NO: 34542 - DNA, 25 bp, Homo sapien
attcaaattcaggaaacattcaaat

SEQ ID NO: 34543 - DNA, 25 bp, Homo sapien
attcaaatttaggaaacattcaaat

SEQ ID NO: 34544 - DNA, 25 bp, Homo sapien
attcaaccacaatgaaggaattatt

SEQ ID NO: 34545 - DNA, 25 bp, Homo sapien
attcaaccacagtgaaggaattatt

SEQ ID NO: 34546 - DNA, 25 bp, Homo sapien
attcaacgggttcacaagtttttag

SEQ ID NO: 34547 - DNA, 25 bp, Homo sapien
attcaacgtgttcacaagtttttag

SEQ ID NO: 34548 - DNA, 25 bp, Homo sapien
attcaactaatccctaacctttcta

SEQ ID NO: 34549 - DNA, 25 bp, Homo sapien
attcaactaatgaaggccagaagcc

SEQ ID NO: 34550 - DNA, 25 bp, Homo sapien
attcaactaatggaggccagaagcc

SEQ ID NO: 34551 - DNA, 25 bp, Homo sapien
attcaactagtccctaacctttcta

SEQ ID NO: 34552 - DNA, 25 bp, Homo sapien
attcaagtttccatttgtattctgg

SEQ ID NO: 34553 - DNA, 25 bp, Homo sapien
attcaagtttccgtttgtattctgg

SEQ ID NO: 34554 - DNA, 25 bp, Homo sapien
attcaataatgcatgacaaatggcc

SEQ ID NO: 34555 - DNA, 25 bp, Homo sapien
attcaataatgcatgataaatggcc

SEQ ID NO: 34556 - DNA, 25 bp, Homo sapien
attcaatgaaattcagaagatgtaa

SEQ ID NO: 34557 - DNA, 25 bp, Homo sapien
attcaatgaaattcggaagatgtaa

SEQ ID NO: 34558 - DNA, 25 bp, Homo sapien
attcaatgcactgtattggatttct

SEQ ID NO: 34559 - DNA, 25 bp, Homo sapien
attcaatgcgctgtattggatttct

SEQ ID NO: 34560 - DNA, 25 bp, Homo sapien
attcaatgcttggaaaggaagttta

SEQ ID NO: 34561 - DNA, 25 bp, Homo sapien
attcaatgcttggaaatgaagttta

SEQ ID NO: 34562 - DNA, 25 bp, Homo sapien
attcaattacttattgtgcacaacc

SEQ ID NO: 34563 - DNA, 25 bp, Homo sapien
attcaattatttattgtgcacaacc

SEQ ID NO: 34564 - DNA, 25 bp, Homo sapien
attcaattctcttatacttgattaa

SEQ ID NO: 34565 - DNA, 25 bp, Homo sapien
attcaattgtttaaagagcaaaaat

SEQ ID NO: 34566 - DNA, 25 bp, Homo sapien
attcaattgtttcaagagcaaaaat

SEQ ID NO: 34567 - DNA, 25 bp, Homo sapien
attcaattttcttatacttgattaa

SEQ ID NO: 34568 - DNA, 25 bp, Homo sapien
attcacaaagggtacaatacatcga

SEQ ID NO: 34569 - DNA, 25 bp, Homo sapien
attcacaaggggtacaatacatcga

SEQ ID NO: 34570 - DNA, 25 bp, Homo sapien
attcacaatgtcatagaatgctaaa

SEQ ID NO: 34571 - DNA, 25 bp, Homo sapien
attcacaatgtcgtagaatgctaaa

SEQ ID NO: 34572 - DNA, 25 bp, Homo sapien
attcacaatgtgagactcgctttgc

SEQ ID NO: 34573 - DNA, 25 bp, Homo sapien
attcacaatttgagactcgctttgc

SEQ ID NO: 34574 - DNA, 25 bp, Homo sapien
attcacacttgggtctccttccaaa

SEQ ID NO: 34575 - DNA, 25 bp, Homo sapien
attcacacttggttctccttccaaa

SEQ ID NO: 34576 - DNA, 25 bp, Homo sapien
attcacagtcgaaataggatcctta

SEQ ID NO: 34577 - DNA, 25 bp, Homo sapien
attcacagttgaaataggatcctta

SEQ ID NO: 34578 - DNA, 25 bp, Homo sapien
attcacatgcaaggatggctcttga

SEQ ID NO: 34579 - DNA, 25 bp, Homo sapien
attcacatgcagggatggctcttga

SEQ ID NO: 34580 - DNA, 25 bp, Homo sapien
attcacatggaaccttcaactataa

SEQ ID NO: 34581 - DNA, 25 bp, Homo sapien
attcacatggaatcttcaactataa

SEQ ID NO: 34582 - DNA, 25 bp, Homo sapien
attcacatgtgacaaaagaaaagaa

SEQ ID NO: 34583 - DNA, 25 bp, Homo sapien
attcacatgtgacaaaggaaaagaa

SEQ ID NO: 34584 - DNA, 25 bp, Homo sapien
attcacattatgaggtccaaaaatt

SEQ ID NO: 34585 - DNA, 25 bp, Homo sapien
attcacattatgaggttcaaaaatt

SEQ ID NO: 34586 - DNA, 25 bp, Homo sapien
attcacgtctgtgctcctggttagg

SEQ ID NO: 34587 - DNA, 25 bp, Homo sapien
attcacgtctgtgttcctggttagg

SEQ ID NO: 34588 - DNA, 25 bp, Homo sapien
attcactacaaaagattgaagcaaa

SEQ ID NO: 34589 - DNA, 25 bp, Homo sapien
attcactacaaaggattgaagcaaa

SEQ ID NO: 34590 - DNA, 25 bp, Homo sapien
attcactcatatcgaattgggcttg

SEQ ID NO: 34591 - DNA, 25 bp, Homo sapien
attcactccaaataaaactgtattt

SEQ ID NO: 34592 - DNA, 25 bp, Homo sapien
attcactccaaatataactgtattt

SEQ ID NO: 34593 - DNA, 25 bp, Homo sapien
attcactcgtatcgaattgggcttg

SEQ ID NO: 34594 - DNA, 25 bp, Homo sapien
attcactcttacattttaactcatt

SEQ ID NO: 34595 - DNA, 25 bp, Homo sapien
attcactcttagattttaactcatt

SEQ ID NO: 34596 - DNA, 25 bp, Homo sapien
attcactcttgaataactaatagga

SEQ ID NO: 34597 - DNA, 25 bp, Homo sapien
attcactcttgaatcactaatagga

SEQ ID NO: 34598 - DNA, 25 bp, Homo sapien
attcactctttgacatgtagggcaa

SEQ ID NO: 34599 - DNA, 25 bp, Homo sapien
attcactctttggcatgtagggcaa

SEQ ID NO: 34600 - DNA, 25 bp, Homo sapien
attcactgatgactgttataatttt

SEQ ID NO: 34601 - DNA, 25 bp, Homo sapien
attcactgatggctgttataatttt

SEQ ID NO: 34602 - DNA, 25 bp, Homo sapien
attcacttaacaacgtcttttgcag

SEQ ID NO: 34603 - DNA, 25 bp, Homo sapien
attcacttaacaatgtcttttgcag

SEQ ID NO: 34604 - DNA, 25 bp, Homo sapien
attcacttcctgccatcattatccc

SEQ ID NO: 34605 - DNA, 25 bp, Homo sapien
attcactttctgccatcattatccc

SEQ ID NO: 34606 - DNA, 25 bp, Homo sapien
attcagaagaaaactttccagcaag

SEQ ID NO: 34607 - DNA, 25 bp, Homo sapien
attcagaagaaacctttccagcaag

SEQ ID NO: 34608 - DNA, 25 bp, Homo sapien
attcagaagctcgtagaattgttct

SEQ ID NO: 34609 - DNA, 25 bp, Homo sapien
attcagaagcttgtagaattgttct

SEQ ID NO: 34610 - DNA, 25 bp, Homo sapien
attcagaattaagcatagtagatat

SEQ ID NO: 34611 - DNA, 25 bp, Homo sapien
attcagaattaagcgtagtagatat

SEQ ID NO: 34612 - DNA, 25 bp, Homo sapien
attcagaggataaattaatctcttc

SEQ ID NO: 34613 - DNA, 25 bp, Homo sapien
attcagaggatgaattaatctcttc

SEQ ID NO: 34614 - DNA, 25 bp, Homo sapien
attcagaggcgctgacacatgctca

SEQ ID NO: 34615 - DNA, 25 bp, Homo sapien
attcagaggtgctgacacatgctca

SEQ ID NO: 34616 - DNA, 25 bp, Homo sapien
attcagagtgaaatgttgggcaaga

SEQ ID NO: 34617 - DNA, 25 bp, Homo sapien
attcagagttaaatgttgggcaaga

SEQ ID NO: 34618 - DNA, 25 bp, Homo sapien
attcagatacacatgaagatttcca

SEQ ID NO: 34619 - DNA, 25 bp, Homo sapien
attcagatagttgcagagaggtgga

SEQ ID NO: 34620 - DNA, 25 bp, Homo sapien
attcagatagttgtagagaggtgga

SEQ ID NO: 34621 - DNA, 25 bp, Homo sapien
attcagatatacatgaagatttcca

SEQ ID NO: 34622 - DNA, 25 bp, Homo sapien
attcagatctccacgtcctactaag

SEQ ID NO: 34623 - DNA, 25 bp, Homo sapien
attcagatctccatgtcctactaag

SEQ ID NO: 34624 - DNA, 25 bp, Homo sapien
attcagattgttggtaagaggaatt

SEQ ID NO: 34625 - DNA, 25 bp, Homo sapien
attcagattgtttgtaagaggaatt

SEQ ID NO: 34626 - DNA, 25 bp, Homo sapien
attcagcagccctggaaagttatta

SEQ ID NO: 34627 - DNA, 25 bp, Homo sapien
attcagcagtcctggaaagttatta

SEQ ID NO: 34628 - DNA, 25 bp, Homo sapien
attcagcagtgatgccattgggtac

SEQ ID NO: 34629 - DNA, 25 bp, Homo sapien
attcagcagtgatgtcattgggtac

SEQ ID NO: 34630 - DNA, 25 bp, Homo sapien
attcagcccacacatggggcacagt

SEQ ID NO: 34631 - DNA, 25 bp, Homo sapien
attcagcccacgcatggggcacagt

SEQ ID NO: 34632 - DNA, 25 bp, Homo sapien
attcagcctggcctatcttatctct

SEQ ID NO: 34633 - DNA, 25 bp, Homo sapien
attcagccttgcctatcttatctct

SEQ ID NO: 34634 - DNA, 25 bp, Homo sapien
attcagctagtcttgctatacgtta

SEQ ID NO: 34635 - DNA, 25 bp, Homo sapien
attcagctattcttgctatacgtta

SEQ ID NO: 34636 - DNA, 25 bp, Homo sapien
attcagctgaatgcagccctatcag

SEQ ID NO: 34637 - DNA, 25 bp, Homo sapien
attcagctgaatgtagccctatcag

SEQ ID NO: 34638 - DNA, 25 bp, Homo sapien
attcagcttcttaaatctgtagact

SEQ ID NO: 34639 - DNA, 25 bp, Homo sapien
attcagcttcttaactctgtagact

SEQ ID NO: 34640 - DNA, 25 bp, Homo sapien
attcagcttttcattgaagctacta

SEQ ID NO: 34641 - DNA, 25 bp, Homo sapien
attcagcttttcgttgaagctacta

SEQ ID NO: 34642 - DNA, 25 bp, Homo sapien
attcaggaaatgtatacgcccgctt

SEQ ID NO: 34643 - DNA, 25 bp, Homo sapien
attcaggaaatgtatatgcccgctt

SEQ ID NO: 34644 - DNA, 25 bp, Homo sapien
attcagggacttatataccagtttg

SEQ ID NO: 34645 - DNA, 25 bp, Homo sapien
attcaggggcttatataccagtttg

SEQ ID NO: 34646 - DNA, 25 bp, Homo sapien
attcaggtgtgaaccagtgcagtgc

SEQ ID NO: 34647 - DNA, 25 bp, Homo sapien
attcaggtgtgacccagtgcagtgc

SEQ ID NO: 34648 - DNA, 25 bp, Homo sapien
attcagtacgaacactggaaatact

SEQ ID NO: 34649 - DNA, 25 bp, Homo sapien
attcagtagcagacacaattatatc

SEQ ID NO: 34650 - DNA, 25 bp, Homo sapien
attcagtagcagacgcaattatatc

SEQ ID NO: 34651 - DNA, 25 bp, Homo sapien
attcagtatgaacactggaaatact

SEQ ID NO: 34652 - DNA, 25 bp, Homo sapien
attcagtattttgacaagaatttag

SEQ ID NO: 34653 - DNA, 25 bp, Homo sapien
attcagtattttggcaagaatttag

SEQ ID NO: 34654 - DNA, 25 bp, Homo sapien
attcagtcagagcggaaaaaacaga

SEQ ID NO: 34655 - DNA, 25 bp, Homo sapien
attcagtcatgtatttccacagatg

SEQ ID NO: 34656 - DNA, 25 bp, Homo sapien
attcagtcatgtctttccacagatg

SEQ ID NO: 34657 - DNA, 25 bp, Homo sapien
attcagtcggagcggaaaaaacaga

SEQ ID NO: 34658 - DNA, 25 bp, Homo sapien
attcagtctccaaaaagcaaagtca

SEQ ID NO: 34659 - DNA, 25 bp, Homo sapien
attcagtctccagaaagcaaagtca

SEQ ID NO: 34660 - DNA, 25 bp, Homo sapien
attcagttaagtttgttcatctttt

SEQ ID NO: 34661 - DNA, 25 bp, Homo sapien
attcagttacgtttgttcatctttt

SEQ ID NO: 34662 - DNA, 25 bp, Homo sapien
attcagttgcaggagattaacgtag

SEQ ID NO: 34663 - DNA, 25 bp, Homo sapien
attcagttgtaggagattaacgtag

SEQ ID NO: 34664 - DNA, 25 bp, Homo sapien
attcagttgtgatagctccttgatt

SEQ ID NO: 34665 - DNA, 25 bp, Homo sapien
attcagttgtgatatctccttgatt

SEQ ID NO: 34666 - DNA, 25 bp, Homo sapien
attcataaatcatagcatcacattg

SEQ ID NO: 34667 - DNA, 25 bp, Homo sapien
attcataaatcattgcatcacattg

SEQ ID NO: 34668 - DNA, 25 bp, Homo sapien
attcataaccacccaaacttggaag

SEQ ID NO: 34669 - DNA, 25 bp, Homo sapien
attcataaccatccaaacttggaag

SEQ ID NO: 34670 - DNA, 25 bp, Homo sapien
attcataagggaaacataacttgca

SEQ ID NO: 34671 - DNA, 25 bp, Homo sapien
attcataagggaaccataacttgca

SEQ ID NO: 34672 - DNA, 25 bp, Homo sapien
attcatacctagagagctcagtaac

SEQ ID NO: 34673 - DNA, 25 bp, Homo sapien
attcatacctagcgagctcagtaac

SEQ ID NO: 34674 - DNA, 25 bp, Homo sapien
attcatacctatagcccactttact

SEQ ID NO: 34675 - DNA, 25 bp, Homo sapien
attcatacttatagcccactttact

SEQ ID NO: 34676 - DNA, 25 bp, Homo sapien
attcatatgtactcattgcaacaaa

SEQ ID NO: 34677 - DNA, 25 bp, Homo sapien
attcatatgtactcgttgcaacaaa

SEQ ID NO: 34678 - DNA, 25 bp, Homo sapien
attcatcacagtaatgacaatgtcc

SEQ ID NO: 34679 - DNA, 25 bp, Homo sapien
attcatcacggcatctttcattgca

SEQ ID NO: 34680 - DNA, 25 bp, Homo sapien
attcatcacggtaatgacaatgtcc

SEQ ID NO: 34681 - DNA, 25 bp, Homo sapien
attcatcacggtatctttcattgca

SEQ ID NO: 34682 - DNA, 25 bp, Homo sapien
attcatcagaaatacttgtctattg

SEQ ID NO: 34683 - DNA, 25 bp, Homo sapien
attcatcagcaacctaagagacagc

SEQ ID NO: 34684 - DNA, 25 bp, Homo sapien
attcatcagcaagtcttgatatttc

SEQ ID NO: 34685 - DNA, 25 bp, Homo sapien
attcatcagcaattcttgatatttc

SEQ ID NO: 34686 - DNA, 25 bp, Homo sapien
attcatcagcagcctaagagacagc

SEQ ID NO: 34687 - DNA, 25 bp, Homo sapien
attcatcaggaatacttgtctattg

SEQ ID NO: 34688 - DNA, 25 bp, Homo sapien
attcatcatcggaaaatatccagga

SEQ ID NO: 34689 - DNA, 25 bp, Homo sapien
attcatcatcggacaatatccagga

SEQ ID NO: 34690 - DNA, 25 bp, Homo sapien
attcatccaagtccttgagtggaag

SEQ ID NO: 34691 - DNA, 25 bp, Homo sapien
attcatccaagtgcttgagtggaag

SEQ ID NO: 34692 - DNA, 25 bp, Homo sapien
attcatccaccaagtagtggcatca

SEQ ID NO: 34693 - DNA, 25 bp, Homo sapien
attcatccaccaggtagtggcatca

SEQ ID NO: 34694 - DNA, 25 bp, Homo sapien
attcatccactccggttgatcagaa

SEQ ID NO: 34695 - DNA, 25 bp, Homo sapien
attcatccactctggttgatcagaa

SEQ ID NO: 34696 - DNA, 25 bp, Homo sapien
attcatcgccatatccaggctcctg

SEQ ID NO: 34697 - DNA, 25 bp, Homo sapien
attcatcgccatgtccaggctcctg

SEQ ID NO: 34698 - DNA, 25 bp, Homo sapien
attcatctaaacactccaaaaatat

SEQ ID NO: 34699 - DNA, 25 bp, Homo sapien
attcatctcagaatatgtctggtca

SEQ ID NO: 34700 - DNA, 25 bp, Homo sapien
attcatctcagagtatgtctggtca

SEQ ID NO: 34701 - DNA, 25 bp, Homo sapien
attcatctcttcttatgggaattac

SEQ ID NO: 34702 - DNA, 25 bp, Homo sapien
attcatctgaacactccaaaaatat

SEQ ID NO: 34703 - DNA, 25 bp, Homo sapien
attcatctgttcttatgggaattac

SEQ ID NO: 34704 - DNA, 25 bp, Homo sapien
attcatgacaccacggactagagta

SEQ ID NO: 34705 - DNA, 25 bp, Homo sapien
attcatgacaccatggactagagta

SEQ ID NO: 34706 - DNA, 25 bp, Homo sapien
attcatgagggaaaaaaacagacca

SEQ ID NO: 34707 - DNA, 25 bp, Homo sapien
attcatgagggaaagaaacagacca

SEQ ID NO: 34708 - DNA, 25 bp, Homo sapien
attcatgatttcaacaatacttata

SEQ ID NO: 34709 - DNA, 25 bp, Homo sapien
attcatgatttccacaatacttata

SEQ ID NO: 34710 - DNA, 25 bp, Homo sapien
attcatggtcactgagttccttgga

SEQ ID NO: 34711 - DNA, 25 bp, Homo sapien
attcatggtcattgagttccttgga

SEQ ID NO: 34712 - DNA, 25 bp, Homo sapien
attcatggtgtcatatagaaggggc

SEQ ID NO: 34713 - DNA, 25 bp, Homo sapien
attcatggtgtcgtatagaaggggc

SEQ ID NO: 34714 - DNA, 25 bp, Homo sapien
attcatgttccaaaggtgacttatt

SEQ ID NO: 34715 - DNA, 25 bp, Homo sapien
attcatgttcttataatggagtgga

SEQ ID NO: 34716 - DNA, 25 bp, Homo sapien
attcatgttcttgactggtttagtt

SEQ ID NO: 34717 - DNA, 25 bp, Homo sapien
attcatgttcttgtctggtttagtt

SEQ ID NO: 34718 - DNA, 25 bp, Homo sapien
attcatgttcttttaatggagtgga

SEQ ID NO: 34719 - DNA, 25 bp, Homo sapien
attcatgttgcaaaggtgacttatt

SEQ ID NO: 34720 - DNA, 25 bp, Homo sapien
attcattaacttcatctttttatat

SEQ ID NO: 34721 - DNA, 25 bp, Homo sapien
attcattaaggatgtctaacaccaa

SEQ ID NO: 34722 - DNA, 25 bp, Homo sapien
attcattaaggatttctaacaccaa

SEQ ID NO: 34723 - DNA, 25 bp, Homo sapien
attcattacctgccattcaatagtc

SEQ ID NO: 34724 - DNA, 25 bp, Homo sapien
attcattacgtgccattcaatagtc

SEQ ID NO: 34725 - DNA, 25 bp, Homo sapien
attcattactataaagttccaaaga

SEQ ID NO: 34726 - DNA, 25 bp, Homo sapien
attcattagcttcatctttttatat

SEQ ID NO: 34727 - DNA, 25 bp, Homo sapien
attcattattataaagttccaaaga

SEQ ID NO: 34728 - DNA, 25 bp, Homo sapien
attcattcatctaaacactccaaaa

SEQ ID NO: 34729 - DNA, 25 bp, Homo sapien
attcattcatctgaacactccaaaa

SEQ ID NO: 34730 - DNA, 25 bp, Homo sapien
attcattccaggaacttctactgag

SEQ ID NO: 34731 - DNA, 25 bp, Homo sapien
attcattccaggagcttctactgag

SEQ ID NO: 34732 - DNA, 25 bp, Homo sapien
attcattgaatggctattactgagc

SEQ ID NO: 34733 - DNA, 25 bp, Homo sapien
attcattgagtggctattactgagc

SEQ ID NO: 34734 - DNA, 25 bp, Homo sapien
attcattgtaccttgtcacaactgc

SEQ ID NO: 34735 - DNA, 25 bp, Homo sapien
attcattgtgccttgtcacaactgc

SEQ ID NO: 34736 - DNA, 25 bp, Homo sapien
attcatttaccgccttacctggaaa

SEQ ID NO: 34737 - DNA, 25 bp, Homo sapien
attcatttccttttacatctcttac

SEQ ID NO: 34738 - DNA, 25 bp, Homo sapien
attcatttctttttacatctcttac

SEQ ID NO: 34739 - DNA, 25 bp, Homo sapien
attcatttgccgccttacctggaaa

SEQ ID NO: 34740 - DNA, 25 bp, Homo sapien
attccaaaaatcagcttactggtaa

SEQ ID NO: 34741 - DNA, 25 bp, Homo sapien
attccaaaaatcggcttactggtaa

SEQ ID NO: 34742 - DNA, 25 bp, Homo sapien
attccaaacagagactagcaggtgc

SEQ ID NO: 34743 - DNA, 25 bp, Homo sapien
attccaaaccgagactagcaggtgc

SEQ ID NO: 34744 - DNA, 25 bp, Homo sapien
attccaacacgaacacaatgtattt

SEQ ID NO: 34745 - DNA, 25 bp, Homo sapien
attccaacacgagcacaatgtattt

SEQ ID NO: 34746 - DNA, 25 bp, Homo sapien
attccaacatttaaagtatctgtca

SEQ ID NO: 34747 - DNA, 25 bp, Homo sapien
attccaacatttaaggtatctgtca

SEQ ID NO: 34748 - DNA, 25 bp, Homo sapien
attccaaggcataaacttgttaaaa

SEQ ID NO: 34749 - DNA, 25 bp, Homo sapien
attccaaggcatgaacttgttaaaa

SEQ ID NO: 34750 - DNA, 25 bp, Homo sapien
attccacatctcctttctgcacatg

SEQ ID NO: 34751 - DNA, 25 bp, Homo sapien
attccacatctcttttctgcacatg

SEQ ID NO: 34752 - DNA, 25 bp, Homo sapien
attccacattctgcacaccagtcca

SEQ ID NO: 34753 - DNA, 25 bp, Homo sapien
attccacattcttcacaccagtcca

SEQ ID NO: 34754 - DNA, 25 bp, Homo sapien
attccacatttttagacgatattgc

SEQ ID NO: 34755 - DNA, 25 bp, Homo sapien
attccacatttttagatgatattgc

SEQ ID NO: 34756 - DNA, 25 bp, Homo sapien
attccaccatagttcagactatata

SEQ ID NO: 34757 - DNA, 25 bp, Homo sapien
attccacccaccaaggagaagcagt

SEQ ID NO: 34758 - DNA, 25 bp, Homo sapien
attccacccgccaaggagaagcagt

SEQ ID NO: 34759 - DNA, 25 bp, Homo sapien
attccaccgtagttcagactatata

SEQ ID NO: 34760 - DNA, 25 bp, Homo sapien
attccacctttgaatagttgccatc

SEQ ID NO: 34761 - DNA, 25 bp, Homo sapien
attccacctttgaatatttgccatc

SEQ ID NO: 34762 - DNA, 25 bp, Homo sapien
attccactccaaatattaatgtgtt

SEQ ID NO: 34763 - DNA, 25 bp, Homo sapien
attccactcccagatacgtacccaa

SEQ ID NO: 34764 - DNA, 25 bp, Homo sapien
attccactcccagatatgtacccaa

SEQ ID NO: 34765 - DNA, 25 bp, Homo sapien
attccactgcaaatattaatgtgtt

SEQ ID NO: 34766 - DNA, 25 bp, Homo sapien
attccacttccgacggactacagct

SEQ ID NO: 34767 - DNA, 25 bp, Homo sapien
attccacttccgatggactacagct

SEQ ID NO: 34768 - DNA, 25 bp, Homo sapien
attccagagcaaagcaaagagaggg

SEQ ID NO: 34769 - DNA, 25 bp, Homo sapien
attccagagcaaaggaaagagaggg

SEQ ID NO: 34770 - DNA, 25 bp, Homo sapien
attccagatttttggaattctgtat

SEQ ID NO: 34771 - DNA, 25 bp, Homo sapien
attccagattttttgaattctgtat

SEQ ID NO: 34772 - DNA, 25 bp, Homo sapien
attccagcacgtctcaattcagagt

SEQ ID NO: 34773 - DNA, 25 bp, Homo sapien
attccagcatgtctcaattcagagt

SEQ ID NO: 34774 - DNA, 25 bp, Homo sapien
attccagccattatcattatccatt

SEQ ID NO: 34775 - DNA, 25 bp, Homo sapien
attccagccattgtcattatccatt

SEQ ID NO: 34776 - DNA, 25 bp, Homo sapien
attccaggaaaagcaaactgcttta

SEQ ID NO: 34777 - DNA, 25 bp, Homo sapien
attccaggaacttctactgagcagt

SEQ ID NO: 34778 - DNA, 25 bp, Homo sapien
attccaggagcttctactgagcagt

SEQ ID NO: 34779 - DNA, 25 bp, Homo sapien
attccaggcaaagcaaactgcttta

SEQ ID NO: 34780 - DNA, 25 bp, Homo sapien
attccaggcacatcctaactcagga

SEQ ID NO: 34781 - DNA, 25 bp, Homo sapien
attccaggcacattctaactcagga

SEQ ID NO: 34782 - DNA, 25 bp, Homo sapien
attccaggctaagattggacaaaag

SEQ ID NO: 34783 - DNA, 25 bp, Homo sapien
attccaggctagctctgttacagca

SEQ ID NO: 34784 - DNA, 25 bp, Homo sapien
attccaggttaagattggacaaaag

SEQ ID NO: 34785 - DNA, 25 bp, Homo sapien
attccaggttagctctgttacagca

SEQ ID NO: 34786 - DNA, 25 bp, Homo sapien
attccataacatcttaatggttggg

SEQ ID NO: 34787 - DNA, 25 bp, Homo sapien
attccataacattttaatggttggg

SEQ ID NO: 34788 - DNA, 25 bp, Homo sapien
attccatgattttgacaagtgcacc

SEQ ID NO: 34789 - DNA, 25 bp, Homo sapien
attccatggtcttggttcattttca

SEQ ID NO: 34790 - DNA, 25 bp, Homo sapien
attccatggtctttgttcattttca

SEQ ID NO: 34791 - DNA, 25 bp, Homo sapien
attccatggttttgacaagtgcacc

SEQ ID NO: 34792 - DNA, 25 bp, Homo sapien
attccattaatggtccatggcctgg

SEQ ID NO: 34793 - DNA, 25 bp, Homo sapien
attccattaatggtccgtggcctgg

SEQ ID NO: 34794 - DNA, 25 bp, Homo sapien
attccattctgcggataggccacat

SEQ ID NO: 34795 - DNA, 25 bp, Homo sapien
attccattctgtggataggccacat

SEQ ID NO: 34796 - DNA, 25 bp, Homo sapien
attccatttagtctacataatacat

SEQ ID NO: 34797 - DNA, 25 bp, Homo sapien
attccatttagtctacgtaatacat

SEQ ID NO: 34798 - DNA, 25 bp, Homo sapien
attccattttacaatcagacagttc

SEQ ID NO: 34799 - DNA, 25 bp, Homo sapien
attccattttataatcagacagttc

SEQ ID NO: 34800 - DNA, 25 bp, Homo sapien
attccattttgaatcggtgctactt

SEQ ID NO: 34801 - DNA, 25 bp, Homo sapien
attccattttgaattggtgctactt

SEQ ID NO: 34802 - DNA, 25 bp, Homo sapien
attcccaaagctgagcagccacccc

SEQ ID NO: 34803 - DNA, 25 bp, Homo sapien
attcccaaatatagcacattcgcaa

SEQ ID NO: 34804 - DNA, 25 bp, Homo sapien
attcccaaatatagtacattcgcaa

SEQ ID NO: 34805 - DNA, 25 bp, Homo sapien
attcccaacaagtctggctacgagt

SEQ ID NO: 34806 - DNA, 25 bp, Homo sapien
attcccaacaagtttggctacgagt

SEQ ID NO: 34807 - DNA, 25 bp, Homo sapien
attcccaacgctgagcagccacccc

SEQ ID NO: 34808 - DNA, 25 bp, Homo sapien
attcccacatgaactctatgcaata

SEQ ID NO: 34809 - DNA, 25 bp, Homo sapien
attcccacgtgaactctatgcaata

SEQ ID NO: 34810 - DNA, 25 bp, Homo sapien
attcccagatccagggctgcagctc

SEQ ID NO: 34811 - DNA, 25 bp, Homo sapien
attcccaggtccagggctgcagctc

SEQ ID NO: 34812 - DNA, 25 bp, Homo sapien
attcccatgcaaactcagatctaag

SEQ ID NO: 34813 - DNA, 25 bp, Homo sapien
attcccatgcaacctcagatctaag

SEQ ID NO: 34814 - DNA, 25 bp, Homo sapien
attccccaccagcgtgtttttctct

SEQ ID NO: 34815 - DNA, 25 bp, Homo sapien
attccccaccagtgtgtttttctct

SEQ ID NO: 34816 - DNA, 25 bp, Homo sapien
attccccatattgcgatggtagtag

SEQ ID NO: 34817 - DNA, 25 bp, Homo sapien
attccccatattgtgatggtagtag

SEQ ID NO: 34818 - DNA, 25 bp, Homo sapien
attcccgaattccgctgtctggtct

SEQ ID NO: 34819 - DNA, 25 bp, Homo sapien
attcccgaattctgctgtctggtct

SEQ ID NO: 34820 - DNA, 25 bp, Homo sapien
attccctaatgcacccatgcttcta

SEQ ID NO: 34821 - DNA, 25 bp, Homo sapien
attccctaatgcacgcatgcttcta

SEQ ID NO: 34822 - DNA, 25 bp, Homo sapien
attcccttatcataaatgctagaag

SEQ ID NO: 34823 - DNA, 25 bp, Homo sapien
attcccttatcatacatgctagaag

SEQ ID NO: 34824 - DNA, 25 bp, Homo sapien
attccctttgccgatggttgggatg

SEQ ID NO: 34825 - DNA, 25 bp, Homo sapien
attccctttgctgatggttgggatg

SEQ ID NO: 34826 - DNA, 25 bp, Homo sapien
attcccttttgtagcgcaaatcagt

SEQ ID NO: 34827 - DNA, 25 bp, Homo sapien
attcccttttgtagtgcaaatcagt

SEQ ID NO: 34828 - DNA, 25 bp, Homo sapien
attccctttttgacctctcatttcc

SEQ ID NO: 34829 - DNA, 25 bp, Homo sapien
attccctttttgacctgtcatttcc

SEQ ID NO: 34830 - DNA, 25 bp, Homo sapien
attccgcttggccaatttaaagaga

SEQ ID NO: 34831 - DNA, 25 bp, Homo sapien
attccgcttggctaatttaaagaga

SEQ ID NO: 34832 - DNA, 25 bp, Homo sapien
attccgtaacgcaagtagagtacac

SEQ ID NO: 34833 - DNA, 25 bp, Homo sapien
attccgtaacgcaggtagagtacac

SEQ ID NO: 34834 - DNA, 25 bp, Homo sapien
attccgtttacaaagggaaagaagg

SEQ ID NO: 34835 - DNA, 25 bp, Homo sapien
attccgtttaccaagggaaagaagg

SEQ ID NO: 34836 - DNA, 25 bp, Homo sapien
attcctaaggtttccgactcagatc

SEQ ID NO: 34837 - DNA, 25 bp, Homo sapien
attcctaaggtttctgactcagatc

SEQ ID NO: 34838 - DNA, 25 bp, Homo sapien
attcctaccaccttccagtctgtga

SEQ ID NO: 34839 - DNA, 25 bp, Homo sapien
attcctacgaccttccagtctgtga

SEQ ID NO: 34840 - DNA, 25 bp, Homo sapien
attcctatcaacagcacacaaacct

SEQ ID NO: 34841 - DNA, 25 bp, Homo sapien
attcctatcaacatcacacaaacct

SEQ ID NO: 34842 - DNA, 25 bp, Homo sapien
attcctatcatcattgacccacatt

SEQ ID NO: 34843 - DNA, 25 bp, Homo sapien
attcctatcatcattggcccacatt

SEQ ID NO: 34844 - DNA, 25 bp, Homo sapien
attcctatccttctgtggacagtga

SEQ ID NO: 34845 - DNA, 25 bp, Homo sapien
attcctatccttttgtggacagtga

SEQ ID NO: 34846 - DNA, 25 bp, Homo sapien
attcctatcttgactttatgttttt

SEQ ID NO: 34847 - DNA, 25 bp, Homo sapien
attcctatcttgattttatgttttt

SEQ ID NO: 34848 - DNA, 25 bp, Homo sapien
attcctatgcttctacctatggaaa

SEQ ID NO: 34849 - DNA, 25 bp, Homo sapien
attcctatggctccaaaggtcttaa

SEQ ID NO: 34850 - DNA, 25 bp, Homo sapien
attcctatggcttcaaaggtcttaa

SEQ ID NO: 34851 - DNA, 25 bp, Homo sapien
attcctattcttctacctatggaaa

SEQ ID NO: 34852 - DNA, 25 bp, Homo sapien
attcctcaacaacagcatgcatgct

SEQ ID NO: 34853 - DNA, 25 bp, Homo sapien
attcctcaacaagccaaattcagtg

SEQ ID NO: 34854 - DNA, 25 bp, Homo sapien
attcctcaacaggccaaattcagtg

SEQ ID NO: 34855 - DNA, 25 bp, Homo sapien
attcctcagcaacagcatgcatgct

SEQ ID NO: 34856 - DNA, 25 bp, Homo sapien
attcctcagctatgacattctaaat

SEQ ID NO: 34857 - DNA, 25 bp, Homo sapien
attcctcagctgtgacattctaaat

SEQ ID NO: 34858 - DNA, 25 bp, Homo sapien
attcctctacgtaaatcttcacctt

SEQ ID NO: 34859 - DNA, 25 bp, Homo sapien
attcctctatgtaaatcttcacctt

SEQ ID NO: 34860 - DNA, 25 bp, Homo sapien
attcctctcatgccctgcctaggac

SEQ ID NO: 34861 - DNA, 25 bp, Homo sapien
attcctctcgtgccctgcctaggac

SEQ ID NO: 34862 - DNA, 25 bp, Homo sapien
attcctgaattacttttaatactgc

SEQ ID NO: 34863 - DNA, 25 bp, Homo sapien
attcctgaattatttttaatactgc

SEQ ID NO: 34864 - DNA, 25 bp, Homo sapien
attcctgacattgagcttcactgtg

SEQ ID NO: 34865 - DNA, 25 bp, Homo sapien
attcctgacgttgagcttcactgtg

SEQ ID NO: 34866 - DNA, 25 bp, Homo sapien
attcctgagagaggagaaccaaatg

SEQ ID NO: 34867 - DNA, 25 bp, Homo sapien
attcctgagagcggagaaccaaatg

SEQ ID NO: 34868 - DNA, 25 bp, Homo sapien
attcctgagtcacagagtacaaaca

SEQ ID NO: 34869 - DNA, 25 bp, Homo sapien
attcctgagtcatagagtacaaaca

SEQ ID NO: 34870 - DNA, 25 bp, Homo sapien
attcctgagtttgaaccatcttcca

SEQ ID NO: 34871 - DNA, 25 bp, Homo sapien
attcctgagtttgagccatcttcca

SEQ ID NO: 34872 - DNA, 25 bp, Homo sapien
attcctgcacaaccatctggcaaac

SEQ ID NO: 34873 - DNA, 25 bp, Homo sapien
attcctgcacatccatctggcaaac

SEQ ID NO: 34874 - DNA, 25 bp, Homo sapien
attcctgccagctgtgagcctgtga

SEQ ID NO: 34875 - DNA, 25 bp, Homo sapien
attcctgcgagctgtgagcctgtga

SEQ ID NO: 34876 - DNA, 25 bp, Homo sapien
attcctgcttttcatgcatcttggt

SEQ ID NO: 34877 - DNA, 25 bp, Homo sapien
attcctgcttttcgtgcatcttggt

SEQ ID NO: 34878 - DNA, 25 bp, Homo sapien
attcctggaaaactcagtgtacatt

SEQ ID NO: 34879 - DNA, 25 bp, Homo sapien
attcctggaaaattcagtgtacatt

SEQ ID NO: 34880 - DNA, 25 bp, Homo sapien
attcctggaactcaaagaaatggta

SEQ ID NO: 34881 - DNA, 25 bp, Homo sapien
attcctggaactgaaagaaatggta

SEQ ID NO: 34882 - DNA, 25 bp, Homo sapien
attcctggacaaagacatggagtta

SEQ ID NO: 34883 - DNA, 25 bp, Homo sapien
attcctggacaaagacttggagtta

SEQ ID NO: 34884 - DNA, 25 bp, Homo sapien
attcctgtgacttataaataatgct

SEQ ID NO: 34885 - DNA, 25 bp, Homo sapien
attcctgtgacttatagataatgct

SEQ ID NO: 34886 - DNA, 25 bp, Homo sapien
attcctgttactgcataagaaacct

SEQ ID NO: 34887 - DNA, 25 bp, Homo sapien
attcctgttacttcataagaaacct

SEQ ID NO: 34888 - DNA, 25 bp, Homo sapien
attccttacagtgtgtgacagggag

SEQ ID NO: 34889 - DNA, 25 bp, Homo sapien
attccttacagtgtgttacagggag

SEQ ID NO: 34890 - DNA, 25 bp, Homo sapien
attccttagcgcagaacagtgtagc

SEQ ID NO: 34891 - DNA, 25 bp, Homo sapien
attccttagcgcagcacagtgtagc

SEQ ID NO: 34892 - DNA, 25 bp, Homo sapien
attccttcaagaaaaaattctccca

SEQ ID NO: 34893 - DNA, 25 bp, Homo sapien
attccttccagaaaaaattctccca

SEQ ID NO: 34894 - DNA, 25 bp, Homo sapien
attccttgttaggcaaaaaccttgg

SEQ ID NO: 34895 - DNA, 25 bp, Homo sapien
attccttgttagtcaaaaaccttgg

SEQ ID NO: 34896 - DNA, 25 bp, Homo sapien
attcctttacttattccatattttg

SEQ ID NO: 34897 - DNA, 25 bp, Homo sapien
attcctttatttattccatattttg

SEQ ID NO: 34898 - DNA, 25 bp, Homo sapien
attcctttcattcaccagttttgaa

SEQ ID NO: 34899 - DNA, 25 bp, Homo sapien
attcctttcattcgccagttttgaa

SEQ ID NO: 34900 - DNA, 25 bp, Homo sapien
attcgaaatgcaatacatttggaac

SEQ ID NO: 34901 - DNA, 25 bp, Homo sapien
attcgaaatgcaatccatttggaac

SEQ ID NO: 34902 - DNA, 25 bp, Homo sapien
attcgaccattttaacacatgatat

SEQ ID NO: 34903 - DNA, 25 bp, Homo sapien
attcgaccattttaacgcatgatat

SEQ ID NO: 34904 - DNA, 25 bp, Homo sapien
attcgagggaccttctatcgcccat

SEQ ID NO: 34905 - DNA, 25 bp, Homo sapien
attcgagggaccttctgtcgcccat

SEQ ID NO: 34906 - DNA, 25 bp, Homo sapien
attcgagtcctttcctgatacttaa

SEQ ID NO: 34907 - DNA, 25 bp, Homo sapien
attcgagttctttcctgatacttaa

SEQ ID NO: 34908 - DNA, 25 bp, Homo sapien
attcgcaacctaagcccactctctc

SEQ ID NO: 34909 - DNA, 25 bp, Homo sapien
attcgcaacttaagcccactctctc

SEQ ID NO: 34910 - DNA, 25 bp, Homo sapien
attcgctgcttcatctcccctgtga

SEQ ID NO: 34911 - DNA, 25 bp, Homo sapien
attcgctgtttcatctcccctgtga

SEQ ID NO: 34912 - DNA, 25 bp, Homo sapien
attcggctaaagtccacgagggcca

SEQ ID NO: 34913 - DNA, 25 bp, Homo sapien
attcggctaaagtctacgagggcca

SEQ ID NO: 34914 - DNA, 25 bp, Homo sapien
attcgggtacttgttgctttacaga

SEQ ID NO: 34915 - DNA, 25 bp, Homo sapien
attcgggtgcttgttgctttacaga

SEQ ID NO: 34916 - DNA, 25 bp, Homo sapien
attcgggtttgctgaaaattcagga

SEQ ID NO: 34917 - DNA, 25 bp, Homo sapien
attcgggtttgctgaacattcagga

SEQ ID NO: 34918 - DNA, 25 bp, Homo sapien
attcgtgacactcggtaaagcacag

SEQ ID NO: 34919 - DNA, 25 bp, Homo sapien
attcgtgacactcggtgaagcacag

SEQ ID NO: 34920 - DNA, 25 bp, Homo sapien
attcgttatagcagcaatagaaaat

SEQ ID NO: 34921 - DNA, 25 bp, Homo sapien
attcgttatagcagcagtagaaaat

SEQ ID NO: 34922 - DNA, 25 bp, Homo sapien
attcgttcacttgaacatcatagca

SEQ ID NO: 34923 - DNA, 25 bp, Homo sapien
attcgttcatttgaacatcatagca

SEQ ID NO: 34924 - DNA, 25 bp, Homo sapien
attcgttgactcgtactgtgctaag

SEQ ID NO: 34925 - DNA, 25 bp, Homo sapien
attcgttgtctcgtactgtgctaag

SEQ ID NO: 34926 - DNA, 25 bp, Homo sapien
attctaaaaaaagttcaagtaacct

SEQ ID NO: 34927 - DNA, 25 bp, Homo sapien
attctaaaaaacgttcaagtaacct

SEQ ID NO: 34928 - DNA, 25 bp, Homo sapien
attctaaaatataagagtgcagttg

SEQ ID NO: 34929 - DNA, 25 bp, Homo sapien
attctaaaatattagagtgcagttg

SEQ ID NO: 34930 - DNA, 25 bp, Homo sapien
attctaaacatcataaggaaattaa

SEQ ID NO: 34931 - DNA, 25 bp, Homo sapien
attctaaacatcgtaaggaaattaa

SEQ ID NO: 34932 - DNA, 25 bp, Homo sapien
attctaactcactacaagtactaca

SEQ ID NO: 34933 - DNA, 25 bp, Homo sapien
attctaactcactgcaagtactaca

SEQ ID NO: 34934 - DNA, 25 bp, Homo sapien
attctaactctcggcttcactagca

SEQ ID NO: 34935 - DNA, 25 bp, Homo sapien
attctaactcttggcttcactagca

SEQ ID NO: 34936 - DNA, 25 bp, Homo sapien
attctaagatacagggttcaaagga

SEQ ID NO: 34937 - DNA, 25 bp, Homo sapien
attctaagatagtaacttggtcagc

SEQ ID NO: 34938 - DNA, 25 bp, Homo sapien
attctaagatagttacttggtcagc

SEQ ID NO: 34939 - DNA, 25 bp, Homo sapien
attctaagatatagggttcaaagga

SEQ ID NO: 34940 - DNA, 25 bp, Homo sapien
attctaaggtacagtaacaacatgc

SEQ ID NO: 34941 - DNA, 25 bp, Homo sapien
attctaaggtacggtaacaacatgc

SEQ ID NO: 34942 - DNA, 25 bp, Homo sapien
attctaatagtgaaaatatgacttg

SEQ ID NO: 34943 - DNA, 25 bp, Homo sapien
attctaatagtggaaatatgacttg

SEQ ID NO: 34944 - DNA, 25 bp, Homo sapien
attctaattctcacagctaaacaat

SEQ ID NO: 34945 - DNA, 25 bp, Homo sapien
attctaattttcacagctaaacaat

SEQ ID NO: 34946 - DNA, 25 bp, Homo sapien
attctacaactagacctggttggat

SEQ ID NO: 34947 - DNA, 25 bp, Homo sapien
attctacaactagagctggttggat

SEQ ID NO: 34948 - DNA, 25 bp, Homo sapien
attctactcagaatcttaccctatt

SEQ ID NO: 34949 - DNA, 25 bp, Homo sapien
attctactcagactcttaccctatt

SEQ ID NO: 34950 - DNA, 25 bp, Homo sapien
attctactctatcgactatattgac

SEQ ID NO: 34951 - DNA, 25 bp, Homo sapien
attctactctattgactatattgac

SEQ ID NO: 34952 - DNA, 25 bp, Homo sapien
attctagaagctgtggaaagaaaaa

SEQ ID NO: 34953 - DNA, 25 bp, Homo sapien
attctagaagctgtgggaagaaaaa

SEQ ID NO: 34954 - DNA, 25 bp, Homo sapien
attctagacagagaagttgaaaatc

SEQ ID NO: 34955 - DNA, 25 bp, Homo sapien
attctagacagcgaagttgaaaatc

SEQ ID NO: 34956 - DNA, 25 bp, Homo sapien
attctagcctctcgtctttcattaa

SEQ ID NO: 34957 - DNA, 25 bp, Homo sapien
attctagcctcttgtctttcattaa

SEQ ID NO: 34958 - DNA, 25 bp, Homo sapien
attctaggaaccaataatcagcaca

SEQ ID NO: 34959 - DNA, 25 bp, Homo sapien
attctaggaaccagtaatcagcaca

SEQ ID NO: 34960 - DNA, 25 bp, Homo sapien
attctagtcagaccgattatctgct

SEQ ID NO: 34961 - DNA, 25 bp, Homo sapien
attctagtcagactgattatctgct

SEQ ID NO: 34962 - DNA, 25 bp, Homo sapien
attctagtcatgattgcagctgatt

SEQ ID NO: 34963 - DNA, 25 bp, Homo sapien
attctagtcattatccatcaagaca

SEQ ID NO: 34964 - DNA, 25 bp, Homo sapien
attctagtcgtgattgcagctgatt

SEQ ID NO: 34965 - DNA, 25 bp, Homo sapien
attctagtcgttatccatcaagaca

SEQ ID NO: 34966 - DNA, 25 bp, Homo sapien
attctatacccacttctttacctca

SEQ ID NO: 34967 - DNA, 25 bp, Homo sapien
attctatacccagttctttacctca

SEQ ID NO: 34968 - DNA, 25 bp, Homo sapien
attctatcagacattcaaaagagaa

SEQ ID NO: 34969 - DNA, 25 bp, Homo sapien
attctatcagacgttcaaaagagaa

SEQ ID NO: 34970 - DNA, 25 bp, Homo sapien
attctatccgaaagaccttggatac

SEQ ID NO: 34971 - DNA, 25 bp, Homo sapien
attctatctgaaagaccttggatac

SEQ ID NO: 34972 - DNA, 25 bp, Homo sapien
attctatgaaactcaaaagtgctag

SEQ ID NO: 34973 - DNA, 25 bp, Homo sapien
attctatgatgaacaatgaagagac

SEQ ID NO: 34974 - DNA, 25 bp, Homo sapien
attctatgatgaccaatgaagagac

SEQ ID NO: 34975 - DNA, 25 bp, Homo sapien
attctatgattatgccaacattcac

SEQ ID NO: 34976 - DNA, 25 bp, Homo sapien
attctatgattattccaacattcac

SEQ ID NO: 34977 - DNA, 25 bp, Homo sapien
attctatggaactcaaaagtgctag

SEQ ID NO: 34978 - DNA, 25 bp, Homo sapien
attctattggcaaggctgcgaggaa

SEQ ID NO: 34979 - DNA, 25 bp, Homo sapien
attctattgtcaaggctgcgaggaa

SEQ ID NO: 34980 - DNA, 25 bp, Homo sapien
attctcaactccataaaagtagtaa

SEQ ID NO: 34981 - DNA, 25 bp, Homo sapien
attctcaactccgtaaaagtagtaa

SEQ ID NO: 34982 - DNA, 25 bp, Homo sapien
attctcaagcctatatcccagagac

SEQ ID NO: 34983 - DNA, 25 bp, Homo sapien
attctcaaggctatatcccagagac

SEQ ID NO: 34984 - DNA, 25 bp, Homo sapien
attctcaccacaacaatttttccct

SEQ ID NO: 34985 - DNA, 25 bp, Homo sapien
attctcaccacagcaatttttccct

SEQ ID NO: 34986 - DNA, 25 bp, Homo sapien
attctcactatactgttttataatt

SEQ ID NO: 34987 - DNA, 25 bp, Homo sapien
attctcactatattgttttataatt

SEQ ID NO: 34988 - DNA, 25 bp, Homo sapien
attctcactttgtcctcactcggtc

SEQ ID NO: 34989 - DNA, 25 bp, Homo sapien
attctcactttgttctcactcggtc

SEQ ID NO: 34990 - DNA, 25 bp, Homo sapien
attctcaggcagaaggcacgacgat

SEQ ID NO: 34991 - DNA, 25 bp, Homo sapien
attctcaggcaggaggcacgacgat

SEQ ID NO: 34992 - DNA, 25 bp, Homo sapien
attctcaggcattacaggagggagc

SEQ ID NO: 34993 - DNA, 25 bp, Homo sapien
attctcaggcattagaggagggagc

SEQ ID NO: 34994 - DNA, 25 bp, Homo sapien
attctcatagagtttgcagactagt

SEQ ID NO: 34995 - DNA, 25 bp, Homo sapien
attctcatagagtttggagactagt

SEQ ID NO: 34996 - DNA, 25 bp, Homo sapien
attctcatggttacgtgaatatgga

SEQ ID NO: 34997 - DNA, 25 bp, Homo sapien
attctcatggttatgtgaatatgga

SEQ ID NO: 34998 - DNA, 25 bp, Homo sapien
attctcattgtgaattctgggaccc

SEQ ID NO: 34999 - DNA, 25 bp, Homo sapien
attctcattgttaattctgggaccc

SEQ ID NO: 35000 - DNA, 25 bp, Homo sapien
attctccaaacaaatctatcgtagg

SEQ ID NO: 35001 - DNA, 25 bp, Homo sapien
attctccacagcgttcatcatcact

SEQ ID NO: 35002 - DNA, 25 bp, Homo sapien
attctccacagtgttcatcatcact

SEQ ID NO: 35003 - DNA, 25 bp, Homo sapien
attctccacatggtagtggctcact

SEQ ID NO: 35004 - DNA, 25 bp, Homo sapien
attctccacgtggtagtggctcact

SEQ ID NO: 35005 - DNA, 25 bp, Homo sapien
attctccagtttacatctccatatc

SEQ ID NO: 35006 - DNA, 25 bp, Homo sapien
attctccatacaaatctatcgtagg

SEQ ID NO: 35007 - DNA, 25 bp, Homo sapien
attctccatatgcctgaacatttga

SEQ ID NO: 35008 - DNA, 25 bp, Homo sapien
attctccatatgcctggacatttga

SEQ ID NO: 35009 - DNA, 25 bp, Homo sapien
attctccatcagctcactttccatt

SEQ ID NO: 35010 - DNA, 25 bp, Homo sapien
attctccatcatctcactttccatt

SEQ ID NO: 35011 - DNA, 25 bp, Homo sapien
attctccattttacatctccatatc

SEQ ID NO: 35012 - DNA, 25 bp, Homo sapien
attctcccaggccattctaacgtat

SEQ ID NO: 35013 - DNA, 25 bp, Homo sapien
attctcccaggcgattctaacgtat

SEQ ID NO: 35014 - DNA, 25 bp, Homo sapien
attctcctctgagaccccagggcat

SEQ ID NO: 35015 - DNA, 25 bp, Homo sapien
attctcctctgagtccccagggcat

SEQ ID NO: 35016 - DNA, 25 bp, Homo sapien
attctcgtgttctccatttccattt

SEQ ID NO: 35017 - DNA, 25 bp, Homo sapien
attctcgttttctccatttccattt

SEQ ID NO: 35018 - DNA, 25 bp, Homo sapien
attctctaattacatgctaccaaat

SEQ ID NO: 35019 - DNA, 25 bp, Homo sapien
attctctaatttcatgctaccaaat

SEQ ID NO: 35020 - DNA, 25 bp, Homo sapien
attctctcacatgcttttacagtct

SEQ ID NO: 35021 - DNA, 25 bp, Homo sapien
attctctcacatgtttttacagtct

SEQ ID NO: 35022 - DNA, 25 bp, Homo sapien
attctctcgggctgcatttatgtac

SEQ ID NO: 35023 - DNA, 25 bp, Homo sapien
attctctctgcagattcacctattc

SEQ ID NO: 35024 - DNA, 25 bp, Homo sapien
attctctctgcggattcacctattc

SEQ ID NO: 35025 - DNA, 25 bp, Homo sapien
attctctctggctgcatttatgtac

SEQ ID NO: 35026 - DNA, 25 bp, Homo sapien
attctctgaagtatgaatgtctagg

SEQ ID NO: 35027 - DNA, 25 bp, Homo sapien
attctctgaggtatgaatgtctagg

SEQ ID NO: 35028 - DNA, 25 bp, Homo sapien
attctctgtttccatttttcttttt

SEQ ID NO: 35029 - DNA, 25 bp, Homo sapien
attctctgtttccgtttttcttttt

SEQ ID NO: 35030 - DNA, 25 bp, Homo sapien
attctcttaacaattttctccccta

SEQ ID NO: 35031 - DNA, 25 bp, Homo sapien
attctcttaacgattttctccccta

SEQ ID NO: 35032 - DNA, 25 bp, Homo sapien
attctcttatagttccaaaggccag

SEQ ID NO: 35033 - DNA, 25 bp, Homo sapien
attctcttatagttccgaaggccag

SEQ ID NO: 35034 - DNA, 25 bp, Homo sapien
attctcttggtgcctctgtcacatt

SEQ ID NO: 35035 - DNA, 25 bp, Homo sapien
attctcttggtgtctctgtcacatt

SEQ ID NO: 35036 - DNA, 25 bp, Homo sapien
attctgaaagtgtaaacacgagtcc

SEQ ID NO: 35037 - DNA, 25 bp, Homo sapien
attctgaaagtgtaaagacgagtcc

SEQ ID NO: 35038 - DNA, 25 bp, Homo sapien
attctgacaatgcaagttcaaaaag

SEQ ID NO: 35039 - DNA, 25 bp, Homo sapien
attctgacaggccttgtgttgtgtt

SEQ ID NO: 35040 - DNA, 25 bp, Homo sapien
attctgacaggtcttgtgttgtgtt

SEQ ID NO: 35041 - DNA, 25 bp, Homo sapien
attctgacagtgcaagttcaaaaag

SEQ ID NO: 35042 - DNA, 25 bp, Homo sapien
attctgagactccgcataccagacg

SEQ ID NO: 35043 - DNA, 25 bp, Homo sapien
attctgagactccgtataccagacg

SEQ ID NO: 35044 - DNA, 25 bp, Homo sapien
attctgagagcaacttttgacagaa

SEQ ID NO: 35045 - DNA, 25 bp, Homo sapien
attctgagagcagcttttgacagaa

SEQ ID NO: 35046 - DNA, 25 bp, Homo sapien
attctgagcaggtatacaagaaacc

SEQ ID NO: 35047 - DNA, 25 bp, Homo sapien
attctgagccatacgctttaacagg

SEQ ID NO: 35048 - DNA, 25 bp, Homo sapien
attctgagccatatgctttaacagg

SEQ ID NO: 35049 - DNA, 25 bp, Homo sapien
attctgagcgggtatacaagaaacc

SEQ ID NO: 35050 - DNA, 25 bp, Homo sapien
attctgagtaaggagactgattgga

SEQ ID NO: 35051 - DNA, 25 bp, Homo sapien
attctgagtaaggagattgattgga

SEQ ID NO: 35052 - DNA, 25 bp, Homo sapien
attctgagtgctttccatttgctaa

SEQ ID NO: 35053 - DNA, 25 bp, Homo sapien
attctgagtgctttccgtttgctaa

SEQ ID NO: 35054 - DNA, 25 bp, Homo sapien
attctgatatgacttagtgtatgct

SEQ ID NO: 35055 - DNA, 25 bp, Homo sapien
attctgatcttcaccctgaatgagt

SEQ ID NO: 35056 - DNA, 25 bp, Homo sapien
attctgatcttctccctgaatgagt

SEQ ID NO: 35057 - DNA, 25 bp, Homo sapien
attctgatttgacttagtgtatgct

SEQ ID NO: 35058 - DNA, 25 bp, Homo sapien
attctgcacttggtggccacaaatc

SEQ ID NO: 35059 - DNA, 25 bp, Homo sapien
attctgcatttggtggccacaaatc

SEQ ID NO: 35060 - DNA, 25 bp, Homo sapien
attctgcctgacaaaggactcatct

SEQ ID NO: 35061 - DNA, 25 bp, Homo sapien
attctgcctgaccaaggactcatct

SEQ ID NO: 35062 - DNA, 25 bp, Homo sapien
attctgctataaattaaacagtaca

SEQ ID NO: 35063 - DNA, 25 bp, Homo sapien
attctgctatccaacgaatcactgt

SEQ ID NO: 35064 - DNA, 25 bp, Homo sapien
attctgctctatccacaatgaccta

SEQ ID NO: 35065 - DNA, 25 bp, Homo sapien
attctgctctatccactatgaccta

SEQ ID NO: 35066 - DNA, 25 bp, Homo sapien
attctgctgatataaagtcaaactc

SEQ ID NO: 35067 - DNA, 25 bp, Homo sapien
attctgctgatgtaaagtcaaactc

SEQ ID NO: 35068 - DNA, 25 bp, Homo sapien
attctgctgctaaaacagttattac

SEQ ID NO: 35069 - DNA, 25 bp, Homo sapien
attctgctgtaaattaaacagtaca

SEQ ID NO: 35070 - DNA, 25 bp, Homo sapien
attctgcttctaaaacagttattac

SEQ ID NO: 35071 - DNA, 25 bp, Homo sapien
attctgctttccaacgaatcactgt

SEQ ID NO: 35072 - DNA, 25 bp, Homo sapien
attctggatacattttgaaaataga

SEQ ID NO: 35073 - DNA, 25 bp, Homo sapien
attctggatacgttttgaaaataga

SEQ ID NO: 35074 - DNA, 25 bp, Homo sapien
attctggatacttgcagccagctct

SEQ ID NO: 35075 - DNA, 25 bp, Homo sapien
attctggatactttcagccagctct

SEQ ID NO: 35076 - DNA, 25 bp, Homo sapien
attctggcagctaagtacctatttt

SEQ ID NO: 35077 - DNA, 25 bp, Homo sapien
attctggcagctaggtacctatttt

SEQ ID NO: 35078 - DNA, 25 bp, Homo sapien
attctgggttttctcgtccatttct

SEQ ID NO: 35079 - DNA, 25 bp, Homo sapien
attctgggttttcttgtccatttct

SEQ ID NO: 35080 - DNA, 25 bp, Homo sapien
attctgtaggcaatttagatgatga

SEQ ID NO: 35081 - DNA, 25 bp, Homo sapien
attctgtaggcaatttggatgatga

SEQ ID NO: 35082 - DNA, 25 bp, Homo sapien
attctgtgacagtagcccaaatgga

SEQ ID NO: 35083 - DNA, 25 bp, Homo sapien
attctgtgatagtagcccaaatgga

SEQ ID NO: 35084 - DNA, 25 bp, Homo sapien
attctgttcctcagccttctggacc

SEQ ID NO: 35085 - DNA, 25 bp, Homo sapien
attctgttcctcaggcttctggacc

SEQ ID NO: 35086 - DNA, 25 bp, Homo sapien
attcttaaaaaatttcctcattggg

SEQ ID NO: 35087 - DNA, 25 bp, Homo sapien
attcttaaaaaatttcttcattggg

SEQ ID NO: 35088 - DNA, 25 bp, Homo sapien
attcttaaaagttccacgtacacta

SEQ ID NO: 35089 - DNA, 25 bp, Homo sapien
attcttaaaagttccatgtacacta

SEQ ID NO: 35090 - DNA, 25 bp, Homo sapien
attcttaaaggccctagtatttttg

SEQ ID NO: 35091 - DNA, 25 bp, Homo sapien
attcttaaaggtcctagtatttttg

SEQ ID NO: 35092 - DNA, 25 bp, Homo sapien
attcttaaataacatcatgcagaga

SEQ ID NO: 35093 - DNA, 25 bp, Homo sapien
attcttaacactttcgtcactaagc

SEQ ID NO: 35094 - DNA, 25 bp, Homo sapien
attcttaacacttttgtcactaagc

SEQ ID NO: 35095 - DNA, 25 bp, Homo sapien
attcttaagtaacatcatgcagaga

SEQ ID NO: 35096 - DNA, 25 bp, Homo sapien
attcttacagcagcgctccactacc

SEQ ID NO: 35097 - DNA, 25 bp, Homo sapien
attcttacagcccgttttaagaact

SEQ ID NO: 35098 - DNA, 25 bp, Homo sapien
attcttacagcctgttttaagaact

SEQ ID NO: 35099 - DNA, 25 bp, Homo sapien
attcttacagctgcgctccactacc

SEQ ID NO: 35100 - DNA, 25 bp, Homo sapien
attcttactttgtcttagcccacag

SEQ ID NO: 35101 - DNA, 25 bp, Homo sapien
attcttactttgttttagcccacag

SEQ ID NO: 35102 - DNA, 25 bp, Homo sapien
attcttagagattatgtcaggaata

SEQ ID NO: 35103 - DNA, 25 bp, Homo sapien
attcttagccagtattatttcaaat

SEQ ID NO: 35104 - DNA, 25 bp, Homo sapien
attcttagccattattatttcaaat

SEQ ID NO: 35105 - DNA, 25 bp, Homo sapien
attcttagcgattatgtcaggaata

SEQ ID NO: 35106 - DNA, 25 bp, Homo sapien
attcttagtgtcctcatctttgagt

SEQ ID NO: 35107 - DNA, 25 bp, Homo sapien
attcttagtgtcttcatctttgagt

SEQ ID NO: 35108 - DNA, 25 bp, Homo sapien
attcttatgacaatatatctgtgag

SEQ ID NO: 35109 - DNA, 25 bp, Homo sapien
attcttatgacaatgtatctgtgag

SEQ ID NO: 35110 - DNA, 25 bp, Homo sapien
attcttcaactaaggtgtttatgat

SEQ ID NO: 35111 - DNA, 25 bp, Homo sapien
attcttcacgcatcttaatatagtg

SEQ ID NO: 35112 - DNA, 25 bp, Homo sapien
attcttcagcggcgttcagttctct

SEQ ID NO: 35113 - DNA, 25 bp, Homo sapien
attcttcagcggtgttcagttctct

SEQ ID NO: 35114 - DNA, 25 bp, Homo sapien
attcttcagctaaggtgtttatgat

SEQ ID NO: 35115 - DNA, 25 bp, Homo sapien
attcttcatgcatcttaatatagtg

SEQ ID NO: 35116 - DNA, 25 bp, Homo sapien
attcttccaagctatttgcaactgt

SEQ ID NO: 35117 - DNA, 25 bp, Homo sapien
attcttccaagctctttgcaactgt

SEQ ID NO: 35118 - DNA, 25 bp, Homo sapien
attcttctctggttgatgagattcc

SEQ ID NO: 35119 - DNA, 25 bp, Homo sapien
attcttctgggcttgtgattcctgg

SEQ ID NO: 35120 - DNA, 25 bp, Homo sapien
attcttctgggcttttgattcctgg

SEQ ID NO: 35121 - DNA, 25 bp, Homo sapien
attcttcttctacggttccactaat

SEQ ID NO: 35122 - DNA, 25 bp, Homo sapien
attcttcttctatggttccactaat

SEQ ID NO: 35123 - DNA, 25 bp, Homo sapien
attcttctttggttgatgagattcc

SEQ ID NO: 35124 - DNA, 25 bp, Homo sapien
attcttgagctaagtaagaagtagt

SEQ ID NO: 35125 - DNA, 25 bp, Homo sapien
attcttgaggtaagtaagaagtagt

SEQ ID NO: 35126 - DNA, 25 bp, Homo sapien
attcttgcaaaagatagtaattcat

SEQ ID NO: 35127 - DNA, 25 bp, Homo sapien
attcttgcacaagatagtaattcat

SEQ ID NO: 35128 - DNA, 25 bp, Homo sapien
attcttgtataccgagactatatcc

SEQ ID NO: 35129 - DNA, 25 bp, Homo sapien
attcttgtcctcatacacttttgaa

SEQ ID NO: 35130 - DNA, 25 bp, Homo sapien
attcttgtcctcgtacacttttgaa

SEQ ID NO: 35131 - DNA, 25 bp, Homo sapien
attcttgtgtaccgagactatatcc

SEQ ID NO: 35132 - DNA, 25 bp, Homo sapien
attctttacatcaatgaagcagatt

SEQ ID NO: 35133 - DNA, 25 bp, Homo sapien
attctttacatcgatgaagcagatt

SEQ ID NO: 35134 - DNA, 25 bp, Homo sapien
attctttactaagcggtctcaatat

SEQ ID NO: 35135 - DNA, 25 bp, Homo sapien
attctttagctgataagttgattaa

SEQ ID NO: 35136 - DNA, 25 bp, Homo sapien
attctttagctggtaagttgattaa

SEQ ID NO: 35137 - DNA, 25 bp, Homo sapien
attctttagtaagcggtctcaatat

SEQ ID NO: 35138 - DNA, 25 bp, Homo sapien
attctttatctggacgtagcaatga

SEQ ID NO: 35139 - DNA, 25 bp, Homo sapien
attctttatctggatgtagcaatga

SEQ ID NO: 35140 - DNA, 25 bp, Homo sapien
attctttcaaaactccattgactag

SEQ ID NO: 35141 - DNA, 25 bp, Homo sapien
attctttcaaatctccattgactag

SEQ ID NO: 35142 - DNA, 25 bp, Homo sapien
attctttcacttaagagatctgaga

SEQ ID NO: 35143 - DNA, 25 bp, Homo sapien
attctttcatgggctaagctccact

SEQ ID NO: 35144 - DNA, 25 bp, Homo sapien
attctttcccttaagagatctgaga

SEQ ID NO: 35145 - DNA, 25 bp, Homo sapien
attctttcctaagacatttcaacat

SEQ ID NO: 35146 - DNA, 25 bp, Homo sapien
attctttcctaagatatttcaacat

SEQ ID NO: 35147 - DNA, 25 bp, Homo sapien
attctttccttactgcaggacttca

SEQ ID NO: 35148 - DNA, 25 bp, Homo sapien
attctttccttattgcaggacttca

SEQ ID NO: 35149 - DNA, 25 bp, Homo sapien
attctttcgtgggctaagctccact

SEQ ID NO: 35150 - DNA, 25 bp, Homo sapien
attctttcttctgctgaatcaattc

SEQ ID NO: 35151 - DNA, 25 bp, Homo sapien
attctttcttctgctggatcaattc

SEQ ID NO: 35152 - DNA, 25 bp, Homo sapien
attctttgctcttggagtttttaag

SEQ ID NO: 35153 - DNA, 25 bp, Homo sapien
attctttgctcttggattttttaag

SEQ ID NO: 35154 - DNA, 25 bp, Homo sapien
attcttttaccaatttccccttatc

SEQ ID NO: 35155 - DNA, 25 bp, Homo sapien
attcttttaccattttccccttatc

SEQ ID NO: 35156 - DNA, 25 bp, Homo sapien
attcttttgccagaacataccacaa

SEQ ID NO: 35157 - DNA, 25 bp, Homo sapien
attcttttgccagagcataccacaa

SEQ ID NO: 35158 - DNA, 25 bp, Homo sapien
attcttttgtgcacgaggcatttta

SEQ ID NO: 35159 - DNA, 25 bp, Homo sapien
attcttttgtgcatgaggcatttta

SEQ ID NO: 35160 - DNA, 25 bp, Homo sapien
attctttttcttagctactaaaatc

SEQ ID NO: 35161 - DNA, 25 bp, Homo sapien
attctttttcttagctgctaaaatc

SEQ ID NO: 35162 - DNA, 25 bp, Homo sapien
attgaaaagcagattccaaagttat

SEQ ID NO: 35163 - DNA, 25 bp, Homo sapien
attgaaaagcaggttccaaagttat

SEQ ID NO: 35164 - DNA, 25 bp, Homo sapien
attgaaatacgaagacatggaaaac

SEQ ID NO: 35165 - DNA, 25 bp, Homo sapien
attgaaatatgaagacatggaaaac

SEQ ID NO: 35166 - DNA, 25 bp, Homo sapien
attgaaatcagaaaaaaacagaagt

SEQ ID NO: 35167 - DNA, 25 bp, Homo sapien
attgaaatcagaagaaaacagaagt

SEQ ID NO: 35168 - DNA, 25 bp, Homo sapien
attgaaattcgcttccggtgccagg

SEQ ID NO: 35169 - DNA, 25 bp, Homo sapien
attgaaattcggttccggtgccagg

SEQ ID NO: 35170 - DNA, 25 bp, Homo sapien
attgaacacaattgaatcttattct

SEQ ID NO: 35171 - DNA, 25 bp, Homo sapien
attgaacacaattggatcttattct

SEQ ID NO: 35172 - DNA, 25 bp, Homo sapien
attgaacagcaactctccatctccc

SEQ ID NO: 35173 - DNA, 25 bp, Homo sapien
attgaacagtaactctccatctccc

SEQ ID NO: 35174 - DNA, 25 bp, Homo sapien
attgaacatgcactgaatttacaaa

SEQ ID NO: 35175 - DNA, 25 bp, Homo sapien
attgaacatgcgctgaatttacaaa

SEQ ID NO: 35176 - DNA, 25 bp, Homo sapien
attgaacccgttcaggatgaaaaga

SEQ ID NO: 35177 - DNA, 25 bp, Homo sapien
attgaacccgttcagggtgaaaaga

SEQ ID NO: 35178 - DNA, 25 bp, Homo sapien
attgaactaggctctgaggagataa

SEQ ID NO: 35179 - DNA, 25 bp, Homo sapien
attgaactaggctttgaggagataa

SEQ ID NO: 35180 - DNA, 25 bp, Homo sapien
attgaaggaagcaaaatattgttcc

SEQ ID NO: 35181 - DNA, 25 bp, Homo sapien
attgaaggaaggaaaatattgttcc

SEQ ID NO: 35182 - DNA, 25 bp, Homo sapien
attgaaggagtatgattaccacctg

SEQ ID NO: 35183 - DNA, 25 bp, Homo sapien
attgaaggagtgtgattaccacctg

SEQ ID NO: 35184 - DNA, 25 bp, Homo sapien
attgaaggattccatgagaaaaaat

SEQ ID NO: 35185 - DNA, 25 bp, Homo sapien
attgaaggattctatgagaaaaaat

SEQ ID NO: 35186 - DNA, 25 bp, Homo sapien
attgaaggtgctgtcattgttgtag

SEQ ID NO: 35187 - DNA, 25 bp, Homo sapien
attgaaggttctgtcattgttgtag

SEQ ID NO: 35188 - DNA, 25 bp, Homo sapien
attgaagttattactgtttcttgta

SEQ ID NO: 35189 - DNA, 25 bp, Homo sapien
attgaagttattcctgtttcttgta

SEQ ID NO: 35190 - DNA, 25 bp, Homo sapien
attgaatctcacgttaataggacag

SEQ ID NO: 35191 - DNA, 25 bp, Homo sapien
attgaatctcaggttaataggacag

SEQ ID NO: 35192 - DNA, 25 bp, Homo sapien
attgaatgggccatactagctgagt

SEQ ID NO: 35193 - DNA, 25 bp, Homo sapien
attgaatgtgaatatgcaagtgaga

SEQ ID NO: 35194 - DNA, 25 bp, Homo sapien
attgaatgtgactatgcaagtgaga

SEQ ID NO: 35195 - DNA, 25 bp, Homo sapien
attgaatgtgccatactagctgagt

SEQ ID NO: 35196 - DNA, 25 bp, Homo sapien
attgaatgttcaatcactaacaaag

SEQ ID NO: 35197 - DNA, 25 bp, Homo sapien
attgaatgttcagtcactaacaaag

SEQ ID NO: 35198 - DNA, 25 bp, Homo sapien
attgaattaatagaaccatgactga

SEQ ID NO: 35199 - DNA, 25 bp, Homo sapien
attgaattaatagatccatgactga

SEQ ID NO: 35200 - DNA, 25 bp, Homo sapien
attgaatttttgttttagtaggcag

SEQ ID NO: 35201 - DNA, 25 bp, Homo sapien
attgaatttttgttttcgtaggcag

SEQ ID NO: 35202 - DNA, 25 bp, Homo sapien
attgacagaaattcaaaaaagttct

SEQ ID NO: 35203 - DNA, 25 bp, Homo sapien
attgacagacttggtcattaaggtt

SEQ ID NO: 35204 - DNA, 25 bp, Homo sapien
attgacagacttggtcgttaaggtt

SEQ ID NO: 35205 - DNA, 25 bp, Homo sapien
attgacagcaattcaaaaaagttct

SEQ ID NO: 35206 - DNA, 25 bp, Homo sapien
attgacagccagtgcggtggatttc

SEQ ID NO: 35207 - DNA, 25 bp, Homo sapien
attgacagccagtgtggtggatttc

SEQ ID NO: 35208 - DNA, 25 bp, Homo sapien
attgacaggcattttggcaactctg

SEQ ID NO: 35209 - DNA, 25 bp, Homo sapien
attgacaggtattttggcaactctg

SEQ ID NO: 35210 - DNA, 25 bp, Homo sapien
attgacatatactccttctctataa

SEQ ID NO: 35211 - DNA, 25 bp, Homo sapien
attgacatatgacggacataatgaa

SEQ ID NO: 35212 - DNA, 25 bp, Homo sapien
attgacatatgatggacataatgaa

SEQ ID NO: 35213 - DNA, 25 bp, Homo sapien
attgacatctactccttctctataa

SEQ ID NO: 35214 - DNA, 25 bp, Homo sapien
attgacattacatatgcccagtagt

SEQ ID NO: 35215 - DNA, 25 bp, Homo sapien
attgacattgcatatgcccagtagt

SEQ ID NO: 35216 - DNA, 25 bp, Homo sapien
attgactactagctagaaatatgtg

SEQ ID NO: 35217 - DNA, 25 bp, Homo sapien
attgactaggtccgtgttaagtgta

SEQ ID NO: 35218 - DNA, 25 bp, Homo sapien
attgactaggtctgtgttaagtgta

SEQ ID NO: 35219 - DNA, 25 bp, Homo sapien
attgactagtagctagaaatatgtg

SEQ ID NO: 35220 - DNA, 25 bp, Homo sapien
attgactggaacgcttttggccgac

SEQ ID NO: 35221 - DNA, 25 bp, Homo sapien
attgactggaacgtttttggccgac

SEQ ID NO: 35222 - DNA, 25 bp, Homo sapien
attgactgggaacaagccgagaata

SEQ ID NO: 35223 - DNA, 25 bp, Homo sapien
attgactgggaataagccgagaata

SEQ ID NO: 35224 - DNA, 25 bp, Homo sapien
attgactgtttattcccaattgcac

SEQ ID NO: 35225 - DNA, 25 bp, Homo sapien
attgactgtttattcctaattgcac

SEQ ID NO: 35226 - DNA, 25 bp, Homo sapien
attgagaaaatggcaataaaaagaa

SEQ ID NO: 35227 - DNA, 25 bp, Homo sapien
attgagaaaatggcgataaaaagaa

SEQ ID NO: 35228 - DNA, 25 bp, Homo sapien
attgagaacctctactctaggagaa

SEQ ID NO: 35229 - DNA, 25 bp, Homo sapien
attgagaacctctgctctaggagaa

SEQ ID NO: 35230 - DNA, 25 bp, Homo sapien
attgagaagagttaggaaataaagt

SEQ ID NO: 35231 - DNA, 25 bp, Homo sapien
attgagaagagtttggaaataaagt

SEQ ID NO: 35232 - DNA, 25 bp, Homo sapien
attgagaccgagaggaagtagataa

SEQ ID NO: 35233 - DNA, 25 bp, Homo sapien
attgagactgagaggaagtagataa

SEQ ID NO: 35234 - DNA, 25 bp, Homo sapien
attgagatacgtattacatgttgtt

SEQ ID NO: 35235 - DNA, 25 bp, Homo sapien
attgagatatgtattacatgttgtt

SEQ ID NO: 35236 - DNA, 25 bp, Homo sapien
attgagattaatggaattgtctctc

SEQ ID NO: 35237 - DNA, 25 bp, Homo sapien
attgagattaattgaattgtctctc

SEQ ID NO: 35238 - DNA, 25 bp, Homo sapien
attgagcagaattccggagttgagg

SEQ ID NO: 35239 - DNA, 25 bp, Homo sapien
attgagcagaattctggagttgagg

SEQ ID NO: 35240 - DNA, 25 bp, Homo sapien
attgagcagtcaagagaaaaaatgt

SEQ ID NO: 35241 - DNA, 25 bp, Homo sapien
attgagcagtcaagggaaaaaatgt

SEQ ID NO: 35242 - DNA, 25 bp, Homo sapien
attgagcatctatactatgtcaggt

SEQ ID NO: 35243 - DNA, 25 bp, Homo sapien
attgagcatctatactgtgtcaggt

SEQ ID NO: 35244 - DNA, 25 bp, Homo sapien
attgagcattacaataagtgctgag

SEQ ID NO: 35245 - DNA, 25 bp, Homo sapien
attgagcattataataagtgctgag

SEQ ID NO: 35246 - DNA, 25 bp, Homo sapien
attgagcatttaaccccttggtgat

SEQ ID NO: 35247 - DNA, 25 bp, Homo sapien
attgagcatttaacccgttggtgat

SEQ ID NO: 35248 - DNA, 25 bp, Homo sapien
attgagccaagcagcttaaaacaac

SEQ ID NO: 35249 - DNA, 25 bp, Homo sapien
attgagccaagctgcttaaaacaac

SEQ ID NO: 35250 - DNA, 25 bp, Homo sapien
attgagccaccatttaagaaatctg

SEQ ID NO: 35251 - DNA, 25 bp, Homo sapien
attgagccatcatttaagaaatctg

SEQ ID NO: 35252 - DNA, 25 bp, Homo sapien
attgaggaatggaggaactgcttac

SEQ ID NO: 35253 - DNA, 25 bp, Homo sapien
attgaggactcacgtagtaaggtgt

SEQ ID NO: 35254 - DNA, 25 bp, Homo sapien
attgaggactcatgtagtaaggtgt

SEQ ID NO: 35255 - DNA, 25 bp, Homo sapien
attgaggactggaggaactgcttac

SEQ ID NO: 35256 - DNA, 25 bp, Homo sapien
attgaggtatagagatgttaaccac

SEQ ID NO: 35257 - DNA, 25 bp, Homo sapien
attgaggtatagagattttaaccac

SEQ ID NO: 35258 - DNA, 25 bp, Homo sapien
attgaggtcaaatgaactgtcagca

SEQ ID NO: 35259 - DNA, 25 bp, Homo sapien
attgaggtcaactgaactgtcagca

SEQ ID NO: 35260 - DNA, 25 bp, Homo sapien
attgaggttatggcttcccttacat

SEQ ID NO: 35261 - DNA, 25 bp, Homo sapien
attgaggttatggctttccttacat

SEQ ID NO: 35262 - DNA, 25 bp, Homo sapien
attgagtaacttctatgtgccaggt

SEQ ID NO: 35263 - DNA, 25 bp, Homo sapien
attgagtaacttctgtgtgccaggt

SEQ ID NO: 35264 - DNA, 25 bp, Homo sapien
attgagtacctattgatatgtgtgg

SEQ ID NO: 35265 - DNA, 25 bp, Homo sapien
attgagtacctgttgatatgtgtgg

SEQ ID NO: 35266 - DNA, 25 bp, Homo sapien
attgagtattcacctgtaagatagt

SEQ ID NO: 35267 - DNA, 25 bp, Homo sapien
attgagtattcatctgtaagatagt

SEQ ID NO: 35268 - DNA, 25 bp, Homo sapien
attgagtgaattcattacccaatcc

SEQ ID NO: 35269 - DNA, 25 bp, Homo sapien
attgagtgaattgattacccaatcc

SEQ ID NO: 35270 - DNA, 25 bp, Homo sapien
attgatacagaaagagctttcaata

SEQ ID NO: 35271 - DNA, 25 bp, Homo sapien
attgatacagaaagagttttcaata

SEQ ID NO: 35272 - DNA, 25 bp, Homo sapien
attgatagctatggtaaaataagga

SEQ ID NO: 35273 - DNA, 25 bp, Homo sapien
attgatagctatgttaaaataagga

SEQ ID NO: 35274 - DNA, 25 bp, Homo sapien
attgatcgaggaatatgttattatt

SEQ ID NO: 35275 - DNA, 25 bp, Homo sapien
attgatcgaggattatgttattatt

SEQ ID NO: 35276 - DNA, 25 bp, Homo sapien
attgatgatcaactgatttttgaca

SEQ ID NO: 35277 - DNA, 25 bp, Homo sapien
attgatgatcaattgatttttgaca

SEQ ID NO: 35278 - DNA, 25 bp, Homo sapien
attgatgcattttgtgtatgataaa

SEQ ID NO: 35279 - DNA, 25 bp, Homo sapien
attgatgcattttttgtatgataaa

SEQ ID NO: 35280 - DNA, 25 bp, Homo sapien
attgatggataaatttttctcagaa

SEQ ID NO: 35281 - DNA, 25 bp, Homo sapien
attgatggataactttttctcagaa

SEQ ID NO: 35282 - DNA, 25 bp, Homo sapien
attgatggatgtgtcatgtctccct

SEQ ID NO: 35283 - DNA, 25 bp, Homo sapien
attgatggatgtgttatgtctccct

SEQ ID NO: 35284 - DNA, 25 bp, Homo sapien
attgatggcctcaaaagatagtgcc

SEQ ID NO: 35285 - DNA, 25 bp, Homo sapien
attgatggctataatggcattttgg

SEQ ID NO: 35286 - DNA, 25 bp, Homo sapien
attgatggctttattttctaagatg

SEQ ID NO: 35287 - DNA, 25 bp, Homo sapien
attgatgggtataatggcattttgg

SEQ ID NO: 35288 - DNA, 25 bp, Homo sapien
attgatggtctcaaaagatagtgcc

SEQ ID NO: 35289 - DNA, 25 bp, Homo sapien
attgatggttttattttctaagatg

SEQ ID NO: 35290 - DNA, 25 bp, Homo sapien
attgatgtctgaatcgattggcagt

SEQ ID NO: 35291 - DNA, 25 bp, Homo sapien
attgatgtctgaattgattggcagt

SEQ ID NO: 35292 - DNA, 25 bp, Homo sapien
attgattaccgataaaagtttgttt

SEQ ID NO: 35293 - DNA, 25 bp, Homo sapien
attgattaccggtaaaagtttgttt

SEQ ID NO: 35294 - DNA, 25 bp, Homo sapien
attgattacctgagttgcaaaaaga

SEQ ID NO: 35295 - DNA, 25 bp, Homo sapien
attgattacctgggttgcaaaaaga

SEQ ID NO: 35296 - DNA, 25 bp, Homo sapien
attgattccctgcaaaaccaaactt

SEQ ID NO: 35297 - DNA, 25 bp, Homo sapien
attgattccctgccaaaccaaactt

SEQ ID NO: 35298 - DNA, 25 bp, Homo sapien
attgattctggaatgaaattaagta

SEQ ID NO: 35299 - DNA, 25 bp, Homo sapien
attgattctgggatgaaattaagta

SEQ ID NO: 35300 - DNA, 25 bp, Homo sapien
attgatttctacagcacaacctagc

SEQ ID NO: 35301 - DNA, 25 bp, Homo sapien
attgatttctacagcataacctagc

SEQ ID NO: 35302 - DNA, 25 bp, Homo sapien
attgatttgaaggagtcagacaggc

SEQ ID NO: 35303 - DNA, 25 bp, Homo sapien
attgatttgaaggcgtcagacaggc

SEQ ID NO: 35304 - DNA, 25 bp, Homo sapien
attgatttgtgcatctgtaaaatgg

SEQ ID NO: 35305 - DNA, 25 bp, Homo sapien
attgatttgtgtatctgtaaaatgg

SEQ ID NO: 35306 - DNA, 25 bp, Homo sapien
attgcaaaatttactactgagacag

SEQ ID NO: 35307 - DNA, 25 bp, Homo sapien
attgcaaaggaagatccacatctat

SEQ ID NO: 35308 - DNA, 25 bp, Homo sapien
attgcaaaggaggatccacatctat

SEQ ID NO: 35309 - DNA, 25 bp, Homo sapien
attgcaaagtttactactgagacag

SEQ ID NO: 35310 - DNA, 25 bp, Homo sapien
attgcaaatgtcttaccacttgttc

SEQ ID NO: 35311 - DNA, 25 bp, Homo sapien
attgcaaatgtcttcccacttgttc

SEQ ID NO: 35312 - DNA, 25 bp, Homo sapien
attgcaaccatttatctaataagag

SEQ ID NO: 35313 - DNA, 25 bp, Homo sapien
attgcaaccgtttatctaataagag

SEQ ID NO: 35314 - DNA, 25 bp, Homo sapien
attgcaacttgtttggctcttcctc

SEQ ID NO: 35315 - DNA, 25 bp, Homo sapien
attgcaacttgtttggttcttcctc

SEQ ID NO: 35316 - DNA, 25 bp, Homo sapien
attgcaagagaataggcctgagtct

SEQ ID NO: 35317 - DNA, 25 bp, Homo sapien
attgcaagagaataggtctgagtct

SEQ ID NO: 35318 - DNA, 25 bp, Homo sapien
attgcaagagccatggaggactctg

SEQ ID NO: 35319 - DNA, 25 bp, Homo sapien
attgcaagagccgtggaggactctg

SEQ ID NO: 35320 - DNA, 25 bp, Homo sapien
attgcaatgaatcttctcattctaa

SEQ ID NO: 35321 - DNA, 25 bp, Homo sapien
attgcaatgattcaagagggagagg

SEQ ID NO: 35322 - DNA, 25 bp, Homo sapien
attgcaatgattcaggagggagagg

SEQ ID NO: 35323 - DNA, 25 bp, Homo sapien
attgcaattaatcttctcattctaa

SEQ ID NO: 35324 - DNA, 25 bp, Homo sapien
attgcacaggacaaactcaatcatg

SEQ ID NO: 35325 - DNA, 25 bp, Homo sapien
attgcacaggacaagctcaatcatg

SEQ ID NO: 35326 - DNA, 25 bp, Homo sapien
attgcacatgcattaaaaaaaagaa

SEQ ID NO: 35327 - DNA, 25 bp, Homo sapien
attgcacatgcgttaaaaaaaagaa

SEQ ID NO: 35328 - DNA, 25 bp, Homo sapien
attgcaccagcgggcttcttagcct

SEQ ID NO: 35329 - DNA, 25 bp, Homo sapien
attgcaccatcgggcttcttagcct

SEQ ID NO: 35330 - DNA, 25 bp, Homo sapien
attgcacctctacactatagcctgg

SEQ ID NO: 35331 - DNA, 25 bp, Homo sapien
attgcacctctgcactatagcctgg

SEQ ID NO: 35332 - DNA, 25 bp, Homo sapien
attgcagagacaaccaccaatagtg

SEQ ID NO: 35333 - DNA, 25 bp, Homo sapien
attgcagagacaatcaccaatagtg

SEQ ID NO: 35334 - DNA, 25 bp, Homo sapien
attgcagatgaaagacaaaagtacc

SEQ ID NO: 35335 - DNA, 25 bp, Homo sapien
attgcagatgaaagacgaaagtacc

SEQ ID NO: 35336 - DNA, 25 bp, Homo sapien
attgcagcaacagaaacctattaag

SEQ ID NO: 35337 - DNA, 25 bp, Homo sapien
attgcagcaacagaaatctattaag

SEQ ID NO: 35338 - DNA, 25 bp, Homo sapien
attgcagtaacttaacacaacaaag

SEQ ID NO: 35339 - DNA, 25 bp, Homo sapien
attgcagtctaatactcaaaatttc

SEQ ID NO: 35340 - DNA, 25 bp, Homo sapien
attgcagtctaatattcaaaatttc

SEQ ID NO: 35341 - DNA, 25 bp, Homo sapien
attgcagtgacttaacacaacaaag

SEQ ID NO: 35342 - DNA, 25 bp, Homo sapien
attgcagtgattaaattgaagctct

SEQ ID NO: 35343 - DNA, 25 bp, Homo sapien
attgcagtgattgaattgaagctct

SEQ ID NO: 35344 - DNA, 25 bp, Homo sapien
attgcagttccccgtaaatagggtg

SEQ ID NO: 35345 - DNA, 25 bp, Homo sapien
attgcagttccctgtaaatagggtg

SEQ ID NO: 35346 - DNA, 25 bp, Homo sapien
attgcataaaagaataatttaaaac

SEQ ID NO: 35347 - DNA, 25 bp, Homo sapien
attgcataaaagaatattttaaaac

SEQ ID NO: 35348 - DNA, 25 bp, Homo sapien
attgcataataaggggtatcagatt

SEQ ID NO: 35349 - DNA, 25 bp, Homo sapien
attgcatagtaaggggtatcagatt

SEQ ID NO: 35350 - DNA, 25 bp, Homo sapien
attgcatctcaattatccaggcatg

SEQ ID NO: 35351 - DNA, 25 bp, Homo sapien
attgcatctcaattttccaggcatg

SEQ ID NO: 35352 - DNA, 25 bp, Homo sapien
attgcatgcctccgctgagctgtca

SEQ ID NO: 35353 - DNA, 25 bp, Homo sapien
attgcatgcctctgctgagctgtca

SEQ ID NO: 35354 - DNA, 25 bp, Homo sapien
attgccaagcacaagtaaaataagg

SEQ ID NO: 35355 - DNA, 25 bp, Homo sapien
attgccaagcataagtaaaataagg

SEQ ID NO: 35356 - DNA, 25 bp, Homo sapien
attgccaattctctcccctgaaacc

SEQ ID NO: 35357 - DNA, 25 bp, Homo sapien
attgccaattctttcccctgaaacc

SEQ ID NO: 35358 - DNA, 25 bp, Homo sapien
attgccactatttatttttctgata

SEQ ID NO: 35359 - DNA, 25 bp, Homo sapien
attgccactatttctttttctgata

SEQ ID NO: 35360 - DNA, 25 bp, Homo sapien
attgccactttcatggactagtgca

SEQ ID NO: 35361 - DNA, 25 bp, Homo sapien
attgccacttttatggactagtgca

SEQ ID NO: 35362 - DNA, 25 bp, Homo sapien
attgccagcactgcaaacatacttc

SEQ ID NO: 35363 - DNA, 25 bp, Homo sapien
attgccagcactgcaaccatacttc

SEQ ID NO: 35364 - DNA, 25 bp, Homo sapien
attgccagcaggtcagaaccctgtg

SEQ ID NO: 35365 - DNA, 25 bp, Homo sapien
attgccagcgggtcagaaccctgtg

SEQ ID NO: 35366 - DNA, 25 bp, Homo sapien
attgccaggtgaacaccacagccaa

SEQ ID NO: 35367 - DNA, 25 bp, Homo sapien
attgccaggtgagcaccacagccaa

SEQ ID NO: 35368 - DNA, 25 bp, Homo sapien
attgccgtccacgctaagccttttg

SEQ ID NO: 35369 - DNA, 25 bp, Homo sapien
attgccgtctacgctaagccttttg

SEQ ID NO: 35370 - DNA, 25 bp, Homo sapien
attgcctaactgggtatgatgctgt

SEQ ID NO: 35371 - DNA, 25 bp, Homo sapien
attgcctaattgggtatgatgctgt

SEQ ID NO: 35372 - DNA, 25 bp, Homo sapien
attgcctcaagcatgctgaacttgg

SEQ ID NO: 35373 - DNA, 25 bp, Homo sapien
attgcctcaagcattctgaacttgg

SEQ ID NO: 35374 - DNA, 25 bp, Homo sapien
attgcctcactcaacttatttgtac

SEQ ID NO: 35375 - DNA, 25 bp, Homo sapien
attgcctcactcatcttatttgtac

SEQ ID NO: 35376 - DNA, 25 bp, Homo sapien
attgcctggaaatgtgacggtccgg

SEQ ID NO: 35377 - DNA, 25 bp, Homo sapien
attgcctggaaatttgacggtccgg

SEQ ID NO: 35378 - DNA, 25 bp, Homo sapien
attgcctggccatgtatcttttggg

SEQ ID NO: 35379 - DNA, 25 bp, Homo sapien
attgcctggccttgtatcttttggg

SEQ ID NO: 35380 - DNA, 25 bp, Homo sapien
attgcctttacacacactgatgcat

SEQ ID NO: 35381 - DNA, 25 bp, Homo sapien
attgcctttacatacactgatgcat

SEQ ID NO: 35382 - DNA, 25 bp, Homo sapien
attgctaaaagcccagacattttaa

SEQ ID NO: 35383 - DNA, 25 bp, Homo sapien
attgctaaaagcccggacattttaa

SEQ ID NO: 35384 - DNA, 25 bp, Homo sapien
attgctaaactacgcaggccctctt

SEQ ID NO: 35385 - DNA, 25 bp, Homo sapien
attgctaaactatgcaggccctctt

SEQ ID NO: 35386 - DNA, 25 bp, Homo sapien
attgctaaacttctggtattgtttc

SEQ ID NO: 35387 - DNA, 25 bp, Homo sapien
attgctaaagaacattcttggcaag

SEQ ID NO: 35388 - DNA, 25 bp, Homo sapien
attgctaaagaacgttcttggcaag

SEQ ID NO: 35389 - DNA, 25 bp, Homo sapien
attgctaaagagaagtagctgagat

SEQ ID NO: 35390 - DNA, 25 bp, Homo sapien
attgctaaatctcttgcacaggtat

SEQ ID NO: 35391 - DNA, 25 bp, Homo sapien
attgctaaatctgttgcacaggtat

SEQ ID NO: 35392 - DNA, 25 bp, Homo sapien
attgctaacagagaagtgtgaggag

SEQ ID NO: 35393 - DNA, 25 bp, Homo sapien
attgctaacagagaggtgtgaggag

SEQ ID NO: 35394 - DNA, 25 bp, Homo sapien
attgctaaggagaagtagctgagat

SEQ ID NO: 35395 - DNA, 25 bp, Homo sapien
attgctaagtagtactccattttat

SEQ ID NO: 35396 - DNA, 25 bp, Homo sapien
attgctaagtagtattccattttat

SEQ ID NO: 35397 - DNA, 25 bp, Homo sapien
attgctaatcttctggtattgtttc

SEQ ID NO: 35398 - DNA, 25 bp, Homo sapien
attgctaatgaaagatatgttgact

SEQ ID NO: 35399 - DNA, 25 bp, Homo sapien
attgctaatgaaggatatgttgact

SEQ ID NO: 35400 - DNA, 25 bp, Homo sapien
attgctacaaactaatgactaatga

SEQ ID NO: 35401 - DNA, 25 bp, Homo sapien
attgctacaaactgatgactaatga

SEQ ID NO: 35402 - DNA, 25 bp, Homo sapien
attgctagactcgctttgctaacat

SEQ ID NO: 35403 - DNA, 25 bp, Homo sapien
attgctagactcgttttgctaacat

SEQ ID NO: 35404 - DNA, 25 bp, Homo sapien
attgctatggattactcttcatcaa

SEQ ID NO: 35405 - DNA, 25 bp, Homo sapien
attgctatggattattcttcatcaa

SEQ ID NO: 35406 - DNA, 25 bp, Homo sapien
attgctcagatgtccccctggtagt

SEQ ID NO: 35407 - DNA, 25 bp, Homo sapien
attgctcagatgttcccctggtagt

SEQ ID NO: 35408 - DNA, 25 bp, Homo sapien
attgctcagttattctcattcatgt

SEQ ID NO: 35409 - DNA, 25 bp, Homo sapien
attgctcatagtactggaggcaaga

SEQ ID NO: 35410 - DNA, 25 bp, Homo sapien
attgctcatagtagtggaggcaaga

SEQ ID NO: 35411 - DNA, 25 bp, Homo sapien
attgctcatttattctcattcatgt

SEQ ID NO: 35412 - DNA, 25 bp, Homo sapien
attgctcccatctgcgcactttgag

SEQ ID NO: 35413 - DNA, 25 bp, Homo sapien
attgctcccatctgggcactttgag

SEQ ID NO: 35414 - DNA, 25 bp, Homo sapien
attgctcctcacaagcttaaaatcc

SEQ ID NO: 35415 - DNA, 25 bp, Homo sapien
attgctcctcataagcttaaaatcc

SEQ ID NO: 35416 - DNA, 25 bp, Homo sapien
attgctccttacatgtcagaagcac

SEQ ID NO: 35417 - DNA, 25 bp, Homo sapien
attgctccttacgtgtcagaagcac

SEQ ID NO: 35418 - DNA, 25 bp, Homo sapien
attgctccttataacaaaatgacca

SEQ ID NO: 35419 - DNA, 25 bp, Homo sapien
attgctccttataataaaatgacca

SEQ ID NO: 35420 - DNA, 25 bp, Homo sapien
attgctgaaggctgcaatagctgtg

SEQ ID NO: 35421 - DNA, 25 bp, Homo sapien
attgctgaaggctggaatagctgtg

SEQ ID NO: 35422 - DNA, 25 bp, Homo sapien
attgctgagaaaacaagtaagttac

SEQ ID NO: 35423 - DNA, 25 bp, Homo sapien
attgctgagaaaataagtaagttac

SEQ ID NO: 35424 - DNA, 25 bp, Homo sapien
attgctgcaggtagagactacattt

SEQ ID NO: 35425 - DNA, 25 bp, Homo sapien
attgctgcaggtggagactacattt

SEQ ID NO: 35426 - DNA, 25 bp, Homo sapien
attgctgtttctcaatgattctcac

SEQ ID NO: 35427 - DNA, 25 bp, Homo sapien
attgctgtttctcattgattctcac

SEQ ID NO: 35428 - DNA, 25 bp, Homo sapien
attgcttaggtaaggtatgtatgtg

SEQ ID NO: 35429 - DNA, 25 bp, Homo sapien
attgcttatgctcgaattgatttgt

SEQ ID NO: 35430 - DNA, 25 bp, Homo sapien
attgcttatgcttgaattgatttgt

SEQ ID NO: 35431 - DNA, 25 bp, Homo sapien
attgcttatgtaaggtatgtatgtg

SEQ ID NO: 35432 - DNA, 25 bp, Homo sapien
attgcttcaccatcaattaatgttg

SEQ ID NO: 35433 - DNA, 25 bp, Homo sapien
attgcttcaccgtcaattaatgttg

SEQ ID NO: 35434 - DNA, 25 bp, Homo sapien
attgcttcatccctgccccatagta

SEQ ID NO: 35435 - DNA, 25 bp, Homo sapien
attgcttcgtccctgccccatagta

SEQ ID NO: 35436 - DNA, 25 bp, Homo sapien
attgcttctcggtctgtaaatccaa

SEQ ID NO: 35437 - DNA, 25 bp, Homo sapien
attgcttcttggtctgtaaatccaa

SEQ ID NO: 35438 - DNA, 25 bp, Homo sapien
attgcttgcctcataagacttccaa

SEQ ID NO: 35439 - DNA, 25 bp, Homo sapien
attgcttgcctcgtaagacttccaa

SEQ ID NO: 35440 - DNA, 25 bp, Homo sapien
attgctttactttatacaaacacat

SEQ ID NO: 35441 - DNA, 25 bp, Homo sapien
attgctttcgcttcattacacttgt

SEQ ID NO: 35442 - DNA, 25 bp, Homo sapien
attgctttgctttatacaaacacat

SEQ ID NO: 35443 - DNA, 25 bp, Homo sapien
attgcttttgcttcattacacttgt

SEQ ID NO: 35444 - DNA, 25 bp, Homo sapien
attgctttttcatgggaatgtagag

SEQ ID NO: 35445 - DNA, 25 bp, Homo sapien
attgctttttcgtgggaatgtagag

SEQ ID NO: 35446 - DNA, 25 bp, Homo sapien
attggaaagacatcagaaataccaa

SEQ ID NO: 35447 - DNA, 25 bp, Homo sapien
attggaaagacatcggaaataccaa

SEQ ID NO: 35448 - DNA, 25 bp, Homo sapien
attggaacccttgcgcaccgttggt

SEQ ID NO: 35449 - DNA, 25 bp, Homo sapien
attggaactcttgcgcaccgttggt

SEQ ID NO: 35450 - DNA, 25 bp, Homo sapien
attggacaaaagacgataatgttta

SEQ ID NO: 35451 - DNA, 25 bp, Homo sapien
attggacaaaagatgataatgttta

SEQ ID NO: 35452 - DNA, 25 bp, Homo sapien
attggacacactgatcaatcatgcc

SEQ ID NO: 35453 - DNA, 25 bp, Homo sapien
attggacactaccaatttcatgtat

SEQ ID NO: 35454 - DNA, 25 bp, Homo sapien
attggacactactaatttcatgtat

SEQ ID NO: 35455 - DNA, 25 bp, Homo sapien
attggacactctgatcaatcatgcc

SEQ ID NO: 35456 - DNA, 25 bp, Homo sapien
attggacagcaagagacgaagttga

SEQ ID NO: 35457 - DNA, 25 bp, Homo sapien
attggacagcaagagatgaagttga

SEQ ID NO: 35458 - DNA, 25 bp, Homo sapien
attggaccaagagtacaaagttctc

SEQ ID NO: 35459 - DNA, 25 bp, Homo sapien
attggaccaagagtaccaagttctc

SEQ ID NO: 35460 - DNA, 25 bp, Homo sapien
attggagagattcatctacaagtca

SEQ ID NO: 35461 - DNA, 25 bp, Homo sapien
attggagagattgatctacaagtca

SEQ ID NO: 35462 - DNA, 25 bp, Homo sapien
attggagcctcttaaattgaaggag

SEQ ID NO: 35463 - DNA, 25 bp, Homo sapien
attggagcttcttaaattgaaggag

SEQ ID NO: 35464 - DNA, 25 bp, Homo sapien
attggagtcacaatgcatagctgag

SEQ ID NO: 35465 - DNA, 25 bp, Homo sapien
attggagtcaccatgcatagctgag

SEQ ID NO: 35466 - DNA, 25 bp, Homo sapien
attggagttatagcatgagaggaaa

SEQ ID NO: 35467 - DNA, 25 bp, Homo sapien
attggagttctagcatgagaggaaa

SEQ ID NO: 35468 - DNA, 25 bp, Homo sapien
attggagttcttgcatttaagcctg

SEQ ID NO: 35469 - DNA, 25 bp, Homo sapien
attggagttcttgcgtttaagcctg

SEQ ID NO: 35470 - DNA, 25 bp, Homo sapien
attggataactcaaaccgccaaatt

SEQ ID NO: 35471 - DNA, 25 bp, Homo sapien
attggataactcaaactgccaaatt

SEQ ID NO: 35472 - DNA, 25 bp, Homo sapien
attggataagtgaaaacaatgactt

SEQ ID NO: 35473 - DNA, 25 bp, Homo sapien
attggataattgaaaacaatgactt

SEQ ID NO: 35474 - DNA, 25 bp, Homo sapien
attggataggtaacccacagtcaca

SEQ ID NO: 35475 - DNA, 25 bp, Homo sapien
attggataggtaccccacagtcaca

SEQ ID NO: 35476 - DNA, 25 bp, Homo sapien
attggattacatacttcgaagtgac

SEQ ID NO: 35477 - DNA, 25 bp, Homo sapien
attggattacatatttcgaagtgac

SEQ ID NO: 35478 - DNA, 25 bp, Homo sapien
attggattagacaaacatttcttag

SEQ ID NO: 35479 - DNA, 25 bp, Homo sapien
attggattatacaaacatttcttag

SEQ ID NO: 35480 - DNA, 25 bp, Homo sapien
attggatttccatggttttttttgt

SEQ ID NO: 35481 - DNA, 25 bp, Homo sapien
attggattttcatggttttttttgt

SEQ ID NO: 35482 - DNA, 25 bp, Homo sapien
attggcaactaatatcaccatgaga

SEQ ID NO: 35483 - DNA, 25 bp, Homo sapien
attggcaactaatgtcaccatgaga

SEQ ID NO: 35484 - DNA, 25 bp, Homo sapien
attggcagagataaacaattaaatt

SEQ ID NO: 35485 - DNA, 25 bp, Homo sapien
attggcagagataagcaattaaatt

SEQ ID NO: 35486 - DNA, 25 bp, Homo sapien
attggcagggaccaaaataacatac

SEQ ID NO: 35487 - DNA, 25 bp, Homo sapien
attggcagggacgaaaataacatac

SEQ ID NO: 35488 - DNA, 25 bp, Homo sapien
attggccaaggacgtcgtagttgga

SEQ ID NO: 35489 - DNA, 25 bp, Homo sapien
attggccaaggacttcgtagttgga

SEQ ID NO: 35490 - DNA, 25 bp, Homo sapien
attggcgtaacatacatactattga

SEQ ID NO: 35491 - DNA, 25 bp, Homo sapien
attggcgtaacatatatactattga

SEQ ID NO: 35492 - DNA, 25 bp, Homo sapien
attggctaggaaaatgaatatttac

SEQ ID NO: 35493 - DNA, 25 bp, Homo sapien
attggctaggaaagtgaatatttac

SEQ ID NO: 35494 - DNA, 25 bp, Homo sapien
attggctccactgttggtcaagatc

SEQ ID NO: 35495 - DNA, 25 bp, Homo sapien
attggctccgctgttggtcaagatc

SEQ ID NO: 35496 - DNA, 25 bp, Homo sapien
attggctgggaccggtcatgtgtct

SEQ ID NO: 35497 - DNA, 25 bp, Homo sapien
attggctgggactggtcatgtgtct

SEQ ID NO: 35498 - DNA, 25 bp, Homo sapien
attgggaaacactcttgccagcaaa

SEQ ID NO: 35499 - DNA, 25 bp, Homo sapien
attgggaaagacatattcagcatct

SEQ ID NO: 35500 - DNA, 25 bp, Homo sapien
attgggaaagatatattcagcatct

SEQ ID NO: 35501 - DNA, 25 bp, Homo sapien
attgggaaatactcttgccagcaaa

SEQ ID NO: 35502 - DNA, 25 bp, Homo sapien
attgggagaatataaagccaatgta

SEQ ID NO: 35503 - DNA, 25 bp, Homo sapien
attgggagaatatgaagccaatgta

SEQ ID NO: 35504 - DNA, 25 bp, Homo sapien
attgggattgactgcatttgtgtgt

SEQ ID NO: 35505 - DNA, 25 bp, Homo sapien
attgggattgattgcatttgtgtgt

SEQ ID NO: 35506 - DNA, 25 bp, Homo sapien
attgggccagaagaaagttctagat

SEQ ID NO: 35507 - DNA, 25 bp, Homo sapien
attgggccagaaggaagttctagat

SEQ ID NO: 35508 - DNA, 25 bp, Homo sapien
attgggccagactcttcctatgtgg

SEQ ID NO: 35509 - DNA, 25 bp, Homo sapien
attgggccagacttttcctatgtgg

SEQ ID NO: 35510 - DNA, 25 bp, Homo sapien
attggggaagtaccctcggatcact

SEQ ID NO: 35511 - DNA, 25 bp, Homo sapien
attggggaagtcccctcggatcact

SEQ ID NO: 35512 - DNA, 25 bp, Homo sapien
attgggtaaacagttcttaggagtc

SEQ ID NO: 35513 - DNA, 25 bp, Homo sapien
attgggtatacagttcttaggagtc

SEQ ID NO: 35514 - DNA, 25 bp, Homo sapien
attgggtgcttattccctggctccc

SEQ ID NO: 35515 - DNA, 25 bp, Homo sapien
attgggtgtagacagtaaatacaca

SEQ ID NO: 35516 - DNA, 25 bp, Homo sapien
attgggtgtagatagtaaatacaca

SEQ ID NO: 35517 - DNA, 25 bp, Homo sapien
attgggtgtttattccctggctccc

SEQ ID NO: 35518 - DNA, 25 bp, Homo sapien
attggtaccccagcgggttcaacag

SEQ ID NO: 35519 - DNA, 25 bp, Homo sapien
attggtaccccagtgggttcaacag

SEQ ID NO: 35520 - DNA, 25 bp, Homo sapien
attggtactattaactgccaaccac

SEQ ID NO: 35521 - DNA, 25 bp, Homo sapien
attggtactgttaactgccaaccac

SEQ ID NO: 35522 - DNA, 25 bp, Homo sapien
attggtcaatatgcatagcaagtca

SEQ ID NO: 35523 - DNA, 25 bp, Homo sapien
attggtcaatatgcgtagcaagtca

SEQ ID NO: 35524 - DNA, 25 bp, Homo sapien
attggtgacaggccaaatacgaaaa

SEQ ID NO: 35525 - DNA, 25 bp, Homo sapien
attggtgagaggccaaatacgaaaa

SEQ ID NO: 35526 - DNA, 25 bp, Homo sapien
attggtgcaaatgcaggtattgtaa

SEQ ID NO: 35527 - DNA, 25 bp, Homo sapien
attggtgcagatgcaggtattgtaa

SEQ ID NO: 35528 - DNA, 25 bp, Homo sapien
attggtgggatttaaatcaaaccag

SEQ ID NO: 35529 - DNA, 25 bp, Homo sapien
attggtgggattttaatcaaaccag

SEQ ID NO: 35530 - DNA, 25 bp, Homo sapien
attggtgtatcgattcctattgact

SEQ ID NO: 35531 - DNA, 25 bp, Homo sapien
attggtgtatcgattcttattgact

SEQ ID NO: 35532 - DNA, 25 bp, Homo sapien
attggttcaatcatccgtctactat

SEQ ID NO: 35533 - DNA, 25 bp, Homo sapien
attggttcaatcgtccgtctactat

SEQ ID NO: 35534 - DNA, 25 bp, Homo sapien
attggttgacatccacctgatcacc

SEQ ID NO: 35535 - DNA, 25 bp, Homo sapien
attggttgacatcctcctgatcacc

SEQ ID NO: 35536 - DNA, 25 bp, Homo sapien
attggttgtcttatttcatctagat

SEQ ID NO: 35537 - DNA, 25 bp, Homo sapien
attggttgttttatttcatctagat

SEQ ID NO: 35538 - DNA, 25 bp, Homo sapien
attggttttttggatgcgaatggaa

SEQ ID NO: 35539 - DNA, 25 bp, Homo sapien
attggttttttggatgtgaatggaa

SEQ ID NO: 35540 - DNA, 25 bp, Homo sapien
attgtaaataaaacgggtagcagct

SEQ ID NO: 35541 - DNA, 25 bp, Homo sapien
attgtaaataaaacggttagcagct

SEQ ID NO: 35542 - DNA, 25 bp, Homo sapien
attgtaaatataggattaaagtgca

SEQ ID NO: 35543 - DNA, 25 bp, Homo sapien
attgtaaatatgggattaaagtgca

SEQ ID NO: 35544 - DNA, 25 bp, Homo sapien
attgtaaatcttttttcggacaaag

SEQ ID NO: 35545 - DNA, 25 bp, Homo sapien
attgtaaatctttttttggacaaag

SEQ ID NO: 35546 - DNA, 25 bp, Homo sapien
attgtaaattggcagtgtgtatggc

SEQ ID NO: 35547 - DNA, 25 bp, Homo sapien
attgtaaattggtagtgtgtatggc

SEQ ID NO: 35548 - DNA, 25 bp, Homo sapien
attgtaacaaggatgatgtaatttt

SEQ ID NO: 35549 - DNA, 25 bp, Homo sapien
attgtaacaaggattatgtaatttt

SEQ ID NO: 35550 - DNA, 25 bp, Homo sapien
attgtaagtacaagtgtcagccatc

SEQ ID NO: 35551 - DNA, 25 bp, Homo sapien
attgtaagtacgagtgtcagccatc

SEQ ID NO: 35552 - DNA, 25 bp, Homo sapien
attgtaatcggagcagggctgcagc

SEQ ID NO: 35553 - DNA, 25 bp, Homo sapien
attgtaattggagcagggctgcagc

SEQ ID NO: 35554 - DNA, 25 bp, Homo sapien
attgtacaactatccatgcaaaaga

SEQ ID NO: 35555 - DNA, 25 bp, Homo sapien
attgtacaagtatccatgcaaaaga

SEQ ID NO: 35556 - DNA, 25 bp, Homo sapien
attgtacaataattcccagtgttgg

SEQ ID NO: 35557 - DNA, 25 bp, Homo sapien
attgtacacaggtactgaaacatca

SEQ ID NO: 35558 - DNA, 25 bp, Homo sapien
attgtacacaggtattgaaacatca

SEQ ID NO: 35559 - DNA, 25 bp, Homo sapien
attgtacagtaattcccagtgttgg

SEQ ID NO: 35560 - DNA, 25 bp, Homo sapien
attgtacatccaactcgttgttttc

SEQ ID NO: 35561 - DNA, 25 bp, Homo sapien
attgtacatccacctcgttgttttc

SEQ ID NO: 35562 - DNA, 25 bp, Homo sapien
attgtagaaaccacagagtgacagg

SEQ ID NO: 35563 - DNA, 25 bp, Homo sapien
attgtagaaaccacggagtgacagg

SEQ ID NO: 35564 - DNA, 25 bp, Homo sapien
attgtagcatcagagatatgtctga

SEQ ID NO: 35565 - DNA, 25 bp, Homo sapien
attgtagcgtcagagatatgtctga

SEQ ID NO: 35566 - DNA, 25 bp, Homo sapien
attgtaggtataactactgctaaat

SEQ ID NO: 35567 - DNA, 25 bp, Homo sapien
attgtaggtataattactgctaaat

SEQ ID NO: 35568 - DNA, 25 bp, Homo sapien
attgtagtgcccattggaggttggc

SEQ ID NO: 35569 - DNA, 25 bp, Homo sapien
attgtagtgccctttggaggttggc

SEQ ID NO: 35570 - DNA, 25 bp, Homo sapien
attgtagttttgactgaatttctta

SEQ ID NO: 35571 - DNA, 25 bp, Homo sapien
attgtagttttgattgaatttctta

SEQ ID NO: 35572 - DNA, 25 bp, Homo sapien
attgtataatgaatcaacattttat

SEQ ID NO: 35573 - DNA, 25 bp, Homo sapien
attgtatagtgaatcaacattttat

SEQ ID NO: 35574 - DNA, 25 bp, Homo sapien
attgtatcacctctttacactccaa

SEQ ID NO: 35575 - DNA, 25 bp, Homo sapien
attgtatcatctctttacactccaa

SEQ ID NO: 35576 - DNA, 25 bp, Homo sapien
attgtatctaaacttcaaagtacca

SEQ ID NO: 35577 - DNA, 25 bp, Homo sapien
attgtatctaaccttcaaagtacca

SEQ ID NO: 35578 - DNA, 25 bp, Homo sapien
attgtatctgccactgattgctgtt

SEQ ID NO: 35579 - DNA, 25 bp, Homo sapien
attgtatctgccgctgattgctgtt

SEQ ID NO: 35580 - DNA, 25 bp, Homo sapien
attgtatggatttaatgtaagtctt

SEQ ID NO: 35581 - DNA, 25 bp, Homo sapien
attgtatggatttagtgtaagtctt

SEQ ID NO: 35582 - DNA, 25 bp, Homo sapien
attgtatgtgaaacttttgaaacag

SEQ ID NO: 35583 - DNA, 25 bp, Homo sapien
attgtatgtgaaatttttgaaacag

SEQ ID NO: 35584 - DNA, 25 bp, Homo sapien
attgtattcattggttttcattgtt

SEQ ID NO: 35585 - DNA, 25 bp, Homo sapien
attgtattcatttgttttcattgtt

SEQ ID NO: 35586 - DNA, 25 bp, Homo sapien
attgtattgattaactagtatggaa

SEQ ID NO: 35587 - DNA, 25 bp, Homo sapien
attgtattgattgactagtatggaa

SEQ ID NO: 35588 - DNA, 25 bp, Homo sapien
attgtattgcttcaccatcaattaa

SEQ ID NO: 35589 - DNA, 25 bp, Homo sapien
attgtattgcttcaccgtcaattaa

SEQ ID NO: 35590 - DNA, 25 bp, Homo sapien
attgtattgttttgtctataacttt

SEQ ID NO: 35591 - DNA, 25 bp, Homo sapien
attgtattgttttttctataacttt

SEQ ID NO: 35592 - DNA, 25 bp, Homo sapien
attgtcaaaggtaaaatattctgcc

SEQ ID NO: 35593 - DNA, 25 bp, Homo sapien
attgtcaaaggtagtatgagctctg

SEQ ID NO: 35594 - DNA, 25 bp, Homo sapien
attgtcaaaggtgaaatattctgcc

SEQ ID NO: 35595 - DNA, 25 bp, Homo sapien
attgtcaaaggtggtatgagctctg

SEQ ID NO: 35596 - DNA, 25 bp, Homo sapien
attgtcaatagcaaatgtttcaatt

SEQ ID NO: 35597 - DNA, 25 bp, Homo sapien
attgtcaatagcaagtgtttcaatt

SEQ ID NO: 35598 - DNA, 25 bp, Homo sapien
attgtcacaacttaggagatgcctc

SEQ ID NO: 35599 - DNA, 25 bp, Homo sapien
attgtcacagcttaggagatgcctc

SEQ ID NO: 35600 - DNA, 25 bp, Homo sapien
attgtcactccaagggctgaggtgg

SEQ ID NO: 35601 - DNA, 25 bp, Homo sapien
attgtcactccgagggctgaggtgg

SEQ ID NO: 35602 - DNA, 25 bp, Homo sapien
attgtcagtggaacctttcacattc

SEQ ID NO: 35603 - DNA, 25 bp, Homo sapien
attgtcagtggaagctttcacattc

SEQ ID NO: 35604 - DNA, 25 bp, Homo sapien
attgtcataatcacttcattttatt

SEQ ID NO: 35605 - DNA, 25 bp, Homo sapien
attgtcataattaatagaaacacag

SEQ ID NO: 35606 - DNA, 25 bp, Homo sapien
attgtcatcagtcacttggaggaca

SEQ ID NO: 35607 - DNA, 25 bp, Homo sapien
attgtcatcagttacttggaggaca

SEQ ID NO: 35608 - DNA, 25 bp, Homo sapien
attgtcatcattaatagaaacacag

SEQ ID NO: 35609 - DNA, 25 bp, Homo sapien
attgtcatcttaccctggaagtctc

SEQ ID NO: 35610 - DNA, 25 bp, Homo sapien
attgtcatcttaccttggaagtctc

SEQ ID NO: 35611 - DNA, 25 bp, Homo sapien
attgtcatgatcacttcattttatt

SEQ ID NO: 35612 - DNA, 25 bp, Homo sapien
attgtcattgctgtcactgacttcc

SEQ ID NO: 35613 - DNA, 25 bp, Homo sapien
attgtcattgctgtcattgacttcc

SEQ ID NO: 35614 - DNA, 25 bp, Homo sapien
attgtccagaccttcatgttttaca

SEQ ID NO: 35615 - DNA, 25 bp, Homo sapien
attgtccaggccttcatgttttaca

SEQ ID NO: 35616 - DNA, 25 bp, Homo sapien
attgtcctatgaaagactagggtta

SEQ ID NO: 35617 - DNA, 25 bp, Homo sapien
attgtcctatgatgatacttcacaa

SEQ ID NO: 35618 - DNA, 25 bp, Homo sapien
attgtcctgtgaaagactagggtta

SEQ ID NO: 35619 - DNA, 25 bp, Homo sapien
attgtcctgtgatgatacttcacaa

SEQ ID NO: 35620 - DNA, 25 bp, Homo sapien
attgtcctttgattcatggaggtac

SEQ ID NO: 35621 - DNA, 25 bp, Homo sapien
attgtcctttgtttcatggaggtac

SEQ ID NO: 35622 - DNA, 25 bp, Homo sapien
attgtccttttaagttttttgatat

SEQ ID NO: 35623 - DNA, 25 bp, Homo sapien
attgtccttttacgttttttgatat

SEQ ID NO: 35624 - DNA, 25 bp, Homo sapien
attgtctagtttatcacttggacaa

SEQ ID NO: 35625 - DNA, 25 bp, Homo sapien
attgtctagtttctcacttggacaa

SEQ ID NO: 35626 - DNA, 25 bp, Homo sapien
attgtctcaggccgcatataaaata

SEQ ID NO: 35627 - DNA, 25 bp, Homo sapien
attgtctcaggctgcatataaaata

SEQ ID NO: 35628 - DNA, 25 bp, Homo sapien
attgtctccctcaaagcaaggccat

SEQ ID NO: 35629 - DNA, 25 bp, Homo sapien
attgtctccctcagagcaaggccat

SEQ ID NO: 35630 - DNA, 25 bp, Homo sapien
attgtctgcctgctttttgttgttg

SEQ ID NO: 35631 - DNA, 25 bp, Homo sapien
attgtctgcttgctttttgttgttg

SEQ ID NO: 35632 - DNA, 25 bp, Homo sapien
attgtctgtacaacccagcacatca

SEQ ID NO: 35633 - DNA, 25 bp, Homo sapien
attgtctgtaccacccagcacatca

SEQ ID NO: 35634 - DNA, 25 bp, Homo sapien
attgtcttccttgtgctgtgatccc

SEQ ID NO: 35635 - DNA, 25 bp, Homo sapien
attgtcttctttgtgctgtgatccc

SEQ ID NO: 35636 - DNA, 25 bp, Homo sapien
attgtgaaagtatagtcgtccttta

SEQ ID NO: 35637 - DNA, 25 bp, Homo sapien
attgtgaaagtatagttgtccttta

SEQ ID NO: 35638 - DNA, 25 bp, Homo sapien
attgtgaatgcatagaaattaatca

SEQ ID NO: 35639 - DNA, 25 bp, Homo sapien
attgtgaatgcgtagaaattaatca

SEQ ID NO: 35640 - DNA, 25 bp, Homo sapien
attgtgaattccaacatgctcagag

SEQ ID NO: 35641 - DNA, 25 bp, Homo sapien
attgtgaattccagcatgctcagag

SEQ ID NO: 35642 - DNA, 25 bp, Homo sapien
attgtgaccatacatttaaaaacaa

SEQ ID NO: 35643 - DNA, 25 bp, Homo sapien
attgtgaccatacgtttaaaaacaa

SEQ ID NO: 35644 - DNA, 25 bp, Homo sapien
attgtgacttctcttagggagcaca

SEQ ID NO: 35645 - DNA, 25 bp, Homo sapien
attgtgacttctcttatggagcaca

SEQ ID NO: 35646 - DNA, 25 bp, Homo sapien
attgtgacttgttatttttcttttt

SEQ ID NO: 35647 - DNA, 25 bp, Homo sapien
attgtgacttgttctttttcttttt

SEQ ID NO: 35648 - DNA, 25 bp, Homo sapien
attgtgagacaggttcaggaacaag

SEQ ID NO: 35649 - DNA, 25 bp, Homo sapien
attgtgagcagtaggtcttgaaagt

SEQ ID NO: 35650 - DNA, 25 bp, Homo sapien
attgtgagcggtaggtcttgaaagt

SEQ ID NO: 35651 - DNA, 25 bp, Homo sapien
attgtgaggcaggttcaggaacaag

SEQ ID NO: 35652 - DNA, 25 bp, Homo sapien
attgtgcatcgtatggttggcacaa

SEQ ID NO: 35653 - DNA, 25 bp, Homo sapien
attgtgcattgtatggttggcacaa

SEQ ID NO: 35654 - DNA, 25 bp, Homo sapien
attgtgccaccagctgcacctgagg

SEQ ID NO: 35655 - DNA, 25 bp, Homo sapien
attgtgccattgactatgttggtta

SEQ ID NO: 35656 - DNA, 25 bp, Homo sapien
attgtgccattgtctatgttggtta

SEQ ID NO: 35657 - DNA, 25 bp, Homo sapien
attgtgccgccagctgcacctgagg

SEQ ID NO: 35658 - DNA, 25 bp, Homo sapien
attgtgctaaagttaaagcaatatg

SEQ ID NO: 35659 - DNA, 25 bp, Homo sapien
attgtgctaaagttaaggcaatatg

SEQ ID NO: 35660 - DNA, 25 bp, Homo sapien
attgtgcttctttggtattatcaga

SEQ ID NO: 35661 - DNA, 25 bp, Homo sapien
attgtgcttctttggtgttatcaga

SEQ ID NO: 35662 - DNA, 25 bp, Homo sapien
attgtggaaacaaacagaatgcact

SEQ ID NO: 35663 - DNA, 25 bp, Homo sapien
attgtggaagcaaacagaatgcact

SEQ ID NO: 35664 - DNA, 25 bp, Homo sapien
attgtggagctgagtaataccctca

SEQ ID NO: 35665 - DNA, 25 bp, Homo sapien
attgtggagctgggtaataccctca

SEQ ID NO: 35666 - DNA, 25 bp, Homo sapien
attgtggattgaccacctaatctca

SEQ ID NO: 35667 - DNA, 25 bp, Homo sapien
attgtggattgaccacgtaatctca

SEQ ID NO: 35668 - DNA, 25 bp, Homo sapien
attgtggcatttgggcctgggttcg

SEQ ID NO: 35669 - DNA, 25 bp, Homo sapien
attgtggcgtttgggcctgggttcg

SEQ ID NO: 35670 - DNA, 25 bp, Homo sapien
attgtgggaccagagcattcaggac

SEQ ID NO: 35671 - DNA, 25 bp, Homo sapien
attgtgggaccggagcattcaggac

SEQ ID NO: 35672 - DNA, 25 bp, Homo sapien
attgtggttgtgaccatgcccgaga

SEQ ID NO: 35673 - DNA, 25 bp, Homo sapien
attgtggttgtgtccatgcccgaga

SEQ ID NO: 35674 - DNA, 25 bp, Homo sapien
attgtgtcaggagcagctctaagaa

SEQ ID NO: 35675 - DNA, 25 bp, Homo sapien
attgtgtcgggagcagctctaagaa

SEQ ID NO: 35676 - DNA, 25 bp, Homo sapien
attgtgtctatcctggagtttccct

SEQ ID NO: 35677 - DNA, 25 bp, Homo sapien
attgtgtctattctggagtttccct

SEQ ID NO: 35678 - DNA, 25 bp, Homo sapien
attgtgtgactgttccataagttat

SEQ ID NO: 35679 - DNA, 25 bp, Homo sapien
attgtgtgactgttccgtaagttat

SEQ ID NO: 35680 - DNA, 25 bp, Homo sapien
attgtgtggaatggaatagaggtca

SEQ ID NO: 35681 - DNA, 25 bp, Homo sapien
attgtgtgtaatggaatagaggtca

SEQ ID NO: 35682 - DNA, 25 bp, Homo sapien
attgtgttgccactgagtttctatt

SEQ ID NO: 35683 - DNA, 25 bp, Homo sapien
attgtgttgccattgagtttctatt

SEQ ID NO: 35684 - DNA, 25 bp, Homo sapien
attgtgttgttctggctgtcaataa

SEQ ID NO: 35685 - DNA, 25 bp, Homo sapien
attgtgttgttcttgctgtcaataa

SEQ ID NO: 35686 - DNA, 25 bp, Homo sapien
attgttaaattgcagctttcaagga

SEQ ID NO: 35687 - DNA, 25 bp, Homo sapien
attgttaagttgcagctttcaagga

SEQ ID NO: 35688 - DNA, 25 bp, Homo sapien
attgttatctgaggatgaaaaaatg

SEQ ID NO: 35689 - DNA, 25 bp, Homo sapien
attgttatctgaggttgaaaaaatg

SEQ ID NO: 35690 - DNA, 25 bp, Homo sapien
attgttattatccttccaaaaatag

SEQ ID NO: 35691 - DNA, 25 bp, Homo sapien
attgttattatcgttccaaaaatag

SEQ ID NO: 35692 - DNA, 25 bp, Homo sapien
attgttcaaagatatacgcatgaga

SEQ ID NO: 35693 - DNA, 25 bp, Homo sapien
attgttcaaagatgtacgcatgaga

SEQ ID NO: 35694 - DNA, 25 bp, Homo sapien
attgttcaggcaaagaagaaggagt

SEQ ID NO: 35695 - DNA, 25 bp, Homo sapien
attgttcaggcaaggaagaaggagt

SEQ ID NO: 35696 - DNA, 25 bp, Homo sapien
attgttcattcacttgctcaacaac

SEQ ID NO: 35697 - DNA, 25 bp, Homo sapien
attgttcattcagttgctcaacaac

SEQ ID NO: 35698 - DNA, 25 bp, Homo sapien
attgttccatttcccttctctactt

SEQ ID NO: 35699 - DNA, 25 bp, Homo sapien
attgttccatttcctttctctactt

SEQ ID NO: 35700 - DNA, 25 bp, Homo sapien
attgttctcagcaaaaagcagcaat

SEQ ID NO: 35701 - DNA, 25 bp, Homo sapien
attgttctcagcacaaagcagcaat

SEQ ID NO: 35702 - DNA, 25 bp, Homo sapien
attgttctgcagcctaaatacttga

SEQ ID NO: 35703 - DNA, 25 bp, Homo sapien
attgttctgcagcctagatacttga

SEQ ID NO: 35704 - DNA, 25 bp, Homo sapien
attgttcttactcctagatatttga

SEQ ID NO: 35705 - DNA, 25 bp, Homo sapien
attgttcttactgctagatatttga

SEQ ID NO: 35706 - DNA, 25 bp, Homo sapien
attgttcttatcgcaccttattgac

SEQ ID NO: 35707 - DNA, 25 bp, Homo sapien
attgttcttattgcaccttattgac

SEQ ID NO: 35708 - DNA, 25 bp, Homo sapien
attgttcttcaacgtcctactctgt

SEQ ID NO: 35709 - DNA, 25 bp, Homo sapien
attgttcttcaatgtcctactctgt

SEQ ID NO: 35710 - DNA, 25 bp, Homo sapien
attgttcttggacgcataaacaaaa

SEQ ID NO: 35711 - DNA, 25 bp, Homo sapien
attgttcttggaggcataaacaaaa

SEQ ID NO: 35712 - DNA, 25 bp, Homo sapien
attgttgaaatgacaaccaaggctt

SEQ ID NO: 35713 - DNA, 25 bp, Homo sapien
attgttgaaatgacgaccaaggctt

SEQ ID NO: 35714 - DNA, 25 bp, Homo sapien
attgttgcctgcccaaaatagtact

SEQ ID NO: 35715 - DNA, 25 bp, Homo sapien
attgttgcctgtccaaaatagtact

SEQ ID NO: 35716 - DNA, 25 bp, Homo sapien
attgttggagatgaggtcaggaaac

SEQ ID NO: 35717 - DNA, 25 bp, Homo sapien
attgttggcgatgaggtcaggaaac

SEQ ID NO: 35718 - DNA, 25 bp, Homo sapien
attgttgtagtacgatattcccaaa

SEQ ID NO: 35719 - DNA, 25 bp, Homo sapien
attgttgtagtatgatattcccaaa

SEQ ID NO: 35720 - DNA, 25 bp, Homo sapien
attgttgtgttagaaaggcatgtaa

SEQ ID NO: 35721 - DNA, 25 bp, Homo sapien
attgttgtgttataaaggcatgtaa

SEQ ID NO: 35722 - DNA, 25 bp, Homo sapien
attgttgttgacacggggaaaattt

SEQ ID NO: 35723 - DNA, 25 bp, Homo sapien
attgttgttgatacggggaaaattt

SEQ ID NO: 35724 - DNA, 25 bp, Homo sapien
attgtttaagacatactagagcttt

SEQ ID NO: 35725 - DNA, 25 bp, Homo sapien
attgtttaagacgtactagagcttt

SEQ ID NO: 35726 - DNA, 25 bp, Homo sapien
attgtttagcgacttctccaaacaa

SEQ ID NO: 35727 - DNA, 25 bp, Homo sapien
attgtttagtgacttctccaaacaa

SEQ ID NO: 35728 - DNA, 25 bp, Homo sapien
attgtttatttgtaggcattattgt

SEQ ID NO: 35729 - DNA, 25 bp, Homo sapien
attgtttatttgtgggcattattgt

SEQ ID NO: 35730 - DNA, 25 bp, Homo sapien
attgtttcagcctcaaatttaactt

SEQ ID NO: 35731 - DNA, 25 bp, Homo sapien
attgtttcagcctctaatttaactt

SEQ ID NO: 35732 - DNA, 25 bp, Homo sapien
attgtttcatatgccaattgtattt

SEQ ID NO: 35733 - DNA, 25 bp, Homo sapien
attgtttcgtatgccaattgtattt

SEQ ID NO: 35734 - DNA, 25 bp, Homo sapien
attgtttctggctctgccgtttcta

SEQ ID NO: 35735 - DNA, 25 bp, Homo sapien
attgtttctggctctgtcgtttcta

SEQ ID NO: 35736 - DNA, 25 bp, Homo sapien
attgtttctttctttgatggtagag

SEQ ID NO: 35737 - DNA, 25 bp, Homo sapien
attgtttctttctttggtggtagag

SEQ ID NO: 35738 - DNA, 25 bp, Homo sapien
attgtttgagctctttcgcatttat

SEQ ID NO: 35739 - DNA, 25 bp, Homo sapien
attgtttgagctcttttgcatttat

SEQ ID NO: 35740 - DNA, 25 bp, Homo sapien
attgttttaactacatgggattttg

SEQ ID NO: 35741 - DNA, 25 bp, Homo sapien
attgttttaactacgtgggattttg

SEQ ID NO: 35742 - DNA, 25 bp, Homo sapien
attgttttactcctcgcttaacatc

SEQ ID NO: 35743 - DNA, 25 bp, Homo sapien
attgttttactccttgcttaacatc

SEQ ID NO: 35744 - DNA, 25 bp, Homo sapien
attgttttccacagcggctatgctg

SEQ ID NO: 35745 - DNA, 25 bp, Homo sapien
attgttttccacagtggctatgctg

SEQ ID NO: 35746 - DNA, 25 bp, Homo sapien
attgttttcttgggatagcaaggac

SEQ ID NO: 35747 - DNA, 25 bp, Homo sapien
attgttttctttggatagcaaggac

SEQ ID NO: 35748 - DNA, 25 bp, Homo sapien
attgttttgtctataactttgtgtt

SEQ ID NO: 35749 - DNA, 25 bp, Homo sapien
attgtttttgaactgggtggtggta

SEQ ID NO: 35750 - DNA, 25 bp, Homo sapien
attgtttttgacctgggtggtggta

SEQ ID NO: 35751 - DNA, 25 bp, Homo sapien
attgttttttctataactttgtgtt

SEQ ID NO: 35752 - DNA, 25 bp, Homo sapien
atttaaaaaccatagcgacactaaa

SEQ ID NO: 35753 - DNA, 25 bp, Homo sapien
atttaaaaagcatagcgacactaaa

SEQ ID NO: 35754 - DNA, 25 bp, Homo sapien
atttaaaaatacgaccactttggta

SEQ ID NO: 35755 - DNA, 25 bp, Homo sapien
atttaaaaatatgaccactttggta

SEQ ID NO: 35756 - DNA, 25 bp, Homo sapien
atttaaaaattagtagcgtttctac

SEQ ID NO: 35757 - DNA, 25 bp, Homo sapien
atttaaaaattagtagtgtttctac

SEQ ID NO: 35758 - DNA, 25 bp, Homo sapien
atttaaaagctgaagtagtaattca

SEQ ID NO: 35759 - DNA, 25 bp, Homo sapien
atttaaaagctgaagttgtaattca

SEQ ID NO: 35760 - DNA, 25 bp, Homo sapien
atttaaaatagcagtcaaaaaaatc

SEQ ID NO: 35761 - DNA, 25 bp, Homo sapien
atttaaaatagcagtccaaaaaatc

SEQ ID NO: 35762 - DNA, 25 bp, Homo sapien
atttaaacatcatcaatataatttg

SEQ ID NO: 35763 - DNA, 25 bp, Homo sapien
atttaaacatcatcgatataatttg

SEQ ID NO: 35764 - DNA, 25 bp, Homo sapien
atttaaacatttgtgggagatattg

SEQ ID NO: 35765 - DNA, 25 bp, Homo sapien
atttaaacatttgttggagatattg

SEQ ID NO: 35766 - DNA, 25 bp, Homo sapien
atttaaaccattatcaactcttgct

SEQ ID NO: 35767 - DNA, 25 bp, Homo sapien
atttaaaccattatcatctcttgct

SEQ ID NO: 35768 - DNA, 25 bp, Homo sapien
atttaaagaaaaaaggacagtgagt

SEQ ID NO: 35769 - DNA, 25 bp, Homo sapien
atttaaagaaaaaagggcagtgagt

SEQ ID NO: 35770 - DNA, 25 bp, Homo sapien
atttaaagagccatgattattgtaa

SEQ ID NO: 35771 - DNA, 25 bp, Homo sapien
atttaaagagccgtgattattgtaa

SEQ ID NO: 35772 - DNA, 25 bp, Homo sapien
atttaaataaagtgcagataggaac

SEQ ID NO: 35773 - DNA, 25 bp, Homo sapien
atttaaatcatatagcatgccatat

SEQ ID NO: 35774 - DNA, 25 bp, Homo sapien
atttaaatcgtatagcatgccatat

SEQ ID NO: 35775 - DNA, 25 bp, Homo sapien
atttaaatgaagtgcagataggaac

SEQ ID NO: 35776 - DNA, 25 bp, Homo sapien
atttaaatgaggatctgattccaaa

SEQ ID NO: 35777 - DNA, 25 bp, Homo sapien
atttaaatgagtatctgattccaaa

SEQ ID NO: 35778 - DNA, 25 bp, Homo sapien
atttaaattccaaaaagcagcatct

SEQ ID NO: 35779 - DNA, 25 bp, Homo sapien
atttaaattcccaaaagcagcatct

SEQ ID NO: 35780 - DNA, 25 bp, Homo sapien
atttaactaccaggactaattactc

SEQ ID NO: 35781 - DNA, 25 bp, Homo sapien
atttaactgaagttcagttgctttg

SEQ ID NO: 35782 - DNA, 25 bp, Homo sapien
atttaactgaagttcatttgctttg

SEQ ID NO: 35783 - DNA, 25 bp, Homo sapien
atttaactgattccttggctcacca

SEQ ID NO: 35784 - DNA, 25 bp, Homo sapien
atttaactgattgcttggctcacca

SEQ ID NO: 35785 - DNA, 25 bp, Homo sapien
atttaacttccaggactaattactc

SEQ ID NO: 35786 - DNA, 25 bp, Homo sapien
atttaagagaagtatgcaagaattc

SEQ ID NO: 35787 - DNA, 25 bp, Homo sapien
atttaagagaagtttgcaagaattc

SEQ ID NO: 35788 - DNA, 25 bp, Homo sapien
atttaaggacacatataggctgaaa

SEQ ID NO: 35789 - DNA, 25 bp, Homo sapien
atttaaggacacgtataggctgaaa

SEQ ID NO: 35790 - DNA, 25 bp, Homo sapien
atttaaggaccggcgttgctttctg

SEQ ID NO: 35791 - DNA, 25 bp, Homo sapien
atttaaggaccggtgttgctttctg

SEQ ID NO: 35792 - DNA, 25 bp, Homo sapien
atttaagtactgggatagactgata

SEQ ID NO: 35793 - DNA, 25 bp, Homo sapien
atttaagtactggggtagactgata

SEQ ID NO: 35794 - DNA, 25 bp, Homo sapien
atttaagtgcgataatttgtcagtg

SEQ ID NO: 35795 - DNA, 25 bp, Homo sapien
atttaagtggtacatcagtgacctc

SEQ ID NO: 35796 - DNA, 25 bp, Homo sapien
atttaagtggtatatcagtgacctc

SEQ ID NO: 35797 - DNA, 25 bp, Homo sapien
atttaagtgtgataatttgtcagtg

SEQ ID NO: 35798 - DNA, 25 bp, Homo sapien
atttaatactcagatttcatatacg

SEQ ID NO: 35799 - DNA, 25 bp, Homo sapien
atttaatactcggatttcatatacg

SEQ ID NO: 35800 - DNA, 25 bp, Homo sapien
atttaatctgtggatcaatttgaac

SEQ ID NO: 35801 - DNA, 25 bp, Homo sapien
atttaatctgtggatccatttgaac

SEQ ID NO: 35802 - DNA, 25 bp, Homo sapien
atttaatgagcatcttagttatata

SEQ ID NO: 35803 - DNA, 25 bp, Homo sapien
atttaatgagcgtcttagttatata

SEQ ID NO: 35804 - DNA, 25 bp, Homo sapien
atttaatgcttggtattatgtgagt

SEQ ID NO: 35805 - DNA, 25 bp, Homo sapien
atttaatgtttggtattatgtgagt

SEQ ID NO: 35806 - DNA, 25 bp, Homo sapien
atttaattttcacatcacagtaata

SEQ ID NO: 35807 - DNA, 25 bp, Homo sapien
atttaattttcacgtcacagtaata

SEQ ID NO: 35808 - DNA, 25 bp, Homo sapien
atttaattttccacttgtgcaaatc

SEQ ID NO: 35809 - DNA, 25 bp, Homo sapien
atttaattttctacttgtgcaaatc

SEQ ID NO: 35810 - DNA, 25 bp, Homo sapien
atttacaagcacgtttcaaaaacca

SEQ ID NO: 35811 - DNA, 25 bp, Homo sapien
atttacaagcatgtgcatgagtctg

SEQ ID NO: 35812 - DNA, 25 bp, Homo sapien
atttacaagcatgtgcgtgagtctg

SEQ ID NO: 35813 - DNA, 25 bp, Homo sapien
atttacaagcatgtttcaaaaacca

SEQ ID NO: 35814 - DNA, 25 bp, Homo sapien
atttacaagcgattagtttgctgtg

SEQ ID NO: 35815 - DNA, 25 bp, Homo sapien
atttacaagtgattagtttgctgtg

SEQ ID NO: 35816 - DNA, 25 bp, Homo sapien
atttacaatcgagaccactacagtt

SEQ ID NO: 35817 - DNA, 25 bp, Homo sapien
atttacaattgagaccactacagtt

SEQ ID NO: 35818 - DNA, 25 bp, Homo sapien
atttacacaccgatggatttggctt

SEQ ID NO: 35819 - DNA, 25 bp, Homo sapien
atttacacaccgttggatttggctt

SEQ ID NO: 35820 - DNA, 25 bp, Homo sapien
atttacaggcttttggcttgagcaa

SEQ ID NO: 35821 - DNA, 25 bp, Homo sapien
atttacaggtttttggcttgagcaa

SEQ ID NO: 35822 - DNA, 25 bp, Homo sapien
atttacatattagtgctcttctgag

SEQ ID NO: 35823 - DNA, 25 bp, Homo sapien
atttacatcattttcttcctagtaa

SEQ ID NO: 35824 - DNA, 25 bp, Homo sapien
atttacatcatttttttcctagtaa

SEQ ID NO: 35825 - DNA, 25 bp, Homo sapien
atttacatgttagtgctcttctgag

SEQ ID NO: 35826 - DNA, 25 bp, Homo sapien
atttacatgtttaacaagctaccag

SEQ ID NO: 35827 - DNA, 25 bp, Homo sapien
atttacattacacattgcggtgcca

SEQ ID NO: 35828 - DNA, 25 bp, Homo sapien
atttacattacacgttgcggtgcca

SEQ ID NO: 35829 - DNA, 25 bp, Homo sapien
atttacatttttaacaagctaccag

SEQ ID NO: 35830 - DNA, 25 bp, Homo sapien
atttaccaaataccacatatacata

SEQ ID NO: 35831 - DNA, 25 bp, Homo sapien
atttaccaaatatcacatatacata

SEQ ID NO: 35832 - DNA, 25 bp, Homo sapien
atttaccaaggccgtgaaagtatgc

SEQ ID NO: 35833 - DNA, 25 bp, Homo sapien
atttaccaaggctgtgaaagtatgc

SEQ ID NO: 35834 - DNA, 25 bp, Homo sapien
atttaccagaaaaactgttgctatt

SEQ ID NO: 35835 - DNA, 25 bp, Homo sapien
atttaccagaaaacctgttgctatt

SEQ ID NO: 35836 - DNA, 25 bp, Homo sapien
atttacccaacatcacatagctagg

SEQ ID NO: 35837 - DNA, 25 bp, Homo sapien
atttacccatcatcacatagctagg

SEQ ID NO: 35838 - DNA, 25 bp, Homo sapien
atttaccctgcatcattttgcatag

SEQ ID NO: 35839 - DNA, 25 bp, Homo sapien
atttaccctgcgtcattttgcatag

SEQ ID NO: 35840 - DNA, 25 bp, Homo sapien
atttacctacttcaaaacatggaaa

SEQ ID NO: 35841 - DNA, 25 bp, Homo sapien
atttacctgcttcaaaacatggaaa

SEQ ID NO: 35842 - DNA, 25 bp, Homo sapien
atttacctggacaattcttccaatg

SEQ ID NO: 35843 - DNA, 25 bp, Homo sapien
atttacctggacagttcttccaatg

SEQ ID NO: 35844 - DNA, 25 bp, Homo sapien
atttactatcgcatgatagagccaa

SEQ ID NO: 35845 - DNA, 25 bp, Homo sapien
atttactattgcatgatagagccaa

SEQ ID NO: 35846 - DNA, 25 bp, Homo sapien
atttactcacccacaaaagtgtgtg

SEQ ID NO: 35847 - DNA, 25 bp, Homo sapien
atttactcagccacaaaagtgtgtg

SEQ ID NO: 35848 - DNA, 25 bp, Homo sapien
atttactctaggaaatcttatattc

SEQ ID NO: 35849 - DNA, 25 bp, Homo sapien
atttactcttggaaatcttatattc

SEQ ID NO: 35850 - DNA, 25 bp, Homo sapien
atttacttgggttccgctcagcaac

SEQ ID NO: 35851 - DNA, 25 bp, Homo sapien
atttacttgggtttcgctcagcaac

SEQ ID NO: 35852 - DNA, 25 bp, Homo sapien
atttacttgtggccgatgagttgtg

SEQ ID NO: 35853 - DNA, 25 bp, Homo sapien
atttacttgtggtcgatgagttgtg

SEQ ID NO: 35854 - DNA, 25 bp, Homo sapien
atttagaaagacagcatcactaaaa

SEQ ID NO: 35855 - DNA, 25 bp, Homo sapien
atttagaaagacaggatcactaaaa

SEQ ID NO: 35856 - DNA, 25 bp, Homo sapien
atttagaacccaaccatttctacca

SEQ ID NO: 35857 - DNA, 25 bp, Homo sapien
atttagaacccagccatttctacca

SEQ ID NO: 35858 - DNA, 25 bp, Homo sapien
atttagatgttcaaaacttttcact

SEQ ID NO: 35859 - DNA, 25 bp, Homo sapien
atttagatgttcaaaatttttcact

SEQ ID NO: 35860 - DNA, 25 bp, Homo sapien
atttagcaaacccaagtgatcattt

SEQ ID NO: 35861 - DNA, 25 bp, Homo sapien
atttagcaaacccacgtgatcattt

SEQ ID NO: 35862 - DNA, 25 bp, Homo sapien
atttagcccagactattcatatact

SEQ ID NO: 35863 - DNA, 25 bp, Homo sapien
atttagcccagattattcatatact

SEQ ID NO: 35864 - DNA, 25 bp, Homo sapien
atttagctcagtgagtcccaggatg

SEQ ID NO: 35865 - DNA, 25 bp, Homo sapien
atttagctcagtgcgtcccaggatg

SEQ ID NO: 35866 - DNA, 25 bp, Homo sapien
atttagcttccacctttttttgagg

SEQ ID NO: 35867 - DNA, 25 bp, Homo sapien
atttagcttccatctttttttgagg

SEQ ID NO: 35868 - DNA, 25 bp, Homo sapien
atttaggtcatatttatttcaaagc

SEQ ID NO: 35869 - DNA, 25 bp, Homo sapien
atttaggtcgtatttatttcaaagc

SEQ ID NO: 35870 - DNA, 25 bp, Homo sapien
atttagtaactgcaggtaagcagga

SEQ ID NO: 35871 - DNA, 25 bp, Homo sapien
atttagtaattgcaggtaagcagga

SEQ ID NO: 35872 - DNA, 25 bp, Homo sapien
atttagtagcaagaaggttactggt

SEQ ID NO: 35873 - DNA, 25 bp, Homo sapien
atttagtagcaaggaggttactggt

SEQ ID NO: 35874 - DNA, 25 bp, Homo sapien
atttagtagtgacgccattaggtct

SEQ ID NO: 35875 - DNA, 25 bp, Homo sapien
atttagtagtgatgccattaggtct

SEQ ID NO: 35876 - DNA, 25 bp, Homo sapien
atttagtcattcagcacagtacatg

SEQ ID NO: 35877 - DNA, 25 bp, Homo sapien
atttagtcgttcagcacagtacatg

SEQ ID NO: 35878 - DNA, 25 bp, Homo sapien
atttagtctacataatacatccctc

SEQ ID NO: 35879 - DNA, 25 bp, Homo sapien
atttagtctacgtaatacatccctc

SEQ ID NO: 35880 - DNA, 25 bp, Homo sapien
atttagtgggtcaaaacaatacaac

SEQ ID NO: 35881 - DNA, 25 bp, Homo sapien
atttagtgggttaaaacaatacaac

SEQ ID NO: 35882 - DNA, 25 bp, Homo sapien
atttagttagggacgaattcagatt

SEQ ID NO: 35883 - DNA, 25 bp, Homo sapien
atttagttagggatgaattcagatt

SEQ ID NO: 35884 - DNA, 25 bp, Homo sapien
atttagttgcaagatgtaaaaatcc

SEQ ID NO: 35885 - DNA, 25 bp, Homo sapien
atttagttgcgttgaactcaaaatc

SEQ ID NO: 35886 - DNA, 25 bp, Homo sapien
atttagttgggttgaactcaaaatc

SEQ ID NO: 35887 - DNA, 25 bp, Homo sapien
atttagtttcaagatgtaaaaatcc

SEQ ID NO: 35888 - DNA, 25 bp, Homo sapien
atttataaagcagaaaaaatctcta

SEQ ID NO: 35889 - DNA, 25 bp, Homo sapien
atttataagccatataattttgcaa

SEQ ID NO: 35890 - DNA, 25 bp, Homo sapien
atttataaggcagaaaaaatctcta

SEQ ID NO: 35891 - DNA, 25 bp, Homo sapien
atttataagtcatataattttgcaa

SEQ ID NO: 35892 - DNA, 25 bp, Homo sapien
atttatacatcatcactctctggaa

SEQ ID NO: 35893 - DNA, 25 bp, Homo sapien
atttatacatcgtcactctctggaa

SEQ ID NO: 35894 - DNA, 25 bp, Homo sapien
atttataggcacttagcgaatggag

SEQ ID NO: 35895 - DNA, 25 bp, Homo sapien
atttataggcacttagtgaatggag

SEQ ID NO: 35896 - DNA, 25 bp, Homo sapien
atttatataaatgagaacacactga

SEQ ID NO: 35897 - DNA, 25 bp, Homo sapien
atttatataaatgcgaacacactga

SEQ ID NO: 35898 - DNA, 25 bp, Homo sapien
atttatatgaatcgataatcttcca

SEQ ID NO: 35899 - DNA, 25 bp, Homo sapien
atttatatgaatcggtaatcttcca

SEQ ID NO: 35900 - DNA, 25 bp, Homo sapien
atttatcacgtcttggtgtttcact

SEQ ID NO: 35901 - DNA, 25 bp, Homo sapien
atttatcactcaagactattgtgtc

SEQ ID NO: 35902 - DNA, 25 bp, Homo sapien
atttatcactcaggactattgtgtc

SEQ ID NO: 35903 - DNA, 25 bp, Homo sapien
atttatcagtccatgagtaatactg

SEQ ID NO: 35904 - DNA, 25 bp, Homo sapien
atttatcagtccgtgagtaatactg

SEQ ID NO: 35905 - DNA, 25 bp, Homo sapien
atttatcagttcagctgcttcaaac

SEQ ID NO: 35906 - DNA, 25 bp, Homo sapien
atttatcagttcagttgcttcaaac

SEQ ID NO: 35907 - DNA, 25 bp, Homo sapien
atttatcatgtcttggtgtttcact

SEQ ID NO: 35908 - DNA, 25 bp, Homo sapien
atttatccaaatgtcaataatcagt

SEQ ID NO: 35909 - DNA, 25 bp, Homo sapien
atttatccaaatgtcagtaatcagt

SEQ ID NO: 35910 - DNA, 25 bp, Homo sapien
atttatcgttttcagaacatctctg

SEQ ID NO: 35911 - DNA, 25 bp, Homo sapien
atttatcgttttcggaacatctctg

SEQ ID NO: 35912 - DNA, 25 bp, Homo sapien
atttatctgaaactagagttcgtat

SEQ ID NO: 35913 - DNA, 25 bp, Homo sapien
atttatctgaaattagagttcgtat

SEQ ID NO: 35914 - DNA, 25 bp, Homo sapien
atttatcttgctgagttctagtcgc

SEQ ID NO: 35915 - DNA, 25 bp, Homo sapien
atttatcttgcttagttctagtcgc

SEQ ID NO: 35916 - DNA, 25 bp, Homo sapien
atttatgatctcacagttctgcagc

SEQ ID NO: 35917 - DNA, 25 bp, Homo sapien
atttatgatttcacagttctgcagc

SEQ ID NO: 35918 - DNA, 25 bp, Homo sapien
atttatgtcctgccgattgagtata

SEQ ID NO: 35919 - DNA, 25 bp, Homo sapien
atttatgtcctgctgattgagtata

SEQ ID NO: 35920 - DNA, 25 bp, Homo sapien
atttattaacatccaaacaaacttg

SEQ ID NO: 35921 - DNA, 25 bp, Homo sapien
atttattaacatccaagcaaacttg

SEQ ID NO: 35922 - DNA, 25 bp, Homo sapien
atttattacctggatgattttacag

SEQ ID NO: 35923 - DNA, 25 bp, Homo sapien
atttattatcaacaatgataccact

SEQ ID NO: 35924 - DNA, 25 bp, Homo sapien
atttattatcaactatgataccact

SEQ ID NO: 35925 - DNA, 25 bp, Homo sapien
atttattatctggatgattttacag

SEQ ID NO: 35926 - DNA, 25 bp, Homo sapien
atttattcaaagccaacctgcacat

SEQ ID NO: 35927 - DNA, 25 bp, Homo sapien
atttattcaaagccaatctgcacat

SEQ ID NO: 35928 - DNA, 25 bp, Homo sapien
atttattccatcaacacagtattga

SEQ ID NO: 35929 - DNA, 25 bp, Homo sapien
atttattccatcgacacagtattga

SEQ ID NO: 35930 - DNA, 25 bp, Homo sapien
atttattccatgcaagaccatacaa

SEQ ID NO: 35931 - DNA, 25 bp, Homo sapien
atttattccatgcacgaccatacaa

SEQ ID NO: 35932 - DNA, 25 bp, Homo sapien
atttattcctatggctccaaaggtc

SEQ ID NO: 35933 - DNA, 25 bp, Homo sapien
atttattcctatggcttcaaaggtc

SEQ ID NO: 35934 - DNA, 25 bp, Homo sapien
atttattctcgtggatggtctaatg

SEQ ID NO: 35935 - DNA, 25 bp, Homo sapien
atttattcttgtggatggtctaatg

SEQ ID NO: 35936 - DNA, 25 bp, Homo sapien
atttattgacgtaccagatggtgtg

SEQ ID NO: 35937 - DNA, 25 bp, Homo sapien
atttattgaggtaccagatggtgtg

SEQ ID NO: 35938 - DNA, 25 bp, Homo sapien
atttattgcaacactgtgagtttcc

SEQ ID NO: 35939 - DNA, 25 bp, Homo sapien
atttattgcagtatatttttgaagt

SEQ ID NO: 35940 - DNA, 25 bp, Homo sapien
atttattgccacactgtgagtttcc

SEQ ID NO: 35941 - DNA, 25 bp, Homo sapien
atttattggagtatatttttgaagt

SEQ ID NO: 35942 - DNA, 25 bp, Homo sapien
atttatttagccgtcactatatacc

SEQ ID NO: 35943 - DNA, 25 bp, Homo sapien
atttatttagccttcactatatacc

SEQ ID NO: 35944 - DNA, 25 bp, Homo sapien
atttatttctcagcctgatgataga

SEQ ID NO: 35945 - DNA, 25 bp, Homo sapien
atttatttgaaccttttttgaccac

SEQ ID NO: 35946 - DNA, 25 bp, Homo sapien
atttatttgaactttttttgaccac

SEQ ID NO: 35947 - DNA, 25 bp, Homo sapien
atttatttgatttcgcagtctggct

SEQ ID NO: 35948 - DNA, 25 bp, Homo sapien
atttatttgattttgcagtctggct

SEQ ID NO: 35949 - DNA, 25 bp, Homo sapien
atttatttgcatattgtggttcacc

SEQ ID NO: 35950 - DNA, 25 bp, Homo sapien
atttatttgcatgttgtggttcacc

SEQ ID NO: 35951 - DNA, 25 bp, Homo sapien
atttatttgcttgcttaggattttc

SEQ ID NO: 35952 - DNA, 25 bp, Homo sapien
atttatttgcttgcttgggattttc

SEQ ID NO: 35953 - DNA, 25 bp, Homo sapien
atttatttgtcagcctgatgataga

SEQ ID NO: 35954 - DNA, 25 bp, Homo sapien
atttattttagcagtacgaaacaga

SEQ ID NO: 35955 - DNA, 25 bp, Homo sapien
atttattttagcagtatgaaacaga

SEQ ID NO: 35956 - DNA, 25 bp, Homo sapien
atttattttccacataaatccatca

SEQ ID NO: 35957 - DNA, 25 bp, Homo sapien
atttattttccacgtaaatccatca

SEQ ID NO: 35958 - DNA, 25 bp, Homo sapien
atttattttcctgtatcagtgtgtt

SEQ ID NO: 35959 - DNA, 25 bp, Homo sapien
atttattttggcaattattggagag

SEQ ID NO: 35960 - DNA, 25 bp, Homo sapien
atttattttggtaattattggagag

SEQ ID NO: 35961 - DNA, 25 bp, Homo sapien
atttatttttctgtatcagtgtgtt

SEQ ID NO: 35962 - DNA, 25 bp, Homo sapien
atttattttttgagaccgaattttg

SEQ ID NO: 35963 - DNA, 25 bp, Homo sapien
atttattttttgagactgaattttg

SEQ ID NO: 35964 - DNA, 25 bp, Homo sapien
atttcaaactctgagcactaaaata

SEQ ID NO: 35965 - DNA, 25 bp, Homo sapien
atttcaaactctgagctctaaaata

SEQ ID NO: 35966 - DNA, 25 bp, Homo sapien
atttcaaactgtagcattaatagga

SEQ ID NO: 35967 - DNA, 25 bp, Homo sapien
atttcaaaggccagggcgatccaag

SEQ ID NO: 35968 - DNA, 25 bp, Homo sapien
atttcaaaggccagggtgatccaag

SEQ ID NO: 35969 - DNA, 25 bp, Homo sapien
atttcaaatattgaataacacatga

SEQ ID NO: 35970 - DNA, 25 bp, Homo sapien
atttcaaatattgactaacacatga

SEQ ID NO: 35971 - DNA, 25 bp, Homo sapien
atttcaaattgtagcattaatagga

SEQ ID NO: 35972 - DNA, 25 bp, Homo sapien
atttcaacaactaaagtaggtgatc

SEQ ID NO: 35973 - DNA, 25 bp, Homo sapien
atttcaacaactaaggtaggtgatc

SEQ ID NO: 35974 - DNA, 25 bp, Homo sapien
atttcaacactaaaatttagcgata

SEQ ID NO: 35975 - DNA, 25 bp, Homo sapien
atttcaacagtaaaatttagcgata

SEQ ID NO: 35976 - DNA, 25 bp, Homo sapien
atttcaacataggttctattttcca

SEQ ID NO: 35977 - DNA, 25 bp, Homo sapien
atttcaaccggactaagccaatttc

SEQ ID NO: 35978 - DNA, 25 bp, Homo sapien
atttcaacgtaggttctattttcca

SEQ ID NO: 35979 - DNA, 25 bp, Homo sapien
atttcaactggactaagccaatttc

SEQ ID NO: 35980 - DNA, 25 bp, Homo sapien
atttcaagtataagagagatgtata

SEQ ID NO: 35981 - DNA, 25 bp, Homo sapien
atttcaagtatgagagagatgtata

SEQ ID NO: 35982 - DNA, 25 bp, Homo sapien
atttcaattctttcgggtaaatact

SEQ ID NO: 35983 - DNA, 25 bp, Homo sapien
atttcaattcttttgggtaaatact

SEQ ID NO: 35984 - DNA, 25 bp, Homo sapien
atttcacaaatgctacctgtgtatg

SEQ ID NO: 35985 - DNA, 25 bp, Homo sapien
atttcacaaatgttacctgtgtatg

SEQ ID NO: 35986 - DNA, 25 bp, Homo sapien
atttcacacgtatgatctcatttca

SEQ ID NO: 35987 - DNA, 25 bp, Homo sapien
atttcacagcctcttctcaaggact

SEQ ID NO: 35988 - DNA, 25 bp, Homo sapien
atttcacagtcgaattgttcataat

SEQ ID NO: 35989 - DNA, 25 bp, Homo sapien
atttcacagtctaattgttcataat

SEQ ID NO: 35990 - DNA, 25 bp, Homo sapien
atttcacatccagaggttaattaag

SEQ ID NO: 35991 - DNA, 25 bp, Homo sapien
atttcacatccataggttaattaag

SEQ ID NO: 35992 - DNA, 25 bp, Homo sapien
atttcacatcctcttctcaaggact

SEQ ID NO: 35993 - DNA, 25 bp, Homo sapien
atttcacatgtatgatctcatttca

SEQ ID NO: 35994 - DNA, 25 bp, Homo sapien
atttcacatttccctggcttgattt

SEQ ID NO: 35995 - DNA, 25 bp, Homo sapien
atttcacatttccgtggcttgattt

SEQ ID NO: 35996 - DNA, 25 bp, Homo sapien
atttcaccataagcgtgcatgcagt

SEQ ID NO: 35997 - DNA, 25 bp, Homo sapien
atttcaccataggcgtgcatgcagt

SEQ ID NO: 35998 - DNA, 25 bp, Homo sapien
atttcactgcttagaacttaataga

SEQ ID NO: 35999 - DNA, 25 bp, Homo sapien
atttcacttcttagaacttaataga

SEQ ID NO: 36000 - DNA, 25 bp, Homo sapien
atttcagaaagagaaccacacttat

SEQ ID NO: 36001 - DNA, 25 bp, Homo sapien
atttcagaaaggtgaagatgaagtc

SEQ ID NO: 36002 - DNA, 25 bp, Homo sapien
atttcagaaagttgaagatgaagtc

SEQ ID NO: 36003 - DNA, 25 bp, Homo sapien
atttcagaaggagaaccacacttat

SEQ ID NO: 36004 - DNA, 25 bp, Homo sapien
atttcagaatgggccaagcttaggt

SEQ ID NO: 36005 - DNA, 25 bp, Homo sapien
atttcagaatgggtcaagcttaggt

SEQ ID NO: 36006 - DNA, 25 bp, Homo sapien
atttcagagacaacaaggcctatag

SEQ ID NO: 36007 - DNA, 25 bp, Homo sapien
atttcagagacaactaggcctatag

SEQ ID NO: 36008 - DNA, 25 bp, Homo sapien
atttcagaggaaaatctgaactgtc

SEQ ID NO: 36009 - DNA, 25 bp, Homo sapien
atttcagaggaatatctgaactgtc

SEQ ID NO: 36010 - DNA, 25 bp, Homo sapien
atttcagattacattaatacagctt

SEQ ID NO: 36011 - DNA, 25 bp, Homo sapien
atttcagattacattattacagctt

SEQ ID NO: 36012 - DNA, 25 bp, Homo sapien
atttcagccttacagtgggagcctt

SEQ ID NO: 36013 - DNA, 25 bp, Homo sapien
atttcagccttagagtgggagcctt

SEQ ID NO: 36014 - DNA, 25 bp, Homo sapien
atttcaggtggagcaaatgcttatt

SEQ ID NO: 36015 - DNA, 25 bp, Homo sapien
atttcaggttgagcaaatgcttatt

SEQ ID NO: 36016 - DNA, 25 bp, Homo sapien
atttcagtaaaaggaaagagtaagc

SEQ ID NO: 36017 - DNA, 25 bp, Homo sapien
atttcagtaaaatgaaagagtaagc

SEQ ID NO: 36018 - DNA, 25 bp, Homo sapien
atttcagtcacatcccaattaattt

SEQ ID NO: 36019 - DNA, 25 bp, Homo sapien
atttcagtcacgtcccaattaattt

SEQ ID NO: 36020 - DNA, 25 bp, Homo sapien
atttcagtcactaatggggcttcat

SEQ ID NO: 36021 - DNA, 25 bp, Homo sapien
atttcagtcactactggggcttcat

SEQ ID NO: 36022 - DNA, 25 bp, Homo sapien
atttcagtccagctaaattagaaat

SEQ ID NO: 36023 - DNA, 25 bp, Homo sapien
atttcagtccagttaaattagaaat

SEQ ID NO: 36024 - DNA, 25 bp, Homo sapien
atttcagttaaggttctcttggcac

SEQ ID NO: 36025 - DNA, 25 bp, Homo sapien
atttcagttgaggttctcttggcac

SEQ ID NO: 36026 - DNA, 25 bp, Homo sapien
atttcatacacctcataaaaacttc

SEQ ID NO: 36027 - DNA, 25 bp, Homo sapien
atttcatacacctcgtaaaaacttc

SEQ ID NO: 36028 - DNA, 25 bp, Homo sapien
atttcatcagtccctgttagctcta

SEQ ID NO: 36029 - DNA, 25 bp, Homo sapien
atttcatcagttcctgttagctcta

SEQ ID NO: 36030 - DNA, 25 bp, Homo sapien
atttcatcggcaggcactcagtctc

SEQ ID NO: 36031 - DNA, 25 bp, Homo sapien
atttcatctaaagctgacatttttt

SEQ ID NO: 36032 - DNA, 25 bp, Homo sapien
atttcatctaatgctgacatttttt

SEQ ID NO: 36033 - DNA, 25 bp, Homo sapien
atttcatctgcaggcactcagtctc

SEQ ID NO: 36034 - DNA, 25 bp, Homo sapien
atttcatgacgtcttgaggcaggtc

SEQ ID NO: 36035 - DNA, 25 bp, Homo sapien
atttcatgatgtcttgaggcaggtc

SEQ ID NO: 36036 - DNA, 25 bp, Homo sapien
atttcatgctgacgaacgtttgagt

SEQ ID NO: 36037 - DNA, 25 bp, Homo sapien
atttcatgctgatgaacgtttgagt

SEQ ID NO: 36038 - DNA, 25 bp, Homo sapien
atttcatgctgccggccactgaaag

SEQ ID NO: 36039 - DNA, 25 bp, Homo sapien
atttcatgctgctggccactgaaag

SEQ ID NO: 36040 - DNA, 25 bp, Homo sapien
atttcattgaaagtctcctccaaat

SEQ ID NO: 36041 - DNA, 25 bp, Homo sapien
atttcattggaagtctcctccaaat

SEQ ID NO: 36042 - DNA, 25 bp, Homo sapien
atttcattgtaggaagcggaagtat

SEQ ID NO: 36043 - DNA, 25 bp, Homo sapien
atttcattgtaggaagtggaagtat

SEQ ID NO: 36044 - DNA, 25 bp, Homo sapien
atttcattgttgctcttgatggttt

SEQ ID NO: 36045 - DNA, 25 bp, Homo sapien
atttcattgttgcttttgatggttt

SEQ ID NO: 36046 - DNA, 25 bp, Homo sapien
atttcatttctgtgttgggtcactt

SEQ ID NO: 36047 - DNA, 25 bp, Homo sapien
atttcatttctgttttgggtcactt

SEQ ID NO: 36048 - DNA, 25 bp, Homo sapien
atttccaaaatagctgcctaaaatg

SEQ ID NO: 36049 - DNA, 25 bp, Homo sapien
atttccaaaataggtgcctaaaatg

SEQ ID NO: 36050 - DNA, 25 bp, Homo sapien
atttccaaatagctgaactgtaaac

SEQ ID NO: 36051 - DNA, 25 bp, Homo sapien
atttccaaatagttgaactgtaaac

SEQ ID NO: 36052 - DNA, 25 bp, Homo sapien
atttccaagtgggtatagcaagctg

SEQ ID NO: 36053 - DNA, 25 bp, Homo sapien
atttccaagtggttatagcaagctg

SEQ ID NO: 36054 - DNA, 25 bp, Homo sapien
atttccaatggccatacatttacta

SEQ ID NO: 36055 - DNA, 25 bp, Homo sapien
atttccaatggccttacatttacta

SEQ ID NO: 36056 - DNA, 25 bp, Homo sapien
atttccacagaattgtcattatttg

SEQ ID NO: 36057 - DNA, 25 bp, Homo sapien
atttccacggaattgtcattatttg

SEQ ID NO: 36058 - DNA, 25 bp, Homo sapien
atttccagaatctctttgatcgctc

SEQ ID NO: 36059 - DNA, 25 bp, Homo sapien
atttccagagtctctttgatcgctc

SEQ ID NO: 36060 - DNA, 25 bp, Homo sapien
atttccagctgactcacagtgggct

SEQ ID NO: 36061 - DNA, 25 bp, Homo sapien
atttccaggtccatgttttcagagg

SEQ ID NO: 36062 - DNA, 25 bp, Homo sapien
atttccaggtccattttttcagagg

SEQ ID NO: 36063 - DNA, 25 bp, Homo sapien
atttccagttgactcacagtgggct

SEQ ID NO: 36064 - DNA, 25 bp, Homo sapien
atttccataccacactctcttcact

SEQ ID NO: 36065 - DNA, 25 bp, Homo sapien
atttccataccacagtctcttcact

SEQ ID NO: 36066 - DNA, 25 bp, Homo sapien
atttccatcagaatttgagtagctt

SEQ ID NO: 36067 - DNA, 25 bp, Homo sapien
atttccatcagtgtagcctaatcta

SEQ ID NO: 36068 - DNA, 25 bp, Homo sapien
atttccatcagtgtcgcctaatcta

SEQ ID NO: 36069 - DNA, 25 bp, Homo sapien
atttccatcattccattgtgtcacc

SEQ ID NO: 36070 - DNA, 25 bp, Homo sapien
atttccatcggaatttgagtagctt

SEQ ID NO: 36071 - DNA, 25 bp, Homo sapien
atttccatctttccattgtgtcacc

SEQ ID NO: 36072 - DNA, 25 bp, Homo sapien
atttccatgttcctataaaaatggg

SEQ ID NO: 36073 - DNA, 25 bp, Homo sapien
atttccatgttgctataaaaatggg

SEQ ID NO: 36074 - DNA, 25 bp, Homo sapien
atttccattctagttctacccatgg

SEQ ID NO: 36075 - DNA, 25 bp, Homo sapien
atttccattctggttctacccatgg

SEQ ID NO: 36076 - DNA, 25 bp, Homo sapien
atttccatttaccaagttttaggga

SEQ ID NO: 36077 - DNA, 25 bp, Homo sapien
atttccatttatcaagttttaggga

SEQ ID NO: 36078 - DNA, 25 bp, Homo sapien
atttccatttgctctgccattcaaa

SEQ ID NO: 36079 - DNA, 25 bp, Homo sapien
atttccatttgttctgccattcaaa

SEQ ID NO: 36080 - DNA, 25 bp, Homo sapien
atttcccagaacaaaagacagaaag

SEQ ID NO: 36081 - DNA, 25 bp, Homo sapien
atttcccataacaaaagacagaaag

SEQ ID NO: 36082 - DNA, 25 bp, Homo sapien
atttccctaacattaagcatttttg

SEQ ID NO: 36083 - DNA, 25 bp, Homo sapien
atttccctaacgttaagcatttttg

SEQ ID NO: 36084 - DNA, 25 bp, Homo sapien
atttcctactagctataagagtgtt

SEQ ID NO: 36085 - DNA, 25 bp, Homo sapien
atttcctactagctgtaagagtgtt

SEQ ID NO: 36086 - DNA, 25 bp, Homo sapien
atttcctcactaatatctataaggg

SEQ ID NO: 36087 - DNA, 25 bp, Homo sapien
atttcctcactaatctctataaggg

SEQ ID NO: 36088 - DNA, 25 bp, Homo sapien
atttcctcatctgttttggtatttt

SEQ ID NO: 36089 - DNA, 25 bp, Homo sapien
atttcctcttctgttttggtatttt

SEQ ID NO: 36090 - DNA, 25 bp, Homo sapien
atttcctgcagacaagactgcttct

SEQ ID NO: 36091 - DNA, 25 bp, Homo sapien
atttcctgcagataagactgcttct

SEQ ID NO: 36092 - DNA, 25 bp, Homo sapien
atttcctgttatagccagtttgtgt

SEQ ID NO: 36093 - DNA, 25 bp, Homo sapien
atttcctgttatagccggtttgtgt

SEQ ID NO: 36094 - DNA, 25 bp, Homo sapien
atttccttatttctctcagccttca

SEQ ID NO: 36095 - DNA, 25 bp, Homo sapien
atttccttatttgtctcagccttca

SEQ ID NO: 36096 - DNA, 25 bp, Homo sapien
atttccttcctacatatttgacctg

SEQ ID NO: 36097 - DNA, 25 bp, Homo sapien
atttccttcctacgtatttgacctg

SEQ ID NO: 36098 - DNA, 25 bp, Homo sapien
atttccttcgtgtccaagctagtct

SEQ ID NO: 36099 - DNA, 25 bp, Homo sapien
atttcctttgtgtccaagctagtct

SEQ ID NO: 36100 - DNA, 25 bp, Homo sapien
atttccttttgaagtagatgtttat

SEQ ID NO: 36101 - DNA, 25 bp, Homo sapien
atttccttttgaggtagatgtttat

SEQ ID NO: 36102 - DNA, 25 bp, Homo sapien
atttcgccgattcattaaaataatc

SEQ ID NO: 36103 - DNA, 25 bp, Homo sapien
atttcgccgattcgttaaaataatc

SEQ ID NO: 36104 - DNA, 25 bp, Homo sapien
atttcggaacgtgctgatctcagag

SEQ ID NO: 36105 - DNA, 25 bp, Homo sapien
atttcggaatgtgctgatctcagag

SEQ ID NO: 36106 - DNA, 25 bp, Homo sapien
atttcgtaacgctatttctgccata

SEQ ID NO: 36107 - DNA, 25 bp, Homo sapien
atttcgtaatgctatttctgccata

SEQ ID NO: 36108 - DNA, 25 bp, Homo sapien
atttctaattttatccacatcattc

SEQ ID NO: 36109 - DNA, 25 bp, Homo sapien
atttctaattttatccgcatcattc

SEQ ID NO: 36110 - DNA, 25 bp, Homo sapien
atttctacagcacaacctagcatat

SEQ ID NO: 36111 - DNA, 25 bp, Homo sapien
atttctacagcataacctagcatat

SEQ ID NO: 36112 - DNA, 25 bp, Homo sapien
atttctaccatcatagcccaagcca

SEQ ID NO: 36113 - DNA, 25 bp, Homo sapien
atttctaccatcgtagcccaagcca

SEQ ID NO: 36114 - DNA, 25 bp, Homo sapien
atttctattcttacgtggtagaacg

SEQ ID NO: 36115 - DNA, 25 bp, Homo sapien
atttctattcttatgtggtagaacg

SEQ ID NO: 36116 - DNA, 25 bp, Homo sapien
atttctcaacaaccaaagtttgaac

SEQ ID NO: 36117 - DNA, 25 bp, Homo sapien
atttctcaacaaccaatgtttgaac

SEQ ID NO: 36118 - DNA, 25 bp, Homo sapien
atttctcactgtaaggatcttcatt

SEQ ID NO: 36119 - DNA, 25 bp, Homo sapien
atttctcactgtaaggttcttcatt

SEQ ID NO: 36120 - DNA, 25 bp, Homo sapien
atttctcagcccagaactgacacat

SEQ ID NO: 36121 - DNA, 25 bp, Homo sapien
atttctcagtccagaactgacacat

SEQ ID NO: 36122 - DNA, 25 bp, Homo sapien
atttctccatttcattctagttgct

SEQ ID NO: 36123 - DNA, 25 bp, Homo sapien
atttctccattttattctagttgct

SEQ ID NO: 36124 - DNA, 25 bp, Homo sapien
atttctccgctatccaattcagccc

SEQ ID NO: 36125 - DNA, 25 bp, Homo sapien
atttctccgctatccatttcagccc

SEQ ID NO: 36126 - DNA, 25 bp, Homo sapien
atttctccttaagtacaattggatt

SEQ ID NO: 36127 - DNA, 25 bp, Homo sapien
atttctccttaagttcaattggatt

SEQ ID NO: 36128 - DNA, 25 bp, Homo sapien
atttctctatccatgtaccttaagc

SEQ ID NO: 36129 - DNA, 25 bp, Homo sapien
atttctctatccgtgtaccttaagc

SEQ ID NO: 36130 - DNA, 25 bp, Homo sapien
atttctctcctaaacgctggtataa

SEQ ID NO: 36131 - DNA, 25 bp, Homo sapien
atttctctctcacgttatatgtgtg

SEQ ID NO: 36132 - DNA, 25 bp, Homo sapien
atttctctctcatgttatatgtgtg

SEQ ID NO: 36133 - DNA, 25 bp, Homo sapien
atttctctctgatgtcaaagatttt

SEQ ID NO: 36134 - DNA, 25 bp, Homo sapien
atttctctctggtgtcaaagatttt

SEQ ID NO: 36135 - DNA, 25 bp, Homo sapien
atttctctcttaaacgctggtataa

SEQ ID NO: 36136 - DNA, 25 bp, Homo sapien
atttctcttattgcaaaattctatt

SEQ ID NO: 36137 - DNA, 25 bp, Homo sapien
atttctcttatttcaaaattctatt

SEQ ID NO: 36138 - DNA, 25 bp, Homo sapien
atttctcttcatccaggaaggcaaa

SEQ ID NO: 36139 - DNA, 25 bp, Homo sapien
atttctcttcccgggtgcgattcct

SEQ ID NO: 36140 - DNA, 25 bp, Homo sapien
atttctcttcctgggtgcgattcct

SEQ ID NO: 36141 - DNA, 25 bp, Homo sapien
atttctctttatccaggaaggcaaa

SEQ ID NO: 36142 - DNA, 25 bp, Homo sapien
atttctgacacacagtaggtgctca

SEQ ID NO: 36143 - DNA, 25 bp, Homo sapien
atttctgacccacagtaggtgctca

SEQ ID NO: 36144 - DNA, 25 bp, Homo sapien
atttctgcagttattaaaagttatg

SEQ ID NO: 36145 - DNA, 25 bp, Homo sapien
atttctgcagttcttaaaagttatg

SEQ ID NO: 36146 - DNA, 25 bp, Homo sapien
atttctgcataacttgtgtgtgtgt

SEQ ID NO: 36147 - DNA, 25 bp, Homo sapien
atttctgcataatttgtgtgtgtgt

SEQ ID NO: 36148 - DNA, 25 bp, Homo sapien
atttctggtgccctctttacaggat

SEQ ID NO: 36149 - DNA, 25 bp, Homo sapien
atttctggtgccttctttacaggat

SEQ ID NO: 36150 - DNA, 25 bp, Homo sapien
atttctgtacttgcagttgctaggg

SEQ ID NO: 36151 - DNA, 25 bp, Homo sapien
atttctgtacttggagttgctaggg

SEQ ID NO: 36152 - DNA, 25 bp, Homo sapien
atttctgtggggtgaatggtaatgt

SEQ ID NO: 36153 - DNA, 25 bp, Homo sapien
atttctgtgggttgaatggtaatgt

SEQ ID NO: 36154 - DNA, 25 bp, Homo sapien
atttctgtggtttgtaagccactca

SEQ ID NO: 36155 - DNA, 25 bp, Homo sapien
atttctgtgtacattttgagaaata

SEQ ID NO: 36156 - DNA, 25 bp, Homo sapien
atttctgtgtatattttgagaaata

SEQ ID NO: 36157 - DNA, 25 bp, Homo sapien
atttctgtgttgggtcactttcctt

SEQ ID NO: 36158 - DNA, 25 bp, Homo sapien
atttctgttgtttgtaagccactca

SEQ ID NO: 36159 - DNA, 25 bp, Homo sapien
atttctgttttgggtcactttcctt

SEQ ID NO: 36160 - DNA, 25 bp, Homo sapien
atttcttaatgcaataggagggcaa

SEQ ID NO: 36161 - DNA, 25 bp, Homo sapien
atttcttaatgcgataggagggcaa

SEQ ID NO: 36162 - DNA, 25 bp, Homo sapien
atttcttaggtgttcaggcaaggtt

SEQ ID NO: 36163 - DNA, 25 bp, Homo sapien
atttcttaggtgttgaggcaaggtt

SEQ ID NO: 36164 - DNA, 25 bp, Homo sapien
atttcttcagtgatacaagaatctt

SEQ ID NO: 36165 - DNA, 25 bp, Homo sapien
atttcttcagtgatacgagaatctt

SEQ ID NO: 36166 - DNA, 25 bp, Homo sapien
atttcttccactacaagacactaga

SEQ ID NO: 36167 - DNA, 25 bp, Homo sapien
atttcttccactgcaagacactaga

SEQ ID NO: 36168 - DNA, 25 bp, Homo sapien
atttcttccctggatttcaatttgg

SEQ ID NO: 36169 - DNA, 25 bp, Homo sapien
atttcttccctgggtttcaatttgg

SEQ ID NO: 36170 - DNA, 25 bp, Homo sapien
atttcttctcattaaatctcctgca

SEQ ID NO: 36171 - DNA, 25 bp, Homo sapien
atttcttctgaagggtattctgctg

SEQ ID NO: 36172 - DNA, 25 bp, Homo sapien
atttcttctgaaggttattctgctg

SEQ ID NO: 36173 - DNA, 25 bp, Homo sapien
atttcttctgattaaatctcctgca

SEQ ID NO: 36174 - DNA, 25 bp, Homo sapien
atttcttcttctcatttctcgccac

SEQ ID NO: 36175 - DNA, 25 bp, Homo sapien
atttcttcttctgatttctcgccac

SEQ ID NO: 36176 - DNA, 25 bp, Homo sapien
atttcttgaaataaatagcaagagc

SEQ ID NO: 36177 - DNA, 25 bp, Homo sapien
atttcttgaaatgaatagcaagagc

SEQ ID NO: 36178 - DNA, 25 bp, Homo sapien
atttcttgaactttatacttaaatg

SEQ ID NO: 36179 - DNA, 25 bp, Homo sapien
atttcttgagccgagactttttgtt

SEQ ID NO: 36180 - DNA, 25 bp, Homo sapien
atttcttgagctgagactttttgtt

SEQ ID NO: 36181 - DNA, 25 bp, Homo sapien
atttcttgagctttatacttaaatg

SEQ ID NO: 36182 - DNA, 25 bp, Homo sapien
atttcttgcctggattatagtaatt

SEQ ID NO: 36183 - DNA, 25 bp, Homo sapien
atttcttgcttggattatagtaatt

SEQ ID NO: 36184 - DNA, 25 bp, Homo sapien
atttctttacttaatctcagaactc

SEQ ID NO: 36185 - DNA, 25 bp, Homo sapien
atttctttcaattgtattcctttcc

SEQ ID NO: 36186 - DNA, 25 bp, Homo sapien
atttctttccaagtctgcataagct

SEQ ID NO: 36187 - DNA, 25 bp, Homo sapien
atttctttccaattctgcataagct

SEQ ID NO: 36188 - DNA, 25 bp, Homo sapien
atttctttccattgtattcctttcc

SEQ ID NO: 36189 - DNA, 25 bp, Homo sapien
atttctttcctatcaaattgtgtta

SEQ ID NO: 36190 - DNA, 25 bp, Homo sapien
atttctttcctatcaatttgtgtta

SEQ ID NO: 36191 - DNA, 25 bp, Homo sapien
atttctttcggtgacaaagtcacaa

SEQ ID NO: 36192 - DNA, 25 bp, Homo sapien
atttctttctccatggttaatgggt

SEQ ID NO: 36193 - DNA, 25 bp, Homo sapien
atttctttctctcggctcattaccc

SEQ ID NO: 36194 - DNA, 25 bp, Homo sapien
atttctttctcttggctcattaccc

SEQ ID NO: 36195 - DNA, 25 bp, Homo sapien
atttcttttaaacattggttctcct

SEQ ID NO: 36196 - DNA, 25 bp, Homo sapien
atttcttttaagcattggttctcct

SEQ ID NO: 36197 - DNA, 25 bp, Homo sapien
atttcttttatacatcataggtagc

SEQ ID NO: 36198 - DNA, 25 bp, Homo sapien
atttcttttcaactatgtgtttaaa

SEQ ID NO: 36199 - DNA, 25 bp, Homo sapien
atttcttttcaactgtgtgtttaaa

SEQ ID NO: 36200 - DNA, 25 bp, Homo sapien
atttcttttccctgatgacatatga

SEQ ID NO: 36201 - DNA, 25 bp, Homo sapien
atttcttttccgtgatgacatatga

SEQ ID NO: 36202 - DNA, 25 bp, Homo sapien
atttcttttcttaatctcagaactc

SEQ ID NO: 36203 - DNA, 25 bp, Homo sapien
atttcttttggtgacaaagtcacaa

SEQ ID NO: 36204 - DNA, 25 bp, Homo sapien
atttcttttgtacatcataggtagc

SEQ ID NO: 36205 - DNA, 25 bp, Homo sapien
atttctttttccatggttaatgggt

SEQ ID NO: 36206 - DNA, 25 bp, Homo sapien
atttctttttccttgcactgggcag

SEQ ID NO: 36207 - DNA, 25 bp, Homo sapien
atttctttttccttgcgctgggcag

SEQ ID NO: 36208 - DNA, 25 bp, Homo sapien
atttgaaaagaaattgtggaaattt

SEQ ID NO: 36209 - DNA, 25 bp, Homo sapien
atttgaaaatttcactattttgtca

SEQ ID NO: 36210 - DNA, 25 bp, Homo sapien
atttgaaaatttccctattttgtca

SEQ ID NO: 36211 - DNA, 25 bp, Homo sapien
atttgaaaccagaaaactgttgcca

SEQ ID NO: 36212 - DNA, 25 bp, Homo sapien
atttgaaactagaaaactgttgcca

SEQ ID NO: 36213 - DNA, 25 bp, Homo sapien
atttgaaaggaaattgtggaaattt

SEQ ID NO: 36214 - DNA, 25 bp, Homo sapien
atttgaacaaaactcttaaacagcc

SEQ ID NO: 36215 - DNA, 25 bp, Homo sapien
atttgaacaaacctcttaaacagcc

SEQ ID NO: 36216 - DNA, 25 bp, Homo sapien
atttgaaccacacacagtctaagtc

SEQ ID NO: 36217 - DNA, 25 bp, Homo sapien
atttgaaccacgcacagtctaagtc

SEQ ID NO: 36218 - DNA, 25 bp, Homo sapien
atttgaagagtttaattttttcctg

SEQ ID NO: 36219 - DNA, 25 bp, Homo sapien
atttgaagagttttattttttcctg

SEQ ID NO: 36220 - DNA, 25 bp, Homo sapien
atttgaagctacatctgaattactt

SEQ ID NO: 36221 - DNA, 25 bp, Homo sapien
atttgaagctatatctgaattactt

SEQ ID NO: 36222 - DNA, 25 bp, Homo sapien
atttgaagcttcttttgttcagagt

SEQ ID NO: 36223 - DNA, 25 bp, Homo sapien
atttgaagcttgttttgttcagagt

SEQ ID NO: 36224 - DNA, 25 bp, Homo sapien
atttgaaggagtcagacaggccgtg

SEQ ID NO: 36225 - DNA, 25 bp, Homo sapien
atttgaaggcgtcagacaggccgtg

SEQ ID NO: 36226 - DNA, 25 bp, Homo sapien
atttgaaggtggtgctgagaaggat

SEQ ID NO: 36227 - DNA, 25 bp, Homo sapien
atttgaaggtggttctgagaaggat

SEQ ID NO: 36228 - DNA, 25 bp, Homo sapien
atttgaatagaaggaatcaatttct

SEQ ID NO: 36229 - DNA, 25 bp, Homo sapien
atttgaatagaatgaatcaatttct

SEQ ID NO: 36230 - DNA, 25 bp, Homo sapien
atttgaatagcccgaagtggcggaa

SEQ ID NO: 36231 - DNA, 25 bp, Homo sapien
atttgaatagccggaagtggcggaa

SEQ ID NO: 36232 - DNA, 25 bp, Homo sapien
atttgaatatatgatacaatgatgg

SEQ ID NO: 36233 - DNA, 25 bp, Homo sapien
atttgaatatatgatataatgatgg

SEQ ID NO: 36234 - DNA, 25 bp, Homo sapien
atttgaatatgactggtatggtcct

SEQ ID NO: 36235 - DNA, 25 bp, Homo sapien
atttgaatatgagtggtatggtcct

SEQ ID NO: 36236 - DNA, 25 bp, Homo sapien
atttgaattattccagtccatagaa

SEQ ID NO: 36237 - DNA, 25 bp, Homo sapien
atttgaattattgcagtccatagaa

SEQ ID NO: 36238 - DNA, 25 bp, Homo sapien
atttgacaagagggtaaggtcagta

SEQ ID NO: 36239 - DNA, 25 bp, Homo sapien
atttgacagaggacttggacagtgt

SEQ ID NO: 36240 - DNA, 25 bp, Homo sapien
atttgacagaggtcttggacagtgt

SEQ ID NO: 36241 - DNA, 25 bp, Homo sapien
atttgacaggagggtaaggtcagta

SEQ ID NO: 36242 - DNA, 25 bp, Homo sapien
atttgacatggaaagtctaggtatt

SEQ ID NO: 36243 - DNA, 25 bp, Homo sapien
atttgacatgggaagtctaggtatt

SEQ ID NO: 36244 - DNA, 25 bp, Homo sapien
atttgacattggttctcctgtgtgt

SEQ ID NO: 36245 - DNA, 25 bp, Homo sapien
atttgacattggttttcctgtgtgt

SEQ ID NO: 36246 - DNA, 25 bp, Homo sapien
atttgactgcaaactccaccactaa

SEQ ID NO: 36247 - DNA, 25 bp, Homo sapien
atttgactgcaaactctaccactaa

SEQ ID NO: 36248 - DNA, 25 bp, Homo sapien
atttgacttgttggcatgttaattt

SEQ ID NO: 36249 - DNA, 25 bp, Homo sapien
atttgacttgttggtatgttaattt

SEQ ID NO: 36250 - DNA, 25 bp, Homo sapien
atttgactttctagcagtagcatag

SEQ ID NO: 36251 - DNA, 25 bp, Homo sapien
atttgactttctagtagtagcatag

SEQ ID NO: 36252 - DNA, 25 bp, Homo sapien
atttgagaagagacgcattggtaat

SEQ ID NO: 36253 - DNA, 25 bp, Homo sapien
atttgagaagagacgcgttggtaat

SEQ ID NO: 36254 - DNA, 25 bp, Homo sapien
atttgagtctaaaaacaaggcagtg

SEQ ID NO: 36255 - DNA, 25 bp, Homo sapien
atttgagtctaagaacaaggcagtg

SEQ ID NO: 36256 - DNA, 25 bp, Homo sapien
atttgagttactcaactgggagtcg

SEQ ID NO: 36257 - DNA, 25 bp, Homo sapien
atttgagttactgaactgggagtcg

SEQ ID NO: 36258 - DNA, 25 bp, Homo sapien
atttgagttgtttccatattttagc

SEQ ID NO: 36259 - DNA, 25 bp, Homo sapien
atttgagttgttttcatattttagc

SEQ ID NO: 36260 - DNA, 25 bp, Homo sapien
atttgatacttgacttttatattca

SEQ ID NO: 36261 - DNA, 25 bp, Homo sapien
atttgatacttgatttttatattca

SEQ ID NO: 36262 - DNA, 25 bp, Homo sapien
atttgatgaggccgtgaaatgccag

SEQ ID NO: 36263 - DNA, 25 bp, Homo sapien
atttgatgaggctgtgaaatgccag

SEQ ID NO: 36264 - DNA, 25 bp, Homo sapien
atttgatgaggtggtagagttggat

SEQ ID NO: 36265 - DNA, 25 bp, Homo sapien
atttgatgaggttgtagagttggat

SEQ ID NO: 36266 - DNA, 25 bp, Homo sapien
atttgatgatctagtcactctgtaa

SEQ ID NO: 36267 - DNA, 25 bp, Homo sapien
atttgatggaagagaattgtccccc

SEQ ID NO: 36268 - DNA, 25 bp, Homo sapien
atttgatggaagtgaattgtccccc

SEQ ID NO: 36269 - DNA, 25 bp, Homo sapien
atttgatgggtagagagcaaaaaat

SEQ ID NO: 36270 - DNA, 25 bp, Homo sapien
atttgatgggtatagagcaaaaaat

SEQ ID NO: 36271 - DNA, 25 bp, Homo sapien
atttgatggtctagtcactctgtaa

SEQ ID NO: 36272 - DNA, 25 bp, Homo sapien
atttgattcctttcgcttcctcctt

SEQ ID NO: 36273 - DNA, 25 bp, Homo sapien
atttgattcctttctcttcctcctt

SEQ ID NO: 36274 - DNA, 25 bp, Homo sapien
atttgatttcgcagtctggctaatt

SEQ ID NO: 36275 - DNA, 25 bp, Homo sapien
atttgatttgatttgatttttagac

SEQ ID NO: 36276 - DNA, 25 bp, Homo sapien
atttgatttgattttatttttagac

SEQ ID NO: 36277 - DNA, 25 bp, Homo sapien
atttgatttgatttttagacggagt

SEQ ID NO: 36278 - DNA, 25 bp, Homo sapien
atttgattttatttttagacggagt

SEQ ID NO: 36279 - DNA, 25 bp, Homo sapien
atttgattttgcagtctggctaatt

SEQ ID NO: 36280 - DNA, 25 bp, Homo sapien
atttgatttttttaacgtaagattt

SEQ ID NO: 36281 - DNA, 25 bp, Homo sapien
atttgatttttttaccgtaagattt

SEQ ID NO: 36282 - DNA, 25 bp, Homo sapien
atttgcaatcaatcaccaagttctg

SEQ ID NO: 36283 - DNA, 25 bp, Homo sapien
atttgcaatcagtcaccaagttctg

SEQ ID NO: 36284 - DNA, 25 bp, Homo sapien
atttgcacactatattaccggaaag

SEQ ID NO: 36285 - DNA, 25 bp, Homo sapien
atttgcacactgtattaccggaaag

SEQ ID NO: 36286 - DNA, 25 bp, Homo sapien
atttgcacgtccgtcttttttcttc

SEQ ID NO: 36287 - DNA, 25 bp, Homo sapien
atttgcacgtctgtcttttttcttc

SEQ ID NO: 36288 - DNA, 25 bp, Homo sapien
atttgcagatacaaagctggttttt

SEQ ID NO: 36289 - DNA, 25 bp, Homo sapien
atttgcagatacaaggctggttttt

SEQ ID NO: 36290 - DNA, 25 bp, Homo sapien
atttgcagtattagaacacagacat

SEQ ID NO: 36291 - DNA, 25 bp, Homo sapien
atttgcagtattaggacacagacat

SEQ ID NO: 36292 - DNA, 25 bp, Homo sapien
atttgcatagtatactcatttgagc

SEQ ID NO: 36293 - DNA, 25 bp, Homo sapien
atttgcatagtgtactcatttgagc

SEQ ID NO: 36294 - DNA, 25 bp, Homo sapien
atttgcatattgtggttcacccctt

SEQ ID NO: 36295 - DNA, 25 bp, Homo sapien
atttgcatgttgtggttcacccctt

SEQ ID NO: 36296 - DNA, 25 bp, Homo sapien
atttgcattaaaaactaaaaaacag

SEQ ID NO: 36297 - DNA, 25 bp, Homo sapien
atttgcattaaaaagtaaaaaacag

SEQ ID NO: 36298 - DNA, 25 bp, Homo sapien
atttgcattaagcattttataaagt

SEQ ID NO: 36299 - DNA, 25 bp, Homo sapien
atttgcattaagcgttttataaagt

SEQ ID NO: 36300 - DNA, 25 bp, Homo sapien
atttgccaaaaatttacatgctaaa

SEQ ID NO: 36301 - DNA, 25 bp, Homo sapien
atttgccaaaaatttagatgctaaa

SEQ ID NO: 36302 - DNA, 25 bp, Homo sapien
atttgccataatataaggaaaaatg

SEQ ID NO: 36303 - DNA, 25 bp, Homo sapien
atttgccataatctaaggaaaaatg

SEQ ID NO: 36304 - DNA, 25 bp, Homo sapien
atttgccatcaggtagttcatttgt

SEQ ID NO: 36305 - DNA, 25 bp, Homo sapien
atttgccattaggtagttcatttgt

SEQ ID NO: 36306 - DNA, 25 bp, Homo sapien
atttgcctacatatttggcatgtct

SEQ ID NO: 36307 - DNA, 25 bp, Homo sapien
atttgcctacatgtttggcatgtct

SEQ ID NO: 36308 - DNA, 25 bp, Homo sapien
atttgcctacttgacccacattttc

SEQ ID NO: 36309 - DNA, 25 bp, Homo sapien
atttgcctacttgatccacattttc

SEQ ID NO: 36310 - DNA, 25 bp, Homo sapien
atttgcctcgactgtctctaatttt

SEQ ID NO: 36311 - DNA, 25 bp, Homo sapien
atttgccttgactgtctctaatttt

SEQ ID NO: 36312 - DNA, 25 bp, Homo sapien
atttgctacttacgatgtgaaagca

SEQ ID NO: 36313 - DNA, 25 bp, Homo sapien
atttgctacttatgatgtgaaagca

SEQ ID NO: 36314 - DNA, 25 bp, Homo sapien
atttgctaggtcaccattgagtagg

SEQ ID NO: 36315 - DNA, 25 bp, Homo sapien
atttgctaggtcatcattgagtagg

SEQ ID NO: 36316 - DNA, 25 bp, Homo sapien
atttgctcaagaaaaatgaaattac

SEQ ID NO: 36317 - DNA, 25 bp, Homo sapien
atttgctcaaggaaaatgaaattac

SEQ ID NO: 36318 - DNA, 25 bp, Homo sapien
atttgctcttggattcaccaagcac

SEQ ID NO: 36319 - DNA, 25 bp, Homo sapien
atttgctcttggattcgccaagcac

SEQ ID NO: 36320 - DNA, 25 bp, Homo sapien
atttgctgagtaacacctgcattct

SEQ ID NO: 36321 - DNA, 25 bp, Homo sapien
atttgctgagtaactcctgcattct

SEQ ID NO: 36322 - DNA, 25 bp, Homo sapien
atttgctgggacgcagtatgaccag

SEQ ID NO: 36323 - DNA, 25 bp, Homo sapien
atttgctgggacgcggtatgaccag

SEQ ID NO: 36324 - DNA, 25 bp, Homo sapien
atttgctgtaaattcctttcagggt

SEQ ID NO: 36325 - DNA, 25 bp, Homo sapien
atttgctgtaaatttctttcagggt

SEQ ID NO: 36326 - DNA, 25 bp, Homo sapien
atttgcttagaagcgtaaggtttat

SEQ ID NO: 36327 - DNA, 25 bp, Homo sapien
atttgcttagaagcttaaggtttat

SEQ ID NO: 36328 - DNA, 25 bp, Homo sapien
atttgcttcaccttctgttttcaaa

SEQ ID NO: 36329 - DNA, 25 bp, Homo sapien
atttgcttcgccttctgttttcaaa

SEQ ID NO: 36330 - DNA, 25 bp, Homo sapien
atttgcttcgcgtttggagagtttt

SEQ ID NO: 36331 - DNA, 25 bp, Homo sapien
atttgcttgcttaggattttcatat

SEQ ID NO: 36332 - DNA, 25 bp, Homo sapien
atttgcttgcttgggattttcatat

SEQ ID NO: 36333 - DNA, 25 bp, Homo sapien
atttgcttggcctcggaacccaaag

SEQ ID NO: 36334 - DNA, 25 bp, Homo sapien
atttgcttggccttggaacccaaag

SEQ ID NO: 36335 - DNA, 25 bp, Homo sapien
atttgctttcctgtaccagacacct

SEQ ID NO: 36336 - DNA, 25 bp, Homo sapien
atttgctttcctttaccagacacct

SEQ ID NO: 36337 - DNA, 25 bp, Homo sapien
atttgctttgcgtttggagagtttt

SEQ ID NO: 36338 - DNA, 25 bp, Homo sapien
atttggaaacactgatggcctatct

SEQ ID NO: 36339 - DNA, 25 bp, Homo sapien
atttggaaactttaattgatgtaat

SEQ ID NO: 36340 - DNA, 25 bp, Homo sapien
atttggaaactttagttgatgtaat

SEQ ID NO: 36341 - DNA, 25 bp, Homo sapien
atttggaaatactgatggcctatct

SEQ ID NO: 36342 - DNA, 25 bp, Homo sapien
atttggaaatctacatgccactgtc

SEQ ID NO: 36343 - DNA, 25 bp, Homo sapien
atttggaaatctacctgccactgtc

SEQ ID NO: 36344 - DNA, 25 bp, Homo sapien
atttggaaatgactggggacatttt

SEQ ID NO: 36345 - DNA, 25 bp, Homo sapien
atttggaaattaaatgtctgagaac

SEQ ID NO: 36346 - DNA, 25 bp, Homo sapien
atttggaaattaagtgtctgagaac

SEQ ID NO: 36347 - DNA, 25 bp, Homo sapien
atttggaattgactggggacatttt

SEQ ID NO: 36348 - DNA, 25 bp, Homo sapien
atttggagaatgcaaaaaaatcaaa

SEQ ID NO: 36349 - DNA, 25 bp, Homo sapien
atttggagaatgcagaaaaatcaaa

SEQ ID NO: 36350 - DNA, 25 bp, Homo sapien
atttggagcaattatacatagtact

SEQ ID NO: 36351 - DNA, 25 bp, Homo sapien
atttggagcaattatagatagtact

SEQ ID NO: 36352 - DNA, 25 bp, Homo sapien
atttggagtcagtttctcccaccac

SEQ ID NO: 36353 - DNA, 25 bp, Homo sapien
atttggagttagtttctcccaccac

SEQ ID NO: 36354 - DNA, 25 bp, Homo sapien
atttggatcaaccctcagaacacac

SEQ ID NO: 36355 - DNA, 25 bp, Homo sapien
atttggatcaactctcagaacacac

SEQ ID NO: 36356 - DNA, 25 bp, Homo sapien
atttggatgtctggatctctatcaa

SEQ ID NO: 36357 - DNA, 25 bp, Homo sapien
atttggatttctggatctctatcaa

SEQ ID NO: 36358 - DNA, 25 bp, Homo sapien
atttggcaacagaaatatgcaaaat

SEQ ID NO: 36359 - DNA, 25 bp, Homo sapien
atttggcaatagaaatatgcaaaat

SEQ ID NO: 36360 - DNA, 25 bp, Homo sapien
atttggcatacacatacgagttgaa

SEQ ID NO: 36361 - DNA, 25 bp, Homo sapien
atttggcatacgcatacgagttgaa

SEQ ID NO: 36362 - DNA, 25 bp, Homo sapien
atttggccatcactcgggaaaatcc

SEQ ID NO: 36363 - DNA, 25 bp, Homo sapien
atttggccatcattcgggaaaatcc

SEQ ID NO: 36364 - DNA, 25 bp, Homo sapien
atttggctccaagagagatgaagcc

SEQ ID NO: 36365 - DNA, 25 bp, Homo sapien
atttggctccaatagagatgaagcc

SEQ ID NO: 36366 - DNA, 25 bp, Homo sapien
atttggctgaacacaaaacactgga

SEQ ID NO: 36367 - DNA, 25 bp, Homo sapien
atttggctgaatacaaaacactgga

SEQ ID NO: 36368 - DNA, 25 bp, Homo sapien
atttggctgttgttctccagaaccc

SEQ ID NO: 36369 - DNA, 25 bp, Homo sapien
atttggctgtttttctccagaaccc

SEQ ID NO: 36370 - DNA, 25 bp, Homo sapien
atttggctttcattacacagtagct

SEQ ID NO: 36371 - DNA, 25 bp, Homo sapien
atttggctttcattgcacagtagct

SEQ ID NO: 36372 - DNA, 25 bp, Homo sapien
atttgggaacaactctttggcaggg

SEQ ID NO: 36373 - DNA, 25 bp, Homo sapien
atttgggaacaattctttggcaggg

SEQ ID NO: 36374 - DNA, 25 bp, Homo sapien
atttgggacatattggattaactaa

SEQ ID NO: 36375 - DNA, 25 bp, Homo sapien
atttgggacatattggcttaactaa

SEQ ID NO: 36376 - DNA, 25 bp, Homo sapien
atttgggagatacttcagagggaga

SEQ ID NO: 36377 - DNA, 25 bp, Homo sapien
atttgggagatatttcagagggaga

SEQ ID NO: 36378 - DNA, 25 bp, Homo sapien
atttgggagtttctactgctctgat

SEQ ID NO: 36379 - DNA, 25 bp, Homo sapien
atttgggagtttctcctgctctgat

SEQ ID NO: 36380 - DNA, 25 bp, Homo sapien
atttgggatgactaaaaagttttgg

SEQ ID NO: 36381 - DNA, 25 bp, Homo sapien
atttgggatgattaaaaagttttgg

SEQ ID NO: 36382 - DNA, 25 bp, Homo sapien
atttgggccgcaaagtaacaacaac

SEQ ID NO: 36383 - DNA, 25 bp, Homo sapien
atttgggcctcaaagtaacaacaac

SEQ ID NO: 36384 - DNA, 25 bp, Homo sapien
atttgggcgcctcaatccatctcct

SEQ ID NO: 36385 - DNA, 25 bp, Homo sapien
atttgggctcctcaatccatctcct

SEQ ID NO: 36386 - DNA, 25 bp, Homo sapien
atttgggctttccaggtctgccttc

SEQ ID NO: 36387 - DNA, 25 bp, Homo sapien
atttgggctttccatgtctgccttc

SEQ ID NO: 36388 - DNA, 25 bp, Homo sapien
atttggggactcaattaatggaaca

SEQ ID NO: 36389 - DNA, 25 bp, Homo sapien
atttggggactgaattaatggaaca

SEQ ID NO: 36390 - DNA, 25 bp, Homo sapien
atttggggctgcacctaacttctgc

SEQ ID NO: 36391 - DNA, 25 bp, Homo sapien
atttggggctgcatctaacttctgc

SEQ ID NO: 36392 - DNA, 25 bp, Homo sapien
atttgtaaaccgtacgccttgacca

SEQ ID NO: 36393 - DNA, 25 bp, Homo sapien
atttgtaaaccgtgcgccttgacca

SEQ ID NO: 36394 - DNA, 25 bp, Homo sapien
atttgtaagaataagaatggtacgt

SEQ ID NO: 36395 - DNA, 25 bp, Homo sapien
atttgtaagaataagagtggtacgt

SEQ ID NO: 36396 - DNA, 25 bp, Homo sapien
atttgtaagtcctgcaagatcatga

SEQ ID NO: 36397 - DNA, 25 bp, Homo sapien
atttgtaagtcgtgcaagatcatga

SEQ ID NO: 36398 - DNA, 25 bp, Homo sapien
atttgtacatcttaaaaattgacat

SEQ ID NO: 36399 - DNA, 25 bp, Homo sapien
atttgtacatcttgaaaattgacat

SEQ ID NO: 36400 - DNA, 25 bp, Homo sapien
atttgtagacgtgaactgcatcaga

SEQ ID NO: 36401 - DNA, 25 bp, Homo sapien
atttgtagatgtgaactgcatcaga

SEQ ID NO: 36402 - DNA, 25 bp, Homo sapien
atttgtagccagtgttgcgtgtctt

SEQ ID NO: 36403 - DNA, 25 bp, Homo sapien
atttgtagccagtgtttcgtgtctt

SEQ ID NO: 36404 - DNA, 25 bp, Homo sapien
atttgtatcttattgtaaggaaagc

SEQ ID NO: 36405 - DNA, 25 bp, Homo sapien
atttgtattattgtctcagacctca

SEQ ID NO: 36406 - DNA, 25 bp, Homo sapien
atttgtattcttgtctcagacctca

SEQ ID NO: 36407 - DNA, 25 bp, Homo sapien
atttgtattgctatcaacaacgtat

SEQ ID NO: 36408 - DNA, 25 bp, Homo sapien
atttgtattgctatcagcaacgtat

SEQ ID NO: 36409 - DNA, 25 bp, Homo sapien
atttgtattgcttcatccctgcccc

SEQ ID NO: 36410 - DNA, 25 bp, Homo sapien
atttgtattgcttcgtccctgcccc

SEQ ID NO: 36411 - DNA, 25 bp, Homo sapien
atttgtattttattgtaaggaaagc

SEQ ID NO: 36412 - DNA, 25 bp, Homo sapien
atttgtcacaaacaaacagcagtga

SEQ ID NO: 36413 - DNA, 25 bp, Homo sapien
atttgtcagaaacaaacagcagtga

SEQ ID NO: 36414 - DNA, 25 bp, Homo sapien
atttgtccaacagcacatagttaat

SEQ ID NO: 36415 - DNA, 25 bp, Homo sapien
atttgtccaacagcacgtagttaat

SEQ ID NO: 36416 - DNA, 25 bp, Homo sapien
atttgtccatatttccatgtattat

SEQ ID NO: 36417 - DNA, 25 bp, Homo sapien
atttgtccatattttcatgtattat

SEQ ID NO: 36418 - DNA, 25 bp, Homo sapien
atttgtcgtagtctggaactatttt

SEQ ID NO: 36419 - DNA, 25 bp, Homo sapien
atttgtcgtcgtctggaactatttt

SEQ ID NO: 36420 - DNA, 25 bp, Homo sapien
atttgtctacataagatcctgctca

SEQ ID NO: 36421 - DNA, 25 bp, Homo sapien
atttgtctatataagatcctgctca

SEQ ID NO: 36422 - DNA, 25 bp, Homo sapien
atttgtctcaaggaatttttaaatg

SEQ ID NO: 36423 - DNA, 25 bp, Homo sapien
atttgtctcgaggaatttttaaatg

SEQ ID NO: 36424 - DNA, 25 bp, Homo sapien
atttgtctgtgatccctgaagcaac

SEQ ID NO: 36425 - DNA, 25 bp, Homo sapien
atttgtctttgatccctgaagcaac

SEQ ID NO: 36426 - DNA, 25 bp, Homo sapien
atttgtgaaagatggctataggaga

SEQ ID NO: 36427 - DNA, 25 bp, Homo sapien
atttgtgaacgatggctataggaga

SEQ ID NO: 36428 - DNA, 25 bp, Homo sapien
atttgtgactgtgaattatttatta

SEQ ID NO: 36429 - DNA, 25 bp, Homo sapien
atttgtgagataagtctgcaaactg

SEQ ID NO: 36430 - DNA, 25 bp, Homo sapien
atttgtgagatcagtctgcaaactg

SEQ ID NO: 36431 - DNA, 25 bp, Homo sapien
atttgtgattgtgaattatttatta

SEQ ID NO: 36432 - DNA, 25 bp, Homo sapien
atttgtgctaacgatctctgtctcc

SEQ ID NO: 36433 - DNA, 25 bp, Homo sapien
atttgtgctaatgatctctgtctcc

SEQ ID NO: 36434 - DNA, 25 bp, Homo sapien
atttgtggattggtcttagttcatt

SEQ ID NO: 36435 - DNA, 25 bp, Homo sapien
atttgtggccaccatgagttatgag

SEQ ID NO: 36436 - DNA, 25 bp, Homo sapien
atttgtggccatcatgagttatgag

SEQ ID NO: 36437 - DNA, 25 bp, Homo sapien
atttgtgggttggtcttagttcatt

SEQ ID NO: 36438 - DNA, 25 bp, Homo sapien
atttgtggtaacaacaatagagacc

SEQ ID NO: 36439 - DNA, 25 bp, Homo sapien
atttgtggtaacagcaatagagacc

SEQ ID NO: 36440 - DNA, 25 bp, Homo sapien
atttgtgtttacgcatttaccttca

SEQ ID NO: 36441 - DNA, 25 bp, Homo sapien
atttgtgtttatgcatttaccttca

SEQ ID NO: 36442 - DNA, 25 bp, Homo sapien
atttgtgtttccctaattgctagtg

SEQ ID NO: 36443 - DNA, 25 bp, Homo sapien
atttgtgtttctctaattgctagtg

SEQ ID NO: 36444 - DNA, 25 bp, Homo sapien
atttgtgttttccgctaggttgctt

SEQ ID NO: 36445 - DNA, 25 bp, Homo sapien
atttgtgttttcctctaggttgctt

SEQ ID NO: 36446 - DNA, 25 bp, Homo sapien
atttgttagaacccatggttgccac

SEQ ID NO: 36447 - DNA, 25 bp, Homo sapien
atttgttagaactcatggttgccac

SEQ ID NO: 36448 - DNA, 25 bp, Homo sapien
atttgttcagtcgtctaataatttt

SEQ ID NO: 36449 - DNA, 25 bp, Homo sapien
atttgttcagtcttctaataatttt

SEQ ID NO: 36450 - DNA, 25 bp, Homo sapien
atttgttcattaaggtgattattgg

SEQ ID NO: 36451 - DNA, 25 bp, Homo sapien
atttgttcattagggtgattattgg

SEQ ID NO: 36452 - DNA, 25 bp, Homo sapien
atttgttctcaccacaggcatctct

SEQ ID NO: 36453 - DNA, 25 bp, Homo sapien
atttgttctctggcaatgtgaatat

SEQ ID NO: 36454 - DNA, 25 bp, Homo sapien
atttgttctctggctatgtgaatat

SEQ ID NO: 36455 - DNA, 25 bp, Homo sapien
atttgttctgaccacaggcatctct

SEQ ID NO: 36456 - DNA, 25 bp, Homo sapien
atttgttcttagaataaatgacaat

SEQ ID NO: 36457 - DNA, 25 bp, Homo sapien
atttgttcttagagtaaatgacaat

SEQ ID NO: 36458 - DNA, 25 bp, Homo sapien
atttgttgaatgttgttgaagagag

SEQ ID NO: 36459 - DNA, 25 bp, Homo sapien
atttgttgagcattggcaataagtc

SEQ ID NO: 36460 - DNA, 25 bp, Homo sapien
atttgttgagcgttggcaataagtc

SEQ ID NO: 36461 - DNA, 25 bp, Homo sapien
atttgttgcatgttgttgaagagag

SEQ ID NO: 36462 - DNA, 25 bp, Homo sapien
atttgttggctcatataatggtaaa

SEQ ID NO: 36463 - DNA, 25 bp, Homo sapien
atttgttggttcatataatggtaaa

SEQ ID NO: 36464 - DNA, 25 bp, Homo sapien
atttgttgtatcatttctatttttg

SEQ ID NO: 36465 - DNA, 25 bp, Homo sapien
atttgttgtatcgtttctatttttg

SEQ ID NO: 36466 - DNA, 25 bp, Homo sapien
atttgtttatccatgagttgtttaa

SEQ ID NO: 36467 - DNA, 25 bp, Homo sapien
atttgtttatccgtgagttgtttaa

SEQ ID NO: 36468 - DNA, 25 bp, Homo sapien
atttgtttatcgtggtataacaggc

SEQ ID NO: 36469 - DNA, 25 bp, Homo sapien
atttgtttatcgtggtgtaacaggc

SEQ ID NO: 36470 - DNA, 25 bp, Homo sapien
atttgtttcaatccagcaatcccac

SEQ ID NO: 36471 - DNA, 25 bp, Homo sapien
atttgtttcaatccggcaatcccac

SEQ ID NO: 36472 - DNA, 25 bp, Homo sapien
atttgtttccaattctccagcataa

SEQ ID NO: 36473 - DNA, 25 bp, Homo sapien
atttgtttccagttctccagcataa

SEQ ID NO: 36474 - DNA, 25 bp, Homo sapien
atttgtttccttaagctcttaacta

SEQ ID NO: 36475 - DNA, 25 bp, Homo sapien
atttgtttccttaggctcttaacta

SEQ ID NO: 36476 - DNA, 25 bp, Homo sapien
atttgttttagcacctgatttagtc

SEQ ID NO: 36477 - DNA, 25 bp, Homo sapien
atttgttttagtacctgatttagtc

SEQ ID NO: 36478 - DNA, 25 bp, Homo sapien
atttgttttgtctgcgaaaatctat

SEQ ID NO: 36479 - DNA, 25 bp, Homo sapien
atttgttttgtctgtgaaaatctat

SEQ ID NO: 36480 - DNA, 25 bp, Homo sapien
attttaaacaatcaaacatggactt

SEQ ID NO: 36481 - DNA, 25 bp, Homo sapien
attttaaacgatcaaacatggactt

SEQ ID NO: 36482 - DNA, 25 bp, Homo sapien
attttaaagttggcgttgatggaac

SEQ ID NO: 36483 - DNA, 25 bp, Homo sapien
attttaaagttggctttgatggaac

SEQ ID NO: 36484 - DNA, 25 bp, Homo sapien
attttaaatatactacacctcaggg

SEQ ID NO: 36485 - DNA, 25 bp, Homo sapien
attttaaatatgctacacctcaggg

SEQ ID NO: 36486 - DNA, 25 bp, Homo sapien
attttaaattggccattccacctta

SEQ ID NO: 36487 - DNA, 25 bp, Homo sapien
attttaaattggtcattccacctta

SEQ ID NO: 36488 - DNA, 25 bp, Homo sapien
attttaacactcaccatagctcaga

SEQ ID NO: 36489 - DNA, 25 bp, Homo sapien
attttaacactcatcatagctcaga

SEQ ID NO: 36490 - DNA, 25 bp, Homo sapien
attttaacagatcgaatgggagttc

SEQ ID NO: 36491 - DNA, 25 bp, Homo sapien
attttaacagattgaatgggagttc

SEQ ID NO: 36492 - DNA, 25 bp, Homo sapien
attttaacattccaaacatgaatca

SEQ ID NO: 36493 - DNA, 25 bp, Homo sapien
attttaacattctaaacatgaatca

SEQ ID NO: 36494 - DNA, 25 bp, Homo sapien
attttaactcataaaaattacaaat

SEQ ID NO: 36495 - DNA, 25 bp, Homo sapien
attttaactcataaaagttacaaat

SEQ ID NO: 36496 - DNA, 25 bp, Homo sapien
attttaagcgatctacagtctggtg

SEQ ID NO: 36497 - DNA, 25 bp, Homo sapien
attttaagctcaccgttgagagacc

SEQ ID NO: 36498 - DNA, 25 bp, Homo sapien
attttaagctcactgttgagagacc

SEQ ID NO: 36499 - DNA, 25 bp, Homo sapien
attttaagtatgtgcagattcaagc

SEQ ID NO: 36500 - DNA, 25 bp, Homo sapien
attttaagtatgtgtagattcaagc

SEQ ID NO: 36501 - DNA, 25 bp, Homo sapien
attttaagtgatctacagtctggtg

SEQ ID NO: 36502 - DNA, 25 bp, Homo sapien
attttaagtttgccgtttaggctct

SEQ ID NO: 36503 - DNA, 25 bp, Homo sapien
attttaagtttgctgtttaggctct

SEQ ID NO: 36504 - DNA, 25 bp, Homo sapien
attttaataagttgcatattttgac

SEQ ID NO: 36505 - DNA, 25 bp, Homo sapien
attttaatcacaaggaacaatcaga

SEQ ID NO: 36506 - DNA, 25 bp, Homo sapien
attttaatcacacggaacaatcaga

SEQ ID NO: 36507 - DNA, 25 bp, Homo sapien
attttaatccctatcaagagacaga

SEQ ID NO: 36508 - DNA, 25 bp, Homo sapien
attttaatccgtcaggtttccatgt

SEQ ID NO: 36509 - DNA, 25 bp, Homo sapien
attttaatcgtatgtccatgaaact

SEQ ID NO: 36510 - DNA, 25 bp, Homo sapien
attttaatctgtcaggtttccatgt

SEQ ID NO: 36511 - DNA, 25 bp, Homo sapien
attttaatgagttgcatattttgac

SEQ ID NO: 36512 - DNA, 25 bp, Homo sapien
attttaatggtatgtccatgaaact

SEQ ID NO: 36513 - DNA, 25 bp, Homo sapien
attttaatgtctctctctgttcctt

SEQ ID NO: 36514 - DNA, 25 bp, Homo sapien
attttaatgtctctctgtgttcctt

SEQ ID NO: 36515 - DNA, 25 bp, Homo sapien
attttaattcctatcaagagacaga

SEQ ID NO: 36516 - DNA, 25 bp, Homo sapien
attttacagacagcagaaactgtat

SEQ ID NO: 36517 - DNA, 25 bp, Homo sapien
attttacagacagcggaaactgtat

SEQ ID NO: 36518 - DNA, 25 bp, Homo sapien
attttacagagtagccttgtgttta

SEQ ID NO: 36519 - DNA, 25 bp, Homo sapien
attttacagagtaggcttgtgttta

SEQ ID NO: 36520 - DNA, 25 bp, Homo sapien
attttaccatgccgtttattcatcc

SEQ ID NO: 36521 - DNA, 25 bp, Homo sapien
attttaccatgctgtttattcatcc

SEQ ID NO: 36522 - DNA, 25 bp, Homo sapien
attttacgctgacaaacccaatcta

SEQ ID NO: 36523 - DNA, 25 bp, Homo sapien
attttacgctgaccaacccaatcta

SEQ ID NO: 36524 - DNA, 25 bp, Homo sapien
attttactcattctttactgagttc

SEQ ID NO: 36525 - DNA, 25 bp, Homo sapien
attttactcgttctttactgagttc

SEQ ID NO: 36526 - DNA, 25 bp, Homo sapien
attttactgctacgtctctcaggtc

SEQ ID NO: 36527 - DNA, 25 bp, Homo sapien
attttactgctatgtctctcaggtc

SEQ ID NO: 36528 - DNA, 25 bp, Homo sapien
attttagaagccacaagtttaaaga

SEQ ID NO: 36529 - DNA, 25 bp, Homo sapien
attttagaagccgcaagtttaaaga

SEQ ID NO: 36530 - DNA, 25 bp, Homo sapien
attttagaatacctcatgagattga

SEQ ID NO: 36531 - DNA, 25 bp, Homo sapien
attttagaatacttcatgagattga

SEQ ID NO: 36532 - DNA, 25 bp, Homo sapien
attttagaatttgggtttagttaag

SEQ ID NO: 36533 - DNA, 25 bp, Homo sapien
attttagagtttgggtttagttaag

SEQ ID NO: 36534 - DNA, 25 bp, Homo sapien
attttagcacttctaaaatcattgt

SEQ ID NO: 36535 - DNA, 25 bp, Homo sapien
attttagcacttttaaaatcattgt

SEQ ID NO: 36536 - DNA, 25 bp, Homo sapien
attttagcagtacgaaacagactaa

SEQ ID NO: 36537 - DNA, 25 bp, Homo sapien
attttagcagtatgaaacagactaa

SEQ ID NO: 36538 - DNA, 25 bp, Homo sapien
attttagcataagctcatttgtact

SEQ ID NO: 36539 - DNA, 25 bp, Homo sapien
attttagcgtaagctcatttgtact

SEQ ID NO: 36540 - DNA, 25 bp, Homo sapien
attttaggctatgcatttaaatctc

SEQ ID NO: 36541 - DNA, 25 bp, Homo sapien
attttaggctattcatttaaatctc

SEQ ID NO: 36542 - DNA, 25 bp, Homo sapien
attttagttatgcaatgctaccaca

SEQ ID NO: 36543 - DNA, 25 bp, Homo sapien
attttagttatgtaatgctaccaca

SEQ ID NO: 36544 - DNA, 25 bp, Homo sapien
attttatagacgatgagttgaaagc

SEQ ID NO: 36545 - DNA, 25 bp, Homo sapien
attttatagacgctgagttgaaagc

SEQ ID NO: 36546 - DNA, 25 bp, Homo sapien
attttatatatgccttcaagcttga

SEQ ID NO: 36547 - DNA, 25 bp, Homo sapien
attttatatatggcttcaagcttga

SEQ ID NO: 36548 - DNA, 25 bp, Homo sapien
attttatatccaaacaagtcaagct

SEQ ID NO: 36549 - DNA, 25 bp, Homo sapien
attttatatccaagcaagtcaagct

SEQ ID NO: 36550 - DNA, 25 bp, Homo sapien
attttatatgacacgagaaaaaatg

SEQ ID NO: 36551 - DNA, 25 bp, Homo sapien
attttatatgacatgagaaaaaatg

SEQ ID NO: 36552 - DNA, 25 bp, Homo sapien
attttatcaagggccatttctgtgt

SEQ ID NO: 36553 - DNA, 25 bp, Homo sapien
attttatcaagggctatttctgtgt

SEQ ID NO: 36554 - DNA, 25 bp, Homo sapien
attttatcatttctgtcattttctt

SEQ ID NO: 36555 - DNA, 25 bp, Homo sapien
attttatcatttttctgatcctacc

SEQ ID NO: 36556 - DNA, 25 bp, Homo sapien
attttatccacatcattctcctata

SEQ ID NO: 36557 - DNA, 25 bp, Homo sapien
attttatccagtgttaaggcttact

SEQ ID NO: 36558 - DNA, 25 bp, Homo sapien
attttatccgcatcattctcctata

SEQ ID NO: 36559 - DNA, 25 bp, Homo sapien
attttatccggtgttaaggcttact

SEQ ID NO: 36560 - DNA, 25 bp, Homo sapien
attttatcgtttctgtcattttctt

SEQ ID NO: 36561 - DNA, 25 bp, Homo sapien
attttatcgtttttctgatcctacc

SEQ ID NO: 36562 - DNA, 25 bp, Homo sapien
attttatctcctttgagcaacatct

SEQ ID NO: 36563 - DNA, 25 bp, Homo sapien
attttatctgctttgagcaacatct

SEQ ID NO: 36564 - DNA, 25 bp, Homo sapien
attttatggtaagatacagagaatt

SEQ ID NO: 36565 - DNA, 25 bp, Homo sapien
attttatggtaagatagagagaatt

SEQ ID NO: 36566 - DNA, 25 bp, Homo sapien
attttatgtcaaagattagatcaag

SEQ ID NO: 36567 - DNA, 25 bp, Homo sapien
attttatgtcaaaggttagatcaag

SEQ ID NO: 36568 - DNA, 25 bp, Homo sapien
attttattatgtgatttttcctgct

SEQ ID NO: 36569 - DNA, 25 bp, Homo sapien
attttattatgtggtttttcctgct

SEQ ID NO: 36570 - DNA, 25 bp, Homo sapien
attttattggccatctctctgactg

SEQ ID NO: 36571 - DNA, 25 bp, Homo sapien
attttattggccgtctctctgactg

SEQ ID NO: 36572 - DNA, 25 bp, Homo sapien
attttattgtctcttcccatacctc

SEQ ID NO: 36573 - DNA, 25 bp, Homo sapien
attttattgtctcttctcatacctc

SEQ ID NO: 36574 - DNA, 25 bp, Homo sapien
attttatttatccgacatttttctt

SEQ ID NO: 36575 - DNA, 25 bp, Homo sapien
attttatttatctgacatttttctt

SEQ ID NO: 36576 - DNA, 25 bp, Homo sapien
attttattttaagctaacatacaca

SEQ ID NO: 36577 - DNA, 25 bp, Homo sapien
attttattttaaggtaacatacaca

SEQ ID NO: 36578 - DNA, 25 bp, Homo sapien
attttcaaaaaacggtcagctgatc

SEQ ID NO: 36579 - DNA, 25 bp, Homo sapien
attttcaaaaaatggtcagctgatc

SEQ ID NO: 36580 - DNA, 25 bp, Homo sapien
attttcaaaacacaaaagtataaag

SEQ ID NO: 36581 - DNA, 25 bp, Homo sapien
attttcaaaacataaaagtataaag

SEQ ID NO: 36582 - DNA, 25 bp, Homo sapien
attttcaaaatcactacagctgtcc

SEQ ID NO: 36583 - DNA, 25 bp, Homo sapien
attttcaaaatgccctttgcaatga

SEQ ID NO: 36584 - DNA, 25 bp, Homo sapien
attttcaaaatgtcctttgcaatga

SEQ ID NO: 36585 - DNA, 25 bp, Homo sapien
attttcaaataactccatggtgttc

SEQ ID NO: 36586 - DNA, 25 bp, Homo sapien
attttcaaataatgccaggaaatgc

SEQ ID NO: 36587 - DNA, 25 bp, Homo sapien
attttcaaataatgtcaggaaatgc

SEQ ID NO: 36588 - DNA, 25 bp, Homo sapien
attttcaaatcttaaggcagcattt

SEQ ID NO: 36589 - DNA, 25 bp, Homo sapien
attttcaaatcttaagtcagcattt

SEQ ID NO: 36590 - DNA, 25 bp, Homo sapien
attttcaaatgatgtggtattgtct

SEQ ID NO: 36591 - DNA, 25 bp, Homo sapien
attttcaaattcactacagctgtcc

SEQ ID NO: 36592 - DNA, 25 bp, Homo sapien
attttcaactgtgggaatcaagact

SEQ ID NO: 36593 - DNA, 25 bp, Homo sapien
attttcaagaatcctcatacaaatt

SEQ ID NO: 36594 - DNA, 25 bp, Homo sapien
attttcaagaatcctcgtacaaatt

SEQ ID NO: 36595 - DNA, 25 bp, Homo sapien
attttcaagtaactccatggtgttc

SEQ ID NO: 36596 - DNA, 25 bp, Homo sapien
attttcaagtgatgtggtattgtct

SEQ ID NO: 36597 - DNA, 25 bp, Homo sapien
attttcaattgtgggaatcaagact

SEQ ID NO: 36598 - DNA, 25 bp, Homo sapien
attttcacatacaacgctttgataa

SEQ ID NO: 36599 - DNA, 25 bp, Homo sapien
attttcacatacaatgctttgataa

SEQ ID NO: 36600 - DNA, 25 bp, Homo sapien
attttcaccgcaattttctaaataa

SEQ ID NO: 36601 - DNA, 25 bp, Homo sapien
attttcaccgggaagtgtcaagttc

SEQ ID NO: 36602 - DNA, 25 bp, Homo sapien
attttcacctttaatcaacagcata

SEQ ID NO: 36603 - DNA, 25 bp, Homo sapien
attttcacctttagtcaacagcata

SEQ ID NO: 36604 - DNA, 25 bp, Homo sapien
attttcacgggtgtaggttttctca

SEQ ID NO: 36605 - DNA, 25 bp, Homo sapien
attttcacgggtttaggttttctca

SEQ ID NO: 36606 - DNA, 25 bp, Homo sapien
attttcactctaccaaaaaaaggca

SEQ ID NO: 36607 - DNA, 25 bp, Homo sapien
attttcactctaccaacaaaaggca

SEQ ID NO: 36608 - DNA, 25 bp, Homo sapien
attttcactgcaattttctaaataa

SEQ ID NO: 36609 - DNA, 25 bp, Homo sapien
attttcactgggaagtgtcaagttc

SEQ ID NO: 36610 - DNA, 25 bp, Homo sapien
attttcactttgaagtctttttact

SEQ ID NO: 36611 - DNA, 25 bp, Homo sapien
attttcacttttaagtctttttact

SEQ ID NO: 36612 - DNA, 25 bp, Homo sapien
attttcagcaagttcattagttggg

SEQ ID NO: 36613 - DNA, 25 bp, Homo sapien
attttcagcatctgtgagattattt

SEQ ID NO: 36614 - DNA, 25 bp, Homo sapien
attttcagcatctttgagattattt

SEQ ID NO: 36615 - DNA, 25 bp, Homo sapien
attttcagccacatttatttactgt

SEQ ID NO: 36616 - DNA, 25 bp, Homo sapien
attttcagccacgtttatttactgt

SEQ ID NO: 36617 - DNA, 25 bp, Homo sapien
attttcaggctccttaagtctcata

SEQ ID NO: 36618 - DNA, 25 bp, Homo sapien
attttcaggctcgttaagtctcata

SEQ ID NO: 36619 - DNA, 25 bp, Homo sapien
attttcaggtgttcactagttccta

SEQ ID NO: 36620 - DNA, 25 bp, Homo sapien
attttcaggtgttcgctagttccta

SEQ ID NO: 36621 - DNA, 25 bp, Homo sapien
attttcagtaagttcattagttggg

SEQ ID NO: 36622 - DNA, 25 bp, Homo sapien
attttcagttgacttctcaattttc

SEQ ID NO: 36623 - DNA, 25 bp, Homo sapien
attttcagttgccttctcaattttc

SEQ ID NO: 36624 - DNA, 25 bp, Homo sapien
attttcatactctcagaagagaaac

SEQ ID NO: 36625 - DNA, 25 bp, Homo sapien
attttcatactggcatggaaagatg

SEQ ID NO: 36626 - DNA, 25 bp, Homo sapien
attttcatattctcagaagagaaac

SEQ ID NO: 36627 - DNA, 25 bp, Homo sapien
attttcatcatcacatttgtcacca

SEQ ID NO: 36628 - DNA, 25 bp, Homo sapien
attttcatcatcacgtttgtcacca

SEQ ID NO: 36629 - DNA, 25 bp, Homo sapien
attttcatcctggcatggaaagatg

SEQ ID NO: 36630 - DNA, 25 bp, Homo sapien
attttcatctacaaatggaacaatc

SEQ ID NO: 36631 - DNA, 25 bp, Homo sapien
attttcatctacgaatggaacaatc

SEQ ID NO: 36632 - DNA, 25 bp, Homo sapien
attttccaaagacgatttattgaaa

SEQ ID NO: 36633 - DNA, 25 bp, Homo sapien
attttccaaagatgatttattgaaa

SEQ ID NO: 36634 - DNA, 25 bp, Homo sapien
attttccaaggcaccactgttaaat

SEQ ID NO: 36635 - DNA, 25 bp, Homo sapien
attttccaaggtaccactgttaaat

SEQ ID NO: 36636 - DNA, 25 bp, Homo sapien
attttccacataaatccatcaaact

SEQ ID NO: 36637 - DNA, 25 bp, Homo sapien
attttccacgtaaatccatcaaact

SEQ ID NO: 36638 - DNA, 25 bp, Homo sapien
attttccactatgtactccaagttg

SEQ ID NO: 36639 - DNA, 25 bp, Homo sapien
attttccattatgtactccaagttg

SEQ ID NO: 36640 - DNA, 25 bp, Homo sapien
attttccatttcttttatacatcat

SEQ ID NO: 36641 - DNA, 25 bp, Homo sapien
attttccatttcttttgtacatcat

SEQ ID NO: 36642 - DNA, 25 bp, Homo sapien
attttcccgattatctctgtttcat

SEQ ID NO: 36643 - DNA, 25 bp, Homo sapien
attttcccgattatgtctgtttcat

SEQ ID NO: 36644 - DNA, 25 bp, Homo sapien
attttcctgtgccaaatttttatgt

SEQ ID NO: 36645 - DNA, 25 bp, Homo sapien
attttcctgtgctaaatttttatgt

SEQ ID NO: 36646 - DNA, 25 bp, Homo sapien
attttcggtttggcatagcacattg

SEQ ID NO: 36647 - DNA, 25 bp, Homo sapien
attttcggtttggcgtagcacattg

SEQ ID NO: 36648 - DNA, 25 bp, Homo sapien
attttctaggttccacattcgtctc

SEQ ID NO: 36649 - DNA, 25 bp, Homo sapien
attttctaggttgcacattcgtctc

SEQ ID NO: 36650 - DNA, 25 bp, Homo sapien
attttctcaagaacctgggtttctc

SEQ ID NO: 36651 - DNA, 25 bp, Homo sapien
attttctcaagatcctgggtttctc

SEQ ID NO: 36652 - DNA, 25 bp, Homo sapien
attttctcatgatgaattcttctgt

SEQ ID NO: 36653 - DNA, 25 bp, Homo sapien
attttctcattgcctggctggtgtt

SEQ ID NO: 36654 - DNA, 25 bp, Homo sapien
attttctcctttgtttcagtggttg

SEQ ID NO: 36655 - DNA, 25 bp, Homo sapien
attttctcgttgcctggctggtgtt

SEQ ID NO: 36656 - DNA, 25 bp, Homo sapien
attttctctgcaatttaacattcat

SEQ ID NO: 36657 - DNA, 25 bp, Homo sapien
attttctcttcaatttaacattcat

SEQ ID NO: 36658 - DNA, 25 bp, Homo sapien
attttctcttgatgaattcttctgt

SEQ ID NO: 36659 - DNA, 25 bp, Homo sapien
attttctcttttgtttcagtggttg

SEQ ID NO: 36660 - DNA, 25 bp, Homo sapien
attttctgcattcctcaacatagga

SEQ ID NO: 36661 - DNA, 25 bp, Homo sapien
attttctgcattgctcaacatagga

SEQ ID NO: 36662 - DNA, 25 bp, Homo sapien
attttctgcgcttagaatgctcctg

SEQ ID NO: 36663 - DNA, 25 bp, Homo sapien
attttctgctaggtagtaatttcta

SEQ ID NO: 36664 - DNA, 25 bp, Homo sapien
attttctgctaggtggtaatttcta

SEQ ID NO: 36665 - DNA, 25 bp, Homo sapien
attttctgctcttagaatgctcctg

SEQ ID NO: 36666 - DNA, 25 bp, Homo sapien
attttctggaggccttttctggaaa

SEQ ID NO: 36667 - DNA, 25 bp, Homo sapien
attttctggaggtcttttctggaaa

SEQ ID NO: 36668 - DNA, 25 bp, Homo sapien
attttctggccatgtgtctactgcc

SEQ ID NO: 36669 - DNA, 25 bp, Homo sapien
attttctggccgtgtgtctactgcc

SEQ ID NO: 36670 - DNA, 25 bp, Homo sapien
attttctgggcaacttttgtgtgcc

SEQ ID NO: 36671 - DNA, 25 bp, Homo sapien
attttctgggcaatttttgtgtgcc

SEQ ID NO: 36672 - DNA, 25 bp, Homo sapien
attttctgtaatgactttcagagtg

SEQ ID NO: 36673 - DNA, 25 bp, Homo sapien
attttctgtaatgattttcagagtg

SEQ ID NO: 36674 - DNA, 25 bp, Homo sapien
attttctgtagcatgtatttacatt

SEQ ID NO: 36675 - DNA, 25 bp, Homo sapien
attttctgtagcgtgtatttacatt

SEQ ID NO: 36676 - DNA, 25 bp, Homo sapien
attttctgtggacagactcaagcca

SEQ ID NO: 36677 - DNA, 25 bp, Homo sapien
attttctgtggacagattcaagcca

SEQ ID NO: 36678 - DNA, 25 bp, Homo sapien
attttctgttacaattattaattca

SEQ ID NO: 36679 - DNA, 25 bp, Homo sapien
attttctgttacaattgttaattca

SEQ ID NO: 36680 - DNA, 25 bp, Homo sapien
attttcttgccaaactccattgaat

SEQ ID NO: 36681 - DNA, 25 bp, Homo sapien
attttcttgccgaactccattgaat

SEQ ID NO: 36682 - DNA, 25 bp, Homo sapien
attttctttctttgccttacattcc

SEQ ID NO: 36683 - DNA, 25 bp, Homo sapien
attttctttctttggcttacattcc

SEQ ID NO: 36684 - DNA, 25 bp, Homo sapien
attttcttttcaacagtgagtgctg

SEQ ID NO: 36685 - DNA, 25 bp, Homo sapien
attttcttttcgacagtgagtgctg

SEQ ID NO: 36686 - DNA, 25 bp, Homo sapien
attttgaaaatcatgggtttctcta

SEQ ID NO: 36687 - DNA, 25 bp, Homo sapien
attttgaaaatcatggttttctcta

SEQ ID NO: 36688 - DNA, 25 bp, Homo sapien
attttgaacagaactgacctgttta

SEQ ID NO: 36689 - DNA, 25 bp, Homo sapien
attttgaacagcactgacctgttta

SEQ ID NO: 36690 - DNA, 25 bp, Homo sapien
attttgaagaccatttacttacaag

SEQ ID NO: 36691 - DNA, 25 bp, Homo sapien
attttgaagaccatttgcttacaag

SEQ ID NO: 36692 - DNA, 25 bp, Homo sapien
attttgaagacttctttttaatcct

SEQ ID NO: 36693 - DNA, 25 bp, Homo sapien
attttgaagacttgtttttaatcct

SEQ ID NO: 36694 - DNA, 25 bp, Homo sapien
attttgaagccaaatagaatttttt

SEQ ID NO: 36695 - DNA, 25 bp, Homo sapien
attttgaagccaaatataatttttt

SEQ ID NO: 36696 - DNA, 25 bp, Homo sapien
attttgaatcggtgctactttgaat

SEQ ID NO: 36697 - DNA, 25 bp, Homo sapien
attttgaattggtgctactttgaat

SEQ ID NO: 36698 - DNA, 25 bp, Homo sapien
attttgacagagctaatcacagggt

SEQ ID NO: 36699 - DNA, 25 bp, Homo sapien
attttgacagagttaatcacagggt

SEQ ID NO: 36700 - DNA, 25 bp, Homo sapien
attttgacagtccatatgtggtgaa

SEQ ID NO: 36701 - DNA, 25 bp, Homo sapien
attttgacagttcatatgtggtgaa

SEQ ID NO: 36702 - DNA, 25 bp, Homo sapien
attttgaccatcttttacactactt

SEQ ID NO: 36703 - DNA, 25 bp, Homo sapien
attttgactatcttttacactactt

SEQ ID NO: 36704 - DNA, 25 bp, Homo sapien
attttgactttcccattgcagtggc

SEQ ID NO: 36705 - DNA, 25 bp, Homo sapien
attttgactttcccgttgcagtggc

SEQ ID NO: 36706 - DNA, 25 bp, Homo sapien
attttgagattaccgtgcaatcagt

SEQ ID NO: 36707 - DNA, 25 bp, Homo sapien
attttgagattactgtgcaatcagt

SEQ ID NO: 36708 - DNA, 25 bp, Homo sapien
attttgagccaaataaccctttgct

SEQ ID NO: 36709 - DNA, 25 bp, Homo sapien
attttgagccagataaccctttgct

SEQ ID NO: 36710 - DNA, 25 bp, Homo sapien
attttgagtaagagatttttctgga

SEQ ID NO: 36711 - DNA, 25 bp, Homo sapien
attttgagtaagggatttttctgga

SEQ ID NO: 36712 - DNA, 25 bp, Homo sapien
attttgagtcaaaaagtaacttcgg

SEQ ID NO: 36713 - DNA, 25 bp, Homo sapien
attttgagtgaaaaagtaacttcgg

SEQ ID NO: 36714 - DNA, 25 bp, Homo sapien
attttgataatcattgccaggattt

SEQ ID NO: 36715 - DNA, 25 bp, Homo sapien
attttgataatcattgtcaggattt

SEQ ID NO: 36716 - DNA, 25 bp, Homo sapien
attttgatacagtttgttagaacct

SEQ ID NO: 36717 - DNA, 25 bp, Homo sapien
attttgatatagtttgttagaacct

SEQ ID NO: 36718 - DNA, 25 bp, Homo sapien
attttgatcacatgaaacactttat

SEQ ID NO: 36719 - DNA, 25 bp, Homo sapien
attttgatcacatgaagcactttat

SEQ ID NO: 36720 - DNA, 25 bp, Homo sapien
attttgcaactcctaacaacaacga

SEQ ID NO: 36721 - DNA, 25 bp, Homo sapien
attttgcagctcctaacaacaacga

SEQ ID NO: 36722 - DNA, 25 bp, Homo sapien
attttgcaggcatactggaggaaac

SEQ ID NO: 36723 - DNA, 25 bp, Homo sapien
attttgcagtcatactggaggaaac

SEQ ID NO: 36724 - DNA, 25 bp, Homo sapien
attttgcataccaattacaactctg

SEQ ID NO: 36725 - DNA, 25 bp, Homo sapien
attttgcataccgattacaactctg

SEQ ID NO: 36726 - DNA, 25 bp, Homo sapien
attttgcataggcatctactacaaa

SEQ ID NO: 36727 - DNA, 25 bp, Homo sapien
attttgcattggcatctactacaaa

SEQ ID NO: 36728 - DNA, 25 bp, Homo sapien
attttgccactatcttcttaggata

SEQ ID NO: 36729 - DNA, 25 bp, Homo sapien
attttgccactgtcttcttaggata

SEQ ID NO: 36730 - DNA, 25 bp, Homo sapien
attttgccatctatcaaggtatgtt

SEQ ID NO: 36731 - DNA, 25 bp, Homo sapien
attttgccgtctatcaaggtatgtt

SEQ ID NO: 36732 - DNA, 25 bp, Homo sapien
attttgcctgggaaaaagtcttgga

SEQ ID NO: 36733 - DNA, 25 bp, Homo sapien
attttgcctgggaagaagtcttgga

SEQ ID NO: 36734 - DNA, 25 bp, Homo sapien
attttgctatgccattgtattcact

SEQ ID NO: 36735 - DNA, 25 bp, Homo sapien
attttgctatgctattgtattcact

SEQ ID NO: 36736 - DNA, 25 bp, Homo sapien
attttgctattcagtatttataatt

SEQ ID NO: 36737 - DNA, 25 bp, Homo sapien
attttgctatttagtatttataatt

SEQ ID NO: 36738 - DNA, 25 bp, Homo sapien
attttgctctatagccccgacagct

SEQ ID NO: 36739 - DNA, 25 bp, Homo sapien
attttgctctatatccccgacagct

SEQ ID NO: 36740 - DNA, 25 bp, Homo sapien
attttggacgtgccagcttctataa

SEQ ID NO: 36741 - DNA, 25 bp, Homo sapien
attttggatgtgccagcttctataa

SEQ ID NO: 36742 - DNA, 25 bp, Homo sapien
attttggattgtatcttagacattg

SEQ ID NO: 36743 - DNA, 25 bp, Homo sapien
attttggattgtatgttagacattg

SEQ ID NO: 36744 - DNA, 25 bp, Homo sapien
attttggcaaagcaagacaccctag

SEQ ID NO: 36745 - DNA, 25 bp, Homo sapien
attttggcaaagcaaggcaccctag

SEQ ID NO: 36746 - DNA, 25 bp, Homo sapien
attttggctcatgcttctacaaact

SEQ ID NO: 36747 - DNA, 25 bp, Homo sapien
attttggctctgttctcaacttctt

SEQ ID NO: 36748 - DNA, 25 bp, Homo sapien
attttggctgtgttctcaacttctt

SEQ ID NO: 36749 - DNA, 25 bp, Homo sapien
attttggcttatgcttctacaaact

SEQ ID NO: 36750 - DNA, 25 bp, Homo sapien
attttggtagacaaatgcagtatgt

SEQ ID NO: 36751 - DNA, 25 bp, Homo sapien
attttggtagacatatgcagtatgt

SEQ ID NO: 36752 - DNA, 25 bp, Homo sapien
attttggtcttagggaaataaatca

SEQ ID NO: 36753 - DNA, 25 bp, Homo sapien
attttggtcttaggtaaataaatca

SEQ ID NO: 36754 - DNA, 25 bp, Homo sapien
attttggttctaagccaacctatga

SEQ ID NO: 36755 - DNA, 25 bp, Homo sapien
attttggttctaggccaacctatga

SEQ ID NO: 36756 - DNA, 25 bp, Homo sapien
attttgtaattttcattgctctcct

SEQ ID NO: 36757 - DNA, 25 bp, Homo sapien
attttgtaattttcgttgctctcct

SEQ ID NO: 36758 - DNA, 25 bp, Homo sapien
attttgtacgtggatgagattcttc

SEQ ID NO: 36759 - DNA, 25 bp, Homo sapien
attttgtactctactggctgttctg

SEQ ID NO: 36760 - DNA, 25 bp, Homo sapien
attttgtactctattggctgttctg

SEQ ID NO: 36761 - DNA, 25 bp, Homo sapien
attttgtagaaaggagtgatgtgat

SEQ ID NO: 36762 - DNA, 25 bp, Homo sapien
attttgtagaaaggtgtgatgtgat

SEQ ID NO: 36763 - DNA, 25 bp, Homo sapien
attttgtagcatcaattgtttcatt

SEQ ID NO: 36764 - DNA, 25 bp, Homo sapien
attttgtagcatcacttgtttcatt

SEQ ID NO: 36765 - DNA, 25 bp, Homo sapien
attttgtaggtcaagtttggaccgg

SEQ ID NO: 36766 - DNA, 25 bp, Homo sapien
attttgtaggtcgagtttggaccgg

SEQ ID NO: 36767 - DNA, 25 bp, Homo sapien
attttgtatatggtaaaccttttgc

SEQ ID NO: 36768 - DNA, 25 bp, Homo sapien
attttgtatgtggatgagattcttc

SEQ ID NO: 36769 - DNA, 25 bp, Homo sapien
attttgtatgtggtaaaccttttgc

SEQ ID NO: 36770 - DNA, 25 bp, Homo sapien
attttgtcatcattgaggccttcat

SEQ ID NO: 36771 - DNA, 25 bp, Homo sapien
attttgtcatttcgggatgagaagt

SEQ ID NO: 36772 - DNA, 25 bp, Homo sapien
attttgtcattttgggatgagaagt

SEQ ID NO: 36773 - DNA, 25 bp, Homo sapien
attttgtcgtcattgaggccttcat

SEQ ID NO: 36774 - DNA, 25 bp, Homo sapien
attttgtctacatcaacaatcattt

SEQ ID NO: 36775 - DNA, 25 bp, Homo sapien
attttgtctacattaacaatcattt

SEQ ID NO: 36776 - DNA, 25 bp, Homo sapien
attttgtctttcacaattgcctaga

SEQ ID NO: 36777 - DNA, 25 bp, Homo sapien
attttgtctttcataattgcctaga

SEQ ID NO: 36778 - DNA, 25 bp, Homo sapien
attttgtgaaatagtcacctggatc

SEQ ID NO: 36779 - DNA, 25 bp, Homo sapien
attttgtgagctacgactctggaaa

SEQ ID NO: 36780 - DNA, 25 bp, Homo sapien
attttgtgagctatgactctggaaa

SEQ ID NO: 36781 - DNA, 25 bp, Homo sapien
attttgtgcaatagtcacctggatc

SEQ ID NO: 36782 - DNA, 25 bp, Homo sapien
attttgtgcgctttttccaagtgtg

SEQ ID NO: 36783 - DNA, 25 bp, Homo sapien
attttgtgcgctttttgcaagtgtg

SEQ ID NO: 36784 - DNA, 25 bp, Homo sapien
attttgtgctcacgtcctatgtatc

SEQ ID NO: 36785 - DNA, 25 bp, Homo sapien
attttgtgctcatgtcctatgtatc

SEQ ID NO: 36786 - DNA, 25 bp, Homo sapien
attttgtggatcataggcccccagc

SEQ ID NO: 36787 - DNA, 25 bp, Homo sapien
attttgtggatcatgggcccccagc

SEQ ID NO: 36788 - DNA, 25 bp, Homo sapien
attttgtggcacataatgcatattt

SEQ ID NO: 36789 - DNA, 25 bp, Homo sapien
attttgtgggtaacagtacctgcta

SEQ ID NO: 36790 - DNA, 25 bp, Homo sapien
attttgtgggtaatagtacctgcta

SEQ ID NO: 36791 - DNA, 25 bp, Homo sapien
attttgtggtgcatagggcgattgc

SEQ ID NO: 36792 - DNA, 25 bp, Homo sapien
attttgtggtgcgtagggcgattgc

SEQ ID NO: 36793 - DNA, 25 bp, Homo sapien
attttgtgtcacataatgcatattt

SEQ ID NO: 36794 - DNA, 25 bp, Homo sapien
attttgtgtttcctcggatacagaa

SEQ ID NO: 36795 - DNA, 25 bp, Homo sapien
attttgtgtttccttggatacagaa

SEQ ID NO: 36796 - DNA, 25 bp, Homo sapien
atttttaaaattgctcatgctggct

SEQ ID NO: 36797 - DNA, 25 bp, Homo sapien
atttttaaaatttctcatgctggct

SEQ ID NO: 36798 - DNA, 25 bp, Homo sapien
atttttaaatatttcacgtaaacca

SEQ ID NO: 36799 - DNA, 25 bp, Homo sapien
atttttaaatatttcatgtaaacca

SEQ ID NO: 36800 - DNA, 25 bp, Homo sapien
atttttaacaatttcaattatgcaa

SEQ ID NO: 36801 - DNA, 25 bp, Homo sapien
atttttaacaatttcacttatgcaa

SEQ ID NO: 36802 - DNA, 25 bp, Homo sapien
atttttaacagcaagaaattaacaa

SEQ ID NO: 36803 - DNA, 25 bp, Homo sapien
atttttaacagtaagaaattaacaa

SEQ ID NO: 36804 - DNA, 25 bp, Homo sapien
atttttaatgttcgagtgtttctgc

SEQ ID NO: 36805 - DNA, 25 bp, Homo sapien
atttttaatgtttgagtgtttctgc

SEQ ID NO: 36806 - DNA, 25 bp, Homo sapien
atttttacagtattgcaaacctaga

SEQ ID NO: 36807 - DNA, 25 bp, Homo sapien
atttttacattattgcaaacctaga

SEQ ID NO: 36808 - DNA, 25 bp, Homo sapien
atttttactctagtctctagttcct

SEQ ID NO: 36809 - DNA, 25 bp, Homo sapien
atttttactttagtctctagttcct

SEQ ID NO: 36810 - DNA, 25 bp, Homo sapien
atttttagagcacttctgcaacaaa

SEQ ID NO: 36811 - DNA, 25 bp, Homo sapien
atttttagagcccttctgcaacaaa

SEQ ID NO: 36812 - DNA, 25 bp, Homo sapien
atttttagcattacccactagaccc

SEQ ID NO: 36813 - DNA, 25 bp, Homo sapien
atttttagcattccccactagaccc

SEQ ID NO: 36814 - DNA, 25 bp, Homo sapien
atttttaggcttattactttcacag

SEQ ID NO: 36815 - DNA, 25 bp, Homo sapien
atttttagggtgtaattgtcacatc

SEQ ID NO: 36816 - DNA, 25 bp, Homo sapien
atttttagggtgtacttgtcacatc

SEQ ID NO: 36817 - DNA, 25 bp, Homo sapien
atttttaggtgttgaataaatgagt

SEQ ID NO: 36818 - DNA, 25 bp, Homo sapien
atttttaggtgttggataaatgagt

SEQ ID NO: 36819 - DNA, 25 bp, Homo sapien
atttttaggtttattactttcacag

SEQ ID NO: 36820 - DNA, 25 bp, Homo sapien
atttttagtggtaggtgaagtactt

SEQ ID NO: 36821 - DNA, 25 bp, Homo sapien
atttttagtggtatgtgaagtactt

SEQ ID NO: 36822 - DNA, 25 bp, Homo sapien
atttttcactttagattcatttatt

SEQ ID NO: 36823 - DNA, 25 bp, Homo sapien
atttttcactttgaatatctaggta

SEQ ID NO: 36824 - DNA, 25 bp, Homo sapien
atttttcactttggatatctaggta

SEQ ID NO: 36825 - DNA, 25 bp, Homo sapien
atttttcataccctgctctcaaata

SEQ ID NO: 36826 - DNA, 25 bp, Homo sapien
atttttcatacgctgctctcaaata

SEQ ID NO: 36827 - DNA, 25 bp, Homo sapien
atttttcattttagattcatttatt

SEQ ID NO: 36828 - DNA, 25 bp, Homo sapien
atttttccatgagagagaaaaaaac

SEQ ID NO: 36829 - DNA, 25 bp, Homo sapien
atttttccatgggagagaaaaaaac

SEQ ID NO: 36830 - DNA, 25 bp, Homo sapien
atttttccgcattgttttctagccc

SEQ ID NO: 36831 - DNA, 25 bp, Homo sapien
atttttccgtattgttttctagccc

SEQ ID NO: 36832 - DNA, 25 bp, Homo sapien
atttttctaccaatcaacgaagtgc

SEQ ID NO: 36833 - DNA, 25 bp, Homo sapien
atttttctaccgatcaacgaagtgc

SEQ ID NO: 36834 - DNA, 25 bp, Homo sapien
atttttctgctaaaaggaaaggcca

SEQ ID NO: 36835 - DNA, 25 bp, Homo sapien
atttttctgctaacaggaaaggcca

SEQ ID NO: 36836 - DNA, 25 bp, Homo sapien
atttttctgtttatttaaggctgat

SEQ ID NO: 36837 - DNA, 25 bp, Homo sapien
atttttctgtttgtttaaggctgat

SEQ ID NO: 36838 - DNA, 25 bp, Homo sapien
atttttgaaaatacggtctctgttc

SEQ ID NO: 36839 - DNA, 25 bp, Homo sapien
atttttgaagatacggtctctgttc

SEQ ID NO: 36840 - DNA, 25 bp, Homo sapien
atttttgacagtttaacgtagcccc

SEQ ID NO: 36841 - DNA, 25 bp, Homo sapien
atttttgacagtttaatgtagcccc

SEQ ID NO: 36842 - DNA, 25 bp, Homo sapien
atttttgcagtttatcaatcgtctc

SEQ ID NO: 36843 - DNA, 25 bp, Homo sapien
atttttgccaacatttaagggaggt

SEQ ID NO: 36844 - DNA, 25 bp, Homo sapien
atttttgccaacgtttaagggaggt

SEQ ID NO: 36845 - DNA, 25 bp, Homo sapien
atttttgccgtttatcaatcgtctc

SEQ ID NO: 36846 - DNA, 25 bp, Homo sapien
atttttgcctcagtttatattagtc

SEQ ID NO: 36847 - DNA, 25 bp, Homo sapien
atttttgcctcattttatattagtc

SEQ ID NO: 36848 - DNA, 25 bp, Homo sapien
atttttgctcgctggttatatcctc

SEQ ID NO: 36849 - DNA, 25 bp, Homo sapien
atttttgcttgctggttatatcctc

SEQ ID NO: 36850 - DNA, 25 bp, Homo sapien
atttttggccttgatatttttctgt

SEQ ID NO: 36851 - DNA, 25 bp, Homo sapien
atttttggccttgctatttttctgt

SEQ ID NO: 36852 - DNA, 25 bp, Homo sapien
atttttgtatgctgaaccagccttc

SEQ ID NO: 36853 - DNA, 25 bp, Homo sapien
atttttgtcaatccataatctgata

SEQ ID NO: 36854 - DNA, 25 bp, Homo sapien
atttttgtcaatccgtaatctgata

SEQ ID NO: 36855 - DNA, 25 bp, Homo sapien
atttttgtgctgtaaagtgtctctt

SEQ ID NO: 36856 - DNA, 25 bp, Homo sapien
atttttgtgtgctgaaccagccttc

SEQ ID NO: 36857 - DNA, 25 bp, Homo sapien
atttttgtgtttcttataatgcaac

SEQ ID NO: 36858 - DNA, 25 bp, Homo sapien
atttttgtgtttgttataatgcaac

SEQ ID NO: 36859 - DNA, 25 bp, Homo sapien
atttttgttctgtaaagtgtctctt

SEQ ID NO: 36860 - DNA, 25 bp, Homo sapien
atttttgttttagtaggcagctaat

SEQ ID NO: 36861 - DNA, 25 bp, Homo sapien
atttttgttttcgtaggcagctaat

SEQ ID NO: 36862 - DNA, 25 bp, Homo sapien
attttttaggatcagttgtccttgt

SEQ ID NO: 36863 - DNA, 25 bp, Homo sapien
attttttaggatcggttgtccttgt

SEQ ID NO: 36864 - DNA, 25 bp, Homo sapien
attttttataaaggccttgagcatc

SEQ ID NO: 36865 - DNA, 25 bp, Homo sapien
attttttataagggccttgagcatc

SEQ ID NO: 36866 - DNA, 25 bp, Homo sapien
attttttcagaaagacagaacagag

SEQ ID NO: 36867 - DNA, 25 bp, Homo sapien
attttttcagaaagacggaacagag

SEQ ID NO: 36868 - DNA, 25 bp, Homo sapien
attttttcagttaccggcattctcc

SEQ ID NO: 36869 - DNA, 25 bp, Homo sapien
attttttcatttacgttgaatgcaa

SEQ ID NO: 36870 - DNA, 25 bp, Homo sapien
attttttcatttatgttgaatgcaa

SEQ ID NO: 36871 - DNA, 25 bp, Homo sapien
attttttccgacctcaaaccttaga

SEQ ID NO: 36872 - DNA, 25 bp, Homo sapien
attttttcggttaccggcattctcc

SEQ ID NO: 36873 - DNA, 25 bp, Homo sapien
attttttctgacctcaaaccttaga

SEQ ID NO: 36874 - DNA, 25 bp, Homo sapien
attttttgagaccgaattttgctcg

SEQ ID NO: 36875 - DNA, 25 bp, Homo sapien
attttttgagactgaattttgctcg

SEQ ID NO: 36876 - DNA, 25 bp, Homo sapien
attttttgatgcatttgggtaagta

SEQ ID NO: 36877 - DNA, 25 bp, Homo sapien
attttttgatgcgtttgggtaagta

SEQ ID NO: 36878 - DNA, 25 bp, Homo sapien
attttttgctctatacccatcaaat

SEQ ID NO: 36879 - DNA, 25 bp, Homo sapien
attttttgctctctacccatcaaat

SEQ ID NO: 36880 - DNA, 25 bp, Homo sapien
attttttggcattcatttccctttc

SEQ ID NO: 36881 - DNA, 25 bp, Homo sapien
attttttggcattcgtttccctttc

SEQ ID NO: 36882 - DNA, 25 bp, Homo sapien
attttttgtatgcttcctttcatac

SEQ ID NO: 36883 - DNA, 25 bp, Homo sapien
attttttgtgtgcttcctttcatac

SEQ ID NO: 36884 - DNA, 25 bp, Homo sapien
atttttttaacgtaagatttcgtat

SEQ ID NO: 36885 - DNA, 25 bp, Homo sapien
atttttttaccgtaagatttcgtat

SEQ ID NO: 36886 - DNA, 25 bp, Homo sapien
atttttttcatggaagataagttga

SEQ ID NO: 36887 - DNA, 25 bp, Homo sapien
atttttttcatgggagataagttga

SEQ ID NO: 36888 - DNA, 25 bp, Homo sapien
atttttttcccttaccagtccggcg

SEQ ID NO: 36889 - DNA, 25 bp, Homo sapien
atttttttcccttatcagtccggcg

SEQ ID NO: 36890 - DNA, 25 bp, Homo sapien
atttttttgaattcttccaatatgt

SEQ ID NO: 36891 - DNA, 25 bp, Homo sapien
atttttttgaattcttgcaatatgt

SEQ ID NO: 36892 - DNA, 25 bp, Homo sapien
atttttttgagtgcggatgtaaatg

SEQ ID NO: 36893 - DNA, 25 bp, Homo sapien
atttttttgagtgctgatgtaaatg

SEQ ID NO: 36894 - DNA, 25 bp, Homo sapien
attttttttctccaagcctcatcct

SEQ ID NO: 36895 - DNA, 25 bp, Homo sapien
attttttttctctaagcctcatcct

SEQ ID NO: 36896 - DNA, 25 bp, Homo sapien
caaaaaaaaaaagggaatgaggaat

SEQ ID NO: 36897 - DNA, 25 bp, Homo sapien
caaaaaaaaaaggggaatgaggaat

SEQ ID NO: 36898 - DNA, 25 bp, Homo sapien
caaaaaaaaagtggatgtgtggata

SEQ ID NO: 36899 - DNA, 25 bp, Homo sapien
caaaaaaaagagcatgaattcaaag

SEQ ID NO: 36900 - DNA, 25 bp, Homo sapien
caaaaaaaagatcatgaattcaaag

SEQ ID NO: 36901 - DNA, 25 bp, Homo sapien
caaaaaaaatgtggatgtgtggata

SEQ ID NO: 36902 - DNA, 25 bp, Homo sapien
caaaaaaacttgagtgcttactatg

SEQ ID NO: 36903 - DNA, 25 bp, Homo sapien
caaaaaaagttgagtgcttactatg

SEQ ID NO: 36904 - DNA, 25 bp, Homo sapien
caaaaaaatatgtgattcctgccct

SEQ ID NO: 36905 - DNA, 25 bp, Homo sapien
caaaaaaatatgttattcctgccct

SEQ ID NO: 36906 - DNA, 25 bp, Homo sapien
caaaaaagaaaaactggcaaaacat

SEQ ID NO: 36907 - DNA, 25 bp, Homo sapien
caaaaaagaaaatagccaggcatgg

SEQ ID NO: 36908 - DNA, 25 bp, Homo sapien
caaaaaagaaaatcgccaggcatgg

SEQ ID NO: 36909 - DNA, 25 bp, Homo sapien
caaaaaagaccacatgtgaagaatg

SEQ ID NO: 36910 - DNA, 25 bp, Homo sapien
caaaaaagatcacatgtgaagaatg

SEQ ID NO: 36911 - DNA, 25 bp, Homo sapien
caaaaaagcacagatagtcctctga

SEQ ID NO: 36912 - DNA, 25 bp, Homo sapien
caaaaaagcacagctagtcctctga

SEQ ID NO: 36913 - DNA, 25 bp, Homo sapien
caaaaaagcatgatattagtacaaa

SEQ ID NO: 36914 - DNA, 25 bp, Homo sapien
caaaaaagcatggtattagtacaaa

SEQ ID NO: 36915 - DNA, 25 bp, Homo sapien
caaaaaagcctaaaacaaaagtgcc

SEQ ID NO: 36916 - DNA, 25 bp, Homo sapien
caaaaaaggaaaactggcaaaacat

SEQ ID NO: 36917 - DNA, 25 bp, Homo sapien
caaaaaaggcccttagagactcaat

SEQ ID NO: 36918 - DNA, 25 bp, Homo sapien
caaaaaaggcctttagagactcaat

SEQ ID NO: 36919 - DNA, 25 bp, Homo sapien
caaaaaaggctaaaacaaaagtgcc

SEQ ID NO: 36920 - DNA, 25 bp, Homo sapien
caaaaaagggcacaaagaaaagagt

SEQ ID NO: 36921 - DNA, 25 bp, Homo sapien
caaaaaagggcaccaagaaaagagt

SEQ ID NO: 36922 - DNA, 25 bp, Homo sapien
caaaaaagtagaactaataagtgga

SEQ ID NO: 36923 - DNA, 25 bp, Homo sapien
caaaaaagtagacctaataagtgga

SEQ ID NO: 36924 - DNA, 25 bp, Homo sapien
caaaaaatgagttaaaccaatcaat

SEQ ID NO: 36925 - DNA, 25 bp, Homo sapien
caaaaaatgagttgaaccaatcaat

SEQ ID NO: 36926 - DNA, 25 bp, Homo sapien
caaaaaattagcttacaagcaactt

SEQ ID NO: 36927 - DNA, 25 bp, Homo sapien
caaaaaattagcttactagcaactt

SEQ ID NO: 36928 - DNA, 25 bp, Homo sapien
caaaaacaagccaagtgagtaagcc

SEQ ID NO: 36929 - DNA, 25 bp, Homo sapien
caaaaacaagccgagtgagtaagcc

SEQ ID NO: 36930 - DNA, 25 bp, Homo sapien
caaaaacaatgacccatggaacaga

SEQ ID NO: 36931 - DNA, 25 bp, Homo sapien
caaaaacagccaatataacattcag

SEQ ID NO: 36932 - DNA, 25 bp, Homo sapien
caaaaacagccaatgtaacattcag

SEQ ID NO: 36933 - DNA, 25 bp, Homo sapien
caaaaacagtgccatgttactcaat

SEQ ID NO: 36934 - DNA, 25 bp, Homo sapien
caaaaacagtgccgtgttactcaat

SEQ ID NO: 36935 - DNA, 25 bp, Homo sapien
caaaaacatattaaccaggtgcaac

SEQ ID NO: 36936 - DNA, 25 bp, Homo sapien
caaaaacatattaagcaggtgcaac

SEQ ID NO: 36937 - DNA, 25 bp, Homo sapien
caaaaacattgacccatggaacaga

SEQ ID NO: 36938 - DNA, 25 bp, Homo sapien
caaaaaccagcgttagagtaaaatg

SEQ ID NO: 36939 - DNA, 25 bp, Homo sapien
caaaaaccagctttagagtaaaatg

SEQ ID NO: 36940 - DNA, 25 bp, Homo sapien
caaaaacccaaaactaggcatttgg

SEQ ID NO: 36941 - DNA, 25 bp, Homo sapien
caaaaacccaaaactatgcatttgg

SEQ ID NO: 36942 - DNA, 25 bp, Homo sapien
caaaaaccgaaatcaaacagaagtg

SEQ ID NO: 36943 - DNA, 25 bp, Homo sapien
caaaaaccgaaatcaagcagaagtg

SEQ ID NO: 36944 - DNA, 25 bp, Homo sapien
caaaaacgaaacaacccagtgtccg

SEQ ID NO: 36945 - DNA, 25 bp, Homo sapien
caaaaacgaaacagcccagtgtccg

SEQ ID NO: 36946 - DNA, 25 bp, Homo sapien
caaaaacgtctatactcagcaaaat

SEQ ID NO: 36947 - DNA, 25 bp, Homo sapien
caaaaacgtctatacttagcaaaat

SEQ ID NO: 36948 - DNA, 25 bp, Homo sapien
caaaaactacgtactcttggtggaa

SEQ ID NO: 36949 - DNA, 25 bp, Homo sapien
caaaaactatgtactcttggtggaa

SEQ ID NO: 36950 - DNA, 25 bp, Homo sapien
caaaaactcacaaaatgcccaaaga

SEQ ID NO: 36951 - DNA, 25 bp, Homo sapien
caaaaactcacacaatgcccaaaga

SEQ ID NO: 36952 - DNA, 25 bp, Homo sapien
caaaaactccaaaagtgaaatggag

SEQ ID NO: 36953 - DNA, 25 bp, Homo sapien
caaaaactgggcgcagtaatgagaa

SEQ ID NO: 36954 - DNA, 25 bp, Homo sapien
caaaaactgggtgcagtaatgagaa

SEQ ID NO: 36955 - DNA, 25 bp, Homo sapien
caaaaacttaactactaatagccca

SEQ ID NO: 36956 - DNA, 25 bp, Homo sapien
caaaaacttaactactgatagccca

SEQ ID NO: 36957 - DNA, 25 bp, Homo sapien
caaaaacttcaaaagtgaaatggag

SEQ ID NO: 36958 - DNA, 25 bp, Homo sapien
caaaaagaaatggcagtaccaagtg

SEQ ID NO: 36959 - DNA, 25 bp, Homo sapien
caaaaagaactgtaaaggtcaaggg

SEQ ID NO: 36960 - DNA, 25 bp, Homo sapien
caaaaagaattgtaaaggtcaaggg

SEQ ID NO: 36961 - DNA, 25 bp, Homo sapien
caaaaagagagccagaaaccagtat

SEQ ID NO: 36962 - DNA, 25 bp, Homo sapien
caaaaagagagcccgaaaccagtat

SEQ ID NO: 36963 - DNA, 25 bp, Homo sapien
caaaaagagatggcagtaccaagtg

SEQ ID NO: 36964 - DNA, 25 bp, Homo sapien
caaaaagaggtaccgagatttcctc

SEQ ID NO: 36965 - DNA, 25 bp, Homo sapien
caaaaagaggtactgagatttcctc

SEQ ID NO: 36966 - DNA, 25 bp, Homo sapien
caaaaagcaaatggccatctggacc

SEQ ID NO: 36967 - DNA, 25 bp, Homo sapien
caaaaagcaaatggccgtctggacc

SEQ ID NO: 36968 - DNA, 25 bp, Homo sapien
caaaaagctagaaggacgatactga

SEQ ID NO: 36969 - DNA, 25 bp, Homo sapien
caaaaagctagaaggatgatactga

SEQ ID NO: 36970 - DNA, 25 bp, Homo sapien
caaaaagtatacacatattttgaaa

SEQ ID NO: 36971 - DNA, 25 bp, Homo sapien
caaaaagtatacgcatattttgaaa

SEQ ID NO: 36972 - DNA, 25 bp, Homo sapien
caaaaagttcaagcctatcatcatt

SEQ ID NO: 36973 - DNA, 25 bp, Homo sapien
caaaaagttcaagtctatcatcatt

SEQ ID NO: 36974 - DNA, 25 bp, Homo sapien
caaaaataaacatatatgccatgag

SEQ ID NO: 36975 - DNA, 25 bp, Homo sapien
caaaaataaacgtatatgccatgag

SEQ ID NO: 36976 - DNA, 25 bp, Homo sapien
caaaaataatgtcctggaatttgtt

SEQ ID NO: 36977 - DNA, 25 bp, Homo sapien
caaaaataatgtcttggaatttgtt

SEQ ID NO: 36978 - DNA, 25 bp, Homo sapien
caaaaatacccaacagtgacaacat

SEQ ID NO: 36979 - DNA, 25 bp, Homo sapien
caaaaatacccagcagtgacaacat

SEQ ID NO: 36980 - DNA, 25 bp, Homo sapien
caaaaatagctctagcctcagtacc

SEQ ID NO: 36981 - DNA, 25 bp, Homo sapien
caaaaatagctctagcttcagtacc

SEQ ID NO: 36982 - DNA, 25 bp, Homo sapien
caaaaatatgaacccaatttgtggt

SEQ ID NO: 36983 - DNA, 25 bp, Homo sapien
caaaaatatgaacctaatttgtggt

SEQ ID NO: 36984 - DNA, 25 bp, Homo sapien
caaaaatcaattggacttagtgtgg

SEQ ID NO: 36985 - DNA, 25 bp, Homo sapien
caaaaatcacttggacttagtgtgg

SEQ ID NO: 36986 - DNA, 25 bp, Homo sapien
caaaaatcacttgggcatcatcctt

SEQ ID NO: 36987 - DNA, 25 bp, Homo sapien
caaaaatcatttgggcatcatcctt

SEQ ID NO: 36988 - DNA, 25 bp, Homo sapien
caaaaatccataggcccagtctaat

SEQ ID NO: 36989 - DNA, 25 bp, Homo sapien
caaaaatccatagtcccagtctaat

SEQ ID NO: 36990 - DNA, 25 bp, Homo sapien
caaaaatctgagccttgcatattta

SEQ ID NO: 36991 - DNA, 25 bp, Homo sapien
caaaaatctgagtcttgcatattta

SEQ ID NO: 36992 - DNA, 25 bp, Homo sapien
caaaaatgaagactgccacatcagt

SEQ ID NO: 36993 - DNA, 25 bp, Homo sapien
caaaaatgaagattgccacatcagt

SEQ ID NO: 36994 - DNA, 25 bp, Homo sapien
caaaaatgcaaatactatcatcgta

SEQ ID NO: 36995 - DNA, 25 bp, Homo sapien
caaaaatgcaaatattatcatcgta

SEQ ID NO: 36996 - DNA, 25 bp, Homo sapien
caaaaatgctgagataggaggttga

SEQ ID NO: 36997 - DNA, 25 bp, Homo sapien
caaaaatgctgataatcatgcaagg

SEQ ID NO: 36998 - DNA, 25 bp, Homo sapien
caaaaatgctgatgatcatgcaagg

SEQ ID NO: 36999 - DNA, 25 bp, Homo sapien
caaaaatgctgggataggaggttga

SEQ ID NO: 37000 - DNA, 25 bp, Homo sapien
caaaaatgtatcctaaaataagcca

SEQ ID NO: 37001 - DNA, 25 bp, Homo sapien
caaaaatgtatcctaagataagcca

SEQ ID NO: 37002 - DNA, 25 bp, Homo sapien
caaaaatgtgtctgcaaatataaag

SEQ ID NO: 37003 - DNA, 25 bp, Homo sapien
caaaaatgtgtctggaaatataaag

SEQ ID NO: 37004 - DNA, 25 bp, Homo sapien
caaaacaaaaaaacttgagtgctta

SEQ ID NO: 37005 - DNA, 25 bp, Homo sapien
caaaacaaaaaaagttgagtgctta

SEQ ID NO: 37006 - DNA, 25 bp, Homo sapien
caaaacaaacaaatattgcatcctc

SEQ ID NO: 37007 - DNA, 25 bp, Homo sapien
caaaacaaccaaatattgcatcctc

SEQ ID NO: 37008 - DNA, 25 bp, Homo sapien
caaaacaagaaaaggagaatgtagc

SEQ ID NO: 37009 - DNA, 25 bp, Homo sapien
caaaacaagaaaatgagaatgtagc

SEQ ID NO: 37010 - DNA, 25 bp, Homo sapien
caaaacaagggtgaaaactagctac

SEQ ID NO: 37011 - DNA, 25 bp, Homo sapien
caaaacaagggttaaaactagctac

SEQ ID NO: 37012 - DNA, 25 bp, Homo sapien
caaaacaataaaagtagtaacctct

SEQ ID NO: 37013 - DNA, 25 bp, Homo sapien
caaaacaataaacgcatctcttttc

SEQ ID NO: 37014 - DNA, 25 bp, Homo sapien
caaaacaataaaggtagtaacctct

SEQ ID NO: 37015 - DNA, 25 bp, Homo sapien
caaaacaataaatgcatctcttttc

SEQ ID NO: 37016 - DNA, 25 bp, Homo sapien
caaaacacagtggctcagtagtgca

SEQ ID NO: 37017 - DNA, 25 bp, Homo sapien
caaaacaccagtcacagccatgttc

SEQ ID NO: 37018 - DNA, 25 bp, Homo sapien
caaaacacctgtcacagccatgttc

SEQ ID NO: 37019 - DNA, 25 bp, Homo sapien
caaaacacggtggctcagtagtgca

SEQ ID NO: 37020 - DNA, 25 bp, Homo sapien
caaaacactcacaaataggttcagt

SEQ ID NO: 37021 - DNA, 25 bp, Homo sapien
caaaacacttacaaataggttcagt

SEQ ID NO: 37022 - DNA, 25 bp, Homo sapien
caaaacagtttgcagattcctgatc

SEQ ID NO: 37023 - DNA, 25 bp, Homo sapien
caaaacagtttgcatattcctgatc

SEQ ID NO: 37024 - DNA, 25 bp, Homo sapien
caaaacatacgaaaacctaaataat

SEQ ID NO: 37025 - DNA, 25 bp, Homo sapien
caaaacatatgaaaacctaaataat

SEQ ID NO: 37026 - DNA, 25 bp, Homo sapien
caaaacatcacatactctctgcgat

SEQ ID NO: 37027 - DNA, 25 bp, Homo sapien
caaaacatcacatactgtctgcgat

SEQ ID NO: 37028 - DNA, 25 bp, Homo sapien
caaaacattctatcttgtaatcccc

SEQ ID NO: 37029 - DNA, 25 bp, Homo sapien
caaaacattctgtcttgtaatcccc

SEQ ID NO: 37030 - DNA, 25 bp, Homo sapien
caaaacattgctatgaacataggat

SEQ ID NO: 37031 - DNA, 25 bp, Homo sapien
caaaacattgctgtgaacataggat

SEQ ID NO: 37032 - DNA, 25 bp, Homo sapien
caaaacatttgctagaagaattgtc

SEQ ID NO: 37033 - DNA, 25 bp, Homo sapien
caaaacatttgctagacgaattgtc

SEQ ID NO: 37034 - DNA, 25 bp, Homo sapien
caaaaccacaacaaaagtgatgctt

SEQ ID NO: 37035 - DNA, 25 bp, Homo sapien
caaaaccacaacgaaagtgatgctt

SEQ ID NO: 37036 - DNA, 25 bp, Homo sapien
caaaaccacctttactatgtaagtt

SEQ ID NO: 37037 - DNA, 25 bp, Homo sapien
caaaaccacctttattatgtaagtt

SEQ ID NO: 37038 - DNA, 25 bp, Homo sapien
caaaaccagcataagcaacagaccc

SEQ ID NO: 37039 - DNA, 25 bp, Homo sapien
caaaaccagcataggcaacagaccc

SEQ ID NO: 37040 - DNA, 25 bp, Homo sapien
caaaaccagctcgtggacaaacata

SEQ ID NO: 37041 - DNA, 25 bp, Homo sapien
caaaaccagcttgtggacaaacata

SEQ ID NO: 37042 - DNA, 25 bp, Homo sapien
caaaaccatgagacaattcaaactc

SEQ ID NO: 37043 - DNA, 25 bp, Homo sapien
caaaaccatgagccaattcaaactc

SEQ ID NO: 37044 - DNA, 25 bp, Homo sapien
caaaaccatttctctgtcaagggaa

SEQ ID NO: 37045 - DNA, 25 bp, Homo sapien
caaaaccatttctttgtcaagggaa

SEQ ID NO: 37046 - DNA, 25 bp, Homo sapien
caaaacccaaaagagacataacaaa

SEQ ID NO: 37047 - DNA, 25 bp, Homo sapien
caaaacccgaaagagacataacaaa

SEQ ID NO: 37048 - DNA, 25 bp, Homo sapien
caaaacctcatgatggcctgcagag

SEQ ID NO: 37049 - DNA, 25 bp, Homo sapien
caaaacctcatgttggcctgcagag

SEQ ID NO: 37050 - DNA, 25 bp, Homo sapien
caaaacctggcagagacaacagaaa

SEQ ID NO: 37051 - DNA, 25 bp, Homo sapien
caaaacctggcagagataacagaaa

SEQ ID NO: 37052 - DNA, 25 bp, Homo sapien
caaaacgaggtgcaatgataagtta

SEQ ID NO: 37053 - DNA, 25 bp, Homo sapien
caaaacgaggtgcaattataagtta

SEQ ID NO: 37054 - DNA, 25 bp, Homo sapien
caaaacgtgaagctcaagggataga

SEQ ID NO: 37055 - DNA, 25 bp, Homo sapien
caaaacgtgaagttcaagggataga

SEQ ID NO: 37056 - DNA, 25 bp, Homo sapien
caaaactatgagcgtccaggcagct

SEQ ID NO: 37057 - DNA, 25 bp, Homo sapien
caaaactatgagggtccaggcagct

SEQ ID NO: 37058 - DNA, 25 bp, Homo sapien
caaaactcaatacccttcaatggct

SEQ ID NO: 37059 - DNA, 25 bp, Homo sapien
caaaactccagccaaaaagaggaga

SEQ ID NO: 37060 - DNA, 25 bp, Homo sapien
caaaactccagccacaaagaggaga

SEQ ID NO: 37061 - DNA, 25 bp, Homo sapien
caaaactccatacccttcaatggct

SEQ ID NO: 37062 - DNA, 25 bp, Homo sapien
caaaactgcatgatcttctgctgag

SEQ ID NO: 37063 - DNA, 25 bp, Homo sapien
caaaactgcgtgatcttctgctgag

SEQ ID NO: 37064 - DNA, 25 bp, Homo sapien
caaaactggatatgctttctacatt

SEQ ID NO: 37065 - DNA, 25 bp, Homo sapien
caaaactggatattctttctacatt

SEQ ID NO: 37066 - DNA, 25 bp, Homo sapien
caaaacttagaatgatgtcacattg

SEQ ID NO: 37067 - DNA, 25 bp, Homo sapien
caaaacttagaatgctgtcacattg

SEQ ID NO: 37068 - DNA, 25 bp, Homo sapien
caaaacttcataacaccttggaatg

SEQ ID NO: 37069 - DNA, 25 bp, Homo sapien
caaaacttcctaacaccttggaatg

SEQ ID NO: 37070 - DNA, 25 bp, Homo sapien
caaaacttgcaatcccgattgagac

SEQ ID NO: 37071 - DNA, 25 bp, Homo sapien
caaaactttcaatcccgattgagac

SEQ ID NO: 37072 - DNA, 25 bp, Homo sapien
caaaactttctactccgaagctgtt

SEQ ID NO: 37073 - DNA, 25 bp, Homo sapien
caaaactttctactcctaagctgtt

SEQ ID NO: 37074 - DNA, 25 bp, Homo sapien
caaaagaaaatgccttcagtaccac

SEQ ID NO: 37075 - DNA, 25 bp, Homo sapien
caaaagaaaatggcttcagtaccac

SEQ ID NO: 37076 - DNA, 25 bp, Homo sapien
caaaagaaattcatagtgactatta

SEQ ID NO: 37077 - DNA, 25 bp, Homo sapien
caaaagaatttcatagtgactatta

SEQ ID NO: 37078 - DNA, 25 bp, Homo sapien
caaaagacaagaagagagcaaaccc

SEQ ID NO: 37079 - DNA, 25 bp, Homo sapien
caaaagacatgtacgagaataatca

SEQ ID NO: 37080 - DNA, 25 bp, Homo sapien
caaaagacatgtatgagaataatca

SEQ ID NO: 37081 - DNA, 25 bp, Homo sapien
caaaagaccagaagagagcaaaccc

SEQ ID NO: 37082 - DNA, 25 bp, Homo sapien
caaaagagactgtgaaagaacagct

SEQ ID NO: 37083 - DNA, 25 bp, Homo sapien
caaaagagactgtgaaggaacagct

SEQ ID NO: 37084 - DNA, 25 bp, Homo sapien
caaaagagctattacgttgtgaaga

SEQ ID NO: 37085 - DNA, 25 bp, Homo sapien
caaaagagctattaggttgtgaaga

SEQ ID NO: 37086 - DNA, 25 bp, Homo sapien
caaaagagtagaggttagtggaatt

SEQ ID NO: 37087 - DNA, 25 bp, Homo sapien
caaaagagtagaggttcgtggaatt

SEQ ID NO: 37088 - DNA, 25 bp, Homo sapien
caaaagatattaccccagtgaaaac

SEQ ID NO: 37089 - DNA, 25 bp, Homo sapien
caaaagatatttccccagtgaaaac

SEQ ID NO: 37090 - DNA, 25 bp, Homo sapien
caaaagatcatctataaaccgtaat

SEQ ID NO: 37091 - DNA, 25 bp, Homo sapien
caaaagatcctcagggactatacaa

SEQ ID NO: 37092 - DNA, 25 bp, Homo sapien
caaaagatcctcagggtctatacaa

SEQ ID NO: 37093 - DNA, 25 bp, Homo sapien
caaaagatcgtctataaaccgtaat

SEQ ID NO: 37094 - DNA, 25 bp, Homo sapien
caaaagattcttcatacgtaggcaa

SEQ ID NO: 37095 - DNA, 25 bp, Homo sapien
caaaagattcttcatatgtaggcaa

SEQ ID NO: 37096 - DNA, 25 bp, Homo sapien
caaaagcaacaatatcaaagaatgc

SEQ ID NO: 37097 - DNA, 25 bp, Homo sapien
caaaagcaacagtatcaaagaatgc

SEQ ID NO: 37098 - DNA, 25 bp, Homo sapien
caaaagcaagaactacagagacaga

SEQ ID NO: 37099 - DNA, 25 bp, Homo sapien
caaaagcaagaactccagagacaga

SEQ ID NO: 37100 - DNA, 25 bp, Homo sapien
caaaagcatagtatcgtcattaata

SEQ ID NO: 37101 - DNA, 25 bp, Homo sapien
caaaagcatagtattgtcattaata

SEQ ID NO: 37102 - DNA, 25 bp, Homo sapien
caaaagcatgcctaggaacactagc

SEQ ID NO: 37103 - DNA, 25 bp, Homo sapien
caaaagcatgcctagggacactagc

SEQ ID NO: 37104 - DNA, 25 bp, Homo sapien
caaaagccattgcaaaatttgaaac

SEQ ID NO: 37105 - DNA, 25 bp, Homo sapien
caaaagccattgtaaaatttgaaac

SEQ ID NO: 37106 - DNA, 25 bp, Homo sapien
caaaagcctacatgtgctgttatgg

SEQ ID NO: 37107 - DNA, 25 bp, Homo sapien
caaaagcctacgtgtgctgttatgg

SEQ ID NO: 37108 - DNA, 25 bp, Homo sapien
caaaagctgcaacataaccatatca

SEQ ID NO: 37109 - DNA, 25 bp, Homo sapien
caaaagctgcaatataaccatatca

SEQ ID NO: 37110 - DNA, 25 bp, Homo sapien
caaaaggacaaaattataagcactg

SEQ ID NO: 37111 - DNA, 25 bp, Homo sapien
caaaaggataaaattataagcactg

SEQ ID NO: 37112 - DNA, 25 bp, Homo sapien
caaaaggcagactaactggagaaca

SEQ ID NO: 37113 - DNA, 25 bp, Homo sapien
caaaaggcagattaactggagaaca

SEQ ID NO: 37114 - DNA, 25 bp, Homo sapien
caaaaggcatgatcttgctgggacg

SEQ ID NO: 37115 - DNA, 25 bp, Homo sapien
caaaaggcatggtcttgctgggacg

SEQ ID NO: 37116 - DNA, 25 bp, Homo sapien
caaaaggcgaatccgatcatgtggt

SEQ ID NO: 37117 - DNA, 25 bp, Homo sapien
caaaaggcgaatctgatcatgtggt

SEQ ID NO: 37118 - DNA, 25 bp, Homo sapien
caaaagggaacatgtacagagtgga

SEQ ID NO: 37119 - DNA, 25 bp, Homo sapien
caaaagggaacatgtatagagtgga

SEQ ID NO: 37120 - DNA, 25 bp, Homo sapien
caaaagggtggagaatgtggatatc

SEQ ID NO: 37121 - DNA, 25 bp, Homo sapien
caaaagggtggataatgtggatatc

SEQ ID NO: 37122 - DNA, 25 bp, Homo sapien
caaaaggtcatatcatactgcaagc

SEQ ID NO: 37123 - DNA, 25 bp, Homo sapien
caaaaggtcgtatcatactgcaagc

SEQ ID NO: 37124 - DNA, 25 bp, Homo sapien
caaaaggtgatagaagaaaaagaca

SEQ ID NO: 37125 - DNA, 25 bp, Homo sapien
caaaaggtgatagaaggaaaagaca

SEQ ID NO: 37126 - DNA, 25 bp, Homo sapien
caaaagtgctaagaatataaatatc

SEQ ID NO: 37127 - DNA, 25 bp, Homo sapien
caaaagtgctaggaatataaatatc

SEQ ID NO: 37128 - DNA, 25 bp, Homo sapien
caaaagtggcgctttctgctctgag

SEQ ID NO: 37129 - DNA, 25 bp, Homo sapien
caaaagtggcgttttctgctctgag

SEQ ID NO: 37130 - DNA, 25 bp, Homo sapien
caaaagttagctcattacagatttc

SEQ ID NO: 37131 - DNA, 25 bp, Homo sapien
caaaagttagctcgttacagatttc

SEQ ID NO: 37132 - DNA, 25 bp, Homo sapien
caaaagttccaagagagtgtaaaag

SEQ ID NO: 37133 - DNA, 25 bp, Homo sapien
caaaagttccaagggagtgtaaaag

SEQ ID NO: 37134 - DNA, 25 bp, Homo sapien
caaaagttgcccaaaatttgcatgt

SEQ ID NO: 37135 - DNA, 25 bp, Homo sapien
caaaagttgcccagaatttgcatgt

SEQ ID NO: 37136 - DNA, 25 bp, Homo sapien
caaaataaatttggtctcattaaac

SEQ ID NO: 37137 - DNA, 25 bp, Homo sapien
caaaataagtttggtctcattaaac

SEQ ID NO: 37138 - DNA, 25 bp, Homo sapien
caaaataattcagtaaatcatgcta

SEQ ID NO: 37139 - DNA, 25 bp, Homo sapien
caaaataattcagttaatcatgcta

SEQ ID NO: 37140 - DNA, 25 bp, Homo sapien
caaaatactcgaaaattgcatttga

SEQ ID NO: 37141 - DNA, 25 bp, Homo sapien
caaaatacttgaaaattgcatttga

SEQ ID NO: 37142 - DNA, 25 bp, Homo sapien
caaaatagacctgcacatatagaat

SEQ ID NO: 37143 - DNA, 25 bp, Homo sapien
caaaatagacctgcacgtatagaat

SEQ ID NO: 37144 - DNA, 25 bp, Homo sapien
caaaatagcctgtctctggaacaca

SEQ ID NO: 37145 - DNA, 25 bp, Homo sapien
caaaataggctgtctctggaacaca

SEQ ID NO: 37146 - DNA, 25 bp, Homo sapien
caaaatatcacactagccatttcca

SEQ ID NO: 37147 - DNA, 25 bp, Homo sapien
caaaatatcacactagtcatttcca

SEQ ID NO: 37148 - DNA, 25 bp, Homo sapien
caaaatatgaacaaaaatatcctag

SEQ ID NO: 37149 - DNA, 25 bp, Homo sapien
caaaatatgaacagaaatatcctag

SEQ ID NO: 37150 - DNA, 25 bp, Homo sapien
caaaatatgagataagtgtcagcaa

SEQ ID NO: 37151 - DNA, 25 bp, Homo sapien
caaaatatgcctgcacttcctagaa

SEQ ID NO: 37152 - DNA, 25 bp, Homo sapien
caaaatatgcctgcgcttcctagaa

SEQ ID NO: 37153 - DNA, 25 bp, Homo sapien
caaaatatgtcaaagaaatacactt

SEQ ID NO: 37154 - DNA, 25 bp, Homo sapien
caaaatatgtcaaataaatacactt

SEQ ID NO: 37155 - DNA, 25 bp, Homo sapien
caaaatattaccaatgctactgata

SEQ ID NO: 37156 - DNA, 25 bp, Homo sapien
caaaatattaccagtgctactgata

SEQ ID NO: 37157 - DNA, 25 bp, Homo sapien
caaaatattagataagtgtcagcaa

SEQ ID NO: 37158 - DNA, 25 bp, Homo sapien
caaaatattttacgtcctttgcata

SEQ ID NO: 37159 - DNA, 25 bp, Homo sapien
caaaatattttatgtcctttgcata

SEQ ID NO: 37160 - DNA, 25 bp, Homo sapien
caaaatcaaaacgttgaaatttagc

SEQ ID NO: 37161 - DNA, 25 bp, Homo sapien
caaaatcaactatttcaagtgacag

SEQ ID NO: 37162 - DNA, 25 bp, Homo sapien
caaaatcaagacgagagccactcct

SEQ ID NO: 37163 - DNA, 25 bp, Homo sapien
caaaatcaagacgttgaaatttagc

SEQ ID NO: 37164 - DNA, 25 bp, Homo sapien
caaaatcaagatgagagccactcct

SEQ ID NO: 37165 - DNA, 25 bp, Homo sapien
caaaatcagctatttcaagtgacag

SEQ ID NO: 37166 - DNA, 25 bp, Homo sapien
caaaatcatgtccatttaatagcag

SEQ ID NO: 37167 - DNA, 25 bp, Homo sapien
caaaatcatgtccgtttaatagcag

SEQ ID NO: 37168 - DNA, 25 bp, Homo sapien
caaaatccacttgcaacaaaaactg

SEQ ID NO: 37169 - DNA, 25 bp, Homo sapien
caaaatccacttgcgacaaaaactg

SEQ ID NO: 37170 - DNA, 25 bp, Homo sapien
caaaatccagtgcaaagctgtttta

SEQ ID NO: 37171 - DNA, 25 bp, Homo sapien
caaaatccggtgcaaagctgtttta

SEQ ID NO: 37172 - DNA, 25 bp, Homo sapien
caaaatctttgcatcaaattaacat

SEQ ID NO: 37173 - DNA, 25 bp, Homo sapien
caaaatctttgcatcagattaacat

SEQ ID NO: 37174 - DNA, 25 bp, Homo sapien
caaaatgactttcaaaagaggatag

SEQ ID NO: 37175 - DNA, 25 bp, Homo sapien
caaaatgagattgattataaaccta

SEQ ID NO: 37176 - DNA, 25 bp, Homo sapien
caaaatgagattgattgtaaaccta

SEQ ID NO: 37177 - DNA, 25 bp, Homo sapien
caaaatgatagctgcaatagaaagt

SEQ ID NO: 37178 - DNA, 25 bp, Homo sapien
caaaatgatagctgcagtagaaagt

SEQ ID NO: 37179 - DNA, 25 bp, Homo sapien
caaaatgatctttatgtgactcttt

SEQ ID NO: 37180 - DNA, 25 bp, Homo sapien
caaaatgatctttgtgtgactcttt

SEQ ID NO: 37181 - DNA, 25 bp, Homo sapien
caaaatgattgttacagccaatgaa

SEQ ID NO: 37182 - DNA, 25 bp, Homo sapien
caaaatgattgttatagccaatgaa

SEQ ID NO: 37183 - DNA, 25 bp, Homo sapien
caaaatgattttcaaaagaggatag

SEQ ID NO: 37184 - DNA, 25 bp, Homo sapien
caaaatgccaggttcatattcaaaa

SEQ ID NO: 37185 - DNA, 25 bp, Homo sapien
caaaatgccaggttgatattcaaaa

SEQ ID NO: 37186 - DNA, 25 bp, Homo sapien
caaaatgcctagcaaaatgtacgta

SEQ ID NO: 37187 - DNA, 25 bp, Homo sapien
caaaatgcctaggaaaatgtacgta

SEQ ID NO: 37188 - DNA, 25 bp, Homo sapien
caaaatgctacaaaacttaatccaa

SEQ ID NO: 37189 - DNA, 25 bp, Homo sapien
caaaatgctacgaaacttaatccaa

SEQ ID NO: 37190 - DNA, 25 bp, Homo sapien
caaaatggcaccgagagaaccatgt

SEQ ID NO: 37191 - DNA, 25 bp, Homo sapien
caaaatggcactgagagaaccatgt

SEQ ID NO: 37192 - DNA, 25 bp, Homo sapien
caaaatggctgttcgtaggaatgga

SEQ ID NO: 37193 - DNA, 25 bp, Homo sapien
caaaatggctgtttgtaggaatgga

SEQ ID NO: 37194 - DNA, 25 bp, Homo sapien
caaaatgtcttatcatatcttactc

SEQ ID NO: 37195 - DNA, 25 bp, Homo sapien
caaaatgtcttatcatgtcttactc

SEQ ID NO: 37196 - DNA, 25 bp, Homo sapien
caaaatgttaccacgcctcgacagc

SEQ ID NO: 37197 - DNA, 25 bp, Homo sapien
caaaatgttaccatgcctcgacagc

SEQ ID NO: 37198 - DNA, 25 bp, Homo sapien
caaaatgttctatactcacacaaat

SEQ ID NO: 37199 - DNA, 25 bp, Homo sapien
caaaatgttctatacttacacaaat

SEQ ID NO: 37200 - DNA, 25 bp, Homo sapien
caaaattaacgcttagcttcagtaa

SEQ ID NO: 37201 - DNA, 25 bp, Homo sapien
caaaattaatgcttagcttcagtaa

SEQ ID NO: 37202 - DNA, 25 bp, Homo sapien
caaaattacaaatagcaattcacat

SEQ ID NO: 37203 - DNA, 25 bp, Homo sapien
caaaattacaccctatgctgtgatg

SEQ ID NO: 37204 - DNA, 25 bp, Homo sapien
caaaattacgccctatgctgtgatg

SEQ ID NO: 37205 - DNA, 25 bp, Homo sapien
caaaattactaatgcaaagtggcca

SEQ ID NO: 37206 - DNA, 25 bp, Homo sapien
caaaattactaatggaaagtggcca

SEQ ID NO: 37207 - DNA, 25 bp, Homo sapien
caaaattagaaatagcaattcacat

SEQ ID NO: 37208 - DNA, 25 bp, Homo sapien
caaaattataggcctgatttctcct

SEQ ID NO: 37209 - DNA, 25 bp, Homo sapien
caaaattatagtcctgatttctcct

SEQ ID NO: 37210 - DNA, 25 bp, Homo sapien
caaaattatctgcacgatggaaacg

SEQ ID NO: 37211 - DNA, 25 bp, Homo sapien
caaaattatctgcatgatggaaacg

SEQ ID NO: 37212 - DNA, 25 bp, Homo sapien
caaaattatgtatagttcctgactt

SEQ ID NO: 37213 - DNA, 25 bp, Homo sapien
caaaattatgtgtagttcctgactt

SEQ ID NO: 37214 - DNA, 25 bp, Homo sapien
caaaattccaaaatataaaggcagt

SEQ ID NO: 37215 - DNA, 25 bp, Homo sapien
caaaattccagaatggttccctaag

SEQ ID NO: 37216 - DNA, 25 bp, Homo sapien
caaaattccagaattgttccctaag

SEQ ID NO: 37217 - DNA, 25 bp, Homo sapien
caaaattccgaaatataaaggcagt

SEQ ID NO: 37218 - DNA, 25 bp, Homo sapien
caaaattctaaaatataagagtgca

SEQ ID NO: 37219 - DNA, 25 bp, Homo sapien
caaaattctaaaatattagagtgca

SEQ ID NO: 37220 - DNA, 25 bp, Homo sapien
caaaattctatgatgaacaatgaag

SEQ ID NO: 37221 - DNA, 25 bp, Homo sapien
caaaattctatgatgaccaatgaag

SEQ ID NO: 37222 - DNA, 25 bp, Homo sapien
caaaattgaaagctattgaactttg

SEQ ID NO: 37223 - DNA, 25 bp, Homo sapien
caaaattgcgtgatatgacaaaatg

SEQ ID NO: 37224 - DNA, 25 bp, Homo sapien
caaaattggaagctattgaactttg

SEQ ID NO: 37225 - DNA, 25 bp, Homo sapien
caaaattgtgtgatatgacaaaatg

SEQ ID NO: 37226 - DNA, 25 bp, Homo sapien
caaaatttgcaggatatggttgaag

SEQ ID NO: 37227 - DNA, 25 bp, Homo sapien
caaaatttgccagcctttttcactt

SEQ ID NO: 37228 - DNA, 25 bp, Homo sapien
caaaatttgccagtctttttcactt

SEQ ID NO: 37229 - DNA, 25 bp, Homo sapien
caaaatttgtaggatatggttgaag

SEQ ID NO: 37230 - DNA, 25 bp, Homo sapien
caaaattttcaagatggctttgatg

SEQ ID NO: 37231 - DNA, 25 bp, Homo sapien
caaaattttcaccgggaagtgtcaa

SEQ ID NO: 37232 - DNA, 25 bp, Homo sapien
caaaattttcactgggaagtgtcaa

SEQ ID NO: 37233 - DNA, 25 bp, Homo sapien
caaaattttgaagatggctttgatg

SEQ ID NO: 37234 - DNA, 25 bp, Homo sapien
caaacaaaagacgacacaacccaaa

SEQ ID NO: 37235 - DNA, 25 bp, Homo sapien
caaacaaaagatgacacaacccaaa

SEQ ID NO: 37236 - DNA, 25 bp, Homo sapien
caaacaaaattcaaacttcccagcc

SEQ ID NO: 37237 - DNA, 25 bp, Homo sapien
caaacaaaccagaaaatggtatacc

SEQ ID NO: 37238 - DNA, 25 bp, Homo sapien
caaacaaaccaggaaatggtatacc

SEQ ID NO: 37239 - DNA, 25 bp, Homo sapien
caaacaaacttcaaacttcccagcc

SEQ ID NO: 37240 - DNA, 25 bp, Homo sapien
caaacaacaatttcttccgtgaatt

SEQ ID NO: 37241 - DNA, 25 bp, Homo sapien
caaacaaccatttcttccgtgaatt

SEQ ID NO: 37242 - DNA, 25 bp, Homo sapien
caaacaagatgtggcacaatgggaa

SEQ ID NO: 37243 - DNA, 25 bp, Homo sapien
caaacaagatgtggcataatgggaa

SEQ ID NO: 37244 - DNA, 25 bp, Homo sapien
caaacaagcaaacaacaaatacctg

SEQ ID NO: 37245 - DNA, 25 bp, Homo sapien
caaacaagcgaacaacaaatacctg

SEQ ID NO: 37246 - DNA, 25 bp, Homo sapien
caaacaagtaagaagtttcccaagc

SEQ ID NO: 37247 - DNA, 25 bp, Homo sapien
caaacaagtcagaagtttcccaagc

SEQ ID NO: 37248 - DNA, 25 bp, Homo sapien
caaacaatattccacttttacctag

SEQ ID NO: 37249 - DNA, 25 bp, Homo sapien
caaacaatattcgacttttacctag

SEQ ID NO: 37250 - DNA, 25 bp, Homo sapien
caaacaatgtagaagagccaggtaa

SEQ ID NO: 37251 - DNA, 25 bp, Homo sapien
caaacaatgtagaagatccaggtaa

SEQ ID NO: 37252 - DNA, 25 bp, Homo sapien
caaacacaaataggtttctttactt

SEQ ID NO: 37253 - DNA, 25 bp, Homo sapien
caaacacaatgctccgctctattcc

SEQ ID NO: 37254 - DNA, 25 bp, Homo sapien
caaacacactttaaaaacacagaat

SEQ ID NO: 37255 - DNA, 25 bp, Homo sapien
caaacacactttagaaacacagaat

SEQ ID NO: 37256 - DNA, 25 bp, Homo sapien
caaacacagataggtttctttactt

SEQ ID NO: 37257 - DNA, 25 bp, Homo sapien
caaacacaggcaataaaaggacaaa

SEQ ID NO: 37258 - DNA, 25 bp, Homo sapien
caaacacaggcagtaaaaggacaaa

SEQ ID NO: 37259 - DNA, 25 bp, Homo sapien
caaacacagtgctccgctctattcc

SEQ ID NO: 37260 - DNA, 25 bp, Homo sapien
caaacacatcatatcaaaatgcatg

SEQ ID NO: 37261 - DNA, 25 bp, Homo sapien
caaacacatcatgtcaaaatgcatg

SEQ ID NO: 37262 - DNA, 25 bp, Homo sapien
caaacaccatcatgcctaactcggg

SEQ ID NO: 37263 - DNA, 25 bp, Homo sapien
caaacaccatcatggctaactcggg

SEQ ID NO: 37264 - DNA, 25 bp, Homo sapien
caaacaccttccactggggtcttca

SEQ ID NO: 37265 - DNA, 25 bp, Homo sapien
caaacaccttccgctggggtcttca

SEQ ID NO: 37266 - DNA, 25 bp, Homo sapien
caaacactgacattggtgctagact

SEQ ID NO: 37267 - DNA, 25 bp, Homo sapien
caaacactgacgttggtgctagact

SEQ ID NO: 37268 - DNA, 25 bp, Homo sapien
caaacactgatgtaaacgtacaaaa

SEQ ID NO: 37269 - DNA, 25 bp, Homo sapien
caaacactgatgtaaatgtacaaaa

SEQ ID NO: 37270 - DNA, 25 bp, Homo sapien
caaacacttatgccagctcttgagg

SEQ ID NO: 37271 - DNA, 25 bp, Homo sapien
caaacacttatgtcagctcttgagg

SEQ ID NO: 37272 - DNA, 25 bp, Homo sapien
caaacagaagattatttgctgggca

SEQ ID NO: 37273 - DNA, 25 bp, Homo sapien
caaacagaatattatttgctgggca

SEQ ID NO: 37274 - DNA, 25 bp, Homo sapien
caaacagatcttgcaagcactcact

SEQ ID NO: 37275 - DNA, 25 bp, Homo sapien
caaacagatcttgcgagcactcact

SEQ ID NO: 37276 - DNA, 25 bp, Homo sapien
caaacagatgaaagctatccctaaa

SEQ ID NO: 37277 - DNA, 25 bp, Homo sapien
caaacagatgaaggctatccctaaa

SEQ ID NO: 37278 - DNA, 25 bp, Homo sapien
caaacagatgcaggatgatccgcac

SEQ ID NO: 37279 - DNA, 25 bp, Homo sapien
caaacagattcaggatgatccgcac

SEQ ID NO: 37280 - DNA, 25 bp, Homo sapien
caaacagcctaaactctttcacctg

SEQ ID NO: 37281 - DNA, 25 bp, Homo sapien
caaacagcgtaaactctttcacctg

SEQ ID NO: 37282 - DNA, 25 bp, Homo sapien
caaacaggcagttaagaagatgaag

SEQ ID NO: 37283 - DNA, 25 bp, Homo sapien
caaacaggcagttatgaagatgaag

SEQ ID NO: 37284 - DNA, 25 bp, Homo sapien
caaacataagacctagatagcccat

SEQ ID NO: 37285 - DNA, 25 bp, Homo sapien
caaacataagacctagctagcccat

SEQ ID NO: 37286 - DNA, 25 bp, Homo sapien
caaacatacttctaggcattttatt

SEQ ID NO: 37287 - DNA, 25 bp, Homo sapien
caaacatacttgtaggcattttatt

SEQ ID NO: 37288 - DNA, 25 bp, Homo sapien
caaacatattttcaatctctgattc

SEQ ID NO: 37289 - DNA, 25 bp, Homo sapien
caaacatattttctatctctgattc

SEQ ID NO: 37290 - DNA, 25 bp, Homo sapien
caaacatgatgttcttattccaatc

SEQ ID NO: 37291 - DNA, 25 bp, Homo sapien
caaacatgatgttcttgttccaatc

SEQ ID NO: 37292 - DNA, 25 bp, Homo sapien
caaacattcagaagctcgtagaatt

SEQ ID NO: 37293 - DNA, 25 bp, Homo sapien
caaacattcagaagcttgtagaatt

SEQ ID NO: 37294 - DNA, 25 bp, Homo sapien
caaacattcccaaagctgagcagcc

SEQ ID NO: 37295 - DNA, 25 bp, Homo sapien
caaacattcccaacgctgagcagcc

SEQ ID NO: 37296 - DNA, 25 bp, Homo sapien
caaacattcttcattatgatcctca

SEQ ID NO: 37297 - DNA, 25 bp, Homo sapien
caaacattcttcgttatgatcctca

SEQ ID NO: 37298 - DNA, 25 bp, Homo sapien
caaacatttatactcaacttgcctg

SEQ ID NO: 37299 - DNA, 25 bp, Homo sapien
caaacatttatattcaacttgcctg

SEQ ID NO: 37300 - DNA, 25 bp, Homo sapien
caaaccaaatgcttaaagtttcaaa

SEQ ID NO: 37301 - DNA, 25 bp, Homo sapien
caaaccaaatgcttgaagtttcaaa

SEQ ID NO: 37302 - DNA, 25 bp, Homo sapien
caaaccaatctgaactagaacctca

SEQ ID NO: 37303 - DNA, 25 bp, Homo sapien
caaaccaatctgagctagaacctca

SEQ ID NO: 37304 - DNA, 25 bp, Homo sapien
caaaccaatttgggccagatttctg

SEQ ID NO: 37305 - DNA, 25 bp, Homo sapien
caaaccaatttgggtcagatttctg

SEQ ID NO: 37306 - DNA, 25 bp, Homo sapien
caaaccactactaattccaggtcag

SEQ ID NO: 37307 - DNA, 25 bp, Homo sapien
caaaccactactacttccaggtcag

SEQ ID NO: 37308 - DNA, 25 bp, Homo sapien
caaaccagaaaatggtataccaaaa

SEQ ID NO: 37309 - DNA, 25 bp, Homo sapien
caaaccaggaaatggtataccaaaa

SEQ ID NO: 37310 - DNA, 25 bp, Homo sapien
caaaccagttataaccatgccaagt

SEQ ID NO: 37311 - DNA, 25 bp, Homo sapien
caaaccagttataaccgtgccaagt

SEQ ID NO: 37312 - DNA, 25 bp, Homo sapien
caaacccaagtgatcatttagtgtc

SEQ ID NO: 37313 - DNA, 25 bp, Homo sapien
caaacccacgtgatcatttagtgtc

SEQ ID NO: 37314 - DNA, 25 bp, Homo sapien
caaacccatgcaaaagaggaactgc

SEQ ID NO: 37315 - DNA, 25 bp, Homo sapien
caaacccatgcaaaggaggaactgc

SEQ ID NO: 37316 - DNA, 25 bp, Homo sapien
caaaccctaccatggtcatctctac

SEQ ID NO: 37317 - DNA, 25 bp, Homo sapien
caaaccctaccgtggtcatctctac

SEQ ID NO: 37318 - DNA, 25 bp, Homo sapien
caaaccctatgaagagtcttgagaa

SEQ ID NO: 37319 - DNA, 25 bp, Homo sapien
caaaccctatgatgagtcttgagaa

SEQ ID NO: 37320 - DNA, 25 bp, Homo sapien
caaaccgactcaaaacattggatta

SEQ ID NO: 37321 - DNA, 25 bp, Homo sapien
caaaccgactcagaacattggatta

SEQ ID NO: 37322 - DNA, 25 bp, Homo sapien
caaaccgtcacagttaaccattacg

SEQ ID NO: 37323 - DNA, 25 bp, Homo sapien
caaaccgtcactgttaaccattacg

SEQ ID NO: 37324 - DNA, 25 bp, Homo sapien
caaacctcattcttcctggatgcgg

SEQ ID NO: 37325 - DNA, 25 bp, Homo sapien
caaacctcattgttcctggatgcgg

SEQ ID NO: 37326 - DNA, 25 bp, Homo sapien
caaaccttcaatctgcaaaaaatgc

SEQ ID NO: 37327 - DNA, 25 bp, Homo sapien
caaaccttcaatttgcaaaaaatgc

SEQ ID NO: 37328 - DNA, 25 bp, Homo sapien
caaaccttcttcctttataaattac

SEQ ID NO: 37329 - DNA, 25 bp, Homo sapien
caaacctttttcctttataaattac

SEQ ID NO: 37330 - DNA, 25 bp, Homo sapien
caaacgaggacacagggtctgacac

SEQ ID NO: 37331 - DNA, 25 bp, Homo sapien
caaacgaggacacatggtctgacac

SEQ ID NO: 37332 - DNA, 25 bp, Homo sapien
caaacgatactataaggcactagtt

SEQ ID NO: 37333 - DNA, 25 bp, Homo sapien
caaacgatactgtaaggcactagtt

SEQ ID NO: 37334 - DNA, 25 bp, Homo sapien
caaacgattatgagattgattttca

SEQ ID NO: 37335 - DNA, 25 bp, Homo sapien
caaacgattttgagattgattttca

SEQ ID NO: 37336 - DNA, 25 bp, Homo sapien
caaacgccttcgtggtgcttccata

SEQ ID NO: 37337 - DNA, 25 bp, Homo sapien
caaacgccttcttggtgcttccata

SEQ ID NO: 37338 - DNA, 25 bp, Homo sapien
caaacggacctctgcaactttcaag

SEQ ID NO: 37339 - DNA, 25 bp, Homo sapien
caaacggagctctgcaactttcaag

SEQ ID NO: 37340 - DNA, 25 bp, Homo sapien
caaacggctagtatccagaatctac

SEQ ID NO: 37341 - DNA, 25 bp, Homo sapien
caaacggctagtgtccagaatctac

SEQ ID NO: 37342 - DNA, 25 bp, Homo sapien
caaacgtattctcacctacagaaaa

SEQ ID NO: 37343 - DNA, 25 bp, Homo sapien
caaacgtattctcatctacagaaaa

SEQ ID NO: 37344 - DNA, 25 bp, Homo sapien
caaacgttgttaactcatttcaccc

SEQ ID NO: 37345 - DNA, 25 bp, Homo sapien
caaacgttgttagctcatttcaccc

SEQ ID NO: 37346 - DNA, 25 bp, Homo sapien
caaactaaagaactcctacatagca

SEQ ID NO: 37347 - DNA, 25 bp, Homo sapien
caaactaaagaagtcctacatagca

SEQ ID NO: 37348 - DNA, 25 bp, Homo sapien
caaactaacagaaaaattggcaaag

SEQ ID NO: 37349 - DNA, 25 bp, Homo sapien
caaactaacagagaaattggcaaag

SEQ ID NO: 37350 - DNA, 25 bp, Homo sapien
caaactaactttacaactgaaggga

SEQ ID NO: 37351 - DNA, 25 bp, Homo sapien
caaactaactttacaattgaaggga

SEQ ID NO: 37352 - DNA, 25 bp, Homo sapien
caaactacatgactggcttctccaa

SEQ ID NO: 37353 - DNA, 25 bp, Homo sapien
caaactacctgactggcttctccaa

SEQ ID NO: 37354 - DNA, 25 bp, Homo sapien
caaactagagcaatttgagataaac

SEQ ID NO: 37355 - DNA, 25 bp, Homo sapien
caaactagagcactttgagataaac

SEQ ID NO: 37356 - DNA, 25 bp, Homo sapien
caaactatgcccaacatgttttcat

SEQ ID NO: 37357 - DNA, 25 bp, Homo sapien
caaactatgcccaatatgttttcat

SEQ ID NO: 37358 - DNA, 25 bp, Homo sapien
caaactcggtggcataaaacaatag

SEQ ID NO: 37359 - DNA, 25 bp, Homo sapien
caaactcggtgtcataaaacaatag

SEQ ID NO: 37360 - DNA, 25 bp, Homo sapien
caaactctcttgggacaagaaatac

SEQ ID NO: 37361 - DNA, 25 bp, Homo sapien
caaactctcttgggaccagaaatac

SEQ ID NO: 37362 - DNA, 25 bp, Homo sapien
caaactctgaatatgcaatattttc

SEQ ID NO: 37363 - DNA, 25 bp, Homo sapien
caaactctgagcactaaaatatact

SEQ ID NO: 37364 - DNA, 25 bp, Homo sapien
caaactctgagctctaaaatatact

SEQ ID NO: 37365 - DNA, 25 bp, Homo sapien
caaactctgtatatgcaatattttc

SEQ ID NO: 37366 - DNA, 25 bp, Homo sapien
caaactgacaggcttgaataaagaa

SEQ ID NO: 37367 - DNA, 25 bp, Homo sapien
caaactgactggcttgaataaagaa

SEQ ID NO: 37368 - DNA, 25 bp, Homo sapien
caaactgagccacaaacgcctacaa

SEQ ID NO: 37369 - DNA, 25 bp, Homo sapien
caaactgagccacaaatgcctacaa

SEQ ID NO: 37370 - DNA, 25 bp, Homo sapien
caaactgaggttaaacagccagcaa

SEQ ID NO: 37371 - DNA, 25 bp, Homo sapien
caaactgaggttaaacggccagcaa

SEQ ID NO: 37372 - DNA, 25 bp, Homo sapien
caaactgccacctcagggcaaatgc

SEQ ID NO: 37373 - DNA, 25 bp, Homo sapien
caaactgccgcctcagggcaaatgc

SEQ ID NO: 37374 - DNA, 25 bp, Homo sapien
caaactggactgggtactccctatt

SEQ ID NO: 37375 - DNA, 25 bp, Homo sapien
caaactggactgggtattccctatt

SEQ ID NO: 37376 - DNA, 25 bp, Homo sapien
caaactggtccccgataaaaactgg

SEQ ID NO: 37377 - DNA, 25 bp, Homo sapien
caaactggtccctgataaaaactgg

SEQ ID NO: 37378 - DNA, 25 bp, Homo sapien
caaacttaacatacagtaagcaatc

SEQ ID NO: 37379 - DNA, 25 bp, Homo sapien
caaacttaacatacggtaagcaatc

SEQ ID NO: 37380 - DNA, 25 bp, Homo sapien
caaacttaggaacatattttatgag

SEQ ID NO: 37381 - DNA, 25 bp, Homo sapien
caaacttaggaacgtattttatgag

SEQ ID NO: 37382 - DNA, 25 bp, Homo sapien
caaacttcatatcacttgacatgga

SEQ ID NO: 37383 - DNA, 25 bp, Homo sapien
caaacttcgtatcacttgacatgga

SEQ ID NO: 37384 - DNA, 25 bp, Homo sapien
caaacttgttcatcgcctatcaagc

SEQ ID NO: 37385 - DNA, 25 bp, Homo sapien
caaacttgttcattgcctatcaagc

SEQ ID NO: 37386 - DNA, 25 bp, Homo sapien
caaactttccttccgataggttttt

SEQ ID NO: 37387 - DNA, 25 bp, Homo sapien
caaactttccttctgataggttttt

SEQ ID NO: 37388 - DNA, 25 bp, Homo sapien
caaacttttccatagcagctgtgcc

SEQ ID NO: 37389 - DNA, 25 bp, Homo sapien
caaacttttccgtagcagctgtgcc

SEQ ID NO: 37390 - DNA, 25 bp, Homo sapien
caaagaaaactattcttggctgagg

SEQ ID NO: 37391 - DNA, 25 bp, Homo sapien
caaagaaaagaacccagatactctg

SEQ ID NO: 37392 - DNA, 25 bp, Homo sapien
caaagaaaagaacctagatactctg

SEQ ID NO: 37393 - DNA, 25 bp, Homo sapien
caaagaaaagtattcttggctgagg

SEQ ID NO: 37394 - DNA, 25 bp, Homo sapien
caaagaaaatactcagatagcttta

SEQ ID NO: 37395 - DNA, 25 bp, Homo sapien
caaagaaaatactgagatagcttta

SEQ ID NO: 37396 - DNA, 25 bp, Homo sapien
caaagaaacaaacggagaccaaaat

SEQ ID NO: 37397 - DNA, 25 bp, Homo sapien
caaagaaacaaatggagaccaaaat

SEQ ID NO: 37398 - DNA, 25 bp, Homo sapien
caaagaaataccattgcttgcatgt

SEQ ID NO: 37399 - DNA, 25 bp, Homo sapien
caaagaaataccattgtttgcatgt

SEQ ID NO: 37400 - DNA, 25 bp, Homo sapien
caaagaacaactgaatggaatcatg

SEQ ID NO: 37401 - DNA, 25 bp, Homo sapien
caaagaacaatgacgactataacag

SEQ ID NO: 37402 - DNA, 25 bp, Homo sapien
caaagaacaatgatgactataacag

SEQ ID NO: 37403 - DNA, 25 bp, Homo sapien
caaagaacacatcgacaacagggga

SEQ ID NO: 37404 - DNA, 25 bp, Homo sapien
caaagaacacatcgacgacagggga

SEQ ID NO: 37405 - DNA, 25 bp, Homo sapien
caaagaacaccattgtatgtgctaa

SEQ ID NO: 37406 - DNA, 25 bp, Homo sapien
caaagaacacctcatttattatatt

SEQ ID NO: 37407 - DNA, 25 bp, Homo sapien
caaagaacaggagtacccaggaaca

SEQ ID NO: 37408 - DNA, 25 bp, Homo sapien
caaagaacaggattacccaggaaca

SEQ ID NO: 37409 - DNA, 25 bp, Homo sapien
caaagaacatatatataaaggacct

SEQ ID NO: 37410 - DNA, 25 bp, Homo sapien
caaagaacatatgtataaaggacct

SEQ ID NO: 37411 - DNA, 25 bp, Homo sapien
caaagaacatctcatttattatatt

SEQ ID NO: 37412 - DNA, 25 bp, Homo sapien
caaagaaccactgaatggaatcatg

SEQ ID NO: 37413 - DNA, 25 bp, Homo sapien
caaagaactacataagcttctgaaa

SEQ ID NO: 37414 - DNA, 25 bp, Homo sapien
caaagaactacgtaagcttctgaaa

SEQ ID NO: 37415 - DNA, 25 bp, Homo sapien
caaagaactccattgtatgtgctaa

SEQ ID NO: 37416 - DNA, 25 bp, Homo sapien
caaagaaggttcagttggatatcaa

SEQ ID NO: 37417 - DNA, 25 bp, Homo sapien
caaagaagtttcagttggatatcaa

SEQ ID NO: 37418 - DNA, 25 bp, Homo sapien
caaagaattagccattgatacaaga

SEQ ID NO: 37419 - DNA, 25 bp, Homo sapien
caaagaattagtcattgatacaaga

SEQ ID NO: 37420 - DNA, 25 bp, Homo sapien
caaagaattgcctaatatcataaaa

SEQ ID NO: 37421 - DNA, 25 bp, Homo sapien
caaagaattgcctgatatcataaaa

SEQ ID NO: 37422 - DNA, 25 bp, Homo sapien
caaagacacggagaattccaggtgg

SEQ ID NO: 37423 - DNA, 25 bp, Homo sapien
caaagacacggaggtatcagaaata

SEQ ID NO: 37424 - DNA, 25 bp, Homo sapien
caaagacacggcggtatcagaaata

SEQ ID NO: 37425 - DNA, 25 bp, Homo sapien
caaagacatggagaattccaggtgg

SEQ ID NO: 37426 - DNA, 25 bp, Homo sapien
caaagaccatttgactctatttgta

SEQ ID NO: 37427 - DNA, 25 bp, Homo sapien
caaagaccattttactctatttgta

SEQ ID NO: 37428 - DNA, 25 bp, Homo sapien
caaagactgctaactgatttgaaca

SEQ ID NO: 37429 - DNA, 25 bp, Homo sapien
caaagactgctaactggtttgaaca

SEQ ID NO: 37430 - DNA, 25 bp, Homo sapien
caaagagaaccagatttctgctttc

SEQ ID NO: 37431 - DNA, 25 bp, Homo sapien
caaagagaaccaggtttctgctttc

SEQ ID NO: 37432 - DNA, 25 bp, Homo sapien
caaagagatgcaggttaatttccta

SEQ ID NO: 37433 - DNA, 25 bp, Homo sapien
caaagagattcaggttaatttccta

SEQ ID NO: 37434 - DNA, 25 bp, Homo sapien
caaagagcaagctaaacagtccact

SEQ ID NO: 37435 - DNA, 25 bp, Homo sapien
caaagagcagatagaaataggtgag

SEQ ID NO: 37436 - DNA, 25 bp, Homo sapien
caaagagcatatagaaataggtgag

SEQ ID NO: 37437 - DNA, 25 bp, Homo sapien
caaagagccaaagcagtgattatct

SEQ ID NO: 37438 - DNA, 25 bp, Homo sapien
caaagagccacgaagagaaaatggt

SEQ ID NO: 37439 - DNA, 25 bp, Homo sapien
caaagagccgaagcagtgattatct

SEQ ID NO: 37440 - DNA, 25 bp, Homo sapien
caaagagccttgaaagtactatttc

SEQ ID NO: 37441 - DNA, 25 bp, Homo sapien
caaagagccttgaatgtactatttc

SEQ ID NO: 37442 - DNA, 25 bp, Homo sapien
caaagagcgagctaaacagtccact

SEQ ID NO: 37443 - DNA, 25 bp, Homo sapien
caaagagctacgaagagaaaatggt

SEQ ID NO: 37444 - DNA, 25 bp, Homo sapien
caaagagctgagcccgcaagtttgc

SEQ ID NO: 37445 - DNA, 25 bp, Homo sapien
caaagagctgagccggcaagtttgc

SEQ ID NO: 37446 - DNA, 25 bp, Homo sapien
caaagagcttagtcggatttgaggg

SEQ ID NO: 37447 - DNA, 25 bp, Homo sapien
caaagagcttagttggatttgaggg

SEQ ID NO: 37448 - DNA, 25 bp, Homo sapien
caaagaggaacattgccaaattcta

SEQ ID NO: 37449 - DNA, 25 bp, Homo sapien
caaagaggagcattgccaaattcta

SEQ ID NO: 37450 - DNA, 25 bp, Homo sapien
caaagagtagcatatgattctaata

SEQ ID NO: 37451 - DNA, 25 bp, Homo sapien
caaagagtagcatgcgattctaata

SEQ ID NO: 37452 - DNA, 25 bp, Homo sapien
caaagagtagcatgtgattctaata

SEQ ID NO: 37453 - DNA, 25 bp, Homo sapien
caaagagtcactttacaatggagaa

SEQ ID NO: 37454 - DNA, 25 bp, Homo sapien
caaagagtcactttgcaatggagaa

SEQ ID NO: 37455 - DNA, 25 bp, Homo sapien
caaagagtttgcagtttgctcctta

SEQ ID NO: 37456 - DNA, 25 bp, Homo sapien
caaagagtttgccgtttgctcctta

SEQ ID NO: 37457 - DNA, 25 bp, Homo sapien
caaagatcacaaacagtgcaaattg

SEQ ID NO: 37458 - DNA, 25 bp, Homo sapien
caaagatcaggacggaagcaaggct

SEQ ID NO: 37459 - DNA, 25 bp, Homo sapien
caaagatcaggatggaagcaaggct

SEQ ID NO: 37460 - DNA, 25 bp, Homo sapien
caaagatcataaacagtgcaaattg

SEQ ID NO: 37461 - DNA, 25 bp, Homo sapien
caaagatccctcacttggagatgtg

SEQ ID NO: 37462 - DNA, 25 bp, Homo sapien
caaagatccctcgcttggagatgtg

SEQ ID NO: 37463 - DNA, 25 bp, Homo sapien
caaagatctgaatttgagctctagt

SEQ ID NO: 37464 - DNA, 25 bp, Homo sapien
caaagatctgaatttgcgctctagt

SEQ ID NO: 37465 - DNA, 25 bp, Homo sapien
caaagatgaaaacagaattcctagt

SEQ ID NO: 37466 - DNA, 25 bp, Homo sapien
caaagatgaaaagagaattcctagt

SEQ ID NO: 37467 - DNA, 25 bp, Homo sapien
caaagatgaaatccataaaggtcag

SEQ ID NO: 37468 - DNA, 25 bp, Homo sapien
caaagatgaaatccatgaaggtcag

SEQ ID NO: 37469 - DNA, 25 bp, Homo sapien
caaagatgcgtcttttcctgctgct

SEQ ID NO: 37470 - DNA, 25 bp, Homo sapien
caaagatggatcggagagtcagggg

SEQ ID NO: 37471 - DNA, 25 bp, Homo sapien
caaagatggatctgagagtcagggg

SEQ ID NO: 37472 - DNA, 25 bp, Homo sapien
caaagatgtggcaacagtattcaag

SEQ ID NO: 37473 - DNA, 25 bp, Homo sapien
caaagatgtggcgacagtattcaag

SEQ ID NO: 37474 - DNA, 25 bp, Homo sapien
caaagatgtgtcttttcctgctgct

SEQ ID NO: 37475 - DNA, 25 bp, Homo sapien
caaagcaacaggattggatgagaga

SEQ ID NO: 37476 - DNA, 25 bp, Homo sapien
caaagcaacagggttggatgagaga

SEQ ID NO: 37477 - DNA, 25 bp, Homo sapien
caaagcaacgtatcaaaagctatgg

SEQ ID NO: 37478 - DNA, 25 bp, Homo sapien
caaagcaacgtatcgaaagctatgg

SEQ ID NO: 37479 - DNA, 25 bp, Homo sapien
caaagcaagacaaatgacctggaaa

SEQ ID NO: 37480 - DNA, 25 bp, Homo sapien
caaagcaagacaccctagtaaaatg

SEQ ID NO: 37481 - DNA, 25 bp, Homo sapien
caaagcaagacagatgacctggaaa

SEQ ID NO: 37482 - DNA, 25 bp, Homo sapien
caaagcaaggcaccctagtaaaatg

SEQ ID NO: 37483 - DNA, 25 bp, Homo sapien
caaagcaccgtaacttggggtattg

SEQ ID NO: 37484 - DNA, 25 bp, Homo sapien
caaagcaccgtatcttggggtattg

SEQ ID NO: 37485 - DNA, 25 bp, Homo sapien
caaagcataaagaaaaagtagcaca

SEQ ID NO: 37486 - DNA, 25 bp, Homo sapien
caaagcataaagaacaagtagcaca

SEQ ID NO: 37487 - DNA, 25 bp, Homo sapien
caaagccaacctgcacattagcatc

SEQ ID NO: 37488 - DNA, 25 bp, Homo sapien
caaagccaagataacaactctatca

SEQ ID NO: 37489 - DNA, 25 bp, Homo sapien
caaagccaagataacacctctatca

SEQ ID NO: 37490 - DNA, 25 bp, Homo sapien
caaagccaatctgcacattagcatc

SEQ ID NO: 37491 - DNA, 25 bp, Homo sapien
caaagccagctcatagacagtatct

SEQ ID NO: 37492 - DNA, 25 bp, Homo sapien
caaagccagctcgtagacagtatct

SEQ ID NO: 37493 - DNA, 25 bp, Homo sapien
caaagcgaactcaaaggaagaggct

SEQ ID NO: 37494 - DNA, 25 bp, Homo sapien
caaagcgaactcaagggaagaggct

SEQ ID NO: 37495 - DNA, 25 bp, Homo sapien
caaagctagaacaatgagcaacaaa

SEQ ID NO: 37496 - DNA, 25 bp, Homo sapien
caaagctagaacactgagcaacaaa

SEQ ID NO: 37497 - DNA, 25 bp, Homo sapien
caaagctcacaactccaaaaatgcc

SEQ ID NO: 37498 - DNA, 25 bp, Homo sapien
caaagctcagaactccaaaaatgcc

SEQ ID NO: 37499 - DNA, 25 bp, Homo sapien
caaagctgattggaacctttgaata

SEQ ID NO: 37500 - DNA, 25 bp, Homo sapien
caaagctgattgggacctttgaata

SEQ ID NO: 37501 - DNA, 25 bp, Homo sapien
caaagcttcacctctagggaatcta

SEQ ID NO: 37502 - DNA, 25 bp, Homo sapien
caaagcttcgcctctagggaatcta

SEQ ID NO: 37503 - DNA, 25 bp, Homo sapien
caaaggaacagagacagtcaaagaa

SEQ ID NO: 37504 - DNA, 25 bp, Homo sapien
caaaggaaccgagacagtcaaagaa

SEQ ID NO: 37505 - DNA, 25 bp, Homo sapien
caaaggacagtgaggccataaaatg

SEQ ID NO: 37506 - DNA, 25 bp, Homo sapien
caaaggacagtgtggccataaaatg

SEQ ID NO: 37507 - DNA, 25 bp, Homo sapien
caaaggacgatatttgggagtggaa

SEQ ID NO: 37508 - DNA, 25 bp, Homo sapien
caaaggacgatgtttgggagtggaa

SEQ ID NO: 37509 - DNA, 25 bp, Homo sapien
caaaggagaaaggtccttgatttag

SEQ ID NO: 37510 - DNA, 25 bp, Homo sapien
caaaggagataggtccttgatttag

SEQ ID NO: 37511 - DNA, 25 bp, Homo sapien
caaaggagcttcaatgaataaaact

SEQ ID NO: 37512 - DNA, 25 bp, Homo sapien
caaaggagcttcagtgaataaaact

SEQ ID NO: 37513 - DNA, 25 bp, Homo sapien
caaaggatcgagtggaaggagctga

SEQ ID NO: 37514 - DNA, 25 bp, Homo sapien
caaaggatggagaaaacagatctga

SEQ ID NO: 37515 - DNA, 25 bp, Homo sapien
caaaggatggagtggaaggagctga

SEQ ID NO: 37516 - DNA, 25 bp, Homo sapien
caaaggatggataaaacagatctga

SEQ ID NO: 37517 - DNA, 25 bp, Homo sapien
caaaggattcttgtcttcattatta

SEQ ID NO: 37518 - DNA, 25 bp, Homo sapien
caaaggattgttgtcttcattatta

SEQ ID NO: 37519 - DNA, 25 bp, Homo sapien
caaaggcaaactttagaaattgaga

SEQ ID NO: 37520 - DNA, 25 bp, Homo sapien
caaaggcagactttagaaattgaga

SEQ ID NO: 37521 - DNA, 25 bp, Homo sapien
caaaggcaggtggttctaaagaagg

SEQ ID NO: 37522 - DNA, 25 bp, Homo sapien
caaaggcagttggttctaaagaagg

SEQ ID NO: 37523 - DNA, 25 bp, Homo sapien
caaaggccagggcgatccaagctga

SEQ ID NO: 37524 - DNA, 25 bp, Homo sapien
caaaggccagggtgatccaagctga

SEQ ID NO: 37525 - DNA, 25 bp, Homo sapien
caaaggcgacataaggcactaggca

SEQ ID NO: 37526 - DNA, 25 bp, Homo sapien
caaaggcggcataaggcactaggca

SEQ ID NO: 37527 - DNA, 25 bp, Homo sapien
caaaggcgtaaagaggtgagaaagt

SEQ ID NO: 37528 - DNA, 25 bp, Homo sapien
caaaggcgtaaggaggtgagaaagt

SEQ ID NO: 37529 - DNA, 25 bp, Homo sapien
caaaggcttacctgactctttgaag

SEQ ID NO: 37530 - DNA, 25 bp, Homo sapien
caaaggcttacctggctctttgaag

SEQ ID NO: 37531 - DNA, 25 bp, Homo sapien
caaaggcttcaccggttttggtcac

SEQ ID NO: 37532 - DNA, 25 bp, Homo sapien
caaaggcttcatcggttttggtcac

SEQ ID NO: 37533 - DNA, 25 bp, Homo sapien
caaaggcttgcttgcagcttcccag

SEQ ID NO: 37534 - DNA, 25 bp, Homo sapien
caaaggcttgcttgtagcttcccag

SEQ ID NO: 37535 - DNA, 25 bp, Homo sapien
caaagggaaaatatgaagcagccac

SEQ ID NO: 37536 - DNA, 25 bp, Homo sapien
caaagggaaaatatgaggcagccac

SEQ ID NO: 37537 - DNA, 25 bp, Homo sapien
caaagggagaccgcgtttagtttga

SEQ ID NO: 37538 - DNA, 25 bp, Homo sapien
caaagggagacctcgtttagtttga

SEQ ID NO: 37539 - DNA, 25 bp, Homo sapien
caaagggatattaaccaagacccag

SEQ ID NO: 37540 - DNA, 25 bp, Homo sapien
caaagggatattaatcaagacccag

SEQ ID NO: 37541 - DNA, 25 bp, Homo sapien
caaagggcaagcttcaggatgttgt

SEQ ID NO: 37542 - DNA, 25 bp, Homo sapien
caaagggcacgcttcaggatgttgt

SEQ ID NO: 37543 - DNA, 25 bp, Homo sapien
caaagggctaacagtcaaaccatgg

SEQ ID NO: 37544 - DNA, 25 bp, Homo sapien
caaagggctaagagtcaaaccatgg

SEQ ID NO: 37545 - DNA, 25 bp, Homo sapien
caaaggtaaccaactatccgaactg

SEQ ID NO: 37546 - DNA, 25 bp, Homo sapien
caaaggtaaccagctatccgaactg

SEQ ID NO: 37547 - DNA, 25 bp, Homo sapien
caaaggtaagtcatttcaaattttc

SEQ ID NO: 37548 - DNA, 25 bp, Homo sapien
caaaggtaagtcattttaaattttc

SEQ ID NO: 37549 - DNA, 25 bp, Homo sapien
caaaggtacagaaagcagagttatt

SEQ ID NO: 37550 - DNA, 25 bp, Homo sapien
caaaggtacagaaggcagagttatt

SEQ ID NO: 37551 - DNA, 25 bp, Homo sapien
caaaggtagctttgccaactaagac

SEQ ID NO: 37552 - DNA, 25 bp, Homo sapien
caaaggtagctttgccgactaagac

SEQ ID NO: 37553 - DNA, 25 bp, Homo sapien
caaaggtgcaactgaagatcatcgt

SEQ ID NO: 37554 - DNA, 25 bp, Homo sapien
caaaggtgcaattgaagatcatcgt

SEQ ID NO: 37555 - DNA, 25 bp, Homo sapien
caaaggttctaaagtacgaaaagat

SEQ ID NO: 37556 - DNA, 25 bp, Homo sapien
caaaggttctaaggtacgaaaagat

SEQ ID NO: 37557 - DNA, 25 bp, Homo sapien
caaagtaaaacactgatatatcatt

SEQ ID NO: 37558 - DNA, 25 bp, Homo sapien
caaagtaaataaaatggaacactgt

SEQ ID NO: 37559 - DNA, 25 bp, Homo sapien
caaagtaaataaagtggaacactgt

SEQ ID NO: 37560 - DNA, 25 bp, Homo sapien
caaagtaatacactgatatatcatt

SEQ ID NO: 37561 - DNA, 25 bp, Homo sapien
caaagtagaatgagagatggcattg

SEQ ID NO: 37562 - DNA, 25 bp, Homo sapien
caaagtagaattagagatggcattg

SEQ ID NO: 37563 - DNA, 25 bp, Homo sapien
caaagtatccagctaattttggaca

SEQ ID NO: 37564 - DNA, 25 bp, Homo sapien
caaagtatgaagatagaaagcagca

SEQ ID NO: 37565 - DNA, 25 bp, Homo sapien
caaagtatgaaggtagaaagcagca

SEQ ID NO: 37566 - DNA, 25 bp, Homo sapien
caaagtattaatcctgcgtgtgtct

SEQ ID NO: 37567 - DNA, 25 bp, Homo sapien
caaagtattcagctaattttggaca

SEQ ID NO: 37568 - DNA, 25 bp, Homo sapien
caaagtattgatcctgcgtgtgtct

SEQ ID NO: 37569 - DNA, 25 bp, Homo sapien
caaagtcactcacggtctaaagaat

SEQ ID NO: 37570 - DNA, 25 bp, Homo sapien
caaagtcactcatggtctaaagaat

SEQ ID NO: 37571 - DNA, 25 bp, Homo sapien
caaagtccataacatttatctgaca

SEQ ID NO: 37572 - DNA, 25 bp, Homo sapien
caaagtccctaacatttatctgaca

SEQ ID NO: 37573 - DNA, 25 bp, Homo sapien
caaagtctaaaaaaaccctgaaatc

SEQ ID NO: 37574 - DNA, 25 bp, Homo sapien
caaagtctaaaaaacccctgaaatc

SEQ ID NO: 37575 - DNA, 25 bp, Homo sapien
caaagtctcttttaccacatgaaat

SEQ ID NO: 37576 - DNA, 25 bp, Homo sapien
caaagtctcttttaccgcatgaaat

SEQ ID NO: 37577 - DNA, 25 bp, Homo sapien
caaagtctgtgacctctgtgctttg

SEQ ID NO: 37578 - DNA, 25 bp, Homo sapien
caaagtctgtgatctctgtgctttg

SEQ ID NO: 37579 - DNA, 25 bp, Homo sapien
caaagtgaagagtaaatcagtgagg

SEQ ID NO: 37580 - DNA, 25 bp, Homo sapien
caaagtgaatagtaaatcagtgagg

SEQ ID NO: 37581 - DNA, 25 bp, Homo sapien
caaagtgacctcaaaatcaacccac

SEQ ID NO: 37582 - DNA, 25 bp, Homo sapien
caaagtgacctcagaatcaacccac

SEQ ID NO: 37583 - DNA, 25 bp, Homo sapien
caaagtggctaataattgagaatcc

SEQ ID NO: 37584 - DNA, 25 bp, Homo sapien
caaagtggctagtaattgagaatcc

SEQ ID NO: 37585 - DNA, 25 bp, Homo sapien
caaagtggtcctccatgatctccac

SEQ ID NO: 37586 - DNA, 25 bp, Homo sapien
caaagtggtcctccgtgatctccac

SEQ ID NO: 37587 - DNA, 25 bp, Homo sapien
caaagtgttgtgactatagttaaat

SEQ ID NO: 37588 - DNA, 25 bp, Homo sapien
caaagtgttgtgattatagttaaat

SEQ ID NO: 37589 - DNA, 25 bp, Homo sapien
caaagttatgtcctccaatctaaac

SEQ ID NO: 37590 - DNA, 25 bp, Homo sapien
caaagttatgttctccaatctaaac

SEQ ID NO: 37591 - DNA, 25 bp, Homo sapien
caaagttctctttgcgtggcatttc

SEQ ID NO: 37592 - DNA, 25 bp, Homo sapien
caaagttctctttgtgtggcatttc

SEQ ID NO: 37593 - DNA, 25 bp, Homo sapien
caaagtttcagcatcacttatctag

SEQ ID NO: 37594 - DNA, 25 bp, Homo sapien
caaagtttcgctaattaagtagcat

SEQ ID NO: 37595 - DNA, 25 bp, Homo sapien
caaagtttcggcatcacttatctag

SEQ ID NO: 37596 - DNA, 25 bp, Homo sapien
caaagttttcgtgcaaaatgtaacg

SEQ ID NO: 37597 - DNA, 25 bp, Homo sapien
caaagttttgcctgagctataggag

SEQ ID NO: 37598 - DNA, 25 bp, Homo sapien
caaagttttgctaattaagtagcat

SEQ ID NO: 37599 - DNA, 25 bp, Homo sapien
caaagttttgcttgagctataggag

SEQ ID NO: 37600 - DNA, 25 bp, Homo sapien
caaagtttttgtgcaaaatgtaacg

SEQ ID NO: 37601 - DNA, 25 bp, Homo sapien
caaataaaaatgtcaagagtatgtt

SEQ ID NO: 37602 - DNA, 25 bp, Homo sapien
caaataaaaatgtcgagagtatgtt

SEQ ID NO: 37603 - DNA, 25 bp, Homo sapien
caaataaaatataatctgtgtatga

SEQ ID NO: 37604 - DNA, 25 bp, Homo sapien
caaataaaatatgatctgtgtatga

SEQ ID NO: 37605 - DNA, 25 bp, Homo sapien
caaataaaatatttcaaaactcagc

SEQ ID NO: 37606 - DNA, 25 bp, Homo sapien
caaataaacaaacagtatgtcaggt

SEQ ID NO: 37607 - DNA, 25 bp, Homo sapien
caaataaacaaatacaagacatagg

SEQ ID NO: 37608 - DNA, 25 bp, Homo sapien
caaataaacaaatagtatgtcaggt

SEQ ID NO: 37609 - DNA, 25 bp, Homo sapien
caaataaacaactacaagacatagg

SEQ ID NO: 37610 - DNA, 25 bp, Homo sapien
caaataaagtatttcaaaactcagc

SEQ ID NO: 37611 - DNA, 25 bp, Homo sapien
caaataaagtcacaagatgcccagt

SEQ ID NO: 37612 - DNA, 25 bp, Homo sapien
caaataaagtcacaggatgcccagt

SEQ ID NO: 37613 - DNA, 25 bp, Homo sapien
caaataaatcaccaatgaatacaaa

SEQ ID NO: 37614 - DNA, 25 bp, Homo sapien
caaataaatcaccagtgaatacaaa

SEQ ID NO: 37615 - DNA, 25 bp, Homo sapien
caaataactacaatacacggacaca

SEQ ID NO: 37616 - DNA, 25 bp, Homo sapien
caaataactaccatacacggacaca

SEQ ID NO: 37617 - DNA, 25 bp, Homo sapien
caaataactgggatcgtgcatcacg

SEQ ID NO: 37618 - DNA, 25 bp, Homo sapien
caaataactgggattgtgcatcacg

SEQ ID NO: 37619 - DNA, 25 bp, Homo sapien
caaataagaaagaactttgagatgg

SEQ ID NO: 37620 - DNA, 25 bp, Homo sapien
caaataagaaaggactttgagatgg

SEQ ID NO: 37621 - DNA, 25 bp, Homo sapien
caaataagcaacggaaccagaattc

SEQ ID NO: 37622 - DNA, 25 bp, Homo sapien
caaataagcaatggaaccagaattc

SEQ ID NO: 37623 - DNA, 25 bp, Homo sapien
caaataataaaccataaatatgtga

SEQ ID NO: 37624 - DNA, 25 bp, Homo sapien
caaataataaatcataaatatgtga

SEQ ID NO: 37625 - DNA, 25 bp, Homo sapien
caaataatggatgacaaatgctgag

SEQ ID NO: 37626 - DNA, 25 bp, Homo sapien
caaataatggatggcaaatgctgag

SEQ ID NO: 37627 - DNA, 25 bp, Homo sapien
caaataattaagaacaccagcaaca

SEQ ID NO: 37628 - DNA, 25 bp, Homo sapien
caaataattaaggacaccagcaaca

SEQ ID NO: 37629 - DNA, 25 bp, Homo sapien
caaatacaaacagatggaaagctaa

SEQ ID NO: 37630 - DNA, 25 bp, Homo sapien
caaatacaataatgcgctcaggagt

SEQ ID NO: 37631 - DNA, 25 bp, Homo sapien
caaatacaataatgtgctcaggagt

SEQ ID NO: 37632 - DNA, 25 bp, Homo sapien
caaatacacacagatggaaagctaa

SEQ ID NO: 37633 - DNA, 25 bp, Homo sapien
caaatacctcaaatgtctatcagtc

SEQ ID NO: 37634 - DNA, 25 bp, Homo sapien
caaataccttaaatgtctatcagtc

SEQ ID NO: 37635 - DNA, 25 bp, Homo sapien
caaatacgaatccctccttgtcagc

SEQ ID NO: 37636 - DNA, 25 bp, Homo sapien
caaatacgaatctctccttgtcagc

SEQ ID NO: 37637 - DNA, 25 bp, Homo sapien
caaatacgacaacggctgaggaatg

SEQ ID NO: 37638 - DNA, 25 bp, Homo sapien
caaatacgacaatggctgaggaatg

SEQ ID NO: 37639 - DNA, 25 bp, Homo sapien
caaatactgagggcagggccttgtc

SEQ ID NO: 37640 - DNA, 25 bp, Homo sapien
caaatactgcgtttcatcccagcaa

SEQ ID NO: 37641 - DNA, 25 bp, Homo sapien
caaatactgtgtttcatcccagcaa

SEQ ID NO: 37642 - DNA, 25 bp, Homo sapien
caaatacttagggcagggccttgtc

SEQ ID NO: 37643 - DNA, 25 bp, Homo sapien
caaatacttccagatccttatggag

SEQ ID NO: 37644 - DNA, 25 bp, Homo sapien
caaatacttccaggtccttatggag

SEQ ID NO: 37645 - DNA, 25 bp, Homo sapien
caaatagcagcttaccaagaccaaa

SEQ ID NO: 37646 - DNA, 25 bp, Homo sapien
caaatagcagcttaccgagaccaaa

SEQ ID NO: 37647 - DNA, 25 bp, Homo sapien
caaatagctcccagtaaaatttaag

SEQ ID NO: 37648 - DNA, 25 bp, Homo sapien
caaatagctcccagtacaatttaag

SEQ ID NO: 37649 - DNA, 25 bp, Homo sapien
caaataggcgttctccctccttcct

SEQ ID NO: 37650 - DNA, 25 bp, Homo sapien
caaataggctgcaccgtactttgag

SEQ ID NO: 37651 - DNA, 25 bp, Homo sapien
caaataggctgcactgtactttgag

SEQ ID NO: 37652 - DNA, 25 bp, Homo sapien
caaataggctttctccctccttcct

SEQ ID NO: 37653 - DNA, 25 bp, Homo sapien
caaatagtcaaggaagaatcagcat

SEQ ID NO: 37654 - DNA, 25 bp, Homo sapien
caaatagtcaaggaggaatcagcat

SEQ ID NO: 37655 - DNA, 25 bp, Homo sapien
caaatataaacagctaatggggtta

SEQ ID NO: 37656 - DNA, 25 bp, Homo sapien
caaatataaacggctaatggggtta

SEQ ID NO: 37657 - DNA, 25 bp, Homo sapien
caaatatacaaacacaagcttttaa

SEQ ID NO: 37658 - DNA, 25 bp, Homo sapien
caaatatacaaatacaagcttttaa

SEQ ID NO: 37659 - DNA, 25 bp, Homo sapien
caaatatactcctcagtccatgaaa

SEQ ID NO: 37660 - DNA, 25 bp, Homo sapien
caaatatactcctgagtccatgaaa

SEQ ID NO: 37661 - DNA, 25 bp, Homo sapien
caaatatagcacattcgcaactcac

SEQ ID NO: 37662 - DNA, 25 bp, Homo sapien
caaatatagtacattcgcaactcac

SEQ ID NO: 37663 - DNA, 25 bp, Homo sapien
caaatatatatttctcttaacgacc

SEQ ID NO: 37664 - DNA, 25 bp, Homo sapien
caaatatatatttttcttaacgacc

SEQ ID NO: 37665 - DNA, 25 bp, Homo sapien
caaatatattaaacacagcaattaa

SEQ ID NO: 37666 - DNA, 25 bp, Homo sapien
caaatatattaaccacagcaattaa

SEQ ID NO: 37667 - DNA, 25 bp, Homo sapien
caaatatcacaggcagaagaattcc

SEQ ID NO: 37668 - DNA, 25 bp, Homo sapien
caaatatcacatgcagaagaattcc

SEQ ID NO: 37669 - DNA, 25 bp, Homo sapien
caaatatcagtggcttcatatacca

SEQ ID NO: 37670 - DNA, 25 bp, Homo sapien
caaatatcagtgtcttcatatacca

SEQ ID NO: 37671 - DNA, 25 bp, Homo sapien
caaatatcgtctagtgtaggttttg

SEQ ID NO: 37672 - DNA, 25 bp, Homo sapien
caaatatctaggtacggagacagcc

SEQ ID NO: 37673 - DNA, 25 bp, Homo sapien
caaatatctaggtatggagacagcc

SEQ ID NO: 37674 - DNA, 25 bp, Homo sapien
caaatatcttctagtgtaggttttg

SEQ ID NO: 37675 - DNA, 25 bp, Homo sapien
caaatatgataccgacaggctatta

SEQ ID NO: 37676 - DNA, 25 bp, Homo sapien
caaatatgatactgacaggctatta

SEQ ID NO: 37677 - DNA, 25 bp, Homo sapien
caaatatggttgatcctaaattgac

SEQ ID NO: 37678 - DNA, 25 bp, Homo sapien
caaatatggttgattctaaattgac

SEQ ID NO: 37679 - DNA, 25 bp, Homo sapien
caaatatgtgtagagctattatcct

SEQ ID NO: 37680 - DNA, 25 bp, Homo sapien
caaatatgtgtagatctattatcct

SEQ ID NO: 37681 - DNA, 25 bp, Homo sapien
caaatattcatttcatggacataag

SEQ ID NO: 37682 - DNA, 25 bp, Homo sapien
caaatattgatttcatggacataag

SEQ ID NO: 37683 - DNA, 25 bp, Homo sapien
caaatatttaaaaaaatctcagcaa

SEQ ID NO: 37684 - DNA, 25 bp, Homo sapien
caaatattttaaaaaatctcagcaa

SEQ ID NO: 37685 - DNA, 25 bp, Homo sapien
caaatcaaacggtttattcctagtt

SEQ ID NO: 37686 - DNA, 25 bp, Homo sapien
caaatcaaagtggaatccacaagcc

SEQ ID NO: 37687 - DNA, 25 bp, Homo sapien
caaatcaaagtggagtccacaagcc

SEQ ID NO: 37688 - DNA, 25 bp, Homo sapien
caaatcaaatggtttattcctagtt

SEQ ID NO: 37689 - DNA, 25 bp, Homo sapien
caaatcaattttcgatgctcatgga

SEQ ID NO: 37690 - DNA, 25 bp, Homo sapien
caaatcaatttttgatgctcatgga

SEQ ID NO: 37691 - DNA, 25 bp, Homo sapien
caaatcacagtatgcgatagtgcac

SEQ ID NO: 37692 - DNA, 25 bp, Homo sapien
caaatcacattaagagagctactat

SEQ ID NO: 37693 - DNA, 25 bp, Homo sapien
caaatcacattaatagagctactat

SEQ ID NO: 37694 - DNA, 25 bp, Homo sapien
caaatcacattatatacatgacaca

SEQ ID NO: 37695 - DNA, 25 bp, Homo sapien
caaatcacattatgtacatgacaca

SEQ ID NO: 37696 - DNA, 25 bp, Homo sapien
caaatcaccctttgcaaactaatag

SEQ ID NO: 37697 - DNA, 25 bp, Homo sapien
caaatcacccttttcaaactaatag

SEQ ID NO: 37698 - DNA, 25 bp, Homo sapien
caaatcacggtatgcgatagtgcac

SEQ ID NO: 37699 - DNA, 25 bp, Homo sapien
caaatcagcctgccaaggttccaat

SEQ ID NO: 37700 - DNA, 25 bp, Homo sapien
caaatcagcctgccaatgttccaat

SEQ ID NO: 37701 - DNA, 25 bp, Homo sapien
caaatcaggtaaggaatacaggtgt

SEQ ID NO: 37702 - DNA, 25 bp, Homo sapien
caaatcaggtaatgaatacaggtgt

SEQ ID NO: 37703 - DNA, 25 bp, Homo sapien
caaatcagtgccacagttgcaccaa

SEQ ID NO: 37704 - DNA, 25 bp, Homo sapien
caaatcagtgctacagttgcaccaa

SEQ ID NO: 37705 - DNA, 25 bp, Homo sapien
caaatcatgagttccttgagtgtga

SEQ ID NO: 37706 - DNA, 25 bp, Homo sapien
caaatcatgagtttcttgagtgtga

SEQ ID NO: 37707 - DNA, 25 bp, Homo sapien
caaatccaaataatccctgaataac

SEQ ID NO: 37708 - DNA, 25 bp, Homo sapien
caaatccaaataatccttgaataac

SEQ ID NO: 37709 - DNA, 25 bp, Homo sapien
caaatccaacagttcattaaaaagg

SEQ ID NO: 37710 - DNA, 25 bp, Homo sapien
caaatccaagagttcattaaaaagg

SEQ ID NO: 37711 - DNA, 25 bp, Homo sapien
caaatccaagtctttcctacttcaa

SEQ ID NO: 37712 - DNA, 25 bp, Homo sapien
caaatccaattatctgcttacaaga

SEQ ID NO: 37713 - DNA, 25 bp, Homo sapien
caaatccacattccacttaatatcc

SEQ ID NO: 37714 - DNA, 25 bp, Homo sapien
caaatccactttccacttaatatcc

SEQ ID NO: 37715 - DNA, 25 bp, Homo sapien
caaatccaggtctttcctacttcaa

SEQ ID NO: 37716 - DNA, 25 bp, Homo sapien
caaatccagttatctgcttacaaga

SEQ ID NO: 37717 - DNA, 25 bp, Homo sapien
caaatcccaatgtgatgctgaaatc

SEQ ID NO: 37718 - DNA, 25 bp, Homo sapien
caaatcccgatgtgatgctgaaatc

SEQ ID NO: 37719 - DNA, 25 bp, Homo sapien
caaatcctaacagcagaactttggg

SEQ ID NO: 37720 - DNA, 25 bp, Homo sapien
caaatcctagcagcagaactttggg

SEQ ID NO: 37721 - DNA, 25 bp, Homo sapien
caaatctaacacgataggcttgtat

SEQ ID NO: 37722 - DNA, 25 bp, Homo sapien
caaatctaacatgataggcttgtat

SEQ ID NO: 37723 - DNA, 25 bp, Homo sapien
caaatctaatccaatgcaagacact

SEQ ID NO: 37724 - DNA, 25 bp, Homo sapien
caaatctaatccagtgcaagacact

SEQ ID NO: 37725 - DNA, 25 bp, Homo sapien
caaatctcaaggagaataaattgat

SEQ ID NO: 37726 - DNA, 25 bp, Homo sapien
caaatctcaaggagtataaattgat

SEQ ID NO: 37727 - DNA, 25 bp, Homo sapien
caaatctcccgggcctacgcagcgc

SEQ ID NO: 37728 - DNA, 25 bp, Homo sapien
caaatctcccgggtctacgcagcgc

SEQ ID NO: 37729 - DNA, 25 bp, Homo sapien
caaatctgaatttaatccatatgag

SEQ ID NO: 37730 - DNA, 25 bp, Homo sapien
caaatctgaatttattccatatgag

SEQ ID NO: 37731 - DNA, 25 bp, Homo sapien
caaatctgcagataactttgtcaaa

SEQ ID NO: 37732 - DNA, 25 bp, Homo sapien
caaatctgtagataactttgtcaaa

SEQ ID NO: 37733 - DNA, 25 bp, Homo sapien
caaatctttctgcctaacctgtatt

SEQ ID NO: 37734 - DNA, 25 bp, Homo sapien
caaatctttctgtctaacctgtatt

SEQ ID NO: 37735 - DNA, 25 bp, Homo sapien
caaatgaaaagttaagcgattattt

SEQ ID NO: 37736 - DNA, 25 bp, Homo sapien
caaatgaaaagttaagtgattattt

SEQ ID NO: 37737 - DNA, 25 bp, Homo sapien
caaatgaacatctttacctttatgc

SEQ ID NO: 37738 - DNA, 25 bp, Homo sapien
caaatgaatatctttacctttatgc

SEQ ID NO: 37739 - DNA, 25 bp, Homo sapien
caaatgaatccaaaacaagactcaa

SEQ ID NO: 37740 - DNA, 25 bp, Homo sapien
caaatgaatccaaaactagactcaa

SEQ ID NO: 37741 - DNA, 25 bp, Homo sapien
caaatgacaatagtttaccttctcc

SEQ ID NO: 37742 - DNA, 25 bp, Homo sapien
caaatgacacattcattgagatagt

SEQ ID NO: 37743 - DNA, 25 bp, Homo sapien
caaatgacccattcattgagatagt

SEQ ID NO: 37744 - DNA, 25 bp, Homo sapien
caaatgaccggggaccaaccaccaa

SEQ ID NO: 37745 - DNA, 25 bp, Homo sapien
caaatgaccggtgaccaaccaccaa

SEQ ID NO: 37746 - DNA, 25 bp, Homo sapien
caaatgacgatagtttaccttctcc

SEQ ID NO: 37747 - DNA, 25 bp, Homo sapien
caaatgagccttttttccttcatcc

SEQ ID NO: 37748 - DNA, 25 bp, Homo sapien
caaatgagggaaccgaggtatagaa

SEQ ID NO: 37749 - DNA, 25 bp, Homo sapien
caaatgagggaactgaggtatagaa

SEQ ID NO: 37750 - DNA, 25 bp, Homo sapien
caaatgagtcttttttccttcatcc

SEQ ID NO: 37751 - DNA, 25 bp, Homo sapien
caaatgataatacaagctcataaaa

SEQ ID NO: 37752 - DNA, 25 bp, Homo sapien
caaatgataattcaagctcataaaa

SEQ ID NO: 37753 - DNA, 25 bp, Homo sapien
caaatgatacttatgactttaaaag

SEQ ID NO: 37754 - DNA, 25 bp, Homo sapien
caaatgatagttatgactttaaaag

SEQ ID NO: 37755 - DNA, 25 bp, Homo sapien
caaatgatcctgatcttatcttttc

SEQ ID NO: 37756 - DNA, 25 bp, Homo sapien
caaatgatcctggtcttatcttttc

SEQ ID NO: 37757 - DNA, 25 bp, Homo sapien
caaatgatgctatacgctttatata

SEQ ID NO: 37758 - DNA, 25 bp, Homo sapien
caaatgatgctatatgctttatata

SEQ ID NO: 37759 - DNA, 25 bp, Homo sapien
caaatgcaaaagtcccacatgtcct

SEQ ID NO: 37760 - DNA, 25 bp, Homo sapien
caaatgcaaaagtcccgcatgtcct

SEQ ID NO: 37761 - DNA, 25 bp, Homo sapien
caaatgcacctctcgaatcctggaa

SEQ ID NO: 37762 - DNA, 25 bp, Homo sapien
caaatgcagtatatccaaagtttaa

SEQ ID NO: 37763 - DNA, 25 bp, Homo sapien
caaatgcagtatatccgaagtttaa

SEQ ID NO: 37764 - DNA, 25 bp, Homo sapien
caaatgcatctctcgaatcctggaa

SEQ ID NO: 37765 - DNA, 25 bp, Homo sapien
caaatgcatttaagcagatgtcaag

SEQ ID NO: 37766 - DNA, 25 bp, Homo sapien
caaatgcatttaaggagatgtcaag

SEQ ID NO: 37767 - DNA, 25 bp, Homo sapien
caaatgctcgtaagaatatgacaac

SEQ ID NO: 37768 - DNA, 25 bp, Homo sapien
caaatgcttaaagtttcaaatgctt

SEQ ID NO: 37769 - DNA, 25 bp, Homo sapien
caaatgcttcctggaggctggtatt

SEQ ID NO: 37770 - DNA, 25 bp, Homo sapien
caaatgcttcctggagtctggtatt

SEQ ID NO: 37771 - DNA, 25 bp, Homo sapien
caaatgcttgaagtttcaaatgctt

SEQ ID NO: 37772 - DNA, 25 bp, Homo sapien
caaatgcttgtaagaatatgacaac

SEQ ID NO: 37773 - DNA, 25 bp, Homo sapien
caaatggaccaaggaaaacaaacgt

SEQ ID NO: 37774 - DNA, 25 bp, Homo sapien
caaatggaccagggaaaacaaacgt

SEQ ID NO: 37775 - DNA, 25 bp, Homo sapien
caaatggcatgcccacttagtaatg

SEQ ID NO: 37776 - DNA, 25 bp, Homo sapien
caaatggcatgccctcttagtaatg

SEQ ID NO: 37777 - DNA, 25 bp, Homo sapien
caaatggccaggccaggattcaaac

SEQ ID NO: 37778 - DNA, 25 bp, Homo sapien
caaatggccatctggaccagacaga

SEQ ID NO: 37779 - DNA, 25 bp, Homo sapien
caaatggccgggccaggattcaaac

SEQ ID NO: 37780 - DNA, 25 bp, Homo sapien
caaatggccgtctggaccagacaga

SEQ ID NO: 37781 - DNA, 25 bp, Homo sapien
caaatggctcacggttggagtctgt

SEQ ID NO: 37782 - DNA, 25 bp, Homo sapien
caaatggctcatggttggagtctgt

SEQ ID NO: 37783 - DNA, 25 bp, Homo sapien
caaatggcttagttgatccctttga

SEQ ID NO: 37784 - DNA, 25 bp, Homo sapien
caaatggcttatttgatccctttga

SEQ ID NO: 37785 - DNA, 25 bp, Homo sapien
caaatggttgaacttctttttcctc

SEQ ID NO: 37786 - DNA, 25 bp, Homo sapien
caaatggttgaatttctttttcctc

SEQ ID NO: 37787 - DNA, 25 bp, Homo sapien
caaatgtaaatagtgaaacaccatt

SEQ ID NO: 37788 - DNA, 25 bp, Homo sapien
caaatgtaaatattgaaacaccatt

SEQ ID NO: 37789 - DNA, 25 bp, Homo sapien
caaatgtacagttgagtagtgttaa

SEQ ID NO: 37790 - DNA, 25 bp, Homo sapien
caaatgtacagtttagtagtgttaa

SEQ ID NO: 37791 - DNA, 25 bp, Homo sapien
caaatgtagagccagtaaaacatta

SEQ ID NO: 37792 - DNA, 25 bp, Homo sapien
caaatgtagagccagtgaaacatta

SEQ ID NO: 37793 - DNA, 25 bp, Homo sapien
caaatgtcaataatcagttggaaat

SEQ ID NO: 37794 - DNA, 25 bp, Homo sapien
caaatgtcagtaatcagttggaaat

SEQ ID NO: 37795 - DNA, 25 bp, Homo sapien
caaatgtcttcttgctttgggaaat

SEQ ID NO: 37796 - DNA, 25 bp, Homo sapien
caaatgtcttcttgttttgggaaat

SEQ ID NO: 37797 - DNA, 25 bp, Homo sapien
caaatgtgtttccactaactccatg

SEQ ID NO: 37798 - DNA, 25 bp, Homo sapien
caaatgtgtttccgctaactccatg

SEQ ID NO: 37799 - DNA, 25 bp, Homo sapien
caaatgttcaaagcgcttgcaacct

SEQ ID NO: 37800 - DNA, 25 bp, Homo sapien
caaatgttcaacgcgcttgcaacct

SEQ ID NO: 37801 - DNA, 25 bp, Homo sapien
caaattaaacctctgacttcccttg

SEQ ID NO: 37802 - DNA, 25 bp, Homo sapien
caaattaaatctctgacttcccttg

SEQ ID NO: 37803 - DNA, 25 bp, Homo sapien
caaattaaattgcatgttcttggag

SEQ ID NO: 37804 - DNA, 25 bp, Homo sapien
caaattaaattgcttgttcttggag

SEQ ID NO: 37805 - DNA, 25 bp, Homo sapien
caaattaacataccaacaagtcaaa

SEQ ID NO: 37806 - DNA, 25 bp, Homo sapien
caaattaacatgccaacaagtcaaa

SEQ ID NO: 37807 - DNA, 25 bp, Homo sapien
caaattacacgaagagtgtttatta

SEQ ID NO: 37808 - DNA, 25 bp, Homo sapien
caaattacatgaagagtgtttatta

SEQ ID NO: 37809 - DNA, 25 bp, Homo sapien
caaattagttaactccaaattttct

SEQ ID NO: 37810 - DNA, 25 bp, Homo sapien
caaattagttatctccaaattttct

SEQ ID NO: 37811 - DNA, 25 bp, Homo sapien
caaattatatactcaacgttcaaca

SEQ ID NO: 37812 - DNA, 25 bp, Homo sapien
caaattatatactcaatgttcaaca

SEQ ID NO: 37813 - DNA, 25 bp, Homo sapien
caaattattcgtcattggcagagcg

SEQ ID NO: 37814 - DNA, 25 bp, Homo sapien
caaattatttgtcattggcagagcg

SEQ ID NO: 37815 - DNA, 25 bp, Homo sapien
caaattcaacacaagttttagagag

SEQ ID NO: 37816 - DNA, 25 bp, Homo sapien
caaattcaacagaagttttagagag

SEQ ID NO: 37817 - DNA, 25 bp, Homo sapien
caaattcacatgcaaggatggctct

SEQ ID NO: 37818 - DNA, 25 bp, Homo sapien
caaattcacatgcagggatggctct

SEQ ID NO: 37819 - DNA, 25 bp, Homo sapien
caaattcagaggataaattaatctc

SEQ ID NO: 37820 - DNA, 25 bp, Homo sapien
caaattcagaggatgaattaatctc

SEQ ID NO: 37821 - DNA, 25 bp, Homo sapien
caaattcctgcttttcatgcatctt

SEQ ID NO: 37822 - DNA, 25 bp, Homo sapien
caaattcctgcttttcgtgcatctt

SEQ ID NO: 37823 - DNA, 25 bp, Homo sapien
caaattctatgaaactcaaaagtgc

SEQ ID NO: 37824 - DNA, 25 bp, Homo sapien
caaattctatggaactcaaaagtgc

SEQ ID NO: 37825 - DNA, 25 bp, Homo sapien
caaattctgacaatgcaagttcaaa

SEQ ID NO: 37826 - DNA, 25 bp, Homo sapien
caaattctgacagtgcaagttcaaa

SEQ ID NO: 37827 - DNA, 25 bp, Homo sapien
caaattgaatgatatattttcacat

SEQ ID NO: 37828 - DNA, 25 bp, Homo sapien
caaattgaatgatgtattttcacat

SEQ ID NO: 37829 - DNA, 25 bp, Homo sapien
caaattgccatctgaaaaactaaaa

SEQ ID NO: 37830 - DNA, 25 bp, Homo sapien
caaattgccatcttaaaaactaaaa

SEQ ID NO: 37831 - DNA, 25 bp, Homo sapien
caaattgccatgtctttgaaaagtc

SEQ ID NO: 37832 - DNA, 25 bp, Homo sapien
caaattgcccagggaaggtattttg

SEQ ID NO: 37833 - DNA, 25 bp, Homo sapien
caaattgccgtgtctttgaaaagtc

SEQ ID NO: 37834 - DNA, 25 bp, Homo sapien
caaattgctcagggaaggtattttg

SEQ ID NO: 37835 - DNA, 25 bp, Homo sapien
caaattgctgagaaaacaagtaagt

SEQ ID NO: 37836 - DNA, 25 bp, Homo sapien
caaattgctgagaaaataagtaagt

SEQ ID NO: 37837 - DNA, 25 bp, Homo sapien
caaattggttgtcttatttcatcta

SEQ ID NO: 37838 - DNA, 25 bp, Homo sapien
caaattggttgttttatttcatcta

SEQ ID NO: 37839 - DNA, 25 bp, Homo sapien
caaattgtacaactatccatgcaaa

SEQ ID NO: 37840 - DNA, 25 bp, Homo sapien
caaattgtacaagtatccatgcaaa

SEQ ID NO: 37841 - DNA, 25 bp, Homo sapien
caaattgtacaataattcccagtgt

SEQ ID NO: 37842 - DNA, 25 bp, Homo sapien
caaattgtacagtaattcccagtgt

SEQ ID NO: 37843 - DNA, 25 bp, Homo sapien
caaattgtggttcttgaattgtcta

SEQ ID NO: 37844 - DNA, 25 bp, Homo sapien
caaattgtggttgttgaattgtcta

SEQ ID NO: 37845 - DNA, 25 bp, Homo sapien
caaattgttaaattgcagctttcaa

SEQ ID NO: 37846 - DNA, 25 bp, Homo sapien
caaattgttaagttgcagctttcaa

SEQ ID NO: 37847 - DNA, 25 bp, Homo sapien
caaatttaagtattagttggcagct

SEQ ID NO: 37848 - DNA, 25 bp, Homo sapien
caaatttacgtattagttggcagct

SEQ ID NO: 37849 - DNA, 25 bp, Homo sapien
caaatttatgacccaaacttagtaa

SEQ ID NO: 37850 - DNA, 25 bp, Homo sapien
caaatttatgatccaaacttagtaa

SEQ ID NO: 37851 - DNA, 25 bp, Homo sapien
caaatttccatacatgtcaaacaaa

SEQ ID NO: 37852 - DNA, 25 bp, Homo sapien
caaatttccatacgtgtcaaacaaa

SEQ ID NO: 37853 - DNA, 25 bp, Homo sapien
caaatttctaggagagtagggagaa

SEQ ID NO: 37854 - DNA, 25 bp, Homo sapien
caaatttctaggagtgtagggagaa

SEQ ID NO: 37855 - DNA, 25 bp, Homo sapien
caaatttgctgatactttcttccgc

SEQ ID NO: 37856 - DNA, 25 bp, Homo sapien
caaatttgctgatattttcttccgc

SEQ ID NO: 37857 - DNA, 25 bp, Homo sapien
caaatttgtagacgtgaactgcatc

SEQ ID NO: 37858 - DNA, 25 bp, Homo sapien
caaatttgtagatgtgaactgcatc

SEQ ID NO: 37859 - DNA, 25 bp, Homo sapien
caaatttgtctaatgggaatctctc

SEQ ID NO: 37860 - DNA, 25 bp, Homo sapien
caaatttgtttaatgggaatctctc

SEQ ID NO: 37861 - DNA, 25 bp, Homo sapien
caaattttgcgaagataagaataac

SEQ ID NO: 37862 - DNA, 25 bp, Homo sapien
caaattttgtgaagataagaataac

SEQ ID NO: 37863 - DNA, 25 bp, Homo sapien
caaattttgtgtcacgtaaagtgct

SEQ ID NO: 37864 - DNA, 25 bp, Homo sapien
caaattttgtgtcatgtaaagtgct

SEQ ID NO: 37865 - DNA, 25 bp, Homo sapien
caacaaaaaagggctgcctttccat

SEQ ID NO: 37866 - DNA, 25 bp, Homo sapien
caacaaaaagaaatggcagtaccaa

SEQ ID NO: 37867 - DNA, 25 bp, Homo sapien
caacaaaaagagatggcagtaccaa

SEQ ID NO: 37868 - DNA, 25 bp, Homo sapien
caacaaaaaggggctgcctttccat

SEQ ID NO: 37869 - DNA, 25 bp, Homo sapien
caacaaaacacagtggctcagtagt

SEQ ID NO: 37870 - DNA, 25 bp, Homo sapien
caacaaaacacggtggctcagtagt

SEQ ID NO: 37871 - DNA, 25 bp, Homo sapien
caacaaaatactcgaaaattgcatt

SEQ ID NO: 37872 - DNA, 25 bp, Homo sapien
caacaaaatacttgaaaattgcatt

SEQ ID NO: 37873 - DNA, 25 bp, Homo sapien
caacaaaatgctacaaaacttaatc

SEQ ID NO: 37874 - DNA, 25 bp, Homo sapien
caacaaaatgctacgaaacttaatc

SEQ ID NO: 37875 - DNA, 25 bp, Homo sapien
caacaaagatgaaacaagaatgaaa

SEQ ID NO: 37876 - DNA, 25 bp, Homo sapien
caacaaagatgaagcaagaatgaaa

SEQ ID NO: 37877 - DNA, 25 bp, Homo sapien
caacaaaggagaagttctggctctg

SEQ ID NO: 37878 - DNA, 25 bp, Homo sapien
caacaaaggagaagttttggctctg

SEQ ID NO: 37879 - DNA, 25 bp, Homo sapien
caacaaaggttcagaaatgtcatcc

SEQ ID NO: 37880 - DNA, 25 bp, Homo sapien
caacaaagtttcagaaatgtcatcc

SEQ ID NO: 37881 - DNA, 25 bp, Homo sapien
caacaaagttttatctcggtgaact

SEQ ID NO: 37882 - DNA, 25 bp, Homo sapien
caacaaagttttatcttggtgaact

SEQ ID NO: 37883 - DNA, 25 bp, Homo sapien
caacaaataatttgatacgtaagac

SEQ ID NO: 37884 - DNA, 25 bp, Homo sapien
caacaaatagtttgatacgtaagac

SEQ ID NO: 37885 - DNA, 25 bp, Homo sapien
caacaaatcaaacggtttattccta

SEQ ID NO: 37886 - DNA, 25 bp, Homo sapien
caacaaatcaaatggtttattccta

SEQ ID NO: 37887 - DNA, 25 bp, Homo sapien
caacaaatcctatcaattttacctc

SEQ ID NO: 37888 - DNA, 25 bp, Homo sapien
caacaaatgctatcaattttacctc

SEQ ID NO: 37889 - DNA, 25 bp, Homo sapien
caacaacaaaaaagggctgcctttc

SEQ ID NO: 37890 - DNA, 25 bp, Homo sapien
caacaacaaaaaggggctgcctttc

SEQ ID NO: 37891 - DNA, 25 bp, Homo sapien
caacaacagtaggttaatactcaga

SEQ ID NO: 37892 - DNA, 25 bp, Homo sapien
caacaacagtaggttagtactcaga

SEQ ID NO: 37893 - DNA, 25 bp, Homo sapien
caacaacagtttattcaaaagttta

SEQ ID NO: 37894 - DNA, 25 bp, Homo sapien
caacaacagtttgttcaaaagttta

SEQ ID NO: 37895 - DNA, 25 bp, Homo sapien
caacaactccctagcaaaaggagcc

SEQ ID NO: 37896 - DNA, 25 bp, Homo sapien
caacaactccctagcagaaggagcc

SEQ ID NO: 37897 - DNA, 25 bp, Homo sapien
caacaactgagtattgctaacatac

SEQ ID NO: 37898 - DNA, 25 bp, Homo sapien
caacaactgagtattggtaacatac

SEQ ID NO: 37899 - DNA, 25 bp, Homo sapien
caacaagaaacattgtccatatagg

SEQ ID NO: 37900 - DNA, 25 bp, Homo sapien
caacaagaatcattgtccatatagg

SEQ ID NO: 37901 - DNA, 25 bp, Homo sapien
caacaagatacatatttactcaaca

SEQ ID NO: 37902 - DNA, 25 bp, Homo sapien
caacaagatacttatttactcaaca

SEQ ID NO: 37903 - DNA, 25 bp, Homo sapien
caacaagcatactttccagagatca

SEQ ID NO: 37904 - DNA, 25 bp, Homo sapien
caacaagcatattttccagagatca

SEQ ID NO: 37905 - DNA, 25 bp, Homo sapien
caacaagctttcacattgaatcagt

SEQ ID NO: 37906 - DNA, 25 bp, Homo sapien
caacaagctttgacattgaatcagt

SEQ ID NO: 37907 - DNA, 25 bp, Homo sapien
caacaataggatttactagaattag

SEQ ID NO: 37908 - DNA, 25 bp, Homo sapien
caacaataggatttcctagaattag

SEQ ID NO: 37909 - DNA, 25 bp, Homo sapien
caacaatcaaagaaagttcttgttg

SEQ ID NO: 37910 - DNA, 25 bp, Homo sapien
caacaatcagagaaagttcttgttg

SEQ ID NO: 37911 - DNA, 25 bp, Homo sapien
caacaatgaatctccacacaataaa

SEQ ID NO: 37912 - DNA, 25 bp, Homo sapien
caacaatgaatctctacacaataaa

SEQ ID NO: 37913 - DNA, 25 bp, Homo sapien
caacaatgggaagttaagaagaaag

SEQ ID NO: 37914 - DNA, 25 bp, Homo sapien
caacaatgggaggttaagaagaaag

SEQ ID NO: 37915 - DNA, 25 bp, Homo sapien
caacaatgttacataaaaggaatca

SEQ ID NO: 37916 - DNA, 25 bp, Homo sapien
caacaatgttacgtaaaaggaatca

SEQ ID NO: 37917 - DNA, 25 bp, Homo sapien
caacaattatcaagcgtcaaaaatt

SEQ ID NO: 37918 - DNA, 25 bp, Homo sapien
caacaattatcaagtgtcaaaaatt

SEQ ID NO: 37919 - DNA, 25 bp, Homo sapien
caacaattcatcaacgagcatttgt

SEQ ID NO: 37920 - DNA, 25 bp, Homo sapien
caacaattcgtcaacgagcatttgt

SEQ ID NO: 37921 - DNA, 25 bp, Homo sapien
caacaattgggaaacactcttgcca

SEQ ID NO: 37922 - DNA, 25 bp, Homo sapien
caacaattgggaaatactcttgcca

SEQ ID NO: 37923 - DNA, 25 bp, Homo sapien
caacaatttcacacgtatgatctca

SEQ ID NO: 37924 - DNA, 25 bp, Homo sapien
caacaatttcacatgtatgatctca

SEQ ID NO: 37925 - DNA, 25 bp, Homo sapien
caacaatttttaaatcagggtttca

SEQ ID NO: 37926 - DNA, 25 bp, Homo sapien
caacaattttttaatcagggtttca

SEQ ID NO: 37927 - DNA, 25 bp, Homo sapien
caacacaatacaaagagctgtattt

SEQ ID NO: 37928 - DNA, 25 bp, Homo sapien
caacacaataccaatgaaggaaaaa

SEQ ID NO: 37929 - DNA, 25 bp, Homo sapien
caacacaataccgatgaaggaaaaa

SEQ ID NO: 37930 - DNA, 25 bp, Homo sapien
caacacaatacgaagagctgtattt

SEQ ID NO: 37931 - DNA, 25 bp, Homo sapien
caacacacatagcaatttaagaaag

SEQ ID NO: 37932 - DNA, 25 bp, Homo sapien
caacacacgtagcaatttaagaaag

SEQ ID NO: 37933 - DNA, 25 bp, Homo sapien
caacacactctaatgaatcttgttc

SEQ ID NO: 37934 - DNA, 25 bp, Homo sapien
caacacactgtaatgaatcttgttc

SEQ ID NO: 37935 - DNA, 25 bp, Homo sapien
caacacaggattagcacataaaaag

SEQ ID NO: 37936 - DNA, 25 bp, Homo sapien
caacacagtaggtttcactatcacc

SEQ ID NO: 37937 - DNA, 25 bp, Homo sapien
caacacagtagttttcactatcacc

SEQ ID NO: 37938 - DNA, 25 bp, Homo sapien
caacacagtattagcacataaaaag

SEQ ID NO: 37939 - DNA, 25 bp, Homo sapien
caacacagtcctagagagaagaaag

SEQ ID NO: 37940 - DNA, 25 bp, Homo sapien
caacacagtcctagagggaagaaag

SEQ ID NO: 37941 - DNA, 25 bp, Homo sapien
caacacagtggaacctcatctctac

SEQ ID NO: 37942 - DNA, 25 bp, Homo sapien
caacacagtgggacctcatctctac

SEQ ID NO: 37943 - DNA, 25 bp, Homo sapien
caacacatatgaatacacaacagac

SEQ ID NO: 37944 - DNA, 25 bp, Homo sapien
caacacatatgactacacaacagac

SEQ ID NO: 37945 - DNA, 25 bp, Homo sapien
caacacattgattctctaacgctaa

SEQ ID NO: 37946 - DNA, 25 bp, Homo sapien
caacacatttattctctaacgctaa

SEQ ID NO: 37947 - DNA, 25 bp, Homo sapien
caacaccaaaagtgagccctaatgt

SEQ ID NO: 37948 - DNA, 25 bp, Homo sapien
caacaccaagagtgagccctaatgt

SEQ ID NO: 37949 - DNA, 25 bp, Homo sapien
caacaccacagttgatagtagtaca

SEQ ID NO: 37950 - DNA, 25 bp, Homo sapien
caacaccacagttgatggtagtaca

SEQ ID NO: 37951 - DNA, 25 bp, Homo sapien
caacacccaagtttagcagcagtac

SEQ ID NO: 37952 - DNA, 25 bp, Homo sapien
caacacccaggtttagcagcagtac

SEQ ID NO: 37953 - DNA, 25 bp, Homo sapien
caacacctctgtctgtgtgctcttc

SEQ ID NO: 37954 - DNA, 25 bp, Homo sapien
caacacctctgtttgtgtgctcttc

SEQ ID NO: 37955 - DNA, 25 bp, Homo sapien
caacacggataagcaaagaaatgct

SEQ ID NO: 37956 - DNA, 25 bp, Homo sapien
caacacgggtaagcaaagaaatgct

SEQ ID NO: 37957 - DNA, 25 bp, Homo sapien
caacactaaatgtcggtgaagatgt

SEQ ID NO: 37958 - DNA, 25 bp, Homo sapien
caacactaaatgttggtgaagatgt

SEQ ID NO: 37959 - DNA, 25 bp, Homo sapien
caacactatgccctttcactctttg

SEQ ID NO: 37960 - DNA, 25 bp, Homo sapien
caacactatgccttttcactctttg

SEQ ID NO: 37961 - DNA, 25 bp, Homo sapien
caacactatgtcctcaatatccaat

SEQ ID NO: 37962 - DNA, 25 bp, Homo sapien
caacactatgtcctcagtatccaat

SEQ ID NO: 37963 - DNA, 25 bp, Homo sapien
caacactgctcctcaggcgggtggt

SEQ ID NO: 37964 - DNA, 25 bp, Homo sapien
caacactgctcctcgggcgggtggt

SEQ ID NO: 37965 - DNA, 25 bp, Homo sapien
caacactggagtagggttgtcattc

SEQ ID NO: 37966 - DNA, 25 bp, Homo sapien
caacactgtactatgcgtctgcctc

SEQ ID NO: 37967 - DNA, 25 bp, Homo sapien
caacactgtactgtgcgtctgcctc

SEQ ID NO: 37968 - DNA, 25 bp, Homo sapien
caacactgtagtagggttgtcattc

SEQ ID NO: 37969 - DNA, 25 bp, Homo sapien
caacactgtgcccatttcatattat

SEQ ID NO: 37970 - DNA, 25 bp, Homo sapien
caacactgtgcctatttcatattat

SEQ ID NO: 37971 - DNA, 25 bp, Homo sapien
caacactttcccaatatccctggag

SEQ ID NO: 37972 - DNA, 25 bp, Homo sapien
caacactttcccgatatccctggag

SEQ ID NO: 37973 - DNA, 25 bp, Homo sapien
caacagaaacctattaagatccttt

SEQ ID NO: 37974 - DNA, 25 bp, Homo sapien
caacagaaatctattaagatccttt

SEQ ID NO: 37975 - DNA, 25 bp, Homo sapien
caacagaacttcgtttacaaaaaca

SEQ ID NO: 37976 - DNA, 25 bp, Homo sapien
caacagaatgcacggtcccaaacaa

SEQ ID NO: 37977 - DNA, 25 bp, Homo sapien
caacagaatgcatggtcccaaacaa

SEQ ID NO: 37978 - DNA, 25 bp, Homo sapien
caacagaatttcgtttacaaaaaca

SEQ ID NO: 37979 - DNA, 25 bp, Homo sapien
caacagacatttctgcaacaggcag

SEQ ID NO: 37980 - DNA, 25 bp, Homo sapien
caacagacttttctgcaacaggcag

SEQ ID NO: 37981 - DNA, 25 bp, Homo sapien
caacagagatgagaaataaatatta

SEQ ID NO: 37982 - DNA, 25 bp, Homo sapien
caacagagatgagtaataaatatta

SEQ ID NO: 37983 - DNA, 25 bp, Homo sapien
caacagagtataatgtttaaatgct

SEQ ID NO: 37984 - DNA, 25 bp, Homo sapien
caacagagtatagtgtttaaatgct

SEQ ID NO: 37985 - DNA, 25 bp, Homo sapien
caacagatcctcatgattttaccaa

SEQ ID NO: 37986 - DNA, 25 bp, Homo sapien
caacagatcctcgtgattttaccaa

SEQ ID NO: 37987 - DNA, 25 bp, Homo sapien
caacagattttcaaaagttttcatt

SEQ ID NO: 37988 - DNA, 25 bp, Homo sapien
caacagattttcagaagttttcatt

SEQ ID NO: 37989 - DNA, 25 bp, Homo sapien
caacagcaaattcaatgaaggaaat

SEQ ID NO: 37990 - DNA, 25 bp, Homo sapien
caacagcaaattcattgaaggaaat

SEQ ID NO: 37991 - DNA, 25 bp, Homo sapien
caacagctgcaatggataacagctt

SEQ ID NO: 37992 - DNA, 25 bp, Homo sapien
caacagctgcaatgtataacagctt

SEQ ID NO: 37993 - DNA, 25 bp, Homo sapien
caacaggaactctcaggaactctca

SEQ ID NO: 37994 - DNA, 25 bp, Homo sapien
caacaggaactgtcaggaactctca

SEQ ID NO: 37995 - DNA, 25 bp, Homo sapien
caacagggaccaccgggaagctcac

SEQ ID NO: 37996 - DNA, 25 bp, Homo sapien
caacagggaccactgggaagctcac

SEQ ID NO: 37997 - DNA, 25 bp, Homo sapien
caacagggactgcagaaagtctggg

SEQ ID NO: 37998 - DNA, 25 bp, Homo sapien
caacagggagcaactggccttctac

SEQ ID NO: 37999 - DNA, 25 bp, Homo sapien
caacagggagcaagtggccttctac

SEQ ID NO: 38000 - DNA, 25 bp, Homo sapien
caacaggggctgcagaaagtctggg

SEQ ID NO: 38001 - DNA, 25 bp, Homo sapien
caacagggttagaacaaagataata

SEQ ID NO: 38002 - DNA, 25 bp, Homo sapien
caacagggttagaacagagataata

SEQ ID NO: 38003 - DNA, 25 bp, Homo sapien
caacaggtgaattcataaacaaact

SEQ ID NO: 38004 - DNA, 25 bp, Homo sapien
caacaggtgaattcgtaaacaaact

SEQ ID NO: 38005 - DNA, 25 bp, Homo sapien
caacagtagccactagatatcagcc

SEQ ID NO: 38006 - DNA, 25 bp, Homo sapien
caacagtagccattagatatcagcc

SEQ ID NO: 38007 - DNA, 25 bp, Homo sapien
caacagtaggttaatactcagaatg

SEQ ID NO: 38008 - DNA, 25 bp, Homo sapien
caacagtaggttagtactcagaatg

SEQ ID NO: 38009 - DNA, 25 bp, Homo sapien
caacagtatcccgtgccttctggag

SEQ ID NO: 38010 - DNA, 25 bp, Homo sapien
caacagtatcccgtgctttctggag

SEQ ID NO: 38011 - DNA, 25 bp, Homo sapien
caacagtctctaatttttttatttt

SEQ ID NO: 38012 - DNA, 25 bp, Homo sapien
caacagtctctgatttttttatttt

SEQ ID NO: 38013 - DNA, 25 bp, Homo sapien
caacagtgacataaaacggaaatat

SEQ ID NO: 38014 - DNA, 25 bp, Homo sapien
caacagtgacataaaatggaaatat

SEQ ID NO: 38015 - DNA, 25 bp, Homo sapien
caacagttcatcgtgtttcaaatat

SEQ ID NO: 38016 - DNA, 25 bp, Homo sapien
caacagttcattgtgtttcaaatat

SEQ ID NO: 38017 - DNA, 25 bp, Homo sapien
caacagtttatgtgcaactcaacag

SEQ ID NO: 38018 - DNA, 25 bp, Homo sapien
caacagtttattcaaaagtttaata

SEQ ID NO: 38019 - DNA, 25 bp, Homo sapien
caacagtttgtgtgcaactcaacag

SEQ ID NO: 38020 - DNA, 25 bp, Homo sapien
caacagtttgttcaaaagtttaata

SEQ ID NO: 38021 - DNA, 25 bp, Homo sapien
caacataaccacagctgaattctta

SEQ ID NO: 38022 - DNA, 25 bp, Homo sapien
caacataaggacctgtcactatcat

SEQ ID NO: 38023 - DNA, 25 bp, Homo sapien
caacataaggacctttcactatcat

SEQ ID NO: 38024 - DNA, 25 bp, Homo sapien
caacataatcacagctgaattctta

SEQ ID NO: 38025 - DNA, 25 bp, Homo sapien
caacataatgcgtgaggcccagacc

SEQ ID NO: 38026 - DNA, 25 bp, Homo sapien
caacataatgcttgaggcccagacc

SEQ ID NO: 38027 - DNA, 25 bp, Homo sapien
caacataatttaccaactcaacatt

SEQ ID NO: 38028 - DNA, 25 bp, Homo sapien
caacataatttatcaactcaacatt

SEQ ID NO: 38029 - DNA, 25 bp, Homo sapien
caacatacaaatattaaaggaaccc

SEQ ID NO: 38030 - DNA, 25 bp, Homo sapien
caacatacactaaatgtaactggaa

SEQ ID NO: 38031 - DNA, 25 bp, Homo sapien
caacatacgaatattaaaggaaccc

SEQ ID NO: 38032 - DNA, 25 bp, Homo sapien
caacatacgctaaatgtaactggaa

SEQ ID NO: 38033 - DNA, 25 bp, Homo sapien
caacatagaaaaagataatcaaagt

SEQ ID NO: 38034 - DNA, 25 bp, Homo sapien
caacatagaaaaggataatcaaagt

SEQ ID NO: 38035 - DNA, 25 bp, Homo sapien
caacatagctataactctgggagtg

SEQ ID NO: 38036 - DNA, 25 bp, Homo sapien
caacatagctataattctgggagtg

SEQ ID NO: 38037 - DNA, 25 bp, Homo sapien
caacataggacaagagtagagaaac

SEQ ID NO: 38038 - DNA, 25 bp, Homo sapien
caacatagggcaagagtagagaaac

SEQ ID NO: 38039 - DNA, 25 bp, Homo sapien
caacatatagtaattaaggtaatag

SEQ ID NO: 38040 - DNA, 25 bp, Homo sapien
caacatatcacataattgtgcctag

SEQ ID NO: 38041 - DNA, 25 bp, Homo sapien
caacatatcccataattgtgcctag

SEQ ID NO: 38042 - DNA, 25 bp, Homo sapien
caacatatggtaattaaggtaatag

SEQ ID NO: 38043 - DNA, 25 bp, Homo sapien
caacatcactgattagtagagaaat

SEQ ID NO: 38044 - DNA, 25 bp, Homo sapien
caacatcattgattagtagagaaat

SEQ ID NO: 38045 - DNA, 25 bp, Homo sapien
caacatcattgcctgggttgcagtc

SEQ ID NO: 38046 - DNA, 25 bp, Homo sapien
caacatcattgcttgggttgcagtc

SEQ ID NO: 38047 - DNA, 25 bp, Homo sapien
caacatccaaacaggtgagcaaaag

SEQ ID NO: 38048 - DNA, 25 bp, Homo sapien
caacatccatacaggtgagcaaaag

SEQ ID NO: 38049 - DNA, 25 bp, Homo sapien
caacatctcattacatctgaattta

SEQ ID NO: 38050 - DNA, 25 bp, Homo sapien
caacatctcattgcatctgaattta

SEQ ID NO: 38051 - DNA, 25 bp, Homo sapien
caacatgaaaaaaaataatgcacat

SEQ ID NO: 38052 - DNA, 25 bp, Homo sapien
caacatgaaattcagtcaaggcagc

SEQ ID NO: 38053 - DNA, 25 bp, Homo sapien
caacatgaaattgagtcaaggcagc

SEQ ID NO: 38054 - DNA, 25 bp, Homo sapien
caacatgagaaaaaataatgcacat

SEQ ID NO: 38055 - DNA, 25 bp, Homo sapien
caacatgataaaagcttgcttattt

SEQ ID NO: 38056 - DNA, 25 bp, Homo sapien
caacatgataaaaggttgcttattt

SEQ ID NO: 38057 - DNA, 25 bp, Homo sapien
caacatgatttctttcaattgtatt

SEQ ID NO: 38058 - DNA, 25 bp, Homo sapien
caacatgatttctttccattgtatt

SEQ ID NO: 38059 - DNA, 25 bp, Homo sapien
caacatgctccttcctgattcctta

SEQ ID NO: 38060 - DNA, 25 bp, Homo sapien
caacatgctccttcttgattcctta

SEQ ID NO: 38061 - DNA, 25 bp, Homo sapien
caacatggttaagcatcagcattcc

SEQ ID NO: 38062 - DNA, 25 bp, Homo sapien
caacatggttaaggatcagcattcc

SEQ ID NO: 38063 - DNA, 25 bp, Homo sapien
caacattaaaatgcagccaatttct

SEQ ID NO: 38064 - DNA, 25 bp, Homo sapien
caacattaagatgcagccaatttct

SEQ ID NO: 38065 - DNA, 25 bp, Homo sapien
caacattgatcaccagagttaagga

SEQ ID NO: 38066 - DNA, 25 bp, Homo sapien
caacattgatcatcagagttaagga

SEQ ID NO: 38067 - DNA, 25 bp, Homo sapien
caacatttccatcagaatttgagta

SEQ ID NO: 38068 - DNA, 25 bp, Homo sapien
caacatttccatcggaatttgagta

SEQ ID NO: 38069 - DNA, 25 bp, Homo sapien
caacatttcccttcgggttccagcc

SEQ ID NO: 38070 - DNA, 25 bp, Homo sapien
caacatttccctttgggttccagcc

SEQ ID NO: 38071 - DNA, 25 bp, Homo sapien
caacatttgaacaatgatgaagtca

SEQ ID NO: 38072 - DNA, 25 bp, Homo sapien
caacatttggacaatgatgaagtca

SEQ ID NO: 38073 - DNA, 25 bp, Homo sapien
caacatttgtactcctctctaattg

SEQ ID NO: 38074 - DNA, 25 bp, Homo sapien
caacattttaacattccaaacatga

SEQ ID NO: 38075 - DNA, 25 bp, Homo sapien
caacattttaacattctaaacatga

SEQ ID NO: 38076 - DNA, 25 bp, Homo sapien
caacatttttactcctctctaattg

SEQ ID NO: 38077 - DNA, 25 bp, Homo sapien
caacatttttgtgaacttcccaaaa

SEQ ID NO: 38078 - DNA, 25 bp, Homo sapien
caacatttttgtggacttcccaaaa

SEQ ID NO: 38079 - DNA, 25 bp, Homo sapien
caaccaactcaaatttgctaatcca

SEQ ID NO: 38080 - DNA, 25 bp, Homo sapien
caaccaactcagatttgctaatcca

SEQ ID NO: 38081 - DNA, 25 bp, Homo sapien
caaccaattctatgaaaacaagcga

SEQ ID NO: 38082 - DNA, 25 bp, Homo sapien
caaccaattctgtgaaaacaagcga

SEQ ID NO: 38083 - DNA, 25 bp, Homo sapien
caaccacaaagcacacatgggcatt

SEQ ID NO: 38084 - DNA, 25 bp, Homo sapien
caaccacaaagcacacgtgggcatt

SEQ ID NO: 38085 - DNA, 25 bp, Homo sapien
caaccacaatgaaggaattattgtc

SEQ ID NO: 38086 - DNA, 25 bp, Homo sapien
caaccacagtgaaggaattattgtc

SEQ ID NO: 38087 - DNA, 25 bp, Homo sapien
caaccacatttaggaagcgtcacca

SEQ ID NO: 38088 - DNA, 25 bp, Homo sapien
caaccacatttgggaagcgtcacca

SEQ ID NO: 38089 - DNA, 25 bp, Homo sapien
caaccaccaccatctgggtgacact

SEQ ID NO: 38090 - DNA, 25 bp, Homo sapien
caaccaccgccatctgggtgacact

SEQ ID NO: 38091 - DNA, 25 bp, Homo sapien
caaccagacatcacaaaccagacac

SEQ ID NO: 38092 - DNA, 25 bp, Homo sapien
caaccagacatcgcaaaccagacac

SEQ ID NO: 38093 - DNA, 25 bp, Homo sapien
caaccagaccgttagaagtgttgaa

SEQ ID NO: 38094 - DNA, 25 bp, Homo sapien
caaccagactgttagaagtgttgaa

SEQ ID NO: 38095 - DNA, 25 bp, Homo sapien
caaccagacttcggaatagttggac

SEQ ID NO: 38096 - DNA, 25 bp, Homo sapien
caaccagactttggaatagttggac

SEQ ID NO: 38097 - DNA, 25 bp, Homo sapien
caaccatctgcaccattttacactc

SEQ ID NO: 38098 - DNA, 25 bp, Homo sapien
caaccatctgcatcattttacactc

SEQ ID NO: 38099 - DNA, 25 bp, Homo sapien
caaccatctttacatcctccaggcc

SEQ ID NO: 38100 - DNA, 25 bp, Homo sapien
caaccatctttacgtcctccaggcc

SEQ ID NO: 38101 - DNA, 25 bp, Homo sapien
caaccatgcaaaactggcactgatg

SEQ ID NO: 38102 - DNA, 25 bp, Homo sapien
caaccatgcaaaattggcactgatg

SEQ ID NO: 38103 - DNA, 25 bp, Homo sapien
caaccatgccatgtcggacttcaga

SEQ ID NO: 38104 - DNA, 25 bp, Homo sapien
caaccatgccatgttggacttcaga

SEQ ID NO: 38105 - DNA, 25 bp, Homo sapien
caaccatgctacaaatgtttattga

SEQ ID NO: 38106 - DNA, 25 bp, Homo sapien
caaccatgctacagatgtttattga

SEQ ID NO: 38107 - DNA, 25 bp, Homo sapien
caaccatttggaaattatgttttac

SEQ ID NO: 38108 - DNA, 25 bp, Homo sapien
caaccatttggaaattgtgttttac

SEQ ID NO: 38109 - DNA, 25 bp, Homo sapien
caaccatttttccttctttgctctt

SEQ ID NO: 38110 - DNA, 25 bp, Homo sapien
caaccattttttcttctttgctctt

SEQ ID NO: 38111 - DNA, 25 bp, Homo sapien
caacccaaggttacgcatctagcaa

SEQ ID NO: 38112 - DNA, 25 bp, Homo sapien
caacccaaggttactcatctagcaa

SEQ ID NO: 38113 - DNA, 25 bp, Homo sapien
caacccacaggactaaacttgccat

SEQ ID NO: 38114 - DNA, 25 bp, Homo sapien
caacccacaggcctaaacttgccat

SEQ ID NO: 38115 - DNA, 25 bp, Homo sapien
caacccaggtcttgcatctgccacc

SEQ ID NO: 38116 - DNA, 25 bp, Homo sapien
caacccaggtcttgtatctgccacc

SEQ ID NO: 38117 - DNA, 25 bp, Homo sapien
caacccatcaacaaatcctatcaat

SEQ ID NO: 38118 - DNA, 25 bp, Homo sapien
caacccatcaacaaatgctatcaat

SEQ ID NO: 38119 - DNA, 25 bp, Homo sapien
caaccccaaaagagtgatggcgtct

SEQ ID NO: 38120 - DNA, 25 bp, Homo sapien
caaccccaaaagattgatggcgtct

SEQ ID NO: 38121 - DNA, 25 bp, Homo sapien
caaccctagggtatagttcttgctc

SEQ ID NO: 38122 - DNA, 25 bp, Homo sapien
caaccctagggtatggttcttgctc

SEQ ID NO: 38123 - DNA, 25 bp, Homo sapien
caaccctgcagctaagtagtattag

SEQ ID NO: 38124 - DNA, 25 bp, Homo sapien
caaccctgcagctaggtagtattag

SEQ ID NO: 38125 - DNA, 25 bp, Homo sapien
caaccgattgaaattcaactctttt

SEQ ID NO: 38126 - DNA, 25 bp, Homo sapien
caaccgattgaagttcaactctttt

SEQ ID NO: 38127 - DNA, 25 bp, Homo sapien
caacctaatacagccacctgctaaa

SEQ ID NO: 38128 - DNA, 25 bp, Homo sapien
caacctaatacagccatctgctaaa

SEQ ID NO: 38129 - DNA, 25 bp, Homo sapien
caacctacattgagaagtacgcctc

SEQ ID NO: 38130 - DNA, 25 bp, Homo sapien
caacctacatttagaagtacgcctc

SEQ ID NO: 38131 - DNA, 25 bp, Homo sapien
caacctactatttttcccacataag

SEQ ID NO: 38132 - DNA, 25 bp, Homo sapien
caacctactatttttcgcacataag

SEQ ID NO: 38133 - DNA, 25 bp, Homo sapien
caacctcattaagaaggtggaacag

SEQ ID NO: 38134 - DNA, 25 bp, Homo sapien
caacctcattaagatggtggaacag

SEQ ID NO: 38135 - DNA, 25 bp, Homo sapien
caacctcattagcacgtcactaact

SEQ ID NO: 38136 - DNA, 25 bp, Homo sapien
caacctcattagcatgtcactaact

SEQ ID NO: 38137 - DNA, 25 bp, Homo sapien
caacctccaaccgctggattcaaac

SEQ ID NO: 38138 - DNA, 25 bp, Homo sapien
caacctccaactgctggattcaaac

SEQ ID NO: 38139 - DNA, 25 bp, Homo sapien
caacctcgacgtcctggccttaggt

SEQ ID NO: 38140 - DNA, 25 bp, Homo sapien
caacctcgacgtcttggccttaggt

SEQ ID NO: 38141 - DNA, 25 bp, Homo sapien
caacctgacgcctctgctttccttc

SEQ ID NO: 38142 - DNA, 25 bp, Homo sapien
caacctgacgcctgtgctttccttc

SEQ ID NO: 38143 - DNA, 25 bp, Homo sapien
caacctgggatactcgagtttggtg

SEQ ID NO: 38144 - DNA, 25 bp, Homo sapien
caacctgggatacttgagtttggtg

SEQ ID NO: 38145 - DNA, 25 bp, Homo sapien
caacctgtgtggcaatatgattagt

SEQ ID NO: 38146 - DNA, 25 bp, Homo sapien
caacctgtgtggcgatatgattagt

SEQ ID NO: 38147 - DNA, 25 bp, Homo sapien
caaccttaacatatgcaaataataa

SEQ ID NO: 38148 - DNA, 25 bp, Homo sapien
caaccttaacatgtgcaaataataa

SEQ ID NO: 38149 - DNA, 25 bp, Homo sapien
caaccttcctacagctaacctaggg

SEQ ID NO: 38150 - DNA, 25 bp, Homo sapien
caaccttcttacagctaacctaggg

SEQ ID NO: 38151 - DNA, 25 bp, Homo sapien
caaccttgataagaccccactactc

SEQ ID NO: 38152 - DNA, 25 bp, Homo sapien
caaccttgatcacatctgaaaaatc

SEQ ID NO: 38153 - DNA, 25 bp, Homo sapien
caaccttgatcatatctgaaaaatc

SEQ ID NO: 38154 - DNA, 25 bp, Homo sapien
caaccttggtaagaccccactactc

SEQ ID NO: 38155 - DNA, 25 bp, Homo sapien
caacctttcttacaatagaaccatc

SEQ ID NO: 38156 - DNA, 25 bp, Homo sapien
caacctttcttacagtagaaccatc

SEQ ID NO: 38157 - DNA, 25 bp, Homo sapien
caacgaacaatgtcaaataacaatg

SEQ ID NO: 38158 - DNA, 25 bp, Homo sapien
caacgaacaatgtcaagtaacaatg

SEQ ID NO: 38159 - DNA, 25 bp, Homo sapien
caacgaacatgcaccctttagctgc

SEQ ID NO: 38160 - DNA, 25 bp, Homo sapien
caacgaacatgcactctttagctgc

SEQ ID NO: 38161 - DNA, 25 bp, Homo sapien
caacgaacctactattttgacaggt

SEQ ID NO: 38162 - DNA, 25 bp, Homo sapien
caacgaacctactgttttgacaggt

SEQ ID NO: 38163 - DNA, 25 bp, Homo sapien
caacgaataaatagatggatctttg

SEQ ID NO: 38164 - DNA, 25 bp, Homo sapien
caacgaataaatggatggatctttg

SEQ ID NO: 38165 - DNA, 25 bp, Homo sapien
caacgatacggcagaagtatgcaca

SEQ ID NO: 38166 - DNA, 25 bp, Homo sapien
caacgatatggcagaagtatgcaca

SEQ ID NO: 38167 - DNA, 25 bp, Homo sapien
caacgattgttcgagacttacatgc

SEQ ID NO: 38168 - DNA, 25 bp, Homo sapien
caacgattgttcgagatttacatgc

SEQ ID NO: 38169 - DNA, 25 bp, Homo sapien
caacggactctccagacaactctca

SEQ ID NO: 38170 - DNA, 25 bp, Homo sapien
caacggactgtccagacaactctca

SEQ ID NO: 38171 - DNA, 25 bp, Homo sapien
caacggagtttgagacaaaagctag

SEQ ID NO: 38172 - DNA, 25 bp, Homo sapien
caacggagtttgggacaaaagctag

SEQ ID NO: 38173 - DNA, 25 bp, Homo sapien
caacgggaaggataacagtcatacc

SEQ ID NO: 38174 - DNA, 25 bp, Homo sapien
caacgggaatgataacagtcatacc

SEQ ID NO: 38175 - DNA, 25 bp, Homo sapien
caacgtatcaaaagctatgggatac

SEQ ID NO: 38176 - DNA, 25 bp, Homo sapien
caacgtatcgaaagctatgggatac

SEQ ID NO: 38177 - DNA, 25 bp, Homo sapien
caacgtggagactcagaagcaagcg

SEQ ID NO: 38178 - DNA, 25 bp, Homo sapien
caacgtggagactgagaagcaagcg

SEQ ID NO: 38179 - DNA, 25 bp, Homo sapien
caacgttattgggatgaccccttga

SEQ ID NO: 38180 - DNA, 25 bp, Homo sapien
caacgttattgggatgcccccttga

SEQ ID NO: 38181 - DNA, 25 bp, Homo sapien
caacgttttacgaacgtccagactt

SEQ ID NO: 38182 - DNA, 25 bp, Homo sapien
caacgttttacgaatgtccagactt

SEQ ID NO: 38183 - DNA, 25 bp, Homo sapien
caactaaaaaattacacgatttgtg

SEQ ID NO: 38184 - DNA, 25 bp, Homo sapien
caactaaaaaattacatgatttgtg

SEQ ID NO: 38185 - DNA, 25 bp, Homo sapien
caactaaactggcaaaatgtcttat

SEQ ID NO: 38186 - DNA, 25 bp, Homo sapien
caactaaactggcacaatgtcttat

SEQ ID NO: 38187 - DNA, 25 bp, Homo sapien
caactaatatcacaaagagatgttc

SEQ ID NO: 38188 - DNA, 25 bp, Homo sapien
caactaatatcacagagagatgttc

SEQ ID NO: 38189 - DNA, 25 bp, Homo sapien
caactaatatcaccatgagactcag

SEQ ID NO: 38190 - DNA, 25 bp, Homo sapien
caactaatgaaggccagaagccaat

SEQ ID NO: 38191 - DNA, 25 bp, Homo sapien
caactaatggaggccagaagccaat

SEQ ID NO: 38192 - DNA, 25 bp, Homo sapien
caactaatgtcaccatgagactcag

SEQ ID NO: 38193 - DNA, 25 bp, Homo sapien
caactacagggaaacctattctttt

SEQ ID NO: 38194 - DNA, 25 bp, Homo sapien
caactacatggaaacctattctttt

SEQ ID NO: 38195 - DNA, 25 bp, Homo sapien
caactaccaagcgaggcagagatga

SEQ ID NO: 38196 - DNA, 25 bp, Homo sapien
caactaccaagtgaggcagagatga

SEQ ID NO: 38197 - DNA, 25 bp, Homo sapien
caactacctgctatattcaagagac

SEQ ID NO: 38198 - DNA, 25 bp, Homo sapien
caactacctgctatcttcaagagac

SEQ ID NO: 38199 - DNA, 25 bp, Homo sapien
caactactacgggagtttcagatgt

SEQ ID NO: 38200 - DNA, 25 bp, Homo sapien
caactactatgggagtttcagatgt

SEQ ID NO: 38201 - DNA, 25 bp, Homo sapien
caactacttcaattgcctcctacct

SEQ ID NO: 38202 - DNA, 25 bp, Homo sapien
caactacttcagttgcctcctacct

SEQ ID NO: 38203 - DNA, 25 bp, Homo sapien
caactaggaggcaacggcgagggag

SEQ ID NO: 38204 - DNA, 25 bp, Homo sapien
caactaggaggcaatggcgagggag

SEQ ID NO: 38205 - DNA, 25 bp, Homo sapien
caactatcttgatcccctgaaaaaa

SEQ ID NO: 38206 - DNA, 25 bp, Homo sapien
caactatcttgatctcctgaaaaaa

SEQ ID NO: 38207 - DNA, 25 bp, Homo sapien
caactatgaacgatattgaggtgac

SEQ ID NO: 38208 - DNA, 25 bp, Homo sapien
caactatgaacgatgttgaggtgac

SEQ ID NO: 38209 - DNA, 25 bp, Homo sapien
caactatgatgcctcagcggtgacc

SEQ ID NO: 38210 - DNA, 25 bp, Homo sapien
caactatgatgcttcagcggtgacc

SEQ ID NO: 38211 - DNA, 25 bp, Homo sapien
caactatggctcacgactccacata

SEQ ID NO: 38212 - DNA, 25 bp, Homo sapien
caactatggctcgcgactccacata

SEQ ID NO: 38213 - DNA, 25 bp, Homo sapien
caactattatgtggagaagcaactg

SEQ ID NO: 38214 - DNA, 25 bp, Homo sapien
caactattatgtggaggagcaactg

SEQ ID NO: 38215 - DNA, 25 bp, Homo sapien
caactatttaagaaggctactttgc

SEQ ID NO: 38216 - DNA, 25 bp, Homo sapien
caactatttaagcaggctactttgc

SEQ ID NO: 38217 - DNA, 25 bp, Homo sapien
caactcaatgaaaccaaagtctttg

SEQ ID NO: 38218 - DNA, 25 bp, Homo sapien
caactcaatgaagccaaagtctttg

SEQ ID NO: 38219 - DNA, 25 bp, Homo sapien
caactcacccatggaaagttatgga

SEQ ID NO: 38220 - DNA, 25 bp, Homo sapien
caactcacccatgggaagttatgga

SEQ ID NO: 38221 - DNA, 25 bp, Homo sapien
caactcccatacagaaaaaaaaatc

SEQ ID NO: 38222 - DNA, 25 bp, Homo sapien
caactcccatatagaaaaaaaaatc

SEQ ID NO: 38223 - DNA, 25 bp, Homo sapien
caactccctagattatgttgaggat

SEQ ID NO: 38224 - DNA, 25 bp, Homo sapien
caactccctggattatgttgaggat

SEQ ID NO: 38225 - DNA, 25 bp, Homo sapien
caactctaccaaacaccaacttaca

SEQ ID NO: 38226 - DNA, 25 bp, Homo sapien
caactctaccaagcaccaacttaca

SEQ ID NO: 38227 - DNA, 25 bp, Homo sapien
caactctgaatttctgaaatcccat

SEQ ID NO: 38228 - DNA, 25 bp, Homo sapien
caactctgattttctgaaatcccat

SEQ ID NO: 38229 - DNA, 25 bp, Homo sapien
caactctttgacaccaggttatttc

SEQ ID NO: 38230 - DNA, 25 bp, Homo sapien
caactctttgacatcaggttatttc

SEQ ID NO: 38231 - DNA, 25 bp, Homo sapien
caactctttttcaattaaaacctga

SEQ ID NO: 38232 - DNA, 25 bp, Homo sapien
caactctttttcgattaaaacctga

SEQ ID NO: 38233 - DNA, 25 bp, Homo sapien
caactgaaatgatatgacctcggtg

SEQ ID NO: 38234 - DNA, 25 bp, Homo sapien
caactgaagtgatatgacctcggtg

SEQ ID NO: 38235 - DNA, 25 bp, Homo sapien
caactgacaatcatggcagaaggtg

SEQ ID NO: 38236 - DNA, 25 bp, Homo sapien
caactgacagtcatggcagaaggtg

SEQ ID NO: 38237 - DNA, 25 bp, Homo sapien
caactgagttctacatgagcctctc

SEQ ID NO: 38238 - DNA, 25 bp, Homo sapien
caactgagttcttcatgagcctctc

SEQ ID NO: 38239 - DNA, 25 bp, Homo sapien
caactgcaacaatctgacttgacaa

SEQ ID NO: 38240 - DNA, 25 bp, Homo sapien
caactgcaacaatttgacttgacaa

SEQ ID NO: 38241 - DNA, 25 bp, Homo sapien
caactgcacctatgccctgctagaa

SEQ ID NO: 38242 - DNA, 25 bp, Homo sapien
caactgcacttatgccctgctagaa

SEQ ID NO: 38243 - DNA, 25 bp, Homo sapien
caactgccctcagcacaaagtgtgt

SEQ ID NO: 38244 - DNA, 25 bp, Homo sapien
caactgccctcagcgcaaagtgtgt

SEQ ID NO: 38245 - DNA, 25 bp, Homo sapien
caactggctcatgactcatactagg

SEQ ID NO: 38246 - DNA, 25 bp, Homo sapien
caactggctcatggctcatactagg

SEQ ID NO: 38247 - DNA, 25 bp, Homo sapien
caactgggaaccacattaaggtata

SEQ ID NO: 38248 - DNA, 25 bp, Homo sapien
caactgggaaccacgttaaggtata

SEQ ID NO: 38249 - DNA, 25 bp, Homo sapien
caactgggaggttccgattttgttg

SEQ ID NO: 38250 - DNA, 25 bp, Homo sapien
caactgggaggttctgattttgttg

SEQ ID NO: 38251 - DNA, 25 bp, Homo sapien
caactgggccaaagttcatcaggta

SEQ ID NO: 38252 - DNA, 25 bp, Homo sapien
caactgggccaaggttcatcaggta

SEQ ID NO: 38253 - DNA, 25 bp, Homo sapien
caactggtgataccgtttgacctaa

SEQ ID NO: 38254 - DNA, 25 bp, Homo sapien
caactggtgatactgtttgacctaa

SEQ ID NO: 38255 - DNA, 25 bp, Homo sapien
caactggtttaggaaaagctactgg

SEQ ID NO: 38256 - DNA, 25 bp, Homo sapien
caactggtttatgaaaagctactgg

SEQ ID NO: 38257 - DNA, 25 bp, Homo sapien
caactgtaagctattattatatggt

SEQ ID NO: 38258 - DNA, 25 bp, Homo sapien
caactgtaagctcttattatatggt

SEQ ID NO: 38259 - DNA, 25 bp, Homo sapien
caactgtacgtcagaagtcccactt

SEQ ID NO: 38260 - DNA, 25 bp, Homo sapien
caactgtatgtcagaagtcccactt

SEQ ID NO: 38261 - DNA, 25 bp, Homo sapien
caactgtccacttcttcaatctcac

SEQ ID NO: 38262 - DNA, 25 bp, Homo sapien
caactgtccgcttcttcaatctcac

SEQ ID NO: 38263 - DNA, 25 bp, Homo sapien
caactgtgagcatggtcatggatcc

SEQ ID NO: 38264 - DNA, 25 bp, Homo sapien
caactgtgagcatggttatggatcc

SEQ ID NO: 38265 - DNA, 25 bp, Homo sapien
caactgtgcacaacgtgctgaatat

SEQ ID NO: 38266 - DNA, 25 bp, Homo sapien
caactgtgcgcaacgtgctgaatat

SEQ ID NO: 38267 - DNA, 25 bp, Homo sapien
caactgttcattacatgttactatg

SEQ ID NO: 38268 - DNA, 25 bp, Homo sapien
caactgttcatttcatgttactatg

SEQ ID NO: 38269 - DNA, 25 bp, Homo sapien
caactgttcttctctctggatcctg

SEQ ID NO: 38270 - DNA, 25 bp, Homo sapien
caactgttcttgtctctggatcctg

SEQ ID NO: 38271 - DNA, 25 bp, Homo sapien
caacttaatatccataagcaaaatc

SEQ ID NO: 38272 - DNA, 25 bp, Homo sapien
caacttaatatccgtaagcaaaatc

SEQ ID NO: 38273 - DNA, 25 bp, Homo sapien
caacttatacctatcatatagcaca

SEQ ID NO: 38274 - DNA, 25 bp, Homo sapien
caacttatacctgtcatatagcaca

SEQ ID NO: 38275 - DNA, 25 bp, Homo sapien
caacttatgtcaaagcgcagggtca

SEQ ID NO: 38276 - DNA, 25 bp, Homo sapien
caacttatgtcaaagctcagggtca

SEQ ID NO: 38277 - DNA, 25 bp, Homo sapien
caacttcctccacagtaactgaaca

SEQ ID NO: 38278 - DNA, 25 bp, Homo sapien
caacttcctccgcagtaactgaaca

SEQ ID NO: 38279 - DNA, 25 bp, Homo sapien
caacttgaggactgtaagtaacaca

SEQ ID NO: 38280 - DNA, 25 bp, Homo sapien
caacttgaggactttaagtaacaca

SEQ ID NO: 38281 - DNA, 25 bp, Homo sapien
caacttgatcaacgaaatattaaac

SEQ ID NO: 38282 - DNA, 25 bp, Homo sapien
caacttgatcaatgaaatattaaac

SEQ ID NO: 38283 - DNA, 25 bp, Homo sapien
caacttgctcaagaaggtggccaca

SEQ ID NO: 38284 - DNA, 25 bp, Homo sapien
caacttgctcatgaaggtggccaca

SEQ ID NO: 38285 - DNA, 25 bp, Homo sapien
caacttggagcctcgtgagtgctgg

SEQ ID NO: 38286 - DNA, 25 bp, Homo sapien
caacttggagccttgtgagtgctgg

SEQ ID NO: 38287 - DNA, 25 bp, Homo sapien
caacttggtacctccactgaattaa

SEQ ID NO: 38288 - DNA, 25 bp, Homo sapien
caacttggtacctccattgaattaa

SEQ ID NO: 38289 - DNA, 25 bp, Homo sapien
caacttgtttggctcttcctcaaca

SEQ ID NO: 38290 - DNA, 25 bp, Homo sapien
caacttgtttggttcttcctcaaca

SEQ ID NO: 38291 - DNA, 25 bp, Homo sapien
caactttatagttgtcatcagtagg

SEQ ID NO: 38292 - DNA, 25 bp, Homo sapien
caactttatagttgtcgtcagtagg

SEQ ID NO: 38293 - DNA, 25 bp, Homo sapien
caactttcctttttctcgtcacttg

SEQ ID NO: 38294 - DNA, 25 bp, Homo sapien
caactttcctttttcttgtcacttg

SEQ ID NO: 38295 - DNA, 25 bp, Homo sapien
caactttgagacctgggccactcgg

SEQ ID NO: 38296 - DNA, 25 bp, Homo sapien
caactttgagacttgggccactcgg

SEQ ID NO: 38297 - DNA, 25 bp, Homo sapien
caactttgcagactcaaataaatcc

SEQ ID NO: 38298 - DNA, 25 bp, Homo sapien
caactttgcagattcaaataaatcc

SEQ ID NO: 38299 - DNA, 25 bp, Homo sapien
caactttgcttcccctagagttttg

SEQ ID NO: 38300 - DNA, 25 bp, Homo sapien
caactttggttcccctagagttttg

SEQ ID NO: 38301 - DNA, 25 bp, Homo sapien
caacttttaactccaccctttctct

SEQ ID NO: 38302 - DNA, 25 bp, Homo sapien
caacttttcactccaccctttctct

SEQ ID NO: 38303 - DNA, 25 bp, Homo sapien
caacttttccacggactgaggttgg

SEQ ID NO: 38304 - DNA, 25 bp, Homo sapien
caacttttccatggactgaggttgg

SEQ ID NO: 38305 - DNA, 25 bp, Homo sapien
caactttttcttttagctcccacac

SEQ ID NO: 38306 - DNA, 25 bp, Homo sapien
caactttttcttttagttcccacac

SEQ ID NO: 38307 - DNA, 25 bp, Homo sapien
caagaaaaggagaatgtagcaatgc

SEQ ID NO: 38308 - DNA, 25 bp, Homo sapien
caagaaaatgagaatgtagcaatgc

SEQ ID NO: 38309 - DNA, 25 bp, Homo sapien
caagaaaattgagtctgaattaatt

SEQ ID NO: 38310 - DNA, 25 bp, Homo sapien
caagaaaattgagtttgaattaatt

SEQ ID NO: 38311 - DNA, 25 bp, Homo sapien
caagaaagcacccaaaaactaatgg

SEQ ID NO: 38312 - DNA, 25 bp, Homo sapien
caagaaagcactcaaaaactaatgg

SEQ ID NO: 38313 - DNA, 25 bp, Homo sapien
caagaaaggaaacaattatcagtac

SEQ ID NO: 38314 - DNA, 25 bp, Homo sapien
caagaaaggaaacagttatcagtac

SEQ ID NO: 38315 - DNA, 25 bp, Homo sapien
caagaaaggcctggggcaagaagac

SEQ ID NO: 38316 - DNA, 25 bp, Homo sapien
caagaaaggtctggggcaagaagac

SEQ ID NO: 38317 - DNA, 25 bp, Homo sapien
caagaaataagctgcaaatatatac

SEQ ID NO: 38318 - DNA, 25 bp, Homo sapien
caagaaataatcatctgtgtactaa

SEQ ID NO: 38319 - DNA, 25 bp, Homo sapien
caagaaataatcgtctgtgtactaa

SEQ ID NO: 38320 - DNA, 25 bp, Homo sapien
caagaaatatacatccatcatctat

SEQ ID NO: 38321 - DNA, 25 bp, Homo sapien
caagaaatatatatccatcatctat

SEQ ID NO: 38322 - DNA, 25 bp, Homo sapien
caagaaatatgctgcaaatatatac

SEQ ID NO: 38323 - DNA, 25 bp, Homo sapien
caagaaatgcctccatagagtcctt

SEQ ID NO: 38324 - DNA, 25 bp, Homo sapien
caagaaatgccttcatagagtcctt

SEQ ID NO: 38325 - DNA, 25 bp, Homo sapien
caagaaattctggccagcatcagga

SEQ ID NO: 38326 - DNA, 25 bp, Homo sapien
caagaaattctgggcagcatcagga

SEQ ID NO: 38327 - DNA, 25 bp, Homo sapien
caagaacaattagtggcatgagccc

SEQ ID NO: 38328 - DNA, 25 bp, Homo sapien
caagaacaattcgtggcatgagccc

SEQ ID NO: 38329 - DNA, 25 bp, Homo sapien
caagaacacgcttccttgtagctcc

SEQ ID NO: 38330 - DNA, 25 bp, Homo sapien
caagaacacttgtcatcacccgctt

SEQ ID NO: 38331 - DNA, 25 bp, Homo sapien
caagaacatcaatgcagaatgacta

SEQ ID NO: 38332 - DNA, 25 bp, Homo sapien
caagaacatcagtgcagaatgacta

SEQ ID NO: 38333 - DNA, 25 bp, Homo sapien
caagaacatgcttccttgtagctcc

SEQ ID NO: 38334 - DNA, 25 bp, Homo sapien
caagaacatttgtcatcacccgctt

SEQ ID NO: 38335 - DNA, 25 bp, Homo sapien
caagaaccagtgaaaacataaacag

SEQ ID NO: 38336 - DNA, 25 bp, Homo sapien
caagaaccagtgagaacataaacag

SEQ ID NO: 38337 - DNA, 25 bp, Homo sapien
caagaactacagagacagagttgtt

SEQ ID NO: 38338 - DNA, 25 bp, Homo sapien
caagaactacgtggagacaaaagtg

SEQ ID NO: 38339 - DNA, 25 bp, Homo sapien
caagaactacgtggtgacaaaagtg

SEQ ID NO: 38340 - DNA, 25 bp, Homo sapien
caagaactactgtattttctgcgta

SEQ ID NO: 38341 - DNA, 25 bp, Homo sapien
caagaactattgtattttctgcgta

SEQ ID NO: 38342 - DNA, 25 bp, Homo sapien
caagaactccagagacagagttgtt

SEQ ID NO: 38343 - DNA, 25 bp, Homo sapien
caagaactgcaaaaaacagtcaatt

SEQ ID NO: 38344 - DNA, 25 bp, Homo sapien
caagaactgcaagaaacagtcaatt

SEQ ID NO: 38345 - DNA, 25 bp, Homo sapien
caagaacttacacgacaattttcag

SEQ ID NO: 38346 - DNA, 25 bp, Homo sapien
caagaacttacatgacaattttcag

SEQ ID NO: 38347 - DNA, 25 bp, Homo sapien
caagaagaaaataaaagttggcatt

SEQ ID NO: 38348 - DNA, 25 bp, Homo sapien
caagaagaaaatacaagttggcatt

SEQ ID NO: 38349 - DNA, 25 bp, Homo sapien
caagaagacgctaaaaggatagtag

SEQ ID NO: 38350 - DNA, 25 bp, Homo sapien
caagaagagtctcacactttctttc

SEQ ID NO: 38351 - DNA, 25 bp, Homo sapien
caagaagagtctcacattttctttc

SEQ ID NO: 38352 - DNA, 25 bp, Homo sapien
caagaagatgctaaaaggatagtag

SEQ ID NO: 38353 - DNA, 25 bp, Homo sapien
caagaagattaaactgatcggccaa

SEQ ID NO: 38354 - DNA, 25 bp, Homo sapien
caagaagattaagctgatcggccaa

SEQ ID NO: 38355 - DNA, 25 bp, Homo sapien
caagaagcagtaaattactttttcc

SEQ ID NO: 38356 - DNA, 25 bp, Homo sapien
caagaagcattaaattactttttcc

SEQ ID NO: 38357 - DNA, 25 bp, Homo sapien
caagaagccaagaaatgttactcaa

SEQ ID NO: 38358 - DNA, 25 bp, Homo sapien
caagaagcccagcgccagggtagga

SEQ ID NO: 38359 - DNA, 25 bp, Homo sapien
caagaagcccagtgccagggtagga

SEQ ID NO: 38360 - DNA, 25 bp, Homo sapien
caagaagccgagaaatgttactcaa

SEQ ID NO: 38361 - DNA, 25 bp, Homo sapien
caagaaggatgttttcattttcagt

SEQ ID NO: 38362 - DNA, 25 bp, Homo sapien
caagaaggatgttttcgttttcagt

SEQ ID NO: 38363 - DNA, 25 bp, Homo sapien
caagaaggcaaaacagatgagagca

SEQ ID NO: 38364 - DNA, 25 bp, Homo sapien
caagaaggcaaaagagatgagagca

SEQ ID NO: 38365 - DNA, 25 bp, Homo sapien
caagaataaccccataaacaagcaa

SEQ ID NO: 38366 - DNA, 25 bp, Homo sapien
caagaataatcccataaacaagcaa

SEQ ID NO: 38367 - DNA, 25 bp, Homo sapien
caagaatacaatacagtacttagga

SEQ ID NO: 38368 - DNA, 25 bp, Homo sapien
caagaatacgatacagtacttagga

SEQ ID NO: 38369 - DNA, 25 bp, Homo sapien
caagaatagacccattgcttcaaat

SEQ ID NO: 38370 - DNA, 25 bp, Homo sapien
caagaatagacccgttgcttcaaat

SEQ ID NO: 38371 - DNA, 25 bp, Homo sapien
caagaatcctcacatggctgtaaaa

SEQ ID NO: 38372 - DNA, 25 bp, Homo sapien
caagaatcctcacctggctgtaaaa

SEQ ID NO: 38373 - DNA, 25 bp, Homo sapien
caagaatcctcatacaaattgtcca

SEQ ID NO: 38374 - DNA, 25 bp, Homo sapien
caagaatcctcgtacaaattgtcca

SEQ ID NO: 38375 - DNA, 25 bp, Homo sapien
caagaatgaaaagtcaagtgctgaa

SEQ ID NO: 38376 - DNA, 25 bp, Homo sapien
caagaatgaaaagtcaggtgctgaa

SEQ ID NO: 38377 - DNA, 25 bp, Homo sapien
caagaatggatatataactttgact

SEQ ID NO: 38378 - DNA, 25 bp, Homo sapien
caagaatggatatgtaactttgact

SEQ ID NO: 38379 - DNA, 25 bp, Homo sapien
caagacaaaaagcgttactagaaat

SEQ ID NO: 38380 - DNA, 25 bp, Homo sapien
caagacaaaaagtgttactagaaat

SEQ ID NO: 38381 - DNA, 25 bp, Homo sapien
caagacagaaacaaagcaaaagtat

SEQ ID NO: 38382 - DNA, 25 bp, Homo sapien
caagacagaaacaaaggaaaagtat

SEQ ID NO: 38383 - DNA, 25 bp, Homo sapien
caagaccacaacaggaacatagcca

SEQ ID NO: 38384 - DNA, 25 bp, Homo sapien
caagaccacaacgggaacatagcca

SEQ ID NO: 38385 - DNA, 25 bp, Homo sapien
caagaccgaactggaacgggctttt

SEQ ID NO: 38386 - DNA, 25 bp, Homo sapien
caagaccgaactggaatgggctttt

SEQ ID NO: 38387 - DNA, 25 bp, Homo sapien
caagacctcaactgcttcattcacc

SEQ ID NO: 38388 - DNA, 25 bp, Homo sapien
caagaccttaactgcttcattcacc

SEQ ID NO: 38389 - DNA, 25 bp, Homo sapien
caagactctcttctcttttatagat

SEQ ID NO: 38390 - DNA, 25 bp, Homo sapien
caagactctcttctgttttatagat

SEQ ID NO: 38391 - DNA, 25 bp, Homo sapien
caagactgaaatttgaactcagggt

SEQ ID NO: 38392 - DNA, 25 bp, Homo sapien
caagactggaatttgaactcagggt

SEQ ID NO: 38393 - DNA, 25 bp, Homo sapien
caagactgggagctctttggaaaca

SEQ ID NO: 38394 - DNA, 25 bp, Homo sapien
caagactgggagctttttggaaaca

SEQ ID NO: 38395 - DNA, 25 bp, Homo sapien
caagactgggggcgcaaagagcttc

SEQ ID NO: 38396 - DNA, 25 bp, Homo sapien
caagactgggggtgcaaagagcttc

SEQ ID NO: 38397 - DNA, 25 bp, Homo sapien
caagacttacgcctgggataccttt

SEQ ID NO: 38398 - DNA, 25 bp, Homo sapien
caagacttacgccttggataccttt

SEQ ID NO: 38399 - DNA, 25 bp, Homo sapien
caagacttgctcaacttagacatgc

SEQ ID NO: 38400 - DNA, 25 bp, Homo sapien
caagacttgctcaccttagacatgc

SEQ ID NO: 38401 - DNA, 25 bp, Homo sapien
caagagaaatgcaaggagagtcgga

SEQ ID NO: 38402 - DNA, 25 bp, Homo sapien
caagagaaatgccaggagagtcgga

SEQ ID NO: 38403 - DNA, 25 bp, Homo sapien
caagagaacttaacggttttccaga

SEQ ID NO: 38404 - DNA, 25 bp, Homo sapien
caagagaacttaatggttttccaga

SEQ ID NO: 38405 - DNA, 25 bp, Homo sapien
caagagaagcctgtaaatccgttat

SEQ ID NO: 38406 - DNA, 25 bp, Homo sapien
caagagaaggctgtaaatccgttat

SEQ ID NO: 38407 - DNA, 25 bp, Homo sapien
caagagaataggcctgagtcttgct

SEQ ID NO: 38408 - DNA, 25 bp, Homo sapien
caagagaataggtctgagtcttgct

SEQ ID NO: 38409 - DNA, 25 bp, Homo sapien
caagagaatttgttggctcatataa

SEQ ID NO: 38410 - DNA, 25 bp, Homo sapien
caagagaatttgttggttcatataa

SEQ ID NO: 38411 - DNA, 25 bp, Homo sapien
caagagacaaggaatatcatgaaca

SEQ ID NO: 38412 - DNA, 25 bp, Homo sapien
caagagaccaggaatatcatgaaca

SEQ ID NO: 38413 - DNA, 25 bp, Homo sapien
caagagagaccaaaactcactgaac

SEQ ID NO: 38414 - DNA, 25 bp, Homo sapien
caagagagaccaacactcactgaac

SEQ ID NO: 38415 - DNA, 25 bp, Homo sapien
caagagaggaaggccgatgggaagg

SEQ ID NO: 38416 - DNA, 25 bp, Homo sapien
caagagaggaaggtcgatgggaagg

SEQ ID NO: 38417 - DNA, 25 bp, Homo sapien
caagagcaagttgtttagttttcat

SEQ ID NO: 38418 - DNA, 25 bp, Homo sapien
caagagcaagttgtttggttttcat

SEQ ID NO: 38419 - DNA, 25 bp, Homo sapien
caagagcatcttctgtacaattaac

SEQ ID NO: 38420 - DNA, 25 bp, Homo sapien
caagagcatcttttgtacaattaac

SEQ ID NO: 38421 - DNA, 25 bp, Homo sapien
caagagcatggaatcaagaaaaggg

SEQ ID NO: 38422 - DNA, 25 bp, Homo sapien
caagagcatggactcaagaaaaggg

SEQ ID NO: 38423 - DNA, 25 bp, Homo sapien
caagagccatggaggactctggtgt

SEQ ID NO: 38424 - DNA, 25 bp, Homo sapien
caagagccctattcatatgtggcct

SEQ ID NO: 38425 - DNA, 25 bp, Homo sapien
caagagccctattcatgtgtggcct

SEQ ID NO: 38426 - DNA, 25 bp, Homo sapien
caagagccgtggaggactctggtgt

SEQ ID NO: 38427 - DNA, 25 bp, Homo sapien
caagaggaacgcataaataggtccc

SEQ ID NO: 38428 - DNA, 25 bp, Homo sapien
caagaggaatgcataaataggtccc

SEQ ID NO: 38429 - DNA, 25 bp, Homo sapien
caagaggacatagtaggtacacaat

SEQ ID NO: 38430 - DNA, 25 bp, Homo sapien
caagaggacatggtaggtacacaat

SEQ ID NO: 38431 - DNA, 25 bp, Homo sapien
caagaggcaagagacaacctgaagg

SEQ ID NO: 38432 - DNA, 25 bp, Homo sapien
caagaggcaagagataacctgaagg

SEQ ID NO: 38433 - DNA, 25 bp, Homo sapien
caagaggcaggcacagacgttagta

SEQ ID NO: 38434 - DNA, 25 bp, Homo sapien
caagaggcaggtacagacgttagta

SEQ ID NO: 38435 - DNA, 25 bp, Homo sapien
caagaggctgagccacagaggaatg

SEQ ID NO: 38436 - DNA, 25 bp, Homo sapien
caagaggctgagtcacagaggaatg

SEQ ID NO: 38437 - DNA, 25 bp, Homo sapien
caagagtacaaagttctccatgaac

SEQ ID NO: 38438 - DNA, 25 bp, Homo sapien
caagagtaccaagttctccatgaac

SEQ ID NO: 38439 - DNA, 25 bp, Homo sapien
caagagtcaactatagatcttttaa

SEQ ID NO: 38440 - DNA, 25 bp, Homo sapien
caagagtcgactatagatcttttaa

SEQ ID NO: 38441 - DNA, 25 bp, Homo sapien
caagagtgatatcttacgaggtttt

SEQ ID NO: 38442 - DNA, 25 bp, Homo sapien
caagagtgatatcttatgaggtttt

SEQ ID NO: 38443 - DNA, 25 bp, Homo sapien
caagagtgctcttgtttcacactca

SEQ ID NO: 38444 - DNA, 25 bp, Homo sapien
caagagtggtcttgtttcacactca

SEQ ID NO: 38445 - DNA, 25 bp, Homo sapien
caagagtgttctcaacatatttaaa

SEQ ID NO: 38446 - DNA, 25 bp, Homo sapien
caagagtgttctctacatatttaaa

SEQ ID NO: 38447 - DNA, 25 bp, Homo sapien
caagagttaagtgtctctgacccag

SEQ ID NO: 38448 - DNA, 25 bp, Homo sapien
caagagttatgtgtctctgacccag

SEQ ID NO: 38449 - DNA, 25 bp, Homo sapien
caagagttcacacaagtattaagtg

SEQ ID NO: 38450 - DNA, 25 bp, Homo sapien
caagagttcacgcaagtattaagtg

SEQ ID NO: 38451 - DNA, 25 bp, Homo sapien
caagataagaccagccctactttat

SEQ ID NO: 38452 - DNA, 25 bp, Homo sapien
caagataagacgagccctactttat

SEQ ID NO: 38453 - DNA, 25 bp, Homo sapien
caagataattcaatgaaagaaagaa

SEQ ID NO: 38454 - DNA, 25 bp, Homo sapien
caagataattcaatgagagaaagaa

SEQ ID NO: 38455 - DNA, 25 bp, Homo sapien
caagatagcctacaggacccaaaag

SEQ ID NO: 38456 - DNA, 25 bp, Homo sapien
caagatagcctacgggacccaaaag

SEQ ID NO: 38457 - DNA, 25 bp, Homo sapien
caagatagctctacttgaccttcat

SEQ ID NO: 38458 - DNA, 25 bp, Homo sapien
caagatagctctgcttgaccttcat

SEQ ID NO: 38459 - DNA, 25 bp, Homo sapien
caagatagtagacataaaacaactt

SEQ ID NO: 38460 - DNA, 25 bp, Homo sapien
caagatagtagtcataaaacaactt

SEQ ID NO: 38461 - DNA, 25 bp, Homo sapien
caagatataattgcacaaacatgta

SEQ ID NO: 38462 - DNA, 25 bp, Homo sapien
caagatataatttcacaaacatgta

SEQ ID NO: 38463 - DNA, 25 bp, Homo sapien
caagatatactcatttgcctagtac

SEQ ID NO: 38464 - DNA, 25 bp, Homo sapien
caagatatcacacgatcaagtgctg

SEQ ID NO: 38465 - DNA, 25 bp, Homo sapien
caagatatcacatgatcaagtgctg

SEQ ID NO: 38466 - DNA, 25 bp, Homo sapien
caagatattctcatttgcctagtac

SEQ ID NO: 38467 - DNA, 25 bp, Homo sapien
caagatcctcaacagtccttatcca

SEQ ID NO: 38468 - DNA, 25 bp, Homo sapien
caagatcctcaacagttcttatcca

SEQ ID NO: 38469 - DNA, 25 bp, Homo sapien
caagatctgtgaccaaaccaggcca

SEQ ID NO: 38470 - DNA, 25 bp, Homo sapien
caagatctgtgactaaaccaggcca

SEQ ID NO: 38471 - DNA, 25 bp, Homo sapien
caagatgaggatacaaagcagagca

SEQ ID NO: 38472 - DNA, 25 bp, Homo sapien
caagatgaggatacgaagcagagca

SEQ ID NO: 38473 - DNA, 25 bp, Homo sapien
caagatgagggtgaatagaaatgaa

SEQ ID NO: 38474 - DNA, 25 bp, Homo sapien
caagatgagggtgaatggaaatgaa

SEQ ID NO: 38475 - DNA, 25 bp, Homo sapien
caagatgatgtttatatttccatgt

SEQ ID NO: 38476 - DNA, 25 bp, Homo sapien
caagatgatgtttgtatttccatgt

SEQ ID NO: 38477 - DNA, 25 bp, Homo sapien
caagatgcctatgtacgtggtatag

SEQ ID NO: 38478 - DNA, 25 bp, Homo sapien
caagatgcctatgtgcgtggtatag

SEQ ID NO: 38479 - DNA, 25 bp, Homo sapien
caagatggacttttcccgagaggct

SEQ ID NO: 38480 - DNA, 25 bp, Homo sapien
caagatggacttttcctgagaggct

SEQ ID NO: 38481 - DNA, 25 bp, Homo sapien
caagatggttatatagcagggctca

SEQ ID NO: 38482 - DNA, 25 bp, Homo sapien
caagatggttatattgcagggctca

SEQ ID NO: 38483 - DNA, 25 bp, Homo sapien
caagatgtctgcacctgccctgagc

SEQ ID NO: 38484 - DNA, 25 bp, Homo sapien
caagatgtctggacctgccctgagc

SEQ ID NO: 38485 - DNA, 25 bp, Homo sapien
caagatgtggcacaatgggaattaa

SEQ ID NO: 38486 - DNA, 25 bp, Homo sapien
caagatgtggcataatgggaattaa

SEQ ID NO: 38487 - DNA, 25 bp, Homo sapien
caagattaatatgcaaaaatcaatt

SEQ ID NO: 38488 - DNA, 25 bp, Homo sapien
caagattaggcatctgcatttggtg

SEQ ID NO: 38489 - DNA, 25 bp, Homo sapien
caagattaggcttctgcatttggtg

SEQ ID NO: 38490 - DNA, 25 bp, Homo sapien
caagattagtatgcaaaaatcaatt

SEQ ID NO: 38491 - DNA, 25 bp, Homo sapien
caagattcaactaatgaaggccaga

SEQ ID NO: 38492 - DNA, 25 bp, Homo sapien
caagattcaactaatggaggccaga

SEQ ID NO: 38493 - DNA, 25 bp, Homo sapien
caagattgaaatacgaagacatgga

SEQ ID NO: 38494 - DNA, 25 bp, Homo sapien
caagattgaaatatgaagacatgga

SEQ ID NO: 38495 - DNA, 25 bp, Homo sapien
caagattgatggctttattttctaa

SEQ ID NO: 38496 - DNA, 25 bp, Homo sapien
caagattgatggttttattttctaa

SEQ ID NO: 38497 - DNA, 25 bp, Homo sapien
caagatttaaactacaccatgatgc

SEQ ID NO: 38498 - DNA, 25 bp, Homo sapien
caagatttaaactataccatgatgc

SEQ ID NO: 38499 - DNA, 25 bp, Homo sapien
caagatttgaaaagaaattgtggaa

SEQ ID NO: 38500 - DNA, 25 bp, Homo sapien
caagatttgaaaggaaattgtggaa

SEQ ID NO: 38501 - DNA, 25 bp, Homo sapien
caagcaaaataacattgagtagaca

SEQ ID NO: 38502 - DNA, 25 bp, Homo sapien
caagcaaaatagcattgagtagaca

SEQ ID NO: 38503 - DNA, 25 bp, Homo sapien
caagcaaagcctcaagacatttgcc

SEQ ID NO: 38504 - DNA, 25 bp, Homo sapien
caagcaaagcctcaggacatttgcc

SEQ ID NO: 38505 - DNA, 25 bp, Homo sapien
caagcaagctctcgtattccaggca

SEQ ID NO: 38506 - DNA, 25 bp, Homo sapien
caagcaagctcttgtattccaggca

SEQ ID NO: 38507 - DNA, 25 bp, Homo sapien
caagcaagtaaattattctttctgt

SEQ ID NO: 38508 - DNA, 25 bp, Homo sapien
caagcaagtaacttattctttctgt

SEQ ID NO: 38509 - DNA, 25 bp, Homo sapien
caagcacaagtcactgttgtaagca

SEQ ID NO: 38510 - DNA, 25 bp, Homo sapien
caagcacaattcactgttgtaagca

SEQ ID NO: 38511 - DNA, 25 bp, Homo sapien
caagcaccatgtgttctcactttta

SEQ ID NO: 38512 - DNA, 25 bp, Homo sapien
caagcaccgtgtgttctcactttta

SEQ ID NO: 38513 - DNA, 25 bp, Homo sapien
caagcacttaacaaaattcaacatt

SEQ ID NO: 38514 - DNA, 25 bp, Homo sapien
caagcacttaataaaattcaacatt

SEQ ID NO: 38515 - DNA, 25 bp, Homo sapien
caagcacttccccttggtgtcaaac

SEQ ID NO: 38516 - DNA, 25 bp, Homo sapien
caagcacttgtaaagaaacacaagg

SEQ ID NO: 38517 - DNA, 25 bp, Homo sapien
caagcacttgtaaggaaacacaagg

SEQ ID NO: 38518 - DNA, 25 bp, Homo sapien
caagcactttcccttggtgtcaaac

SEQ ID NO: 38519 - DNA, 25 bp, Homo sapien
caagcagagtatgcgataagagata

SEQ ID NO: 38520 - DNA, 25 bp, Homo sapien
caagcagagtatgtgataagagata

SEQ ID NO: 38521 - DNA, 25 bp, Homo sapien
caagcagattttaaaatttatgtgg

SEQ ID NO: 38522 - DNA, 25 bp, Homo sapien
caagcagatttttaaatttatgtgg

SEQ ID NO: 38523 - DNA, 25 bp, Homo sapien
caagcagtcttcctgcaatggtgct

SEQ ID NO: 38524 - DNA, 25 bp, Homo sapien
caagcagtctttctgcaatggtgct

SEQ ID NO: 38525 - DNA, 25 bp, Homo sapien
caagcatagaccaaaaatgtggaga

SEQ ID NO: 38526 - DNA, 25 bp, Homo sapien
caagcataggccaaaaatgtggaga

SEQ ID NO: 38527 - DNA, 25 bp, Homo sapien
caagcatcaaagtattaataagaac

SEQ ID NO: 38528 - DNA, 25 bp, Homo sapien
caagcatcaaagtgttaataagaac

SEQ ID NO: 38529 - DNA, 25 bp, Homo sapien
caagcatcacaaacatctaagtttc

SEQ ID NO: 38530 - DNA, 25 bp, Homo sapien
caagcatcacaaacatttaagtttc

SEQ ID NO: 38531 - DNA, 25 bp, Homo sapien
caagcatgctgaacatggaaaccac

SEQ ID NO: 38532 - DNA, 25 bp, Homo sapien
caagcatgctgaacttggaaaccac

SEQ ID NO: 38533 - DNA, 25 bp, Homo sapien
caagcattatcacctgcgctccgcc

SEQ ID NO: 38534 - DNA, 25 bp, Homo sapien
caagcattatcacctgtgctccgcc

SEQ ID NO: 38535 - DNA, 25 bp, Homo sapien
caagccaattcacacggcaaaacct

SEQ ID NO: 38536 - DNA, 25 bp, Homo sapien
caagccaattcacatggcaaaacct

SEQ ID NO: 38537 - DNA, 25 bp, Homo sapien
caagccagaaaatgaacgaatgtgc

SEQ ID NO: 38538 - DNA, 25 bp, Homo sapien
caagccagaaaatgaatgaatgtgc

SEQ ID NO: 38539 - DNA, 25 bp, Homo sapien
caagccagaatgactctgaactttc

SEQ ID NO: 38540 - DNA, 25 bp, Homo sapien
caagccagaatgtctctgaactttc

SEQ ID NO: 38541 - DNA, 25 bp, Homo sapien
caagccatgaaaatttaaaaggact

SEQ ID NO: 38542 - DNA, 25 bp, Homo sapien
caagccatgaaaattttaaaggact

SEQ ID NO: 38543 - DNA, 25 bp, Homo sapien
caagccctgcagatctttttcctgg

SEQ ID NO: 38544 - DNA, 25 bp, Homo sapien
caagccctgcatatctttttcctgg

SEQ ID NO: 38545 - DNA, 25 bp, Homo sapien
caagcccttacgaacaaaagatgga

SEQ ID NO: 38546 - DNA, 25 bp, Homo sapien
caagcccttactaacaaaagatgga

SEQ ID NO: 38547 - DNA, 25 bp, Homo sapien
caagcccttcgaagagcaacatcag

SEQ ID NO: 38548 - DNA, 25 bp, Homo sapien
caagcccttcgaagaggaacatcag

SEQ ID NO: 38549 - DNA, 25 bp, Homo sapien
caagccgctttgccgtgctgattgc

SEQ ID NO: 38550 - DNA, 25 bp, Homo sapien
caagccgctttgctgtgctgattgc

SEQ ID NO: 38551 - DNA, 25 bp, Homo sapien
caagcctgcacatatacctcttcat

SEQ ID NO: 38552 - DNA, 25 bp, Homo sapien
caagcctgcacgtatacctcttcat

SEQ ID NO: 38553 - DNA, 25 bp, Homo sapien
caagccttatcaaagaagaataaaa

SEQ ID NO: 38554 - DNA, 25 bp, Homo sapien
caagccttatcaaggaagaataaaa

SEQ ID NO: 38555 - DNA, 25 bp, Homo sapien
caagcggagagacgaaaattctaag

SEQ ID NO: 38556 - DNA, 25 bp, Homo sapien
caagcggagagacgaacattctaag

SEQ ID NO: 38557 - DNA, 25 bp, Homo sapien
caagcgttttgattaagtgctggat

SEQ ID NO: 38558 - DNA, 25 bp, Homo sapien
caagcgttttgatttagtgctggat

SEQ ID NO: 38559 - DNA, 25 bp, Homo sapien
caagctaagaccatgtgcgccctgt

SEQ ID NO: 38560 - DNA, 25 bp, Homo sapien
caagctaagtccatgtgcgccctgt

SEQ ID NO: 38561 - DNA, 25 bp, Homo sapien
caagctacaaaattgacgaattcct

SEQ ID NO: 38562 - DNA, 25 bp, Homo sapien
caagctacaaaattgatgaattcct

SEQ ID NO: 38563 - DNA, 25 bp, Homo sapien
caagctaccgacgtgcatcaaccag

SEQ ID NO: 38564 - DNA, 25 bp, Homo sapien
caagctaccgacgtgcgtcaaccag

SEQ ID NO: 38565 - DNA, 25 bp, Homo sapien
caagctactacttaatactgagcca

SEQ ID NO: 38566 - DNA, 25 bp, Homo sapien
caagctactacttactactgagcca

SEQ ID NO: 38567 - DNA, 25 bp, Homo sapien
caagctaggaagcaagccctcccca

SEQ ID NO: 38568 - DNA, 25 bp, Homo sapien
caagctaggaagcgagccctcccca

SEQ ID NO: 38569 - DNA, 25 bp, Homo sapien
caagctataaagaagtgtatagagt

SEQ ID NO: 38570 - DNA, 25 bp, Homo sapien
caagctatatagaagtgtatagagt

SEQ ID NO: 38571 - DNA, 25 bp, Homo sapien
caagctcaaggacgggacaaagttc

SEQ ID NO: 38572 - DNA, 25 bp, Homo sapien
caagctcaaggatgggacaaagttc

SEQ ID NO: 38573 - DNA, 25 bp, Homo sapien
caagctgacaagaaaaaagcatttc

SEQ ID NO: 38574 - DNA, 25 bp, Homo sapien
caagctgacaaggaaaaagcatttc

SEQ ID NO: 38575 - DNA, 25 bp, Homo sapien
caagctgaccatcaaggatctgcct

SEQ ID NO: 38576 - DNA, 25 bp, Homo sapien
caagctgaccatgaaggatctgcct

SEQ ID NO: 38577 - DNA, 25 bp, Homo sapien
caagctgaggagaacacgctgtgct

SEQ ID NO: 38578 - DNA, 25 bp, Homo sapien
caagctgaggagaacatgctgtgct

SEQ ID NO: 38579 - DNA, 25 bp, Homo sapien
caagctgaggttcacaaagtttgag

SEQ ID NO: 38580 - DNA, 25 bp, Homo sapien
caagctgaggttcagaaagtttgag

SEQ ID NO: 38581 - DNA, 25 bp, Homo sapien
caagctgatgtattggtattgtgct

SEQ ID NO: 38582 - DNA, 25 bp, Homo sapien
caagctgatgttttggtattgtgct

SEQ ID NO: 38583 - DNA, 25 bp, Homo sapien
caagctgcaaagctcacaactccaa

SEQ ID NO: 38584 - DNA, 25 bp, Homo sapien
caagctgcaaagctcagaactccaa

SEQ ID NO: 38585 - DNA, 25 bp, Homo sapien
caagctgcaagacataatcctcttt

SEQ ID NO: 38586 - DNA, 25 bp, Homo sapien
caagctgcaagatataatcctcttt

SEQ ID NO: 38587 - DNA, 25 bp, Homo sapien
caagctgcagttcaggcagccctgt

SEQ ID NO: 38588 - DNA, 25 bp, Homo sapien
caagctgcagttcaggtagccctgt

SEQ ID NO: 38589 - DNA, 25 bp, Homo sapien
caagctggaaccacacaaaaagctt

SEQ ID NO: 38590 - DNA, 25 bp, Homo sapien
caagctggaaccacacgaaaagctt

SEQ ID NO: 38591 - DNA, 25 bp, Homo sapien
caagctgtaacacagtagacattca

SEQ ID NO: 38592 - DNA, 25 bp, Homo sapien
caagctgtaacatagtagacattca

SEQ ID NO: 38593 - DNA, 25 bp, Homo sapien
caagctgtaggcggatctaccattc

SEQ ID NO: 38594 - DNA, 25 bp, Homo sapien
caagctgtaggtggatctaccattc

SEQ ID NO: 38595 - DNA, 25 bp, Homo sapien
caagctgtgcaaagtcaattcaact

SEQ ID NO: 38596 - DNA, 25 bp, Homo sapien
caagctgtgcagagtcaattcaact

SEQ ID NO: 38597 - DNA, 25 bp, Homo sapien
caagcttcacaactttctccgactc

SEQ ID NO: 38598 - DNA, 25 bp, Homo sapien
caagcttcacatctttctccgactc

SEQ ID NO: 38599 - DNA, 25 bp, Homo sapien
caagctttcacattgaatcagtaat

SEQ ID NO: 38600 - DNA, 25 bp, Homo sapien
caagctttgacattgaatcagtaat

SEQ ID NO: 38601 - DNA, 25 bp, Homo sapien
caagcttttgctatgaggcaataac

SEQ ID NO: 38602 - DNA, 25 bp, Homo sapien
caagcttttgctattaggcaataac

SEQ ID NO: 38603 - DNA, 25 bp, Homo sapien
caaggaaacgagggccactatgcta

SEQ ID NO: 38604 - DNA, 25 bp, Homo sapien
caaggaaatgagggccactatgcta

SEQ ID NO: 38605 - DNA, 25 bp, Homo sapien
caaggaacaagatcatggcagtaaa

SEQ ID NO: 38606 - DNA, 25 bp, Homo sapien
caaggaaccagatcatggcagtaaa

SEQ ID NO: 38607 - DNA, 25 bp, Homo sapien
caaggaacctctgcgaatgaagcac

SEQ ID NO: 38608 - DNA, 25 bp, Homo sapien
caaggaacctctgtgaatgaagcac

SEQ ID NO: 38609 - DNA, 25 bp, Homo sapien
caaggaagacaatgacagataaagg

SEQ ID NO: 38610 - DNA, 25 bp, Homo sapien
caaggaagccaatgacagataaagg

SEQ ID NO: 38611 - DNA, 25 bp, Homo sapien
caaggaagctcagaggaggaacttt

SEQ ID NO: 38612 - DNA, 25 bp, Homo sapien
caaggaagctgcaaaaaggctgtgt

SEQ ID NO: 38613 - DNA, 25 bp, Homo sapien
caaggaagctgcagaaaggctgtgt

SEQ ID NO: 38614 - DNA, 25 bp, Homo sapien
caaggaaggtattatgatctttaca

SEQ ID NO: 38615 - DNA, 25 bp, Homo sapien
caaggaaggtattatgctctttaca

SEQ ID NO: 38616 - DNA, 25 bp, Homo sapien
caaggaagttcagaggaggaacttt

SEQ ID NO: 38617 - DNA, 25 bp, Homo sapien
caaggaagttcttccaagccaccac

SEQ ID NO: 38618 - DNA, 25 bp, Homo sapien
caaggaagttcttccaggccaccac

SEQ ID NO: 38619 - DNA, 25 bp, Homo sapien
caaggaataaatgaactcaagtaag

SEQ ID NO: 38620 - DNA, 25 bp, Homo sapien
caaggaataaattaactcaagtaag

SEQ ID NO: 38621 - DNA, 25 bp, Homo sapien
caaggacaaagcactacactggctc

SEQ ID NO: 38622 - DNA, 25 bp, Homo sapien
caaggacaaagcactatactggctc

SEQ ID NO: 38623 - DNA, 25 bp, Homo sapien
caaggaccaaagaaggaacctaagg

SEQ ID NO: 38624 - DNA, 25 bp, Homo sapien
caaggaccaaaggaggaacctaagg

SEQ ID NO: 38625 - DNA, 25 bp, Homo sapien
caaggaccaatcagtgtgcactttc

SEQ ID NO: 38626 - DNA, 25 bp, Homo sapien
caaggaccagtcagtgtgcactttc

SEQ ID NO: 38627 - DNA, 25 bp, Homo sapien
caaggactccataggaattatgtat

SEQ ID NO: 38628 - DNA, 25 bp, Homo sapien
caaggactctataggaattatgtat

SEQ ID NO: 38629 - DNA, 25 bp, Homo sapien
caaggagcaattttccaatcttctt

SEQ ID NO: 38630 - DNA, 25 bp, Homo sapien
caaggagcaattttccgatcttctt

SEQ ID NO: 38631 - DNA, 25 bp, Homo sapien
caaggagcacaactgttgaatcaca

SEQ ID NO: 38632 - DNA, 25 bp, Homo sapien
caaggagcataactgttgaatcaca

SEQ ID NO: 38633 - DNA, 25 bp, Homo sapien
caaggagctgaaaagtcacaatctt

SEQ ID NO: 38634 - DNA, 25 bp, Homo sapien
caaggagctgaagagtcacaatctt

SEQ ID NO: 38635 - DNA, 25 bp, Homo sapien
caaggaggtccaacatccaaataaa

SEQ ID NO: 38636 - DNA, 25 bp, Homo sapien
caaggaggtccgacatccaaataaa

SEQ ID NO: 38637 - DNA, 25 bp, Homo sapien
caaggagtgtgctagctagattgta

SEQ ID NO: 38638 - DNA, 25 bp, Homo sapien
caaggagtgtgcttgctagattgta

SEQ ID NO: 38639 - DNA, 25 bp, Homo sapien
caaggataaaagacgcatttgtgat

SEQ ID NO: 38640 - DNA, 25 bp, Homo sapien
caaggataaaagatgcatttgtgat

SEQ ID NO: 38641 - DNA, 25 bp, Homo sapien
caaggataaagaggagaattgctgt

SEQ ID NO: 38642 - DNA, 25 bp, Homo sapien
caaggataacatccctttgctgtgc

SEQ ID NO: 38643 - DNA, 25 bp, Homo sapien
caaggataattaaagcatgagctca

SEQ ID NO: 38644 - DNA, 25 bp, Homo sapien
caaggataattgaagcatgagctca

SEQ ID NO: 38645 - DNA, 25 bp, Homo sapien
caaggatagagaggagaattgctgt

SEQ ID NO: 38646 - DNA, 25 bp, Homo sapien
caaggatagcatccctttgctgtgc

SEQ ID NO: 38647 - DNA, 25 bp, Homo sapien
caaggatcctcaacattgtactgta

SEQ ID NO: 38648 - DNA, 25 bp, Homo sapien
caaggatcctcaatattgtactgta

SEQ ID NO: 38649 - DNA, 25 bp, Homo sapien
caaggatggcttaaagtatgcaaat

SEQ ID NO: 38650 - DNA, 25 bp, Homo sapien
caaggatggcttaacgtatgcaaat

SEQ ID NO: 38651 - DNA, 25 bp, Homo sapien
caaggatgtcataatgtcatgtgga

SEQ ID NO: 38652 - DNA, 25 bp, Homo sapien
caaggatgtcatgatgtcatgtgga

SEQ ID NO: 38653 - DNA, 25 bp, Homo sapien
caaggattcgggcataacagattaa

SEQ ID NO: 38654 - DNA, 25 bp, Homo sapien
caaggattcgggcataccagattaa

SEQ ID NO: 38655 - DNA, 25 bp, Homo sapien
caaggcaaaagactagagagtgaca

SEQ ID NO: 38656 - DNA, 25 bp, Homo sapien
caaggcaaaagattagagagtgaca

SEQ ID NO: 38657 - DNA, 25 bp, Homo sapien
caaggcaatcattatgaagcttcag

SEQ ID NO: 38658 - DNA, 25 bp, Homo sapien
caaggcaatcattgtgaagcttcag

SEQ ID NO: 38659 - DNA, 25 bp, Homo sapien
caaggcagagggcatcagattgtga

SEQ ID NO: 38660 - DNA, 25 bp, Homo sapien
caaggcagagggcgtcagattgtga

SEQ ID NO: 38661 - DNA, 25 bp, Homo sapien
caaggcataaacttgttaaaattac

SEQ ID NO: 38662 - DNA, 25 bp, Homo sapien
caaggcatacagacagctgaagaac

SEQ ID NO: 38663 - DNA, 25 bp, Homo sapien
caaggcatacaggcagctgaagaac

SEQ ID NO: 38664 - DNA, 25 bp, Homo sapien
caaggcatgaacttgttaaaattac

SEQ ID NO: 38665 - DNA, 25 bp, Homo sapien
caaggccattgaaccagacagaaag

SEQ ID NO: 38666 - DNA, 25 bp, Homo sapien
caaggccattgacccagacagaaag

SEQ ID NO: 38667 - DNA, 25 bp, Homo sapien
caaggcggatccctgaatgccacac

SEQ ID NO: 38668 - DNA, 25 bp, Homo sapien
caaggcggatccctgagtgccacac

SEQ ID NO: 38669 - DNA, 25 bp, Homo sapien
caaggctacataagacctagatatg

SEQ ID NO: 38670 - DNA, 25 bp, Homo sapien
caaggctacatacgacctagatatg

SEQ ID NO: 38671 - DNA, 25 bp, Homo sapien
caaggctatgacataattcttggtt

SEQ ID NO: 38672 - DNA, 25 bp, Homo sapien
caaggctatgacgtaattcttggtt

SEQ ID NO: 38673 - DNA, 25 bp, Homo sapien
caaggctcaatgcggaaattcatgg

SEQ ID NO: 38674 - DNA, 25 bp, Homo sapien
caaggctcaatgctgaaattcatgg

SEQ ID NO: 38675 - DNA, 25 bp, Homo sapien
caaggctcaattctgcttttccctc

SEQ ID NO: 38676 - DNA, 25 bp, Homo sapien
caaggctcaattgtgcttttccctc

SEQ ID NO: 38677 - DNA, 25 bp, Homo sapien
caaggctcccattctgagcatctca

SEQ ID NO: 38678 - DNA, 25 bp, Homo sapien
caaggctcctattctgagcatctca

SEQ ID NO: 38679 - DNA, 25 bp, Homo sapien
caaggctctcgacttacctgagaag

SEQ ID NO: 38680 - DNA, 25 bp, Homo sapien
caaggctctgtgggcataggacccg

SEQ ID NO: 38681 - DNA, 25 bp, Homo sapien
caaggctctgtgggtataggacccg

SEQ ID NO: 38682 - DNA, 25 bp, Homo sapien
caaggctcttgacttacctgagaag

SEQ ID NO: 38683 - DNA, 25 bp, Homo sapien
caaggctgagacccgctgtgtttcc

SEQ ID NO: 38684 - DNA, 25 bp, Homo sapien
caaggctgagacctgctgtgtttcc

SEQ ID NO: 38685 - DNA, 25 bp, Homo sapien
caaggctttcagcactcaatcagct

SEQ ID NO: 38686 - DNA, 25 bp, Homo sapien
caaggctttcagcactgaatcagct

SEQ ID NO: 38687 - DNA, 25 bp, Homo sapien
caaggcttttgacacttattgccaa

SEQ ID NO: 38688 - DNA, 25 bp, Homo sapien
caaggcttttgatacttattgccaa

SEQ ID NO: 38689 - DNA, 25 bp, Homo sapien
caagggaaatgatcactcttccaat

SEQ ID NO: 38690 - DNA, 25 bp, Homo sapien
caagggaactgacgagtcttgggtg

SEQ ID NO: 38691 - DNA, 25 bp, Homo sapien
caagggaactgatcactcttccaat

SEQ ID NO: 38692 - DNA, 25 bp, Homo sapien
caagggaactgatgagtcttgggtg

SEQ ID NO: 38693 - DNA, 25 bp, Homo sapien
caagggactatttcttcaattactg

SEQ ID NO: 38694 - DNA, 25 bp, Homo sapien
caagggactgtagaccactgcatac

SEQ ID NO: 38695 - DNA, 25 bp, Homo sapien
caagggactgtagagcactgcatac

SEQ ID NO: 38696 - DNA, 25 bp, Homo sapien
caagggactgtttcttcaattactg

SEQ ID NO: 38697 - DNA, 25 bp, Homo sapien
caagggagactaaactggatgacct

SEQ ID NO: 38698 - DNA, 25 bp, Homo sapien
caagggaggctaaactggatgacct

SEQ ID NO: 38699 - DNA, 25 bp, Homo sapien
caagggattgttaaataatttctga

SEQ ID NO: 38700 - DNA, 25 bp, Homo sapien
caagggattgttaaatgatttctga

SEQ ID NO: 38701 - DNA, 25 bp, Homo sapien
caagggccacatgccttcaatttgg

SEQ ID NO: 38702 - DNA, 25 bp, Homo sapien
caagggccacatgtcttcaatttgg

SEQ ID NO: 38703 - DNA, 25 bp, Homo sapien
caagggtaaaaaataaacaagtcag

SEQ ID NO: 38704 - DNA, 25 bp, Homo sapien
caagggtaagaaataaacaagtcag

SEQ ID NO: 38705 - DNA, 25 bp, Homo sapien
caagggtagtcgccttctgatgttg

SEQ ID NO: 38706 - DNA, 25 bp, Homo sapien
caagggtagtcgtcttctgatgttg

SEQ ID NO: 38707 - DNA, 25 bp, Homo sapien
caagggtcataaaaaagattcaagt

SEQ ID NO: 38708 - DNA, 25 bp, Homo sapien
caagggtcataaacaagattcaagt

SEQ ID NO: 38709 - DNA, 25 bp, Homo sapien
caagggttaaacgtagtggtaagaa

SEQ ID NO: 38710 - DNA, 25 bp, Homo sapien
caagggttaaatgtagtggtaagaa

SEQ ID NO: 38711 - DNA, 25 bp, Homo sapien
caaggtacaaactcacgtgcattaa

SEQ ID NO: 38712 - DNA, 25 bp, Homo sapien
caaggtacagactcacgtgcattaa

SEQ ID NO: 38713 - DNA, 25 bp, Homo sapien
caaggtagcgaggttggccaatcca

SEQ ID NO: 38714 - DNA, 25 bp, Homo sapien
caaggtagctaaaattaagcacatt

SEQ ID NO: 38715 - DNA, 25 bp, Homo sapien
caaggtagctataattaagcacatt

SEQ ID NO: 38716 - DNA, 25 bp, Homo sapien
caaggtagtgaggttggccaatcca

SEQ ID NO: 38717 - DNA, 25 bp, Homo sapien
caaggtcaaagtatgtctcctcata

SEQ ID NO: 38718 - DNA, 25 bp, Homo sapien
caaggtcaaagtttgtctcctcata

SEQ ID NO: 38719 - DNA, 25 bp, Homo sapien
caaggtcagaacccaaggctcaatt

SEQ ID NO: 38720 - DNA, 25 bp, Homo sapien
caaggtcagaacccgaggctcaatt

SEQ ID NO: 38721 - DNA, 25 bp, Homo sapien
caaggtcttcaacattttaacctgc

SEQ ID NO: 38722 - DNA, 25 bp, Homo sapien
caaggtcttcagcattttaacctgc

SEQ ID NO: 38723 - DNA, 25 bp, Homo sapien
caaggtcttgtacatcacattgcca

SEQ ID NO: 38724 - DNA, 25 bp, Homo sapien
caaggtcttgtacatctcattgcca

SEQ ID NO: 38725 - DNA, 25 bp, Homo sapien
caaggtggagtacagcctgggtatc

SEQ ID NO: 38726 - DNA, 25 bp, Homo sapien
caaggtggagtacggcctgggtatc

SEQ ID NO: 38727 - DNA, 25 bp, Homo sapien
caaggttaataccctgatagtgtta

SEQ ID NO: 38728 - DNA, 25 bp, Homo sapien
caaggttacgcatctagcaagtggc

SEQ ID NO: 38729 - DNA, 25 bp, Homo sapien
caaggttactcatctagcaagtggc

SEQ ID NO: 38730 - DNA, 25 bp, Homo sapien
caaggttagtaccctgatagtgtta

SEQ ID NO: 38731 - DNA, 25 bp, Homo sapien
caaggttagtgcatgagtaacaatt

SEQ ID NO: 38732 - DNA, 25 bp, Homo sapien
caaggttagtgtatgagtaacaatt

SEQ ID NO: 38733 - DNA, 25 bp, Homo sapien
caaggttccgtgcaccaaatcacta

SEQ ID NO: 38734 - DNA, 25 bp, Homo sapien
caaggttctgtgcaccaaatcacta

SEQ ID NO: 38735 - DNA, 25 bp, Homo sapien
caaggtttacggccctgaggatgcc

SEQ ID NO: 38736 - DNA, 25 bp, Homo sapien
caaggtttatggccctgaggatgcc

SEQ ID NO: 38737 - DNA, 25 bp, Homo sapien
caagtaattgcagcaatgccacagc

SEQ ID NO: 38738 - DNA, 25 bp, Homo sapien
caagtaattgcggcaatgccacagc

SEQ ID NO: 38739 - DNA, 25 bp, Homo sapien
caagtaggaaaggttacagaggcta

SEQ ID NO: 38740 - DNA, 25 bp, Homo sapien
caagtaggaaatgttacagaggcta

SEQ ID NO: 38741 - DNA, 25 bp, Homo sapien
caagtaggacccagagacagagttt

SEQ ID NO: 38742 - DNA, 25 bp, Homo sapien
caagtaggacctagagacagagttt

SEQ ID NO: 38743 - DNA, 25 bp, Homo sapien
caagtagttctcattgcctattgtt

SEQ ID NO: 38744 - DNA, 25 bp, Homo sapien
caagtagttctcattgtctattgtt

SEQ ID NO: 38745 - DNA, 25 bp, Homo sapien
caagtatagggccattgaaaaacac

SEQ ID NO: 38746 - DNA, 25 bp, Homo sapien
caagtatagggccgttgaaaaacac

SEQ ID NO: 38747 - DNA, 25 bp, Homo sapien
caagtatagtttctaagcctttaag

SEQ ID NO: 38748 - DNA, 25 bp, Homo sapien
caagtatagtttttaagcctttaag

SEQ ID NO: 38749 - DNA, 25 bp, Homo sapien
caagtatatggtagcaccaggtttt

SEQ ID NO: 38750 - DNA, 25 bp, Homo sapien
caagtatatggtagtaccaggtttt

SEQ ID NO: 38751 - DNA, 25 bp, Homo sapien
caagtatctggtaaagtgacaaaaa

SEQ ID NO: 38752 - DNA, 25 bp, Homo sapien
caagtatctggtgaagtgacaaaaa

SEQ ID NO: 38753 - DNA, 25 bp, Homo sapien
caagtatgatattaatagtgggctg

SEQ ID NO: 38754 - DNA, 25 bp, Homo sapien
caagtatgatattgatagtgggctg

SEQ ID NO: 38755 - DNA, 25 bp, Homo sapien
caagtattaacaatcgagtctggcc

SEQ ID NO: 38756 - DNA, 25 bp, Homo sapien
caagtattagcaatcgagtctggcc

SEQ ID NO: 38757 - DNA, 25 bp, Homo sapien
caagtattgcagccaggaaatgaat

SEQ ID NO: 38758 - DNA, 25 bp, Homo sapien
caagtattgcagtcaggaaatgaat

SEQ ID NO: 38759 - DNA, 25 bp, Homo sapien
caagtcaacattatttattcactaa

SEQ ID NO: 38760 - DNA, 25 bp, Homo sapien
caagtcaacattgtttattcactaa

SEQ ID NO: 38761 - DNA, 25 bp, Homo sapien
caagtcaacggaatataatacagtg

SEQ ID NO: 38762 - DNA, 25 bp, Homo sapien
caagtcaatgaccatgagagaatgc

SEQ ID NO: 38763 - DNA, 25 bp, Homo sapien
caagtcaatgactatgagagaatgc

SEQ ID NO: 38764 - DNA, 25 bp, Homo sapien
caagtcaatggaatataatacagtg

SEQ ID NO: 38765 - DNA, 25 bp, Homo sapien
caagtcagaggttcatccaaggcgc

SEQ ID NO: 38766 - DNA, 25 bp, Homo sapien
caagtcagaggttcgtccaaggcgc

SEQ ID NO: 38767 - DNA, 25 bp, Homo sapien
caagtccaaggtccacatcaaagtt

SEQ ID NO: 38768 - DNA, 25 bp, Homo sapien
caagtccaaggttcacatcaaagtt

SEQ ID NO: 38769 - DNA, 25 bp, Homo sapien
caagtccaagttaaatacatgttac

SEQ ID NO: 38770 - DNA, 25 bp, Homo sapien
caagtccaagttgaatacatgttac

SEQ ID NO: 38771 - DNA, 25 bp, Homo sapien
caagtcctgtctcctataacgtggg

SEQ ID NO: 38772 - DNA, 25 bp, Homo sapien
caagtcctttctcctataacgtggg

SEQ ID NO: 38773 - DNA, 25 bp, Homo sapien
caagtcgccaaaaattctaggtaat

SEQ ID NO: 38774 - DNA, 25 bp, Homo sapien
caagtcgcccaaaattctaggtaat

SEQ ID NO: 38775 - DNA, 25 bp, Homo sapien
caagtctaacttgtttcatgttcac

SEQ ID NO: 38776 - DNA, 25 bp, Homo sapien
caagtctaccttgtttcatgttcac

SEQ ID NO: 38777 - DNA, 25 bp, Homo sapien
caagtctatgagacggactaacacc

SEQ ID NO: 38778 - DNA, 25 bp, Homo sapien
caagtctatgagatggactaacacc

SEQ ID NO: 38779 - DNA, 25 bp, Homo sapien
caagtctcaatagtttgctagatgg

SEQ ID NO: 38780 - DNA, 25 bp, Homo sapien
caagtctcaatggtttgctagatgg

SEQ ID NO: 38781 - DNA, 25 bp, Homo sapien
caagtctcacaattcaaggtgacca

SEQ ID NO: 38782 - DNA, 25 bp, Homo sapien
caagtctcgcaattcaaggtgacca

SEQ ID NO: 38783 - DNA, 25 bp, Homo sapien
caagtctgcttagaaaggaaagagg

SEQ ID NO: 38784 - DNA, 25 bp, Homo sapien
caagtctgtttagaaaggaaagagg

SEQ ID NO: 38785 - DNA, 25 bp, Homo sapien
caagtcttaataaattcgaaaattg

SEQ ID NO: 38786 - DNA, 25 bp, Homo sapien
caagtcttaatgaattcgaaaattg

SEQ ID NO: 38787 - DNA, 25 bp, Homo sapien
caagtgaacactcagctcaaagtcc

SEQ ID NO: 38788 - DNA, 25 bp, Homo sapien
caagtgaacactcggctcaaagtcc

SEQ ID NO: 38789 - DNA, 25 bp, Homo sapien
caagtgaacctggagaagcaacaat

SEQ ID NO: 38790 - DNA, 25 bp, Homo sapien
caagtgaactgaagaaaccttgggc

SEQ ID NO: 38791 - DNA, 25 bp, Homo sapien
caagtgaactgaagaacccttgggc

SEQ ID NO: 38792 - DNA, 25 bp, Homo sapien
caagtgaagttgctgtcaggtaact

SEQ ID NO: 38793 - DNA, 25 bp, Homo sapien
caagtgaagttggtgtcaggtaact

SEQ ID NO: 38794 - DNA, 25 bp, Homo sapien
caagtgaatctggagaagcaacaat

SEQ ID NO: 38795 - DNA, 25 bp, Homo sapien
caagtgaccaatttgcacagtaagg

SEQ ID NO: 38796 - DNA, 25 bp, Homo sapien
caagtgaccgatttgcacagtaagg

SEQ ID NO: 38797 - DNA, 25 bp, Homo sapien
caagtgctaattcattataaggtta

SEQ ID NO: 38798 - DNA, 25 bp, Homo sapien
caagtgctaattcgttataaggtta

SEQ ID NO: 38799 - DNA, 25 bp, Homo sapien
caagtgctcactagtccagagactg

SEQ ID NO: 38800 - DNA, 25 bp, Homo sapien
caagtgctcgctagtccagagactg

SEQ ID NO: 38801 - DNA, 25 bp, Homo sapien
caagtggacggtctccaacttcgaa

SEQ ID NO: 38802 - DNA, 25 bp, Homo sapien
caagtggagaaattgaagatccctg

SEQ ID NO: 38803 - DNA, 25 bp, Homo sapien
caagtggagaaatttaagatccctg

SEQ ID NO: 38804 - DNA, 25 bp, Homo sapien
caagtggaggaattgaagatccctg

SEQ ID NO: 38805 - DNA, 25 bp, Homo sapien
caagtggagtagacagcaggaacca

SEQ ID NO: 38806 - DNA, 25 bp, Homo sapien
caagtggagtagatagcaggaacca

SEQ ID NO: 38807 - DNA, 25 bp, Homo sapien
caagtggatggtctccaacttcgaa

SEQ ID NO: 38808 - DNA, 25 bp, Homo sapien
caagtggcctcaccctggacgctgg

SEQ ID NO: 38809 - DNA, 25 bp, Homo sapien
caagtggcctcatcctggacgctgg

SEQ ID NO: 38810 - DNA, 25 bp, Homo sapien
caagtgggaataacaatgcccatca

SEQ ID NO: 38811 - DNA, 25 bp, Homo sapien
caagtgggaatagcaatgcccatca

SEQ ID NO: 38812 - DNA, 25 bp, Homo sapien
caagtgtatgaaattctgaaggaag

SEQ ID NO: 38813 - DNA, 25 bp, Homo sapien
caagtgtatgaagttctgaaggaag

SEQ ID NO: 38814 - DNA, 25 bp, Homo sapien
caagtgttaaaatatacctacaaat

SEQ ID NO: 38815 - DNA, 25 bp, Homo sapien
caagtgttaaaatgtacctacaaat

SEQ ID NO: 38816 - DNA, 25 bp, Homo sapien
caagtgttctcccatagaaataaaa

SEQ ID NO: 38817 - DNA, 25 bp, Homo sapien
caagtgttctcccgtagaaataaaa

SEQ ID NO: 38818 - DNA, 25 bp, Homo sapien
caagtgtttgctctataactggatc

SEQ ID NO: 38819 - DNA, 25 bp, Homo sapien
caagtgtttgctctttaactggatc

SEQ ID NO: 38820 - DNA, 25 bp, Homo sapien
caagttaaggcaaatttcaaaaagc

SEQ ID NO: 38821 - DNA, 25 bp, Homo sapien
caagttaagtcaaatttcaaaaagc

SEQ ID NO: 38822 - DNA, 25 bp, Homo sapien
caagttacctctcagacatcaggca

SEQ ID NO: 38823 - DNA, 25 bp, Homo sapien
caagttacctctcagatatcaggca

SEQ ID NO: 38824 - DNA, 25 bp, Homo sapien
caagttatcggttgacatcctcctg

SEQ ID NO: 38825 - DNA, 25 bp, Homo sapien
caagttattggttgacatcctcctg

SEQ ID NO: 38826 - DNA, 25 bp, Homo sapien
caagttatttgacaaaatttctcat

SEQ ID NO: 38827 - DNA, 25 bp, Homo sapien
caagttatttgacataatttctcat

SEQ ID NO: 38828 - DNA, 25 bp, Homo sapien
caagttcagtgacaaaacaacaagc

SEQ ID NO: 38829 - DNA, 25 bp, Homo sapien
caagttcagtgtcaaaacaacaagc

SEQ ID NO: 38830 - DNA, 25 bp, Homo sapien
caagttccagccttatttttatagc

SEQ ID NO: 38831 - DNA, 25 bp, Homo sapien
caagttccagcgttatttttatagc

SEQ ID NO: 38832 - DNA, 25 bp, Homo sapien
caagttccaggaccacaatttgctt

SEQ ID NO: 38833 - DNA, 25 bp, Homo sapien
caagttccaggaccacgatttgctt

SEQ ID NO: 38834 - DNA, 25 bp, Homo sapien
caagttccagtgagggccctcttct

SEQ ID NO: 38835 - DNA, 25 bp, Homo sapien
caagttccggtgagggccctcttct

SEQ ID NO: 38836 - DNA, 25 bp, Homo sapien
caagttctactagttcatcttctat

SEQ ID NO: 38837 - DNA, 25 bp, Homo sapien
caagttctactagttcgtcttctat

SEQ ID NO: 38838 - DNA, 25 bp, Homo sapien
caagttcttggccttctgtgtgctg

SEQ ID NO: 38839 - DNA, 25 bp, Homo sapien
caagttcttggcgttctgtgtgctg

SEQ ID NO: 38840 - DNA, 25 bp, Homo sapien
caagttgacacccgatcactcaata

SEQ ID NO: 38841 - DNA, 25 bp, Homo sapien
caagttgacaccggatcactcaata

SEQ ID NO: 38842 - DNA, 25 bp, Homo sapien
caagttgagacaatggcttaacatg

SEQ ID NO: 38843 - DNA, 25 bp, Homo sapien
caagttgaggcaatggcttaacatg

SEQ ID NO: 38844 - DNA, 25 bp, Homo sapien
caagttgctattgaaacctccaatt

SEQ ID NO: 38845 - DNA, 25 bp, Homo sapien
caagttgctattgatacctccaatt

SEQ ID NO: 38846 - DNA, 25 bp, Homo sapien
caagttggtaactgatatatgtgaa

SEQ ID NO: 38847 - DNA, 25 bp, Homo sapien
caagttggtaattgatatatgtgaa

SEQ ID NO: 38848 - DNA, 25 bp, Homo sapien
caagttgtagttcttctgtagattg

SEQ ID NO: 38849 - DNA, 25 bp, Homo sapien
caagttgtagtttttctgtagattg

SEQ ID NO: 38850 - DNA, 25 bp, Homo sapien
caagtttacctgttatataagagca

SEQ ID NO: 38851 - DNA, 25 bp, Homo sapien
caagtttatctgttatataagagca

SEQ ID NO: 38852 - DNA, 25 bp, Homo sapien
caagtttatttgtaatcaagagtgg

SEQ ID NO: 38853 - DNA, 25 bp, Homo sapien
caagtttatttgtagtcaagagtgg

SEQ ID NO: 38854 - DNA, 25 bp, Homo sapien
caagtttccatttgtattctggtag

SEQ ID NO: 38855 - DNA, 25 bp, Homo sapien
caagtttccgtttgtattctggtag

SEQ ID NO: 38856 - DNA, 25 bp, Homo sapien
caagtttctggtattcaacaaaata

SEQ ID NO: 38857 - DNA, 25 bp, Homo sapien
caagtttctggtcttcaacaaaata

SEQ ID NO: 38858 - DNA, 25 bp, Homo sapien
caagtttgacttcgcaacagtgcaa

SEQ ID NO: 38859 - DNA, 25 bp, Homo sapien
caagtttgactttgcaacagtgcaa

SEQ ID NO: 38860 - DNA, 25 bp, Homo sapien
caagttttatgggttctccctgtgt

SEQ ID NO: 38861 - DNA, 25 bp, Homo sapien
caagttttcagcttattggcacatc

SEQ ID NO: 38862 - DNA, 25 bp, Homo sapien
caagttttccgcttattggcacatc

SEQ ID NO: 38863 - DNA, 25 bp, Homo sapien
caagttttgtgggttctccctgtgt

SEQ ID NO: 38864 - DNA, 25 bp, Homo sapien
caagttttgttatcaatattataca

SEQ ID NO: 38865 - DNA, 25 bp, Homo sapien
caagttttgttgtcaatattataca

SEQ ID NO: 38866 - DNA, 25 bp, Homo sapien
caagtttttatcaggccttcctcct

SEQ ID NO: 38867 - DNA, 25 bp, Homo sapien
caagtttttattaggccttcctcct

SEQ ID NO: 38868 - DNA, 25 bp, Homo sapien
caagtttttgtgtaagataaatttc

SEQ ID NO: 38869 - DNA, 25 bp, Homo sapien
caagtttttgtgtaagttaaatttc

SEQ ID NO: 38870 - DNA, 25 bp, Homo sapien
caataaaaccacaacaaacagcttt

SEQ ID NO: 38871 - DNA, 25 bp, Homo sapien
caataaaaccacagcaaacagcttt

SEQ ID NO: 38872 - DNA, 25 bp, Homo sapien
caataaaatatgcgcttgtgtgctg

SEQ ID NO: 38873 - DNA, 25 bp, Homo sapien
caataaaatatgtgcttgtgtgctg

SEQ ID NO: 38874 - DNA, 25 bp, Homo sapien
caataaacacgactactgatttgat

SEQ ID NO: 38875 - DNA, 25 bp, Homo sapien
caataaacacgattactgatttgat

SEQ ID NO: 38876 - DNA, 25 bp, Homo sapien
caataaaccacttatccgagtctgc

SEQ ID NO: 38877 - DNA, 25 bp, Homo sapien
caataaaccacttatctgagtctgc

SEQ ID NO: 38878 - DNA, 25 bp, Homo sapien
caataaatgcctactgagaaataaa

SEQ ID NO: 38879 - DNA, 25 bp, Homo sapien
caataaatggctaagtcaaaaaagt

SEQ ID NO: 38880 - DNA, 25 bp, Homo sapien
caataaatggctacgtcaaaaaagt

SEQ ID NO: 38881 - DNA, 25 bp, Homo sapien
caataaatgtctactgagaaataaa

SEQ ID NO: 38882 - DNA, 25 bp, Homo sapien
caataaatgtgctacttggaatttg

SEQ ID NO: 38883 - DNA, 25 bp, Homo sapien
caataaatgtgttacttggaatttg

SEQ ID NO: 38884 - DNA, 25 bp, Homo sapien
caataaattctacggcacatcagtc

SEQ ID NO: 38885 - DNA, 25 bp, Homo sapien
caataaattctatggcacatcagtc

SEQ ID NO: 38886 - DNA, 25 bp, Homo sapien
caataaattgatatgcagatgaatt

SEQ ID NO: 38887 - DNA, 25 bp, Homo sapien
caataaattgatatgcggatgaatt

SEQ ID NO: 38888 - DNA, 25 bp, Homo sapien
caataacaaaatcaaggcaaaagta

SEQ ID NO: 38889 - DNA, 25 bp, Homo sapien
caataacaagcatggagctagggct

SEQ ID NO: 38890 - DNA, 25 bp, Homo sapien
caataacagaaaagctcttgtgagg

SEQ ID NO: 38891 - DNA, 25 bp, Homo sapien
caataacagaaaatctcttgtgagg

SEQ ID NO: 38892 - DNA, 25 bp, Homo sapien
caataacagaatcaaggcaaaagta

SEQ ID NO: 38893 - DNA, 25 bp, Homo sapien
caataacaggcatggagctagggct

SEQ ID NO: 38894 - DNA, 25 bp, Homo sapien
caataacatcggtatgacacaggag

SEQ ID NO: 38895 - DNA, 25 bp, Homo sapien
caataacattggtatgacacaggag

SEQ ID NO: 38896 - DNA, 25 bp, Homo sapien
caataaccatggatttcattcccac

SEQ ID NO: 38897 - DNA, 25 bp, Homo sapien
caataaccatggattttattcccac

SEQ ID NO: 38898 - DNA, 25 bp, Homo sapien
caataagaacctcaaaaatatatct

SEQ ID NO: 38899 - DNA, 25 bp, Homo sapien
caataagaacctcagaaatatatct

SEQ ID NO: 38900 - DNA, 25 bp, Homo sapien
caataagactctctctacgtaattt

SEQ ID NO: 38901 - DNA, 25 bp, Homo sapien
caataagactctctttacgtaattt

SEQ ID NO: 38902 - DNA, 25 bp, Homo sapien
caataagcaattgattcgaaaacct

SEQ ID NO: 38903 - DNA, 25 bp, Homo sapien
caataagcaattgatttgaaaacct

SEQ ID NO: 38904 - DNA, 25 bp, Homo sapien
caataagtgatacctttttctgtcc

SEQ ID NO: 38905 - DNA, 25 bp, Homo sapien
caataagtgatacgtttttctgtcc

SEQ ID NO: 38906 - DNA, 25 bp, Homo sapien
caataatattacgcaccatttgtga

SEQ ID NO: 38907 - DNA, 25 bp, Homo sapien
caataatattatgcaccatttgtga

SEQ ID NO: 38908 - DNA, 25 bp, Homo sapien
caataatattctgcctattgctctc

SEQ ID NO: 38909 - DNA, 25 bp, Homo sapien
caataatattctgcgtattgctctc

SEQ ID NO: 38910 - DNA, 25 bp, Homo sapien
caataatgagtgacatgcctttgat

SEQ ID NO: 38911 - DNA, 25 bp, Homo sapien
caataatgagtggcatgcctttgat

SEQ ID NO: 38912 - DNA, 25 bp, Homo sapien
caataatgcatgacaaatggcctgt

SEQ ID NO: 38913 - DNA, 25 bp, Homo sapien
caataatgcatgataaatggcctgt

SEQ ID NO: 38914 - DNA, 25 bp, Homo sapien
caataatgcgctcaggagtgcagtc

SEQ ID NO: 38915 - DNA, 25 bp, Homo sapien
caataatgtgctcaggagtgcagtc

SEQ ID NO: 38916 - DNA, 25 bp, Homo sapien
caataattcccaagatgtttcagaa

SEQ ID NO: 38917 - DNA, 25 bp, Homo sapien
caataattcccaggatgtttcagaa

SEQ ID NO: 38918 - DNA, 25 bp, Homo sapien
caataattctatcattttgtcaaag

SEQ ID NO: 38919 - DNA, 25 bp, Homo sapien
caataattctatccttttgtcaaag

SEQ ID NO: 38920 - DNA, 25 bp, Homo sapien
caatacaaacttattgagcaatgtg

SEQ ID NO: 38921 - DNA, 25 bp, Homo sapien
caatacaaatttattgagcaatgtg

SEQ ID NO: 38922 - DNA, 25 bp, Homo sapien
caatacacagatgctctcctattta

SEQ ID NO: 38923 - DNA, 25 bp, Homo sapien
caatacacagatgttctcctattta

SEQ ID NO: 38924 - DNA, 25 bp, Homo sapien
caatacacttgaccgggccaggtcc

SEQ ID NO: 38925 - DNA, 25 bp, Homo sapien
caatacacttgactgggccaggtcc

SEQ ID NO: 38926 - DNA, 25 bp, Homo sapien
caatacaggactgaaggacaaacag

SEQ ID NO: 38927 - DNA, 25 bp, Homo sapien
caatacagggctgaaggacaaacag

SEQ ID NO: 38928 - DNA, 25 bp, Homo sapien
caatacatacagactttttgtgtgg

SEQ ID NO: 38929 - DNA, 25 bp, Homo sapien
caatacatacagattttttgtgtgg

SEQ ID NO: 38930 - DNA, 25 bp, Homo sapien
caataccaacaggagcaagaagttt

SEQ ID NO: 38931 - DNA, 25 bp, Homo sapien
caataccaacaggggcaagaagttt

SEQ ID NO: 38932 - DNA, 25 bp, Homo sapien
caataccacttcaatgcatactgta

SEQ ID NO: 38933 - DNA, 25 bp, Homo sapien
caataccacttcgatgcatactgta

SEQ ID NO: 38934 - DNA, 25 bp, Homo sapien
caataccaggaaccagacagcagaa

SEQ ID NO: 38935 - DNA, 25 bp, Homo sapien
caataccaggaaccaggcagcagaa

SEQ ID NO: 38936 - DNA, 25 bp, Homo sapien
caataccagtagcaagtcagtttct

SEQ ID NO: 38937 - DNA, 25 bp, Homo sapien
caataccagtatcaagtcagtttct

SEQ ID NO: 38938 - DNA, 25 bp, Homo sapien
caataccagtgatatacgagggctg

SEQ ID NO: 38939 - DNA, 25 bp, Homo sapien
caataccagtgatatatgagggctg

SEQ ID NO: 38940 - DNA, 25 bp, Homo sapien
caatacccagacaaaaacaaacata

SEQ ID NO: 38941 - DNA, 25 bp, Homo sapien
caatacccagacacaaacaaacata

SEQ ID NO: 38942 - DNA, 25 bp, Homo sapien
caataccctttcagaggagactgta

SEQ ID NO: 38943 - DNA, 25 bp, Homo sapien
caataccctttcggaggagactgta

SEQ ID NO: 38944 - DNA, 25 bp, Homo sapien
caatacgcttttcaaactttttgtg

SEQ ID NO: 38945 - DNA, 25 bp, Homo sapien
caatacgcttttcatactttttgtg

SEQ ID NO: 38946 - DNA, 25 bp, Homo sapien
caatacgtgcacaacgggacataga

SEQ ID NO: 38947 - DNA, 25 bp, Homo sapien
caatacgtgcacaatgggacataga

SEQ ID NO: 38948 - DNA, 25 bp, Homo sapien
caatactaaatagttctcacccatt

SEQ ID NO: 38949 - DNA, 25 bp, Homo sapien
caatactaagtagttctcacccatt

SEQ ID NO: 38950 - DNA, 25 bp, Homo sapien
caatactactactctgaatttgaga

SEQ ID NO: 38951 - DNA, 25 bp, Homo sapien
caatactactactttgaatttgaga

SEQ ID NO: 38952 - DNA, 25 bp, Homo sapien
caatactatttacattaacaccaaa

SEQ ID NO: 38953 - DNA, 25 bp, Homo sapien
caatactatttacgttaacaccaaa

SEQ ID NO: 38954 - DNA, 25 bp, Homo sapien
caatactcatcatatcagtgattgg

SEQ ID NO: 38955 - DNA, 25 bp, Homo sapien
caatactcatcgtatcagtgattgg

SEQ ID NO: 38956 - DNA, 25 bp, Homo sapien
caatactttttcagctctgaagttt

SEQ ID NO: 38957 - DNA, 25 bp, Homo sapien
caatactttttcagttctgaagttt

SEQ ID NO: 38958 - DNA, 25 bp, Homo sapien
caatagaactgcattaaattatttc

SEQ ID NO: 38959 - DNA, 25 bp, Homo sapien
caatagaactgcgttaaattatttc

SEQ ID NO: 38960 - DNA, 25 bp, Homo sapien
caatagaagacatccataggagatc

SEQ ID NO: 38961 - DNA, 25 bp, Homo sapien
caatagaaggcatccataggagatc

SEQ ID NO: 38962 - DNA, 25 bp, Homo sapien
caatagagctacgagtctctgtatt

SEQ ID NO: 38963 - DNA, 25 bp, Homo sapien
caatagagctacgcgtctctgtatt

SEQ ID NO: 38964 - DNA, 25 bp, Homo sapien
caatagagttgacaggataattagc

SEQ ID NO: 38965 - DNA, 25 bp, Homo sapien
caatagagttgataggataattagc

SEQ ID NO: 38966 - DNA, 25 bp, Homo sapien
caatagcagggtctttctgcagaca

SEQ ID NO: 38967 - DNA, 25 bp, Homo sapien
caatagcagggtctttgtgcagaca

SEQ ID NO: 38968 - DNA, 25 bp, Homo sapien
caatagccatgatgactactggagg

SEQ ID NO: 38969 - DNA, 25 bp, Homo sapien
caatagccgtgatgactactggagg

SEQ ID NO: 38970 - DNA, 25 bp, Homo sapien
caatagctatacgttggatgacatt

SEQ ID NO: 38971 - DNA, 25 bp, Homo sapien
caatagctatatgttggatgacatt

SEQ ID NO: 38972 - DNA, 25 bp, Homo sapien
caatagctcaagaaatgctgttata

SEQ ID NO: 38973 - DNA, 25 bp, Homo sapien
caatagctcaagaagtgctgttata

SEQ ID NO: 38974 - DNA, 25 bp, Homo sapien
caataggacactcagctaatgactt

SEQ ID NO: 38975 - DNA, 25 bp, Homo sapien
caataggacgctcagctaatgactt

SEQ ID NO: 38976 - DNA, 25 bp, Homo sapien
caataggatttactagaattagtgg

SEQ ID NO: 38977 - DNA, 25 bp, Homo sapien
caataggatttcctagaattagtgg

SEQ ID NO: 38978 - DNA, 25 bp, Homo sapien
caataggcttattcagcggcagccc

SEQ ID NO: 38979 - DNA, 25 bp, Homo sapien
caataggcttattcagtggcagccc

SEQ ID NO: 38980 - DNA, 25 bp, Homo sapien
caataggttaaatgtgattacaatg

SEQ ID NO: 38981 - DNA, 25 bp, Homo sapien
caataggttcaatgtgattacaatg

SEQ ID NO: 38982 - DNA, 25 bp, Homo sapien
caatagtaactatccaggatgaaac

SEQ ID NO: 38983 - DNA, 25 bp, Homo sapien
caatagtagctatccaggatgaaac

SEQ ID NO: 38984 - DNA, 25 bp, Homo sapien
caatatacagagaaatttttaggct

SEQ ID NO: 38985 - DNA, 25 bp, Homo sapien
caatatacagataaatttttaggct

SEQ ID NO: 38986 - DNA, 25 bp, Homo sapien
caatatacgcggaatgtcttaaatg

SEQ ID NO: 38987 - DNA, 25 bp, Homo sapien
caatatacgtggaatgtcttaaatg

SEQ ID NO: 38988 - DNA, 25 bp, Homo sapien
caatatcaggttaccgtcaacatta

SEQ ID NO: 38989 - DNA, 25 bp, Homo sapien
caatatcaggttagcgtcaacatta

SEQ ID NO: 38990 - DNA, 25 bp, Homo sapien
caatatccagggttacttctagccc

SEQ ID NO: 38991 - DNA, 25 bp, Homo sapien
caatatccagggttccttctagccc

SEQ ID NO: 38992 - DNA, 25 bp, Homo sapien
caatatcttctaaataatccaccca

SEQ ID NO: 38993 - DNA, 25 bp, Homo sapien
caatatcttctaaatactccaccca

SEQ ID NO: 38994 - DNA, 25 bp, Homo sapien
caatatgaaatgctctttcagaggc

SEQ ID NO: 38995 - DNA, 25 bp, Homo sapien
caatatgaaatggtctttcagaggc

SEQ ID NO: 38996 - DNA, 25 bp, Homo sapien
caatatgaagatttttaaggcttct

SEQ ID NO: 38997 - DNA, 25 bp, Homo sapien
caatatgacatctatacacacaaag

SEQ ID NO: 38998 - DNA, 25 bp, Homo sapien
caatatgacatctatatacacaaag

SEQ ID NO: 38999 - DNA, 25 bp, Homo sapien
caatatgaggatttttaaggcttct

SEQ ID NO: 39000 - DNA, 25 bp, Homo sapien
caatatgcactttccttaataaaaa

SEQ ID NO: 39001 - DNA, 25 bp, Homo sapien
caatatgcactttcgttaataaaaa

SEQ ID NO: 39002 - DNA, 25 bp, Homo sapien
caatatggattttgataaggattgt

SEQ ID NO: 39003 - DNA, 25 bp, Homo sapien
caatatggattttgttaaggattgt

SEQ ID NO: 39004 - DNA, 25 bp, Homo sapien
caatatgttcagtgccttgaaataa

SEQ ID NO: 39005 - DNA, 25 bp, Homo sapien
caatatgttcagtgtcttgaaataa

SEQ ID NO: 39006 - DNA, 25 bp, Homo sapien
caatattcagtctccaaaaagcaaa

SEQ ID NO: 39007 - DNA, 25 bp, Homo sapien
caatattcagtctccagaaagcaaa

SEQ ID NO: 39008 - DNA, 25 bp, Homo sapien
caatattctcaacacggcaatgatt

SEQ ID NO: 39009 - DNA, 25 bp, Homo sapien
caatattctcaacatggcaatgatt

SEQ ID NO: 39010 - DNA, 25 bp, Homo sapien
caatattgaaaagcagattccaaag

SEQ ID NO: 39011 - DNA, 25 bp, Homo sapien
caatattgaaaagcaggttccaaag

SEQ ID NO: 39012 - DNA, 25 bp, Homo sapien
caatattgtcatcagtcacttggag

SEQ ID NO: 39013 - DNA, 25 bp, Homo sapien
caatattgtcatcagttacttggag

SEQ ID NO: 39014 - DNA, 25 bp, Homo sapien
caatatttaagcgtacaattcagca

SEQ ID NO: 39015 - DNA, 25 bp, Homo sapien
caatatttaagtgtacaattcagca

SEQ ID NO: 39016 - DNA, 25 bp, Homo sapien
caatatttatcacgtcttggtgttt

SEQ ID NO: 39017 - DNA, 25 bp, Homo sapien
caatatttatcatgtcttggtgttt

SEQ ID NO: 39018 - DNA, 25 bp, Homo sapien
caatatttatgactgcctggtagat

SEQ ID NO: 39019 - DNA, 25 bp, Homo sapien
caatatttctgactgcctggtagat

SEQ ID NO: 39020 - DNA, 25 bp, Homo sapien
caatatttgaactaacataaagaat

SEQ ID NO: 39021 - DNA, 25 bp, Homo sapien
caatatttgaactgacataaagaat

SEQ ID NO: 39022 - DNA, 25 bp, Homo sapien
caatcaaaccttcttcctttataaa

SEQ ID NO: 39023 - DNA, 25 bp, Homo sapien
caatcaaacctttttcctttataaa

SEQ ID NO: 39024 - DNA, 25 bp, Homo sapien
caatcaaaggtaaccaactatccga

SEQ ID NO: 39025 - DNA, 25 bp, Homo sapien
caatcaaaggtaaccagctatccga

SEQ ID NO: 39026 - DNA, 25 bp, Homo sapien
caatcaaatgtcagtaaacaataaa

SEQ ID NO: 39027 - DNA, 25 bp, Homo sapien
caatcaaatttcagtaaacaataaa

SEQ ID NO: 39028 - DNA, 25 bp, Homo sapien
caatcaactccgttaatttcagagc

SEQ ID NO: 39029 - DNA, 25 bp, Homo sapien
caatcaactcctttaatttcagagc

SEQ ID NO: 39030 - DNA, 25 bp, Homo sapien
caatcaagaagacgctaaaaggata

SEQ ID NO: 39031 - DNA, 25 bp, Homo sapien
caatcaagaagatgctaaaaggata

SEQ ID NO: 39032 - DNA, 25 bp, Homo sapien
caatcaagtgaattctagccactta

SEQ ID NO: 39033 - DNA, 25 bp, Homo sapien
caatcaagtgaattttagccactta

SEQ ID NO: 39034 - DNA, 25 bp, Homo sapien
caatcaatgtcagttacgacttatg

SEQ ID NO: 39035 - DNA, 25 bp, Homo sapien
caatcaatgtcagttaggacttatg

SEQ ID NO: 39036 - DNA, 25 bp, Homo sapien
caatcacaggagtctatcacagttt

SEQ ID NO: 39037 - DNA, 25 bp, Homo sapien
caatcacaggagtttatcacagttt

SEQ ID NO: 39038 - DNA, 25 bp, Homo sapien
caatcagacagcttatcttcagctc

SEQ ID NO: 39039 - DNA, 25 bp, Homo sapien
caatcagacagcttattttcagctc

SEQ ID NO: 39040 - DNA, 25 bp, Homo sapien
caatcagccacaagctttcatatca

SEQ ID NO: 39041 - DNA, 25 bp, Homo sapien
caatcagcccggaacttctgatgaa

SEQ ID NO: 39042 - DNA, 25 bp, Homo sapien
caatcagcccggagcttctgatgaa

SEQ ID NO: 39043 - DNA, 25 bp, Homo sapien
caatcagccgcaagctttcatatca

SEQ ID NO: 39044 - DNA, 25 bp, Homo sapien
caatcagggcacgatctgtctccaa

SEQ ID NO: 39045 - DNA, 25 bp, Homo sapien
caatcagggcaggatctgtctccaa

SEQ ID NO: 39046 - DNA, 25 bp, Homo sapien
caatcaggtggcgaacatcccgtcc

SEQ ID NO: 39047 - DNA, 25 bp, Homo sapien
caatcaggtggtgaacatcccgtcc

SEQ ID NO: 39048 - DNA, 25 bp, Homo sapien
caatcagtgctcaatggaatcccgt

SEQ ID NO: 39049 - DNA, 25 bp, Homo sapien
caatcagtgctcagtggaatcccgt

SEQ ID NO: 39050 - DNA, 25 bp, Homo sapien
caatcataaagacggtaaagagtct

SEQ ID NO: 39051 - DNA, 25 bp, Homo sapien
caatcataaagatggtaaagagtct

SEQ ID NO: 39052 - DNA, 25 bp, Homo sapien
caatcataatcaaaaagcatcatct

SEQ ID NO: 39053 - DNA, 25 bp, Homo sapien
caatcataatccaaaagcatcatct

SEQ ID NO: 39054 - DNA, 25 bp, Homo sapien
caatcatcagtagcacgcaccccca

SEQ ID NO: 39055 - DNA, 25 bp, Homo sapien
caatcatcggtagcacgcaccccca

SEQ ID NO: 39056 - DNA, 25 bp, Homo sapien
caatcatctgaatccatgcagaaaa

SEQ ID NO: 39057 - DNA, 25 bp, Homo sapien
caatcatctgaatctatgcagaaaa

SEQ ID NO: 39058 - DNA, 25 bp, Homo sapien
caatcatggaatgctcagggatcag

SEQ ID NO: 39059 - DNA, 25 bp, Homo sapien
caatcatggaatggtcagggatcag

SEQ ID NO: 39060 - DNA, 25 bp, Homo sapien
caatcattatgaagcttcagcccag

SEQ ID NO: 39061 - DNA, 25 bp, Homo sapien
caatcattgtgaagcttcagcccag

SEQ ID NO: 39062 - DNA, 25 bp, Homo sapien
caatccaaaaatagaccctaggttt

SEQ ID NO: 39063 - DNA, 25 bp, Homo sapien
caatccaaaaataggccctaggttt

SEQ ID NO: 39064 - DNA, 25 bp, Homo sapien
caatccaaattatacctttgtgaat

SEQ ID NO: 39065 - DNA, 25 bp, Homo sapien
caatccaaattatatctttgtgaat

SEQ ID NO: 39066 - DNA, 25 bp, Homo sapien
caatccaacacagtaggtttcacta

SEQ ID NO: 39067 - DNA, 25 bp, Homo sapien
caatccaacacagtagttttcacta

SEQ ID NO: 39068 - DNA, 25 bp, Homo sapien
caatccaaggaggtccaacatccaa

SEQ ID NO: 39069 - DNA, 25 bp, Homo sapien
caatccaaggaggtccgacatccaa

SEQ ID NO: 39070 - DNA, 25 bp, Homo sapien
caatccacattaagataaggctggg

SEQ ID NO: 39071 - DNA, 25 bp, Homo sapien
caatccacattgagataaggctggg

SEQ ID NO: 39072 - DNA, 25 bp, Homo sapien
caatccactcggtgtccatcccgat

SEQ ID NO: 39073 - DNA, 25 bp, Homo sapien
caatccactgggtgtccatcccgat

SEQ ID NO: 39074 - DNA, 25 bp, Homo sapien
caatccagaaaacttgctaaaagtg

SEQ ID NO: 39075 - DNA, 25 bp, Homo sapien
caatccagaaagcttgctaaaagtg

SEQ ID NO: 39076 - DNA, 25 bp, Homo sapien
caatccatgtgcgcagaactcagaa

SEQ ID NO: 39077 - DNA, 25 bp, Homo sapien
caatccatgtgtgcagaactcagaa

SEQ ID NO: 39078 - DNA, 25 bp, Homo sapien
caatccattaaacttctcctggcta

SEQ ID NO: 39079 - DNA, 25 bp, Homo sapien
caatccattaatcttctcctggcta

SEQ ID NO: 39080 - DNA, 25 bp, Homo sapien
caatcccaacttcgttccactacag

SEQ ID NO: 39081 - DNA, 25 bp, Homo sapien
caatcccaactttgttccactacag

SEQ ID NO: 39082 - DNA, 25 bp, Homo sapien
caatcccaatagtttcttgatctat

SEQ ID NO: 39083 - DNA, 25 bp, Homo sapien
caatcccagtagtttcttgatctat

SEQ ID NO: 39084 - DNA, 25 bp, Homo sapien
caatcctctctcaaaaaaaatcaat

SEQ ID NO: 39085 - DNA, 25 bp, Homo sapien
caatcctctcttaaaaaaaatcaat

SEQ ID NO: 39086 - DNA, 25 bp, Homo sapien
caatcctttccacaaattaccatgc

SEQ ID NO: 39087 - DNA, 25 bp, Homo sapien
caatcctttccataaattaccatgc

SEQ ID NO: 39088 - DNA, 25 bp, Homo sapien
caatcgccctaaagaatgatttttt

SEQ ID NO: 39089 - DNA, 25 bp, Homo sapien
caatcgccttaaagaatgatttttt

SEQ ID NO: 39090 - DNA, 25 bp, Homo sapien
caatctaaaatagtcatgttcttag

SEQ ID NO: 39091 - DNA, 25 bp, Homo sapien
caatctaaacagtcccatgagtaag

SEQ ID NO: 39092 - DNA, 25 bp, Homo sapien
caatctaaacagtcccgtgagtaag

SEQ ID NO: 39093 - DNA, 25 bp, Homo sapien
caatctaaactagtcatgttcttag

SEQ ID NO: 39094 - DNA, 25 bp, Homo sapien
caatctaacgccactggtaagctca

SEQ ID NO: 39095 - DNA, 25 bp, Homo sapien
caatctaatgccactggtaagctca

SEQ ID NO: 39096 - DNA, 25 bp, Homo sapien
caatctaatttcattgaaagtctcc

SEQ ID NO: 39097 - DNA, 25 bp, Homo sapien
caatctaatttcattggaagtctcc

SEQ ID NO: 39098 - DNA, 25 bp, Homo sapien
caatctacaaagtgctgaaacaaat

SEQ ID NO: 39099 - DNA, 25 bp, Homo sapien
caatctacagagtgctgaaacaaat

SEQ ID NO: 39100 - DNA, 25 bp, Homo sapien
caatctacatgacagggatgttgca

SEQ ID NO: 39101 - DNA, 25 bp, Homo sapien
caatctacgtgacagggatgttgca

SEQ ID NO: 39102 - DNA, 25 bp, Homo sapien
caatctagggtgctatatgcttagg

SEQ ID NO: 39103 - DNA, 25 bp, Homo sapien
caatctagggtggtatatgcttagg

SEQ ID NO: 39104 - DNA, 25 bp, Homo sapien
caatctgaactagaacctcacatat

SEQ ID NO: 39105 - DNA, 25 bp, Homo sapien
caatctgagagcattgttaggagag

SEQ ID NO: 39106 - DNA, 25 bp, Homo sapien
caatctgagagcgttgttaggagag

SEQ ID NO: 39107 - DNA, 25 bp, Homo sapien
caatctgagctagaacctcacatat

SEQ ID NO: 39108 - DNA, 25 bp, Homo sapien
caatctgcaacaagaaacattgtcc

SEQ ID NO: 39109 - DNA, 25 bp, Homo sapien
caatctgcaacaagaatcattgtcc

SEQ ID NO: 39110 - DNA, 25 bp, Homo sapien
caatctgtcactactggccagaaca

SEQ ID NO: 39111 - DNA, 25 bp, Homo sapien
caatctgtcactattggccagaaca

SEQ ID NO: 39112 - DNA, 25 bp, Homo sapien
caatctgtgcaacaggatatgtcct

SEQ ID NO: 39113 - DNA, 25 bp, Homo sapien
caatctgtgcaataggatatgtcct

SEQ ID NO: 39114 - DNA, 25 bp, Homo sapien
caatctgtgcagaagaaagtaacta

SEQ ID NO: 39115 - DNA, 25 bp, Homo sapien
caatctgtgcaggagaaagtaacta

SEQ ID NO: 39116 - DNA, 25 bp, Homo sapien
caatcttcatttgggagtatcagga

SEQ ID NO: 39117 - DNA, 25 bp, Homo sapien
caatcttcgtttgggagtatcagga

SEQ ID NO: 39118 - DNA, 25 bp, Homo sapien
caatcttttaccagaactttgaata

SEQ ID NO: 39119 - DNA, 25 bp, Homo sapien
caatcttttaccagcactttgaata

SEQ ID NO: 39120 - DNA, 25 bp, Homo sapien
caatgaaagtcctttgagaaaaaca

SEQ ID NO: 39121 - DNA, 25 bp, Homo sapien
caatgaaagtcctttgggaaaaaca

SEQ ID NO: 39122 - DNA, 25 bp, Homo sapien
caatgaaatatctatgcaaatcagc

SEQ ID NO: 39123 - DNA, 25 bp, Homo sapien
caatgaaatcacataaaccttagca

SEQ ID NO: 39124 - DNA, 25 bp, Homo sapien
caatgaaatcacatcaaccttagca

SEQ ID NO: 39125 - DNA, 25 bp, Homo sapien
caatgaaatgtctatgcaaatcagc

SEQ ID NO: 39126 - DNA, 25 bp, Homo sapien
caatgaacagggtaagtataataat

SEQ ID NO: 39127 - DNA, 25 bp, Homo sapien
caatgaacatggtaagtataataat

SEQ ID NO: 39128 - DNA, 25 bp, Homo sapien
caatgaagaaagtttccaaggtgtc

SEQ ID NO: 39129 - DNA, 25 bp, Homo sapien
caatgaagacattggactgagtgat

SEQ ID NO: 39130 - DNA, 25 bp, Homo sapien
caatgaagatattggactgagtgat

SEQ ID NO: 39131 - DNA, 25 bp, Homo sapien
caatgaaggaagtttccaaggtgtc

SEQ ID NO: 39132 - DNA, 25 bp, Homo sapien
caatgaaggtacaaaaatgacctgt

SEQ ID NO: 39133 - DNA, 25 bp, Homo sapien
caatgaaggtaccaaaatgacctgt

SEQ ID NO: 39134 - DNA, 25 bp, Homo sapien
caatgaatacgacagcgacaactta

SEQ ID NO: 39135 - DNA, 25 bp, Homo sapien
caatgaatacgacggcgacaactta

SEQ ID NO: 39136 - DNA, 25 bp, Homo sapien
caatgaatctccacacaataaaaca

SEQ ID NO: 39137 - DNA, 25 bp, Homo sapien
caatgaatctctacacaataaaaca

SEQ ID NO: 39138 - DNA, 25 bp, Homo sapien
caatgaatgagattgaggttctctc

SEQ ID NO: 39139 - DNA, 25 bp, Homo sapien
caatgaatgcgattgaggttctctc

SEQ ID NO: 39140 - DNA, 25 bp, Homo sapien
caatgaatgtttacaacacattttc

SEQ ID NO: 39141 - DNA, 25 bp, Homo sapien
caatgaatgtttacgacacattttc

SEQ ID NO: 39142 - DNA, 25 bp, Homo sapien
caatgacaacactcactcaatgggt

SEQ ID NO: 39143 - DNA, 25 bp, Homo sapien
caatgacaacattcactcaatgggt

SEQ ID NO: 39144 - DNA, 25 bp, Homo sapien
caatgactcactcatgaaggataca

SEQ ID NO: 39145 - DNA, 25 bp, Homo sapien
caatgactcatacagtgagaaagtg

SEQ ID NO: 39146 - DNA, 25 bp, Homo sapien
caatgactcatatagtgagaaagtg

SEQ ID NO: 39147 - DNA, 25 bp, Homo sapien
caatgactcatgatgtaaaattgga

SEQ ID NO: 39148 - DNA, 25 bp, Homo sapien
caatgactcatgctgtaaaattgga

SEQ ID NO: 39149 - DNA, 25 bp, Homo sapien
caatgacttactcatgaaggataca

SEQ ID NO: 39150 - DNA, 25 bp, Homo sapien
caatgagaaaacgaaggcataaaaa

SEQ ID NO: 39151 - DNA, 25 bp, Homo sapien
caatgagaaaatgaaggcataaaaa

SEQ ID NO: 39152 - DNA, 25 bp, Homo sapien
caatgagatatatataagatagcat

SEQ ID NO: 39153 - DNA, 25 bp, Homo sapien
caatgagatatatatacgatagcat

SEQ ID NO: 39154 - DNA, 25 bp, Homo sapien
caatgaggagacacaatttaataaa

SEQ ID NO: 39155 - DNA, 25 bp, Homo sapien
caatgaggagacgcaatttaataaa

SEQ ID NO: 39156 - DNA, 25 bp, Homo sapien
caatgagtgttggtggatccaagtc

SEQ ID NO: 39157 - DNA, 25 bp, Homo sapien
caatgagtgttggttgatccaagtc

SEQ ID NO: 39158 - DNA, 25 bp, Homo sapien
caatgatagaacatcatccttccat

SEQ ID NO: 39159 - DNA, 25 bp, Homo sapien
caatgatagaacgtcatccttccat

SEQ ID NO: 39160 - DNA, 25 bp, Homo sapien
caatgatcctagcctaatgtgctat

SEQ ID NO: 39161 - DNA, 25 bp, Homo sapien
caatgatcctagcttaatgtgctat

SEQ ID NO: 39162 - DNA, 25 bp, Homo sapien
caatgatgtatcagaccattcatgt

SEQ ID NO: 39163 - DNA, 25 bp, Homo sapien
caatgatgtatctgaccattcatgt

SEQ ID NO: 39164 - DNA, 25 bp, Homo sapien
caatgattaaaaagactaaaaataa

SEQ ID NO: 39165 - DNA, 25 bp, Homo sapien
caatgattagaaagactaaaaataa

SEQ ID NO: 39166 - DNA, 25 bp, Homo sapien
caatgatttctaagcacctgtatct

SEQ ID NO: 39167 - DNA, 25 bp, Homo sapien
caatgatttgtaagcacctgtatct

SEQ ID NO: 39168 - DNA, 25 bp, Homo sapien
caatgcaccaagtggtcttcctaaa

SEQ ID NO: 39169 - DNA, 25 bp, Homo sapien
caatgcaccgagtggtcttcctaaa

SEQ ID NO: 39170 - DNA, 25 bp, Homo sapien
caatgcagaaacgacacaaagattc

SEQ ID NO: 39171 - DNA, 25 bp, Homo sapien
caatgcagaaactacacaaagattc

SEQ ID NO: 39172 - DNA, 25 bp, Homo sapien
caatgcagcatattaaaattgcctc

SEQ ID NO: 39173 - DNA, 25 bp, Homo sapien
caatgcagcgtattaaaattgcctc

SEQ ID NO: 39174 - DNA, 25 bp, Homo sapien
caatgccaaaacggaaagtcaagat

SEQ ID NO: 39175 - DNA, 25 bp, Homo sapien
caatgccaaaatggaaagtcaagat

SEQ ID NO: 39176 - DNA, 25 bp, Homo sapien
caatgcccagtctctgatgataagg

SEQ ID NO: 39177 - DNA, 25 bp, Homo sapien
caatgcccagtgtctgatgataagg

SEQ ID NO: 39178 - DNA, 25 bp, Homo sapien
caatgccttgccaatattgaaataa

SEQ ID NO: 39179 - DNA, 25 bp, Homo sapien
caatgccttgccagtattgaaataa

SEQ ID NO: 39180 - DNA, 25 bp, Homo sapien
caatgcggaaaacgctgccaagaca

SEQ ID NO: 39181 - DNA, 25 bp, Homo sapien
caatgcggaaaatgctgccaagaca

SEQ ID NO: 39182 - DNA, 25 bp, Homo sapien
caatgctattaccggttgagtatcc

SEQ ID NO: 39183 - DNA, 25 bp, Homo sapien
caatgctattactggttgagtatcc

SEQ ID NO: 39184 - DNA, 25 bp, Homo sapien
caatgctccaacgtggtcttctcat

SEQ ID NO: 39185 - DNA, 25 bp, Homo sapien
caatgctccaacttggtcttctcat

SEQ ID NO: 39186 - DNA, 25 bp, Homo sapien
caatgctgtaaataggagtcattaa

SEQ ID NO: 39187 - DNA, 25 bp, Homo sapien
caatgctgtaaatcggagtcattaa

SEQ ID NO: 39188 - DNA, 25 bp, Homo sapien
caatgcttcaaatacgttgtcatct

SEQ ID NO: 39189 - DNA, 25 bp, Homo sapien
caatgcttcaaatatgttgtcatct

SEQ ID NO: 39190 - DNA, 25 bp, Homo sapien
caatgcttggaaaggaagtttaagt

SEQ ID NO: 39191 - DNA, 25 bp, Homo sapien
caatgcttggaaatgaagtttaagt

SEQ ID NO: 39192 - DNA, 25 bp, Homo sapien
caatgcttgtcaattctgcctttaa

SEQ ID NO: 39193 - DNA, 25 bp, Homo sapien
caatgcttgtcagttctgcctttaa

SEQ ID NO: 39194 - DNA, 25 bp, Homo sapien
caatggaataggagcacggaggcca

SEQ ID NO: 39195 - DNA, 25 bp, Homo sapien
caatggaataggagcatggaggcca

SEQ ID NO: 39196 - DNA, 25 bp, Homo sapien
caatggagtctgccagatcaacaat

SEQ ID NO: 39197 - DNA, 25 bp, Homo sapien
caatggagtctgtcagatcaacaat

SEQ ID NO: 39198 - DNA, 25 bp, Homo sapien
caatggattgatatgattattgggc

SEQ ID NO: 39199 - DNA, 25 bp, Homo sapien
caatggattgatgtgattattgggc

SEQ ID NO: 39200 - DNA, 25 bp, Homo sapien
caatggcgtaacatcaccaggccac

SEQ ID NO: 39201 - DNA, 25 bp, Homo sapien
caatggcgtgacatcaccaggccac

SEQ ID NO: 39202 - DNA, 25 bp, Homo sapien
caatggcttatgtgacctatgagac

SEQ ID NO: 39203 - DNA, 25 bp, Homo sapien
caatggcttatgtgacttatgagac

SEQ ID NO: 39204 - DNA, 25 bp, Homo sapien
caatgggaccacataattgaagttg

SEQ ID NO: 39205 - DNA, 25 bp, Homo sapien
caatgggactacataattgaagttg

SEQ ID NO: 39206 - DNA, 25 bp, Homo sapien
caatggtaaagctccttggtctctg

SEQ ID NO: 39207 - DNA, 25 bp, Homo sapien
caatggtaaagctctttggtctctg

SEQ ID NO: 39208 - DNA, 25 bp, Homo sapien
caatggtaagatgttggactaagtt

SEQ ID NO: 39209 - DNA, 25 bp, Homo sapien
caatggtaagattttggactaagtt

SEQ ID NO: 39210 - DNA, 25 bp, Homo sapien
caatggtatgaaaatgtttaacact

SEQ ID NO: 39211 - DNA, 25 bp, Homo sapien
caatggtatgaatatgtttaacact

SEQ ID NO: 39212 - DNA, 25 bp, Homo sapien
caatggttgccagcatacactgtca

SEQ ID NO: 39213 - DNA, 25 bp, Homo sapien
caatggttgtcagcatacactgtca

SEQ ID NO: 39214 - DNA, 25 bp, Homo sapien
caatgtaacagcaagctctgctttc

SEQ ID NO: 39215 - DNA, 25 bp, Homo sapien
caatgtaacagcgagctctgctttc

SEQ ID NO: 39216 - DNA, 25 bp, Homo sapien
caatgtaattcttccggtgaattta

SEQ ID NO: 39217 - DNA, 25 bp, Homo sapien
caatgtaattcttctggtgaattta

SEQ ID NO: 39218 - DNA, 25 bp, Homo sapien
caatgtagaagagccaggtaatagc

SEQ ID NO: 39219 - DNA, 25 bp, Homo sapien
caatgtagaagatccaggtaatagc

SEQ ID NO: 39220 - DNA, 25 bp, Homo sapien
caatgtataaaccatttgggcactg

SEQ ID NO: 39221 - DNA, 25 bp, Homo sapien
caatgtatagaccatttgggcactg

SEQ ID NO: 39222 - DNA, 25 bp, Homo sapien
caatgtatttccagtgcagtgttct

SEQ ID NO: 39223 - DNA, 25 bp, Homo sapien
caatgtatttccggtgcagtgttct

SEQ ID NO: 39224 - DNA, 25 bp, Homo sapien
caatgtcactataagaagttgcttt

SEQ ID NO: 39225 - DNA, 25 bp, Homo sapien
caatgtcactataagaggttgcttt

SEQ ID NO: 39226 - DNA, 25 bp, Homo sapien
caatgtcagttacgacttatggata

SEQ ID NO: 39227 - DNA, 25 bp, Homo sapien
caatgtcagttaggacttatggata

SEQ ID NO: 39228 - DNA, 25 bp, Homo sapien
caatgtcgctggacaacgaaacact

SEQ ID NO: 39229 - DNA, 25 bp, Homo sapien
caatgtcgctggacaatgaaacact

SEQ ID NO: 39230 - DNA, 25 bp, Homo sapien
caatgtctccatgtttctttttgtt

SEQ ID NO: 39231 - DNA, 25 bp, Homo sapien
caatgtctccatttttctttttgtt

SEQ ID NO: 39232 - DNA, 25 bp, Homo sapien
caatgtctcccaaatttataaagac

SEQ ID NO: 39233 - DNA, 25 bp, Homo sapien
caatgtctcccagatttataaagac

SEQ ID NO: 39234 - DNA, 25 bp, Homo sapien
caatgtgaaaaggtgggaagacttg

SEQ ID NO: 39235 - DNA, 25 bp, Homo sapien
caatgtgaaaagttgggaagacttg

SEQ ID NO: 39236 - DNA, 25 bp, Homo sapien
caatgtgactccaagctagttccct

SEQ ID NO: 39237 - DNA, 25 bp, Homo sapien
caatgtgactccgagctagttccct

SEQ ID NO: 39238 - DNA, 25 bp, Homo sapien
caatgtgccatatccaatcgtgttc

SEQ ID NO: 39239 - DNA, 25 bp, Homo sapien
caatgtgccatatccagtcgtgttc

SEQ ID NO: 39240 - DNA, 25 bp, Homo sapien
caatgtgctcaagcatttaaagaaa

SEQ ID NO: 39241 - DNA, 25 bp, Homo sapien
caatgtgctcaaggatttaaagaaa

SEQ ID NO: 39242 - DNA, 25 bp, Homo sapien
caatgtggagaattttttaggacaa

SEQ ID NO: 39243 - DNA, 25 bp, Homo sapien
caatgtggagatttttttaggacaa

SEQ ID NO: 39244 - DNA, 25 bp, Homo sapien
caatgtgttgtcattacaggactgt

SEQ ID NO: 39245 - DNA, 25 bp, Homo sapien
caatgtgttgtcgttacaggactgt

SEQ ID NO: 39246 - DNA, 25 bp, Homo sapien
caatgttacataaaaggaatcacat

SEQ ID NO: 39247 - DNA, 25 bp, Homo sapien
caatgttacgtaaaaggaatcacat

SEQ ID NO: 39248 - DNA, 25 bp, Homo sapien
caatgttctaaattcgtcgtgcgat

SEQ ID NO: 39249 - DNA, 25 bp, Homo sapien
caatgttctaaatttgtcgtgcgat

SEQ ID NO: 39250 - DNA, 25 bp, Homo sapien
caatgttctaacagttcaaattaag

SEQ ID NO: 39251 - DNA, 25 bp, Homo sapien
caatgttctaatagttcaaattaag

SEQ ID NO: 39252 - DNA, 25 bp, Homo sapien
caatgttggtttcaatgtttgattt

SEQ ID NO: 39253 - DNA, 25 bp, Homo sapien
caatgttggtttcagtgtttgattt

SEQ ID NO: 39254 - DNA, 25 bp, Homo sapien
caatgtttatcagcaatattggcct

SEQ ID NO: 39255 - DNA, 25 bp, Homo sapien
caatgtttatcaggaatattggcct

SEQ ID NO: 39256 - DNA, 25 bp, Homo sapien
caatgtttcaatcgctaaaaccaag

SEQ ID NO: 39257 - DNA, 25 bp, Homo sapien
caatgtttcaattgctaaaaccaag

SEQ ID NO: 39258 - DNA, 25 bp, Homo sapien
caatgtttcagtgagtacacagtca

SEQ ID NO: 39259 - DNA, 25 bp, Homo sapien
caatgtttcagtgcgtacacagtca

SEQ ID NO: 39260 - DNA, 25 bp, Homo sapien
caattaaaacctcggtggtgaagat

SEQ ID NO: 39261 - DNA, 25 bp, Homo sapien
caattaaaaccttggtggtgaagat

SEQ ID NO: 39262 - DNA, 25 bp, Homo sapien
caattaaacttcactgctttcaaag

SEQ ID NO: 39263 - DNA, 25 bp, Homo sapien
caattaaacttcagtgctttcaaag

SEQ ID NO: 39264 - DNA, 25 bp, Homo sapien
caattaatgtaaactaccaaatcaa

SEQ ID NO: 39265 - DNA, 25 bp, Homo sapien
caattaatgtaatctaccaaatcaa

SEQ ID NO: 39266 - DNA, 25 bp, Homo sapien
caattacacccatctgtggaaaatt

SEQ ID NO: 39267 - DNA, 25 bp, Homo sapien
caattacacccgtctgtggaaaatt

SEQ ID NO: 39268 - DNA, 25 bp, Homo sapien
caattacactggcacaacatacatt

SEQ ID NO: 39269 - DNA, 25 bp, Homo sapien
caattacactggcacaccatacatt

SEQ ID NO: 39270 - DNA, 25 bp, Homo sapien
caattacagccgtgtaagacatttt

SEQ ID NO: 39271 - DNA, 25 bp, Homo sapien
caattacagccgtttaagacatttt

SEQ ID NO: 39272 - DNA, 25 bp, Homo sapien
caattacaggcttatttttagagac

SEQ ID NO: 39273 - DNA, 25 bp, Homo sapien
caattacaggcttgtttttagagac

SEQ ID NO: 39274 - DNA, 25 bp, Homo sapien
caattacatttttcaaagtgcacac

SEQ ID NO: 39275 - DNA, 25 bp, Homo sapien
caattacatttttgaaagtgcacac

SEQ ID NO: 39276 - DNA, 25 bp, Homo sapien
caattacctggtggcaaattgatta

SEQ ID NO: 39277 - DNA, 25 bp, Homo sapien
caattacctggtggcagattgatta

SEQ ID NO: 39278 - DNA, 25 bp, Homo sapien
caattactttgtgacttccatatgc

SEQ ID NO: 39279 - DNA, 25 bp, Homo sapien
caattactttgtgtcttccatatgc

SEQ ID NO: 39280 - DNA, 25 bp, Homo sapien
caattagaaaaccagtagtaggcaa

SEQ ID NO: 39281 - DNA, 25 bp, Homo sapien
caattagaaaaccggtagtaggcaa

SEQ ID NO: 39282 - DNA, 25 bp, Homo sapien
caattagacctcatcacttttcccc

SEQ ID NO: 39283 - DNA, 25 bp, Homo sapien
caattagacctcatcagttttcccc

SEQ ID NO: 39284 - DNA, 25 bp, Homo sapien
caattagagaatgaatgcctaggtc

SEQ ID NO: 39285 - DNA, 25 bp, Homo sapien
caattagaggatgaatgcctaggtc

SEQ ID NO: 39286 - DNA, 25 bp, Homo sapien
caattagccgaacacgtagcccagt

SEQ ID NO: 39287 - DNA, 25 bp, Homo sapien
caattagctgaacacgtagcccagt

SEQ ID NO: 39288 - DNA, 25 bp, Homo sapien
caattaggactacagtttcttgatg

SEQ ID NO: 39289 - DNA, 25 bp, Homo sapien
caattaggactatagtttcttgatg

SEQ ID NO: 39290 - DNA, 25 bp, Homo sapien
caattagtggagactttaatagaaa

SEQ ID NO: 39291 - DNA, 25 bp, Homo sapien
caattagtggagattttaatagaaa

SEQ ID NO: 39292 - DNA, 25 bp, Homo sapien
caattataatccatttctcataccc

SEQ ID NO: 39293 - DNA, 25 bp, Homo sapien
caattatagaacaaaatttaagaaa

SEQ ID NO: 39294 - DNA, 25 bp, Homo sapien
caattatagaaccaaatttaagaaa

SEQ ID NO: 39295 - DNA, 25 bp, Homo sapien
caattatagtccatttctcataccc

SEQ ID NO: 39296 - DNA, 25 bp, Homo sapien
caattatgaaatctgtggagcttga

SEQ ID NO: 39297 - DNA, 25 bp, Homo sapien
caattatgaaatttgtggagcttga

SEQ ID NO: 39298 - DNA, 25 bp, Homo sapien
caattattgaggtcaaatgaactgt

SEQ ID NO: 39299 - DNA, 25 bp, Homo sapien
caattattgaggtcaactgaactgt

SEQ ID NO: 39300 - DNA, 25 bp, Homo sapien
caattatttgaacctgtcttttttt

SEQ ID NO: 39301 - DNA, 25 bp, Homo sapien
caattatttgaacttgtcttttttt

SEQ ID NO: 39302 - DNA, 25 bp, Homo sapien
caattcacacggcaaaacctagaaa

SEQ ID NO: 39303 - DNA, 25 bp, Homo sapien
caattcacatggcaaaacctagaaa

SEQ ID NO: 39304 - DNA, 25 bp, Homo sapien
caattcagcatacccagtttaagtg

SEQ ID NO: 39305 - DNA, 25 bp, Homo sapien
caattcagtatacccagtttaagtg

SEQ ID NO: 39306 - DNA, 25 bp, Homo sapien
caattcagttagaacagagtgctga

SEQ ID NO: 39307 - DNA, 25 bp, Homo sapien
caattcagttagaccagagtgctga

SEQ ID NO: 39308 - DNA, 25 bp, Homo sapien
caattcagttgtgatagctccttga

SEQ ID NO: 39309 - DNA, 25 bp, Homo sapien
caattcagttgtgatatctccttga

SEQ ID NO: 39310 - DNA, 25 bp, Homo sapien
caattcatacctagagagctcagta

SEQ ID NO: 39311 - DNA, 25 bp, Homo sapien
caattcatacctagcgagctcagta

SEQ ID NO: 39312 - DNA, 25 bp, Homo sapien
caattcatgcttcgttgaatccaca

SEQ ID NO: 39313 - DNA, 25 bp, Homo sapien
caattcatgcttggttgaatccaca

SEQ ID NO: 39314 - DNA, 25 bp, Homo sapien
caattccaacggctcagagcaaaac

SEQ ID NO: 39315 - DNA, 25 bp, Homo sapien
caattccaagggctcagagcaaaac

SEQ ID NO: 39316 - DNA, 25 bp, Homo sapien
caattccacgaaaaaaatatgctac

SEQ ID NO: 39317 - DNA, 25 bp, Homo sapien
caattccagcacgtctcaattcaga

SEQ ID NO: 39318 - DNA, 25 bp, Homo sapien
caattccagcatgtctcaattcaga

SEQ ID NO: 39319 - DNA, 25 bp, Homo sapien
caattccatgaaaaaaatatgctac

SEQ ID NO: 39320 - DNA, 25 bp, Homo sapien
caattcgacggttagttattcagcc

SEQ ID NO: 39321 - DNA, 25 bp, Homo sapien
caattcgatggttagttattcagcc

SEQ ID NO: 39322 - DNA, 25 bp, Homo sapien
caattctaccacgtcaatattatct

SEQ ID NO: 39323 - DNA, 25 bp, Homo sapien
caattctaccatgtcaatattatct

SEQ ID NO: 39324 - DNA, 25 bp, Homo sapien
caattctgctgaacgggataataat

SEQ ID NO: 39325 - DNA, 25 bp, Homo sapien
caattctgttcccagagaaatgaaa

SEQ ID NO: 39326 - DNA, 25 bp, Homo sapien
caattctgttcctagagaaatgaaa

SEQ ID NO: 39327 - DNA, 25 bp, Homo sapien
caattctgttgaacgggataataat

SEQ ID NO: 39328 - DNA, 25 bp, Homo sapien
caattctgttgtacttacatggagt

SEQ ID NO: 39329 - DNA, 25 bp, Homo sapien
caattctgttgttcttacatggagt

SEQ ID NO: 39330 - DNA, 25 bp, Homo sapien
caattcttgtcctcatacacttttg

SEQ ID NO: 39331 - DNA, 25 bp, Homo sapien
caattcttgtcctcgtacacttttg

SEQ ID NO: 39332 - DNA, 25 bp, Homo sapien
caattctttcgggtaaatactcaga

SEQ ID NO: 39333 - DNA, 25 bp, Homo sapien
caattctttcttaaactacaaaagc

SEQ ID NO: 39334 - DNA, 25 bp, Homo sapien
caattctttcttgaactacaaaagc

SEQ ID NO: 39335 - DNA, 25 bp, Homo sapien
caattcttttgggtaaatactcaga

SEQ ID NO: 39336 - DNA, 25 bp, Homo sapien
caattctttttacatacttggttgc

SEQ ID NO: 39337 - DNA, 25 bp, Homo sapien
caattctttttacatagttggttgc

SEQ ID NO: 39338 - DNA, 25 bp, Homo sapien
caattgaatatggtcaattggcatc

SEQ ID NO: 39339 - DNA, 25 bp, Homo sapien
caattgaatatgttcaattggcatc

SEQ ID NO: 39340 - DNA, 25 bp, Homo sapien
caattgaatgaaggctttgtggaaa

SEQ ID NO: 39341 - DNA, 25 bp, Homo sapien
caattgaatgatggctttgtggaaa

SEQ ID NO: 39342 - DNA, 25 bp, Homo sapien
caattgaccaactgtgcgtggaatc

SEQ ID NO: 39343 - DNA, 25 bp, Homo sapien
caattgaccgactgtgcgtggaatc

SEQ ID NO: 39344 - DNA, 25 bp, Homo sapien
caattgattcgaaaacctgtgtaat

SEQ ID NO: 39345 - DNA, 25 bp, Homo sapien
caattgatttgaaaacctgtgtaat

SEQ ID NO: 39346 - DNA, 25 bp, Homo sapien
caattgcaatgattcaagagggaga

SEQ ID NO: 39347 - DNA, 25 bp, Homo sapien
caattgcaatgattcaggagggaga

SEQ ID NO: 39348 - DNA, 25 bp, Homo sapien
caattgcacaggacaaactcaatca

SEQ ID NO: 39349 - DNA, 25 bp, Homo sapien
caattgcacaggacaagctcaatca

SEQ ID NO: 39350 - DNA, 25 bp, Homo sapien
caattgcatcagcaaataattatta

SEQ ID NO: 39351 - DNA, 25 bp, Homo sapien
caattgcatcagtaaataattatta

SEQ ID NO: 39352 - DNA, 25 bp, Homo sapien
caattgcattgctccatagctgttc

SEQ ID NO: 39353 - DNA, 25 bp, Homo sapien
caattgcattgttccatagctgttc

SEQ ID NO: 39354 - DNA, 25 bp, Homo sapien
caattgctaaatctcttgcacaggt

SEQ ID NO: 39355 - DNA, 25 bp, Homo sapien
caattgctaaatctgttgcacaggt

SEQ ID NO: 39356 - DNA, 25 bp, Homo sapien
caattgggaaacactcttgccagca

SEQ ID NO: 39357 - DNA, 25 bp, Homo sapien
caattgggaaatactcttgccagca

SEQ ID NO: 39358 - DNA, 25 bp, Homo sapien
caattgggcaaaataataatccttg

SEQ ID NO: 39359 - DNA, 25 bp, Homo sapien
caattgggccaaataataatccttg

SEQ ID NO: 39360 - DNA, 25 bp, Homo sapien
caattgtttccctatactctaagaa

SEQ ID NO: 39361 - DNA, 25 bp, Homo sapien
caattgtttccctgtactctaagaa

SEQ ID NO: 39362 - DNA, 25 bp, Homo sapien
caatttaaattccaaaaagcagcat

SEQ ID NO: 39363 - DNA, 25 bp, Homo sapien
caatttaaattcccaaaagcagcat

SEQ ID NO: 39364 - DNA, 25 bp, Homo sapien
caatttactatcgcatgatagagcc

SEQ ID NO: 39365 - DNA, 25 bp, Homo sapien
caatttactattgcatgatagagcc

SEQ ID NO: 39366 - DNA, 25 bp, Homo sapien
caatttatagtcactaagcatctac

SEQ ID NO: 39367 - DNA, 25 bp, Homo sapien
caatttatagtcagtaagcatctac

SEQ ID NO: 39368 - DNA, 25 bp, Homo sapien
caatttatatgaatcgataatcttc

SEQ ID NO: 39369 - DNA, 25 bp, Homo sapien
caatttatatgaatcggtaatcttc

SEQ ID NO: 39370 - DNA, 25 bp, Homo sapien
caatttcaacggcagcttcctcctg

SEQ ID NO: 39371 - DNA, 25 bp, Homo sapien
caatttcaagggcagcttcctcctg

SEQ ID NO: 39372 - DNA, 25 bp, Homo sapien
caatttcatctaaagctgacatttt

SEQ ID NO: 39373 - DNA, 25 bp, Homo sapien
caatttcatctaatgctgacatttt

SEQ ID NO: 39374 - DNA, 25 bp, Homo sapien
caatttccatatgaagatgctgtac

SEQ ID NO: 39375 - DNA, 25 bp, Homo sapien
caatttccatgttcctataaaaatg

SEQ ID NO: 39376 - DNA, 25 bp, Homo sapien
caatttccatgttgctataaaaatg

SEQ ID NO: 39377 - DNA, 25 bp, Homo sapien
caatttcccttggcagtaaattttc

SEQ ID NO: 39378 - DNA, 25 bp, Homo sapien
caatttccttatgaagatgctgtac

SEQ ID NO: 39379 - DNA, 25 bp, Homo sapien
caatttcctttggcagtaaattttc

SEQ ID NO: 39380 - DNA, 25 bp, Homo sapien
caatttctggcaggcatccagccca

SEQ ID NO: 39381 - DNA, 25 bp, Homo sapien
caatttcttgcaggcatccagccca

SEQ ID NO: 39382 - DNA, 25 bp, Homo sapien
caatttgactgtaagctctttcaaa

SEQ ID NO: 39383 - DNA, 25 bp, Homo sapien
caatttgattgtaagctctttcaaa

SEQ ID NO: 39384 - DNA, 25 bp, Homo sapien
caatttgcaatcaatcaccaagttc

SEQ ID NO: 39385 - DNA, 25 bp, Homo sapien
caatttgcaatcagtcaccaagttc

SEQ ID NO: 39386 - DNA, 25 bp, Homo sapien
caatttgcattaaaaactaaaaaac

SEQ ID NO: 39387 - DNA, 25 bp, Homo sapien
caatttgcattaaaaagtaaaaaac

SEQ ID NO: 39388 - DNA, 25 bp, Homo sapien
caatttgtcatcttgataagaaggc

SEQ ID NO: 39389 - DNA, 25 bp, Homo sapien
caatttgtggccaccatgagttatg

SEQ ID NO: 39390 - DNA, 25 bp, Homo sapien
caatttgtggccatcatgagttatg

SEQ ID NO: 39391 - DNA, 25 bp, Homo sapien
caatttgttagaacccatggttgcc

SEQ ID NO: 39392 - DNA, 25 bp, Homo sapien
caatttgttagaactcatggttgcc

SEQ ID NO: 39393 - DNA, 25 bp, Homo sapien
caatttgttatcttgataagaaggc

SEQ ID NO: 39394 - DNA, 25 bp, Homo sapien
caattttatgtaagagctgaaattg

SEQ ID NO: 39395 - DNA, 25 bp, Homo sapien
caattttatgttagagctgaaattg

SEQ ID NO: 39396 - DNA, 25 bp, Homo sapien
caattttcttttcaacagtgagtgc

SEQ ID NO: 39397 - DNA, 25 bp, Homo sapien
caattttcttttcgacagtgagtgc

SEQ ID NO: 39398 - DNA, 25 bp, Homo sapien
caattttgtggccatgtttccgtgt

SEQ ID NO: 39399 - DNA, 25 bp, Homo sapien
caattttgtggctatgtttccgtgt

SEQ ID NO: 39400 - DNA, 25 bp, Homo sapien
caattttgtggtcattctcctcact

SEQ ID NO: 39401 - DNA, 25 bp, Homo sapien
caattttgtggtcattttcctcact

SEQ ID NO: 39402 - DNA, 25 bp, Homo sapien
caattttttaaagacatgttcaatt

SEQ ID NO: 39403 - DNA, 25 bp, Homo sapien
caattttttaaggacatgttcaatt

SEQ ID NO: 39404 - DNA, 25 bp, Homo sapien
caattttttgtaggtcaattatacc

SEQ ID NO: 39405 - DNA, 25 bp, Homo sapien
caattttttgtatgtcaattatacc

SEQ ID NO: 39406 - DNA, 25 bp, Homo sapien
caatttttttcgttttaatccatga

SEQ ID NO: 39407 - DNA, 25 bp, Homo sapien
caatttttttctttttaatccatga

SEQ ID NO: 39408 - DNA, 25 bp, Homo sapien
cacaaaaccacagacacatttcaca

SEQ ID NO: 39409 - DNA, 25 bp, Homo sapien
cacaaaaccacggacacatttcaca

SEQ ID NO: 39410 - DNA, 25 bp, Homo sapien
cacaaaagatattaccccagtgaaa

SEQ ID NO: 39411 - DNA, 25 bp, Homo sapien
cacaaaagatatttccccagtgaaa

SEQ ID NO: 39412 - DNA, 25 bp, Homo sapien
cacaaaagatcatctataaaccgta

SEQ ID NO: 39413 - DNA, 25 bp, Homo sapien
cacaaaagatcgtctataaaccgta

SEQ ID NO: 39414 - DNA, 25 bp, Homo sapien
cacaaaaggattcgatacactagtc

SEQ ID NO: 39415 - DNA, 25 bp, Homo sapien
cacaaaaggatttgatacactagtc

SEQ ID NO: 39416 - DNA, 25 bp, Homo sapien
cacaaaataaataactgaagaaatt

SEQ ID NO: 39417 - DNA, 25 bp, Homo sapien
cacaaaataaatcactgaagaaatt

SEQ ID NO: 39418 - DNA, 25 bp, Homo sapien
cacaaaatatgcagcttgggcatgc

SEQ ID NO: 39419 - DNA, 25 bp, Homo sapien
cacaaaatatgctgcttgggcatgc

SEQ ID NO: 39420 - DNA, 25 bp, Homo sapien
cacaaaatcaagacgagagccactc

SEQ ID NO: 39421 - DNA, 25 bp, Homo sapien
cacaaaatcaagatgagagccactc

SEQ ID NO: 39422 - DNA, 25 bp, Homo sapien
cacaaaattatgtatagttcctgac

SEQ ID NO: 39423 - DNA, 25 bp, Homo sapien
cacaaaattatgtgtagttcctgac

SEQ ID NO: 39424 - DNA, 25 bp, Homo sapien
cacaaacaaaagaaattcaaaactg

SEQ ID NO: 39425 - DNA, 25 bp, Homo sapien
cacaaacaaaataaattcaaaactg

SEQ ID NO: 39426 - DNA, 25 bp, Homo sapien
cacaaacaagcaaacaacaaatacc

SEQ ID NO: 39427 - DNA, 25 bp, Homo sapien
cacaaacaagcgaacaacaaatacc

SEQ ID NO: 39428 - DNA, 25 bp, Homo sapien
cacaaactagagcaatttgagataa

SEQ ID NO: 39429 - DNA, 25 bp, Homo sapien
cacaaactagagcactttgagataa

SEQ ID NO: 39430 - DNA, 25 bp, Homo sapien
cacaaactcggtggcataaaacaat

SEQ ID NO: 39431 - DNA, 25 bp, Homo sapien
cacaaactcggtgtcataaaacaat

SEQ ID NO: 39432 - DNA, 25 bp, Homo sapien
cacaaagagccttgaaagtactatt

SEQ ID NO: 39433 - DNA, 25 bp, Homo sapien
cacaaagagccttgaatgtactatt

SEQ ID NO: 39434 - DNA, 25 bp, Homo sapien
cacaaagatagaccgaggttctggt

SEQ ID NO: 39435 - DNA, 25 bp, Homo sapien
cacaaagatagactgaggttctggt

SEQ ID NO: 39436 - DNA, 25 bp, Homo sapien
cacaaagcaagatgtgataagtatt

SEQ ID NO: 39437 - DNA, 25 bp, Homo sapien
cacaaagcacacatgggcatttgct

SEQ ID NO: 39438 - DNA, 25 bp, Homo sapien
cacaaagcacacgtgggcatttgct

SEQ ID NO: 39439 - DNA, 25 bp, Homo sapien
cacaaagcaggatgtgataagtatt

SEQ ID NO: 39440 - DNA, 25 bp, Homo sapien
cacaaaggacgtgtctctcacagta

SEQ ID NO: 39441 - DNA, 25 bp, Homo sapien
cacaaaggaggcctttccttggttg

SEQ ID NO: 39442 - DNA, 25 bp, Homo sapien
cacaaaggaggcttttccttggttg

SEQ ID NO: 39443 - DNA, 25 bp, Homo sapien
cacaaaggatgtgtctctcacagta

SEQ ID NO: 39444 - DNA, 25 bp, Homo sapien
cacaaaggcttcaccggttttggtc

SEQ ID NO: 39445 - DNA, 25 bp, Homo sapien
cacaaaggcttcatcggttttggtc

SEQ ID NO: 39446 - DNA, 25 bp, Homo sapien
cacaaataacaaaaactgaatgtgt

SEQ ID NO: 39447 - DNA, 25 bp, Homo sapien
cacaaataacaacaactgaatgtgt

SEQ ID NO: 39448 - DNA, 25 bp, Homo sapien
cacaaataacataaacaagttagaa

SEQ ID NO: 39449 - DNA, 25 bp, Homo sapien
cacaaataagataaacaagttagaa

SEQ ID NO: 39450 - DNA, 25 bp, Homo sapien
cacaaatacaataatgcgctcagga

SEQ ID NO: 39451 - DNA, 25 bp, Homo sapien
cacaaatacaataatgtgctcagga

SEQ ID NO: 39452 - DNA, 25 bp, Homo sapien
cacaaatacatgtgcatatgtgtgc

SEQ ID NO: 39453 - DNA, 25 bp, Homo sapien
cacaaatagaaacacctacatagcc

SEQ ID NO: 39454 - DNA, 25 bp, Homo sapien
cacaaatagaaagacctacatagcc

SEQ ID NO: 39455 - DNA, 25 bp, Homo sapien
cacaaatagacctcaggaggaatcg

SEQ ID NO: 39456 - DNA, 25 bp, Homo sapien
cacaaatagccctcaggaggaatcg

SEQ ID NO: 39457 - DNA, 25 bp, Homo sapien
cacaaatatatgtgcatatgtgtgc

SEQ ID NO: 39458 - DNA, 25 bp, Homo sapien
cacaaatcaattaaccattaatgta

SEQ ID NO: 39459 - DNA, 25 bp, Homo sapien
cacaaatcaatttaccattaatgta

SEQ ID NO: 39460 - DNA, 25 bp, Homo sapien
cacaaatcacccaaacaaattttaa

SEQ ID NO: 39461 - DNA, 25 bp, Homo sapien
cacaaatcagccaaacaaattttaa

SEQ ID NO: 39462 - DNA, 25 bp, Homo sapien
cacaaatccacacaaaaggtcaagg

SEQ ID NO: 39463 - DNA, 25 bp, Homo sapien
cacaaatccacataaaaggtcaagg

SEQ ID NO: 39464 - DNA, 25 bp, Homo sapien
cacaaatctgaatttaatccatatg

SEQ ID NO: 39465 - DNA, 25 bp, Homo sapien
cacaaatctgaatttattccatatg

SEQ ID NO: 39466 - DNA, 25 bp, Homo sapien
cacaaatgctacctgtgtatgtcca

SEQ ID NO: 39467 - DNA, 25 bp, Homo sapien
cacaaatgtaaatagtgaaacacca

SEQ ID NO: 39468 - DNA, 25 bp, Homo sapien
cacaaatgtaaatattgaaacacca

SEQ ID NO: 39469 - DNA, 25 bp, Homo sapien
cacaaatgtactacattgattgtca

SEQ ID NO: 39470 - DNA, 25 bp, Homo sapien
cacaaatgtactccattgattgtca

SEQ ID NO: 39471 - DNA, 25 bp, Homo sapien
cacaaatgttacctgtgtatgtcca

SEQ ID NO: 39472 - DNA, 25 bp, Homo sapien
cacaaattacacgaagagtgtttat

SEQ ID NO: 39473 - DNA, 25 bp, Homo sapien
cacaaattacatgaagagtgtttat

SEQ ID NO: 39474 - DNA, 25 bp, Homo sapien
cacaaattccacattaattcttaga

SEQ ID NO: 39475 - DNA, 25 bp, Homo sapien
cacaaattccacgttaattcttaga

SEQ ID NO: 39476 - DNA, 25 bp, Homo sapien
cacaaattgggtcgctgaaaacaat

SEQ ID NO: 39477 - DNA, 25 bp, Homo sapien
cacaaattgggtggctgaaaacaat

SEQ ID NO: 39478 - DNA, 25 bp, Homo sapien
cacaaatttagtgggtcaaaacaat

SEQ ID NO: 39479 - DNA, 25 bp, Homo sapien
cacaaatttagtgggttaaaacaat

SEQ ID NO: 39480 - DNA, 25 bp, Homo sapien
cacaaatttatagtttggttgcttt

SEQ ID NO: 39481 - DNA, 25 bp, Homo sapien
cacaaatttgaacaaaactcttaaa

SEQ ID NO: 39482 - DNA, 25 bp, Homo sapien
cacaaatttgaacaaacctcttaaa

SEQ ID NO: 39483 - DNA, 25 bp, Homo sapien
cacaaatttgtagtttggttgcttt

SEQ ID NO: 39484 - DNA, 25 bp, Homo sapien
cacaacacgccatcttttcatagga

SEQ ID NO: 39485 - DNA, 25 bp, Homo sapien
cacaacacgtcatcttttcatagga

SEQ ID NO: 39486 - DNA, 25 bp, Homo sapien
cacaacatatccgctcctccaggac

SEQ ID NO: 39487 - DNA, 25 bp, Homo sapien
cacaacatatctgctcctccaggac

SEQ ID NO: 39488 - DNA, 25 bp, Homo sapien
cacaacatccaaacaggtgagcaaa

SEQ ID NO: 39489 - DNA, 25 bp, Homo sapien
cacaacatccatacaggtgagcaaa

SEQ ID NO: 39490 - DNA, 25 bp, Homo sapien
cacaacattcatctcctctgagtcc

SEQ ID NO: 39491 - DNA, 25 bp, Homo sapien
cacaacattcatgtcctctgagtcc

SEQ ID NO: 39492 - DNA, 25 bp, Homo sapien
cacaaccacattttcctgctctata

SEQ ID NO: 39493 - DNA, 25 bp, Homo sapien
cacaaccaccttttcctgctctata

SEQ ID NO: 39494 - DNA, 25 bp, Homo sapien
cacaaccatctgcaccattttacac

SEQ ID NO: 39495 - DNA, 25 bp, Homo sapien
cacaaccatctgcatcattttacac

SEQ ID NO: 39496 - DNA, 25 bp, Homo sapien
cacaaccatgtcaccttactttgcc

SEQ ID NO: 39497 - DNA, 25 bp, Homo sapien
cacaaccatgtcgccttactttgcc

SEQ ID NO: 39498 - DNA, 25 bp, Homo sapien
cacaaccgagtagcggagccaagat

SEQ ID NO: 39499 - DNA, 25 bp, Homo sapien
cacaaccgagtagtggagccaagat

SEQ ID NO: 39500 - DNA, 25 bp, Homo sapien
cacaacgcactagaagtgtttaaga

SEQ ID NO: 39501 - DNA, 25 bp, Homo sapien
cacaacgcactagcagtgtttaaga

SEQ ID NO: 39502 - DNA, 25 bp, Homo sapien
cacaacgttttacgaacgtccagac

SEQ ID NO: 39503 - DNA, 25 bp, Homo sapien
cacaacgttttacgaatgtccagac

SEQ ID NO: 39504 - DNA, 25 bp, Homo sapien
cacaactatggctcacgactccaca

SEQ ID NO: 39505 - DNA, 25 bp, Homo sapien
cacaactatggctcgcgactccaca

SEQ ID NO: 39506 - DNA, 25 bp, Homo sapien
cacaactctgaatttctgaaatccc

SEQ ID NO: 39507 - DNA, 25 bp, Homo sapien
cacaactctgattttctgaaatccc

SEQ ID NO: 39508 - DNA, 25 bp, Homo sapien
cacaactgctgacgatcacgagata

SEQ ID NO: 39509 - DNA, 25 bp, Homo sapien
cacaactgctgatgatcacgagata

SEQ ID NO: 39510 - DNA, 25 bp, Homo sapien
cacaactgtagggtctgaagacaat

SEQ ID NO: 39511 - DNA, 25 bp, Homo sapien
cacaactgtggggtctgaagacaat

SEQ ID NO: 39512 - DNA, 25 bp, Homo sapien
cacaacttacatcggttttcagatt

SEQ ID NO: 39513 - DNA, 25 bp, Homo sapien
cacaacttacattggttttcagatt

SEQ ID NO: 39514 - DNA, 25 bp, Homo sapien
cacaacttcctccggaaacacttgt

SEQ ID NO: 39515 - DNA, 25 bp, Homo sapien
cacaacttcctctggaaacacttgt

SEQ ID NO: 39516 - DNA, 25 bp, Homo sapien
cacaacttgatcaacgaaatattaa

SEQ ID NO: 39517 - DNA, 25 bp, Homo sapien
cacaacttgatcaatgaaatattaa

SEQ ID NO: 39518 - DNA, 25 bp, Homo sapien
cacaactttgaatcgttatataata

SEQ ID NO: 39519 - DNA, 25 bp, Homo sapien
cacaactttgaatggttatataata

SEQ ID NO: 39520 - DNA, 25 bp, Homo sapien
cacaagaacttaagcggttcaaaag

SEQ ID NO: 39521 - DNA, 25 bp, Homo sapien
cacaagaacttaggcggttcaaaag

SEQ ID NO: 39522 - DNA, 25 bp, Homo sapien
cacaagacctatcgcaagccctcag

SEQ ID NO: 39523 - DNA, 25 bp, Homo sapien
cacaagacctattgcaagccctcag

SEQ ID NO: 39524 - DNA, 25 bp, Homo sapien
cacaagagctctgtggattctggac

SEQ ID NO: 39525 - DNA, 25 bp, Homo sapien
cacaagagctctttggattctggac

SEQ ID NO: 39526 - DNA, 25 bp, Homo sapien
cacaagataattctgtgagccgtca

SEQ ID NO: 39527 - DNA, 25 bp, Homo sapien
cacaagatgagtcactctgaccatt

SEQ ID NO: 39528 - DNA, 25 bp, Homo sapien
cacaagatgagtcactgtgaccatt

SEQ ID NO: 39529 - DNA, 25 bp, Homo sapien
cacaagatgattctgtgagccgtca

SEQ ID NO: 39530 - DNA, 25 bp, Homo sapien
cacaagcacaagtcactgttgtaag

SEQ ID NO: 39531 - DNA, 25 bp, Homo sapien
cacaagcacaattcactgttgtaag

SEQ ID NO: 39532 - DNA, 25 bp, Homo sapien
cacaagcatagaccaaaaatgtgga

SEQ ID NO: 39533 - DNA, 25 bp, Homo sapien
cacaagcataggccaaaaatgtgga

SEQ ID NO: 39534 - DNA, 25 bp, Homo sapien
cacaagcctggccgagcttgccacc

SEQ ID NO: 39535 - DNA, 25 bp, Homo sapien
cacaagcctggctgagcttgccacc

SEQ ID NO: 39536 - DNA, 25 bp, Homo sapien
cacaaggagacagagatgattggat

SEQ ID NO: 39537 - DNA, 25 bp, Homo sapien
cacaaggagacggagatgattggat

SEQ ID NO: 39538 - DNA, 25 bp, Homo sapien
cacaaggcacatagtatcctcagct

SEQ ID NO: 39539 - DNA, 25 bp, Homo sapien
cacaaggcacatggtatcctcagct

SEQ ID NO: 39540 - DNA, 25 bp, Homo sapien
cacaaggctctcgacttacctgaga

SEQ ID NO: 39541 - DNA, 25 bp, Homo sapien
cacaaggctcttgacttacctgaga

SEQ ID NO: 39542 - DNA, 25 bp, Homo sapien
cacaagtaggacccagagacagagt

SEQ ID NO: 39543 - DNA, 25 bp, Homo sapien
cacaagtaggacctagagacagagt

SEQ ID NO: 39544 - DNA, 25 bp, Homo sapien
cacaagtgaagttgctgtcaggtaa

SEQ ID NO: 39545 - DNA, 25 bp, Homo sapien
cacaagtgaagttggtgtcaggtaa

SEQ ID NO: 39546 - DNA, 25 bp, Homo sapien
cacaagttgctattgaaacctccaa

SEQ ID NO: 39547 - DNA, 25 bp, Homo sapien
cacaagttgctattgatacctccaa

SEQ ID NO: 39548 - DNA, 25 bp, Homo sapien
cacaagtttccaagtggtgctgata

SEQ ID NO: 39549 - DNA, 25 bp, Homo sapien
cacaagtttcccagtggtgctgata

SEQ ID NO: 39550 - DNA, 25 bp, Homo sapien
cacaataaataattgaattatcctc

SEQ ID NO: 39551 - DNA, 25 bp, Homo sapien
cacaataagtaattgaattatcctc

SEQ ID NO: 39552 - DNA, 25 bp, Homo sapien
cacaatacaacattccctttggata

SEQ ID NO: 39553 - DNA, 25 bp, Homo sapien
cacaataccaatgaaggaaaaatat

SEQ ID NO: 39554 - DNA, 25 bp, Homo sapien
cacaataccgatgaaggaaaaatat

SEQ ID NO: 39555 - DNA, 25 bp, Homo sapien
cacaatacgacattccctttggata

SEQ ID NO: 39556 - DNA, 25 bp, Homo sapien
cacaataggacactcagctaatgac

SEQ ID NO: 39557 - DNA, 25 bp, Homo sapien
cacaataggacgctcagctaatgac

SEQ ID NO: 39558 - DNA, 25 bp, Homo sapien
cacaatatacagagaaatttttagg

SEQ ID NO: 39559 - DNA, 25 bp, Homo sapien
cacaatatacagataaatttttagg

SEQ ID NO: 39560 - DNA, 25 bp, Homo sapien
cacaatattgattgcacaatagcta

SEQ ID NO: 39561 - DNA, 25 bp, Homo sapien
cacaatatttattgcacaatagcta

SEQ ID NO: 39562 - DNA, 25 bp, Homo sapien
cacaatcaactccgttaatttcaga

SEQ ID NO: 39563 - DNA, 25 bp, Homo sapien
cacaatcaactcctttaatttcaga

SEQ ID NO: 39564 - DNA, 25 bp, Homo sapien
cacaatccaagcatctgaaaattgt

SEQ ID NO: 39565 - DNA, 25 bp, Homo sapien
cacaatccaagcgtctgaaaattgt

SEQ ID NO: 39566 - DNA, 25 bp, Homo sapien
cacaatctacaaagtgctgaaacaa

SEQ ID NO: 39567 - DNA, 25 bp, Homo sapien
cacaatctacagagtgctgaaacaa

SEQ ID NO: 39568 - DNA, 25 bp, Homo sapien
cacaatctatctcaaataacacatt

SEQ ID NO: 39569 - DNA, 25 bp, Homo sapien
cacaatctgtctcaaataacacatt

SEQ ID NO: 39570 - DNA, 25 bp, Homo sapien
cacaatgaacgaggacatccaatga

SEQ ID NO: 39571 - DNA, 25 bp, Homo sapien
cacaatgaaggttcggattgtggca

SEQ ID NO: 39572 - DNA, 25 bp, Homo sapien
cacaatgaaggtttggattgtggca

SEQ ID NO: 39573 - DNA, 25 bp, Homo sapien
cacaatgaatgagattgaggttctc

SEQ ID NO: 39574 - DNA, 25 bp, Homo sapien
cacaatgaatgaggacatccaatga

SEQ ID NO: 39575 - DNA, 25 bp, Homo sapien
cacaatgaatgcgattgaggttctc

SEQ ID NO: 39576 - DNA, 25 bp, Homo sapien
cacaatgaggagacacaatttaata

SEQ ID NO: 39577 - DNA, 25 bp, Homo sapien
cacaatgaggagacgcaatttaata

SEQ ID NO: 39578 - DNA, 25 bp, Homo sapien
cacaatgcaccaagtggtcttccta

SEQ ID NO: 39579 - DNA, 25 bp, Homo sapien
cacaatgcaccgagtggtcttccta

SEQ ID NO: 39580 - DNA, 25 bp, Homo sapien
cacaatgcctaacgcagagtaaaca

SEQ ID NO: 39581 - DNA, 25 bp, Homo sapien
cacaatgcctaatgcagagtaaaca

SEQ ID NO: 39582 - DNA, 25 bp, Homo sapien
cacaatggcttcttttcgtaaagag

SEQ ID NO: 39583 - DNA, 25 bp, Homo sapien
cacaatggcttctttttgtaaagag

SEQ ID NO: 39584 - DNA, 25 bp, Homo sapien
cacaatggtatgaaaatgtttaaca

SEQ ID NO: 39585 - DNA, 25 bp, Homo sapien
cacaatggtatgaatatgtttaaca

SEQ ID NO: 39586 - DNA, 25 bp, Homo sapien
cacaatggttagaaggttaagttct

SEQ ID NO: 39587 - DNA, 25 bp, Homo sapien
cacaatggttaggaggttaagttct

SEQ ID NO: 39588 - DNA, 25 bp, Homo sapien
cacaatgtaacgcacattttaataa

SEQ ID NO: 39589 - DNA, 25 bp, Homo sapien
cacaatgtacgctaaatgtactact

SEQ ID NO: 39590 - DNA, 25 bp, Homo sapien
cacaatgtatgctaaatgtactact

SEQ ID NO: 39591 - DNA, 25 bp, Homo sapien
cacaatgttacgcacattttaataa

SEQ ID NO: 39592 - DNA, 25 bp, Homo sapien
cacaattatagtctgtatgctttct

SEQ ID NO: 39593 - DNA, 25 bp, Homo sapien
cacaattatagtttgtatgctttct

SEQ ID NO: 39594 - DNA, 25 bp, Homo sapien
cacaattgaatcttattctgccata

SEQ ID NO: 39595 - DNA, 25 bp, Homo sapien
cacaattgaggaatggaggaactgc

SEQ ID NO: 39596 - DNA, 25 bp, Homo sapien
cacaattgaggactggaggaactgc

SEQ ID NO: 39597 - DNA, 25 bp, Homo sapien
cacaattggatcttattctgccata

SEQ ID NO: 39598 - DNA, 25 bp, Homo sapien
cacaattttcaatatggtaattaag

SEQ ID NO: 39599 - DNA, 25 bp, Homo sapien
cacaattttcagtatggtaattaag

SEQ ID NO: 39600 - DNA, 25 bp, Homo sapien
cacacaaaaatgtcaatagaggcat

SEQ ID NO: 39601 - DNA, 25 bp, Homo sapien
cacacaaaactactgcttcatcaac

SEQ ID NO: 39602 - DNA, 25 bp, Homo sapien
cacacaaaatgcatttcatttaatt

SEQ ID NO: 39603 - DNA, 25 bp, Homo sapien
cacacaaaattactgcttcatcaac

SEQ ID NO: 39604 - DNA, 25 bp, Homo sapien
cacacaaaattgtcaatagaggcat

SEQ ID NO: 39605 - DNA, 25 bp, Homo sapien
cacacaaaggcccaggaatcagaat

SEQ ID NO: 39606 - DNA, 25 bp, Homo sapien
cacacaaagtcccaggaatcagaat

SEQ ID NO: 39607 - DNA, 25 bp, Homo sapien
cacacaaagtgcatttcatttaatt

SEQ ID NO: 39608 - DNA, 25 bp, Homo sapien
cacacaaatgtactacattgattgt

SEQ ID NO: 39609 - DNA, 25 bp, Homo sapien
cacacaaatgtactccattgattgt

SEQ ID NO: 39610 - DNA, 25 bp, Homo sapien
cacacaactcatagtatgtctacag

SEQ ID NO: 39611 - DNA, 25 bp, Homo sapien
cacacaactcatcgtatgtctacag

SEQ ID NO: 39612 - DNA, 25 bp, Homo sapien
cacacaacttcctccggaaacactt

SEQ ID NO: 39613 - DNA, 25 bp, Homo sapien
cacacaacttcctctggaaacactt

SEQ ID NO: 39614 - DNA, 25 bp, Homo sapien
cacacaacttgatcaacgaaatatt

SEQ ID NO: 39615 - DNA, 25 bp, Homo sapien
cacacaacttgatcaatgaaatatt

SEQ ID NO: 39616 - DNA, 25 bp, Homo sapien
cacacaatgtacgctaaatgtacta

SEQ ID NO: 39617 - DNA, 25 bp, Homo sapien
cacacaatgtatgctaaatgtacta

SEQ ID NO: 39618 - DNA, 25 bp, Homo sapien
cacacacacatgcatgtatcttgag

SEQ ID NO: 39619 - DNA, 25 bp, Homo sapien
cacacacacatgcttgtatcttgag

SEQ ID NO: 39620 - DNA, 25 bp, Homo sapien
cacacacaggagacatttgagtcca

SEQ ID NO: 39621 - DNA, 25 bp, Homo sapien
cacacacaggagacgtttgagtcca

SEQ ID NO: 39622 - DNA, 25 bp, Homo sapien
cacacacatgcatgtatcttgagtg

SEQ ID NO: 39623 - DNA, 25 bp, Homo sapien
cacacacatgcttgtatcttgagtg

SEQ ID NO: 39624 - DNA, 25 bp, Homo sapien
cacacaccacacgggagagagtttg

SEQ ID NO: 39625 - DNA, 25 bp, Homo sapien
cacacaccacatgggagagagtttg

SEQ ID NO: 39626 - DNA, 25 bp, Homo sapien
cacacacctttaaccatatctcatg

SEQ ID NO: 39627 - DNA, 25 bp, Homo sapien
cacacacctttaatcatatctcatg

SEQ ID NO: 39628 - DNA, 25 bp, Homo sapien
cacacactcagccatatattgatat

SEQ ID NO: 39629 - DNA, 25 bp, Homo sapien
cacacactcagccgtatattgatat

SEQ ID NO: 39630 - DNA, 25 bp, Homo sapien
cacacactgaaactaagtaatactt

SEQ ID NO: 39631 - DNA, 25 bp, Homo sapien
cacacactgaatctaagtaatactt

SEQ ID NO: 39632 - DNA, 25 bp, Homo sapien
cacacactgagaaacgaggagcagt

SEQ ID NO: 39633 - DNA, 25 bp, Homo sapien
cacacactgagaaatgaggagcagt

SEQ ID NO: 39634 - DNA, 25 bp, Homo sapien
cacacagctagaagacacttaccag

SEQ ID NO: 39635 - DNA, 25 bp, Homo sapien
cacacagctagatgacacttaccag

SEQ ID NO: 39636 - DNA, 25 bp, Homo sapien
cacacaggagacatttgagtccaat

SEQ ID NO: 39637 - DNA, 25 bp, Homo sapien
cacacaggagacgtttgagtccaat

SEQ ID NO: 39638 - DNA, 25 bp, Homo sapien
cacacaggccaactcctccattgta

SEQ ID NO: 39639 - DNA, 25 bp, Homo sapien
cacacaggccatctcctccattgta

SEQ ID NO: 39640 - DNA, 25 bp, Homo sapien
cacacatagctgtttcactgctaat

SEQ ID NO: 39641 - DNA, 25 bp, Homo sapien
cacacatagttgtttcactgctaat

SEQ ID NO: 39642 - DNA, 25 bp, Homo sapien
cacacatcatgaatgactcaaaagc

SEQ ID NO: 39643 - DNA, 25 bp, Homo sapien
cacacatccaagctcccacagttat

SEQ ID NO: 39644 - DNA, 25 bp, Homo sapien
cacacatccaaggtcccacagttat

SEQ ID NO: 39645 - DNA, 25 bp, Homo sapien
cacacatcggtattcaaattcttat

SEQ ID NO: 39646 - DNA, 25 bp, Homo sapien
cacacatcgtgaatgactcaaaagc

SEQ ID NO: 39647 - DNA, 25 bp, Homo sapien
cacacatctcttcattgtgcttgtg

SEQ ID NO: 39648 - DNA, 25 bp, Homo sapien
cacacatctctttattgtgcttgtg

SEQ ID NO: 39649 - DNA, 25 bp, Homo sapien
cacacatctgtattcaaattcttat

SEQ ID NO: 39650 - DNA, 25 bp, Homo sapien
cacacatgctgactagttgcttgtg

SEQ ID NO: 39651 - DNA, 25 bp, Homo sapien
cacacatgctgattagttgcttgtg

SEQ ID NO: 39652 - DNA, 25 bp, Homo sapien
cacacatgctgtgagaccacaaggc

SEQ ID NO: 39653 - DNA, 25 bp, Homo sapien
cacacatgctgtgggaccacaaggc

SEQ ID NO: 39654 - DNA, 25 bp, Homo sapien
cacaccaagaacgaaagggacgata

SEQ ID NO: 39655 - DNA, 25 bp, Homo sapien
cacaccaagaatgaaagggacgata

SEQ ID NO: 39656 - DNA, 25 bp, Homo sapien
cacaccaagttttatgggttctccc

SEQ ID NO: 39657 - DNA, 25 bp, Homo sapien
cacaccaagttttgtgggttctccc

SEQ ID NO: 39658 - DNA, 25 bp, Homo sapien
cacaccacacgggagagagtttgct

SEQ ID NO: 39659 - DNA, 25 bp, Homo sapien
cacaccacataccaggatgttttgg

SEQ ID NO: 39660 - DNA, 25 bp, Homo sapien
cacaccacataccgggatgttttgg

SEQ ID NO: 39661 - DNA, 25 bp, Homo sapien
cacaccacatgggagagagtttgct

SEQ ID NO: 39662 - DNA, 25 bp, Homo sapien
cacaccactctcgtaaaagtattcc

SEQ ID NO: 39663 - DNA, 25 bp, Homo sapien
cacaccactcttgtaaaagtattcc

SEQ ID NO: 39664 - DNA, 25 bp, Homo sapien
cacaccatcctaaattttttttcat

SEQ ID NO: 39665 - DNA, 25 bp, Homo sapien
cacaccatcctagattttttttcat

SEQ ID NO: 39666 - DNA, 25 bp, Homo sapien
cacaccctatgcttttcatcttcct

SEQ ID NO: 39667 - DNA, 25 bp, Homo sapien
cacaccctatgctttttatcttcct

SEQ ID NO: 39668 - DNA, 25 bp, Homo sapien
cacaccgaagaagcctggagtaaaa

SEQ ID NO: 39669 - DNA, 25 bp, Homo sapien
cacaccgaagaaggctggagtaaaa

SEQ ID NO: 39670 - DNA, 25 bp, Homo sapien
cacacctagaagaggaaaagctagt

SEQ ID NO: 39671 - DNA, 25 bp, Homo sapien
cacacctagcagaggaaaagctagt

SEQ ID NO: 39672 - DNA, 25 bp, Homo sapien
cacacctgatgtcagcatgtctcag

SEQ ID NO: 39673 - DNA, 25 bp, Homo sapien
cacacctgatgtccgcatgtctcag

SEQ ID NO: 39674 - DNA, 25 bp, Homo sapien
cacacctgcacagtcggcagtctgt

SEQ ID NO: 39675 - DNA, 25 bp, Homo sapien
cacacctgcacagttggcagtctgt

SEQ ID NO: 39676 - DNA, 25 bp, Homo sapien
cacaccttacacaccttatacaaaa

SEQ ID NO: 39677 - DNA, 25 bp, Homo sapien
cacaccttatacaccttatacaaaa

SEQ ID NO: 39678 - DNA, 25 bp, Homo sapien
cacacgaaaggaaaaatgtaaatga

SEQ ID NO: 39679 - DNA, 25 bp, Homo sapien
cacacgaaaggataaatgtaaatga

SEQ ID NO: 39680 - DNA, 25 bp, Homo sapien
cacacggtaaagtttgagaagctca

SEQ ID NO: 39681 - DNA, 25 bp, Homo sapien
cacacggtcaagtttgagaagctca

SEQ ID NO: 39682 - DNA, 25 bp, Homo sapien
cacacgttcagccaacacatctcta

SEQ ID NO: 39683 - DNA, 25 bp, Homo sapien
cacacgttcagccaacgcatctcta

SEQ ID NO: 39684 - DNA, 25 bp, Homo sapien
cacacgttgtggacagcaaagccag

SEQ ID NO: 39685 - DNA, 25 bp, Homo sapien
cacacgttgtgggcagcaaagccag

SEQ ID NO: 39686 - DNA, 25 bp, Homo sapien
cacacgtttctcccgtgctcactct

SEQ ID NO: 39687 - DNA, 25 bp, Homo sapien
cacacgtttctcctgtgctcactct

SEQ ID NO: 39688 - DNA, 25 bp, Homo sapien
cacacgtttttagtctctccactca

SEQ ID NO: 39689 - DNA, 25 bp, Homo sapien
cacacgtttttagtttctccactca

SEQ ID NO: 39690 - DNA, 25 bp, Homo sapien
cacactagccatttccacaactggc

SEQ ID NO: 39691 - DNA, 25 bp, Homo sapien
cacactagtcatttccacaactggc

SEQ ID NO: 39692 - DNA, 25 bp, Homo sapien
cacactatatttattccccttgcac

SEQ ID NO: 39693 - DNA, 25 bp, Homo sapien
cacactatgtttattccccttgcac

SEQ ID NO: 39694 - DNA, 25 bp, Homo sapien
cacactcaatgagaaaaggacattt

SEQ ID NO: 39695 - DNA, 25 bp, Homo sapien
cacactcagccatatattgatatac

SEQ ID NO: 39696 - DNA, 25 bp, Homo sapien
cacactcagccgtatattgatatac

SEQ ID NO: 39697 - DNA, 25 bp, Homo sapien
cacactcagtgagaaaaggacattt

SEQ ID NO: 39698 - DNA, 25 bp, Homo sapien
cacactccaagaagctttatcttct

SEQ ID NO: 39699 - DNA, 25 bp, Homo sapien
cacactccaagaagttttatcttct

SEQ ID NO: 39700 - DNA, 25 bp, Homo sapien
cacactccagccacttcttttatca

SEQ ID NO: 39701 - DNA, 25 bp, Homo sapien
cacactccagccgcttcttttatca

SEQ ID NO: 39702 - DNA, 25 bp, Homo sapien
cacactcccacgtccattcagcaga

SEQ ID NO: 39703 - DNA, 25 bp, Homo sapien
cacactcccacttccattcagcaga

SEQ ID NO: 39704 - DNA, 25 bp, Homo sapien
cacactgaaactaagtaatactttt

SEQ ID NO: 39705 - DNA, 25 bp, Homo sapien
cacactgaacagttcattcttacaa

SEQ ID NO: 39706 - DNA, 25 bp, Homo sapien
cacactgaagagttcattcttacaa

SEQ ID NO: 39707 - DNA, 25 bp, Homo sapien
cacactgaatctaagtaatactttt

SEQ ID NO: 39708 - DNA, 25 bp, Homo sapien
cacactgagaaacgaggagcagtct

SEQ ID NO: 39709 - DNA, 25 bp, Homo sapien
cacactgagaaatgaggagcagtct

SEQ ID NO: 39710 - DNA, 25 bp, Homo sapien
cacactgcagtaccctgtaaatatt

SEQ ID NO: 39711 - DNA, 25 bp, Homo sapien
cacactgcggtaccctgtaaatatt

SEQ ID NO: 39712 - DNA, 25 bp, Homo sapien
cacactgtctcattgttccacatct

SEQ ID NO: 39713 - DNA, 25 bp, Homo sapien
cacactgtttcattgttccacatct

SEQ ID NO: 39714 - DNA, 25 bp, Homo sapien
cacacttaagtacaccattgacgcc

SEQ ID NO: 39715 - DNA, 25 bp, Homo sapien
cacacttaagtataccattgacgcc

SEQ ID NO: 39716 - DNA, 25 bp, Homo sapien
cacacttccggacagcaaatgggga

SEQ ID NO: 39717 - DNA, 25 bp, Homo sapien
cacacttctggacagcaaatgggga

SEQ ID NO: 39718 - DNA, 25 bp, Homo sapien
cacacttgaataattagtgtttcct

SEQ ID NO: 39719 - DNA, 25 bp, Homo sapien
cacacttgctctttcggaaaggtgt

SEQ ID NO: 39720 - DNA, 25 bp, Homo sapien
cacacttgctcttttggaaaggtgt

SEQ ID NO: 39721 - DNA, 25 bp, Homo sapien
cacacttggataattagtgtttcct

SEQ ID NO: 39722 - DNA, 25 bp, Homo sapien
cacacttgggtctccttccaaagcc

SEQ ID NO: 39723 - DNA, 25 bp, Homo sapien
cacacttggttctccttccaaagcc

SEQ ID NO: 39724 - DNA, 25 bp, Homo sapien
cacactttaaaaacacagaatattt

SEQ ID NO: 39725 - DNA, 25 bp, Homo sapien
cacactttactaacaaccatattaa

SEQ ID NO: 39726 - DNA, 25 bp, Homo sapien
cacactttactaacaagcatattaa

SEQ ID NO: 39727 - DNA, 25 bp, Homo sapien
cacactttagaaacacagaatattt

SEQ ID NO: 39728 - DNA, 25 bp, Homo sapien
cacagaaaaaactaccatttataaa

SEQ ID NO: 39729 - DNA, 25 bp, Homo sapien
cacagaaaaaattaccatttataaa

SEQ ID NO: 39730 - DNA, 25 bp, Homo sapien
cacagaacaccctgagagcattttg

SEQ ID NO: 39731 - DNA, 25 bp, Homo sapien
cacagaacaccctgagtgcattttg

SEQ ID NO: 39732 - DNA, 25 bp, Homo sapien
cacagaagaacaaccacagatgcaa

SEQ ID NO: 39733 - DNA, 25 bp, Homo sapien
cacagaagaacaactacagatgcaa

SEQ ID NO: 39734 - DNA, 25 bp, Homo sapien
cacagaagaagagagaagtcagggt

SEQ ID NO: 39735 - DNA, 25 bp, Homo sapien
cacagaagaagagggaagtcagggt

SEQ ID NO: 39736 - DNA, 25 bp, Homo sapien
cacagaagcagagcatggtatcccc

SEQ ID NO: 39737 - DNA, 25 bp, Homo sapien
cacagaagcagaggatggtatcccc

SEQ ID NO: 39738 - DNA, 25 bp, Homo sapien
cacagaagtgaccagacccaggagt

SEQ ID NO: 39739 - DNA, 25 bp, Homo sapien
cacagaagtgaccggacccaggagt

SEQ ID NO: 39740 - DNA, 25 bp, Homo sapien
cacagaagtgtgacctaaaccggtg

SEQ ID NO: 39741 - DNA, 25 bp, Homo sapien
cacagaagtgtgagctaaaccggtg

SEQ ID NO: 39742 - DNA, 25 bp, Homo sapien
cacagaatttacactggagcctaag

SEQ ID NO: 39743 - DNA, 25 bp, Homo sapien
cacagaatttacattggagcctaag

SEQ ID NO: 39744 - DNA, 25 bp, Homo sapien
cacagaatttcccacgtgtagcatt

SEQ ID NO: 39745 - DNA, 25 bp, Homo sapien
cacagaatttcccatgtgtagcatt

SEQ ID NO: 39746 - DNA, 25 bp, Homo sapien
cacagacaaatctgccattgtaaag

SEQ ID NO: 39747 - DNA, 25 bp, Homo sapien
cacagacaaatctgccgttgtaaag

SEQ ID NO: 39748 - DNA, 25 bp, Homo sapien
cacagacccagtcattgaagcaagc

SEQ ID NO: 39749 - DNA, 25 bp, Homo sapien
cacagacccagtcgttgaagcaagc

SEQ ID NO: 39750 - DNA, 25 bp, Homo sapien
cacagaccgcagtgaaagaaaaata

SEQ ID NO: 39751 - DNA, 25 bp, Homo sapien
cacagacctcagtgaaagaaaaata

SEQ ID NO: 39752 - DNA, 25 bp, Homo sapien
cacagacggggcaaggccacttttt

SEQ ID NO: 39753 - DNA, 25 bp, Homo sapien
cacagacggggctaggccacttttt

SEQ ID NO: 39754 - DNA, 25 bp, Homo sapien
cacagactgtgacgactacaataaa

SEQ ID NO: 39755 - DNA, 25 bp, Homo sapien
cacagactgtgatgactacaataaa

SEQ ID NO: 39756 - DNA, 25 bp, Homo sapien
cacagacttgtactttaagtttgat

SEQ ID NO: 39757 - DNA, 25 bp, Homo sapien
cacagacttgtactttgagtttgat

SEQ ID NO: 39758 - DNA, 25 bp, Homo sapien
cacagagaaaccacaaattactgga

SEQ ID NO: 39759 - DNA, 25 bp, Homo sapien
cacagagaaaccacaacttactgga

SEQ ID NO: 39760 - DNA, 25 bp, Homo sapien
cacagagaaataagaaccaggatga

SEQ ID NO: 39761 - DNA, 25 bp, Homo sapien
cacagagaaataggaaccaggatga

SEQ ID NO: 39762 - DNA, 25 bp, Homo sapien
cacagagaacaatgtaataggaaac

SEQ ID NO: 39763 - DNA, 25 bp, Homo sapien
cacagagagagcacggactgtgaac

SEQ ID NO: 39764 - DNA, 25 bp, Homo sapien
cacagagagagtacggactgtgaac

SEQ ID NO: 39765 - DNA, 25 bp, Homo sapien
cacagagagcaatgtaataggaaac

SEQ ID NO: 39766 - DNA, 25 bp, Homo sapien
cacagagccaaaggctgcatgacct

SEQ ID NO: 39767 - DNA, 25 bp, Homo sapien
cacagagccaagggctgcatgacct

SEQ ID NO: 39768 - DNA, 25 bp, Homo sapien
cacagagcgagcaagcagcagatat

SEQ ID NO: 39769 - DNA, 25 bp, Homo sapien
cacagagctagcaagcagcagatat

SEQ ID NO: 39770 - DNA, 25 bp, Homo sapien
cacagaggaacattgtccaactctt

SEQ ID NO: 39771 - DNA, 25 bp, Homo sapien
cacagaggaacattttccaactctt

SEQ ID NO: 39772 - DNA, 25 bp, Homo sapien
cacagaggatcatgtcatctacaaa

SEQ ID NO: 39773 - DNA, 25 bp, Homo sapien
cacagaggatcgtgtcatctacaaa

SEQ ID NO: 39774 - DNA, 25 bp, Homo sapien
cacagaggtcactacgagtcttatg

SEQ ID NO: 39775 - DNA, 25 bp, Homo sapien
cacagaggtcactatgagtcttatg

SEQ ID NO: 39776 - DNA, 25 bp, Homo sapien
cacagatacgaaggcttactatttt

SEQ ID NO: 39777 - DNA, 25 bp, Homo sapien
cacagatatgaaggcttactatttt

SEQ ID NO: 39778 - DNA, 25 bp, Homo sapien
cacagatcaaaagtgtcgaactcac

SEQ ID NO: 39779 - DNA, 25 bp, Homo sapien
cacagatcacatatcggcagagaac

SEQ ID NO: 39780 - DNA, 25 bp, Homo sapien
cacagatcatatatcggcagagaac

SEQ ID NO: 39781 - DNA, 25 bp, Homo sapien
cacagatcgaaagtgtcgaactcac

SEQ ID NO: 39782 - DNA, 25 bp, Homo sapien
cacagatctactcaaacaagaaagc

SEQ ID NO: 39783 - DNA, 25 bp, Homo sapien
cacagatctactcgaacaagaaagc

SEQ ID NO: 39784 - DNA, 25 bp, Homo sapien
cacagatgagaaaaattagatgaat

SEQ ID NO: 39785 - DNA, 25 bp, Homo sapien
cacagatgctatatctctagtttta

SEQ ID NO: 39786 - DNA, 25 bp, Homo sapien
cacagatgctgagccccaccccaga

SEQ ID NO: 39787 - DNA, 25 bp, Homo sapien
cacagatgggaaaaattagatgaat

SEQ ID NO: 39788 - DNA, 25 bp, Homo sapien
cacagatggtgagccccaccccaga

SEQ ID NO: 39789 - DNA, 25 bp, Homo sapien
cacagatgttatatctctagtttta

SEQ ID NO: 39790 - DNA, 25 bp, Homo sapien
cacagattcctataaacaccaaagg

SEQ ID NO: 39791 - DNA, 25 bp, Homo sapien
cacagattcgttcacttgaacatca

SEQ ID NO: 39792 - DNA, 25 bp, Homo sapien
cacagattcgttcatttgaacatca

SEQ ID NO: 39793 - DNA, 25 bp, Homo sapien
cacagattcttataaacaccaaagg

SEQ ID NO: 39794 - DNA, 25 bp, Homo sapien
cacagattgagttaatcttttgagc

SEQ ID NO: 39795 - DNA, 25 bp, Homo sapien
cacagattgagttaattttttgagc

SEQ ID NO: 39796 - DNA, 25 bp, Homo sapien
cacagattgtggagtccaattgcca

SEQ ID NO: 39797 - DNA, 25 bp, Homo sapien
cacagatttacaacactgtattata

SEQ ID NO: 39798 - DNA, 25 bp, Homo sapien
cacagatttaccacactgtattata

SEQ ID NO: 39799 - DNA, 25 bp, Homo sapien
cacagattttggagtccaattgcca

SEQ ID NO: 39800 - DNA, 25 bp, Homo sapien
cacagcaagatgactacagatgcca

SEQ ID NO: 39801 - DNA, 25 bp, Homo sapien
cacagcaagatgactatagatgcca

SEQ ID NO: 39802 - DNA, 25 bp, Homo sapien
cacagcagagaatacatgtgttttt

SEQ ID NO: 39803 - DNA, 25 bp, Homo sapien
cacagcagagaatgcatgtgttttt

SEQ ID NO: 39804 - DNA, 25 bp, Homo sapien
cacagcagggaacaaccttgtacat

SEQ ID NO: 39805 - DNA, 25 bp, Homo sapien
cacagcagggaaccaccttgtacat

SEQ ID NO: 39806 - DNA, 25 bp, Homo sapien
cacagcatagacacaattgcagtgt

SEQ ID NO: 39807 - DNA, 25 bp, Homo sapien
cacagcatagacacgattgcagtgt

SEQ ID NO: 39808 - DNA, 25 bp, Homo sapien
cacagccagacttacatttagtaga

SEQ ID NO: 39809 - DNA, 25 bp, Homo sapien
cacagccagacttatatttagtaga

SEQ ID NO: 39810 - DNA, 25 bp, Homo sapien
cacagctaaaaagcgaagaataagg

SEQ ID NO: 39811 - DNA, 25 bp, Homo sapien
cacagctaaaaagcgaggaataagg

SEQ ID NO: 39812 - DNA, 25 bp, Homo sapien
cacagctaattgactagtgactaaa

SEQ ID NO: 39813 - DNA, 25 bp, Homo sapien
cacagctaatttactagtgactaaa

SEQ ID NO: 39814 - DNA, 25 bp, Homo sapien
cacagctagtaaatagtagacccag

SEQ ID NO: 39815 - DNA, 25 bp, Homo sapien
cacagctagtaaatggtagacccag

SEQ ID NO: 39816 - DNA, 25 bp, Homo sapien
cacagcttaagggtcagcgtcccca

SEQ ID NO: 39817 - DNA, 25 bp, Homo sapien
cacagcttaggggtcagcgtcccca

SEQ ID NO: 39818 - DNA, 25 bp, Homo sapien
cacagcttgtccacatgatctcctg

SEQ ID NO: 39819 - DNA, 25 bp, Homo sapien
cacagcttgtccgcatgatctcctg

SEQ ID NO: 39820 - DNA, 25 bp, Homo sapien
cacaggaagaaaaccagacttagag

SEQ ID NO: 39821 - DNA, 25 bp, Homo sapien
cacaggaagaaaactagacttagag

SEQ ID NO: 39822 - DNA, 25 bp, Homo sapien
cacaggaagcagcgtgtgtgcctta

SEQ ID NO: 39823 - DNA, 25 bp, Homo sapien
cacaggaagcagggtgtgtgcctta

SEQ ID NO: 39824 - DNA, 25 bp, Homo sapien
cacaggacaaaacttgaaatgaggt

SEQ ID NO: 39825 - DNA, 25 bp, Homo sapien
cacaggacaaacaccgaaaagaata

SEQ ID NO: 39826 - DNA, 25 bp, Homo sapien
cacaggacaaacactgaaaagaata

SEQ ID NO: 39827 - DNA, 25 bp, Homo sapien
cacaggacaaaccttgaaatgaggt

SEQ ID NO: 39828 - DNA, 25 bp, Homo sapien
cacaggacacgtcaccttttctcat

SEQ ID NO: 39829 - DNA, 25 bp, Homo sapien
cacaggacactattaccaggcaaat

SEQ ID NO: 39830 - DNA, 25 bp, Homo sapien
cacaggacactattactaggcaaat

SEQ ID NO: 39831 - DNA, 25 bp, Homo sapien
cacaggacatgtcaccttttctcat

SEQ ID NO: 39832 - DNA, 25 bp, Homo sapien
cacaggagtatgtagaattgaattc

SEQ ID NO: 39833 - DNA, 25 bp, Homo sapien
cacaggagtatgtggaattgaattc

SEQ ID NO: 39834 - DNA, 25 bp, Homo sapien
cacaggataaaaggtcaatatataa

SEQ ID NO: 39835 - DNA, 25 bp, Homo sapien
cacaggatacaaggtcaatatataa

SEQ ID NO: 39836 - DNA, 25 bp, Homo sapien
cacaggcaataaaaggacaaaggag

SEQ ID NO: 39837 - DNA, 25 bp, Homo sapien
cacaggcagtaaaaggacaaaggag

SEQ ID NO: 39838 - DNA, 25 bp, Homo sapien
cacaggccaactcctccattgtaca

SEQ ID NO: 39839 - DNA, 25 bp, Homo sapien
cacaggccatctcctccattgtaca

SEQ ID NO: 39840 - DNA, 25 bp, Homo sapien
cacaggcccttccatacgagtccag

SEQ ID NO: 39841 - DNA, 25 bp, Homo sapien
cacaggcccttccgtacgagtccag

SEQ ID NO: 39842 - DNA, 25 bp, Homo sapien
cacaggctgaagagagagattgtct

SEQ ID NO: 39843 - DNA, 25 bp, Homo sapien
cacaggctggagagagagattgtct

SEQ ID NO: 39844 - DNA, 25 bp, Homo sapien
cacagggaatatccccttctctttc

SEQ ID NO: 39845 - DNA, 25 bp, Homo sapien
cacagggactatccccttctctttc

SEQ ID NO: 39846 - DNA, 25 bp, Homo sapien
cacagggtccctataagagaagact

SEQ ID NO: 39847 - DNA, 25 bp, Homo sapien
cacagggttcacaagcatcagaggc

SEQ ID NO: 39848 - DNA, 25 bp, Homo sapien
cacagggttcacaagcgtcagaggc

SEQ ID NO: 39849 - DNA, 25 bp, Homo sapien
cacagggttcatctattcagtactt

SEQ ID NO: 39850 - DNA, 25 bp, Homo sapien
cacagggttcatctgttcagtactt

SEQ ID NO: 39851 - DNA, 25 bp, Homo sapien
cacagggttcctataagagaagact

SEQ ID NO: 39852 - DNA, 25 bp, Homo sapien
cacaggtaaattcttacaatgttgg

SEQ ID NO: 39853 - DNA, 25 bp, Homo sapien
cacaggtaagttcttacaatgttgg

SEQ ID NO: 39854 - DNA, 25 bp, Homo sapien
cacaggtactgaaacatcacactgt

SEQ ID NO: 39855 - DNA, 25 bp, Homo sapien
cacaggtatctcacagcaggcattg

SEQ ID NO: 39856 - DNA, 25 bp, Homo sapien
cacaggtatctcgcagcaggcattg

SEQ ID NO: 39857 - DNA, 25 bp, Homo sapien
cacaggtattgaaacatcacactgt

SEQ ID NO: 39858 - DNA, 25 bp, Homo sapien
cacaggtccctctgacaaactggta

SEQ ID NO: 39859 - DNA, 25 bp, Homo sapien
cacaggtccctttgacaaactggta

SEQ ID NO: 39860 - DNA, 25 bp, Homo sapien
cacagtaatactattcataacaacc

SEQ ID NO: 39861 - DNA, 25 bp, Homo sapien
cacagtaatactattcctaacaacc

SEQ ID NO: 39862 - DNA, 25 bp, Homo sapien
cacagtagcttctctaaccattttg

SEQ ID NO: 39863 - DNA, 25 bp, Homo sapien
cacagtagcttctgtaaccattttg

SEQ ID NO: 39864 - DNA, 25 bp, Homo sapien
cacagtaggtttcactatcaccatt

SEQ ID NO: 39865 - DNA, 25 bp, Homo sapien
cacagtagttttcactatcaccatt

SEQ ID NO: 39866 - DNA, 25 bp, Homo sapien
cacagtatagacgctggagccagac

SEQ ID NO: 39867 - DNA, 25 bp, Homo sapien
cacagtatagatgctggagccagac

SEQ ID NO: 39868 - DNA, 25 bp, Homo sapien
cacagtattctcggtagtcctgtag

SEQ ID NO: 39869 - DNA, 25 bp, Homo sapien
cacagtattcttggtagtcctgtag

SEQ ID NO: 39870 - DNA, 25 bp, Homo sapien
cacagtcctagagagaagaaagaca

SEQ ID NO: 39871 - DNA, 25 bp, Homo sapien
cacagtcctagagggaagaaagaca

(The sequence listing continues in the following parts.)

What is claimed is:

1. An array consisting of a plurality of nucleic acid probes, wherein each probe in the plurality of nucleic acid probes consists of one of the sequences listed in SEQ ID Nos. 1-124,031 and wherein the plurality of nucleic acid probes of the array consists of each of the sequences listed in SEQ ID NOS. 1-124,031.

2. An array consisting of a plurality of nucleic acid probes, wherein each probe in the plurality of nucleic acid probes consists of one of the sequences listed in SEQ ID NOS. 1-124,031 or the complement of one of the sequences listed in SEQ ID NOS: 1-124,031 and wherein the plurality of nucleic acid probes consists of each of the sequences listed in SEQ ID NOS. 1-124,031 and the complement of each of the sequences listed in SEQ ID NOS: 1-124,031.

3. An array consisting of a plurality of nucleic acid probes attached to a support, wherein each probe in the plurality of nucleic acid probes consists of one of the sequences listed in SEQ ID NOS. 1-124,031 or the sequence of one of the sequences listed in SEQ ID NOS: 1-124,031 except with a mismatch at the central position and wherein the plurality of nucleic acid probes consists of each of the sequences listed in SEQ ID NOS. 1-124,031 and each of the sequences listed in SEQ ID NOS. 1-124,031 with a mismatch at the central position.

4. An array consisting of a plurality of nucleic acid probes, wherein each probe in the plurality of nucleic acid probes consists of one of the sequences listed in SEQ ID Nos. 1-124,031, wherein the plurality of nucleic acid probes of the array consists of each of the sequences listed in SEQ ID NOS. 1-124,031 and wherein each probe is attached to a bead.

* * * * *